United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 194

SEQ ID NO: 8071082 - DNA, 22 bp, Homo sapiens
ggcagctgacctagcaccatcc

SEQ ID NO: 8071083 - DNA, 22 bp, Homo sapiens
ggcagctgagatcatgctgttg

SEQ ID NO: 8071084 - DNA, 22 bp, Homo sapiens
ggcagctgattagcatcaagga

SEQ ID NO: 8071085 - DNA, 22 bp, Homo sapiens
caccaggctggagtgcagtggc

SEQ ID NO: 8071086 - DNA, 20 bp, Homo sapiens
caccctcccagcacctatgc

SEQ ID NO: 8071087 - DNA, 22 bp, Homo sapiens
cacccctgtggagcatggtggc

SEQ ID NO: 8071088 - DNA, 22 bp, Homo sapiens
cacccagttgactacaaagggg

SEQ ID NO: 8071089 - DNA, 22 bp, Homo sapiens
cacccagtgaaggagcaagagg

SEQ ID NO: 8071090 - DNA, 22 bp, Homo sapiens
ggcatcagcccggtcctgggct

SEQ ID NO: 8071091 - DNA, 22 bp, Homo sapiens
ggcatcagaggtgtgttctgct

SEQ ID NO: 8071092 - DNA, 22 bp, Homo sapiens
cacccaggctggaatgcagtgg

SEQ ID NO: 8071093 - DNA, 21 bp, Homo sapiens
cactgcagccttgacctgggc

SEQ ID NO: 8071094 - DNA, 23 bp, Homo sapiens
cactgcagcgtggtctggcagga

SEQ ID NO: 8071095 - DNA, 22 bp, Homo sapiens
cactgcaggtctgagatggggg

SEQ ID NO: 8071096 - DNA, 22 bp, Homo sapiens
cactgcagcaccatgcagggct

SEQ ID NO: 8071097 - DNA, 22 bp, Homo sapiens
ggcctcgcggcttctggtggct

SEQ ID NO: 8071098 - DNA, 22 bp, Homo sapiens
ggcctctcatgtcctgggcttc

SEQ ID NO: 8071099 - DNA, 22 bp, Homo sapiens
cactgagcaagtcagtacagca

SEQ ID NO: 8071100 - DNA, 22 bp, Homo sapiens
ggctcaagcagtctgcctgcct

SEQ ID NO: 8071101 - DNA, 22 bp, Homo sapiens
ggctagggatctagaccaggac

SEQ ID NO: 8071102 - DNA, 22 bp, Homo sapiens
cactgcagtaactctaggactg

SEQ ID NO: 8071103 - DNA, 22 bp, Homo sapiens
cactggcatgtgaggcggtggc

SEQ ID NO: 8071104 - DNA, 22 bp, Homo sapiens
cactggcattagtcacgaggca

SEQ ID NO: 8071105 - DNA, 22 bp, Homo sapiens
cactggaggtcagtggagcact

SEQ ID NO: 8071106 - DNA, 22 bp, Homo sapiens
cactgcctggaaggagagacat

SEQ ID NO: 8071107 - DNA, 20 bp, Homo sapiens
cactggaaagcaggcgactc

SEQ ID NO: 8071108 - DNA, 22 bp, Homo sapiens
ggcagcagttacaaatgtgcag

SEQ ID NO: 8071109 - DNA, 22 bp, Homo sapiens
ggcagcagtggctgctattgtc

SEQ ID NO: 8071110 - DNA, 22 bp, Homo sapiens
ggcagatggaagaggctgggtc

SEQ ID NO: 8071111 - DNA, 22 bp, Homo sapiens
ggcagcatgagcctggtgaatt

SEQ ID NO: 8071112 - DNA, 22 bp, Homo sapiens
ggcagagcttgcagtgagccga

SEQ ID NO: 8071113 - DNA, 22 bp, Homo sapiens
cacagtggcaggtgtgggttgt

SEQ ID NO: 8071114 - DNA, 22 bp, Homo sapiens
cacagtggattgggtgatgccc

SEQ ID NO: 8071115 - DNA, 20 bp, Homo sapiens
ggcagagctatgtctgttgc

SEQ ID NO: 8071116 - DNA, 22 bp, Homo sapiens
ggcagagctgcatgagcactca

SEQ ID NO: 8071117 - DNA, 22 bp, Homo sapiens
ggcagagatgtgggtcagaatc

SEQ ID NO: 8071118 - DNA, 18 bp, Homo sapiens
ggcactgctgttcccctt

SEQ ID NO: 8071119 - DNA, 22 bp, Homo sapiens
cacagggcaggccccaggcctc

SEQ ID NO: 8071120 - DNA, 22 bp, Homo sapiens
cacagggcagagggtccgtggc

SEQ ID NO: 8071121 - DNA, 22 bp, Homo sapiens
cacagggcagagacctgggtgc

SEQ ID NO: 8071122 - DNA, 22 bp, Homo sapiens
ggcacagggaggccctggtgtg

SEQ ID NO: 8071123 - DNA, 22 bp, Homo sapiens
ggcacagggagccgcagttgca

SEQ ID NO: 8071124 - DNA, 20 bp, Homo sapiens
cacagcttgccttttatgac

SEQ ID NO: 8071125 - DNA, 22 bp, Homo sapiens
cacagcttgggctctgacaata

SEQ ID NO: 8071126 - DNA, 22 bp, Homo sapiens
cacagcttctgagtgaggattt

SEQ ID NO: 8071127 - DNA, 22 bp, Homo sapiens
ggaggccaaggcaggtggatcg

SEQ ID NO: 8071128 - DNA, 22 bp, Homo sapiens
ggaggccttgaggccaggagct

SEQ ID NO: 8071129 - DNA, 22 bp, Homo sapiens
cacagcttatgccactgattgg

SEQ ID NO: 8071130 - DNA, 22 bp, Homo sapiens
cacagcttccattagaatgaga

SEQ ID NO: 8071131 - DNA, 22 bp, Homo sapiens
cacagctggtgcactagctctg

SEQ ID NO: 8071132 - DNA, 22 bp, Homo sapiens
ggagggagtcagctgattagaa

SEQ ID NO: 8071133 - DNA, 22 bp, Homo sapiens
ggagggagcatccccttgctga

SEQ ID NO: 8071134 - DNA, 22 bp, Homo sapiens
cacagggcaccagttggccatc

SEQ ID NO: 8071135 - DNA, 22 bp, Homo sapiens
cacagggaggcggtcactggct

SEQ ID NO: 8071136 - DNA, 22 bp, Homo sapiens
gggactggagtagaggccggtg

SEQ ID NO: 8071137 - DNA, 22 bp, Homo sapiens
gggactggaactactggtgcag

SEQ ID NO: 8071138 - DNA, 22 bp, Homo sapiens
gggacagaaggaagtgagcaca

SEQ ID NO: 8071139 - DNA, 22 bp, Homo sapiens
gggacagaaggaagtgagcaca

SEQ ID NO: 8071140 - DNA, 22 bp, Homo sapiens
gggacagacccatgggccaggt

SEQ ID NO: 8071141 - DNA, 22 bp, Homo sapiens
gggaaggagcctgcttgctaga

SEQ ID NO: 8071142 - DNA, 22 bp, Homo sapiens
gggaaggaggtggcttgaagtg

SEQ ID NO: 8071143 - DNA, 22 bp, Homo sapiens
ggcttttgctgtgttttccaga

SEQ ID NO: 8071144 - DNA, 22 bp, Homo sapiens
ggcttttgaattccaaggcatt

SEQ ID NO: 8071145 - DNA, 22 bp, Homo sapiens
ggcttttgtttcagctctgcta

SEQ ID NO: 8071146 - DNA, 22 bp, Homo sapiens
cagaagggacagggtttgtaga

SEQ ID NO: 8071147 - DNA, 22 bp, Homo sapiens
gggagcaggacataatagcaat

SEQ ID NO: 8071148 - DNA, 22 bp, Homo sapiens
gggagcaggagcctgcctgcca

SEQ ID NO: 8071149 - DNA, 22 bp, Homo sapiens
gggactgtcctctgtgtctgtg

SEQ ID NO: 8071150 - DNA, 22 bp, Homo sapiens
gggactgtcctacatggagagg

SEQ ID NO: 8071151 - DNA, 20 bp, Homo sapiens
gggactgtcccatcctcatc

SEQ ID NO: 8071152 - DNA, 22 bp, Homo sapiens
gggactgtccggcagaaggtac

SEQ ID NO: 8071153 - DNA, 22 bp, Homo sapiens
gggactgtaaattcatatggcc

SEQ ID NO: 8071154 - DNA, 22 bp, Homo sapiens
gggactgtaaattcatatggcc

SEQ ID NO: 8071155 - DNA, 22 bp, Homo sapiens
gggactgggagatcctcctggc

SEQ ID NO: 8071156 - DNA, 22 bp, Homo sapiens
gggactgtgaggcctaactggg

SEQ ID NO: 8071157 - DNA, 22 bp, Homo sapiens
cagaagtgaatgtgataaacca

SEQ ID NO: 8071158 - DNA, 22 bp, Homo sapiens
gggaggtcagggtgcctgctgg

SEQ ID NO: 8071159 - DNA, 22 bp, Homo sapiens
cagacaggctagccagactcac

SEQ ID NO: 8071160 - DNA, 22 bp, Homo sapiens
gggagcagttaaaatgattcct

SEQ ID NO: 8071161 - DNA, 22 bp, Homo sapiens
cagacagggacctcgctccaga

SEQ ID NO: 8071162 - DNA, 22 bp, Homo sapiens
cagaggctgggacctcaggcat

SEQ ID NO: 8071163 - DNA, 22 bp, Homo sapiens
cagaggctgtgtaggcagactg

SEQ ID NO: 8071164 - DNA, 22 bp, Homo sapiens
cagagtaaggagctgtcaaacg

SEQ ID NO: 8071165 - DNA, 22 bp, Homo sapiens
gggtgctgaggaagacagcagg

SEQ ID NO: 8071166 - DNA, 22 bp, Homo sapiens
gggtgctgactggggcctgaaa

SEQ ID NO: 8071167 - DNA, 22 bp, Homo sapiens
cagaggccatatttcttcactc

SEQ ID NO: 8071168 - DNA, 21 bp, Homo sapiens
cagaggcctcatgctctgtgc

SEQ ID NO: 8071169 - DNA, 22 bp, Homo sapiens
cagaggcctatccagtgtccat

SEQ ID NO: 8071170 - DNA, 22 bp, Homo sapiens
cagaggccccagaactagctct

SEQ ID NO: 8071171 - DNA, 22 bp, Homo sapiens
cagagctgtcatttgccagtga

SEQ ID NO: 8071172 - DNA, 22 bp, Homo sapiens
cagaggccacctgtggccactg

SEQ ID NO: 8071173 - DNA, 22 bp, Homo sapiens
cagagctggtgttacaagtcca

SEQ ID NO: 8071174 - DNA, 22 bp, Homo sapiens
cagagctgtatttatctttcca

SEQ ID NO: 8071175 - DNA, 22 bp, Homo sapiens
cagagctggtgttacaagtcca

SEQ ID NO: 8071176 - DNA, 22 bp, Homo sapiens
cagagctggtgtgtcctggcat

SEQ ID NO: 8071177 - DNA, 22 bp, Homo sapiens
cagagctggtaagtggtagagg

SEQ ID NO: 8071178 - DNA, 22 bp, Homo sapiens
cagagctggtgtgtcctggcat

SEQ ID NO: 8071179 - DNA, 21 bp, Homo sapiens
gggctttttatttagcactgt

SEQ ID NO: 8071180 - DNA, 19 bp, Homo sapiens
cagagctgctggcctcgtc

SEQ ID NO: 8071181 - DNA, 22 bp, Homo sapiens
cagagctgctcatggtggccag

SEQ ID NO: 8071182 - DNA, 22 bp, Homo sapiens
cagagctgcagattgaaggcat

SEQ ID NO: 8071183 - DNA, 22 bp, Homo sapiens
cagagctgcgctttttcctggt

SEQ ID NO: 8071184 - DNA, 21 bp, Homo sapiens
cagagctctttctgcttgctg

SEQ ID NO: 8071185 - DNA, 22 bp, Homo sapiens
cagagctctgacagctacagcc

SEQ ID NO: 8071186 - DNA, 21 bp, Homo sapiens
cagagctgaagggtgtagtgt

SEQ ID NO: 8071187 - DNA, 22 bp, Homo sapiens
cagagctgacccaaggattgaa

SEQ ID NO: 8071188 - DNA, 22 bp, Homo sapiens
cagagctgattggatccagaga

SEQ ID NO: 8071189 - DNA, 22 bp, Homo sapiens
cagagctgcaaatgcccctccg

SEQ ID NO: 8071190 - DNA, 22 bp, Homo sapiens
cagagctgcacattctatgatg

SEQ ID NO: 8071191 - DNA, 22 bp, Homo sapiens
cagagctgcacattctatgatg

SEQ ID NO: 8071192 - DNA, 22 bp, Homo sapiens
cagagctgagtcttcaaggttg

SEQ ID NO: 8071193 - DNA, 22 bp, Homo sapiens
cagagctgagaatgttgatgct

SEQ ID NO: 8071194 - DNA, 23 bp, Homo sapiens
cagagctgattaaacttaatctc

SEQ ID NO: 8071195 - DNA, 23 bp, Homo sapiens
cagagctgattaaacttaatctc

SEQ ID NO: 8071196 - DNA, 22 bp, Homo sapiens
cagagccccccttctgatcaca

SEQ ID NO: 8071197 - DNA, 22 bp, Homo sapiens
cagagcccctcagctctctccc

SEQ ID NO: 8071198 - DNA, 22 bp, Homo sapiens
gggcacagagggtcttgaagaa

SEQ ID NO: 8071199 - DNA, 22 bp, Homo sapiens
gggcactgtgttcagagtgcag

SEQ ID NO: 8071200 - DNA, 22 bp, Homo sapiens
gggcactgtgctgggtgcttta

SEQ ID NO: 8071201 - DNA, 22 bp, Homo sapiens
cagagccagctgtccttggcat

SEQ ID NO: 8071202 - DNA, 22 bp, Homo sapiens
gggcagagaaatggacagttgg

SEQ ID NO: 8071203 - DNA, 22 bp, Homo sapiens
cagcccagcactaagtagattt

SEQ ID NO: 8071204 - DNA, 22 bp, Homo sapiens
cagccaccatacagcagaagct

SEQ ID NO: 8071205 - DNA, 22 bp, Homo sapiens
cagccactgtggtctagctgca

SEQ ID NO: 8071206 - DNA, 22 bp, Homo sapiens
cagccaggttcaagtccttata

SEQ ID NO: 8071207 - DNA, 22 bp, Homo sapiens
gtatttgcaaatctaaaagaga

SEQ ID NO: 8071208 - DNA, 22 bp, Homo sapiens
gtatttgtagtagcatagaatt

SEQ ID NO: 8071209 - DNA, 22 bp, Homo sapiens
cagcattgatcccaggctgtgg

SEQ ID NO: 8071210 - DNA, 22 bp, Homo sapiens
gggtgggagtctggccctcaaa

SEQ ID NO: 8071211 - DNA, 21 bp, Homo sapiens
gggtgggaggacacagcaggc

SEQ ID NO: 8071212 - DNA, 22 bp, Homo sapiens
ggtggggctcagcaatctgtgt

SEQ ID NO: 8071213 - DNA, 22 bp, Homo sapiens
ggtggggctgcaagcagttcgg

SEQ ID NO: 8071214 - DNA, 22 bp, Homo sapiens
ggtggggtcacgacagagggaa

SEQ ID NO: 8071215 - DNA, 22 bp, Homo sapiens
ggtggggtcacgacagagggaa

SEQ ID NO: 8071216 - DNA, 22 bp, Homo sapiens
ggtgggtatagttagggcctct

SEQ ID NO: 8071217 - DNA, 22 bp, Homo sapiens
ggtgggtattgaatacaggtgt

SEQ ID NO: 8071218 - DNA, 22 bp, Homo sapiens
ggttctgctactctcttgctta

SEQ ID NO: 8071219 - DNA, 22 bp, Homo sapiens
ggttggacactaggtaggagcg

SEQ ID NO: 8071220 - DNA, 22 bp, Homo sapiens
ggttgccggggcaggactggaa

SEQ ID NO: 8071221 - DNA, 22 bp, Homo sapiens
ggttcccggatctccgagtccc

SEQ ID NO: 8071222 - DNA, 23 bp, Homo sapiens
ggttccaggaacacagcctgatg

SEQ ID NO: 8071223 - DNA, 23 bp, Homo sapiens
ggttctgccgcttactgctgtgc

SEQ ID NO: 8071224 - DNA, 22 bp, Homo sapiens
ggttctgagaaactctcaccat

SEQ ID NO: 8071225 - DNA, 22 bp, Homo sapiens
cagcagcaaggtgagggtggag

SEQ ID NO: 8071226 - DNA, 22 bp, Homo sapiens
cagcagcaacaatagcggtcac

SEQ ID NO: 8071227 - DNA, 22 bp, Homo sapiens
cagcagcaacaacggaagcctt

SEQ ID NO: 8071228 - DNA, 22 bp, Homo sapiens
cagcagcaaatctagaagagga

SEQ ID NO: 8071229 - DNA, 22 bp, Homo sapiens
cagcagcaaatctagaagagga

SEQ ID NO: 8071230 - DNA, 22 bp, Homo sapiens
cagcagagtaggtgctacttct

SEQ ID NO: 8071231 - DNA, 22 bp, Homo sapiens
cagcagcagagatactggtttc

SEQ ID NO: 8071232 - DNA, 22 bp, Homo sapiens
cagcagcagagatactggtttc

SEQ ID NO: 8071233 - DNA, 22 bp, Homo sapiens
cagcagcagattcagcgtctgg

SEQ ID NO: 8071234 - DNA, 22 bp, Homo sapiens
cagcagcactctgcgggtcccc

SEQ ID NO: 8071235 - DNA, 22 bp, Homo sapiens
gtatctttatccctcgttggag

SEQ ID NO: 8071236 - DNA, 22 bp, Homo sapiens
cagcaggaccattgaggcatca

SEQ ID NO: 8071237 - DNA, 22 bp, Homo sapiens
cagcagcctggcccctcctcgg

SEQ ID NO: 8071238 - DNA, 22 bp, Homo sapiens
cagcagcctggagggggccacg

SEQ ID NO: 8071239 - DNA, 22 bp, Homo sapiens
gtatctttccacatcttcagta

SEQ ID NO: 8071240 - DNA, 22 bp, Homo sapiens
gtatgaaaattgtaaagttctt

SEQ ID NO: 8071241 - DNA, 23 bp, Homo sapiens
agtctcagctggaaacatgtgtc

SEQ ID NO: 8071242 - DNA, 22 bp, Homo sapiens
agtctcaggcagaggaaggcta

SEQ ID NO: 8071243 - DNA, 22 bp, Homo sapiens
ctcagggacgttagaggacagg

SEQ ID NO: 8071244 - DNA, 22 bp, Homo sapiens
agtcccaacagcttacaaggaa

SEQ ID NO: 8071245 - DNA, 23 bp, Homo sapiens
ctcaaccctagtaagggagtagg

SEQ ID NO: 8071246 - DNA, 22 bp, Homo sapiens
agtatgaacggaaggcctggga

SEQ ID NO: 8071247 - DNA, 22 bp, Homo sapiens
cggggttcatccatgctgtggc

SEQ ID NO: 8071248 - DNA, 22 bp, Homo sapiens
ctcagaagaatcagcagctatt

SEQ ID NO: 8071249 - DNA, 22 bp, Homo sapiens
ctcagaagttcagcctagagta

SEQ ID NO: 8071250 - DNA, 22 bp, Homo sapiens
ctcagaagaacccagggtccca

SEQ ID NO: 8071251 - DNA, 22 bp, Homo sapiens
ctcagaagaacaaaggctctac

SEQ ID NO: 8071252 - DNA, 22 bp, Homo sapiens
ctcagaaatcccactctgtgta

SEQ ID NO: 8071253 - DNA, 22 bp, Homo sapiens
ctcagaaagtgacaggggggtg

SEQ ID NO: 8071254 - DNA, 18 bp, Homo sapiens
ctcagacatgcttctttt

SEQ ID NO: 8071255 - DNA, 22 bp, Homo sapiens
ctcagcaacccacacacggtct

SEQ ID NO: 8071256 - DNA, 22 bp, Homo sapiens
ctcagcaaccctagaacatttg

SEQ ID NO: 8071257 - DNA, 22 bp, Homo sapiens
ctcagcaagattaagcagcttg

SEQ ID NO: 8071258 - DNA, 22 bp, Homo sapiens
agtgctgggctatctactgcta

SEQ ID NO: 8071259 - DNA, 22 bp, Homo sapiens
ctctccaagttatcaagatgaa

SEQ ID NO: 8071260 - DNA, 22 bp, Homo sapiens
ctcgggcttgaggctgtttacc

SEQ ID NO: 8071261 - DNA, 22 bp, Homo sapiens
agtgctggcccatagctgctgg

SEQ ID NO: 8071262 - DNA, 22 bp, Homo sapiens
ctctcccagtcaggctcaggat

SEQ ID NO: 8071263 - DNA, 20 bp, Homo sapiens
ctctcccagcacagcttcct

SEQ ID NO: 8071264 - DNA, 22 bp, Homo sapiens
ctctccccacaccctctgcatg

SEQ ID NO: 8071265 - DNA, 22 bp, Homo sapiens
ctccttggtgtagtactgagca

SEQ ID NO: 8071266 - DNA, 22 bp, Homo sapiens
ctcgcatgccctgcctcatcca

SEQ ID NO: 8071267 - DNA, 22 bp, Homo sapiens
ctcggagggcaacagaagtgct

SEQ ID NO: 8071268 - DNA, 22 bp, Homo sapiens
ctccttctgggcctggcagtgg

SEQ ID NO: 8071269 - DNA, 22 bp, Homo sapiens
ctcctgagtagtagcattgtca

SEQ ID NO: 8071270 - DNA, 22 bp, Homo sapiens
agtgctgactctgggcacagtg

SEQ ID NO: 8071271 - DNA, 22 bp, Homo sapiens
ctctgtcctatgcttgatagaa

SEQ ID NO: 8071272 - DNA, 22 bp, Homo sapiens
ctctgtcctccacctgctttca

SEQ ID NO: 8071273 - DNA, 22 bp, Homo sapiens
ctctgtccacaggtttgtccct

SEQ ID NO: 8071274 - DNA, 22 bp, Homo sapiens
ctctgtcccagacccacctctc

SEQ ID NO: 8071275 - DNA, 22 bp, Homo sapiens
ctctgtccttgcacagttccta

SEQ ID NO: 8071276 - DNA, 22 bp, Homo sapiens
ctctgtctatcccattctgtgc

SEQ ID NO: 8071277 - DNA, 22 bp, Homo sapiens
agtggtggagagatgaggacac

SEQ ID NO: 8071278 - DNA, 22 bp, Homo sapiens
agtggtgccattaaaatcattg

SEQ ID NO: 8071279 - DNA, 22 bp, Homo sapiens
agtggtgctaggtggaatatag

SEQ ID NO: 8071280 - DNA, 22 bp, Homo sapiens
agtggtgctgcgcgcggagctc

SEQ ID NO: 8071281 - DNA, 22 bp, Homo sapiens
ctctggagaactccttgtgtct

SEQ ID NO: 8071282 - DNA, 22 bp, Homo sapiens
ctctggagaactccttgtgtct

SEQ ID NO: 8071283 - DNA, 22 bp, Homo sapiens
ctctggagcaccgggctatcca

SEQ ID NO: 8071284 - DNA, 23 bp, Homo sapiens
ctctggagatcctctgcctgggt

SEQ ID NO: 8071285 - DNA, 22 bp, Homo sapiens
ctctggaccctcctgctgagag

SEQ ID NO: 8071286 - DNA, 22 bp, Homo sapiens
ctctggacagcaggtgctgtgg

SEQ ID NO: 8071287 - DNA, 22 bp, Homo sapiens
ctctggacactggcatggggtc

SEQ ID NO: 8071288 - DNA, 22 bp, Homo sapiens
ctctgtatagaaaggaaacatt

SEQ ID NO: 8071289 - DNA, 22 bp, Homo sapiens
ctctgtatgaatcatatggagt

SEQ ID NO: 8071290 - DNA, 22 bp, Homo sapiens
cggagcctgcttgttgcagctg

SEQ ID NO: 8071291 - DNA, 22 bp, Homo sapiens
aggtggggtgttggatgtttat

SEQ ID NO: 8071292 - DNA, 22 bp, Homo sapiens
aggtggggtgagctgcagacta

SEQ ID NO: 8071293 - DNA, 22 bp, Homo sapiens
cctttattcaattagtcctaat

SEQ ID NO: 8071294 - DNA, 22 bp, Homo sapiens
aggtggggtgagctgcagacta

SEQ ID NO: 8071295 - DNA, 22 bp, Homo sapiens
aggtgggggctgtgtccttgac

SEQ ID NO: 8071296 - DNA, 22 bp, Homo sapiens
aggtggcatgagactgtaccag

SEQ ID NO: 8071297 - DNA, 17 bp, Homo sapiens
aggtgctggagcatcag

SEQ ID NO: 8071298 - DNA, 22 bp, Homo sapiens
aggtgctgccccgagaaggatg

SEQ ID NO: 8071299 - DNA, 22 bp, Homo sapiens
aggtgcctgggagctccctgag

SEQ ID NO: 8071300 - DNA, 21 bp, Homo sapiens
aggtgggagaccatgtaggtc

SEQ ID NO: 8071301 - DNA, 22 bp, Homo sapiens
aggtggggctgggaaagattcc

SEQ ID NO: 8071302 - DNA, 22 bp, Homo sapiens
ccttggagcggtcagcactggt

SEQ ID NO: 8071303 - DNA, 19 bp, Homo sapiens
ccttggagttccaggtgga

SEQ ID NO: 8071304 - DNA, 22 bp, Homo sapiens
ccttggaggactgctgcttctt

SEQ ID NO: 8071305 - DNA, 22 bp, Homo sapiens
cctggcagcgtgccgagctgcg

SEQ ID NO: 8071306 - DNA, 22 bp, Homo sapiens
cctggcagcgccgaagctggcc

SEQ ID NO: 8071307 - DNA, 22 bp, Homo sapiens
cctggaagttggaggttgcagt

SEQ ID NO: 8071308 - DNA, 22 bp, Homo sapiens
cctggaaggcaggcatggattg

SEQ ID NO: 8071309 - DNA, 22 bp, Homo sapiens
cctggaaggtgatggtacagca

SEQ ID NO: 8071310 - DNA, 20 bp, Homo sapiens
cctggaagagctccccaggc

SEQ ID NO: 8071311 - DNA, 22 bp, Homo sapiens
cctggaagattcaccactacca

SEQ ID NO: 8071312 - DNA, 22 bp, Homo sapiens
cctgctctgccaagtcctcttt

SEQ ID NO: 8071313 - DNA, 22 bp, Homo sapiens
cctgctctgccaagtcctcttt

SEQ ID NO: 8071314 - DNA, 22 bp, Homo sapiens
cctgctctggtttagtcagtct

SEQ ID NO: 8071315 - DNA, 22 bp, Homo sapiens
cctgctctggtttagtcagtct

SEQ ID NO: 8071316 - DNA, 22 bp, Homo sapiens
cctgctctccatacactttcta

SEQ ID NO: 8071317 - DNA, 22 bp, Homo sapiens
cctgctctaaatctcatggaac

SEQ ID NO: 8071318 - DNA, 22 bp, Homo sapiens
cctgcctggcttccagaagaga

SEQ ID NO: 8071319 - DNA, 19 bp, Homo sapiens
cctgctgcaccacttgtta

SEQ ID NO: 8071320 - DNA, 19 bp, Homo sapiens
cctgctgcaccacttgtta

SEQ ID NO: 8071321 - DNA, 22 bp, Homo sapiens
cctggctgctttcactatggag

SEQ ID NO: 8071322 - DNA, 22 bp, Homo sapiens
cctggctggggtagaagtgagg

SEQ ID NO: 8071323 - DNA, 22 bp, Homo sapiens
cctggctggcaagatcgtgaag

SEQ ID NO: 8071324 - DNA, 23 bp, Homo sapiens
cctggctggattctctgcattca

SEQ ID NO: 8071325 - DNA, 22 bp, Homo sapiens
cctggcagctaagtgctttgag

SEQ ID NO: 8071326 - DNA, 22 bp, Homo sapiens
cctggcagctcctccccggcgg

SEQ ID NO: 8071327 - DNA, 22 bp, Homo sapiens
agggtcaggagacactggcaac

SEQ ID NO: 8071328 - DNA, 20 bp, Homo sapiens
agggtcagtagcacagagct

SEQ ID NO: 8071329 - DNA, 22 bp, Homo sapiens
agggtctgtggatgcatctggg

SEQ ID NO: 8071330 - DNA, 22 bp, Homo sapiens
agggtgaatctcacaactctta

SEQ ID NO: 8071331 - DNA, 22 bp, Homo sapiens
agggtctgactcctctggcaag

SEQ ID NO: 8071332 - DNA, 20 bp, Homo sapiens
agggtctgatgtggtggccc

SEQ ID NO: 8071333 - DNA, 22 bp, Homo sapiens
agggtctgacaatgtgacttag

SEQ ID NO: 8071334 - DNA, 22 bp, Homo sapiens
cctctgccacctcccacgaggc

SEQ ID NO: 8071335 - DNA, 22 bp, Homo sapiens
cctgccaggacattgcttgaag

SEQ ID NO: 8071336 - DNA, 22 bp, Homo sapiens
cctctgccacctcccacgaggc

SEQ ID NO: 8071337 - DNA, 19 bp, Homo sapiens
cctctgccagcccgcctct

SEQ ID NO: 8071338 - DNA, 19 bp, Homo sapiens
ctggcagcctgtctgtgtc

SEQ ID NO: 8071339 - DNA, 22 bp, Homo sapiens
ctggcagcggtttgcagcctgg

SEQ ID NO: 8071340 - DNA, 22 bp, Homo sapiens
ctggcagcgcagcatgaagtcg

SEQ ID NO: 8071341 - DNA, 22 bp, Homo sapiens
ctggcagctctgagtcccttct

SEQ ID NO: 8071342 - DNA, 22 bp, Homo sapiens
ctggcagctctactcagagcct

SEQ ID NO: 8071343 - DNA, 22 bp, Homo sapiens
ctggcagcgtgtttatgaacat

SEQ ID NO: 8071344 - DNA, 22 bp, Homo sapiens
ctggcagcgtgagcagcatcca

SEQ ID NO: 8071345 - DNA, 22 bp, Homo sapiens
ctggagggctgcagcgaggctg

SEQ ID NO: 8071346 - DNA, 22 bp, Homo sapiens
ctggagtgaagcttatttttca

SEQ ID NO: 8071347 - DNA, 22 bp, Homo sapiens
ctggagtgatactcagaatgtg

SEQ ID NO: 8071348 - DNA, 22 bp, Homo sapiens
ctggaggaaaacaactgcagac

SEQ ID NO: 8071349 - DNA, 22 bp, Homo sapiens
ctggaggaaaacaactgcagac

SEQ ID NO: 8071350 - DNA, 22 bp, Homo sapiens
ctggagccactttttatccttt

SEQ ID NO: 8071351 - DNA, 22 bp, Homo sapiens
ctggagccagccagggccctct

SEQ ID NO: 8071352 - DNA, 22 bp, Homo sapiens
ctggagccactgggtcttgtat

SEQ ID NO: 8071353 - DNA, 17 bp, Homo sapiens
ctggagccaagagggcc

SEQ ID NO: 8071354 - DNA, 22 bp, Homo sapiens
ctggagcatccatgcccagggt

SEQ ID NO: 8071355 - DNA, 22 bp, Homo sapiens
ctggagcattttctgcttctgc

SEQ ID NO: 8071356 - DNA, 22 bp, Homo sapiens
ctggagccatgtcttgactgct

SEQ ID NO: 8071357 - DNA, 22 bp, Homo sapiens
ctggagccatgtatagcctatg

SEQ ID NO: 8071358 - DNA, 22 bp, Homo sapiens
ctggagccccagacagggagag

SEQ ID NO: 8071359 - DNA, 22 bp, Homo sapiens
ctggagcccaggcctggtgtct

SEQ ID NO: 8071360 - DNA, 22 bp, Homo sapiens
ctgctctgctgatcagtgtctc

SEQ ID NO: 8071361 - DNA, 22 bp, Homo sapiens
ctgctctgctgatcagtgtctc

SEQ ID NO: 8071362 - DNA, 20 bp, Homo sapiens
ctgctctgctttgcaggtgg

SEQ ID NO: 8071363 - DNA, 22 bp, Homo sapiens
ctgctctggcgtactcggcatc

SEQ ID NO: 8071364 - DNA, 22 bp, Homo sapiens
ctgctctgcagcttggactccc

SEQ ID NO: 8071365 - DNA, 22 bp, Homo sapiens
ctgctctgcaaggcacagtgat

SEQ ID NO: 8071366 - DNA, 22 bp, Homo sapiens
ctgctctgcaaggcacagtgat

SEQ ID NO: 8071367 - DNA, 22 bp, Homo sapiens
ctgctctgagtattaacggagg

SEQ ID NO: 8071368 - DNA, 22 bp, Homo sapiens
ctgctctggctgtgtacttcag

SEQ ID NO: 8071369 - DNA, 22 bp, Homo sapiens
ctgctctggctgtgtacttcag

SEQ ID NO: 8071370 - DNA, 22 bp, Homo sapiens
ctgctctggggaagccagatgt

SEQ ID NO: 8071371 - DNA, 22 bp, Homo sapiens
ctgctctggtctcttcatgttt

SEQ ID NO: 8071372 - DNA, 21 bp, Homo sapiens
ctgctctggggaccggctgtg

SEQ ID NO: 8071373 - DNA, 22 bp, Homo sapiens
ataatacatggttgatcttttc

SEQ ID NO: 8071374 - DNA, 22 bp, Homo sapiens
ataatacatggttgatcttttc

SEQ ID NO: 8071375 - DNA, 22 bp, Homo sapiens
ctgcccacagttctctgccatg

SEQ ID NO: 8071376 - DNA, 22 bp, Homo sapiens
ctgcccagaatcactcactcga

SEQ ID NO: 8071377 - DNA, 22 bp, Homo sapiens
ctgctctgagaggctcttccta

SEQ ID NO: 8071378 - DNA, 22 bp, Homo sapiens
ctgctcagtaatagtcctatct

SEQ ID NO: 8071379 - DNA, 19 bp, Homo sapiens
ctgctcaggtcagtctgtc

SEQ ID NO: 8071380 - DNA, 19 bp, Homo sapiens
atacaagactagcatttac

SEQ ID NO: 8071381 - DNA, 22 bp, Homo sapiens
atacaagactcagcacagacgg

SEQ ID NO: 8071382 - DNA, 18 bp, Homo sapiens
atacaagatcaagtgttc

SEQ ID NO: 8071383 - DNA, 20 bp, Homo sapiens
ctgcttgggacactgccaga

SEQ ID NO: 8071384 - DNA, 22 bp, Homo sapiens
ctgcttgacctgttgttctcac

SEQ ID NO: 8071385 - DNA, 22 bp, Homo sapiens
ataatatcgctcctttttttga

SEQ ID NO: 8071386 - DNA, 22 bp, Homo sapiens
ctgaggctttgtgtgcatgcct

SEQ ID NO: 8071387 - DNA, 22 bp, Homo sapiens
ctgagggtcaacttgattgtat

SEQ ID NO: 8071388 - DNA, 22 bp, Homo sapiens
ctgaggggtatccaaggggtaa

SEQ ID NO: 8071389 - DNA, 22 bp, Homo sapiens
agttgggtttgtgtcagttgca

SEQ ID NO: 8071390 - DNA, 22 bp, Homo sapiens
ctgcagctcccctgagatcaag

SEQ ID NO: 8071391 - DNA, 22 bp, Homo sapiens
ctgcagctatattttcccacag

SEQ ID NO: 8071392 - DNA, 22 bp, Homo sapiens
agtttgaattgaaatgcagatg

SEQ ID NO: 8071393 - DNA, 22 bp, Homo sapiens
agtttgaaggagttgaatcacc

SEQ ID NO: 8071394 - DNA, 22 bp, Homo sapiens
agtttgaagcacatgaatggca

SEQ ID NO: 8071395 - DNA, 22 bp, Homo sapiens
agtttgaagaaggtgagatgca

SEQ ID NO: 8071396 - DNA, 18 bp, Homo sapiens
agtttgaacaaggaagaa

SEQ ID NO: 8071397 - DNA, 22 bp, Homo sapiens
agtttgaaagtattgacagaag

SEQ ID NO: 8071398 - DNA, 22 bp, Homo sapiens
agtttgaaagcttaacagtaca

SEQ ID NO: 8071399 - DNA, 22 bp, Homo sapiens
agtttgtaaaatgtggcctgga

SEQ ID NO: 8071400 - DNA, 22 bp, Homo sapiens
ataaaagtaggaccaacttaca

SEQ ID NO: 8071401 - DNA, 22 bp, Homo sapiens
ataaaagtctgcttatttgggc

SEQ ID NO: 8071402 - DNA, 22 bp, Homo sapiens
ctgccaggactgacgtcttcag

SEQ ID NO: 8071403 - DNA, 20 bp, Homo sapiens
ataaaataactgccacaaga

SEQ ID NO: 8071404 - DNA, 22 bp, Homo sapiens
ataaatatcactgttgtccctc

SEQ ID NO: 8071405 - DNA, 22 bp, Homo sapiens
ctgtggagcttgtggcagtggg

SEQ ID NO: 8071406 - DNA, 22 bp, Homo sapiens
atccaaagccctaagttaactg

SEQ ID NO: 8071407 - DNA, 22 bp, Homo sapiens
atccaaagatggaaagaacttt

SEQ ID NO: 8071408 - DNA, 22 bp, Homo sapiens
atccaaagatggaaagaacttt

SEQ ID NO: 8071409 - DNA, 22 bp, Homo sapiens
atccaaaggtgacacagaatac

SEQ ID NO: 8071410 - DNA, 22 bp, Homo sapiens
atcctagaatcagcccttgctg

SEQ ID NO: 8071411 - DNA, 22 bp, Homo sapiens
atccctggacggcgcctcccca

SEQ ID NO: 8071412 - DNA, 22 bp, Homo sapiens
atccccagggagtgagctgtct

SEQ ID NO: 8071413 - DNA, 22 bp, Homo sapiens
atccccctgtatctggaagaat

SEQ ID NO: 8071414 - DNA, 22 bp, Homo sapiens
atccccttcacaccctctgcat

SEQ ID NO: 8071415 - DNA, 22 bp, Homo sapiens
atccccagactttagatttctc

SEQ ID NO: 8071416 - DNA, 17 bp, Homo sapiens
atccccagcatctagaa

SEQ ID NO: 8071417 - DNA, 17 bp, Homo sapiens
atccccagcatctagaa

SEQ ID NO: 8071418 - DNA, 22 bp, Homo sapiens
ctgggtctaaaaattctcagat

SEQ ID NO: 8071419 - DNA, 22 bp, Homo sapiens
atcacaggtggtaggaaaagaa

SEQ ID NO: 8071420 - DNA, 22 bp, Homo sapiens
ctgtgataggtcatactgtctc

SEQ ID NO: 8071421 - DNA, 22 bp, Homo sapiens
ctgtgatatactcccaagagga

SEQ ID NO: 8071422 - DNA, 18 bp, Homo sapiens
ctgtcttttttctctcca

SEQ ID NO: 8071423 - DNA, 22 bp, Homo sapiens
ctgtcttttcttctcattgatg

SEQ ID NO: 8071424 - DNA, 22 bp, Homo sapiens
ctgtcttttcatactttccctc

SEQ ID NO: 8071425 - DNA, 22 bp, Homo sapiens
ctgtcttttactatcatttact

SEQ ID NO: 8071426 - DNA, 22 bp, Homo sapiens
ctgtctctgtcttaactcccag

SEQ ID NO: 8071427 - DNA, 19 bp, Homo sapiens
ctgggaggtgttcagagaa

SEQ ID NO: 8071428 - DNA, 22 bp, Homo sapiens
ctgggagagcctttcctgagtc

SEQ ID NO: 8071429 - DNA, 22 bp, Homo sapiens
ctgggactttgtaggccagttg

SEQ ID NO: 8071430 - DNA, 22 bp, Homo sapiens
ctgggaatgagcaggtggctcc

SEQ ID NO: 8071431 - DNA, 22 bp, Homo sapiens
ctgggaagggagtcaagatact

SEQ ID NO: 8071432 - DNA, 22 bp, Homo sapiens
ctggcagctgtgtgaagaactg

SEQ ID NO: 8071433 - DNA, 22 bp, Homo sapiens
ctggcagctgtgtgaagaactg

SEQ ID NO: 8071434 - DNA, 22 bp, Homo sapiens
ctggcttctgggccagggcaga

SEQ ID NO: 8071435 - DNA, 22 bp, Homo sapiens
ctggcagctgcccgagatgccc

SEQ ID NO: 8071436 - DNA, 22 bp, Homo sapiens
ctggcagctggaggctagaggc

SEQ ID NO: 8071437 - DNA, 22 bp, Homo sapiens
atataacatacatacagaaaag

SEQ ID NO: 8071438 - DNA, 22 bp, Homo sapiens
ctgggacacccaaggaaagagc

SEQ ID NO: 8071439 - DNA, 19 bp, Homo sapiens
ctgggacaatgaaagcatc

SEQ ID NO: 8071440 - DNA, 22 bp, Homo sapiens
atatataacctggataaggctt

SEQ ID NO: 8071441 - DNA, 22 bp, Homo sapiens
atatataagctgatgagccaca

SEQ ID NO: 8071442 - DNA, 22 bp, Homo sapiens
atatttcttgagcacctggtat

SEQ ID NO: 8071443 - DNA, 22 bp, Homo sapiens
atatgttactctttcaagcaga

SEQ ID NO: 8071444 - DNA, 22 bp, Homo sapiens
atatgtggcattatttctgagg

SEQ ID NO: 8071445 - DNA, 22 bp, Homo sapiens
ctgggcagtggtggcccttccc

SEQ ID NO: 8071446 - DNA, 22 bp, Homo sapiens
ctgggcagtggtggcccttccc

SEQ ID NO: 8071447 - DNA, 22 bp, Homo sapiens
ctgggcagtggtggcatctttg

SEQ ID NO: 8071448 - DNA, 22 bp, Homo sapiens
ctgggcagtggtggcatctttg

SEQ ID NO: 8071449 - DNA, 22 bp, Homo sapiens
ctgggcagtgcagctatagaac

SEQ ID NO: 8071450 - DNA, 20 bp, Homo sapiens
ctgggcaggtgtttgatctc

SEQ ID NO: 8071451 - DNA, 22 bp, Homo sapiens
ctgggcaggatacttcatggga

SEQ ID NO: 8071452 - DNA, 22 bp, Homo sapiens
atatgatgtgctatgtcactag

SEQ ID NO: 8071453 - DNA, 22 bp, Homo sapiens
aggcatctgagtttgcaagctt

SEQ ID NO: 8071454 - DNA, 23 bp, Homo sapiens
aggcagtggtggtaacatgtcaa

SEQ ID NO: 8071455 - DNA, 23 bp, Homo sapiens
aggcagtgggggccactttgctt

SEQ ID NO: 8071456 - DNA, 22 bp, Homo sapiens
aggcagtggctgagaccagggg

SEQ ID NO: 8071457 - DNA, 22 bp, Homo sapiens
aggcagtggcttttgttgtgtt

SEQ ID NO: 8071458 - DNA, 22 bp, Homo sapiens
ccactgggcgtttctgtccaat

SEQ ID NO: 8071459 - DNA, 22 bp, Homo sapiens
aggcatttaaagatgtaagact

SEQ ID NO: 8071460 - DNA, 22 bp, Homo sapiens
aggcagtgctcaagacagcagc

SEQ ID NO: 8071461 - DNA, 22 bp, Homo sapiens
aggcagtgcctggaccccagct

SEQ ID NO: 8071462 - DNA, 22 bp, Homo sapiens
aggcagtgcatgcaaaggtcgg

SEQ ID NO: 8071463 - DNA, 22 bp, Homo sapiens
aggcagtgcagagtcctcttct

SEQ ID NO: 8071464 - DNA, 22 bp, Homo sapiens
aggcagtgatgagtcatgaata

SEQ ID NO: 8071465 - DNA, 22 bp, Homo sapiens
aggcagtgcagagtcctcttct

SEQ ID NO: 8071466 - DNA, 22 bp, Homo sapiens
aggcagtgagtgtgacttcaca

SEQ ID NO: 8071467 - DNA, 22 bp, Homo sapiens
aggcagtgagcagggtgtcatg

SEQ ID NO: 8071468 - DNA, 22 bp, Homo sapiens
aggcagtgagaaatagcaagat

SEQ ID NO: 8071469 - DNA, 22 bp, Homo sapiens
aggcagtggagaaggtttgtga

SEQ ID NO: 8071470 - DNA, 22 bp, Homo sapiens
aggcagtggagctggaataggc

SEQ ID NO: 8071471 - DNA, 22 bp, Homo sapiens
aggcagtgctgtgccctgaacc

SEQ ID NO: 8071472 - DNA, 22 bp, Homo sapiens
aggcagtggaaggagaaagcaa

SEQ ID NO: 8071473 - DNA, 22 bp, Homo sapiens
aggcagtggatgtcaggaatgg

SEQ ID NO: 8071474 - DNA, 22 bp, Homo sapiens
aggcagtggctgagaccagggg

SEQ ID NO: 8071475 - DNA, 22 bp, Homo sapiens
aggcattttgttcaagatgaca

SEQ ID NO: 8071476 - DNA, 22 bp, Homo sapiens
aggccagctgccacccggtccg

SEQ ID NO: 8071477 - DNA, 22 bp, Homo sapiens
aggccagctgttactagagcca

SEQ ID NO: 8071478 - DNA, 22 bp, Homo sapiens
aggccagctctacccttggact

SEQ ID NO: 8071479 - DNA, 22 bp, Homo sapiens
aggccagctatgactctgctcc

SEQ ID NO: 8071480 - DNA, 23 bp, Homo sapiens
aggccagcgcagacaccgagcac

SEQ ID NO: 8071481 - DNA, 22 bp, Homo sapiens
aggccagcttctaccctctgtt

SEQ ID NO: 8071482 - DNA, 22 bp, Homo sapiens
aggccctgaagtcggcccctca

SEQ ID NO: 8071483 - DNA, 22 bp, Homo sapiens
aggccctgggttagggcccact

SEQ ID NO: 8071484 - DNA, 22 bp, Homo sapiens
aggctctgcagaccccagctgt

SEQ ID NO: 8071485 - DNA, 22 bp, Homo sapiens
aggctctgcagaccccagctgt

SEQ ID NO: 8071486 - DNA, 22 bp, Homo sapiens
aggctctgatgcaagcccaggg

SEQ ID NO: 8071487 - DNA, 23 bp, Homo sapiens
ccagtgattgcctggaaggaggt

SEQ ID NO: 8071488 - DNA, 22 bp, Homo sapiens
ccagttctaaacataaagctaa

SEQ ID NO: 8071489 - DNA, 22 bp, Homo sapiens
ccagttggtttcaatgggacag

SEQ ID NO: 8071490 - DNA, 22 bp, Homo sapiens
ccagtttaagacttatctcaat

SEQ ID NO: 8071491 - DNA, 22 bp, Homo sapiens
aggctccagtctgaaccttggg

SEQ ID NO: 8071492 - DNA, 22 bp, Homo sapiens
aggctccacggtcactggctct

SEQ ID NO: 8071493 - DNA, 22 bp, Homo sapiens
aggctccacggcaggatgctgt

SEQ ID NO: 8071494 - DNA, 22 bp, Homo sapiens
aggctccatgcaaaggctgttt

SEQ ID NO: 8071495 - DNA, 22 bp, Homo sapiens
aggctccataccatctccggag

SEQ ID NO: 8071496 - DNA, 22 bp, Homo sapiens
aggctccatgctaagcgatatg

SEQ ID NO: 8071497 - DNA, 22 bp, Homo sapiens
aggctccatggttctccctcag

SEQ ID NO: 8071498 - DNA, 22 bp, Homo sapiens
aggctccattcatgtgaaggca

SEQ ID NO: 8071499 - DNA, 22 bp, Homo sapiens
ccaggcccgttcccttctccag

SEQ ID NO: 8071500 - DNA, 22 bp, Homo sapiens
ccaggccctgctcctcacacca

SEQ ID NO: 8071501 - DNA, 22 bp, Homo sapiens
ccaggctctgcgctggacatgg

SEQ ID NO: 8071502 - DNA, 22 bp, Homo sapiens
aggctccattttcctgcagctg

SEQ ID NO: 8071503 - DNA, 22 bp, Homo sapiens
aggctccattccaggagctaga

SEQ ID NO: 8071504 - DNA, 22 bp, Homo sapiens
aggctccattccaggagctaga

SEQ ID NO: 8071505 - DNA, 22 bp, Homo sapiens
aggctccattttcctgcagctg

SEQ ID NO: 8071506 - DNA, 22 bp, Homo sapiens
ccaggcagggagctgtttggcc

SEQ ID NO: 8071507 - DNA, 22 bp, Homo sapiens
aggcctcctggctccaggcctt

SEQ ID NO: 8071508 - DNA, 22 bp, Homo sapiens
ccaggcatccattgcttcctct

SEQ ID NO: 8071509 - DNA, 22 bp, Homo sapiens
aggcctcaggaaggtaaagaag

SEQ ID NO: 8071510 - DNA, 17 bp, Homo sapiens
aggcctccctccaggcc

SEQ ID NO: 8071511 - DNA, 22 bp, Homo sapiens
aggcctcctgcagggatgagtg

SEQ ID NO: 8071512 - DNA, 22 bp, Homo sapiens
agggcagcattgcctttctcca

SEQ ID NO: 8071513 - DNA, 22 bp, Homo sapiens
agggcagatggaacttccccga

SEQ ID NO: 8071514 - DNA, 22 bp, Homo sapiens
agggcagccatgagccttcagg

SEQ ID NO: 8071515 - DNA, 22 bp, Homo sapiens
agggaggagaatggactccttc

SEQ ID NO: 8071516 - DNA, 22 bp, Homo sapiens
agggaggaccaatgtgtggtta

SEQ ID NO: 8071517 - DNA, 22 bp, Homo sapiens
agggaggaaggatgttccaaag

SEQ ID NO: 8071518 - DNA, 22 bp, Homo sapiens
agggaggagtcctcaaagtcat

SEQ ID NO: 8071519 - DNA, 22 bp, Homo sapiens
agggcagagggtgcctcacctg

SEQ ID NO: 8071520 - DNA, 22 bp, Homo sapiens
agggaggagaatggactccttc

SEQ ID NO: 8071521 - DNA, 22 bp, Homo sapiens
agggccaggaacacctgaaggg

SEQ ID NO: 8071522 - DNA, 22 bp, Homo sapiens
cctccaggaacttgagagacac

SEQ ID NO: 8071523 - DNA, 21 bp, Homo sapiens
cctccaggagcagagccctga

SEQ ID NO: 8071524 - DNA, 20 bp, Homo sapiens
cctccaggcacacccatgtg

SEQ ID NO: 8071525 - DNA, 22 bp, Homo sapiens
cctccaggataagtcagggcct

SEQ ID NO: 8071526 - DNA, 22 bp, Homo sapiens
cctccaggctgaatatctagaa

SEQ ID NO: 8071527 - DNA, 22 bp, Homo sapiens
cctcgcggcactcgggccggat

SEQ ID NO: 8071528 - DNA, 22 bp, Homo sapiens
cctcccagtgcctccagagcag

SEQ ID NO: 8071529 - DNA, 20 bp, Homo sapiens
cctcaagcagactgacagct

SEQ ID NO: 8071530 - DNA, 22 bp, Homo sapiens
cctcagagcctccagaaggaat

SEQ ID NO: 8071531 - DNA, 22 bp, Homo sapiens
ccctggggctgagggatggccg

SEQ ID NO: 8071532 - DNA, 21 bp, Homo sapiens
ccctgtgttccacagcagaca

SEQ ID NO: 8071533 - DNA, 22 bp, Homo sapiens
cccttcagggttaagtagaggg

SEQ ID NO: 8071534 - DNA, 22 bp, Homo sapiens
cccttcagctgagtgggacagc

SEQ ID NO: 8071535 - DNA, 22 bp, Homo sapiens
cccttcagctgagtgggacagc

SEQ ID NO: 8071536 - DNA, 23 bp, Homo sapiens
cccttcagcgagggcattaaggt

SEQ ID NO: 8071537 - DNA, 22 bp, Homo sapiens
ccatctccactgtccctgtcaa

SEQ ID NO: 8071538 - DNA, 22 bp, Homo sapiens
cccagcatcccagtgggcagca

SEQ ID NO: 8071539 - DNA, 22 bp, Homo sapiens
cccagcctcagctttacttcca

SEQ ID NO: 8071540 - DNA, 22 bp, Homo sapiens
aggctgtgttctgccctctccc

SEQ ID NO: 8071541 - DNA, 22 bp, Homo sapiens
cccagcctctgggttctgccgg

SEQ ID NO: 8071542 - DNA, 22 bp, Homo sapiens
cccagcctctgggctcacccaa

SEQ ID NO: 8071543 - DNA, 22 bp, Homo sapiens
cccagcctctgtttgctcctct

SEQ ID NO: 8071544 - DNA, 22 bp, Homo sapiens
cccagcctctggattctgccct

SEQ ID NO: 8071545 - DNA, 18 bp, Homo sapiens
cccagcctctcctttcta

SEQ ID NO: 8071546 - DNA, 22 bp, Homo sapiens
cccagctccttgtttgcatctc

SEQ ID NO: 8071547 - DNA, 22 bp, Homo sapiens
cccagcctggtgcactgtgggg

SEQ ID NO: 8071548 - DNA, 22 bp, Homo sapiens
cccagctccttggatgggcagg

SEQ ID NO: 8071549 - DNA, 22 bp, Homo sapiens
cccagcctgatctcggccagct

SEQ ID NO: 8071550 - DNA, 22 bp, Homo sapiens
agggagaggttgaaacctcagt

SEQ ID NO: 8071551 - DNA, 22 bp, Homo sapiens
agggagaatgaccaaggtatat

SEQ ID NO: 8071552 - DNA, 19 bp, Homo sapiens
agggaaggattctgtcatt

SEQ ID NO: 8071553 - DNA, 22 bp, Homo sapiens
agggaaggaaaagctgtcgctt

SEQ ID NO: 8071554 - DNA, 22 bp, Homo sapiens
agggaagaagctggtagtaggt

SEQ ID NO: 8071555 - DNA, 22 bp, Homo sapiens
ccccatgctgggatctgacacc

SEQ ID NO: 8071556 - DNA, 22 bp, Homo sapiens
ccccatcttccctgagggattt

SEQ ID NO: 8071557 - DNA, 22 bp, Homo sapiens
agggagccagagttgggagctc

SEQ ID NO: 8071558 - DNA, 22 bp, Homo sapiens
agggagcatgggtgaagcaggc

SEQ ID NO: 8071559 - DNA, 22 bp, Homo sapiens
agggagagtttgatgtttcctc

SEQ ID NO: 8071560 - DNA, 22 bp, Homo sapiens
aggagaggaatcattattacaa

SEQ ID NO: 8071561 - DNA, 22 bp, Homo sapiens
aggagaggcatcaagaaaatcg

SEQ ID NO: 8071562 - DNA, 22 bp, Homo sapiens
aggagaggggtaggattaattt

SEQ ID NO: 8071563 - DNA, 22 bp, Homo sapiens
aggagagggtggcattaagttt

SEQ ID NO: 8071564 - DNA, 22 bp, Homo sapiens
aggagaggctctaactctgtgt

SEQ ID NO: 8071565 - DNA, 22 bp, Homo sapiens
aggagagagaacacttgggtcc

SEQ ID NO: 8071566 - DNA, 22 bp, Homo sapiens
aggagagagctgagctttgctg

SEQ ID NO: 8071567 - DNA, 22 bp, Homo sapiens
aggagagaatgttccaggcttg

SEQ ID NO: 8071568 - DNA, 22 bp, Homo sapiens
aggagaggtctcccttccccag

SEQ ID NO: 8071569 - DNA, 18 bp, Homo sapiens
aggagcctttgcactgga

SEQ ID NO: 8071570 - DNA, 22 bp, Homo sapiens
aggaggaggtaagaaaagcata

SEQ ID NO: 8071571 - DNA, 22 bp, Homo sapiens
aggaggaggtgggacacagtga

SEQ ID NO: 8071572 - DNA, 22 bp, Homo sapiens
aggaggaggtaagaaaagcata

SEQ ID NO: 8071573 - DNA, 22 bp, Homo sapiens
aggaggaatacaatccagcagc

SEQ ID NO: 8071574 - DNA, 22 bp, Homo sapiens
aggaggaggctggagtacaccc

SEQ ID NO: 8071575 - DNA, 22 bp, Homo sapiens
aggagctcttgatgcttgaggg

SEQ ID NO: 8071576 - DNA, 22 bp, Homo sapiens
aggagctgaaacttctcatatg

SEQ ID NO: 8071577 - DNA, 22 bp, Homo sapiens
aggagctgaaacttctcatatg

SEQ ID NO: 8071578 - DNA, 22 bp, Homo sapiens
aggagctgaagtctctgcactc

SEQ ID NO: 8071579 - DNA, 22 bp, Homo sapiens
aggagctgacttgtaaagcatt

SEQ ID NO: 8071580 - DNA, 22 bp, Homo sapiens
cagtcctgaggaagagctgctg

SEQ ID NO: 8071581 - DNA, 23 bp, Homo sapiens
aggagaagagatttccacatgca

SEQ ID NO: 8071582 - DNA, 22 bp, Homo sapiens
aggagaagccaagttgtgagca

SEQ ID NO: 8071583 - DNA, 22 bp, Homo sapiens
cagtctctcttgtagtgcagct

SEQ ID NO: 8071584 - DNA, 22 bp, Homo sapiens
catgaaatctgagtatgtttcc

SEQ ID NO: 8071585 - DNA, 22 bp, Homo sapiens
catgaaaatgtcaagttctgct

SEQ ID NO: 8071586 - DNA, 22 bp, Homo sapiens
catgccagttttgagatgcacc

SEQ ID NO: 8071587 - DNA, 23 bp, Homo sapiens
catgccagtttgtgcaggcagat

SEQ ID NO: 8071588 - DNA, 22 bp, Homo sapiens
catgcagcggcgtttggtttaa

SEQ ID NO: 8071589 - DNA, 22 bp, Homo sapiens
catgcagcctgtgaacagtgtc

SEQ ID NO: 8071590 - DNA, 22 bp, Homo sapiens
catgcaggaggaaaaagcagct

SEQ ID NO: 8071591 - DNA, 22 bp, Homo sapiens
catgcagagtttattaccatct

SEQ ID NO: 8071592 - DNA, 22 bp, Homo sapiens
catgcagatgtcatgaggcatg

SEQ ID NO: 8071593 - DNA, 22 bp, Homo sapiens
catgcagcagaataatgactat

SEQ ID NO: 8071594 - DNA, 22 bp, Homo sapiens
catgcagcaggatctcattccc

SEQ ID NO: 8071595 - DNA, 22 bp, Homo sapiens
aggcacagcctcccttcacatg

SEQ ID NO: 8071596 - DNA, 22 bp, Homo sapiens
aggcacaggaatgtcatccagt

SEQ ID NO: 8071597 - DNA, 22 bp, Homo sapiens
aggcagcagccacaaggcctga

SEQ ID NO: 8071598 - DNA, 18 bp, Homo sapiens
aggcagcagcatcttctc

SEQ ID NO: 8071599 - DNA, 22 bp, Homo sapiens
aggcagcagaggttgaggaaag

SEQ ID NO: 8071600 - DNA, 22 bp, Homo sapiens
aggcagcagaaaacaaatggtt

SEQ ID NO: 8071601 - DNA, 22 bp, Homo sapiens
aggcagcagactgttaatcaga

SEQ ID NO: 8071602 - DNA, 22 bp, Homo sapiens
catttacataacagtaacgctg

SEQ ID NO: 8071603 - DNA, 22 bp, Homo sapiens
aggcagcagcttgctggttgcc

SEQ ID NO: 8071604 - DNA, 19 bp, Homo sapiens
aggcagcattctggggctt

SEQ ID NO: 8071605 - DNA, 22 bp, Homo sapiens
aggcagcagtcatgaggaaaga

SEQ ID NO: 8071606 - DNA, 22 bp, Homo sapiens
aggcagcatttctgcttatcca

SEQ ID NO: 8071607 - DNA, 22 bp, Homo sapiens
aggcagcatttctgcttatcca

SEQ ID NO: 8071608 - DNA, 19 bp, Homo sapiens
aggcagcattctggggctt

SEQ ID NO: 8071609 - DNA, 22 bp, Homo sapiens
aggcagcatttgaatccaggtc

SEQ ID NO: 8071610 - DNA, 22 bp, Homo sapiens
aggcagccagatggcagcctgc

SEQ ID NO: 8071611 - DNA, 22 bp, Homo sapiens
catggcctgcctcctcctggtg

SEQ ID NO: 8071612 - DNA, 19 bp, Homo sapiens
aggcagcacccagtccttg

SEQ ID NO: 8071613 - DNA, 22 bp, Homo sapiens
cattccttaacgtggggagtct

SEQ ID NO: 8071614 - DNA, 22 bp, Homo sapiens
cattcccatgactcctgctcag

SEQ ID NO: 8071615 - DNA, 22 bp, Homo sapiens
agctgcagtaaagctctccagg

SEQ ID NO: 8071616 - DNA, 22 bp, Homo sapiens
cagctttgcaggctggtcagtg

SEQ ID NO: 8071617 - DNA, 22 bp, Homo sapiens
agctgaggcatgatgctatcag

SEQ ID NO: 8071618 - DNA, 22 bp, Homo sapiens
agctgcaggcctctcctgggga

SEQ ID NO: 8071619 - DNA, 21 bp, Homo sapiens
agctgcagccatgtacatggc

SEQ ID NO: 8071620 - DNA, 22 bp, Homo sapiens
cagctcctgttggtcttgagga

SEQ ID NO: 8071621 - DNA, 22 bp, Homo sapiens
cagctctcacaccctcctccca

SEQ ID NO: 8071622 - DNA, 22 bp, Homo sapiens
cagctcctgcctgggcagctgt

SEQ ID NO: 8071623 - DNA, 23 bp, Homo sapiens
agctggaggctgtctactcccaa

SEQ ID NO: 8071624 - DNA, 22 bp, Homo sapiens
agctggaggataactcacttct

SEQ ID NO: 8071625 - DNA, 22 bp, Homo sapiens
agctggcatactttgctaggaa

SEQ ID NO: 8071626 - DNA, 22 bp, Homo sapiens
agctgctctttgaaggacactt

SEQ ID NO: 8071627 - DNA, 22 bp, Homo sapiens
agctgctcctttcctgcaggcg

SEQ ID NO: 8071628 - DNA, 22 bp, Homo sapiens
agctgctctgataaacctactt

SEQ ID NO: 8071629 - DNA, 22 bp, Homo sapiens
agctgctcttgggtgacttcaa

SEQ ID NO: 8071630 - DNA, 21 bp, Homo sapiens
agctgctccagggagctcagg

SEQ ID NO: 8071631 - DNA, 22 bp, Homo sapiens
agctgctccctatcctttcctt

SEQ ID NO: 8071632 - DNA, 22 bp, Homo sapiens
caggaaaaatgccaggagtcag

SEQ ID NO: 8071633 - DNA, 22 bp, Homo sapiens
agctggcctccgggtgcctggg

SEQ ID NO: 8071634 - DNA, 22 bp, Homo sapiens
caggaggtggagctcaagtggt

SEQ ID NO: 8071635 - DNA, 22 bp, Homo sapiens
caggaggttgagggtgcagtga

SEQ ID NO: 8071636 - DNA, 22 bp, Homo sapiens
caggaggtacatagattcagat

SEQ ID NO: 8071637 - DNA, 22 bp, Homo sapiens
caggaggtgaaggagaaccagt

SEQ ID NO: 8071638 - DNA, 22 bp, Homo sapiens
caggaggtgacttccaggggtt

SEQ ID NO: 8071639 - DNA, 22 bp, Homo sapiens
caggaggttggtagcagtagat

SEQ ID NO: 8071640 - DNA, 22 bp, Homo sapiens
caggaggttgtaagagcaggcc

SEQ ID NO: 8071641 - DNA, 22 bp, Homo sapiens
agcttgagttttggatgaagtg

SEQ ID NO: 8071642 - DNA, 22 bp, Homo sapiens
agctgtgtggtgtctgacagct

SEQ ID NO: 8071643 - DNA, 22 bp, Homo sapiens
agctgttccctcactgcagtca

SEQ ID NO: 8071644 - DNA, 22 bp, Homo sapiens
agctgttccaggcctcattgct

SEQ ID NO: 8071645 - DNA, 22 bp, Homo sapiens
agctgtgtcctgaagacactgc

SEQ ID NO: 8071646 - DNA, 22 bp, Homo sapiens
aggaagctcggagagggcaaat

SEQ ID NO: 8071647 - DNA, 18 bp, Homo sapiens
aggaagcaggaggaaggc

SEQ ID NO: 8071648 - DNA, 22 bp, Homo sapiens
aggaaataggaccagacaaagc

SEQ ID NO: 8071649 - DNA, 22 bp, Homo sapiens
aggaaatgctgatgctcctgga

SEQ ID NO: 8071650 - DNA, 22 bp, Homo sapiens
aggaaatgccgcggctctcttt

SEQ ID NO: 8071651 - DNA, 22 bp, Homo sapiens
aggaaaggggtaggtgtggacg

SEQ ID NO: 8071652 - DNA, 22 bp, Homo sapiens
cagggccagcgtctcgggctat

SEQ ID NO: 8071653 - DNA, 22 bp, Homo sapiens
cagggccagcgcccaggcccag

SEQ ID NO: 8071654 - DNA, 22 bp, Homo sapiens
cagggccactgtagatgaggag

SEQ ID NO: 8071655 - DNA, 22 bp, Homo sapiens
cagggccagagagggctggctg

SEQ ID NO: 8071656 - DNA, 22 bp, Homo sapiens
cagggccagccgcagcatccac

SEQ ID NO: 8071657 - DNA, 22 bp, Homo sapiens
cagggccagccatcctgctggg

SEQ ID NO: 8071658 - DNA, 22 bp, Homo sapiens
aggaaagctcccagtagggctc

SEQ ID NO: 8071659 - DNA, 21 bp, Homo sapiens
agcttgtgtgtatcacagtgt

SEQ ID NO: 8071660 - DNA, 17 bp, Homo sapiens
agcttgtttttgaaagc

SEQ ID NO: 8071661 - DNA, 22 bp, Homo sapiens
cagagagggagcagtagtctct

SEQ ID NO: 8071662 - DNA, 22 bp, Homo sapiens
cagacagcaaatctgcttgcat

SEQ ID NO: 8071663 - DNA, 22 bp, Homo sapiens
cagacagctgctttcttgctgt

SEQ ID NO: 8071664 - DNA, 22 bp, Homo sapiens
cagacagagtcttcccatcagt

SEQ ID NO: 8071665 - DNA, 22 bp, Homo sapiens
agcccaggagtttgaggctgtg

SEQ ID NO: 8071666 - DNA, 22 bp, Homo sapiens
agcccaggagtttgaggctgtg

SEQ ID NO: 8071667 - DNA, 22 bp, Homo sapiens
cagagctgcttcccagtttgtg

SEQ ID NO: 8071668 - DNA, 22 bp, Homo sapiens
cagagctggacttaaatatatt

SEQ ID NO: 8071669 - DNA, 22 bp, Homo sapiens
cagagctggagaagtggattta

SEQ ID NO: 8071670 - DNA, 22 bp, Homo sapiens
cagagctggagcttgaatggag

SEQ ID NO: 8071671 - DNA, 22 bp, Homo sapiens
agccctcatggaacagctccta

SEQ ID NO: 8071672 - DNA, 22 bp, Homo sapiens
cagagctggcggtgagaagaca

SEQ ID NO: 8071673 - DNA, 22 bp, Homo sapiens
cagagctggagggaaccctggc

SEQ ID NO: 8071674 - DNA, 22 bp, Homo sapiens
cagagctggcctgtgatttttg

SEQ ID NO: 8071675 - DNA, 23 bp, Homo sapiens
cagagctggctcagagctgcctg

SEQ ID NO: 8071676 - DNA, 22 bp, Homo sapiens
cagaagaaagtggggagacaag

SEQ ID NO: 8071677 - DNA, 22 bp, Homo sapiens
cagaagcctgcctcagatgcac

SEQ ID NO: 8071678 - DNA, 22 bp, Homo sapiens
cagaagcctgcctcagatgcac

SEQ ID NO: 8071679 - DNA, 22 bp, Homo sapiens
cagaagctgaggagtgaggcaa

SEQ ID NO: 8071680 - DNA, 22 bp, Homo sapiens
cagaagcattgactccttgctc

SEQ ID NO: 8071681 - DNA, 21 bp, Homo sapiens
agccagctatcacacagcatt

SEQ ID NO: 8071682 - DNA, 22 bp, Homo sapiens
agccaggacgttgctcagctcc

SEQ ID NO: 8071683 - DNA, 22 bp, Homo sapiens
agccaggattggctgagcctta

SEQ ID NO: 8071684 - DNA, 22 bp, Homo sapiens
cagacagaaggctccttgaggt

SEQ ID NO: 8071685 - DNA, 23 bp, Homo sapiens
agccacagccagagctatctcca

SEQ ID NO: 8071686 - DNA, 22 bp, Homo sapiens
cagaaccaggaactgatggaga

SEQ ID NO: 8071687 - DNA, 22 bp, Homo sapiens
agccacacctgtcctgccagct

SEQ ID NO: 8071688 - DNA, 22 bp, Homo sapiens
agctcccagcagagctggccac

SEQ ID NO: 8071689 - DNA, 22 bp, Homo sapiens
agctcccaggcagtcatgagga

SEQ ID NO: 8071690 - DNA, 22 bp, Homo sapiens
agctcccagtctcctctccatg

SEQ ID NO: 8071691 - DNA, 22 bp, Homo sapiens
cagccagcctctcaaccatgca

SEQ ID NO: 8071692 - DNA, 22 bp, Homo sapiens
cagccctgggagttggggccga

SEQ ID NO: 8071693 - DNA, 22 bp, Homo sapiens
cagccctgggtccctgccctgg

SEQ ID NO: 8071694 - DNA, 22 bp, Homo sapiens
cagccctggctagggcgagggc

SEQ ID NO: 8071695 - DNA, 22 bp, Homo sapiens
agctcctcctgagtgtctggga

SEQ ID NO: 8071696 - DNA, 22 bp, Homo sapiens
cagccctggccccaggtggtct

SEQ ID NO: 8071697 - DNA, 22 bp, Homo sapiens
agctcacagtgtccttcctcaa

SEQ ID NO: 8071698 - DNA, 22 bp, Homo sapiens
agccttgggcaatttggacact

SEQ ID NO: 8071699 - DNA, 22 bp, Homo sapiens
agccttgctttttcagtagcac

SEQ ID NO: 8071700 - DNA, 22 bp, Homo sapiens
agccttcataatcttgggcttt

SEQ ID NO: 8071701 - DNA, 22 bp, Homo sapiens
agccttcagtaaatccactgtg

SEQ ID NO: 8071702 - DNA, 23 bp, Homo sapiens
agccttcaggcaatgtcagtaga

SEQ ID NO: 8071703 - DNA, 22 bp, Homo sapiens
agccttcagcagttcaggtgcc

SEQ ID NO: 8071704 - DNA, 22 bp, Homo sapiens
agcctggtttaagcattttata

SEQ ID NO: 8071705 - DNA, 22 bp, Homo sapiens
agcctgtccagaggacagggct

SEQ ID NO: 8071706 - DNA, 22 bp, Homo sapiens
cagcagcatcaggtctgtggtt

SEQ ID NO: 8071707 - DNA, 22 bp, Homo sapiens
cagcagcatgaattcgagccac

SEQ ID NO: 8071708 - DNA, 22 bp, Homo sapiens
cagcagcagtggctgcagaaca

SEQ ID NO: 8071709 - DNA, 22 bp, Homo sapiens
cagcagcagtggctgcagaaca

SEQ ID NO: 8071710 - DNA, 22 bp, Homo sapiens
cagcagcagcttagtggtcccc

SEQ ID NO: 8071711 - DNA, 22 bp, Homo sapiens
agcctcagtttcaggcctcctc

SEQ ID NO: 8071712 - DNA, 22 bp, Homo sapiens
agcctccacagatgcaaagggc

SEQ ID NO: 8071713 - DNA, 22 bp, Homo sapiens
agcctccagtagctgaagagac

SEQ ID NO: 8071714 - DNA, 22 bp, Homo sapiens
agcctccaaatgtcaggtcccg

SEQ ID NO: 8071715 - DNA, 22 bp, Homo sapiens
agcctccatcccatgcacaaag

SEQ ID NO: 8071716 - DNA, 22 bp, Homo sapiens
cagcagaggaaagcaaatctaa

SEQ ID NO: 8071717 - DNA, 22 bp, Homo sapiens
cagcacagctggctctggaagc

SEQ ID NO: 8071718 - DNA, 23 bp, Homo sapiens
agcctcagccggtggcagaagtg

SEQ ID NO: 8071719 - DNA, 22 bp, Homo sapiens
cagaggctcaccagcctttcac

SEQ ID NO: 8071720 - DNA, 22 bp, Homo sapiens
agccctcctcacatcagcgtcc

SEQ ID NO: 8071721 - DNA, 22 bp, Homo sapiens
cagaggctaagatgagtgggtg

SEQ ID NO: 8071722 - DNA, 22 bp, Homo sapiens
cacagtccagactcctggagtt

SEQ ID NO: 8071723 - DNA, 22 bp, Homo sapiens
cacatctgacttccagtgcagg

SEQ ID NO: 8071724 - DNA, 22 bp, Homo sapiens
cacatccctggagttacccagt

SEQ ID NO: 8071725 - DNA, 22 bp, Homo sapiens
cacatctgaaaagatgcacaag

SEQ ID NO: 8071726 - DNA, 22 bp, Homo sapiens
cactctgcagctgaagggctgg

SEQ ID NO: 8071727 - DNA, 22 bp, Homo sapiens
agcaggtgcgttacttcactct

SEQ ID NO: 8071728 - DNA, 22 bp, Homo sapiens
agcagttcataaacattttgag

SEQ ID NO: 8071729 - DNA, 22 bp, Homo sapiens
caccagggtacaatttcgcaga

SEQ ID NO: 8071730 - DNA, 22 bp, Homo sapiens
caccagggctctgagctctgaa

SEQ ID NO: 8071731 - DNA, 22 bp, Homo sapiens
cacaggaggaggccagagcgta

SEQ ID NO: 8071732 - DNA, 22 bp, Homo sapiens
cacaggaggaggtgcccgggcc

SEQ ID NO: 8071733 - DNA, 22 bp, Homo sapiens
cacagggccttgtgtgactgca

SEQ ID NO: 8071734 - DNA, 22 bp, Homo sapiens
cacagggcctggggcagctgct

SEQ ID NO: 8071735 - DNA, 22 bp, Homo sapiens
cacagggccactttcccagtaa

SEQ ID NO: 8071736 - DNA, 22 bp, Homo sapiens
cacagggcagtgctgcccactc

SEQ ID NO: 8071737 - DNA, 19 bp, Homo sapiens
cacagggcaggtctcatgt

SEQ ID NO: 8071738 - DNA, 22 bp, Homo sapiens
cacagggcagtgattgtccaca

SEQ ID NO: 8071739 - DNA, 22 bp, Homo sapiens
cacagggcaggtactctcagag

SEQ ID NO: 8071740 - DNA, 23 bp, Homo sapiens
cacaggctgcgcataagcttctc

SEQ ID NO: 8071741 - DNA, 22 bp, Homo sapiens
cacagggctttgatggctgagt

SEQ ID NO: 8071742 - DNA, 22 bp, Homo sapiens
cacagggctaaatgaagggttg

SEQ ID NO: 8071743 - DNA, 22 bp, Homo sapiens
cacagggcttctcatggggtgc

SEQ ID NO: 8071744 - DNA, 22 bp, Homo sapiens
agcagctgtggaaaagtaacta

SEQ ID NO: 8071745 - DNA, 22 bp, Homo sapiens
agcagctgtcccttaacatcag

SEQ ID NO: 8071746 - DNA, 21 bp, Homo sapiens
agcagctgggcaacatggagg

SEQ ID NO: 8071747 - DNA, 22 bp, Homo sapiens
agcagctgtactttcatctgtt

SEQ ID NO: 8071748 - DNA, 20 bp, Homo sapiens
agcagctgtgttttcatcct

SEQ ID NO: 8071749 - DNA, 22 bp, Homo sapiens
agcagcttctttcactcctgga

SEQ ID NO: 8071750 - DNA, 22 bp, Homo sapiens
cacaggagctgtggggcagtgt

SEQ ID NO: 8071751 - DNA, 22 bp, Homo sapiens
caaatattccaggtacatccct

SEQ ID NO: 8071752 - DNA, 22 bp, Homo sapiens
caaatgatactgtttttagtct

SEQ ID NO: 8071753 - DNA, 22 bp, Homo sapiens
caaatgatagagccgattatca

SEQ ID NO: 8071754 - DNA, 22 bp, Homo sapiens
caaatgcaggtcagcaggtgtc

SEQ ID NO: 8071755 - DNA, 22 bp, Homo sapiens
caaatgcaaaatataaccctgt

SEQ ID NO: 8071756 - DNA, 22 bp, Homo sapiens
caaatgatgcatggctagtgag

SEQ ID NO: 8071757 - DNA, 22 bp, Homo sapiens
caaatgcagattcaggagttct

SEQ ID NO: 8071758 - DNA, 22 bp, Homo sapiens
caaatgcatagaaagatgaaac

SEQ ID NO: 8071759 - DNA, 22 bp, Homo sapiens
caaatgcaggtcataacctgag

SEQ ID NO: 8071760 - DNA, 22 bp, Homo sapiens
caaatgcagtccctttgttgct

SEQ ID NO: 8071761 - DNA, 22 bp, Homo sapiens
agcactgttatgggatgactta

SEQ ID NO: 8071762 - DNA, 22 bp, Homo sapiens
agcactgttatgggatgactta

SEQ ID NO: 8071763 - DNA, 22 bp, Homo sapiens
agcacagattctgaagagtcct

SEQ ID NO: 8071764 - DNA, 22 bp, Homo sapiens
agcacagagttgcagagagcgt

SEQ ID NO: 8071765 - DNA, 23 bp, Homo sapiens
agcacagactagaaaggtctttc

SEQ ID NO: 8071766 - DNA, 22 bp, Homo sapiens
caaggcaggcagttcacttgag

SEQ ID NO: 8071767 - DNA, 22 bp, Homo sapiens
agcagcagggtgtaattgggca

SEQ ID NO: 8071768 - DNA, 22 bp, Homo sapiens
agcagcatagaagctgggagga

SEQ ID NO: 8071769 - DNA, 22 bp, Homo sapiens
agcagcatgatgacagagtctc

SEQ ID NO: 8071770 - DNA, 22 bp, Homo sapiens
agcagcattctctggtatgggg

SEQ ID NO: 8071771 - DNA, 22 bp, Homo sapiens
agcagcagaaagttgatggcag

SEQ ID NO: 8071772 - DNA, 22 bp, Homo sapiens
agcagcacgagtccacaaatcc

SEQ ID NO: 8071773 - DNA, 22 bp, Homo sapiens
agcagcacctgtcctcgctgct

SEQ ID NO: 8071774 - DNA, 22 bp, Homo sapiens
agcagcacccagagccatgtct

SEQ ID NO: 8071775 - DNA, 22 bp, Homo sapiens
agcagcagaagggagacccagg

SEQ ID NO: 8071776 - DNA, 22 bp, Homo sapiens
agcagcagaaggtttgcaccca

SEQ ID NO: 8071777 - DNA, 22 bp, Homo sapiens
agcagcacacgggagaaagaca

SEQ ID NO: 8071778 - DNA, 22 bp, Homo sapiens
agcagacaacccagatgaccca

SEQ ID NO: 8071779 - DNA, 18 bp, Homo sapiens
agcagaattctagggttc

SEQ ID NO: 8071780 - DNA, 22 bp, Homo sapiens
caactgttataaatcaacagag

SEQ ID NO: 8071781 - DNA, 22 bp, Homo sapiens
agagggtgggcacgtgatggat

SEQ ID NO: 8071782 - DNA, 22 bp, Homo sapiens
agaggtagaggttgcagtgagc

SEQ ID NO: 8071783 - DNA, 22 bp, Homo sapiens
attcttcatacctactgaggtt

SEQ ID NO: 8071784 - DNA, 23 bp, Homo sapiens
attcttcattatcttctagaaaa

SEQ ID NO: 8071785 - DNA, 23 bp, Homo sapiens
attcttcattatcttctagaaaa

SEQ ID NO: 8071786 - DNA, 22 bp, Homo sapiens
attcttcatgttgaagctgtca

SEQ ID NO: 8071787 - DNA, 22 bp, Homo sapiens
attcttcatggctgtgagtcct

SEQ ID NO: 8071788 - DNA, 22 bp, Homo sapiens
attcttcattgttgattcatgt

SEQ ID NO: 8071789 - DNA, 22 bp, Homo sapiens
attcttcctcatcaatctgtag

SEQ ID NO: 8071790 - DNA, 22 bp, Homo sapiens
attcttcatttactgttacttg

SEQ ID NO: 8071791 - DNA, 23 bp, Homo sapiens
atttaatgctgagttgaatgtta

SEQ ID NO: 8071792 - DNA, 18 bp, Homo sapiens
atttaatgaactgaaagc

SEQ ID NO: 8071793 - DNA, 22 bp, Homo sapiens
atttagcaaaaaatgatgaagc

SEQ ID NO: 8071794 - DNA, 22 bp, Homo sapiens
agagtggggaaggtgttgagaa

SEQ ID NO: 8071795 - DNA, 22 bp, Homo sapiens
agatgaagactcaggagcaggt

SEQ ID NO: 8071796 - DNA, 23 bp, Homo sapiens
agatgaaagcttcccatcacagt

SEQ ID NO: 8071797 - DNA, 22 bp, Homo sapiens
agatgaagatgccactaagacc

SEQ ID NO: 8071798 - DNA, 22 bp, Homo sapiens
agatgaaaagataagcagcaat

SEQ ID NO: 8071799 - DNA, 22 bp, Homo sapiens
agatgaaaatacgtgactttaa

SEQ ID NO: 8071800 - DNA, 22 bp, Homo sapiens
agatgggcgccctggactgagg

SEQ ID NO: 8071801 - DNA, 22 bp, Homo sapiens
agatgtaaactctcatgtcatt

SEQ ID NO: 8071802 - DNA, 22 bp, Homo sapiens
agatggttgtcgcaaatgaatg

SEQ ID NO: 8071803 - DNA, 22 bp, Homo sapiens
agcaaacagtgtgctaagaaat

SEQ ID NO: 8071804 - DNA, 22 bp, Homo sapiens
agatttcacatgctgctctatt

SEQ ID NO: 8071805 - DNA, 22 bp, Homo sapiens
attcacaattagaagtagataa

SEQ ID NO: 8071806 - DNA, 22 bp, Homo sapiens
attatagagggttacagttaat

SEQ ID NO: 8071807 - DNA, 22 bp, Homo sapiens
attataaatattttctaggggt

SEQ ID NO: 8071808 - DNA, 22 bp, Homo sapiens
attataaacctttgagggtggg

SEQ ID NO: 8071809 - DNA, 22 bp, Homo sapiens
attataaagaacatgtgtgtgg

SEQ ID NO: 8071810 - DNA, 22 bp, Homo sapiens
attcagcagttcctgcttcagt

SEQ ID NO: 8071811 - DNA, 22 bp, Homo sapiens
attcagcataatcagtagcttg

SEQ ID NO: 8071812 - DNA, 22 bp, Homo sapiens
attcacagggacaatgggagag

SEQ ID NO: 8071813 - DNA, 22 bp, Homo sapiens
attctctgtttccaagatgaaa

SEQ ID NO: 8071814 - DNA, 22 bp, Homo sapiens
attctggccttggctctgtcac

SEQ ID NO: 8071815 - DNA, 22 bp, Homo sapiens
agagggtgctggagagacattg

SEQ ID NO: 8071816 - DNA, 22 bp, Homo sapiens
agagggtgaatgagatagaaaa

SEQ ID NO: 8071817 - DNA, 22 bp, Homo sapiens
agagggagcccagtcatagctg

SEQ ID NO: 8071818 - DNA, 22 bp, Homo sapiens
attaaatactgcaggctaagca

SEQ ID NO: 8071819 - DNA, 20 bp, Homo sapiens
atgttaaatagcatttagag

SEQ ID NO: 8071820 - DNA, 20 bp, Homo sapiens
atgttaaatagcatttagag

SEQ ID NO: 8071821 - DNA, 22 bp, Homo sapiens
atgttaaatagccatttgtttg

SEQ ID NO: 8071822 - DNA, 22 bp, Homo sapiens
atgtgtgctcttgagccttcac

SEQ ID NO: 8071823 - DNA, 23 bp, Homo sapiens
atgttaaacataactgaagagcc

SEQ ID NO: 8071824 - DNA, 22 bp, Homo sapiens
atgttaaagatggtgggaaatt

SEQ ID NO: 8071825 - DNA, 22 bp, Homo sapiens
atgttaaataatcccttaaagc

SEQ ID NO: 8071826 - DNA, 22 bp, Homo sapiens
atgttaaataatcccttaaagc

SEQ ID NO: 8071827 - DNA, 20 bp, Homo sapiens
atctttgtctctgtagttgt

SEQ ID NO: 8071828 - DNA, 20 bp, Homo sapiens
agaaggctccttttgccaag

SEQ ID NO: 8071829 - DNA, 22 bp, Homo sapiens
agaatacaattgttcagtaata

SEQ ID NO: 8071830 - DNA, 22 bp, Homo sapiens
atctttatatatctcctctgaa

SEQ ID NO: 8071831 - DNA, 18 bp, Homo sapiens
agaagcacaagatgtctt

SEQ ID NO: 8071832 - DNA, 19 bp, Homo sapiens
agaagcaccagtcattcct

SEQ ID NO: 8071833 - DNA, 22 bp, Homo sapiens
atcttgttctcccttgttctta

SEQ ID NO: 8071834 - DNA, 18 bp, Homo sapiens
atcttgtttttggattaa

SEQ ID NO: 8071835 - DNA, 22 bp, Homo sapiens
agaagagtagtaacagaaatta

SEQ ID NO: 8071836 - DNA, 22 bp, Homo sapiens
agaattctgacaatagaattgg

SEQ ID NO: 8071837 - DNA, 22 bp, Homo sapiens
agacacagaagttgctgttggg

SEQ ID NO: 8071838 - DNA, 19 bp, Homo sapiens
agacacacttacgtggaat

SEQ ID NO: 8071839 - DNA, 22 bp, Homo sapiens
agaatgcttgtacctttgtttt

SEQ ID NO: 8071840 - DNA, 22 bp, Homo sapiens
agaatgctcttcaaaatctagc

SEQ ID NO: 8071841 - DNA, 22 bp, Homo sapiens
agaatgtgttattagagaagga

SEQ ID NO: 8071842 - DNA, 22 bp, Homo sapiens
agaatcaggaagacagcctggc

SEQ ID NO: 8071843 - DNA, 21 bp, Homo sapiens
atgcaggctgctcagaagcaa

SEQ ID NO: 8071844 - DNA, 22 bp, Homo sapiens
agacacagtataagcacaacaa

SEQ ID NO: 8071845 - DNA, 22 bp, Homo sapiens
agacacaggtgtaatttctgct

SEQ ID NO: 8071846 - DNA, 22 bp, Homo sapiens
agacacagctgcaggaggtggg

SEQ ID NO: 8071847 - DNA, 22 bp, Homo sapiens
agacacaggattctgcatttct

SEQ ID NO: 8071848 - DNA, 21 bp, Homo sapiens
agacacaggggttgctggggt

SEQ ID NO: 8071849 - DNA, 22 bp, Homo sapiens
agacacatcttaggttgtcagg

SEQ ID NO: 8071850 - DNA, 22 bp, Homo sapiens
agacacagtctgtctggaggag

SEQ ID NO: 8071851 - DNA, 22 bp, Homo sapiens
agacacagtgctgggtgctgag

SEQ ID NO: 8071852 - DNA, 19 bp, Homo sapiens
atgtcccaccgcccctgag

SEQ ID NO: 8071853 - DNA, 22 bp, Homo sapiens
atgtctgtttatccttcaagat

SEQ ID NO: 8071854 - DNA, 22 bp, Homo sapiens
atgtctgtgtgatcttggataa

SEQ ID NO: 8071855 - DNA, 22 bp, Homo sapiens
atgtctgtggcattatatgttt

SEQ ID NO: 8071856 - DNA, 22 bp, Homo sapiens
atgggaggatgctcgggtgctc

SEQ ID NO: 8071857 - DNA, 22 bp, Homo sapiens
atgggaggcagcagagcccagc

SEQ ID NO: 8071858 - DNA, 22 bp, Homo sapiens
atgggaggcagacactaagttc

SEQ ID NO: 8071859 - DNA, 22 bp, Homo sapiens
atgggaggcaggctcagaaccg

SEQ ID NO: 8071860 - DNA, 22 bp, Homo sapiens
atgggaggaaggaggcccttga

SEQ ID NO: 8071861 - DNA, 22 bp, Homo sapiens
atgggaggatcacttgaggcca

SEQ ID NO: 8071862 - DNA, 22 bp, Homo sapiens
atgggaggaagagaagatgtct

SEQ ID NO: 8071863 - DNA, 20 bp, Homo sapiens
atgtaaaattataaggctga

SEQ ID NO: 8071864 - DNA, 22 bp, Homo sapiens
atgggtgtgaaaatggtcatct

SEQ ID NO: 8071865 - DNA, 22 bp, Homo sapiens
atgggtggccccgtgtgcagtc

SEQ ID NO: 8071866 - DNA, 22 bp, Homo sapiens
atggtttgtgtggcccagatga

SEQ ID NO: 8071867 - DNA, 22 bp, Homo sapiens
agactctgagacatgaaccatc

SEQ ID NO: 8071868 - DNA, 22 bp, Homo sapiens
agacgctattttgaggggtcta

SEQ ID NO: 8071869 - DNA, 22 bp, Homo sapiens
atggaaagggaagcaaggaaca

SEQ ID NO: 8071870 - DNA, 22 bp, Homo sapiens
atggaaagctaagccatttacc

SEQ ID NO: 8071871 - DNA, 22 bp, Homo sapiens
atggaaagccagtgttccatca

SEQ ID NO: 8071872 - DNA, 22 bp, Homo sapiens
atggaaaggctgtggaaactta

SEQ ID NO: 8071873 - DNA, 22 bp, Homo sapiens
atggcagcaaatgtctggctgg

SEQ ID NO: 8071874 - DNA, 21 bp, Homo sapiens
atggagtcaggggaatgggcc

SEQ ID NO: 8071875 - DNA, 22 bp, Homo sapiens
actcaacagggaacaagatcag

SEQ ID NO: 8071876 - DNA, 19 bp, Homo sapiens
actcaagtctaatgaaatc

SEQ ID NO: 8071877 - DNA, 22 bp, Homo sapiens
actaaatagttttgacagaaca

SEQ ID NO: 8071878 - DNA, 21 bp, Homo sapiens
accttcagtgttctcagctgc

SEQ ID NO: 8071879 - DNA, 22 bp, Homo sapiens
accttcagacatcaactatctc

SEQ ID NO: 8071880 - DNA, 22 bp, Homo sapiens
accttcaatgaaaataatagtc

SEQ ID NO: 8071881 - DNA, 22 bp, Homo sapiens
accttaaaactgacacatggag

SEQ ID NO: 8071882 - DNA, 22 bp, Homo sapiens
acctgtttacctgcacctgttt

SEQ ID NO: 8071883 - DNA, 22 bp, Homo sapiens
agggtgcctggaagccactcac

SEQ ID NO: 8071884 - DNA, 22 bp, Homo sapiens
agggtgcctgctgcaggttcag

SEQ ID NO: 8071885 - DNA, 22 bp, Homo sapiens
agggtgggctagactcttcccc

SEQ ID NO: 8071886 - DNA, 22 bp, Homo sapiens
agggctggtatgtccatgaaag

SEQ ID NO: 8071887 - DNA, 22 bp, Homo sapiens
agggtggggtgctacatcttta

SEQ ID NO: 8071888 - DNA, 22 bp, Homo sapiens
acctgtgttttccctcagtttc

SEQ ID NO: 8071889 - DNA, 22 bp, Homo sapiens
acctggacacctgctgtcatct

SEQ ID NO: 8071890 - DNA, 20 bp, Homo sapiens
acctggagacagcactctgg

SEQ ID NO: 8071891 - DNA, 22 bp, Homo sapiens
acctgccttctcaaggacatga

SEQ ID NO: 8071892 - DNA, 22 bp, Homo sapiens
actccacaccacgggggccgcc

SEQ ID NO: 8071893 - DNA, 22 bp, Homo sapiens
actccagaatcctagggtcagc

SEQ ID NO: 8071894 - DNA, 22 bp, Homo sapiens
agtctacaacgcaagcaacatg

SEQ ID NO: 8071895 - DNA, 22 bp, Homo sapiens
agtctctgctggttgtgcctat

SEQ ID NO: 8071896 - DNA, 22 bp, Homo sapiens
agtctctgccagcttgtcctct

SEQ ID NO: 8071897 - DNA, 22 bp, Homo sapiens
agtctctgcacagtaagaagca

SEQ ID NO: 8071898 - DNA, 22 bp, Homo sapiens
agtctctgcatgatgcagcaca

SEQ ID NO: 8071899 - DNA, 22 bp, Homo sapiens
agtctctgcatgcctgctgtgc

SEQ ID NO: 8071900 - DNA, 20 bp, Homo sapiens
agtctctgtagtgcctgaga

SEQ ID NO: 8071901 - DNA, 22 bp, Homo sapiens
actgaacaccatttataacatt

SEQ ID NO: 8071902 - DNA, 22 bp, Homo sapiens
agtctgggtgtgaatgaacttg

SEQ ID NO: 8071903 - DNA, 22 bp, Homo sapiens
agtctgggtggctgagctacag

SEQ ID NO: 8071904 - DNA, 22 bp, Homo sapiens
agtctgggctgtctgcaggagt

SEQ ID NO: 8071905 - DNA, 23 bp, Homo sapiens
actgcctgtgccgatctctctca

SEQ ID NO: 8071906 - DNA, 22 bp, Homo sapiens
actgcctgtagctcttcatctc

SEQ ID NO: 8071907 - DNA, 22 bp, Homo sapiens
actgcttacaaaaggaaagaat

SEQ ID NO: 8071908 - DNA, 20 bp, Homo sapiens
actgcttctttctctgacct

SEQ ID NO: 8071909 - DNA, 22 bp, Homo sapiens
actgctgactaaacagctccat

SEQ ID NO: 8071910 - DNA, 22 bp, Homo sapiens
actgctgcaggtccagcccctt

SEQ ID NO: 8071911 - DNA, 23 bp, Homo sapiens
actgctgtctttgaagtgcttga

SEQ ID NO: 8071912 - DNA, 22 bp, Homo sapiens
actggatgaggggaaagagaca

SEQ ID NO: 8071913 - DNA, 22 bp, Homo sapiens
actggcagaggttggacaccat

SEQ ID NO: 8071914 - DNA, 22 bp, Homo sapiens
actggcagccacaactggcagg

SEQ ID NO: 8071915 - DNA, 22 bp, Homo sapiens
acttcattgtaatattatagca

SEQ ID NO: 8071916 - DNA, 22 bp, Homo sapiens
acttccaaagaagtgattacag

SEQ ID NO: 8071917 - DNA, 22 bp, Homo sapiens
acttccaaaacacagcatggca

SEQ ID NO: 8071918 - DNA, 22 bp, Homo sapiens
acttcagccaagaaaactcagt

SEQ ID NO: 8071919 - DNA, 22 bp, Homo sapiens
acttccaaataccatcacattg

SEQ ID NO: 8071920 - DNA, 22 bp, Homo sapiens
acttccaacttcagtcctgagc

SEQ ID NO: 8071921 - DNA, 22 bp, Homo sapiens
acttccaagtgacattcatatc

SEQ ID NO: 8071922 - DNA, 17 bp, Homo sapiens
acttccaagcattgctg

SEQ ID NO: 8071923 - DNA, 22 bp, Homo sapiens
acttccaagtttattcatgtga

SEQ ID NO: 8071924 - DNA, 22 bp, Homo sapiens
acttggagagcattgctgggga

SEQ ID NO: 8071925 - DNA, 22 bp, Homo sapiens
actgtgtcctatttccttgaca

SEQ ID NO: 8071926 - DNA, 22 bp, Homo sapiens
actgtggtgcacggcctgctcc

SEQ ID NO: 8071927 - DNA, 22 bp, Homo sapiens
actgtgccacaattcaccaggg

SEQ ID NO: 8071928 - DNA, 22 bp, Homo sapiens
actgtctgtcctgctctccgtg

SEQ ID NO: 8071929 - DNA, 22 bp, Homo sapiens
actgtctgctggcccctggtta

SEQ ID NO: 8071930 - DNA, 22 bp, Homo sapiens
actgtcttgtgttaaagaacca

SEQ ID NO: 8071931 - DNA, 20 bp, Homo sapiens
actggcagcctgcctgctgt

SEQ ID NO: 8071932 - DNA, 22 bp, Homo sapiens
actggcagctgtaggatgcatg

SEQ ID NO: 8071933 - DNA, 22 bp, Homo sapiens
actggcagtggcagcagaaaga

SEQ ID NO: 8071934 - DNA, 22 bp, Homo sapiens
actggcagtttgagaatgcatt

SEQ ID NO: 8071935 - DNA, 22 bp, Homo sapiens
atccagaacacctgtatcacca

SEQ ID NO: 8071936 - DNA, 22 bp, Homo sapiens
atccagagtaatacagaatgca

SEQ ID NO: 8071937 - DNA, 23 bp, Homo sapiens
atcaccagcggaagctgcagacc

SEQ ID NO: 8071938 - DNA, 22 bp, Homo sapiens
atatacacatctttttaaatat

SEQ ID NO: 8071939 - DNA, 22 bp, Homo sapiens
atatataacctggataaggctt

SEQ ID NO: 8071940 - DNA, 22 bp, Homo sapiens
atataatagtttcataaaggct

SEQ ID NO: 8071941 - DNA, 22 bp, Homo sapiens
atataattctcaggtttgacta

SEQ ID NO: 8071942 - DNA, 22 bp, Homo sapiens
atatatttgagaatattcatga

SEQ ID NO: 8071943 - DNA, 22 bp, Homo sapiens
atatatttgagaatattcatga

SEQ ID NO: 8071944 - DNA, 22 bp, Homo sapiens
agaaacagaaccaggtgtcatt

SEQ ID NO: 8071945 - DNA, 22 bp, Homo sapiens
agaaacaaggtgtaggttgacc

SEQ ID NO: 8071946 - DNA, 22 bp, Homo sapiens
agaaaataaattgatggtggaa

SEQ ID NO: 8071947 - DNA, 21 bp, Homo sapiens
acagccttgtgatggagacag

SEQ ID NO: 8071948 - DNA, 22 bp, Homo sapiens
agctggggctgcagagaacagg

SEQ ID NO: 8071949 - DNA, 17 bp, Homo sapiens
agctgccagggagtgtg

SEQ ID NO: 8071950 - DNA, 22 bp, Homo sapiens
acagcagacacaggcacgctgt

SEQ ID NO: 8071951 - DNA, 22 bp, Homo sapiens
agctgccttaaattactttgtg

SEQ ID NO: 8071952 - DNA, 22 bp, Homo sapiens
agctgctatgacaacaccagcc

SEQ ID NO: 8071953 - DNA, 22 bp, Homo sapiens
acagcctgcagccccaggtcgc

SEQ ID NO: 8071954 - DNA, 22 bp, Homo sapiens
acagccttctcttcactgtgtc

SEQ ID NO: 8071955 - DNA, 23 bp, Homo sapiens
acagccttctggggcttctgggc

SEQ ID NO: 8071956 - DNA, 22 bp, Homo sapiens
acaggctctggggcaggatggc

SEQ ID NO: 8071957 - DNA, 22 bp, Homo sapiens
acaggctgccacttgcatccaa

SEQ ID NO: 8071958 - DNA, 22 bp, Homo sapiens
acaggctgcccgctccccacct

SEQ ID NO: 8071959 - DNA, 22 bp, Homo sapiens
acaggctgcctaccaagtatca

SEQ ID NO: 8071960 - DNA, 22 bp, Homo sapiens
acaggctgctgagccatttgct

SEQ ID NO: 8071961 - DNA, 22 bp, Homo sapiens
acaggctgctgggctccgtgct

SEQ ID NO: 8071962 - DNA, 18 bp, Homo sapiens
acaggctgtgggaatggt

SEQ ID NO: 8071963 - DNA, 22 bp, Homo sapiens
acagctgtgaaaatccacagga

SEQ ID NO: 8071964 - DNA, 22 bp, Homo sapiens
acagctgtgacttagagaagtt

SEQ ID NO: 8071965 - DNA, 22 bp, Homo sapiens
acagctgtgggctctgcatata

SEQ ID NO: 8071966 - DNA, 22 bp, Homo sapiens
acagctgtggccacttgcatcc

SEQ ID NO: 8071967 - DNA, 22 bp, Homo sapiens
acaggcctcaagacacccaggt

SEQ ID NO: 8071968 - DNA, 22 bp, Homo sapiens
acagttcagacaagtgttccat

SEQ ID NO: 8071969 - DNA, 22 bp, Homo sapiens
acagttcaagacatcagtatga

SEQ ID NO: 8071970 - DNA, 22 bp, Homo sapiens
acagtgatgagccggctgaggc

SEQ ID NO: 8071971 - DNA, 22 bp, Homo sapiens
aggcagcagtgataagatagga

SEQ ID NO: 8071972 - DNA, 22 bp, Homo sapiens
aggcagcaattgaaatcattgt

SEQ ID NO: 8071973 - DNA, 22 bp, Homo sapiens
aggcagcatgctctgcttctac

SEQ ID NO: 8071974 - DNA, 21 bp, Homo sapiens
aggcagcatctgatttatatg

SEQ ID NO: 8071975 - DNA, 16 bp, Homo sapiens
aggcagcatgttagtg

SEQ ID NO: 8071976 - DNA, 22 bp, Homo sapiens
aggcagcatgggccccagctcc

SEQ ID NO: 8071977 - DNA, 22 bp, Homo sapiens
aggcagcatgggcccagagtcc

SEQ ID NO: 8071978 - DNA, 21 bp, Homo sapiens
aggcaggattcaaacacagag

SEQ ID NO: 8071979 - DNA, 23 bp, Homo sapiens
acataaacagaaggtgtgcttcc

SEQ ID NO: 8071980 - DNA, 22 bp, Homo sapiens
acataaagtactgagagactct

SEQ ID NO: 8071981 - DNA, 22 bp, Homo sapiens
acataaatagattattgggagg

SEQ ID NO: 8071982 - DNA, 22 bp, Homo sapiens
aggagtggaattactgggttct

SEQ ID NO: 8071983 - DNA, 22 bp, Homo sapiens
aggagtggaattactgggttct

SEQ ID NO: 8071984 - DNA, 22 bp, Homo sapiens
aggagtgcaaatagtccagaga

SEQ ID NO: 8071985 - DNA, 20 bp, Homo sapiens
aggagtccctgtgctctctc

SEQ ID NO: 8071986 - DNA, 17 bp, Homo sapiens
aggagtctcagatgagc

SEQ ID NO: 8071987 - DNA, 22 bp, Homo sapiens
aggagggtgatccgggctggtc

SEQ ID NO: 8071988 - DNA, 21 bp, Homo sapiens
aggaggaacccgtggctgggc

SEQ ID NO: 8071989 - DNA, 23 bp, Homo sapiens
aggaggaaaagttatctgctgag

SEQ ID NO: 8071990 - DNA, 22 bp, Homo sapiens
acaggtgggcttaagagtcggc

SEQ ID NO: 8071991 - DNA, 22 bp, Homo sapiens
acaggtggggaggctgaggttc

SEQ ID NO: 8071992 - DNA, 22 bp, Homo sapiens
acaggtggtaaaatggactgtc

SEQ ID NO: 8071993 - DNA, 22 bp, Homo sapiens
acaggtggcttattggctgatt

SEQ ID NO: 8071994 - DNA, 22 bp, Homo sapiens
acaggtggccccgagggagtgg

SEQ ID NO: 8071995 - DNA, 22 bp, Homo sapiens
aggagcttcagagagaacctgg

SEQ ID NO: 8071996 - DNA, 22 bp, Homo sapiens
acaggtggtctttgctcctttt

SEQ ID NO: 8071997 - DNA, 22 bp, Homo sapiens
acaggtggtctttgctcctttt

SEQ ID NO: 8071998 - DNA, 22 bp, Homo sapiens
acagggcaacctctgggagact

SEQ ID NO: 8071999 - DNA, 22 bp, Homo sapiens
acagggcacctgaggtaggaag

SEQ ID NO: 8072000 - DNA, 22 bp, Homo sapiens
acaggtggcataggcagtttga

SEQ ID NO: 8072001 - DNA, 22 bp, Homo sapiens
acaggtggcataggcagtttga

SEQ ID NO: 8072002 - DNA, 22 bp, Homo sapiens
acaggtggcagaagcatttact

SEQ ID NO: 8072003 - DNA, 22 bp, Homo sapiens
acaggtggaggctttaggaggt

SEQ ID NO: 8072004 - DNA, 22 bp, Homo sapiens
acaggtggagtggttagcaggc

SEQ ID NO: 8072005 - DNA, 22 bp, Homo sapiens
aggccttcctcggagacaggga

SEQ ID NO: 8072006 - DNA, 22 bp, Homo sapiens
acatttaaccaaactgtttaat

SEQ ID NO: 8072007 - DNA, 22 bp, Homo sapiens
aggctatttccactcttctcat

SEQ ID NO: 8072008 - DNA, 22 bp, Homo sapiens
aggccctgtccatggtgctgaa

SEQ ID NO: 8072009 - DNA, 22 bp, Homo sapiens
aggccctgttatgagccactgt

SEQ ID NO: 8072010 - DNA, 20 bp, Homo sapiens
acatgcagtggtcatttcag

SEQ ID NO: 8072011 - DNA, 22 bp, Homo sapiens
acatgcacacgattcagtctgg

SEQ ID NO: 8072012 - DNA, 22 bp, Homo sapiens
agggcctggtgacctgggtcct

SEQ ID NO: 8072013 - DNA, 22 bp, Homo sapiens
agggcctggggtagcttactgc

SEQ ID NO: 8072014 - DNA, 22 bp, Homo sapiens
agggcctggggtagcttactgc

SEQ ID NO: 8072015 - DNA, 22 bp, Homo sapiens
agggcctgggtctgtactcctc

SEQ ID NO: 8072016 - DNA, 22 bp, Homo sapiens
agggcctgggtctgtactcctc

SEQ ID NO: 8072017 - DNA, 22 bp, Homo sapiens
agggcctggttctgtgtaggga

SEQ ID NO: 8072018 - DNA, 22 bp, Homo sapiens
accctcaacaaattcactctat

SEQ ID NO: 8072019 - DNA, 22 bp, Homo sapiens
agggcctgggatgtcctcctag

SEQ ID NO: 8072020 - DNA, 22 bp, Homo sapiens
agggcctgggatgtcctcctag

SEQ ID NO: 8072021 - DNA, 22 bp, Homo sapiens
agggcctgggccagcacccttt

SEQ ID NO: 8072022 - DNA, 22 bp, Homo sapiens
agggcctgggccagcacccttt

SEQ ID NO: 8072023 - DNA, 22 bp, Homo sapiens
acccaggcctgagagacaggag

SEQ ID NO: 8072024 - DNA, 22 bp, Homo sapiens
agggagctcagttggaagcggt

SEQ ID NO: 8072025 - DNA, 22 bp, Homo sapiens
accatcagtcacatgtagagaa

SEQ ID NO: 8072026 - DNA, 22 bp, Homo sapiens
accatcagtactggatgctgac

SEQ ID NO: 8072027 - DNA, 22 bp, Homo sapiens
accatcagagcacagtccgtgc

SEQ ID NO: 8072028 - DNA, 22 bp, Homo sapiens
acccaagttttccatgcctgtt

SEQ ID NO: 8072029 - DNA, 21 bp, Homo sapiens
agggagctatttatagtaagc

SEQ ID NO: 8072030 - DNA, 22 bp, Homo sapiens
agggacagatgaatgactgagt

SEQ ID NO: 8072031 - DNA, 22 bp, Homo sapiens
agggaattcactggaacgccct

SEQ ID NO: 8072032 - DNA, 22 bp, Homo sapiens
agggaatgtagcaagatgccaa

SEQ ID NO: 8072033 - DNA, 22 bp, Homo sapiens
agggaagaggaccagagtctct

SEQ ID NO: 8072034 - DNA, 22 bp, Homo sapiens
accaaacaaaattgtgcactgt

SEQ ID NO: 8072035 - DNA, 21 bp, Homo sapiens
accaaaacctatactttctgt

SEQ ID NO: 8072036 - DNA, 22 bp, Homo sapiens
acatttgtcttctttcagatta

SEQ ID NO: 8072037 - DNA, 22 bp, Homo sapiens
agggaagagcttgcaagaaacc

SEQ ID NO: 8072038 - DNA, 22 bp, Homo sapiens
agggaagaatcactgggatgtt

SEQ ID NO: 8072039 - DNA, 22 bp, Homo sapiens
aagaaacaaccactgctctcct

SEQ ID NO: 8072040 - DNA, 22 bp, Homo sapiens
aatggctttgacattttcaaat

SEQ ID NO: 8072041 - DNA, 22 bp, Homo sapiens
aactttctgtctgagctgcaga

SEQ ID NO: 8072042 - DNA, 22 bp, Homo sapiens
aattctaaatgtaatttagaat

SEQ ID NO: 8072043 - DNA, 22 bp, Homo sapiens
aagaacagattcagcctgaact

SEQ ID NO: 8072044 - DNA, 22 bp, Homo sapiens
aagagacttctagatttgttga

SEQ ID NO: 8072045 - DNA, 21 bp, Homo sapiens
aagagacatttctcatcagca

SEQ ID NO: 8072046 - DNA, 22 bp, Homo sapiens
aagagacaagaattccaacgct

SEQ ID NO: 8072047 - DNA, 22 bp, Homo sapiens
acacaaacagtctatagcacca

SEQ ID NO: 8072048 - DNA, 22 bp, Homo sapiens
acacaaactgctagaaaattgg

SEQ ID NO: 8072049 - DNA, 22 bp, Homo sapiens
aagactttctcccaaatcctca

SEQ ID NO: 8072050 - DNA, 20 bp, Homo sapiens
aattttatctccatcctttg

SEQ ID NO: 8072051 - DNA, 22 bp, Homo sapiens
aagacttgaccaggttgaaggc

SEQ ID NO: 8072052 - DNA, 22 bp, Homo sapiens
aattttaatcagtggtgctgag

SEQ ID NO: 8072053 - DNA, 22 bp, Homo sapiens
aatttgttttcaagtcactgga

SEQ ID NO: 8072054 - DNA, 22 bp, Homo sapiens
aattttaagcatatgactggtt

SEQ ID NO: 8072055 - DNA, 22 bp, Homo sapiens
aatttccagaccccatccacag

SEQ ID NO: 8072056 - DNA, 22 bp, Homo sapiens
aagatgcggttgaccatggtgt

SEQ ID NO: 8072057 - DNA, 22 bp, Homo sapiens
aagatgatagatctgtcaatgt

SEQ ID NO: 8072058 - DNA, 22 bp, Homo sapiens
aagatgatgcagactttgatgt

SEQ ID NO: 8072059 - DNA, 22 bp, Homo sapiens
aagatgataggacttgcttaag

SEQ ID NO: 8072060 - DNA, 22 bp, Homo sapiens
acacatttaaaaaggaacatat

SEQ ID NO: 8072061 - DNA, 22 bp, Homo sapiens
acacattatgagcagttgtctt

SEQ ID NO: 8072062 - DNA, 21 bp, Homo sapiens
acacattatgagcatagactc

SEQ ID NO: 8072063 - DNA, 22 bp, Homo sapiens
aagagcaggacagaatcagaac

SEQ ID NO: 8072064 - DNA, 22 bp, Homo sapiens
acacatgcaggtatacatgttc

SEQ ID NO: 8072065 - DNA, 22 bp, Homo sapiens
acagcctgctgcctgcttcttg

SEQ ID NO: 8072066 - DNA, 22 bp, Homo sapiens
acagcagagcctagcttaatct

SEQ ID NO: 8072067 - DNA, 22 bp, Homo sapiens
aagcagcttaaattagagcctg

SEQ ID NO: 8072068 - DNA, 22 bp, Homo sapiens
acagcagaccccagtgccatgg

SEQ ID NO: 8072069 - DNA, 22 bp, Homo sapiens
acagcagagcaccagggccact

SEQ ID NO: 8072070 - DNA, 22 bp, Homo sapiens
aagcaatagcaacaactttaca

SEQ ID NO: 8072071 - DNA, 22 bp, Homo sapiens
aagcaatagggtaatctactca

SEQ ID NO: 8072072 - DNA, 22 bp, Homo sapiens
aagcaatatactgatatgatta

SEQ ID NO: 8072073 - DNA, 20 bp, Homo sapiens
aagcaatatagtgcaaatgt

SEQ ID NO: 8072074 - DNA, 22 bp, Homo sapiens
aaatttgtcaacttcatatgtt

SEQ ID NO: 8072075 - DNA, 20 bp, Homo sapiens
aacacactggtggcatcagg

SEQ ID NO: 8072076 - DNA, 20 bp, Homo sapiens
aacacactggtggcatcagg

SEQ ID NO: 8072077 - DNA, 23 bp, Homo sapiens
aacacaaagctgattccagtggc

SEQ ID NO: 8072078 - DNA, 22 bp, Homo sapiens
aacactttcttccttgctcagg

SEQ ID NO: 8072079 - DNA, 22 bp, Homo sapiens
aacagacaactcctgtggctca

SEQ ID NO: 8072080 - DNA, 22 bp, Homo sapiens
aacagacatatttttaatatgc

SEQ ID NO: 8072081 - DNA, 22 bp, Homo sapiens
aacagaactgttgttctggagg

SEQ ID NO: 8072082 - DNA, 22 bp, Homo sapiens
aacagaacccgagtgtgaatct

SEQ ID NO: 8072083 - DNA, 22 bp, Homo sapiens
aacagaaaaggtaggtggcttt

SEQ ID NO: 8072084 - DNA, 22 bp, Homo sapiens
aaatgcattctgttttcactag

SEQ ID NO: 8072085 - DNA, 22 bp, Homo sapiens
aaatgcatgtatgtaatatgct

SEQ ID NO: 8072086 - DNA, 22 bp, Homo sapiens
aaatgcatgtgctatagatgtg

SEQ ID NO: 8072087 - DNA, 22 bp, Homo sapiens
aaatgcattggtttctacttgt

SEQ ID NO: 8072088 - DNA, 22 bp, Homo sapiens
aaatgcatttcactaatgtttc

SEQ ID NO: 8072089 - DNA, 22 bp, Homo sapiens
aaatgtccttagagaaaagtca

SEQ ID NO: 8072090 - DNA, 22 bp, Homo sapiens
aaatgtcctgagattcaactta

SEQ ID NO: 8072091 - DNA, 22 bp, Homo sapiens
aaatgtccattgaatggatgag

SEQ ID NO: 8072092 - DNA, 22 bp, Homo sapiens
aaatgtcagaagctttacttct

SEQ ID NO: 8072093 - DNA, 22 bp, Homo sapiens
aaggcagatataaagactagag

SEQ ID NO: 8072094 - DNA, 22 bp, Homo sapiens
aaattattttcagaatggagaa

SEQ ID NO: 8072095 - DNA, 22 bp, Homo sapiens
aacatccccagcgtctcctagg

SEQ ID NO: 8072096 - DNA, 22 bp, Homo sapiens
aacatccccttcatgtcatgat

SEQ ID NO: 8072097 - DNA, 22 bp, Homo sapiens
aacagctgcaaaaggttgcctg

SEQ ID NO: 8072098 - DNA, 22 bp, Homo sapiens
aacatctttttgtttgctgaaa

SEQ ID NO: 8072099 - DNA, 22 bp, Homo sapiens
aacatgaaaagcccagagaggt

SEQ ID NO: 8072100 - DNA, 22 bp, Homo sapiens
aacatgaaaagcccagagaggt

SEQ ID NO: 8072101 - DNA, 22 bp, Homo sapiens
aatagaatttgtactgtgtttt

SEQ ID NO: 8072102 - DNA, 22 bp, Homo sapiens
aatagaatttgtactgtgtttt

SEQ ID NO: 8072103 - DNA, 22 bp, Homo sapiens
aatagatactacttagatgtag

SEQ ID NO: 8072104 - DNA, 22 bp, Homo sapiens
aatagactttctttttagaaca

SEQ ID NO: 8072105 - DNA, 22 bp, Homo sapiens
aacatgtaaccagcattcatct

SEQ ID NO: 8072106 - DNA, 22 bp, Homo sapiens
aacatgtctgggtattcacaag

SEQ ID NO: 8072107 - DNA, 22 bp, Homo sapiens
aacatgtatcgctttttaatat

SEQ ID NO: 8072108 - DNA, 22 bp, Homo sapiens
aatggcttagcagagttagaag

SEQ ID NO: 8072109 - DNA, 22 bp, Homo sapiens
aatggctttaagtagtctcaca

SEQ ID NO: 8072110 - DNA, 22 bp, Homo sapiens
aatgacatgctttttaattata

SEQ ID NO: 8072111 - DNA, 22 bp, Homo sapiens
aacctcaaactcttgggcttaa

SEQ ID NO: 8072112 - DNA, 22 bp, Homo sapiens
aaccctggggcagctgctaggg

SEQ ID NO: 8072113 - DNA, 22 bp, Homo sapiens
aatgaacaacactgaaggaaga

SEQ ID NO: 8072114 - DNA, 22 bp, Homo sapiens
aagagggctgcaatcttattgc

SEQ ID NO: 8072115 - DNA, 22 bp, Homo sapiens
aagagggaggtgcgggtgcaga

SEQ ID NO: 8072116 - DNA, 22 bp, Homo sapiens
aaatacgtgcacatacatacat

SEQ ID NO: 8072117 - DNA, 22 bp, Homo sapiens
aaatacattagacggagagtta

SEQ ID NO: 8072118 - DNA, 22 bp, Homo sapiens
aaatacatttacagtcgtggct

SEQ ID NO: 8072119 - DNA, 22 bp, Homo sapiens
aagaggggtgtgtgtcaaccca

SEQ ID NO: 8072120 - DNA, 22 bp, Homo sapiens
aagaggggtggtctgtgaggat

SEQ ID NO: 8072121 - DNA, 22 bp, Homo sapiens
aagacagagggaagcaatgatg

SEQ ID NO: 8072122 - DNA, 22 bp, Homo sapiens
aaagtgcacctgcttcttcttg

SEQ ID NO: 8072123 - DNA, 22 bp, Homo sapiens
aagacagatgcaacctgctagc

SEQ ID NO: 8072124 - DNA, 22 bp, Homo sapiens
aagactgatgtccagtcccatg

SEQ ID NO: 8072125 - DNA, 22 bp, Homo sapiens
aagactgaatttgcatagttgg

SEQ ID NO: 8072126 - DNA, 22 bp, Homo sapiens
aagcccagatgggagcatttca

SEQ ID NO: 8072127 - DNA, 22 bp, Homo sapiens
aagcaggcattccagagacaat

SEQ ID NO: 8072128 - DNA, 22 bp, Homo sapiens
aagcctcaccttttagaagcta

SEQ ID NO: 8072129 - DNA, 22 bp, Homo sapiens
aaatgcatgtagaataatagag

SEQ ID NO: 8072130 - DNA, 22 bp, Homo sapiens
aaatgcatggtaaatgattgcc

SEQ ID NO: 8072131 - DNA, 22 bp, Homo sapiens
aagcccttttcaagatacaaca

SEQ ID NO: 8072132 - DNA, 21 bp, Homo sapiens
aagcctcaagcagaagacaga

SEQ ID NO: 8072133 - DNA, 22 bp, Homo sapiens
aagcagcatatgacagcatcca

SEQ ID NO: 8072134 - DNA, 22 bp, Homo sapiens
aagatattttagaacattcact

SEQ ID NO: 8072135 - DNA, 22 bp, Homo sapiens
aagatcagctcccgagtctgag

SEQ ID NO: 8072136 - DNA, 14 bp, Homo sapiens
aagatcaccttcct

SEQ ID NO: 8072137 - DNA, 23 bp, Homo sapiens
aagatccattcaaattatgtatc

SEQ ID NO: 8072138 - DNA, 22 bp, Homo sapiens
aagatccatgggaatgtttggc

SEQ ID NO: 8072139 - DNA, 22 bp, Homo sapiens
aaagccattgaactgtacttta

SEQ ID NO: 8072140 - DNA, 22 bp, Homo sapiens
aaagcctcccaggttatgagta

SEQ ID NO: 8072141 - DNA, 22 bp, Homo sapiens
aacatagaataaatgagttagg

SEQ ID NO: 8072142 - DNA, 22 bp, Homo sapiens
aacagtgagttgatgactgaat

SEQ ID NO: 8072143 - DNA, 22 bp, Homo sapiens
aacataaatttgaagtggcaaa

SEQ ID NO: 8072144 - DNA, 22 bp, Homo sapiens
aaagcactgcacatatatttgc

SEQ ID NO: 8072145 - DNA, 23 bp, Homo sapiens
aacaccaaggctcagagagataa

SEQ ID NO: 8072146 - DNA, 22 bp, Homo sapiens
aagaacagttgggaggtgagcc

SEQ ID NO: 8072147 - DNA, 22 bp, Homo sapiens
aacccaggagacggagtttgtg

SEQ ID NO: 8072148 - DNA, 22 bp, Homo sapiens
aaaggcataggatgtggaatcg

SEQ ID NO: 8072149 - DNA, 22 bp, Homo sapiens
aaccccagtaccccaggatatg

SEQ ID NO: 8072150 - DNA, 22 bp, Homo sapiens
aaaatattttagggccaggaga

SEQ ID NO: 8072151 - DNA, 22 bp, Homo sapiens
aaacaggcttccattagagcaa

SEQ ID NO: 8072152 - DNA, 22 bp, Homo sapiens
aaacaggcgcttactaagaaaa

SEQ ID NO: 8072153 - DNA, 22 bp, Homo sapiens
aaacaggcatcactcagcaaag

SEQ ID NO: 8072154 - DNA, 22 bp, Homo sapiens
aaaatactgtggagtgttgaaa

SEQ ID NO: 8072155 - DNA, 20 bp, Homo sapiens
aaaatatgtataactcttct

SEQ ID NO: 8072156 - DNA, 21 bp, Homo sapiens
aaagagcccgctgagaggttc

SEQ ID NO: 8072157 - DNA, 22 bp, Homo sapiens
aaaattggttcctttctgaggc

SEQ ID NO: 8072158 - DNA, 22 bp, Homo sapiens
aaaattgagagttatagatggt

SEQ ID NO: 8072159 - DNA, 22 bp, Homo sapiens
aaacacatcattcatgtcgtca

SEQ ID NO: 8072160 - DNA, 22 bp, Homo sapiens
aaagagctgggacttaaagtgc

SEQ ID NO: 8072161 - DNA, 22 bp, Homo sapiens
aaagagctgatagcatctgttt

SEQ ID NO: 8072162 - DNA, 22 bp, Homo sapiens
aaagagctgagacctggtggag

SEQ ID NO: 8072163 - DNA, 22 bp, Homo sapiens
aaagagctcggaaagtgttgaa

SEQ ID NO: 8072164 - DNA, 22 bp, Homo sapiens
aaagagctcacagtccactgga

SEQ ID NO: 8072165 - DNA, 22 bp, Homo sapiens
aaacactagcaggaagcactga

SEQ ID NO: 8072166 - DNA, 22 bp, Homo sapiens
aaacaccagcactgtttacaaa

SEQ ID NO: 8072167 - DNA, 22 bp, Homo sapiens
aaacacattttaggaaaatcta

SEQ ID NO: 8072168 - DNA, 22 bp, Homo sapiens
aaaactcctgaaattgtttccc

SEQ ID NO: 8072169 - DNA, 22 bp, Homo sapiens
aaaacctgattgaattctattt

SEQ ID NO: 8072170 - DNA, 22 bp, Homo sapiens
aaaaccttcaggtttggagttt

SEQ ID NO: 8072171 - DNA, 18 bp, Homo sapiens
aaaaagtgctcaggccta

SEQ ID NO: 8072172 - DNA, 22 bp, Homo sapiens
aaaagggactactctcagctcc

SEQ ID NO: 8072173 - DNA, 22 bp, Homo sapiens
aaaagtaattgcaattttgtag

SEQ ID NO: 8072174 - DNA, 22 bp, Homo sapiens
aaaactgtatcttcttgggact

SEQ ID NO: 8072175 - DNA, 22 bp, Homo sapiens
aaacatgtaattctgcttaaga

SEQ ID NO: 8072176 - DNA, 22 bp, Homo sapiens
aaacattctcagccctgcttgc

SEQ ID NO: 8072177 - DNA, 22 bp, Homo sapiens
aaacattgagcacttgctattt

SEQ ID NO: 8072178 - DNA, 22 bp, Homo sapiens
aaacattgtaattttagcatgg

SEQ ID NO: 8072179 - DNA, 22 bp, Homo sapiens
aaacagctgtcattgttttaaa

SEQ ID NO: 8072180 - DNA, 22 bp, Homo sapiens
aaagaaacctatcagccacatg

SEQ ID NO: 8072181 - DNA, 22 bp, Homo sapiens
aaatagttcagcttgtaaaccc

SEQ ID NO: 8072182 - DNA, 22 bp, Homo sapiens
aaactgtgaagcaagtacaagg

SEQ ID NO: 8072183 - DNA, 22 bp, Homo sapiens
aaagaacaaattagctgtttta

SEQ ID NO: 8072184 - DNA, 22 bp, Homo sapiens
aaagaacaaatgatatatggtt

SEQ ID NO: 8072185 - DNA, 22 bp, Homo sapiens
aaagaacaatgtggaatctcct

SEQ ID NO: 8072186 - DNA, 22 bp, Homo sapiens
aaagaacagatgtgtggtgcat

SEQ ID NO: 8072187 - DNA, 22 bp, Homo sapiens
acacccaggaataaggactggg

SEQ ID NO: 8072188 - DNA, 22 bp, Homo sapiens
acacattatagagagtataata

SEQ ID NO: 8072189 - DNA, 22 bp, Homo sapiens
acacattataggcaatcaaaag

SEQ ID NO: 8072190 - DNA, 22 bp, Homo sapiens
acactcaccctcccactgcctg

SEQ ID NO: 8072191 - DNA, 22 bp, Homo sapiens
acactatacttccattgctggt

SEQ ID NO: 8072192 - DNA, 22 bp, Homo sapiens
acacagggaggaggtgctgtgc

SEQ ID NO: 8072193 - DNA, 22 bp, Homo sapiens
acacagggaggaggtgctgtgc

SEQ ID NO: 8072194 - DNA, 22 bp, Homo sapiens
acacagggatatttcaggtggt

SEQ ID NO: 8072195 - DNA, 17 bp, Homo sapiens
acacagggagagggagc

SEQ ID NO: 8072196 - DNA, 17 bp, Homo sapiens
acacagggagagggagc

SEQ ID NO: 8072197 - DNA, 22 bp, Homo sapiens
acacagggcaatgctttgacct

SEQ ID NO: 8072198 - DNA, 19 bp, Homo sapiens
acacagggatcagagggtt

SEQ ID NO: 8072199 - DNA, 22 bp, Homo sapiens
acacagggcagagagctggctc

SEQ ID NO: 8072200 - DNA, 22 bp, Homo sapiens
acacagggcggaaagcatgaga

SEQ ID NO: 8072201 - DNA, 22 bp, Homo sapiens
agcagagcaaagctcagaaatg

SEQ ID NO: 8072202 - DNA, 21 bp, Homo sapiens
agcagagccaccattacctgc

SEQ ID NO: 8072203 - DNA, 22 bp, Homo sapiens
agcagaaccacagcactgttga

SEQ ID NO: 8072204 - DNA, 22 bp, Homo sapiens
agcagatggagaatggagtcag

SEQ ID NO: 8072205 - DNA, 22 bp, Homo sapiens
agcagagccaggtctctctgta

SEQ ID NO: 8072206 - DNA, 18 bp, Homo sapiens
agcagagcccatgcattc

SEQ ID NO: 8072207 - DNA, 22 bp, Homo sapiens
acacagataatgctcatatagg

SEQ ID NO: 8072208 - DNA, 22 bp, Homo sapiens
acacagatattttgaatacata

SEQ ID NO: 8072209 - DNA, 22 bp, Homo sapiens
acacagatattgtacttgatcc

SEQ ID NO: 8072210 - DNA, 22 bp, Homo sapiens
acacagatgcattacacatcta

SEQ ID NO: 8072211 - DNA, 22 bp, Homo sapiens
agcagctggggcctgtgacgat

SEQ ID NO: 8072212 - DNA, 22 bp, Homo sapiens
acacagatgctatttagtctct

SEQ ID NO: 8072213 - DNA, 17 bp, Homo sapiens
agcagctgggttgatct

SEQ ID NO: 8072214 - DNA, 22 bp, Homo sapiens
acacagagtatcttttgcctag

SEQ ID NO: 8072215 - DNA, 22 bp, Homo sapiens
acacagaggtggccactctttt

SEQ ID NO: 8072216 - DNA, 22 bp, Homo sapiens
acacagaggcatgacagtggct

SEQ ID NO: 8072217 - DNA, 21 bp, Homo sapiens
acacagaggcatcatcacttt

SEQ ID NO: 8072218 - DNA, 22 bp, Homo sapiens
acacagaggaaagtgtgaaggg

SEQ ID NO: 8072219 - DNA, 20 bp, Homo sapiens
acacagagtgagtctgcttg

SEQ ID NO: 8072220 - DNA, 22 bp, Homo sapiens
acacagagtccttactgaggta

SEQ ID NO: 8072221 - DNA, 22 bp, Homo sapiens
acacagagttattatgtgaact

SEQ ID NO: 8072222 - DNA, 22 bp, Homo sapiens
acacagagtggtttgtagaata

SEQ ID NO: 8072223 - DNA, 22 bp, Homo sapiens
acacagagtttgacacatggga

SEQ ID NO: 8072224 - DNA, 22 bp, Homo sapiens
acagcacaatctgagtcccaga

SEQ ID NO: 8072225 - DNA, 22 bp, Homo sapiens
agctcccagaaggccctgcgcc

SEQ ID NO: 8072226 - DNA, 22 bp, Homo sapiens
acagattcactgcactggccat

SEQ ID NO: 8072227 - DNA, 22 bp, Homo sapiens
acagatggagctactaggtaaa

SEQ ID NO: 8072228 - DNA, 22 bp, Homo sapiens
acagagccaaaaggacatagta

SEQ ID NO: 8072229 - DNA, 21 bp, Homo sapiens
acagagccgggcacaaagctg

SEQ ID NO: 8072230 - DNA, 22 bp, Homo sapiens
acagagcctccaggagtgctgg

SEQ ID NO: 8072231 - DNA, 22 bp, Homo sapiens
acagagccactttggtgcctac

SEQ ID NO: 8072232 - DNA, 22 bp, Homo sapiens
agcctctctttctggtggctaa

SEQ ID NO: 8072233 - DNA, 22 bp, Homo sapiens
agcctctctttattcccagcta

SEQ ID NO: 8072234 - DNA, 22 bp, Homo sapiens
agcctctctgttagtcactggg

SEQ ID NO: 8072235 - DNA, 22 bp, Homo sapiens
agcctctctgatgtgacagcta

SEQ ID NO: 8072236 - DNA, 22 bp, Homo sapiens
agcctctctccagcttggcaga

SEQ ID NO: 8072237 - DNA, 22 bp, Homo sapiens
acagagctgggatctgaaccca

SEQ ID NO: 8072238 - DNA, 22 bp, Homo sapiens
acagagctaatgttgcataggc

SEQ ID NO: 8072239 - DNA, 22 bp, Homo sapiens
acagagctaaatttcaatccca

SEQ ID NO: 8072240 - DNA, 19 bp, Homo sapiens
acagagctctctgcttctg

SEQ ID NO: 8072241 - DNA, 22 bp, Homo sapiens
acagagctaatgttgcataggc

SEQ ID NO: 8072242 - DNA, 22 bp, Homo sapiens
acacttttaagactttaatgaa

SEQ ID NO: 8072243 - DNA, 22 bp, Homo sapiens
agccaggggattcatcagggac

SEQ ID NO: 8072244 - DNA, 22 bp, Homo sapiens
acagagaaagtgggctgaagat

SEQ ID NO: 8072245 - DNA, 19 bp, Homo sapiens
agccagggtccagacatgt

SEQ ID NO: 8072246 - DNA, 19 bp, Homo sapiens
agccagggtgagaaggagc

SEQ ID NO: 8072247 - DNA, 22 bp, Homo sapiens
agccagggtctctcgctctgtt

SEQ ID NO: 8072248 - DNA, 22 bp, Homo sapiens
acagagacttggagcaggctga

SEQ ID NO: 8072249 - DNA, 22 bp, Homo sapiens
acagagactgggatgcctgcct

SEQ ID NO: 8072250 - DNA, 22 bp, Homo sapiens
acagagactgggagcaagaggc

SEQ ID NO: 8072251 - DNA, 23 bp, Homo sapiens
acagagactgccaagatattctc

SEQ ID NO: 8072252 - DNA, 20 bp, Homo sapiens
acagagactgagacacttgc

SEQ ID NO: 8072253 - DNA, 22 bp, Homo sapiens
acagagacaaatgttagtagtt

SEQ ID NO: 8072254 - DNA, 22 bp, Homo sapiens
acagagacaatatttgtaaagt

SEQ ID NO: 8072255 - DNA, 22 bp, Homo sapiens
acagagacacggaagctaaaga

SEQ ID NO: 8072256 - DNA, 23 bp, Homo sapiens
acagagacaatggtttcatcttg

SEQ ID NO: 8072257 - DNA, 22 bp, Homo sapiens
acagagaccagcatcttctgcc

SEQ ID NO: 8072258 - DNA, 22 bp, Homo sapiens
acagagacaggcagacagtctt

SEQ ID NO: 8072259 - DNA, 22 bp, Homo sapiens
acagagacctggccttgctttg

SEQ ID NO: 8072260 - DNA, 22 bp, Homo sapiens
acagagaccagttacagcgtcc

SEQ ID NO: 8072261 - DNA, 22 bp, Homo sapiens
acagagactaagcttttcatca

SEQ ID NO: 8072262 - DNA, 22 bp, Homo sapiens
acagagactcatgaaagatgac

SEQ ID NO: 8072263 - DNA, 20 bp, Homo sapiens
agaggcttccttgggaggag

SEQ ID NO: 8072264 - DNA, 22 bp, Homo sapiens
acaaagaaggaattggtcttta

SEQ ID NO: 8072265 - DNA, 22 bp, Homo sapiens
acaaaggcagagaattcaacat

SEQ ID NO: 8072266 - DNA, 22 bp, Homo sapiens
acaaaggcagccaatcatctgc

SEQ ID NO: 8072267 - DNA, 19 bp, Homo sapiens
acaaagctgtgagcagctt

SEQ ID NO: 8072268 - DNA, 22 bp, Homo sapiens
acaaaggcaggattgacttagt

SEQ ID NO: 8072269 - DNA, 22 bp, Homo sapiens
acaaaggcatagtgaatgtttt

SEQ ID NO: 8072270 - DNA, 22 bp, Homo sapiens
acaaaggtggaccatgtggctt

SEQ ID NO: 8072271 - DNA, 22 bp, Homo sapiens
agaggctgaatgatgtcatcat

SEQ ID NO: 8072272 - DNA, 22 bp, Homo sapiens
agaggctgaatgatgtcatcat

SEQ ID NO: 8072273 - DNA, 22 bp, Homo sapiens
agaggccctctctctcctgatg

SEQ ID NO: 8072274 - DNA, 22 bp, Homo sapiens
aattgcttgtttctttaactga

SEQ ID NO: 8072275 - DNA, 22 bp, Homo sapiens
aattgcttatcttgttgaatag

SEQ ID NO: 8072276 - DNA, 22 bp, Homo sapiens
aattctgtgcaggcagagctat

SEQ ID NO: 8072277 - DNA, 19 bp, Homo sapiens
aattctgtttcagcagatc

SEQ ID NO: 8072278 - DNA, 22 bp, Homo sapiens
aattgatgggcactgaaatatt

SEQ ID NO: 8072279 - DNA, 22 bp, Homo sapiens
aattgagtgcagccagcccagt

SEQ ID NO: 8072280 - DNA, 22 bp, Homo sapiens
acaagcgggccacagtgctggt

SEQ ID NO: 8072281 - DNA, 22 bp, Homo sapiens
acaacagagctggactgagagg

SEQ ID NO: 8072282 - DNA, 22 bp, Homo sapiens
acaacaatctaccctagcttct

SEQ ID NO: 8072283 - DNA, 22 bp, Homo sapiens
acaagataaggtgtcagtgtgt

SEQ ID NO: 8072284 - DNA, 22 bp, Homo sapiens
acaagagacaagaggttcttct

SEQ ID NO: 8072285 - DNA, 23 bp, Homo sapiens
aatgggtgcaactatccatgaca

SEQ ID NO: 8072286 - DNA, 22 bp, Homo sapiens
aatgggctttggccagtaggag

SEQ ID NO: 8072287 - DNA, 22 bp, Homo sapiens
aatgggtttctgtcccagctct

SEQ ID NO: 8072288 - DNA, 22 bp, Homo sapiens
aatgggttgctttccacagcct

SEQ ID NO: 8072289 - DNA, 22 bp, Homo sapiens
aatgtgaactttgtcatgtaac

SEQ ID NO: 8072290 - DNA, 22 bp, Homo sapiens
aatgtgattagcctctactgga

SEQ ID NO: 8072291 - DNA, 22 bp, Homo sapiens
aatgggaggtagtatgggaggt

SEQ ID NO: 8072292 - DNA, 22 bp, Homo sapiens
aatggccagcaacaggagtgaa

SEQ ID NO: 8072293 - DNA, 22 bp, Homo sapiens
aatgggagagaacacaaagtcc

SEQ ID NO: 8072294 - DNA, 22 bp, Homo sapiens
aatgggaggattttctctcttg

SEQ ID NO: 8072295 - DNA, 20 bp, Homo sapiens
agacaaaatgacttcatgca

SEQ ID NO: 8072296 - DNA, 23 bp, Homo sapiens
agaagcagcttctggagtatcgg

SEQ ID NO: 8072297 - DNA, 23 bp, Homo sapiens
agacaaaagcctcagtcttaggc

SEQ ID NO: 8072298 - DNA, 22 bp, Homo sapiens
agagcctgcatcaggcttgggg

SEQ ID NO: 8072299 - DNA, 22 bp, Homo sapiens
agagcctgcatcaggcttgggg

SEQ ID NO: 8072300 - DNA, 22 bp, Homo sapiens
agagcctgctacctcattccag

SEQ ID NO: 8072301 - DNA, 20 bp, Homo sapiens
agagcctggaaaaagacatc

SEQ ID NO: 8072302 - DNA, 22 bp, Homo sapiens
agagcctggaggttctgctgaa

SEQ ID NO: 8072303 - DNA, 22 bp, Homo sapiens
agagcctggacttttctgagcc

SEQ ID NO: 8072304 - DNA, 22 bp, Homo sapiens
agagcctggacctgggctctga

SEQ ID NO: 8072305 - DNA, 22 bp, Homo sapiens
agagccaggtgtagtctcggag

SEQ ID NO: 8072306 - DNA, 22 bp, Homo sapiens
agagccaggtgctgctgtttga

SEQ ID NO: 8072307 - DNA, 22 bp, Homo sapiens
agagccaggcggctgggcacct

SEQ ID NO: 8072308 - DNA, 22 bp, Homo sapiens
agagacaggatatctgctcatg

SEQ ID NO: 8072309 - DNA, 22 bp, Homo sapiens
agagacaggagttctgtttcca

SEQ ID NO: 8072310 - DNA, 22 bp, Homo sapiens
agagacaggaatggcattaaga

SEQ ID NO: 8072311 - DNA, 22 bp, Homo sapiens
aattaaattggtttagagagga

SEQ ID NO: 8072312 - DNA, 22 bp, Homo sapiens
aattaaattggtttagagagga

SEQ ID NO: 8072313 - DNA, 17 bp, Homo sapiens
acagggcagaaacagct

SEQ ID NO: 8072314 - DNA, 22 bp, Homo sapiens
aagctcattaattagaagctaa

SEQ ID NO: 8072315 - DNA, 22 bp, Homo sapiens
aagctatgttcctgcactgctc

SEQ ID NO: 8072316 - DNA, 22 bp, Homo sapiens
aagctatgggggagtttcaacc

SEQ ID NO: 8072317 - DNA, 22 bp, Homo sapiens
acagggcagaaatgttgcatct

SEQ ID NO: 8072318 - DNA, 22 bp, Homo sapiens
acagggcagagaggcaggcttg

SEQ ID NO: 8072319 - DNA, 22 bp, Homo sapiens
acagggcagagtgaaatgctat

SEQ ID NO: 8072320 - DNA, 22 bp, Homo sapiens
acagggcagagggcagttggta

SEQ ID NO: 8072321 - DNA, 22 bp, Homo sapiens
aagctggaacatcttgaggaag

SEQ ID NO: 8072322 - DNA, 19 bp, Homo sapiens
acagggcagcaataggata

SEQ ID NO: 8072323 - DNA, 22 bp, Homo sapiens
aagcattttgccacttgaagtt

SEQ ID NO: 8072324 - DNA, 22 bp, Homo sapiens
aagcattttgttttaagaatga

SEQ ID NO: 8072325 - DNA, 22 bp, Homo sapiens
acagccttattgcgagcaaggc

SEQ ID NO: 8072326 - DNA, 22 bp, Homo sapiens
aagcattttagtaatgaacttg

SEQ ID NO: 8072327 - DNA, 22 bp, Homo sapiens
aagcattttagataaagcatca

SEQ ID NO: 8072328 - DNA, 22 bp, Homo sapiens
acagcctggactggctctctgc

SEQ ID NO: 8072329 - DNA, 22 bp, Homo sapiens
aagctatgagctaggcatctct

SEQ ID NO: 8072330 - DNA, 22 bp, Homo sapiens
aagctaagggtgtttaagcagg

SEQ ID NO: 8072331 - DNA, 22 bp, Homo sapiens
aagctaagtggaagtcttatca

SEQ ID NO: 8072332 - DNA, 22 bp, Homo sapiens
aagcatttttgaaatggtagga

SEQ ID NO: 8072333 - DNA, 22 bp, Homo sapiens
aagccaagagttaactatttgt

SEQ ID NO: 8072334 - DNA, 22 bp, Homo sapiens
aagccttcctgagtgcaaggcc

SEQ ID NO: 8072335 - DNA, 22 bp, Homo sapiens
aaggaggagcggaggcttgttg

SEQ ID NO: 8072336 - DNA, 22 bp, Homo sapiens
acatagaacctggcacatagta

SEQ ID NO: 8072337 - DNA, 22 bp, Homo sapiens
aaggaggaatttcagggtgaat

SEQ ID NO: 8072338 - DNA, 22 bp, Homo sapiens
aaggagagtacaggagttggta

SEQ ID NO: 8072339 - DNA, 22 bp, Homo sapiens
aaggagaggttgtccgtgttgt

SEQ ID NO: 8072340 - DNA, 21 bp, Homo sapiens
aaggagcctaggaggctcagg

SEQ ID NO: 8072341 - DNA, 22 bp, Homo sapiens
aagctggagagttaggtgaata

SEQ ID NO: 8072342 - DNA, 22 bp, Homo sapiens
aagctggactctgccatttact

SEQ ID NO: 8072343 - DNA, 22 bp, Homo sapiens
aaggagagagctttgctggaac

SEQ ID NO: 8072344 - DNA, 22 bp, Homo sapiens
acagtcttgagcatcagccaga

SEQ ID NO: 8072345 - DNA, 19 bp, Homo sapiens
accaggcttatggtcagtg

SEQ ID NO: 8072346 - DNA, 21 bp, Homo sapiens
accaggcttgtgggagggagc

SEQ ID NO: 8072347 - DNA, 22 bp, Homo sapiens
accctgccgtgggctgcttgtg

SEQ ID NO: 8072348 - DNA, 22 bp, Homo sapiens
accctgagtcagacagcctgac

SEQ ID NO: 8072349 - DNA, 22 bp, Homo sapiens
accctgagtcagacagcctgac

SEQ ID NO: 8072350 - DNA, 20 bp, Homo sapiens
accctgaggctccccagcct

SEQ ID NO: 8072351 - DNA, 22 bp, Homo sapiens
accctgagaaagtcacatgcat

SEQ ID NO: 8072352 - DNA, 22 bp, Homo sapiens
acccagagtcagacagccatgg

SEQ ID NO: 8072353 - DNA, 22 bp, Homo sapiens
acccagagtcagacagccatgg

SEQ ID NO: 8072354 - DNA, 22 bp, Homo sapiens
aaggctctctgatggcagcagt

SEQ ID NO: 8072355 - DNA, 22 bp, Homo sapiens
aaggctcggcaatgtgcggctc

SEQ ID NO: 8072356 - DNA, 21 bp, Homo sapiens
aaggcctgcttactgctagtt

SEQ ID NO: 8072357 - DNA, 22 bp, Homo sapiens
aaggcctgctcagctgtctgtg

SEQ ID NO: 8072358 - DNA, 22 bp, Homo sapiens
acatttaaatatgccttatatt

SEQ ID NO: 8072359 - DNA, 22 bp, Homo sapiens
aaggctggcaatatatttgtta

SEQ ID NO: 8072360 - DNA, 23 bp, Homo sapiens
actttattgaccccaggtcagtt

SEQ ID NO: 8072361 - DNA, 22 bp, Homo sapiens
actttgaaactaaaattcatta

SEQ ID NO: 8072362 - DNA, 22 bp, Homo sapiens
actttgaaggggaacattttaa

SEQ ID NO: 8072363 - DNA, 22 bp, Homo sapiens
aatcagaaagatcttgatgaga

SEQ ID NO: 8072364 - DNA, 19 bp, Homo sapiens
aatcagaaatatcgaggcc

SEQ ID NO: 8072365 - DNA, 22 bp, Homo sapiens
actttatttcctattgcatcca

SEQ ID NO: 8072366 - DNA, 22 bp, Homo sapiens
actgggctggggctcattctcc

SEQ ID NO: 8072367 - DNA, 22 bp, Homo sapiens
aatactagttattaaagctttt

SEQ ID NO: 8072368 - DNA, 22 bp, Homo sapiens
aatactatgtagccaaaataat

SEQ ID NO: 8072369 - DNA, 22 bp, Homo sapiens
actgggctgcctggttcttcta

SEQ ID NO: 8072370 - DNA, 21 bp, Homo sapiens
actgttcatttgatgaactgg

SEQ ID NO: 8072371 - DNA, 22 bp, Homo sapiens
actgttcatctcttagaaagta

SEQ ID NO: 8072372 - DNA, 21 bp, Homo sapiens
actgttcatctgttcagaagc

SEQ ID NO: 8072373 - DNA, 22 bp, Homo sapiens
actgttcatattcttagaaatt

SEQ ID NO: 8072374 - DNA, 22 bp, Homo sapiens
actgttcacccagcactagcag

SEQ ID NO: 8072375 - DNA, 22 bp, Homo sapiens
actgttcaagcaaatgacattg

SEQ ID NO: 8072376 - DNA, 22 bp, Homo sapiens
actgttcacagattagtcgatg

SEQ ID NO: 8072377 - DNA, 21 bp, Homo sapiens
aatcagaggcttcctagttgg

SEQ ID NO: 8072378 - DNA, 22 bp, Homo sapiens
aatcagagccctctgagcttca

SEQ ID NO: 8072379 - DNA, 22 bp, Homo sapiens
aatcagaatttattgaatcttt

SEQ ID NO: 8072380 - DNA, 22 bp, Homo sapiens
aatcagaaattgagggtctggt

SEQ ID NO: 8072381 - DNA, 22 bp, Homo sapiens
aatcagaacttctcagggtggg

SEQ ID NO: 8072382 - DNA, 22 bp, Homo sapiens
aatcagcaggcttctaaatttt

SEQ ID NO: 8072383 - DNA, 22 bp, Homo sapiens
aatcagcaaatgcttactcagg

SEQ ID NO: 8072384 - DNA, 22 bp, Homo sapiens
aatcaggcacagcgactgcagc

SEQ ID NO: 8072385 - DNA, 22 bp, Homo sapiens
agaaatgacacacatgagacat

SEQ ID NO: 8072386 - DNA, 22 bp, Homo sapiens
agaacaaaattagaggagtgca

SEQ ID NO: 8072387 - DNA, 22 bp, Homo sapiens
agaacaaaattagaggagtgca

SEQ ID NO: 8072388 - DNA, 22 bp, Homo sapiens
agaacaaatcgatggaagcctg

SEQ ID NO: 8072389 - DNA, 20 bp, Homo sapiens
agaacaagtactaaaggaga

SEQ ID NO: 8072390 - DNA, 22 bp, Homo sapiens
agaacaatgttaaattattaag

SEQ ID NO: 8072391 - DNA, 22 bp, Homo sapiens
aatgatgtgagtttttattctc

SEQ ID NO: 8072392 - DNA, 22 bp, Homo sapiens
actgcactccagcctgggtgac

SEQ ID NO: 8072393 - DNA, 20 bp, Homo sapiens
actggagccatctcagccta

SEQ ID NO: 8072394 - DNA, 22 bp, Homo sapiens
actggagcccgtggaggcgcag

SEQ ID NO: 8072395 - DNA, 20 bp, Homo sapiens
actggagccatctcagccta

SEQ ID NO: 8072396 - DNA, 22 bp, Homo sapiens
aataccatgcagaaataacata

SEQ ID NO: 8072397 - DNA, 22 bp, Homo sapiens
actctgcttattgctgcaggca

SEQ ID NO: 8072398 - DNA, 22 bp, Homo sapiens
actctcccttatctaactttac

SEQ ID NO: 8072399 - DNA, 22 bp, Homo sapiens
actgcactccaacctgggtgac

SEQ ID NO: 8072400 - DNA, 22 bp, Homo sapiens
actgcactccagcccgagcaac

SEQ ID NO: 8072401 - DNA, 22 bp, Homo sapiens
actataacctgttagaatagat

SEQ ID NO: 8072402 - DNA, 22 bp, Homo sapiens
actcagaagatataatgactca

SEQ ID NO: 8072403 - DNA, 22 bp, Homo sapiens
actcactgcactttgaaatgtg

SEQ ID NO: 8072404 - DNA, 23 bp, Homo sapiens
actcagagaccccgggaagtgac

SEQ ID NO: 8072405 - DNA, 22 bp, Homo sapiens
actctccctgctatccacttcc

SEQ ID NO: 8072406 - DNA, 22 bp, Homo sapiens
actctccctgagagggaggcat

SEQ ID NO: 8072407 - DNA, 22 bp, Homo sapiens
actctcccacgttcgactctaa

SEQ ID NO: 8072408 - DNA, 22 bp, Homo sapiens
actctcccagctatatgtggtg

SEQ ID NO: 8072409 - DNA, 22 bp, Homo sapiens
actctcagagggtggcagcaat

SEQ ID NO: 8072410 - DNA, 22 bp, Homo sapiens
acggtgctgggtattggggttc

SEQ ID NO: 8072411 - DNA, 22 bp, Homo sapiens
aagtctctcatggctgacagca

SEQ ID NO: 8072412 - DNA, 22 bp, Homo sapiens
aagtctaaacacatatttaaaa

SEQ ID NO: 8072413 - DNA, 22 bp, Homo sapiens
aagtcctttccagtcctgtgat

SEQ ID NO: 8072414 - DNA, 20 bp, Homo sapiens
acgtggccaccagtggctta

SEQ ID NO: 8072415 - DNA, 20 bp, Homo sapiens
acgtggccaccagtggctta

SEQ ID NO: 8072416 - DNA, 22 bp, Homo sapiens
gtggcagcagaggggtggtatg

SEQ ID NO: 8072417 - DNA, 22 bp, Homo sapiens
gtggcagcggcccaggccgtct

SEQ ID NO: 8072418 - DNA, 22 bp, Homo sapiens
gtggcagcaaaatcctgcattc

SEQ ID NO: 8072419 - DNA, 22 bp, Homo sapiens
gtggcagaggttcctcagtgtg

SEQ ID NO: 8072420 - DNA, 22 bp, Homo sapiens
gtggatggattttgaggaatgg

SEQ ID NO: 8072421 - DNA, 22 bp, Homo sapiens
gtggatggattgaggcagtggg

SEQ ID NO: 8072422 - DNA, 22 bp, Homo sapiens
gtggagacctcctaggatgtgt

SEQ ID NO: 8072423 - DNA, 22 bp, Homo sapiens
gtggagacgggacagaagctaa

SEQ ID NO: 8072424 - DNA, 22 bp, Homo sapiens
gtggagacttctactagagacc

SEQ ID NO: 8072425 - DNA, 22 bp, Homo sapiens
gtggagagagataagcctggtc

SEQ ID NO: 8072426 - DNA, 22 bp, Homo sapiens
gtggaggacaaaagaagccttt

SEQ ID NO: 8072427 - DNA, 22 bp, Homo sapiens
gtggagccctggtagggacccc

SEQ ID NO: 8072428 - DNA, 22 bp, Homo sapiens
gtggaggagaggcgccttgcgg

SEQ ID NO: 8072429 - DNA, 22 bp, Homo sapiens
gtggatggacatgggcaagagg

SEQ ID NO: 8072430 - DNA, 22 bp, Homo sapiens
gtggatgcttaggcagcctggg

SEQ ID NO: 8072431 - DNA, 22 bp, Homo sapiens
gtgcctgcagcaatccatggca

SEQ ID NO: 8072432 - DNA, 22 bp, Homo sapiens
gtgcctgccccactcctcagca

SEQ ID NO: 8072433 - DNA, 22 bp, Homo sapiens
gtgcctgctgcagagtcgctgt

SEQ ID NO: 8072434 - DNA, 20 bp, Homo sapiens
gtgaccagaagacagtgggt

SEQ ID NO: 8072435 - DNA, 22 bp, Homo sapiens
gtgcgccagctcaaggggaggc

SEQ ID NO: 8072436 - DNA, 22 bp, Homo sapiens
gtggaaaagaaagtcttccttg

SEQ ID NO: 8072437 - DNA, 22 bp, Homo sapiens
gtggctctaggtgagcatggag

SEQ ID NO: 8072438 - DNA, 22 bp, Homo sapiens
gtggcctggggtttgttctgag

SEQ ID NO: 8072439 - DNA, 22 bp, Homo sapiens
gtggcctggcgagctggcgcgg

SEQ ID NO: 8072440 - DNA, 22 bp, Homo sapiens
gtggcctggatgagcttcgaca

SEQ ID NO: 8072441 - DNA, 22 bp, Homo sapiens
gtggcctggatagactccatct

SEQ ID NO: 8072442 - DNA, 22 bp, Homo sapiens
gtggctctcgccagcctgcggg

SEQ ID NO: 8072443 - DNA, 22 bp, Homo sapiens
gtggctctccattgacatggaa

SEQ ID NO: 8072444 - DNA, 21 bp, Homo sapiens
gtggctctgccaggactgaaa

SEQ ID NO: 8072445 - DNA, 22 bp, Homo sapiens
gtggctcttgcatggggtctct

SEQ ID NO: 8072446 - DNA, 22 bp, Homo sapiens
gtggcctgccagcagatggcgc

SEQ ID NO: 8072447 - DNA, 21 bp, Homo sapiens
gtggcctgattatgaatgggt

SEQ ID NO: 8072448 - DNA, 22 bp, Homo sapiens
gtggcctgatgccagccctgtg

SEQ ID NO: 8072449 - DNA, 22 bp, Homo sapiens
gtggcctgccgtgtggtatggg

SEQ ID NO: 8072450 - DNA, 19 bp, Homo sapiens
gtggcctgcgctgggtgcg

SEQ ID NO: 8072451 - DNA, 22 bp, Homo sapiens
gtggcctggaaaggctggtctg

SEQ ID NO: 8072452 - DNA, 22 bp, Homo sapiens
gtggcctggagtttgatgtagg

SEQ ID NO: 8072453 - DNA, 22 bp, Homo sapiens
gtggcctcatgtctataaagag

SEQ ID NO: 8072454 - DNA, 22 bp, Homo sapiens
gtggcctctgttggctcctagg

SEQ ID NO: 8072455 - DNA, 22 bp, Homo sapiens
gtggctgggctccgagcggctt

SEQ ID NO: 8072456 - DNA, 22 bp, Homo sapiens
gtggctgggctccgagcggctt

SEQ ID NO: 8072457 - DNA, 22 bp, Homo sapiens
gtggcttcacatggcatttggc

SEQ ID NO: 8072458 - DNA, 22 bp, Homo sapiens
gtggctggtttcctgcatgcaa

SEQ ID NO: 8072459 - DNA, 22 bp, Homo sapiens
gtggctggtttcctgcatgcaa

SEQ ID NO: 8072460 - DNA, 22 bp, Homo sapiens
gtggctgctacagagctggagg

SEQ ID NO: 8072461 - DNA, 22 bp, Homo sapiens
gtggctgctaagtctccttcct

SEQ ID NO: 8072462 - DNA, 22 bp, Homo sapiens
gtggctgctgtcctctctggtt

SEQ ID NO: 8072463 - DNA, 22 bp, Homo sapiens
gtggctgctcgggctccggccc

SEQ ID NO: 8072464 - DNA, 22 bp, Homo sapiens
gtggctgcagcccagcggcacg

SEQ ID NO: 8072465 - DNA, 22 bp, Homo sapiens
gtggctgcagagggcacagcat

SEQ ID NO: 8072466 - DNA, 22 bp, Homo sapiens
gtggctgcagcggctgtggaga

SEQ ID NO: 8072467 - DNA, 22 bp, Homo sapiens
gtgggatggtaggtaggtaata

SEQ ID NO: 8072468 - DNA, 22 bp, Homo sapiens
gtgggatgcagtggtgagtggc

SEQ ID NO: 8072469 - DNA, 22 bp, Homo sapiens
gtgggagctttggcatcaggct

SEQ ID NO: 8072470 - DNA, 18 bp, Homo sapiens
gtggccagcctggtcttg

SEQ ID NO: 8072471 - DNA, 22 bp, Homo sapiens
gtggcccaggcttggcgctggc

SEQ ID NO: 8072472 - DNA, 22 bp, Homo sapiens
gtggcagctggtatgcagacag

SEQ ID NO: 8072473 - DNA, 22 bp, Homo sapiens
gtggcatggagaaggaggcagt

SEQ ID NO: 8072474 - DNA, 22 bp, Homo sapiens
gtaaataactggtaattggggt

SEQ ID NO: 8072475 - DNA, 21 bp, Homo sapiens
ggtgtcctgagggataggtag

SEQ ID NO: 8072476 - DNA, 22 bp, Homo sapiens
ggtgtcctcggattcagggcag

SEQ ID NO: 8072477 - DNA, 22 bp, Homo sapiens
gtaaaatagaataacgtggcta

SEQ ID NO: 8072478 - DNA, 22 bp, Homo sapiens
gtacataagaaattactacaga

SEQ ID NO: 8072479 - DNA, 22 bp, Homo sapiens
gtatacatgtggtaaaatgcac

SEQ ID NO: 8072480 - DNA, 22 bp, Homo sapiens
gtatactcatgtctcagaggac

SEQ ID NO: 8072481 - DNA, 22 bp, Homo sapiens
gtatactcaacctgcctagaat

SEQ ID NO: 8072482 - DNA, 22 bp, Homo sapiens
gggtggggttcaggaatcttca

SEQ ID NO: 8072483 - DNA, 22 bp, Homo sapiens
gggtggggttcaggaatcttca

SEQ ID NO: 8072484 - DNA, 22 bp, Homo sapiens
gggtggggtgtatcggatccta

SEQ ID NO: 8072485 - DNA, 22 bp, Homo sapiens
gggtggggtgtatcggatccta

SEQ ID NO: 8072486 - DNA, 22 bp, Homo sapiens
gggtggggcccaggaaatctat

SEQ ID NO: 8072487 - DNA, 22 bp, Homo sapiens
gggtggggcccaggaaatctat

SEQ ID NO: 8072488 - DNA, 22 bp, Homo sapiens
gggtggggccaggcaatttgca

SEQ ID NO: 8072489 - DNA, 22 bp, Homo sapiens
ggtgaggggagagtgaaagaaa

SEQ ID NO: 8072490 - DNA, 22 bp, Homo sapiens
ggtgattctgtgaggggctgac

SEQ ID NO: 8072491 - DNA, 22 bp, Homo sapiens
ggtgtcagatacataggaagta

SEQ ID NO: 8072492 - DNA, 21 bp, Homo sapiens
ggtgtcagttttggtcattag

SEQ ID NO: 8072493 - DNA, 17 bp, Homo sapiens
ggtgtatggggagggaa

SEQ ID NO: 8072494 - DNA, 22 bp, Homo sapiens
ggtgtagctctgtgtcccactg

SEQ ID NO: 8072495 - DNA, 22 bp, Homo sapiens
ggtggccaggccagctctggcc

SEQ ID NO: 8072496 - DNA, 22 bp, Homo sapiens
ggtggccaggccagctctggcc

SEQ ID NO: 8072497 - DNA, 22 bp, Homo sapiens
ggtggcatctcagttcatgggc

SEQ ID NO: 8072498 - DNA, 22 bp, Homo sapiens
ggtggcattcagaagagctggc

SEQ ID NO: 8072499 - DNA, 22 bp, Homo sapiens
gtctggggaagtcagggcatca

SEQ ID NO: 8072500 - DNA, 17 bp, Homo sapiens
gtctgggctttagagac

SEQ ID NO: 8072501 - DNA, 22 bp, Homo sapiens
gtctgagaaagaattctgggga

SEQ ID NO: 8072502 - DNA, 22 bp, Homo sapiens
gtctgagaactactgaggataa

SEQ ID NO: 8072503 - DNA, 22 bp, Homo sapiens
gtctgagacccactcccagaga

SEQ ID NO: 8072504 - DNA, 22 bp, Homo sapiens
gtctgagactgggcacatacct

SEQ ID NO: 8072505 - DNA, 22 bp, Homo sapiens
gtctgagaatcttgcatatcat

SEQ ID NO: 8072506 - DNA, 22 bp, Homo sapiens
gtctgagaggagccaagtattg

SEQ ID NO: 8072507 - DNA, 22 bp, Homo sapiens
gtctgagaggaggcagcctcgg

SEQ ID NO: 8072508 - DNA, 21 bp, Homo sapiens
gtccttcagcaagttagtggc

SEQ ID NO: 8072509 - DNA, 22 bp, Homo sapiens
gtccttcagcacctccctcggc

SEQ ID NO: 8072510 - DNA, 22 bp, Homo sapiens
gtccttcaaggtccttggtgtg

SEQ ID NO: 8072511 - DNA, 22 bp, Homo sapiens
gtccttcaagtaacctgggacc

SEQ ID NO: 8072512 - DNA, 22 bp, Homo sapiens
gtccttcatctggagcctggtc

SEQ ID NO: 8072513 - DNA, 22 bp, Homo sapiens
gtccttcatggagttacagcct

SEQ ID NO: 8072514 - DNA, 22 bp, Homo sapiens
gtccttcagggagtcaaacact

SEQ ID NO: 8072515 - DNA, 22 bp, Homo sapiens
gtccttcatatcatggattata

SEQ ID NO: 8072516 - DNA, 22 bp, Homo sapiens
gtccttcagctttatctgaaca

SEQ ID NO: 8072517 - DNA, 21 bp, Homo sapiens
gtccttcattatcaagtcaaa

SEQ ID NO: 8072518 - DNA, 22 bp, Homo sapiens
gtccttcatttcctgatctcta

SEQ ID NO: 8072519 - DNA, 22 bp, Homo sapiens
gtcccagggatgcagacatgag

SEQ ID NO: 8072520 - DNA, 22 bp, Homo sapiens
gtcccaggtgggctccacctct

SEQ ID NO: 8072521 - DNA, 22 bp, Homo sapiens
gtccttcaaaggcacgcagtta

SEQ ID NO: 8072522 - DNA, 22 bp, Homo sapiens
gtccttatttcacttaaacgta

SEQ ID NO: 8072523 - DNA, 22 bp, Homo sapiens
gtccttcaagagtcccctactg

SEQ ID NO: 8072524 - DNA, 22 bp, Homo sapiens
gtcccacaccttgaggggtctt

SEQ ID NO: 8072525 - DNA, 22 bp, Homo sapiens
gtccagggctaaatcaggttcc

SEQ ID NO: 8072526 - DNA, 22 bp, Homo sapiens
gtccagggaaatagcgacaggg

SEQ ID NO: 8072527 - DNA, 22 bp, Homo sapiens
gtcagaggggcagctgccaggc

SEQ ID NO: 8072528 - DNA, 22 bp, Homo sapiens
gtggggggacgttggtcacttt

SEQ ID NO: 8072529 - DNA, 22 bp, Homo sapiens
gtgggtgatgtactggaggcca

SEQ ID NO: 8072530 - DNA, 22 bp, Homo sapiens
gtgggtggagactgggtgcaag

SEQ ID NO: 8072531 - DNA, 22 bp, Homo sapiens
gtgggtggaggcgtcgagggca

SEQ ID NO: 8072532 - DNA, 22 bp, Homo sapiens
gtggtgcaggccagcaggggcg

SEQ ID NO: 8072533 - DNA, 22 bp, Homo sapiens
gtggtgtttttggggcagagga

SEQ ID NO: 8072534 - DNA, 22 bp, Homo sapiens
gtggtgttcccacgcctgctag

SEQ ID NO: 8072535 - DNA, 22 bp, Homo sapiens
gtggtgtttgagctgccaggga

SEQ ID NO: 8072536 - DNA, 22 bp, Homo sapiens
gtggtgtttgccagttaataac

SEQ ID NO: 8072537 - DNA, 22 bp, Homo sapiens
gtgggggcaggcagtgctagga

SEQ ID NO: 8072538 - DNA, 22 bp, Homo sapiens
gtggggaggcctaagcaagttg

SEQ ID NO: 8072539 - DNA, 22 bp, Homo sapiens
gtggggaggcattcttctccct

SEQ ID NO: 8072540 - DNA, 22 bp, Homo sapiens
gtgggctggaccctcctgctcc

SEQ ID NO: 8072541 - DNA, 22 bp, Homo sapiens
gtgggcttctgttagggaggct

SEQ ID NO: 8072542 - DNA, 22 bp, Homo sapiens
gtgtgcagaagacacaagacat

SEQ ID NO: 8072543 - DNA, 22 bp, Homo sapiens
gtgtgcagtagagaaagagcag

SEQ ID NO: 8072544 - DNA, 22 bp, Homo sapiens
gtgtgcagtgagcaaaagatct

SEQ ID NO: 8072545 - DNA, 22 bp, Homo sapiens
gtgtggtgaggccccttaggct

SEQ ID NO: 8072546 - DNA, 22 bp, Homo sapiens
gtgtggtggccctccttcaggc

SEQ ID NO: 8072547 - DNA, 22 bp, Homo sapiens
gtgtccttatgcataccagagt

SEQ ID NO: 8072548 - DNA, 22 bp, Homo sapiens
gtgtcctgggggacttcaggtt

SEQ ID NO: 8072549 - DNA, 22 bp, Homo sapiens
gtgtcccaggcctctggaatta

SEQ ID NO: 8072550 - DNA, 22 bp, Homo sapiens
gtgtcctgccaccctgggcttt

SEQ ID NO: 8072551 - DNA, 18 bp, Homo sapiens
gtgtcctggctgcggcgc

SEQ ID NO: 8072552 - DNA, 22 bp, Homo sapiens
gtgtcctgcattggctctgccc

SEQ ID NO: 8072553 - DNA, 22 bp, Homo sapiens
gtgtcactggaatactgtctgt

SEQ ID NO: 8072554 - DNA, 21 bp, Homo sapiens
gttcaaatgggtagattcaca

SEQ ID NO: 8072555 - DNA, 21 bp, Homo sapiens
gttcaaatcctgacactacac

SEQ ID NO: 8072556 - DNA, 22 bp, Homo sapiens
gttcaaatctcaggacttcaga

SEQ ID NO: 8072557 - DNA, 22 bp, Homo sapiens
gttcaagaccagcctggccaac

SEQ ID NO: 8072558 - DNA, 22 bp, Homo sapiens
gttctgagtcctcctttgaagg

SEQ ID NO: 8072559 - DNA, 22 bp, Homo sapiens
gttctgctcctgtggcaatcta

SEQ ID NO: 8072560 - DNA, 22 bp, Homo sapiens
gttctgcagggatccagctggg

SEQ ID NO: 8072561 - DNA, 22 bp, Homo sapiens
gttctgacttctctgcatctgc

SEQ ID NO: 8072562 - DNA, 22 bp, Homo sapiens
gttctcagtggggagcagggtt

SEQ ID NO: 8072563 - DNA, 22 bp, Homo sapiens
gtttttctagactgggagtttg

SEQ ID NO: 8072564 - DNA, 20 bp, Homo sapiens
gtttttctctcttgccacta

SEQ ID NO: 8072565 - DNA, 22 bp, Homo sapiens
gtttttctgtgagcggtaaagg

SEQ ID NO: 8072566 - DNA, 22 bp, Homo sapiens
gtttttctctgaaatagttgac

SEQ ID NO: 8072567 - DNA, 22 bp, Homo sapiens
gttttttcatgagtagttatct

SEQ ID NO: 8072568 - DNA, 22 bp, Homo sapiens
gtttaataatgttgaattacta

SEQ ID NO: 8072569 - DNA, 22 bp, Homo sapiens
taaaggctcactggcttggggt

SEQ ID NO: 8072570 - DNA, 22 bp, Homo sapiens
taaaggcttttacaggagtgca

SEQ ID NO: 8072571 - DNA, 22 bp, Homo sapiens
taaaggctcgtattgttgtgtg

SEQ ID NO: 8072572 - DNA, 22 bp, Homo sapiens
taaaggcttctgcagggactga

SEQ ID NO: 8072573 - DNA, 22 bp, Homo sapiens
taaaactagtggttgggactaa

SEQ ID NO: 8072574 - DNA, 22 bp, Homo sapiens
taaagctatgcttaatttatca

SEQ ID NO: 8072575 - DNA, 22 bp, Homo sapiens
taaagctattgctgtttattgt

SEQ ID NO: 8072576 - DNA, 22 bp, Homo sapiens
taaagctattatagttatgttt

SEQ ID NO: 8072577 - DNA, 21 bp, Homo sapiens
taaagctagaaccttagcttt

SEQ ID NO: 8072578 - DNA, 22 bp, Homo sapiens
taaatgagggctgacatgattg

SEQ ID NO: 8072579 - DNA, 22 bp, Homo sapiens
taaatgataataatgctagtgt

SEQ ID NO: 8072580 - DNA, 22 bp, Homo sapiens
taaatgacattcttaagtcttg

SEQ ID NO: 8072581 - DNA, 22 bp, Homo sapiens
taaatgacaacacctgcttttg

SEQ ID NO: 8072582 - DNA, 22 bp, Homo sapiens
taaatgaagaaatggagattgt

SEQ ID NO: 8072583 - DNA, 18 bp, Homo sapiens
taaatctctctttagtca

SEQ ID NO: 8072584 - DNA, 21 bp, Homo sapiens
taaatctctgtattcttcagt

SEQ ID NO: 8072585 - DNA, 22 bp, Homo sapiens
taaatcttgtggcaatgcttct

SEQ ID NO: 8072586 - DNA, 22 bp, Homo sapiens
taaatcagtagatatggtatag

SEQ ID NO: 8072587 - DNA, 22 bp, Homo sapiens
taaatcagtttctcttattggt

SEQ ID NO: 8072588 - DNA, 22 bp, Homo sapiens
taaatcagtaaggcatattctc

SEQ ID NO: 8072589 - DNA, 22 bp, Homo sapiens
taaatcagggagtcatctgcga

SEQ ID NO: 8072590 - DNA, 22 bp, Homo sapiens
taacagaatagcagaaacagaa

SEQ ID NO: 8072591 - DNA, 22 bp, Homo sapiens
taacagaatcctgttattgcca

SEQ ID NO: 8072592 - DNA, 22 bp, Homo sapiens
taacagaatttgctaaactccg

SEQ ID NO: 8072593 - DNA, 22 bp, Homo sapiens
ggagaggcttggcccagcctgg

SEQ ID NO: 8072594 - DNA, 22 bp, Homo sapiens
ggagaggcttggcccagcctgg

SEQ ID NO: 8072595 - DNA, 22 bp, Homo sapiens
ggagagggggctccctgcttgg

SEQ ID NO: 8072596 - DNA, 22 bp, Homo sapiens
ggagaggtgaatggctgctcta

SEQ ID NO: 8072597 - DNA, 22 bp, Homo sapiens
ggagagggtaggggtcctgccc

SEQ ID NO: 8072598 - DNA, 22 bp, Homo sapiens
ggagctattactgtaacgaaca

SEQ ID NO: 8072599 - DNA, 22 bp, Homo sapiens
ggagccttccagactgcccaca

SEQ ID NO: 8072600 - DNA, 22 bp, Homo sapiens
ggagcctgttagttgagtgctc

SEQ ID NO: 8072601 - DNA, 22 bp, Homo sapiens
ggagccttgggcgctctcccat

SEQ ID NO: 8072602 - DNA, 22 bp, Homo sapiens
ggaatacaaatctttgttctct

SEQ ID NO: 8072603 - DNA, 22 bp, Homo sapiens
ggaagtgtttgtgcagatggcc

SEQ ID NO: 8072604 - DNA, 22 bp, Homo sapiens
ggagaaggcacacccacctctg

SEQ ID NO: 8072605 - DNA, 22 bp, Homo sapiens
ggagaaggaagaaagctactat

SEQ ID NO: 8072606 - DNA, 22 bp, Homo sapiens
ggagaaggaagaaagctactat

SEQ ID NO: 8072607 - DNA, 22 bp, Homo sapiens
ggagacacgggtgctgaggacc

SEQ ID NO: 8072608 - DNA, 22 bp, Homo sapiens
ggagacacagagcaacaaaata

SEQ ID NO: 8072609 - DNA, 22 bp, Homo sapiens
ggagacacatatacagaaagag

SEQ ID NO: 8072610 - DNA, 22 bp, Homo sapiens
ggagacacccacattgctgggt

SEQ ID NO: 8072611 - DNA, 22 bp, Homo sapiens
ggaggccaccatggagtcactt

SEQ ID NO: 8072612 - DNA, 22 bp, Homo sapiens
ggaggccaaggcgggcggatca

SEQ ID NO: 8072613 - DNA, 22 bp, Homo sapiens
ggaggccaaggtgggcggatca

SEQ ID NO: 8072614 - DNA, 22 bp, Homo sapiens
ggaggccaagtcactgacctgg

SEQ ID NO: 8072615 - DNA, 22 bp, Homo sapiens
ggaggccacggtttagcaccga

SEQ ID NO: 8072616 - DNA, 22 bp, Homo sapiens
ggaggccacctgacctgctgtt

SEQ ID NO: 8072617 - DNA, 22 bp, Homo sapiens
ggaggccacggtttagcaccga

SEQ ID NO: 8072618 - DNA, 22 bp, Homo sapiens
ggaggccagtcctggccgggct

SEQ ID NO: 8072619 - DNA, 22 bp, Homo sapiens
ggaggccatagtttgggagtca

SEQ ID NO: 8072620 - DNA, 22 bp, Homo sapiens
ggaggccatcagggagggcatt

SEQ ID NO: 8072621 - DNA, 22 bp, Homo sapiens
ggaggccatctggctggaggct

SEQ ID NO: 8072622 - DNA, 22 bp, Homo sapiens
ggaggccatgaggctctaggtg

SEQ ID NO: 8072623 - DNA, 22 bp, Homo sapiens
ggaggccaggaaggctcggaga

SEQ ID NO: 8072624 - DNA, 22 bp, Homo sapiens
ggaggccagcctgaggctgagg

SEQ ID NO: 8072625 - DNA, 22 bp, Homo sapiens
ggaggccagggacccagtcagc

SEQ ID NO: 8072626 - DNA, 22 bp, Homo sapiens
ggaggccagggtgggtggatcg

SEQ ID NO: 8072627 - DNA, 22 bp, Homo sapiens
ggaggaccccagcagctcccca

SEQ ID NO: 8072628 - DNA, 22 bp, Homo sapiens
ggaggacctgctggccctgcaa

SEQ ID NO: 8072629 - DNA, 22 bp, Homo sapiens
ggaggacaggggctgcagcaca

SEQ ID NO: 8072630 - DNA, 22 bp, Homo sapiens
ggaggaagccctcggtgcccca

SEQ ID NO: 8072631 - DNA, 22 bp, Homo sapiens
ggaggaagaggttgttctctca

SEQ ID NO: 8072632 - DNA, 22 bp, Homo sapiens
ggaggaagcacacggcttgtat

SEQ ID NO: 8072633 - DNA, 22 bp, Homo sapiens
ggaggaagcacacggcttgtat

SEQ ID NO: 8072634 - DNA, 22 bp, Homo sapiens
gcttcatttctctctgtagacc

SEQ ID NO: 8072635 - DNA, 22 bp, Homo sapiens
gcttcatttctctctgtagacc

SEQ ID NO: 8072636 - DNA, 22 bp, Homo sapiens
gcttcctggagggagagagctg

SEQ ID NO: 8072637 - DNA, 22 bp, Homo sapiens
gcttcattactgacagtctgtg

SEQ ID NO: 8072638 - DNA, 22 bp, Homo sapiens
gcttcagcccatcccagtacat

SEQ ID NO: 8072639 - DNA, 20 bp, Homo sapiens
gcttcagaacctgggtgctg

SEQ ID NO: 8072640 - DNA, 22 bp, Homo sapiens
gcttcagaaatgaacactgtct

SEQ ID NO: 8072641 - DNA, 22 bp, Homo sapiens
gcttcctgtaggcaggtccaag

SEQ ID NO: 8072642 - DNA, 17 bp, Homo sapiens
gcttcctgtgctgggga

SEQ ID NO: 8072643 - DNA, 22 bp, Homo sapiens
gcttccttctaccacatcatgc

SEQ ID NO: 8072644 - DNA, 22 bp, Homo sapiens
gcttccttccttacattggtgg

SEQ ID NO: 8072645 - DNA, 22 bp, Homo sapiens
gcttcggggtccaagcgcgtgt

SEQ ID NO: 8072646 - DNA, 22 bp, Homo sapiens
gcttaattctggctcagtttcc

SEQ ID NO: 8072647 - DNA, 22 bp, Homo sapiens
ggaaggtcgagctgcatctggc

SEQ ID NO: 8072648 - DNA, 22 bp, Homo sapiens
ggaagggcaaaagagatgaact

SEQ ID NO: 8072649 - DNA, 22 bp, Homo sapiens
ggaagaaagtagaaaaccgtgg

SEQ ID NO: 8072650 - DNA, 22 bp, Homo sapiens
ggaagaaaggtggacaacaggt

SEQ ID NO: 8072651 - DNA, 22 bp, Homo sapiens
gcttctggaggagctgggctga

SEQ ID NO: 8072652 - DNA, 22 bp, Homo sapiens
ggaaagaggatagtgggtaggt

SEQ ID NO: 8072653 - DNA, 22 bp, Homo sapiens
ggaaagagctaaaagggtgaga

SEQ ID NO: 8072654 - DNA, 22 bp, Homo sapiens
ggaaagacctgagataggaata

SEQ ID NO: 8072655 - DNA, 22 bp, Homo sapiens
ggaaagagcccagcagtgcttg

SEQ ID NO: 8072656 - DNA, 23 bp, Homo sapiens
ggaaagagaggagttgtgcatag

SEQ ID NO: 8072657 - DNA, 22 bp, Homo sapiens
ggcaggtgaggcatgtgcctgg

SEQ ID NO: 8072658 - DNA, 22 bp, Homo sapiens
ggcaggctggctttgttccagg

SEQ ID NO: 8072659 - DNA, 22 bp, Homo sapiens
ggcagctggggcagtgccctgt

SEQ ID NO: 8072660 - DNA, 22 bp, Homo sapiens
ggcagctgggttggccagaaac

SEQ ID NO: 8072661 - DNA, 22 bp, Homo sapiens
ggcagctgtgaagtgcctcaca

SEQ ID NO: 8072662 - DNA, 22 bp, Homo sapiens
ggcagctgtaagatgagtgaat

SEQ ID NO: 8072663 - DNA, 22 bp, Homo sapiens
ggcagaggaagctggaagtggg

SEQ ID NO: 8072664 - DNA, 22 bp, Homo sapiens
ggcagctgcacgttgtcccgtc

SEQ ID NO: 8072665 - DNA, 22 bp, Homo sapiens
ggcagacaatctgtctgttagg

SEQ ID NO: 8072666 - DNA, 22 bp, Homo sapiens
ggcagacacaaaaacataaggt

SEQ ID NO: 8072667 - DNA, 22 bp, Homo sapiens
ggcagacactcaaaagctggga

SEQ ID NO: 8072668 - DNA, 22 bp, Homo sapiens
ggcagacacctttatgtctaat

SEQ ID NO: 8072669 - DNA, 19 bp, Homo sapiens
ggcagacacagttgacatg

SEQ ID NO: 8072670 - DNA, 22 bp, Homo sapiens
ggcagagactgggttggcagag

SEQ ID NO: 8072671 - DNA, 23 bp, Homo sapiens
ggcagagagcatggctggggccc

SEQ ID NO: 8072672 - DNA, 22 bp, Homo sapiens
ggcagagcttgttccttctgtt

SEQ ID NO: 8072673 - DNA, 22 bp, Homo sapiens
ggagtgtgggatggagctcagg

SEQ ID NO: 8072674 - DNA, 22 bp, Homo sapiens
ggagttcactgtgcaggctctg

SEQ ID NO: 8072675 - DNA, 22 bp, Homo sapiens
ggcaaggccttgcccagcattc

SEQ ID NO: 8072676 - DNA, 22 bp, Homo sapiens
ggagtggcctctcctgtgcagg

SEQ ID NO: 8072677 - DNA, 22 bp, Homo sapiens
ggagtggccacgactgggagat

SEQ ID NO: 8072678 - DNA, 22 bp, Homo sapiens
ggagtggcagcgaggatcagat

SEQ ID NO: 8072679 - DNA, 22 bp, Homo sapiens
ggagtggcagctaggctgtcag

SEQ ID NO: 8072680 - DNA, 22 bp, Homo sapiens
ggagtggcactctgaggcgggg

SEQ ID NO: 8072681 - DNA, 22 bp, Homo sapiens
ggagtgggcagcactgccctgt

SEQ ID NO: 8072682 - DNA, 22 bp, Homo sapiens
ggagtgggaacaatgacatggt

SEQ ID NO: 8072683 - DNA, 22 bp, Homo sapiens
ggagggttagcaaaggcacaga

SEQ ID NO: 8072684 - DNA, 22 bp, Homo sapiens
ggaggtggaggttgcagtgagc

SEQ ID NO: 8072685 - DNA, 22 bp, Homo sapiens
ggaggtggtggcagtgacaatt

SEQ ID NO: 8072686 - DNA, 22 bp, Homo sapiens
ggaggtgggagacataggcggc

SEQ ID NO: 8072687 - DNA, 22 bp, Homo sapiens
ggaggggtgagaatggctgcct

SEQ ID NO: 8072688 - DNA, 22 bp, Homo sapiens
ggaggcccagagaggtgaagtg

SEQ ID NO: 8072689 - DNA, 22 bp, Homo sapiens
ggaggctgctgcctcacgtggg

SEQ ID NO: 8072690 - DNA, 22 bp, Homo sapiens
ggaggctcccacgcagctcaca

SEQ ID NO: 8072691 - DNA, 22 bp, Homo sapiens
ggagggcatcaatcaggcctgg

SEQ ID NO: 8072692 - DNA, 21 bp, Homo sapiens
ggagggcagcccagactggct

SEQ ID NO: 8072693 - DNA, 22 bp, Homo sapiens
gggctaggcttggccagcactg

SEQ ID NO: 8072694 - DNA, 22 bp, Homo sapiens
gggctctgtccattccttcata

SEQ ID NO: 8072695 - DNA, 22 bp, Homo sapiens
gggctgcttttaagggtctcag

SEQ ID NO: 8072696 - DNA, 22 bp, Homo sapiens
gggctgcttcctggggaatgct

SEQ ID NO: 8072697 - DNA, 22 bp, Homo sapiens
gggctgcttatactgatgataa

SEQ ID NO: 8072698 - DNA, 21 bp, Homo sapiens
gggctggacatggtggctcat

SEQ ID NO: 8072699 - DNA, 22 bp, Homo sapiens
gggctgcttttttcttagcaga

SEQ ID NO: 8072700 - DNA, 22 bp, Homo sapiens
ggggacagttaaagaccaagac

SEQ ID NO: 8072701 - DNA, 22 bp, Homo sapiens
gggctggcatcagttgccgaga

SEQ ID NO: 8072702 - DNA, 22 bp, Homo sapiens
ggggggtgctgatcagtggagc

SEQ ID NO: 8072703 - DNA, 22 bp, Homo sapiens
gggggtcccaagctgggctgct

SEQ ID NO: 8072704 - DNA, 22 bp, Homo sapiens
ggggactgaggcactgaaggtg

SEQ ID NO: 8072705 - DNA, 22 bp, Homo sapiens
ggggactgccttccacagacac

SEQ ID NO: 8072706 - DNA, 22 bp, Homo sapiens
ggggaccctcaggactgcgtct

SEQ ID NO: 8072707 - DNA, 22 bp, Homo sapiens
ggggacgcagaaagagtggcag

SEQ ID NO: 8072708 - DNA, 22 bp, Homo sapiens
gggggctgaggctgttctgagg

SEQ ID NO: 8072709 - DNA, 22 bp, Homo sapiens
gggggctggactttcccacaca

SEQ ID NO: 8072710 - DNA, 22 bp, Homo sapiens
gggggctggaatatccatcaac

SEQ ID NO: 8072711 - DNA, 22 bp, Homo sapiens
gggggctggaatatccatcaac

SEQ ID NO: 8072712 - DNA, 22 bp, Homo sapiens
gggggcttggcccggtctggtt

SEQ ID NO: 8072713 - DNA, 22 bp, Homo sapiens
gggggctgtcctgtgcattgta

SEQ ID NO: 8072714 - DNA, 22 bp, Homo sapiens
gggggctgtcctgtgcattgta

SEQ ID NO: 8072715 - DNA, 23 bp, Homo sapiens
gggggctggttgactctctgcag

SEQ ID NO: 8072716 - DNA, 23 bp, Homo sapiens
gggggctggttgactctctgcag

SEQ ID NO: 8072717 - DNA, 22 bp, Homo sapiens
gggggctggactttcccacaca

SEQ ID NO: 8072718 - DNA, 22 bp, Homo sapiens
gggtgaggagctgccagtcatg

SEQ ID NO: 8072719 - DNA, 20 bp, Homo sapiens
gggtgagatgtaggagaggg

SEQ ID NO: 8072720 - DNA, 22 bp, Homo sapiens
gggtgggaacaggatgccagga

SEQ ID NO: 8072721 - DNA, 22 bp, Homo sapiens
gggtgggcctgtctggccatgt

SEQ ID NO: 8072722 - DNA, 22 bp, Homo sapiens
gggtgacattaggaagatagac

SEQ ID NO: 8072723 - DNA, 22 bp, Homo sapiens
gggtgacatttcccaatgagcc

SEQ ID NO: 8072724 - DNA, 22 bp, Homo sapiens
gggtgaataggggaaggctatt

SEQ ID NO: 8072725 - DNA, 21 bp, Homo sapiens
gggatctgaggcaagtctcct

SEQ ID NO: 8072726 - DNA, 22 bp, Homo sapiens
gggagggaaggtacctgtgtga

SEQ ID NO: 8072727 - DNA, 22 bp, Homo sapiens
gggagggaaggaggcgccgtgt

SEQ ID NO: 8072728 - DNA, 22 bp, Homo sapiens
gggagggaaggaccttatgaat

SEQ ID NO: 8072729 - DNA, 22 bp, Homo sapiens
gggaggctggctctggccacag

SEQ ID NO: 8072730 - DNA, 22 bp, Homo sapiens
gggagggaaagcttgatctgtc

SEQ ID NO: 8072731 - DNA, 22 bp, Homo sapiens
gggatggggagctggaaagggg

SEQ ID NO: 8072732 - DNA, 22 bp, Homo sapiens
gggcagaggggcgcttccctct

SEQ ID NO: 8072733 - DNA, 19 bp, Homo sapiens
gggatgggccctcaccctc

SEQ ID NO: 8072734 - DNA, 22 bp, Homo sapiens
gggatggctttgtggctgactc

SEQ ID NO: 8072735 - DNA, 22 bp, Homo sapiens
gggatggacttggggactccag

SEQ ID NO: 8072736 - DNA, 22 bp, Homo sapiens
gggaccaggtgggtgcattccg

SEQ ID NO: 8072737 - DNA, 22 bp, Homo sapiens
gggcagcctcggtgcctgctgc

SEQ ID NO: 8072738 - DNA, 20 bp, Homo sapiens
gggcagcctcgggagtgggt

SEQ ID NO: 8072739 - DNA, 22 bp, Homo sapiens
gggcagctctcacagcagccaa

SEQ ID NO: 8072740 - DNA, 22 bp, Homo sapiens
gggcagctcctgtggaatccac

SEQ ID NO: 8072741 - DNA, 22 bp, Homo sapiens
gggccacattgaagggtgggta

SEQ ID NO: 8072742 - DNA, 22 bp, Homo sapiens
gggcagcagaattggacagaaa

SEQ ID NO: 8072743 - DNA, 22 bp, Homo sapiens
gggcagcacgtttcaggaggat

SEQ ID NO: 8072744 - DNA, 22 bp, Homo sapiens
gggcagcactcatacctatatt

SEQ ID NO: 8072745 - DNA, 18 bp, Homo sapiens
gggcagcacagcagcctc

SEQ ID NO: 8072746 - DNA, 22 bp, Homo sapiens
gggcagatggggcacaggctga

SEQ ID NO: 8072747 - DNA, 22 bp, Homo sapiens
gggcagaggttcaacttcaaca

SEQ ID NO: 8072748 - DNA, 22 bp, Homo sapiens
gggcgtggatggtcagtgcagg

SEQ ID NO: 8072749 - DNA, 22 bp, Homo sapiens
gggctacagacatgctctaagc

SEQ ID NO: 8072750 - DNA, 22 bp, Homo sapiens
gggctacattgtgagagaagtt

SEQ ID NO: 8072751 - DNA, 22 bp, Homo sapiens
gggctaaatgcagaaatgcaga

SEQ ID NO: 8072752 - DNA, 22 bp, Homo sapiens
gggcctggtgcttctgactcct

SEQ ID NO: 8072753 - DNA, 22 bp, Homo sapiens
gggcccagcgtggttccatctg

SEQ ID NO: 8072754 - DNA, 22 bp, Homo sapiens
gggcctgtatgggtctcagata

SEQ ID NO: 8072755 - DNA, 22 bp, Homo sapiens
gggcccactggctgtctgaccc

SEQ ID NO: 8072756 - DNA, 22 bp, Homo sapiens
gggccatgagaggttcatcaac

SEQ ID NO: 8072757 - DNA, 22 bp, Homo sapiens
gggccatgagaggttcatcaac

SEQ ID NO: 8072758 - DNA, 22 bp, Homo sapiens
ggcaggtgctgggagcatctca

SEQ ID NO: 8072759 - DNA, 22 bp, Homo sapiens
ggcaggtgctctgtgggcctgg

SEQ ID NO: 8072760 - DNA, 22 bp, Homo sapiens
ggccacctgggatctcatcctg

SEQ ID NO: 8072761 - DNA, 20 bp, Homo sapiens
ggccacctgcttcagacccc

SEQ ID NO: 8072762 - DNA, 22 bp, Homo sapiens
ggccaccttccagttgcctgca

SEQ ID NO: 8072763 - DNA, 22 bp, Homo sapiens
ggccagaggccatcctcctgct

SEQ ID NO: 8072764 - DNA, 22 bp, Homo sapiens
ggccagaggccacagctgtgtc

SEQ ID NO: 8072765 - DNA, 22 bp, Homo sapiens
ggccagagaatatgccttacgt

SEQ ID NO: 8072766 - DNA, 22 bp, Homo sapiens
ggccagagagccgctgttagga

SEQ ID NO: 8072767 - DNA, 22 bp, Homo sapiens
ggccatggtcatgggtgagctt

SEQ ID NO: 8072768 - DNA, 22 bp, Homo sapiens
ggcccacttgaaatggagctca

SEQ ID NO: 8072769 - DNA, 22 bp, Homo sapiens
ggccccagcagaccctcctctg

SEQ ID NO: 8072770 - DNA, 22 bp, Homo sapiens
ggccccagattctgggctgggt

SEQ ID NO: 8072771 - DNA, 22 bp, Homo sapiens
ggccccaggtctgaacacgctg

SEQ ID NO: 8072772 - DNA, 22 bp, Homo sapiens
ggccccagttcactcctggccg

SEQ ID NO: 8072773 - DNA, 22 bp, Homo sapiens
ggcccctgcggactgcctagag

SEQ ID NO: 8072774 - DNA, 19 bp, Homo sapiens
ggcccctctcacaggagtt

SEQ ID NO: 8072775 - DNA, 22 bp, Homo sapiens
ggccctccctgagccaggtggg

SEQ ID NO: 8072776 - DNA, 22 bp, Homo sapiens
ggcccctggcaccaggctgatt

SEQ ID NO: 8072777 - DNA, 22 bp, Homo sapiens
ggccctgagctgaagtactgtg

SEQ ID NO: 8072778 - DNA, 22 bp, Homo sapiens
ggcctgggcccactgtcaagag

SEQ ID NO: 8072779 - DNA, 22 bp, Homo sapiens
ggcctgggcctttgtgttttga

SEQ ID NO: 8072780 - DNA, 22 bp, Homo sapiens
ggccttcacgtgacctggcgtg

SEQ ID NO: 8072781 - DNA, 21 bp, Homo sapiens
ggctcctgctttgtgaggggc

SEQ ID NO: 8072782 - DNA, 18 bp, Homo sapiens
gggaagaggatctggccc

SEQ ID NO: 8072783 - DNA, 22 bp, Homo sapiens
gggaacagcatatctgaagggt

SEQ ID NO: 8072784 - DNA, 22 bp, Homo sapiens
ggcttccctttccgagaggaga

SEQ ID NO: 8072785 - DNA, 22 bp, Homo sapiens
ggcttcctggggcctcctgcaa

SEQ ID NO: 8072786 - DNA, 22 bp, Homo sapiens
ggcttcctggagaaggtctgag

SEQ ID NO: 8072787 - DNA, 22 bp, Homo sapiens
ggcttctccaggtactgagcat

SEQ ID NO: 8072788 - DNA, 22 bp, Homo sapiens
ggctggcttgccaagctcaggg

SEQ ID NO: 8072789 - DNA, 22 bp, Homo sapiens
ggctggctcttaccgacagcgt

SEQ ID NO: 8072790 - DNA, 22 bp, Homo sapiens
ggcttcagtgagctgagctcac

SEQ ID NO: 8072791 - DNA, 22 bp, Homo sapiens
ggcttcatggaggaggtgagtc

SEQ ID NO: 8072792 - DNA, 22 bp, Homo sapiens
ggcttcagtgactggtgccctc

SEQ ID NO: 8072793 - DNA, 22 bp, Homo sapiens
ggcttccaaggtcctctccacc

SEQ ID NO: 8072794 - DNA, 22 bp, Homo sapiens
ggcttccagctgggccttggag

SEQ ID NO: 8072795 - DNA, 22 bp, Homo sapiens
ggcttcccagcagagggcgcac

SEQ ID NO: 8072796 - DNA, 22 bp, Homo sapiens
ggcttcccaaggagccaggatg

SEQ ID NO: 8072797 - DNA, 22 bp, Homo sapiens
ggctgctcggagcctcctgtga

SEQ ID NO: 8072798 - DNA, 22 bp, Homo sapiens
ggctgctctgccttccagctgg

SEQ ID NO: 8072799 - DNA, 23 bp, Homo sapiens
ggctgctcttttcatgctgtttc

SEQ ID NO: 8072800 - DNA, 23 bp, Homo sapiens
ggctggcccggggctgctcctga

SEQ ID NO: 8072801 - DNA, 22 bp, Homo sapiens
ggctgcctgggagccctcctct

SEQ ID NO: 8072802 - DNA, 22 bp, Homo sapiens
ggctgcctgtgcccaggcacac

SEQ ID NO: 8072803 - DNA, 22 bp, Homo sapiens
ggctgccttcagactccagctt

SEQ ID NO: 8072804 - DNA, 18 bp, Homo sapiens
ggctgcctgttcctgaag

SEQ ID NO: 8072805 - DNA, 22 bp, Homo sapiens
ggctgcagaggcccccagtggg

SEQ ID NO: 8072806 - DNA, 22 bp, Homo sapiens
ggctgagttgagaggattactt

SEQ ID NO: 8072807 - DNA, 19 bp, Homo sapiens
ggctctcccttgagagagc

SEQ ID NO: 8072808 - DNA, 19 bp, Homo sapiens
ggctctcccttgagagagc

SEQ ID NO: 8072809 - DNA, 22 bp, Homo sapiens
ggctcctgggatgggactgagc

SEQ ID NO: 8072810 - DNA, 22 bp, Homo sapiens
ggctcctggcatctggtgggta

SEQ ID NO: 8072811 - DNA, 23 bp, Homo sapiens
ggctcctggattcaaatcctgcc

SEQ ID NO: 8072812 - DNA, 22 bp, Homo sapiens
ggctcctggaggcaccactggt

SEQ ID NO: 8072813 - DNA, 22 bp, Homo sapiens
ggctcctggaggcaccactggt

SEQ ID NO: 8072814 - DNA, 22 bp, Homo sapiens
ggctcctggggaggtgagcttg

SEQ ID NO: 8072815 - DNA, 22 bp, Homo sapiens
gagctggaagtctgtggtcaga

SEQ ID NO: 8072816 - DNA, 22 bp, Homo sapiens
gagctggccgcagagagggcag

SEQ ID NO: 8072817 - DNA, 22 bp, Homo sapiens
gagctggcaggaggctccccga

SEQ ID NO: 8072818 - DNA, 22 bp, Homo sapiens
gagctgggacatgggtcctctc

SEQ ID NO: 8072819 - DNA, 22 bp, Homo sapiens
gagctggcctcaggcacaggag

SEQ ID NO: 8072820 - DNA, 22 bp, Homo sapiens
gagctggctaatactgacttat

SEQ ID NO: 8072821 - DNA, 23 bp, Homo sapiens
gagctgggatacaggcttactgc

SEQ ID NO: 8072822 - DNA, 22 bp, Homo sapiens
gaggaagagagctctgccttgt

SEQ ID NO: 8072823 - DNA, 22 bp, Homo sapiens
gaggaagggctgcctgccgggc

SEQ ID NO: 8072824 - DNA, 22 bp, Homo sapiens
gaggacacctcacagcctcaca

SEQ ID NO: 8072825 - DNA, 22 bp, Homo sapiens
gaggcagctgaaggagtgacag

SEQ ID NO: 8072826 - DNA, 22 bp, Homo sapiens
gaggcagctgggctggtggttt

SEQ ID NO: 8072827 - DNA, 22 bp, Homo sapiens
gaggcccagcattcagggcagg

SEQ ID NO: 8072828 - DNA, 20 bp, Homo sapiens
gaggcctcagcctcagctcc

SEQ ID NO: 8072829 - DNA, 22 bp, Homo sapiens
gaggcagagtgcaccccaggag

SEQ ID NO: 8072830 - DNA, 22 bp, Homo sapiens
gaggcagagtcacaaagagtct

SEQ ID NO: 8072831 - DNA, 22 bp, Homo sapiens
gaggcagaggttgcagtgagct

SEQ ID NO: 8072832 - DNA, 22 bp, Homo sapiens
gaggaggctggcgccgcctgcc

SEQ ID NO: 8072833 - DNA, 22 bp, Homo sapiens
gaggagggagctggaagctctt

SEQ ID NO: 8072834 - DNA, 16 bp, Homo sapiens
gagggcagaggcggaa

SEQ ID NO: 8072835 - DNA, 22 bp, Homo sapiens
gagggcagagacagtgattcac

SEQ ID NO: 8072836 - DNA, 22 bp, Homo sapiens
gaggctgggaagtccaagacca

SEQ ID NO: 8072837 - DNA, 22 bp, Homo sapiens
gaggctgggaagtccaagacca

SEQ ID NO: 8072838 - DNA, 22 bp, Homo sapiens
gaggcctgctttggcactctgg

SEQ ID NO: 8072839 - DNA, 22 bp, Homo sapiens
gaggctggaggtcaaagatgaa

SEQ ID NO: 8072840 - DNA, 22 bp, Homo sapiens
gaggctggcagaaaagcacagg

SEQ ID NO: 8072841 - DNA, 22 bp, Homo sapiens
gaggctggcagaaaagcacagg

SEQ ID NO: 8072842 - DNA, 22 bp, Homo sapiens
gagggcagtgaattttgaagct

SEQ ID NO: 8072843 - DNA, 22 bp, Homo sapiens
gagggcagtagcctcgtaccct

SEQ ID NO: 8072844 - DNA, 20 bp, Homo sapiens
gagggcaggcacccatttca

SEQ ID NO: 8072845 - DNA, 22 bp, Homo sapiens
gagggcaggggtcttgcacggt

SEQ ID NO: 8072846 - DNA, 22 bp, Homo sapiens
gagggcagagtctaatgatgca

SEQ ID NO: 8072847 - DNA, 19 bp, Homo sapiens
gaggtgggtccccgcagcc

SEQ ID NO: 8072848 - DNA, 22 bp, Homo sapiens
gaggtgggtgtatcacaggtca

SEQ ID NO: 8072849 - DNA, 20 bp, Homo sapiens
gagtcacagaagaagctgaa

SEQ ID NO: 8072850 - DNA, 22 bp, Homo sapiens
gagtccagttgttcacagaggc

SEQ ID NO: 8072851 - DNA, 22 bp, Homo sapiens
gagtccagttgttcacagaggc

SEQ ID NO: 8072852 - DNA, 22 bp, Homo sapiens
gagtccagacaccatacctgat

SEQ ID NO: 8072853 - DNA, 22 bp, Homo sapiens
gaggtcaggcttgcagcagggt

SEQ ID NO: 8072854 - DNA, 22 bp, Homo sapiens
gaggtcaggggagaggctgatg

SEQ ID NO: 8072855 - DNA, 22 bp, Homo sapiens
gaggtcagtcagaccagggttt

SEQ ID NO: 8072856 - DNA, 22 bp, Homo sapiens
gaggtccactgaggcaacaggg

SEQ ID NO: 8072857 - DNA, 22 bp, Homo sapiens
gaggtgggcggatcacaaggtc

SEQ ID NO: 8072858 - DNA, 22 bp, Homo sapiens
gaggtgggatgtgtgtgctact

SEQ ID NO: 8072859 - DNA, 22 bp, Homo sapiens
gaggggctcttgggcatgaagg

SEQ ID NO: 8072860 - DNA, 22 bp, Homo sapiens
gaggtatcttagagagtgtaga

SEQ ID NO: 8072861 - DNA, 22 bp, Homo sapiens
gagtcgagcagaaagccgtcgg

SEQ ID NO: 8072862 - DNA, 22 bp, Homo sapiens
gagtccttttcatagcagtggg

SEQ ID NO: 8072863 - DNA, 22 bp, Homo sapiens
gagtccttccagcaggcattta

SEQ ID NO: 8072864 - DNA, 22 bp, Homo sapiens
gagtcctttgttccttgccaca

SEQ ID NO: 8072865 - DNA, 22 bp, Homo sapiens
gagtccttggcatcatcagtac

SEQ ID NO: 8072866 - DNA, 22 bp, Homo sapiens
gagtgagggcagcaggggctgc

SEQ ID NO: 8072867 - DNA, 22 bp, Homo sapiens
gagtgctgctaatgcaagggtg

SEQ ID NO: 8072868 - DNA, 20 bp, Homo sapiens
gagtgctttggcttgctctc

SEQ ID NO: 8072869 - DNA, 20 bp, Homo sapiens
gagtgctttggcttgctctc

SEQ ID NO: 8072870 - DNA, 22 bp, Homo sapiens
gagtggcagaactgggggtcct

SEQ ID NO: 8072871 - DNA, 22 bp, Homo sapiens
gagtggggtctgggcatcagtc

SEQ ID NO: 8072872 - DNA, 22 bp, Homo sapiens
gagtggggtctgggcatcagtc

SEQ ID NO: 8072873 - DNA, 22 bp, Homo sapiens
gagtgtatggaaggaagagatt

SEQ ID NO: 8072874 - DNA, 21 bp, Homo sapiens
gagtgtctaatccaggctgtc

SEQ ID NO: 8072875 - DNA, 22 bp, Homo sapiens
gagtgtgggcacgggggccttg

SEQ ID NO: 8072876 - DNA, 22 bp, Homo sapiens
gagttctggtcagcagggcagc

SEQ ID NO: 8072877 - DNA, 22 bp, Homo sapiens
gagtgtgtcggtcagcgtggcg

SEQ ID NO: 8072878 - DNA, 22 bp, Homo sapiens
gagtgttcccacaccccagttg

SEQ ID NO: 8072879 - DNA, 22 bp, Homo sapiens
gataaaattcttattttacccg

SEQ ID NO: 8072880 - DNA, 22 bp, Homo sapiens
gataaaataactatggaatact

SEQ ID NO: 8072881 - DNA, 22 bp, Homo sapiens
gataaaataactatggaatact

SEQ ID NO: 8072882 - DNA, 22 bp, Homo sapiens
gataaaatatgtggcctttagt

SEQ ID NO: 8072883 - DNA, 22 bp, Homo sapiens
gataaaatatgtggcctttagt

SEQ ID NO: 8072884 - DNA, 22 bp, Homo sapiens
gataaaattcttattttacccg

SEQ ID NO: 8072885 - DNA, 22 bp, Homo sapiens
gagtttgatagagaggaaccgg

SEQ ID NO: 8072886 - DNA, 22 bp, Homo sapiens
gagttgttcaacgtgtgtgaaa

SEQ ID NO: 8072887 - DNA, 22 bp, Homo sapiens
gatatttacattaagcacattg

SEQ ID NO: 8072888 - DNA, 19 bp, Homo sapiens
gatcagagtgtcagcttgt

SEQ ID NO: 8072889 - DNA, 22 bp, Homo sapiens
gatagaaagaatatagattcca

SEQ ID NO: 8072890 - DNA, 22 bp, Homo sapiens
gatagtcacctcccttaacttt

SEQ ID NO: 8072891 - DNA, 22 bp, Homo sapiens
gatacacaagtggaaggagacg

SEQ ID NO: 8072892 - DNA, 20 bp, Homo sapiens
gatacacagcacagagggcc

SEQ ID NO: 8072893 - DNA, 22 bp, Homo sapiens
gatacacacccttgataggact

SEQ ID NO: 8072894 - DNA, 22 bp, Homo sapiens
gataacattttgaagtgctagt

SEQ ID NO: 8072895 - DNA, 22 bp, Homo sapiens
gatgcacagtgaccctgccagt

SEQ ID NO: 8072896 - DNA, 22 bp, Homo sapiens
gatgcagggctggcaggagctt

SEQ ID NO: 8072897 - DNA, 22 bp, Homo sapiens
gatgacttatgtttacaaatgt

SEQ ID NO: 8072898 - DNA, 22 bp, Homo sapiens
gatgagctgtgattaataagta

SEQ ID NO: 8072899 - DNA, 22 bp, Homo sapiens
gatgaaaaaagacgagcatata

SEQ ID NO: 8072900 - DNA, 22 bp, Homo sapiens
gatcttttcagaatttatcagt

SEQ ID NO: 8072901 - DNA, 22 bp, Homo sapiens
gatcttttcagtcttggtagtt

SEQ ID NO: 8072902 - DNA, 22 bp, Homo sapiens
gatcttttcaggtttctctagt

SEQ ID NO: 8072903 - DNA, 22 bp, Homo sapiens
gatgaaattgttttgatacttt

SEQ ID NO: 8072904 - DNA, 22 bp, Homo sapiens
gaaaggtgccccataggcagga

SEQ ID NO: 8072905 - DNA, 18 bp, Homo sapiens
gaaaatactctgggctca

SEQ ID NO: 8072906 - DNA, 19 bp, Homo sapiens
gaaaggctgctgctacctg

SEQ ID NO: 8072907 - DNA, 22 bp, Homo sapiens
cttttaatgggagcagtatttg

SEQ ID NO: 8072908 - DNA, 22 bp, Homo sapiens
ctttgttatctgtaaatggtta

SEQ ID NO: 8072909 - DNA, 22 bp, Homo sapiens
ctttgttaggggctcagggtgg

SEQ ID NO: 8072910 - DNA, 22 bp, Homo sapiens
gaaaagctaggccagttcagct

SEQ ID NO: 8072911 - DNA, 22 bp, Homo sapiens
gaaaagggcaagagagagggca

SEQ ID NO: 8072912 - DNA, 22 bp, Homo sapiens
gaacagaagaggctggtgccac

SEQ ID NO: 8072913 - DNA, 22 bp, Homo sapiens
gaacagaattaccgaagatctg

SEQ ID NO: 8072914 - DNA, 22 bp, Homo sapiens
gaaataatttagaaggtattcc

SEQ ID NO: 8072915 - DNA, 22 bp, Homo sapiens
ctggctgggagctcgcctgcgg

SEQ ID NO: 8072916 - DNA, 22 bp, Homo sapiens
ctggctggggtaccagttgaac

SEQ ID NO: 8072917 - DNA, 22 bp, Homo sapiens
cttctctccctggcactcagac

SEQ ID NO: 8072918 - DNA, 22 bp, Homo sapiens
ctggctggttccctgctccagg

SEQ ID NO: 8072919 - DNA, 22 bp, Homo sapiens
cttctttgtgcctattggtgac

SEQ ID NO: 8072920 - DNA, 22 bp, Homo sapiens
cttctttgttctgttgtctcac

SEQ ID NO: 8072921 - DNA, 22 bp, Homo sapiens
cttctttactttctagaaataa

SEQ ID NO: 8072922 - DNA, 22 bp, Homo sapiens
ctttatgaacctgttcagcttg

SEQ ID NO: 8072923 - DNA, 22 bp, Homo sapiens
ctttatatattcccaggctgcc

SEQ ID NO: 8072924 - DNA, 22 bp, Homo sapiens
ctttatatccagatgtttggtg

SEQ ID NO: 8072925 - DNA, 22 bp, Homo sapiens
ctttatctgtgtcctcttgcct

SEQ ID NO: 8072926 - DNA, 22 bp, Homo sapiens
ctttatctgtgtcctcttgcct

SEQ ID NO: 8072927 - DNA, 22 bp, Homo sapiens
ctttgtattcatccgtaataat

SEQ ID NO: 8072928 - DNA, 22 bp, Homo sapiens
ctttgtattcagttgggctgtg

SEQ ID NO: 8072929 - DNA, 22 bp, Homo sapiens
ctttacaacctaagttgaagct

SEQ ID NO: 8072930 - DNA, 22 bp, Homo sapiens
cttggggctgtcactctggcat

SEQ ID NO: 8072931 - DNA, 22 bp, Homo sapiens
cttggctgaactccaggatgca

SEQ ID NO: 8072932 - DNA, 22 bp, Homo sapiens
cttggcagagggctgggctcag

SEQ ID NO: 8072933 - DNA, 22 bp, Homo sapiens
cttggctgcttttgtgcacatt

SEQ ID NO: 8072934 - DNA, 22 bp, Homo sapiens
gacacaggggggcgctagaaga

SEQ ID NO: 8072935 - DNA, 22 bp, Homo sapiens
gacacagagtattttaagtact

SEQ ID NO: 8072936 - DNA, 23 bp, Homo sapiens
gacacaggagcacccagctgagc

SEQ ID NO: 8072937 - DNA, 22 bp, Homo sapiens
gaattctgggagagatctgaca

SEQ ID NO: 8072938 - DNA, 22 bp, Homo sapiens
gaattctggttttgaaatgaat

SEQ ID NO: 8072939 - DNA, 22 bp, Homo sapiens
gaattctggtcctgtccaaggt

SEQ ID NO: 8072940 - DNA, 22 bp, Homo sapiens
gaattctgtcgcttactagatg

SEQ ID NO: 8072941 - DNA, 22 bp, Homo sapiens
gaaggcctcactctgcagcata

SEQ ID NO: 8072942 - DNA, 22 bp, Homo sapiens
gaaggcctgtggtagtgagacg

SEQ ID NO: 8072943 - DNA, 22 bp, Homo sapiens
gaaggcctagggatgctctgcg

SEQ ID NO: 8072944 - DNA, 22 bp, Homo sapiens
gaaggagaggattgtgaggctg

SEQ ID NO: 8072945 - DNA, 22 bp, Homo sapiens
gaaggctgatgacagattctgc

SEQ ID NO: 8072946 - DNA, 22 bp, Homo sapiens
gaagtgaagagattagaaatca

SEQ ID NO: 8072947 - DNA, 22 bp, Homo sapiens
gaagggaaggaaagaaccagca

SEQ ID NO: 8072948 - DNA, 22 bp, Homo sapiens
gagacagatctcggctccatgc

SEQ ID NO: 8072949 - DNA, 18 bp, Homo sapiens
gagagctgctacctagct

SEQ ID NO: 8072950 - DNA, 22 bp, Homo sapiens
gagagctgcaaggtagggcggg

SEQ ID NO: 8072951 - DNA, 22 bp, Homo sapiens
gagagctgcagccgagaggggg

SEQ ID NO: 8072952 - DNA, 22 bp, Homo sapiens
gagagctgggctttgggtgaag

SEQ ID NO: 8072953 - DNA, 22 bp, Homo sapiens
gagagctggccagcttcagtat

SEQ ID NO: 8072954 - DNA, 22 bp, Homo sapiens
gagagtctaggaacctcatata

SEQ ID NO: 8072955 - DNA, 20 bp, Homo sapiens
gagagctggggatgaggctg

SEQ ID NO: 8072956 - DNA, 22 bp, Homo sapiens
gactttatttccttatttgtga

SEQ ID NO: 8072957 - DNA, 22 bp, Homo sapiens
gactttattttaacggagattc

SEQ ID NO: 8072958 - DNA, 22 bp, Homo sapiens
gactttattatagtggcaatag

SEQ ID NO: 8072959 - DNA, 22 bp, Homo sapiens
gactttattcgttaactgttaa

SEQ ID NO: 8072960 - DNA, 22 bp, Homo sapiens
gactttattactaaccctgtga

SEQ ID NO: 8072961 - DNA, 22 bp, Homo sapiens
gactttatcttgtccttcctgc

SEQ ID NO: 8072962 - DNA, 22 bp, Homo sapiens
gactttatgaagagatgaccaa

SEQ ID NO: 8072963 - DNA, 22 bp, Homo sapiens
gactttataaatgagaggcgga

SEQ ID NO: 8072964 - DNA, 22 bp, Homo sapiens
gactttatcctgcctgaccacg

SEQ ID NO: 8072965 - DNA, 22 bp, Homo sapiens
gactttgtgccaaacgccagaa

SEQ ID NO: 8072966 - DNA, 22 bp, Homo sapiens
gagacacacattctggagagaa

SEQ ID NO: 8072967 - DNA, 22 bp, Homo sapiens
gagacacacccaaggttatgag

SEQ ID NO: 8072968 - DNA, 22 bp, Homo sapiens
gagacacacattctggagagaa

SEQ ID NO: 8072969 - DNA, 22 bp, Homo sapiens
gagacacaagaagacatgcaca

SEQ ID NO: 8072970 - DNA, 22 bp, Homo sapiens
gagacacaagaagacatgcaca

SEQ ID NO: 8072971 - DNA, 22 bp, Homo sapiens
gagacacaagacgcaactctgt

SEQ ID NO: 8072972 - DNA, 18 bp, Homo sapiens
gagacacaagggcctgga

SEQ ID NO: 8072973 - DNA, 18 bp, Homo sapiens
gagacacaagggcctgga

SEQ ID NO: 8072974 - DNA, 22 bp, Homo sapiens
gagacacaatttccccatccta

SEQ ID NO: 8072975 - DNA, 22 bp, Homo sapiens
gagacacagttatcaggcatac

SEQ ID NO: 8072976 - DNA, 22 bp, Homo sapiens
gagacacttgctgtgaggtcgc

SEQ ID NO: 8072977 - DNA, 22 bp, Homo sapiens
gagacacagagaggctgtgtga

SEQ ID NO: 8072978 - DNA, 22 bp, Homo sapiens
gagacacagagaggctgtgtga

SEQ ID NO: 8072979 - DNA, 22 bp, Homo sapiens
gagacacaggcacagaagaggc

SEQ ID NO: 8072980 - DNA, 22 bp, Homo sapiens
gagacacaggtggttcctgtca

SEQ ID NO: 8072981 - DNA, 22 bp, Homo sapiens
gaccagtcattactcatgccct

SEQ ID NO: 8072982 - DNA, 22 bp, Homo sapiens
gacccagggtttctgcacaggg

SEQ ID NO: 8072983 - DNA, 22 bp, Homo sapiens
gactgtcattctagtgcccatg

SEQ ID NO: 8072984 - DNA, 22 bp, Homo sapiens
gactgtggcagaaatgttgttg

SEQ ID NO: 8072985 - DNA, 22 bp, Homo sapiens
gactgtggctaatggtgttagg

SEQ ID NO: 8072986 - DNA, 22 bp, Homo sapiens
gactgtggcgtagatgctggga

SEQ ID NO: 8072987 - DNA, 22 bp, Homo sapiens
gactgtgggctctgtttgtctt

SEQ ID NO: 8072988 - DNA, 22 bp, Homo sapiens
gactgtgggctccttgagggca

SEQ ID NO: 8072989 - DNA, 22 bp, Homo sapiens
gactgtggggaagcagatgcca

SEQ ID NO: 8072990 - DNA, 22 bp, Homo sapiens
gatgctcatctgtcctttgatg

SEQ ID NO: 8072991 - DNA, 19 bp, Homo sapiens
gatgctcattcaggtggaa

SEQ ID NO: 8072992 - DNA, 22 bp, Homo sapiens
gatgccctgcatgagtcctgct

SEQ ID NO: 8072993 - DNA, 22 bp, Homo sapiens
gatgcttcaagcttccttataa

SEQ ID NO: 8072994 - DNA, 18 bp, Homo sapiens
gatgggagcaagagaaga

SEQ ID NO: 8072995 - DNA, 22 bp, Homo sapiens
gatgggaggaacctgggtccct

SEQ ID NO: 8072996 - DNA, 22 bp, Homo sapiens
gatggcctcatggctgcaggcc

SEQ ID NO: 8072997 - DNA, 22 bp, Homo sapiens
gatggaatgaatggcagataca

SEQ ID NO: 8072998 - DNA, 22 bp, Homo sapiens
gatgtctgtctgagccgctgga

SEQ ID NO: 8072999 - DNA, 22 bp, Homo sapiens
gatgtctggctaccactcgcac

SEQ ID NO: 8073000 - DNA, 22 bp, Homo sapiens
gatgggggccagggcctgcttt

SEQ ID NO: 8073001 - DNA, 22 bp, Homo sapiens
gatggggatgagaagtgagcag

SEQ ID NO: 8073002 - DNA, 22 bp, Homo sapiens
gatgggtggtctcagacttgcc

SEQ ID NO: 8073003 - DNA, 22 bp, Homo sapiens
gatggtgtcccaggctcaggct

SEQ ID NO: 8073004 - DNA, 22 bp, Homo sapiens
gatttaaagtagacctttgttt

SEQ ID NO: 8073005 - DNA, 22 bp, Homo sapiens
gatttattggtctttcattggt

SEQ ID NO: 8073006 - DNA, 22 bp, Homo sapiens
gatttatttttaatcagcaggg

SEQ ID NO: 8073007 - DNA, 21 bp, Homo sapiens
gatttataagccttaagccta

SEQ ID NO: 8073008 - DNA, 22 bp, Homo sapiens
gatttataaaggttgcactgga

SEQ ID NO: 8073009 - DNA, 22 bp, Homo sapiens
gatttatagtatgtgctttcag

SEQ ID NO: 8073010 - DNA, 22 bp, Homo sapiens
gatttataaaggttgcactgga

SEQ ID NO: 8073011 - DNA, 21 bp, Homo sapiens
gattaaatttaagctacatgc

SEQ ID NO: 8073012 - DNA, 22 bp, Homo sapiens
gattcaatgttgcagatggaat

SEQ ID NO: 8073013 - DNA, 22 bp, Homo sapiens
gcacctgctggggctgatgaga

SEQ ID NO: 8073014 - DNA, 22 bp, Homo sapiens
gcacctggctgcccaggtggag

SEQ ID NO: 8073015 - DNA, 22 bp, Homo sapiens
gcacctgcaggatgagccaggg

SEQ ID NO: 8073016 - DNA, 22 bp, Homo sapiens
gcacctgctggaatcagtctgt

SEQ ID NO: 8073017 - DNA, 22 bp, Homo sapiens
gcacctgcctgggactgaagat

SEQ ID NO: 8073018 - DNA, 22 bp, Homo sapiens
gcacacacatgtgagtacatgc

SEQ ID NO: 8073019 - DNA, 22 bp, Homo sapiens
gcacccaggcttgggcagcaac

SEQ ID NO: 8073020 - DNA, 22 bp, Homo sapiens
gcacccagggacttggctggcc

SEQ ID NO: 8073021 - DNA, 22 bp, Homo sapiens
gcagagcatgtcctcaggacag

SEQ ID NO: 8073022 - DNA, 22 bp, Homo sapiens
gcagagcagtactctcttgact

SEQ ID NO: 8073023 - DNA, 22 bp, Homo sapiens
gcagagccatgggaggtttttg

SEQ ID NO: 8073024 - DNA, 22 bp, Homo sapiens
gcagagccccattgctggcggg

SEQ ID NO: 8073025 - DNA, 22 bp, Homo sapiens
gcagagccaggctggggcaggt

SEQ ID NO: 8073026 - DNA, 22 bp, Homo sapiens
gcagagcccctcaagccagcct

SEQ ID NO: 8073027 - DNA, 22 bp, Homo sapiens
gcagagcccctcaagccagcct

SEQ ID NO: 8073028 - DNA, 22 bp, Homo sapiens
gcagagccaggagcccaggatc

SEQ ID NO: 8073029 - DNA, 22 bp, Homo sapiens
gcagagccaggagagacccttg

SEQ ID NO: 8073030 - DNA, 22 bp, Homo sapiens
gcagagccagaatggccaggac

SEQ ID NO: 8073031 - DNA, 22 bp, Homo sapiens
gcagaacatttcacagtatctt

SEQ ID NO: 8073032 - DNA, 22 bp, Homo sapiens
gcagaacagtctgtcggttcta

SEQ ID NO: 8073033 - DNA, 22 bp, Homo sapiens
gcagaagcccggtcagcgcacg

SEQ ID NO: 8073034 - DNA, 22 bp, Homo sapiens
gcagaagctgggcagcgaggtg

SEQ ID NO: 8073035 - DNA, 22 bp, Homo sapiens
gatttcttcattcattagatgg

SEQ ID NO: 8073036 - DNA, 22 bp, Homo sapiens
gatttgcattctgaaagctacc

SEQ ID NO: 8073037 - DNA, 22 bp, Homo sapiens
gcagtgggagcttaggcagtgc

SEQ ID NO: 8073038 - DNA, 22 bp, Homo sapiens
gcaggtggtccccgtggagtgg

SEQ ID NO: 8073039 - DNA, 22 bp, Homo sapiens
gcaggtggtggggctatgatct

SEQ ID NO: 8073040 - DNA, 23 bp, Homo sapiens
gcaggtggttcgaacagaagttt

SEQ ID NO: 8073041 - DNA, 22 bp, Homo sapiens
gcaggtggttaaggtcccatgt

SEQ ID NO: 8073042 - DNA, 22 bp, Homo sapiens
gcaggtgggggtcggtgcatct

SEQ ID NO: 8073043 - DNA, 22 bp, Homo sapiens
gcaggtggggctgctaccagaa

SEQ ID NO: 8073044 - DNA, 22 bp, Homo sapiens
gcaggtggattatcagaagtgc

SEQ ID NO: 8073045 - DNA, 22 bp, Homo sapiens
gcaggtggcagaggtgggatct

SEQ ID NO: 8073046 - DNA, 22 bp, Homo sapiens
gcagggtgatagtgaggctcag

SEQ ID NO: 8073047 - DNA, 22 bp, Homo sapiens
gcagggtgccgacttcagggat

SEQ ID NO: 8073048 - DNA, 22 bp, Homo sapiens
gcatggtggccttagggtagcc

SEQ ID NO: 8073049 - DNA, 22 bp, Homo sapiens
gccagcagccacagaagtcact

SEQ ID NO: 8073050 - DNA, 22 bp, Homo sapiens
gccagcagccacagaagtcact

SEQ ID NO: 8073051 - DNA, 20 bp, Homo sapiens
gccagcacagggagcagttc

SEQ ID NO: 8073052 - DNA, 22 bp, Homo sapiens
gccagcagggaagccttgggct

SEQ ID NO: 8073053 - DNA, 22 bp, Homo sapiens
gcagctcctggcacagtttttt

SEQ ID NO: 8073054 - DNA, 22 bp, Homo sapiens
gcagctcctttaggctgcaaag

SEQ ID NO: 8073055 - DNA, 22 bp, Homo sapiens
gcagctgaaagggatctctaca

SEQ ID NO: 8073056 - DNA, 20 bp, Homo sapiens
gcagctgaaagtatgacacc

SEQ ID NO: 8073057 - DNA, 22 bp, Homo sapiens
gcagctgaagctgcagttccag

SEQ ID NO: 8073058 - DNA, 22 bp, Homo sapiens
gcagctgaatgtccattgctgc

SEQ ID NO: 8073059 - DNA, 18 bp, Homo sapiens
gcagctgacactggagtt

SEQ ID NO: 8073060 - DNA, 22 bp, Homo sapiens
gcagcgtggggctgagtcagct

SEQ ID NO: 8073061 - DNA, 22 bp, Homo sapiens
gcagcgctactcacagctctga

SEQ ID NO: 8073062 - DNA, 22 bp, Homo sapiens
gcagagctatcttctggatttg

SEQ ID NO: 8073063 - DNA, 22 bp, Homo sapiens
gcagagctcaaggtgttcagct

SEQ ID NO: 8073064 - DNA, 22 bp, Homo sapiens
gcagagccgtgaatggatttca

SEQ ID NO: 8073065 - DNA, 20 bp, Homo sapiens
gcagagcctcactgcaaggg

SEQ ID NO: 8073066 - DNA, 22 bp, Homo sapiens
gcagagcctgacgggatttttc

SEQ ID NO: 8073067 - DNA, 21 bp, Homo sapiens
gcagagccggggcgagaaggc

SEQ ID NO: 8073068 - DNA, 21 bp, Homo sapiens
gcagagccggggcgagaaggc

SEQ ID NO: 8073069 - DNA, 22 bp, Homo sapiens
gcagagccctgggggtatggtg

SEQ ID NO: 8073070 - DNA, 21 bp, Homo sapiens
gcagagcctgaggttcttgag

SEQ ID NO: 8073071 - DNA, 22 bp, Homo sapiens
gcagagcctgggggtctgcgga

SEQ ID NO: 8073072 - DNA, 22 bp, Homo sapiens
gcagagcctgtgtctgagcaaa

SEQ ID NO: 8073073 - DNA, 22 bp, Homo sapiens
gcagagccttgcgtcatgtgcc

SEQ ID NO: 8073074 - DNA, 22 bp, Homo sapiens
gcagagcctgtgtctgagcaaa

SEQ ID NO: 8073075 - DNA, 22 bp, Homo sapiens
gcagctgatggaagtcctattg

SEQ ID NO: 8073076 - DNA, 22 bp, Homo sapiens
gcagctgacatctggctgggcc

SEQ ID NO: 8073077 - DNA, 22 bp, Homo sapiens
gcagctgagagaagaacagggc

SEQ ID NO: 8073078 - DNA, 22 bp, Homo sapiens
gcagctgagcgtgaggaagagt

SEQ ID NO: 8073079 - DNA, 22 bp, Homo sapiens
gcaggagagccagcaggcttcc

SEQ ID NO: 8073080 - DNA, 21 bp, Homo sapiens
gcaggggatagaaatggtctg

SEQ ID NO: 8073081 - DNA, 22 bp, Homo sapiens
gcaggggcaggagatctcaggc

SEQ ID NO: 8073082 - DNA, 22 bp, Homo sapiens
gcaggggctactctgagcttcc

SEQ ID NO: 8073083 - DNA, 22 bp, Homo sapiens
gcaggggctgagcaccagcggg

SEQ ID NO: 8073084 - DNA, 22 bp, Homo sapiens
gcaggggctgctgggaactcgg

SEQ ID NO: 8073085 - DNA, 22 bp, Homo sapiens
gcagggcaatgatcccgagagg

SEQ ID NO: 8073086 - DNA, 22 bp, Homo sapiens
gcagggcacagacagtgccaag

SEQ ID NO: 8073087 - DNA, 22 bp, Homo sapiens
gcaggctgtggtatgttgggca

SEQ ID NO: 8073088 - DNA, 21 bp, Homo sapiens
gcaggctggtcaaacctcagt

SEQ ID NO: 8073089 - DNA, 22 bp, Homo sapiens
gcaggctggaggctgttctggg

SEQ ID NO: 8073090 - DNA, 22 bp, Homo sapiens
gcaggctgccaccttctgagtt

SEQ ID NO: 8073091 - DNA, 22 bp, Homo sapiens
gctcctcttatttcatcagggc

SEQ ID NO: 8073092 - DNA, 22 bp, Homo sapiens
gctcctctcctcggagtcgggg

SEQ ID NO: 8073093 - DNA, 22 bp, Homo sapiens
gctcctctgtcaaatgagagtg

SEQ ID NO: 8073094 - DNA, 22 bp, Homo sapiens
gctcctggctccaggcagccaa

SEQ ID NO: 8073095 - DNA, 22 bp, Homo sapiens
gctcatttcttctttccacaat

SEQ ID NO: 8073096 - DNA, 22 bp, Homo sapiens
gctcatgtgtgattacagtttt

SEQ ID NO: 8073097 - DNA, 19 bp, Homo sapiens
gctcacttcaggttttcac

SEQ ID NO: 8073098 - DNA, 22 bp, Homo sapiens
gctcactggcctgaagaggacg

SEQ ID NO: 8073099 - DNA, 22 bp, Homo sapiens
gctcagagatgttcagtagctt

SEQ ID NO: 8073100 - DNA, 22 bp, Homo sapiens
gccttagcatcttaaagctgtg

SEQ ID NO: 8073101 - DNA, 19 bp, Homo sapiens
gctcctgggcctcactcat

SEQ ID NO: 8073102 - DNA, 22 bp, Homo sapiens
gctcctgggctctaccttgcta

SEQ ID NO: 8073103 - DNA, 22 bp, Homo sapiens
gctctgagtgattaaggagctt

SEQ ID NO: 8073104 - DNA, 22 bp, Homo sapiens
gctcttccatttctcttgaact

SEQ ID NO: 8073105 - DNA, 22 bp, Homo sapiens
gctcttgaaaatcaaaagggaa

SEQ ID NO: 8073106 - DNA, 22 bp, Homo sapiens
gctcttctaaagaatgtacagg

SEQ ID NO: 8073107 - DNA, 22 bp, Homo sapiens
gctctgtgttgtcagaggcacc

SEQ ID NO: 8073108 - DNA, 22 bp, Homo sapiens
gctctgtgtccacagctggaaa

SEQ ID NO: 8073109 - DNA, 22 bp, Homo sapiens
gctctgcccaatgtccctacac

SEQ ID NO: 8073110 - DNA, 22 bp, Homo sapiens
gctcttgatttccaggagctag

SEQ ID NO: 8073111 - DNA, 22 bp, Homo sapiens
gctcttgatacatcaagaactt

SEQ ID NO: 8073112 - DNA, 22 bp, Homo sapiens
gctcttgaccttggagaactcg

SEQ ID NO: 8073113 - DNA, 22 bp, Homo sapiens
gctgagcacacctagggtagag

SEQ ID NO: 8073114 - DNA, 22 bp, Homo sapiens
gctgagcagcctaagcaaattt

SEQ ID NO: 8073115 - DNA, 22 bp, Homo sapiens
gctgagcacagcctgtgtcctc

SEQ ID NO: 8073116 - DNA, 22 bp, Homo sapiens
gctggagatagtaggatccata

SEQ ID NO: 8073117 - DNA, 22 bp, Homo sapiens
gctggagatagaatggccactg

SEQ ID NO: 8073118 - DNA, 22 bp, Homo sapiens
gctggagaggggtcactctgag

SEQ ID NO: 8073119 - DNA, 22 bp, Homo sapiens
gctggagctgagttccctgggc

SEQ ID NO: 8073120 - DNA, 22 bp, Homo sapiens
gctggagccttctgctctgttg

SEQ ID NO: 8073121 - DNA, 22 bp, Homo sapiens
gctggagccattggcttggcct

SEQ ID NO: 8073122 - DNA, 22 bp, Homo sapiens
gctggagctgcagcctgggcct

SEQ ID NO: 8073123 - DNA, 22 bp, Homo sapiens
gctggcctcatcactgacttct

SEQ ID NO: 8073124 - DNA, 22 bp, Homo sapiens
gctggcctgaccagccacaggc

SEQ ID NO: 8073125 - DNA, 22 bp, Homo sapiens
gctggcctgacctgaggctggg

SEQ ID NO: 8073126 - DNA, 22 bp, Homo sapiens
gctggcctcgcaggcaggatgt

SEQ ID NO: 8073127 - DNA, 22 bp, Homo sapiens
gctggcctctacaggccggcca

SEQ ID NO: 8073128 - DNA, 22 bp, Homo sapiens
gctggcctttgaggaagctgcg

SEQ ID NO: 8073129 - DNA, 22 bp, Homo sapiens
gctgggagtgggcaagatgaga

SEQ ID NO: 8073130 - DNA, 22 bp, Homo sapiens
gctggcctgcgagggcaggctg

SEQ ID NO: 8073131 - DNA, 22 bp, Homo sapiens
gctggcctgggcagaggctatg

SEQ ID NO: 8073132 - DNA, 22 bp, Homo sapiens
gctggcctgggcagcctgtcgg

SEQ ID NO: 8073133 - DNA, 22 bp, Homo sapiens
gctggccttgtgtctgaggaag

SEQ ID NO: 8073134 - DNA, 22 bp, Homo sapiens
gctgggcacctctcccagattg

SEQ ID NO: 8073135 - DNA, 22 bp, Homo sapiens
gctgggcagcctggccgctgcc

SEQ ID NO: 8073136 - DNA, 22 bp, Homo sapiens
gctgggcagcccctacagagag

SEQ ID NO: 8073137 - DNA, 22 bp, Homo sapiens
gctgggcagcctggccgctgcc

SEQ ID NO: 8073138 - DNA, 22 bp, Homo sapiens
gctgagctagctatctcagtct

SEQ ID NO: 8073139 - DNA, 22 bp, Homo sapiens
gctgagctagctatctcagtct

SEQ ID NO: 8073140 - DNA, 22 bp, Homo sapiens
gctgagctcccagcagtatctg

SEQ ID NO: 8073141 - DNA, 22 bp, Homo sapiens
gctgcctgatcatacaccaggg

SEQ ID NO: 8073142 - DNA, 22 bp, Homo sapiens
gctgcctggaataacggctggc

SEQ ID NO: 8073143 - DNA, 22 bp, Homo sapiens
gctgcctggagaggcagggatg

SEQ ID NO: 8073144 - DNA, 22 bp, Homo sapiens
gctgcctggagctcagcctgcc

SEQ ID NO: 8073145 - DNA, 22 bp, Homo sapiens
gctgcctggctttagtccactt

SEQ ID NO: 8073146 - DNA, 22 bp, Homo sapiens
gctgcctggagctcagcctgcc

SEQ ID NO: 8073147 - DNA, 22 bp, Homo sapiens
gctgcctgctcggctcctggga

SEQ ID NO: 8073148 - DNA, 22 bp, Homo sapiens
gctgctctcagagctcatgctg

SEQ ID NO: 8073149 - DNA, 22 bp, Homo sapiens
gctgctctacccatgcatctgt

SEQ ID NO: 8073150 - DNA, 22 bp, Homo sapiens
gctgctctacccatgcatctgt

SEQ ID NO: 8073151 - DNA, 21 bp, Homo sapiens
gctgctcgagatccagtgctt

SEQ ID NO: 8073152 - DNA, 22 bp, Homo sapiens
gctgcctgggcaggaggcgctg

SEQ ID NO: 8073153 - DNA, 22 bp, Homo sapiens
gctgcctggtttctcagctgca

SEQ ID NO: 8073154 - DNA, 22 bp, Homo sapiens
gctgcctggtttctcagctgca

SEQ ID NO: 8073155 - DNA, 22 bp, Homo sapiens
gctgctctggctctgcagtgtc

SEQ ID NO: 8073156 - DNA, 22 bp, Homo sapiens
gctgctctggctctgcagtgtc

SEQ ID NO: 8073157 - DNA, 19 bp, Homo sapiens
gctgctctgggtctcatct

SEQ ID NO: 8073158 - DNA, 19 bp, Homo sapiens
gctgctctgggtctcatct

SEQ ID NO: 8073159 - DNA, 22 bp, Homo sapiens
gctgctctgctgtgtaagcagg

SEQ ID NO: 8073160 - DNA, 22 bp, Homo sapiens
gctgctctgaaaatgactgttg

SEQ ID NO: 8073161 - DNA, 22 bp, Homo sapiens
gctgctctgaaaatgactgttg

SEQ ID NO: 8073162 - DNA, 22 bp, Homo sapiens
gctgctctctccctaagttggg

SEQ ID NO: 8073163 - DNA, 22 bp, Homo sapiens
gctgctctctccctaagttggg

SEQ ID NO: 8073164 - DNA, 22 bp, Homo sapiens
gctgctctccatggccgtgagt

SEQ ID NO: 8073165 - DNA, 20 bp, Homo sapiens
gctgctctccacggtctgca

SEQ ID NO: 8073166 - DNA, 20 bp, Homo sapiens
gctgctctccacggtctgca

SEQ ID NO: 8073167 - DNA, 22 bp, Homo sapiens
gctgctctgttaattgctgtaa

SEQ ID NO: 8073168 - DNA, 22 bp, Homo sapiens
gctgctctgtgacagcctccgg

SEQ ID NO: 8073169 - DNA, 22 bp, Homo sapiens
gctgctcttttcagagatgaga

SEQ ID NO: 8073170 - DNA, 22 bp, Homo sapiens
gctgctcttttcagagatgaga

SEQ ID NO: 8073171 - DNA, 21 bp, Homo sapiens
gctgctgcccctagtgaggcc

SEQ ID NO: 8073172 - DNA, 21 bp, Homo sapiens
gctgctgcccctagtgaggcc

SEQ ID NO: 8073173 - DNA, 22 bp, Homo sapiens
gctgctgcatgaacagcggtca

SEQ ID NO: 8073174 - DNA, 22 bp, Homo sapiens
gctgctgcaagagccagctctt

SEQ ID NO: 8073175 - DNA, 16 bp, Homo sapiens
gctgctgcttcctgct

SEQ ID NO: 8073176 - DNA, 22 bp, Homo sapiens
gctgctgcctgtagccagggtg

SEQ ID NO: 8073177 - DNA, 22 bp, Homo sapiens
gctgctgcgcttgtctactgtt

SEQ ID NO: 8073178 - DNA, 22 bp, Homo sapiens
gctgctgccgcggccgctggga

SEQ ID NO: 8073179 - DNA, 19 bp, Homo sapiens
gctgctgctcctccctcgc

SEQ ID NO: 8073180 - DNA, 22 bp, Homo sapiens
gctgctgcgcttgtctactgtt

SEQ ID NO: 8073181 - DNA, 22 bp, Homo sapiens
gctgctgctgaggatgcacctg

SEQ ID NO: 8073182 - DNA, 22 bp, Homo sapiens
gctgctgctggtctggggccac

SEQ ID NO: 8073183 - DNA, 22 bp, Homo sapiens
gcctggagcctcagcaaggagg

SEQ ID NO: 8073184 - DNA, 22 bp, Homo sapiens
gcctggagcctcagcaaggagg

SEQ ID NO: 8073185 - DNA, 22 bp, Homo sapiens
gcctggagggctctagagaggc

SEQ ID NO: 8073186 - DNA, 22 bp, Homo sapiens
gcctggagggctctagagaggc

SEQ ID NO: 8073187 - DNA, 21 bp, Homo sapiens
gcctgctgttcaccctgccac

SEQ ID NO: 8073188 - DNA, 22 bp, Homo sapiens
gcctgctgttaactgcaggaat

SEQ ID NO: 8073189 - DNA, 22 bp, Homo sapiens
gcctgccttttggaggcacatt

SEQ ID NO: 8073190 - DNA, 22 bp, Homo sapiens
gcctgcctttgtgaggaagcgg

SEQ ID NO: 8073191 - DNA, 22 bp, Homo sapiens
gcctgccttttggaggcacatt

SEQ ID NO: 8073192 - DNA, 22 bp, Homo sapiens
gcctgctctgacatccatccca

SEQ ID NO: 8073193 - DNA, 23 bp, Homo sapiens
gcctgctgtcacagcgggcccag

SEQ ID NO: 8073194 - DNA, 22 bp, Homo sapiens
gcctgctgggagacacccccag

SEQ ID NO: 8073195 - DNA, 22 bp, Homo sapiens
gcctgctcccagttggcgcctc

SEQ ID NO: 8073196 - DNA, 22 bp, Homo sapiens
gcctgctctccggatccctgat

SEQ ID NO: 8073197 - DNA, 22 bp, Homo sapiens
gcctgctctccggatccctgat

SEQ ID NO: 8073198 - DNA, 23 bp, Homo sapiens
gcctctggagccccagtgctcag

SEQ ID NO: 8073199 - DNA, 20 bp, Homo sapiens
gcctgcctcagctagctgag

SEQ ID NO: 8073200 - DNA, 22 bp, Homo sapiens
gcctgcctcaaaatcccagttc

SEQ ID NO: 8073201 - DNA, 22 bp, Homo sapiens
gcctgcctcaaaatcccagttc

SEQ ID NO: 8073202 - DNA, 21 bp, Homo sapiens
gcctgcctgcgtgaccctctt

SEQ ID NO: 8073203 - DNA, 23 bp, Homo sapiens
gcctgcctgacctgtgcaaagtc

SEQ ID NO: 8073204 - DNA, 22 bp, Homo sapiens
gcctgcctgaaggctgtaccag

SEQ ID NO: 8073205 - DNA, 22 bp, Homo sapiens
gcctgcctgttggctgaggtgc

SEQ ID NO: 8073206 - DNA, 22 bp, Homo sapiens
gcctgcctgttggctgaggtgc

SEQ ID NO: 8073207 - DNA, 22 bp, Homo sapiens
gcctgccttcggtgcgcagcgg

SEQ ID NO: 8073208 - DNA, 22 bp, Homo sapiens
gcctgcctttgtatgaccctga

SEQ ID NO: 8073209 - DNA, 21 bp, Homo sapiens
gcctgcctgcgtgaccctctt

SEQ ID NO: 8073210 - DNA, 22 bp, Homo sapiens
gcctgcctgctgtcatctgcct

SEQ ID NO: 8073211 - DNA, 22 bp, Homo sapiens
gcctgcctgctgtcatctgcct

SEQ ID NO: 8073212 - DNA, 22 bp, Homo sapiens
gcctgcctgctgtgtgcaagtt

SEQ ID NO: 8073213 - DNA, 22 bp, Homo sapiens
gcctgcctggagcttgaggtga

SEQ ID NO: 8073214 - DNA, 19 bp, Homo sapiens
gcctgcctgggtttctgag

SEQ ID NO: 8073215 - DNA, 22 bp, Homo sapiens
gcctgtgtggatgcgccggtgc

SEQ ID NO: 8073216 - DNA, 22 bp, Homo sapiens
gcctgttctccagcatccaggt

SEQ ID NO: 8073217 - DNA, 22 bp, Homo sapiens
gcctgttgggtaacagagttca

SEQ ID NO: 8073218 - DNA, 22 bp, Homo sapiens
gcctgttggtgactttctgttg

SEQ ID NO: 8073219 - DNA, 23 bp, Homo sapiens
gcctgggactcaggaggagctca

SEQ ID NO: 8073220 - DNA, 21 bp, Homo sapiens
gcctgggatagtggcctccgg

SEQ ID NO: 8073221 - DNA, 19 bp, Homo sapiens
gcctgggatgggcagaact

SEQ ID NO: 8073222 - DNA, 22 bp, Homo sapiens
gcctggccgctccgagctccgc

SEQ ID NO: 8073223 - DNA, 22 bp, Homo sapiens
gcctggcctgaactaggaggtg

SEQ ID NO: 8073224 - DNA, 22 bp, Homo sapiens
gcctggcccagggctcttgttg

SEQ ID NO: 8073225 - DNA, 22 bp, Homo sapiens
gcctggccaacgtggtgaaacc

SEQ ID NO: 8073226 - DNA, 22 bp, Homo sapiens
gcctggagggttgaggttttgt

SEQ ID NO: 8073227 - DNA, 22 bp, Homo sapiens
gcctggagtactccttgaagtg

SEQ ID NO: 8073228 - DNA, 22 bp, Homo sapiens
gcctggcaggcctgggccagca

SEQ ID NO: 8073229 - DNA, 22 bp, Homo sapiens
gcctggcaggcctgttggggct

SEQ ID NO: 8073230 - DNA, 22 bp, Homo sapiens
gcctggcaggggcctgggagtg

SEQ ID NO: 8073231 - DNA, 22 bp, Homo sapiens
gccaggctgctggctgctgtcc

SEQ ID NO: 8073232 - DNA, 22 bp, Homo sapiens
gccaggctgctccagggaggcc

SEQ ID NO: 8073233 - DNA, 22 bp, Homo sapiens
gccaggctggtgtcacaactct

SEQ ID NO: 8073234 - DNA, 22 bp, Homo sapiens
gccaggctgtggggaacttgaa

SEQ ID NO: 8073235 - DNA, 22 bp, Homo sapiens
gccaggctgaggctctggaaga

SEQ ID NO: 8073236 - DNA, 22 bp, Homo sapiens
gccaggctgtttttattactgt

SEQ ID NO: 8073237 - DNA, 19 bp, Homo sapiens
gccagtgtgtggtacagtg

SEQ ID NO: 8073238 - DNA, 22 bp, Homo sapiens
gccagtgtttatagcagtgagg

SEQ ID NO: 8073239 - DNA, 22 bp, Homo sapiens
gccataaattgctggtcaaaat

SEQ ID NO: 8073240 - DNA, 22 bp, Homo sapiens
gccctctcttctgcagcctcca

SEQ ID NO: 8073241 - DNA, 22 bp, Homo sapiens
gccctctcggcatagcaggggc

SEQ ID NO: 8073242 - DNA, 21 bp, Homo sapiens
gccctcaggggaggatggcct

SEQ ID NO: 8073243 - DNA, 22 bp, Homo sapiens
gccctcagctcctggacacatg

SEQ ID NO: 8073244 - DNA, 22 bp, Homo sapiens
gccctcagagttccccacagtg

SEQ ID NO: 8073245 - DNA, 22 bp, Homo sapiens
gccctcagatgggaaaggaggg

SEQ ID NO: 8073246 - DNA, 22 bp, Homo sapiens
gcccttccaacccagagggcaa

SEQ ID NO: 8073247 - DNA, 22 bp, Homo sapiens
gcccttccttagacagcaggat

SEQ ID NO: 8073248 - DNA, 22 bp, Homo sapiens
gccctctgcacagctctgagca

SEQ ID NO: 8073249 - DNA, 22 bp, Homo sapiens
gccctctgctggcctcacctcg

SEQ ID NO: 8073250 - DNA, 22 bp, Homo sapiens
gccctctggcacagagatgcag

SEQ ID NO: 8073251 - DNA, 22 bp, Homo sapiens
gccctctgctggcctcacctcg

SEQ ID NO: 8073252 - DNA, 22 bp, Homo sapiens
gcctctgctcggactttgcctc

SEQ ID NO: 8073253 - DNA, 22 bp, Homo sapiens
gcctctgcaattacattgtgcc

SEQ ID NO: 8073254 - DNA, 22 bp, Homo sapiens
gcctcctgttatgccatgtgcc

SEQ ID NO: 8073255 - DNA, 22 bp, Homo sapiens
gccgtgtcatctgcgggtggca

SEQ ID NO: 8073256 - DNA, 22 bp, Homo sapiens
ctccagggatgagacagagtag

SEQ ID NO: 8073257 - DNA, 22 bp, Homo sapiens
ctccagggaggtctgcaggact

SEQ ID NO: 8073258 - DNA, 22 bp, Homo sapiens
ctccaggggccagaagcctggc

SEQ ID NO: 8073259 - DNA, 22 bp, Homo sapiens
ctccaggggccagaagcctggc

SEQ ID NO: 8073260 - DNA, 22 bp, Homo sapiens
ctccagggggcatccacacagc

SEQ ID NO: 8073261 - DNA, 20 bp, Homo sapiens
ctccaggggaagagccttcc

SEQ ID NO: 8073262 - DNA, 22 bp, Homo sapiens
ctccagggcagcatggcagtgg

SEQ ID NO: 8073263 - DNA, 22 bp, Homo sapiens
ctccagggcagcatggcagtgg

SEQ ID NO: 8073264 - DNA, 22 bp, Homo sapiens
ctccagggttccccgatccact

SEQ ID NO: 8073265 - DNA, 22 bp, Homo sapiens
ctccagggagctgtggaggttt

SEQ ID NO: 8073266 - DNA, 22 bp, Homo sapiens
ctccagggaggagcacgggttc

SEQ ID NO: 8073267 - DNA, 22 bp, Homo sapiens
ctccagggagcttggaaagacc

SEQ ID NO: 8073268 - DNA, 22 bp, Homo sapiens
ctccagggagctgtggaggttt

SEQ ID NO: 8073269 - DNA, 22 bp, Homo sapiens
ttgggtgctgtcatggggcacg

SEQ ID NO: 8073270 - DNA, 22 bp, Homo sapiens
ttgggtaggattcagcagtgtg

SEQ ID NO: 8073271 - DNA, 22 bp, Homo sapiens
ttgggtagcagcagggctcgat

SEQ ID NO: 8073272 - DNA, 22 bp, Homo sapiens
ttggaaaaattgcctgatgtct

SEQ ID NO: 8073273 - DNA, 22 bp, Homo sapiens
ttgggcagcattgcagttccct

SEQ ID NO: 8073274 - DNA, 22 bp, Homo sapiens
ctcatcagaaatacctgacaaa

SEQ ID NO: 8073275 - DNA, 22 bp, Homo sapiens
ctcatacatatgccattcctgc

SEQ ID NO: 8073276 - DNA, 22 bp, Homo sapiens
ctcatacatatgccattcctgc

SEQ ID NO: 8073277 - DNA, 22 bp, Homo sapiens
ctcataaggagctcacaaccta

SEQ ID NO: 8073278 - DNA, 22 bp, Homo sapiens
tttaaatttagaagaaacactg

SEQ ID NO: 8073279 - DNA, 22 bp, Homo sapiens
tttacattgcattaggtattat

SEQ ID NO: 8073280 - DNA, 22 bp, Homo sapiens
tttagaatgtgactgtatttga

SEQ ID NO: 8073281 - DNA, 22 bp, Homo sapiens
ctcctctggaaattcctctgcc

SEQ ID NO: 8073282 - DNA, 22 bp, Homo sapiens
ctcctcccaattgccaagtgct

SEQ ID NO: 8073283 - DNA, 22 bp, Homo sapiens
ctcctctttacccgcatggtct

SEQ ID NO: 8073284 - DNA, 22 bp, Homo sapiens
ctcctctttggggatttacaca

SEQ ID NO: 8073285 - DNA, 22 bp, Homo sapiens
ctcctctgtctggccctgagcc

SEQ ID NO: 8073286 - DNA, 23 bp, Homo sapiens
ctctccccctttgatgttagctc

SEQ ID NO: 8073287 - DNA, 22 bp, Homo sapiens
ctctcccccacagcagccttct

SEQ ID NO: 8073288 - DNA, 22 bp, Homo sapiens
ctctcccccacagcagccttct

SEQ ID NO: 8073289 - DNA, 22 bp, Homo sapiens
ctctcccccacagcagccttct

SEQ ID NO: 8073290 - DNA, 22 bp, Homo sapiens
ctctccctatgcctcccaggag

SEQ ID NO: 8073291 - DNA, 22 bp, Homo sapiens
ctctccctggccagctgtgcag

SEQ ID NO: 8073292 - DNA, 22 bp, Homo sapiens
tttcagttagctgagacccagg

SEQ ID NO: 8073293 - DNA, 22 bp, Homo sapiens
ctctccagcctttagcccacgc

SEQ ID NO: 8073294 - DNA, 22 bp, Homo sapiens
ctcctgggctcaagtgatcctc

SEQ ID NO: 8073295 - DNA, 22 bp, Homo sapiens
ttccttccgggcaccaggcact

SEQ ID NO: 8073296 - DNA, 22 bp, Homo sapiens
ttccttccagcttgtgacagtc

SEQ ID NO: 8073297 - DNA, 22 bp, Homo sapiens
ttccttcagttcagggaaccct

SEQ ID NO: 8073298 - DNA, 22 bp, Homo sapiens
ctaatttaatgaatgagtctta

SEQ ID NO: 8073299 - DNA, 22 bp, Homo sapiens
ttccaaagtcatgttgctgata

SEQ ID NO: 8073300 - DNA, 22 bp, Homo sapiens
ttccaaaggaatggggagctat

SEQ ID NO: 8073301 - DNA, 22 bp, Homo sapiens
ttccaaagaaattgaccaagac

SEQ ID NO: 8073302 - DNA, 22 bp, Homo sapiens
ttccaaagaaattgaccaagac

SEQ ID NO: 8073303 - DNA, 22 bp, Homo sapiens
ttcacagacattgcagactgaa

SEQ ID NO: 8073304 - DNA, 22 bp, Homo sapiens
cggcagtgggcgccaggtctcc

SEQ ID NO: 8073305 - DNA, 22 bp, Homo sapiens
cgctggggctttttgcttgaga

SEQ ID NO: 8073306 - DNA, 22 bp, Homo sapiens
cgctgggggaacagcgagggtg

SEQ ID NO: 8073307 - DNA, 22 bp, Homo sapiens
cgctgggcgccgacctgctggc

SEQ ID NO: 8073308 - DNA, 22 bp, Homo sapiens
ttcagaaaaagaccattgcaat

SEQ ID NO: 8073309 - DNA, 22 bp, Homo sapiens
ttcagaaaaagaccattgcaat

SEQ ID NO: 8073310 - DNA, 22 bp, Homo sapiens
ttcagaaacatcagtggatgga

SEQ ID NO: 8073311 - DNA, 22 bp, Homo sapiens
cggctgggtagaggtgccgggt

SEQ ID NO: 8073312 - DNA, 22 bp, Homo sapiens
cggctggggctgtccccatgac

SEQ ID NO: 8073313 - DNA, 22 bp, Homo sapiens
cggctggggctgtccccatgac

SEQ ID NO: 8073314 - DNA, 22 bp, Homo sapiens
cggctgctgcctgagtcgctgt

SEQ ID NO: 8073315 - DNA, 23 bp, Homo sapiens
cggctgctcggccgagtcctcgg

SEQ ID NO: 8073316 - DNA, 20 bp, Homo sapiens
ttcattcattccacaacttc

SEQ ID NO: 8073317 - DNA, 23 bp, Homo sapiens
ttcatgagttggacaagactggg

SEQ ID NO: 8073318 - DNA, 22 bp, Homo sapiens
ttcagaaaggttaatctggatt

SEQ ID NO: 8073319 - DNA, 22 bp, Homo sapiens
ttcagaaaggataattggaagg

SEQ ID NO: 8073320 - DNA, 22 bp, Homo sapiens
ttgactgtgatgggctcagctg

SEQ ID NO: 8073321 - DNA, 22 bp, Homo sapiens
ttgactgttaagacttggctct

SEQ ID NO: 8073322 - DNA, 22 bp, Homo sapiens
ttgacctatgtttcttcatctg

SEQ ID NO: 8073323 - DNA, 19 bp, Homo sapiens
ttgacgttgtggaattaac

SEQ ID NO: 8073324 - DNA, 22 bp, Homo sapiens
ttgaggagcaggatgggaggct

SEQ ID NO: 8073325 - DNA, 22 bp, Homo sapiens
ttgagttctggtcttttaaaag

SEQ ID NO: 8073326 - DNA, 22 bp, Homo sapiens
ttgagttctgtgtatcctttgt

SEQ ID NO: 8073327 - DNA, 22 bp, Homo sapiens
ttcttgttctcctcatttagag

SEQ ID NO: 8073328 - DNA, 22 bp, Homo sapiens
ttcttggcatcatgaaaaatta

SEQ ID NO: 8073329 - DNA, 22 bp, Homo sapiens
ctcagcagcagggaagaggtca

SEQ ID NO: 8073330 - DNA, 17 bp, Homo sapiens
ctcagcagggctcactt

SEQ ID NO: 8073331 - DNA, 22 bp, Homo sapiens
ctcagcagagaccagggaggaa

SEQ ID NO: 8073332 - DNA, 19 bp, Homo sapiens
ctcagcacttttacacagg

SEQ ID NO: 8073333 - DNA, 20 bp, Homo sapiens
ctaggcagcgagtgactgag

SEQ ID NO: 8073334 - DNA, 21 bp, Homo sapiens
ctagcccctactccaagttga

SEQ ID NO: 8073335 - DNA, 22 bp, Homo sapiens
ctgatgctataagccacagtgg

SEQ ID NO: 8073336 - DNA, 22 bp, Homo sapiens
ctgcagaaacctttcctgattt

SEQ ID NO: 8073337 - DNA, 22 bp, Homo sapiens
ctgcagaaatatggatgtgata

SEQ ID NO: 8073338 - DNA, 22 bp, Homo sapiens
ctgattccaaagccaaagctat

SEQ ID NO: 8073339 - DNA, 22 bp, Homo sapiens
ctgaggatggtgtggtcttctc

SEQ ID NO: 8073340 - DNA, 22 bp, Homo sapiens
ctgagagaaacatgactcagga

SEQ ID NO: 8073341 - DNA, 22 bp, Homo sapiens
ctgccaggcctccgctgtcccc

SEQ ID NO: 8073342 - DNA, 22 bp, Homo sapiens
ctgcagcagtgtgtctcatttt

SEQ ID NO: 8073343 - DNA, 22 bp, Homo sapiens
ctgccagctctctggaggctct

SEQ ID NO: 8073344 - DNA, 22 bp, Homo sapiens
ctgcagccacgagtcacagccc

SEQ ID NO: 8073345 - DNA, 22 bp, Homo sapiens
ctgcagcaggaggctcctgcag

SEQ ID NO: 8073346 - DNA, 22 bp, Homo sapiens
ctgcagcagcctccagccttgg

SEQ ID NO: 8073347 - DNA, 22 bp, Homo sapiens
ctgcagcagaataatctgctca

SEQ ID NO: 8073348 - DNA, 22 bp, Homo sapiens
ctgcagagctttctgaatgaag

SEQ ID NO: 8073349 - DNA, 22 bp, Homo sapiens
ctgcagaggtcttgctgatggt

SEQ ID NO: 8073350 - DNA, 22 bp, Homo sapiens
ctgccaggttggcgctcgctct

SEQ ID NO: 8073351 - DNA, 22 bp, Homo sapiens
ctgccatgcagttagtccctca

SEQ ID NO: 8073352 - DNA, 22 bp, Homo sapiens
ctgcctcctcacgtccacagtg

SEQ ID NO: 8073353 - DNA, 22 bp, Homo sapiens
ctgcctcatgctgcctgcagcc

SEQ ID NO: 8073354 - DNA, 22 bp, Homo sapiens
ctgaagaggacgcagcagcaag

SEQ ID NO: 8073355 - DNA, 22 bp, Homo sapiens
ctgaagatgtctgagatgctca

SEQ ID NO: 8073356 - DNA, 22 bp, Homo sapiens
ctgaagaaatatgattgcttaa

SEQ ID NO: 8073357 - DNA, 22 bp, Homo sapiens
ctgaagaaatatgattgcttaa

SEQ ID NO: 8073358 - DNA, 22 bp, Homo sapiens
ctctgggttcactgaggctctg

SEQ ID NO: 8073359 - DNA, 22 bp, Homo sapiens
ttttgttttcttagaaacctgg

SEQ ID NO: 8073360 - DNA, 22 bp, Homo sapiens
tttttaagagattctccagtct

SEQ ID NO: 8073361 - DNA, 22 bp, Homo sapiens
tttttaagctcctttgatgtca

SEQ ID NO: 8073362 - DNA, 22 bp, Homo sapiens
ctctgggcaggaccagtggacc

SEQ ID NO: 8073363 - DNA, 17 bp, Homo sapiens
ctctgggcagcctgggg

SEQ ID NO: 8073364 - DNA, 22 bp, Homo sapiens
ctctgggcaaagatgcctcatc

SEQ ID NO: 8073365 - DNA, 22 bp, Homo sapiens
ctctgggcaaagatgcctcatc

SEQ ID NO: 8073366 - DNA, 22 bp, Homo sapiens
ctctgggcacattttccaggac

SEQ ID NO: 8073367 - DNA, 22 bp, Homo sapiens
ctctgggcaagtttcttcatga

SEQ ID NO: 8073368 - DNA, 22 bp, Homo sapiens
tttgtcttgtgtccttaggacc

SEQ ID NO: 8073369 - DNA, 22 bp, Homo sapiens
tttgtctttcccctcctcattg

SEQ ID NO: 8073370 - DNA, 19 bp, Homo sapiens
ctctggcttccaaagcatc

SEQ ID NO: 8073371 - DNA, 22 bp, Homo sapiens
ctctggctgtttgcagctcaag

SEQ ID NO: 8073372 - DNA, 22 bp, Homo sapiens
ctctggctgcggggcgcgtgga

SEQ ID NO: 8073373 - DNA, 22 bp, Homo sapiens
ctggaggaataatggcatcttg

SEQ ID NO: 8073374 - DNA, 22 bp, Homo sapiens
ctggaggaatcacagaaggctt

SEQ ID NO: 8073375 - DNA, 22 bp, Homo sapiens
ctggaggacagaggccatgtct

SEQ ID NO: 8073376 - DNA, 22 bp, Homo sapiens
ctggaggaataatggcatcttg

SEQ ID NO: 8073377 - DNA, 22 bp, Homo sapiens
ctggactttggcccatctgcca

SEQ ID NO: 8073378 - DNA, 22 bp, Homo sapiens
ctggagtgtaaagagcatagaa

SEQ ID NO: 8073379 - DNA, 22 bp, Homo sapiens
ctggaggtaatgttatttttgt

SEQ ID NO: 8073380 - DNA, 22 bp, Homo sapiens
ctggagggtgagcctcatctct

SEQ ID NO: 8073381 - DNA, 22 bp, Homo sapiens
ctggagggggaaatgttcattg

SEQ ID NO: 8073382 - DNA, 22 bp, Homo sapiens
ctgcctggctaaactcaagtcg

SEQ ID NO: 8073383 - DNA, 22 bp, Homo sapiens
ctgcctggcctgatctccacgc

SEQ ID NO: 8073384 - DNA, 22 bp, Homo sapiens
ctgcctggcccagggatgggcc

SEQ ID NO: 8073385 - DNA, 22 bp, Homo sapiens
ctgcctgggccggccaccctct

SEQ ID NO: 8073386 - DNA, 22 bp, Homo sapiens
ctgcttctaagaacctgcagct

SEQ ID NO: 8073387 - DNA, 22 bp, Homo sapiens
ctgcctggcatggagaagagaa

SEQ ID NO: 8073388 - DNA, 20 bp, Homo sapiens
ctgcctggaggcctctacct

SEQ ID NO: 8073389 - DNA, 22 bp, Homo sapiens
ctgcctggaatgccagcttctc

SEQ ID NO: 8073390 - DNA, 22 bp, Homo sapiens
ctgcctggacagctcttacctt

SEQ ID NO: 8073391 - DNA, 22 bp, Homo sapiens
ctgcctggaccggcagccctcc

SEQ ID NO: 8073392 - DNA, 22 bp, Homo sapiens
ctgcctggagcattctgaaggt

SEQ ID NO: 8073393 - DNA, 22 bp, Homo sapiens
ctgctttgtaaaatagacataa

SEQ ID NO: 8073394 - DNA, 22 bp, Homo sapiens
ctggacagaaaaggccactgga

SEQ ID NO: 8073395 - DNA, 19 bp, Homo sapiens
ctggaatgtggctggtgca

SEQ ID NO: 8073396 - DNA, 22 bp, Homo sapiens
ctggaaggttctttgtgtgcct

SEQ ID NO: 8073397 - DNA, 22 bp, Homo sapiens
ctggcctgctgggtgaggtcct

SEQ ID NO: 8073398 - DNA, 22 bp, Homo sapiens
ctggcctggcagggagggcatg

SEQ ID NO: 8073399 - DNA, 22 bp, Homo sapiens
ctggcctgaggtcggctgtagg

SEQ ID NO: 8073400 - DNA, 22 bp, Homo sapiens
ctggcctgaggccgccttcaga

SEQ ID NO: 8073401 - DNA, 22 bp, Homo sapiens
ctggcctgagcacagcggctgc

SEQ ID NO: 8073402 - DNA, 22 bp, Homo sapiens
ctggcctgagaatgctaccctt

SEQ ID NO: 8073403 - DNA, 22 bp, Homo sapiens
ctggctccactccctgcctgac

SEQ ID NO: 8073404 - DNA, 22 bp, Homo sapiens
ctggctccctcgctgaggtgct

SEQ ID NO: 8073405 - DNA, 22 bp, Homo sapiens
ctggctcctccaaggcctggag

SEQ ID NO: 8073406 - DNA, 23 bp, Homo sapiens
ctggctccgaagactccaggatc

SEQ ID NO: 8073407 - DNA, 22 bp, Homo sapiens
ctggcctggggcctcagctgct

SEQ ID NO: 8073408 - DNA, 22 bp, Homo sapiens
ctggcctggcgcagtggctcac

SEQ ID NO: 8073409 - DNA, 22 bp, Homo sapiens
ctggcctgggagctgctagcgt

SEQ ID NO: 8073410 - DNA, 22 bp, Homo sapiens
ctggcctggcaggggacctcta

SEQ ID NO: 8073411 - DNA, 22 bp, Homo sapiens
ctggctctatctccaaggctgg

SEQ ID NO: 8073412 - DNA, 22 bp, Homo sapiens
ctggctctctgagatattgagt

SEQ ID NO: 8073413 - DNA, 22 bp, Homo sapiens
ctggcagcagcttctggatcga

SEQ ID NO: 8073414 - DNA, 22 bp, Homo sapiens
ctggcaccaggcatgctgggag

SEQ ID NO: 8073415 - DNA, 22 bp, Homo sapiens
ctggccacatgtgtgctgagca

SEQ ID NO: 8073416 - DNA, 22 bp, Homo sapiens
ctggccacaactagcccaggac

SEQ ID NO: 8073417 - DNA, 22 bp, Homo sapiens
ctggcaggtatctaaagttgtc

SEQ ID NO: 8073418 - DNA, 22 bp, Homo sapiens
ctggcagggtgggctttgcttt

SEQ ID NO: 8073419 - DNA, 22 bp, Homo sapiens
ctggcagcagttatgaaacaat

SEQ ID NO: 8073420 - DNA, 22 bp, Homo sapiens
ctggcagcatggagcctgtgct

SEQ ID NO: 8073421 - DNA, 22 bp, Homo sapiens
ctggcagcattaacagagagca

SEQ ID NO: 8073422 - DNA, 22 bp, Homo sapiens
cctccaagtttgactcaggaca

SEQ ID NO: 8073423 - DNA, 22 bp, Homo sapiens
cctccacaggagctgcagtgct

SEQ ID NO: 8073424 - DNA, 22 bp, Homo sapiens
tggctgagggggcagttcagga

SEQ ID NO: 8073425 - DNA, 22 bp, Homo sapiens
tggctgaggtaactatgaataa

SEQ ID NO: 8073426 - DNA, 22 bp, Homo sapiens
cctcctggtccagcatctcttt

SEQ ID NO: 8073427 - DNA, 22 bp, Homo sapiens
cctcggagcacgccggccgccc

SEQ ID NO: 8073428 - DNA, 18 bp, Homo sapiens
cctcggagcctccgtgtc

SEQ ID NO: 8073429 - DNA, 22 bp, Homo sapiens
cctcggaggcggaggctgcagt

SEQ ID NO: 8073430 - DNA, 22 bp, Homo sapiens
cctcggagcgggtcagagaggg

SEQ ID NO: 8073431 - DNA, 22 bp, Homo sapiens
cctcggctgggccttggccact

SEQ ID NO: 8073432 - DNA, 22 bp, Homo sapiens
cctcccttggccatagccagcc

SEQ ID NO: 8073433 - DNA, 22 bp, Homo sapiens
tggctcagtttcagtcctggtt

SEQ ID NO: 8073434 - DNA, 22 bp, Homo sapiens
tggccctgctgtatcatctgct

SEQ ID NO: 8073435 - DNA, 22 bp, Homo sapiens
tggccctgctatgatcctgcaa

SEQ ID NO: 8073436 - DNA, 22 bp, Homo sapiens
cctctgtgacaaacagtcctgg

SEQ ID NO: 8073437 - DNA, 22 bp, Homo sapiens
cctctgtcctggggagtggagc

SEQ ID NO: 8073438 - DNA, 22 bp, Homo sapiens
cctctgtccccagtgcaggcct

SEQ ID NO: 8073439 - DNA, 18 bp, Homo sapiens
cctctgggttttgttccc

SEQ ID NO: 8073440 - DNA, 22 bp, Homo sapiens
cctctgtaagccttagtctaga

SEQ ID NO: 8073441 - DNA, 21 bp, Homo sapiens
cctctgtagttaagtttccta

SEQ ID NO: 8073442 - DNA, 22 bp, Homo sapiens
cctctggggtgagtgggccact

SEQ ID NO: 8073443 - DNA, 22 bp, Homo sapiens
cctctgggggtcctcagagtct

SEQ ID NO: 8073444 - DNA, 22 bp, Homo sapiens
cctctgggtatctgtggaagta

SEQ ID NO: 8073445 - DNA, 22 bp, Homo sapiens
cctctgggtgacagactcttgg

SEQ ID NO: 8073446 - DNA, 22 bp, Homo sapiens
cctctgggtgggaggccgggcg

SEQ ID NO: 8073447 - DNA, 22 bp, Homo sapiens
cctctgggggcttccttaccct

SEQ ID NO: 8073448 - DNA, 22 bp, Homo sapiens
cctctctgtaagggtccctccc

SEQ ID NO: 8073449 - DNA, 22 bp, Homo sapiens
cctctctgtgtggcctctccat

SEQ ID NO: 8073450 - DNA, 22 bp, Homo sapiens
tggctgcctagtgtctgagcag

SEQ ID NO: 8073451 - DNA, 22 bp, Homo sapiens
tggcagctgtgtccaggtagaa

SEQ ID NO: 8073452 - DNA, 22 bp, Homo sapiens
tggcagctgtgtccaggtagaa

SEQ ID NO: 8073453 - DNA, 22 bp, Homo sapiens
tggcagcttcctgctcatagga

SEQ ID NO: 8073454 - DNA, 22 bp, Homo sapiens
tggcagcttcctgctcatagga

SEQ ID NO: 8073455 - DNA, 22 bp, Homo sapiens
tggcagcttgaatgcagtcttt

SEQ ID NO: 8073456 - DNA, 23 bp, Homo sapiens
tggcagctgtgtaagagaaagca

SEQ ID NO: 8073457 - DNA, 22 bp, Homo sapiens
tggcagctgtctgtggggtctc

SEQ ID NO: 8073458 - DNA, 22 bp, Homo sapiens
tggcagcttgaatgcagtcttt

SEQ ID NO: 8073459 - DNA, 22 bp, Homo sapiens
tggcagcaagttcttgggaggt

SEQ ID NO: 8073460 - DNA, 22 bp, Homo sapiens
tggcagcaattagctagagctg

SEQ ID NO: 8073461 - DNA, 22 bp, Homo sapiens
tggcagcaattagctagagctg

SEQ ID NO: 8073462 - DNA, 22 bp, Homo sapiens
tggcagcaaaaccagaatcaga

SEQ ID NO: 8073463 - DNA, 22 bp, Homo sapiens
tggcagcaaaaccagaatcaga

SEQ ID NO: 8073464 - DNA, 22 bp, Homo sapiens
tggcagcaaaaccagaatcaga

SEQ ID NO: 8073465 - DNA, 22 bp, Homo sapiens
tggcagaggtatattgggagga

SEQ ID NO: 8073466 - DNA, 22 bp, Homo sapiens
tggcagcaatttgtgatgttga

SEQ ID NO: 8073467 - DNA, 22 bp, Homo sapiens
tggcagcacaaggtggcccatg

SEQ ID NO: 8073468 - DNA, 22 bp, Homo sapiens
tggcagcacaaggtggcccatg

SEQ ID NO: 8073469 - DNA, 22 bp, Homo sapiens
tggcagcacattgacccgggct

SEQ ID NO: 8073470 - DNA, 22 bp, Homo sapiens
tggcagcactaggtactgagct

SEQ ID NO: 8073471 - DNA, 22 bp, Homo sapiens
tggcagcactaggtactgagct

SEQ ID NO: 8073472 - DNA, 22 bp, Homo sapiens
tggcagctggagggcaatggcc

SEQ ID NO: 8073473 - DNA, 22 bp, Homo sapiens
tggcagaggtaattcaaatccc

SEQ ID NO: 8073474 - DNA, 22 bp, Homo sapiens
ccctccagagcttgacctgctg

SEQ ID NO: 8073475 - DNA, 22 bp, Homo sapiens
tggagctgagagccaggctggc

SEQ ID NO: 8073476 - DNA, 22 bp, Homo sapiens
tggagctgactcacaccagcta

SEQ ID NO: 8073477 - DNA, 23 bp, Homo sapiens
tggagctgacagtcagagggagg

SEQ ID NO: 8073478 - DNA, 20 bp, Homo sapiens
ccctggagagaagctccacg

SEQ ID NO: 8073479 - DNA, 22 bp, Homo sapiens
ccctggagctagtctgagcaga

SEQ ID NO: 8073480 - DNA, 17 bp, Homo sapiens
tggcaagacagctcagg

SEQ ID NO: 8073481 - DNA, 22 bp, Homo sapiens
tggatctcggcaatgcgggact

SEQ ID NO: 8073482 - DNA, 22 bp, Homo sapiens
ccctggcaaaacactctcttga

SEQ ID NO: 8073483 - DNA, 22 bp, Homo sapiens
ccctcaggagatgtcagctgga

SEQ ID NO: 8073484 - DNA, 19 bp, Homo sapiens
ccctcaggtctgagcagtc

SEQ ID NO: 8073485 - DNA, 22 bp, Homo sapiens
cccctctgcaaatagccaggct

SEQ ID NO: 8073486 - DNA, 22 bp, Homo sapiens
cccctctggtcaaccagtcaca

SEQ ID NO: 8073487 - DNA, 22 bp, Homo sapiens
cccctcgcctgcagagcacagc

SEQ ID NO: 8073488 - DNA, 22 bp, Homo sapiens
cccctcattcatgtccttgctt

SEQ ID NO: 8073489 - DNA, 22 bp, Homo sapiens
cccccagccagcagtgctcagc

SEQ ID NO: 8073490 - DNA, 22 bp, Homo sapiens
ccccctggcaggctggcctctc

SEQ ID NO: 8073491 - DNA, 22 bp, Homo sapiens
ccccctctgccggggtccttca

SEQ ID NO: 8073492 - DNA, 22 bp, Homo sapiens
ccccagcagactcagggcaggt

SEQ ID NO: 8073493 - DNA, 22 bp, Homo sapiens
ccccagccagcttgtagtagaa

SEQ ID NO: 8073494 - DNA, 22 bp, Homo sapiens
ccccagccagcttgtagtagaa

SEQ ID NO: 8073495 - DNA, 22 bp, Homo sapiens
ccccagccagcaggacctctga

SEQ ID NO: 8073496 - DNA, 22 bp, Homo sapiens
ccccagccagcaggacctctga

SEQ ID NO: 8073497 - DNA, 22 bp, Homo sapiens
ccccacctgtgcgtctgccgca

SEQ ID NO: 8073498 - DNA, 22 bp, Homo sapiens
ccccagccttccatgggaattg

SEQ ID NO: 8073499 - DNA, 22 bp, Homo sapiens
ccccagcccacaagcatattaa

SEQ ID NO: 8073500 - DNA, 22 bp, Homo sapiens
ccccagcccacaagcatattaa

SEQ ID NO: 8073501 - DNA, 22 bp, Homo sapiens
ccccagccttccatgggaattg

SEQ ID NO: 8073502 - DNA, 22 bp, Homo sapiens
ccccagccttccatgggaattg

SEQ ID NO: 8073503 - DNA, 22 bp, Homo sapiens
ccccaggcctgttggatggcgc

SEQ ID NO: 8073504 - DNA, 22 bp, Homo sapiens
tgctggagaggaaggtggggtc

SEQ ID NO: 8073505 - DNA, 22 bp, Homo sapiens
tgctggagatcattaatgttca

SEQ ID NO: 8073506 - DNA, 20 bp, Homo sapiens
cccagggacctgagctccat

SEQ ID NO: 8073507 - DNA, 22 bp, Homo sapiens
cccagggaggtagcaggagaaa

SEQ ID NO: 8073508 - DNA, 22 bp, Homo sapiens
tgctctggagtggcttgtgcac

SEQ ID NO: 8073509 - DNA, 20 bp, Homo sapiens
tgcctgggaaggcgtggagg

SEQ ID NO: 8073510 - DNA, 22 bp, Homo sapiens
tgcctgctctgtgccacagttg

SEQ ID NO: 8073511 - DNA, 22 bp, Homo sapiens
tgcctgctcttaccactctccc

SEQ ID NO: 8073512 - DNA, 22 bp, Homo sapiens
tgcctgctcttgagacttacaa

SEQ ID NO: 8073513 - DNA, 22 bp, Homo sapiens
tgcctgggacatgctgtggact

SEQ ID NO: 8073514 - DNA, 22 bp, Homo sapiens
tgcctgggatctgtgccctttg

SEQ ID NO: 8073515 - DNA, 22 bp, Homo sapiens
tgcctgggatctgtgccctttg

SEQ ID NO: 8073516 - DNA, 22 bp, Homo sapiens
cccaggctcctgctgtgttgac

SEQ ID NO: 8073517 - DNA, 22 bp, Homo sapiens
cccaggctcttatgtgacttgc

SEQ ID NO: 8073518 - DNA, 22 bp, Homo sapiens
tgctccatgcgctcggccggcg

SEQ ID NO: 8073519 - DNA, 22 bp, Homo sapiens
cccaggcagcggggtctccttg

SEQ ID NO: 8073520 - DNA, 22 bp, Homo sapiens
cccaggcagtgctgatccctca

SEQ ID NO: 8073521 - DNA, 22 bp, Homo sapiens
cccaggcagtctggctctaaag

SEQ ID NO: 8073522 - DNA, 16 bp, Homo sapiens
tgcctgctctgatctc

SEQ ID NO: 8073523 - DNA, 22 bp, Homo sapiens
cccaggcagggacgtgctctgg

SEQ ID NO: 8073524 - DNA, 22 bp, Homo sapiens
cccaggcagagagctggtgagc

SEQ ID NO: 8073525 - DNA, 22 bp, Homo sapiens
cccaggcagaattagtgtttca

SEQ ID NO: 8073526 - DNA, 21 bp, Homo sapiens
tgccaggcctgagctggggtc

SEQ ID NO: 8073527 - DNA, 21 bp, Homo sapiens
tgccaggcctgagctggggtc

SEQ ID NO: 8073528 - DNA, 22 bp, Homo sapiens
tgccaggcgtggtggtgcgcac

SEQ ID NO: 8073529 - DNA, 22 bp, Homo sapiens
tgccaagattatcgaagtctta

SEQ ID NO: 8073530 - DNA, 22 bp, Homo sapiens
tgccaggcctcaggagtctcca

SEQ ID NO: 8073531 - DNA, 22 bp, Homo sapiens
tgccaggcctcaggagtctcca

SEQ ID NO: 8073532 - DNA, 22 bp, Homo sapiens
cccagcttgcccaggactgagg

SEQ ID NO: 8073533 - DNA, 22 bp, Homo sapiens
cccagctgaacttgcattccaa

SEQ ID NO: 8073534 - DNA, 22 bp, Homo sapiens
cccagctgaacttgcattccaa

SEQ ID NO: 8073535 - DNA, 23 bp, Homo sapiens
cccagctgagacttcctgaactc

SEQ ID NO: 8073536 - DNA, 22 bp, Homo sapiens
cccagctgatttttgcagagat

SEQ ID NO: 8073537 - DNA, 17 bp, Homo sapiens
cccagctggcagtgccg

SEQ ID NO: 8073538 - DNA, 18 bp, Homo sapiens
cccagctggtgggtcagt

SEQ ID NO: 8073539 - DNA, 17 bp, Homo sapiens
cccagctggcagtgccg

SEQ ID NO: 8073540 - DNA, 22 bp, Homo sapiens
cccagctccttacagggccgaa

SEQ ID NO: 8073541 - DNA, 22 bp, Homo sapiens
cccagctccgagctccgagccg

SEQ ID NO: 8073542 - DNA, 22 bp, Homo sapiens
cccagccttccaccctggacta

SEQ ID NO: 8073543 - DNA, 22 bp, Homo sapiens
cccagcctttgcttcctggttc

SEQ ID NO: 8073544 - DNA, 22 bp, Homo sapiens
cccagcctgtctttcccaatga

SEQ ID NO: 8073545 - DNA, 22 bp, Homo sapiens
cccagcctgtgacagccgtcct

SEQ ID NO: 8073546 - DNA, 22 bp, Homo sapiens
cccagcctggtgcactgtgggg

SEQ ID NO: 8073547 - DNA, 22 bp, Homo sapiens
cccagcctactctgccatagca

SEQ ID NO: 8073548 - DNA, 22 bp, Homo sapiens
tctgtggcctgtgtccaagtgc

SEQ ID NO: 8073549 - DNA, 22 bp, Homo sapiens
tgtggggctgtggtgttcttct

SEQ ID NO: 8073550 - DNA, 22 bp, Homo sapiens
tgtggggcttacaaaggcagat

SEQ ID NO: 8073551 - DNA, 22 bp, Homo sapiens
tgtggggcagctagccggcctg

SEQ ID NO: 8073552 - DNA, 22 bp, Homo sapiens
tgtggggcctcgtgctagctgg

SEQ ID NO: 8073553 - DNA, 22 bp, Homo sapiens
tgtggggccaaagcccagccac

SEQ ID NO: 8073554 - DNA, 22 bp, Homo sapiens
tgtggggctccctggcagcctg

SEQ ID NO: 8073555 - DNA, 22 bp, Homo sapiens
tgtggggctgtcaggcaactgg

SEQ ID NO: 8073556 - DNA, 22 bp, Homo sapiens
cctgggaggcggaggttgcagg

SEQ ID NO: 8073557 - DNA, 22 bp, Homo sapiens
cctgggaggcggaggttgcagt

SEQ ID NO: 8073558 - DNA, 22 bp, Homo sapiens
cctgggcaatatagtgaggccc

SEQ ID NO: 8073559 - DNA, 22 bp, Homo sapiens
cctgggcagcctgctcaaggac

SEQ ID NO: 8073560 - DNA, 22 bp, Homo sapiens
cctgggcatcaacaagcagaga

SEQ ID NO: 8073561 - DNA, 21 bp, Homo sapiens
cctgggccaaattccctggac

SEQ ID NO: 8073562 - DNA, 23 bp, Homo sapiens
cctgggcattggctgcagcttct

SEQ ID NO: 8073563 - DNA, 22 bp, Homo sapiens
cctgggcattctttgagttctc

SEQ ID NO: 8073564 - DNA, 22 bp, Homo sapiens
cctgggcatctcatgcacctgc

SEQ ID NO: 8073565 - DNA, 22 bp, Homo sapiens
cctgggcatctcatgcacctgc

SEQ ID NO: 8073566 - DNA, 22 bp, Homo sapiens
tgtggctgctcaggtgcagacc

SEQ ID NO: 8073567 - DNA, 22 bp, Homo sapiens
cctgggagctgtggaaaggctg

SEQ ID NO: 8073568 - DNA, 22 bp, Homo sapiens
tgtggcttaagaatgcctttaa

SEQ ID NO: 8073569 - DNA, 17 bp, Homo sapiens
cctgggaggagttatga

SEQ ID NO: 8073570 - DNA, 19 bp, Homo sapiens
cctgggaggcggaggttgc

SEQ ID NO: 8073571 - DNA, 22 bp, Homo sapiens
cctgggaggcagaggttgcagt

SEQ ID NO: 8073572 - DNA, 22 bp, Homo sapiens
tgtggctgtctgttctcctagg

SEQ ID NO: 8073573 - DNA, 22 bp, Homo sapiens
cctggggaatagagtcaagggg

SEQ ID NO: 8073574 - DNA, 22 bp, Homo sapiens
cctgggtgacccgtgagcgtcc

SEQ ID NO: 8073575 - DNA, 22 bp, Homo sapiens
cctgggtggcagaggttgcagt

SEQ ID NO: 8073576 - DNA, 23 bp, Homo sapiens
tgtgttctcacacagatgcagta

SEQ ID NO: 8073577 - DNA, 22 bp, Homo sapiens
tgtgttctccaactgtagattt

SEQ ID NO: 8073578 - DNA, 19 bp, Homo sapiens
cctgggtccactcagacta

SEQ ID NO: 8073579 - DNA, 22 bp, Homo sapiens
tgtgccataggcagcgtggcca

SEQ ID NO: 8073580 - DNA, 22 bp, Homo sapiens
tgtgccatctgatataagagcc

SEQ ID NO: 8073581 - DNA, 22 bp, Homo sapiens
tgtgccaggccggggcaggaca

SEQ ID NO: 8073582 - DNA, 22 bp, Homo sapiens
tgtgccagtcatccagatgtgt

SEQ ID NO: 8073583 - DNA, 22 bp, Homo sapiens
tgtgctggggtccagctgagcc

SEQ ID NO: 8073584 - DNA, 22 bp, Homo sapiens
tgtgctggtacatgtgaggatg

SEQ ID NO: 8073585 - DNA, 22 bp, Homo sapiens
cctgggagagccatctgtggcc

SEQ ID NO: 8073586 - DNA, 22 bp, Homo sapiens
cctgggagagtctgtggtctcc

SEQ ID NO: 8073587 - DNA, 22 bp, Homo sapiens
cctgggaagcccatagcagctt

SEQ ID NO: 8073588 - DNA, 22 bp, Homo sapiens
tgtgccaggcacttgcccaggc

SEQ ID NO: 8073589 - DNA, 22 bp, Homo sapiens
tgtgccagaaaatatgctgagg

SEQ ID NO: 8073590 - DNA, 21 bp, Homo sapiens
cctgggagatcagctgccttc

SEQ ID NO: 8073591 - DNA, 22 bp, Homo sapiens
cctggctgtggcggtgctctca

SEQ ID NO: 8073592 - DNA, 21 bp, Homo sapiens
cctggcttcagggtgcactgg

SEQ ID NO: 8073593 - DNA, 22 bp, Homo sapiens
cctggcttcctggagctcacaa

SEQ ID NO: 8073594 - DNA, 18 bp, Homo sapiens
cctggcttccatcttggt

SEQ ID NO: 8073595 - DNA, 20 bp, Homo sapiens
cctggctttgcatctgtgat

SEQ ID NO: 8073596 - DNA, 22 bp, Homo sapiens
cctggctgccgagtgtgcagcg

SEQ ID NO: 8073597 - DNA, 22 bp, Homo sapiens
cctggctgcattttgctggatg

SEQ ID NO: 8073598 - DNA, 22 bp, Homo sapiens
cctggctgtcgttttgtgaaat

SEQ ID NO: 8073599 - DNA, 22 bp, Homo sapiens
tgtgaaggcagcagctctgtcc

SEQ ID NO: 8073600 - DNA, 22 bp, Homo sapiens
tgtgaagctggatcctggagct

SEQ ID NO: 8073601 - DNA, 22 bp, Homo sapiens
tgtgaggtaacgctgctctgtt

SEQ ID NO: 8073602 - DNA, 22 bp, Homo sapiens
tgtgaggagaggcccagctccc

SEQ ID NO: 8073603 - DNA, 22 bp, Homo sapiens
tgtctggtgggttgacaggcag

SEQ ID NO: 8073604 - DNA, 22 bp, Homo sapiens
tgtctggtgggttgacaggcag

SEQ ID NO: 8073605 - DNA, 22 bp, Homo sapiens
tgtctttagccagcagtcttct

SEQ ID NO: 8073606 - DNA, 22 bp, Homo sapiens
tgtctttagagtcacaaaacca

SEQ ID NO: 8073607 - DNA, 22 bp, Homo sapiens
tgtctttagttgcttagatttg

SEQ ID NO: 8073608 - DNA, 21 bp, Homo sapiens
tgtctttaggacctgttaaat

SEQ ID NO: 8073609 - DNA, 22 bp, Homo sapiens
tgtctttacttaataaatatac

SEQ ID NO: 8073610 - DNA, 22 bp, Homo sapiens
tgtctttagacctctctggcct

SEQ ID NO: 8073611 - DNA, 22 bp, Homo sapiens
tgtctttagaaagaagcagaca

SEQ ID NO: 8073612 - DNA, 22 bp, Homo sapiens
tgtctttacttagaagttcagg

SEQ ID NO: 8073613 - DNA, 22 bp, Homo sapiens
tgtctttacttagaagttcagg

SEQ ID NO: 8073614 - DNA, 22 bp, Homo sapiens
cctggctgaaccaatgaagtgg

SEQ ID NO: 8073615 - DNA, 23 bp, Homo sapiens
cctggctgacctgaaggtgtagt

SEQ ID NO: 8073616 - DNA, 22 bp, Homo sapiens
cctggctcttcgggagtttgtt

SEQ ID NO: 8073617 - DNA, 22 bp, Homo sapiens
tgtctctggcccatgagcagag

SEQ ID NO: 8073618 - DNA, 22 bp, Homo sapiens
tgtctctgtgactccttccgcc

SEQ ID NO: 8073619 - DNA, 22 bp, Homo sapiens
tgtctctgggtgattcagtcct

SEQ ID NO: 8073620 - DNA, 22 bp, Homo sapiens
tgtctctggtattaggtgaaaa

SEQ ID NO: 8073621 - DNA, 22 bp, Homo sapiens
tgtctcagttcccttctctgga

SEQ ID NO: 8073622 - DNA, 22 bp, Homo sapiens
tgtctctggcccatgagcagag

SEQ ID NO: 8073623 - DNA, 22 bp, Homo sapiens
tgtctctgtgagatctgacgat

SEQ ID NO: 8073624 - DNA, 22 bp, Homo sapiens
tgtctctgtgcatttgtgcttc

SEQ ID NO: 8073625 - DNA, 19 bp, Homo sapiens
cctggccctgctgcgcggg

SEQ ID NO: 8073626 - DNA, 22 bp, Homo sapiens
cctggctcctgcctctgcaggg

SEQ ID NO: 8073627 - DNA, 22 bp, Homo sapiens
tgtcccacaacatttgaggagg

SEQ ID NO: 8073628 - DNA, 22 bp, Homo sapiens
tgtcccagcactttgggagtct

SEQ ID NO: 8073629 - DNA, 23 bp, Homo sapiens
tgtcccagagggagggataggct

SEQ ID NO: 8073630 - DNA, 22 bp, Homo sapiens
tgtcccagatactggacataga

SEQ ID NO: 8073631 - DNA, 22 bp, Homo sapiens
tgtcccagatcacaggagggga

SEQ ID NO: 8073632 - DNA, 22 bp, Homo sapiens
cctggcagttttgcccaggatt

SEQ ID NO: 8073633 - DNA, 22 bp, Homo sapiens
cctggcagtggtgaagaagagg

SEQ ID NO: 8073634 - DNA, 22 bp, Homo sapiens
cctggcaggtggaggttgcagt

SEQ ID NO: 8073635 - DNA, 22 bp, Homo sapiens
cctggcagtcaggggagtcctt

SEQ ID NO: 8073636 - DNA, 22 bp, Homo sapiens
cctggcaggtggcgccctcggc

SEQ ID NO: 8073637 - DNA, 22 bp, Homo sapiens
cctggcaggcccctcctggatt

SEQ ID NO: 8073638 - DNA, 22 bp, Homo sapiens
cctggcagcagcacatgccttc

SEQ ID NO: 8073639 - DNA, 22 bp, Homo sapiens
cctggcagcagcacatgccttc

SEQ ID NO: 8073640 - DNA, 18 bp, Homo sapiens
cctggcagccatgcgcgc

SEQ ID NO: 8073641 - DNA, 22 bp, Homo sapiens
cctggcagcattggtagagatt

SEQ ID NO: 8073642 - DNA, 23 bp, Homo sapiens
cctggcagcaaacgaggaggtta

SEQ ID NO: 8073643 - DNA, 22 bp, Homo sapiens
tgtaggattttcaccagacctt

SEQ ID NO: 8073644 - DNA, 22 bp, Homo sapiens
cctggaggtggaggttgcagtg

SEQ ID NO: 8073645 - DNA, 22 bp, Homo sapiens
cctggagcaaaaatctaaggag

SEQ ID NO: 8073646 - DNA, 22 bp, Homo sapiens
cctggagcacagcccagtccca

SEQ ID NO: 8073647 - DNA, 22 bp, Homo sapiens
cctggagcacagcccagtccca

SEQ ID NO: 8073648 - DNA, 21 bp, Homo sapiens
cctggcagaagcctgatatgc

SEQ ID NO: 8073649 - DNA, 22 bp, Homo sapiens
cctggcagaatattaaagtgca

SEQ ID NO: 8073650 - DNA, 22 bp, Homo sapiens
cctggcagacagcactgaagct

SEQ ID NO: 8073651 - DNA, 22 bp, Homo sapiens
tgtattaacattaataaaatgg

SEQ ID NO: 8073652 - DNA, 22 bp, Homo sapiens
tggtgctgccacctcctctgct

SEQ ID NO: 8073653 - DNA, 22 bp, Homo sapiens
tggtgctgtggaggggcagaag

SEQ ID NO: 8073654 - DNA, 22 bp, Homo sapiens
tggtggccttgatggcatctgc

SEQ ID NO: 8073655 - DNA, 17 bp, Homo sapiens
tggtggctggagtcagg

SEQ ID NO: 8073656 - DNA, 22 bp, Homo sapiens
tggtggctgttgcagaactgag

SEQ ID NO: 8073657 - DNA, 22 bp, Homo sapiens
cctctgtgctttgtccagcctc

SEQ ID NO: 8073658 - DNA, 22 bp, Homo sapiens
cctgccagtgaagctgacgggc

SEQ ID NO: 8073659 - DNA, 22 bp, Homo sapiens
tggtgctgataatggcaggatt

SEQ ID NO: 8073660 - DNA, 22 bp, Homo sapiens
tggtgctcccaagattgttcta

SEQ ID NO: 8073661 - DNA, 19 bp, Homo sapiens
gttctgtgtcctggaggaa

SEQ ID NO: 8073662 - DNA, 22 bp, Homo sapiens
gttcttcaccaaggtcagaggc

SEQ ID NO: 8073663 - DNA, 22 bp, Homo sapiens
gttcttcagcattagaagtcat

SEQ ID NO: 8073664 - DNA, 22 bp, Homo sapiens
gttcttcaggctgagcagagag

SEQ ID NO: 8073665 - DNA, 22 bp, Homo sapiens
caggaaagggatgggctgccac

SEQ ID NO: 8073666 - DNA, 22 bp, Homo sapiens
caggaaaggtgtgtcatgatgg

SEQ ID NO: 8073667 - DNA, 22 bp, Homo sapiens
caggaaaggtagtcacaatgta

SEQ ID NO: 8073668 - DNA, 22 bp, Homo sapiens
caggaacagcaccaggagctag

SEQ ID NO: 8073669 - DNA, 22 bp, Homo sapiens
caggaacacaatgagtctcaaa

SEQ ID NO: 8073670 - DNA, 22 bp, Homo sapiens
caggaacaatgtaagtctcatt

SEQ ID NO: 8073671 - DNA, 22 bp, Homo sapiens
caggaacacaagttcagggatg

SEQ ID NO: 8073672 - DNA, 22 bp, Homo sapiens
caggaacatttaaccacagggt

SEQ ID NO: 8073673 - DNA, 22 bp, Homo sapiens
gtttcaaagcacagctcacatt

SEQ ID NO: 8073674 - DNA, 22 bp, Homo sapiens
gtttgcctgccgacgctctcat

SEQ ID NO: 8073675 - DNA, 22 bp, Homo sapiens
cagcttctgagcaagccagggg

SEQ ID NO: 8073676 - DNA, 22 bp, Homo sapiens
cagcttctcagaaagctgaggt

SEQ ID NO: 8073677 - DNA, 22 bp, Homo sapiens
cagcttggcttccgctttactg

SEQ ID NO: 8073678 - DNA, 22 bp, Homo sapiens
cagcttgggagtttggttttat

SEQ ID NO: 8073679 - DNA, 22 bp, Homo sapiens
cagcttgggtcaggtgcctgct

SEQ ID NO: 8073680 - DNA, 22 bp, Homo sapiens
cagcttggaggaggatctaaga

SEQ ID NO: 8073681 - DNA, 20 bp, Homo sapiens
cagcttggatgagaggctga

SEQ ID NO: 8073682 - DNA, 22 bp, Homo sapiens
caggaaacatatgtgcttgagg

SEQ ID NO: 8073683 - DNA, 22 bp, Homo sapiens
caggaaagaaatgagaacacca

SEQ ID NO: 8073684 - DNA, 22 bp, Homo sapiens
caggaaagagctgccaggcagg

SEQ ID NO: 8073685 - DNA, 22 bp, Homo sapiens
cagctttgaaacatggctctag

SEQ ID NO: 8073686 - DNA, 22 bp, Homo sapiens
caggaaaatctgcccacacaag

SEQ ID NO: 8073687 - DNA, 22 bp, Homo sapiens
cagctgtggggagcttgggcca

SEQ ID NO: 8073688 - DNA, 22 bp, Homo sapiens
cagctgtgtaaacacatgtgta

SEQ ID NO: 8073689 - DNA, 22 bp, Homo sapiens
cagctgtgtagatgcagggtca

SEQ ID NO: 8073690 - DNA, 22 bp, Homo sapiens
cagctgtggagggaggaaatgc

SEQ ID NO: 8073691 - DNA, 22 bp, Homo sapiens
cagctgtggctgccactgctcc

SEQ ID NO: 8073692 - DNA, 22 bp, Homo sapiens
cagctgtgctgattgctcagta

SEQ ID NO: 8073693 - DNA, 22 bp, Homo sapiens
cagcttccatctccactgccct

SEQ ID NO: 8073694 - DNA, 22 bp, Homo sapiens
cagcttccataagagatggaga

SEQ ID NO: 8073695 - DNA, 22 bp, Homo sapiens
gtgtttggtcagacgtccgggg

SEQ ID NO: 8073696 - DNA, 20 bp, Homo sapiens
gtgtgtgctccatgcatgct

SEQ ID NO: 8073697 - DNA, 22 bp, Homo sapiens
gtgtgtgctccccaggagagct

SEQ ID NO: 8073698 - DNA, 22 bp, Homo sapiens
cagctggctggtcagtgcacaa

SEQ ID NO: 8073699 - DNA, 22 bp, Homo sapiens
gtgtgctgcccaactcgcagat

SEQ ID NO: 8073700 - DNA, 22 bp, Homo sapiens
cagctgtctgaagcaggagtcc

SEQ ID NO: 8073701 - DNA, 22 bp, Homo sapiens
cagctgtctttgcacagtttag

SEQ ID NO: 8073702 - DNA, 22 bp, Homo sapiens
cagctgtctggggagtgctcgc

SEQ ID NO: 8073703 - DNA, 22 bp, Homo sapiens
gtgtctgcaagatagccaagtc

SEQ ID NO: 8073704 - DNA, 22 bp, Homo sapiens
gtgtctgctgcaccctcacacc

SEQ ID NO: 8073705 - DNA, 20 bp, Homo sapiens
gtgtgaagccctcaggagga

SEQ ID NO: 8073706 - DNA, 22 bp, Homo sapiens
gtgtgaaagttcctaagactat

SEQ ID NO: 8073707 - DNA, 22 bp, Homo sapiens
gtgtatgatttcaaatggctag

SEQ ID NO: 8073708 - DNA, 22 bp, Homo sapiens
gtgtacatattgagtctgctga

SEQ ID NO: 8073709 - DNA, 22 bp, Homo sapiens
gtggggcatgcacgctgctcct

SEQ ID NO: 8073710 - DNA, 22 bp, Homo sapiens
gtggggagtgttctgtgattgg

SEQ ID NO: 8073711 - DNA, 22 bp, Homo sapiens
gtggggcagtggcctgggagca

SEQ ID NO: 8073712 - DNA, 19 bp, Homo sapiens
cagctgcaccgtgaccatc

SEQ ID NO: 8073713 - DNA, 22 bp, Homo sapiens
cagctgcaggagaaacagaggc

SEQ ID NO: 8073714 - DNA, 22 bp, Homo sapiens
cagctgcagaaagcaagcaggt

SEQ ID NO: 8073715 - DNA, 22 bp, Homo sapiens
cagctgccacaggactttctga

SEQ ID NO: 8073716 - DNA, 22 bp, Homo sapiens
cagctgccacacctctttctct

SEQ ID NO: 8073717 - DNA, 22 bp, Homo sapiens
cagctgccaagaatcttttcta

SEQ ID NO: 8073718 - DNA, 22 bp, Homo sapiens
cagctgcatgtctgtggtggtc

SEQ ID NO: 8073719 - DNA, 22 bp, Homo sapiens
cagctgctgttcagttttgttt

SEQ ID NO: 8073720 - DNA, 22 bp, Homo sapiens
cagctgctgttcagttttgttt

SEQ ID NO: 8073721 - DNA, 22 bp, Homo sapiens
cagctgcctgtctggaggcaat

SEQ ID NO: 8073722 - DNA, 22 bp, Homo sapiens
cagctggccctttggtagcctt

SEQ ID NO: 8073723 - DNA, 22 bp, Homo sapiens
cagctggcgtggagtgattgca

SEQ ID NO: 8073724 - DNA, 22 bp, Homo sapiens
gtggctttcatttcaggatgtg

SEQ ID NO: 8073725 - DNA, 22 bp, Homo sapiens
gtggcttctgcggtgtgcgcag

SEQ ID NO: 8073726 - DNA, 22 bp, Homo sapiens
cagctctttttcacacaacatg

SEQ ID NO: 8073727 - DNA, 22 bp, Homo sapiens
cagctgaacatgtagagcatct

SEQ ID NO: 8073728 - DNA, 22 bp, Homo sapiens
cagctcttcctagccatgccac

SEQ ID NO: 8073729 - DNA, 22 bp, Homo sapiens
cagctcttattttctctcctaa

SEQ ID NO: 8073730 - DNA, 20 bp, Homo sapiens
gtggcctgtcctgttgtggg

SEQ ID NO: 8073731 - DNA, 22 bp, Homo sapiens
gtggcctgtcagaagccgtggg

SEQ ID NO: 8073732 - DNA, 22 bp, Homo sapiens
cagctgagtgttggcatgttca

SEQ ID NO: 8073733 - DNA, 22 bp, Homo sapiens
cagctgagctcccaggccatca

SEQ ID NO: 8073734 - DNA, 23 bp, Homo sapiens
cagctgaagcagcctgggctgga

SEQ ID NO: 8073735 - DNA, 22 bp, Homo sapiens
cagctgaggtcaaagaagcagg

SEQ ID NO: 8073736 - DNA, 22 bp, Homo sapiens
cagctgagtctgaggttctttg

SEQ ID NO: 8073737 - DNA, 22 bp, Homo sapiens
gtggagccctgccttgctcatg

SEQ ID NO: 8073738 - DNA, 19 bp, Homo sapiens
gtggccagggcaggggctg

SEQ ID NO: 8073739 - DNA, 22 bp, Homo sapiens
tacaggggtaacagtggggaat

SEQ ID NO: 8073740 - DNA, 22 bp, Homo sapiens
tacaatacttaacctattttgc

SEQ ID NO: 8073741 - DNA, 22 bp, Homo sapiens
tacaagtgctagcagatattgt

SEQ ID NO: 8073742 - DNA, 22 bp, Homo sapiens
tacaagttgcagaaagttgttt

SEQ ID NO: 8073743 - DNA, 20 bp, Homo sapiens
tacaagtacattatagttat

SEQ ID NO: 8073744 - DNA, 22 bp, Homo sapiens
tacaaatgagttgtatgaacca

SEQ ID NO: 8073745 - DNA, 22 bp, Homo sapiens
tacaaatgcctgacacacagat

SEQ ID NO: 8073746 - DNA, 20 bp, Homo sapiens
tacaaattttccatgtttcc

SEQ ID NO: 8073747 - DNA, 22 bp, Homo sapiens
tacaaattaatgggcatgttta

SEQ ID NO: 8073748 - DNA, 22 bp, Homo sapiens
tacaaatgggttaaaatatagt

SEQ ID NO: 8073749 - DNA, 22 bp, Homo sapiens
tacatattcaacgttcagtatt

SEQ ID NO: 8073750 - DNA, 22 bp, Homo sapiens
tacagtaaccagtctacttaga

SEQ ID NO: 8073751 - DNA, 22 bp, Homo sapiens
caggccctgggcaggcacagag

SEQ ID NO: 8073752 - DNA, 18 bp, Homo sapiens
caggccctgtctggcctc

SEQ ID NO: 8073753 - DNA, 22 bp, Homo sapiens
caggccctggcagggctgagtc

SEQ ID NO: 8073754 - DNA, 22 bp, Homo sapiens
caggccctgggcaggatcagcc

SEQ ID NO: 8073755 - DNA, 22 bp, Homo sapiens
caggccctgggcaggatcagcc

SEQ ID NO: 8073756 - DNA, 22 bp, Homo sapiens
caggcagcaggagccctgctcg

SEQ ID NO: 8073757 - DNA, 22 bp, Homo sapiens
caggcagcagccactctggtat

SEQ ID NO: 8073758 - DNA, 22 bp, Homo sapiens
caggcagcatcagtctgctgta

SEQ ID NO: 8073759 - DNA, 22 bp, Homo sapiens
caggcagccaggggacctgtcc

SEQ ID NO: 8073760 - DNA, 22 bp, Homo sapiens
caggcagcatttactctgatga

SEQ ID NO: 8073761 - DNA, 22 bp, Homo sapiens
caggcagctgactgtcagatat

SEQ ID NO: 8073762 - DNA, 22 bp, Homo sapiens
caggcagccaggggacctgtcc

SEQ ID NO: 8073763 - DNA, 22 bp, Homo sapiens
caggcagctcgatgccttgttg

SEQ ID NO: 8073764 - DNA, 23 bp, Homo sapiens
caggcaggatgaggactacactc

SEQ ID NO: 8073765 - DNA, 22 bp, Homo sapiens
caggcagggagccactgtataa

SEQ ID NO: 8073766 - DNA, 22 bp, Homo sapiens
caggcagctgcgacaagagagc

SEQ ID NO: 8073767 - DNA, 22 bp, Homo sapiens
caggcagctgctgggttcagcc

SEQ ID NO: 8073768 - DNA, 22 bp, Homo sapiens
caggcagactttgagaatgatg

SEQ ID NO: 8073769 - DNA, 22 bp, Homo sapiens
caggcagaagaagtggaaggac

SEQ ID NO: 8073770 - DNA, 22 bp, Homo sapiens
taattgtaaagtagtagtacag

SEQ ID NO: 8073771 - DNA, 22 bp, Homo sapiens
taattgtacgatgttaaatcag

SEQ ID NO: 8073772 - DNA, 22 bp, Homo sapiens
taagacacattggagtagatga

SEQ ID NO: 8073773 - DNA, 22 bp, Homo sapiens
caggcacagtgttgctgttcaa

SEQ ID NO: 8073774 - DNA, 22 bp, Homo sapiens
caggatggtggcatgatcagaa

SEQ ID NO: 8073775 - DNA, 22 bp, Homo sapiens
caggatggtcttcatttggctc

SEQ ID NO: 8073776 - DNA, 22 bp, Homo sapiens
taacagaaaggggacagaaata

SEQ ID NO: 8073777 - DNA, 22 bp, Homo sapiens
taacagaaatagaaatgagagt

SEQ ID NO: 8073778 - DNA, 22 bp, Homo sapiens
taacagaaatagtaggtgaggg

SEQ ID NO: 8073779 - DNA, 22 bp, Homo sapiens
taacagaaatagtaggtgaggg

SEQ ID NO: 8073780 - DNA, 22 bp, Homo sapiens
taacagaagagcaggcagccct

SEQ ID NO: 8073781 - DNA, 22 bp, Homo sapiens
taacagaagaaaacatattgga

SEQ ID NO: 8073782 - DNA, 22 bp, Homo sapiens
taacagaagatgaaacttcttt

SEQ ID NO: 8073783 - DNA, 22 bp, Homo sapiens
taacagaaatatttccaggtga

SEQ ID NO: 8073784 - DNA, 22 bp, Homo sapiens
taacagaaattttagttagggg

SEQ ID NO: 8073785 - DNA, 22 bp, Homo sapiens
taacattcctcaaagttttcag

SEQ ID NO: 8073786 - DNA, 22 bp, Homo sapiens
taacagaagttgttcattgtgg

SEQ ID NO: 8073787 - DNA, 20 bp, Homo sapiens
taacagaagtagaagtgggt

SEQ ID NO: 8073788 - DNA, 22 bp, Homo sapiens
taacagaaacagataagtgtaa

SEQ ID NO: 8073789 - DNA, 22 bp, Homo sapiens
taacagaaaggctcaggtgctc

SEQ ID NO: 8073790 - DNA, 22 bp, Homo sapiens
taacagaaaagaactgagtttg

SEQ ID NO: 8073791 - DNA, 19 bp, Homo sapiens
caggagagcatgcactttg

SEQ ID NO: 8073792 - DNA, 15 bp, Homo sapiens
caggagaggaaggtt

SEQ ID NO: 8073793 - DNA, 22 bp, Homo sapiens
caggagaggaggctacttctta

SEQ ID NO: 8073794 - DNA, 22 bp, Homo sapiens
caggagagcccgggtccgggct

SEQ ID NO: 8073795 - DNA, 22 bp, Homo sapiens
caggagagatatgagtccccac

SEQ ID NO: 8073796 - DNA, 22 bp, Homo sapiens
caggagcaaatccaaaagaatt

SEQ ID NO: 8073797 - DNA, 22 bp, Homo sapiens
caggagaggctgtacgtttctc

SEQ ID NO: 8073798 - DNA, 22 bp, Homo sapiens
caggagcccgttgctccggcgg

SEQ ID NO: 8073799 - DNA, 22 bp, Homo sapiens
caggagctctcatcgtcagggc

SEQ ID NO: 8073800 - DNA, 22 bp, Homo sapiens
taaatcaagaatatcagcttgt

SEQ ID NO: 8073801 - DNA, 22 bp, Homo sapiens
taaatatgcatgtatccttatc

SEQ ID NO: 8073802 - DNA, 22 bp, Homo sapiens
taaatatcacctggaattgtta

SEQ ID NO: 8073803 - DNA, 22 bp, Homo sapiens
taaagccaatatacctagcata

SEQ ID NO: 8073804 - DNA, 22 bp, Homo sapiens
taaagtcagatatctgggttga

SEQ ID NO: 8073805 - DNA, 22 bp, Homo sapiens
taaagtcataagagtggatccg

SEQ ID NO: 8073806 - DNA, 23 bp, Homo sapiens
taaagtcacatattagagtgagc

SEQ ID NO: 8073807 - DNA, 22 bp, Homo sapiens
taaagtcatctttacatctttg

SEQ ID NO: 8073808 - DNA, 22 bp, Homo sapiens
taaagtcatctttaaacatgcc

SEQ ID NO: 8073809 - DNA, 22 bp, Homo sapiens
taaagtcatctttacatctttg

SEQ ID NO: 8073810 - DNA, 20 bp, Homo sapiens
caggaggcaaggtcaaggtc

SEQ ID NO: 8073811 - DNA, 22 bp, Homo sapiens
caggaggaacaagaggttctgg

SEQ ID NO: 8073812 - DNA, 22 bp, Homo sapiens
caggaggaaatgtgaccctgct

SEQ ID NO: 8073813 - DNA, 22 bp, Homo sapiens
caggagcttctgcccatggcca

SEQ ID NO: 8073814 - DNA, 22 bp, Homo sapiens
caggagctggatctccttgcgg

SEQ ID NO: 8073815 - DNA, 22 bp, Homo sapiens
taaatgtctgttaacatgaatg

SEQ ID NO: 8073816 - DNA, 22 bp, Homo sapiens
caggagtgcaggtggtgaggca

SEQ ID NO: 8073817 - DNA, 22 bp, Homo sapiens
caggagtgagatgcgatcactt

SEQ ID NO: 8073818 - DNA, 22 bp, Homo sapiens
caggagtgagttggggtctaca

SEQ ID NO: 8073819 - DNA, 22 bp, Homo sapiens
caggagtgaaatgaggcccagg

SEQ ID NO: 8073820 - DNA, 22 bp, Homo sapiens
caggagtgtctccacacagcaa

SEQ ID NO: 8073821 - DNA, 22 bp, Homo sapiens
caggagtggtgtgagggactcc

SEQ ID NO: 8073822 - DNA, 20 bp, Homo sapiens
caggagggacatttcagcat

SEQ ID NO: 8073823 - DNA, 22 bp, Homo sapiens
caggaggctcctagggctctgt

SEQ ID NO: 8073824 - DNA, 22 bp, Homo sapiens
caggaggccaactgtgggactt

SEQ ID NO: 8073825 - DNA, 22 bp, Homo sapiens
taaactcttctgtagaatcaga

SEQ ID NO: 8073826 - DNA, 22 bp, Homo sapiens
taaaatgatctctcatgttctt

SEQ ID NO: 8073827 - DNA, 22 bp, Homo sapiens
caggagacaagttagcagctga

SEQ ID NO: 8073828 - DNA, 22 bp, Homo sapiens
caggagactatggcccaaggcc

SEQ ID NO: 8073829 - DNA, 22 bp, Homo sapiens
caggagacaatggctgtggggc

SEQ ID NO: 8073830 - DNA, 22 bp, Homo sapiens
caggagaaggtttggagtgcag

SEQ ID NO: 8073831 - DNA, 22 bp, Homo sapiens
caggaccccatattcactgaac

SEQ ID NO: 8073832 - DNA, 23 bp, Homo sapiens
caggacatgggaggaagtatggc

SEQ ID NO: 8073833 - DNA, 22 bp, Homo sapiens
caggacatcgtcatcatgggga

SEQ ID NO: 8073834 - DNA, 22 bp, Homo sapiens
taaaaaacattactctgtcctg

SEQ ID NO: 8073835 - DNA, 22 bp, Homo sapiens
gttttctcaggatggtgtgtac

SEQ ID NO: 8073836 - DNA, 22 bp, Homo sapiens
taaaatgacttcctccaacatc

SEQ ID NO: 8073837 - DNA, 22 bp, Homo sapiens
taaaatgacttcctccaacatc

SEQ ID NO: 8073838 - DNA, 22 bp, Homo sapiens
caggacactaaaaagccaagct

SEQ ID NO: 8073839 - DNA, 22 bp, Homo sapiens
gttttccaggtaccttggtatt

SEQ ID NO: 8073840 - DNA, 18 bp, Homo sapiens
gttttccatttgttcctc

SEQ ID NO: 8073841 - DNA, 22 bp, Homo sapiens
gttttccatggaggtctgacct

SEQ ID NO: 8073842 - DNA, 22 bp, Homo sapiens
caggacaggtgttctagatcag

SEQ ID NO: 8073843 - DNA, 22 bp, Homo sapiens
caggacacatttcttgttcagg

SEQ ID NO: 8073844 - DNA, 22 bp, Homo sapiens
caggacaattttgagccacctg

SEQ ID NO: 8073845 - DNA, 22 bp, Homo sapiens
caggaagccacaggacaggtag

SEQ ID NO: 8073846 - DNA, 22 bp, Homo sapiens
gtttggggtctgcagagcggcg

SEQ ID NO: 8073847 - DNA, 22 bp, Homo sapiens
ccagctccagcatagccaccat

SEQ ID NO: 8073848 - DNA, 22 bp, Homo sapiens
ccagctccaagtttgggcatca

SEQ ID NO: 8073849 - DNA, 22 bp, Homo sapiens
ccagccttctgagctgcctgga

SEQ ID NO: 8073850 - DNA, 23 bp, Homo sapiens
ccagcgctcactcagagcatgtt

SEQ ID NO: 8073851 - DNA, 22 bp, Homo sapiens
ccagcctttgcatcccccatct

SEQ ID NO: 8073852 - DNA, 22 bp, Homo sapiens
ccagccttgcaccgagccagcc

SEQ ID NO: 8073853 - DNA, 22 bp, Homo sapiens
ccagccttctgggactctcatc

SEQ ID NO: 8073854 - DNA, 22 bp, Homo sapiens
ccagccttgactgccccagcac

SEQ ID NO: 8073855 - DNA, 22 bp, Homo sapiens
ccagcctggagggcagtggtgg

SEQ ID NO: 8073856 - DNA, 22 bp, Homo sapiens
ccagctcctcttgtctctagca

SEQ ID NO: 8073857 - DNA, 21 bp, Homo sapiens
ccagctccaggaccttggatc

SEQ ID NO: 8073858 - DNA, 22 bp, Homo sapiens
ccagctctaaacggctctgtgg

SEQ ID NO: 8073859 - DNA, 22 bp, Homo sapiens
ccagctccttctgtctgtggag

SEQ ID NO: 8073860 - DNA, 22 bp, Homo sapiens
ccagctcctgggtcttagtcag

SEQ ID NO: 8073861 - DNA, 22 bp, Homo sapiens
tctgccagaagttctgagagta

SEQ ID NO: 8073862 - DNA, 22 bp, Homo sapiens
tctcttaataagtaaatactga

SEQ ID NO: 8073863 - DNA, 22 bp, Homo sapiens
ccagccactgggccactgccag

SEQ ID NO: 8073864 - DNA, 22 bp, Homo sapiens
ccagccagtcccgcatgaccgc

SEQ ID NO: 8073865 - DNA, 22 bp, Homo sapiens
ccagccctacagtatcacctgt

SEQ ID NO: 8073866 - DNA, 22 bp, Homo sapiens
ccagccctcactgaggcctctc

SEQ ID NO: 8073867 - DNA, 22 bp, Homo sapiens
ccagccatgcacaaaccatgag

SEQ ID NO: 8073868 - DNA, 21 bp, Homo sapiens
ccagcccagcctccttctctt

SEQ ID NO: 8073869 - DNA, 19 bp, Homo sapiens
ccagcccatagtccatcac

SEQ ID NO: 8073870 - DNA, 22 bp, Homo sapiens
ccagccccgggaacctggccgt

SEQ ID NO: 8073871 - DNA, 22 bp, Homo sapiens
ccagccccgggaacctggccgt

SEQ ID NO: 8073872 - DNA, 22 bp, Homo sapiens
ccagccccgggccttaccgtgc

SEQ ID NO: 8073873 - DNA, 22 bp, Homo sapiens
ccagcccctatcctcgctccac

SEQ ID NO: 8073874 - DNA, 22 bp, Homo sapiens
ccaggaggcagaagttgcagtg

SEQ ID NO: 8073875 - DNA, 23 bp, Homo sapiens
tctgtcttgtttaggccactgtt

SEQ ID NO: 8073876 - DNA, 22 bp, Homo sapiens
tctgtcttggccagccatctgg

SEQ ID NO: 8073877 - DNA, 21 bp, Homo sapiens
tctgtcttcctcagcctaagg

SEQ ID NO: 8073878 - DNA, 22 bp, Homo sapiens
tctgtcttagccatctcaggct

SEQ ID NO: 8073879 - DNA, 22 bp, Homo sapiens
tctgtcttcatcagcatgtgat

SEQ ID NO: 8073880 - DNA, 21 bp, Homo sapiens
tctgtctggttttagagtggc

SEQ ID NO: 8073881 - DNA, 18 bp, Homo sapiens
tctgtctgtacaagtatc

SEQ ID NO: 8073882 - DNA, 22 bp, Homo sapiens
ccaggaggcagaggttacagtg

SEQ ID NO: 8073883 - DNA, 22 bp, Homo sapiens
ccaggaggcggaaggtacagtg

SEQ ID NO: 8073884 - DNA, 22 bp, Homo sapiens
tctggagcttgtttcagatggt

SEQ ID NO: 8073885 - DNA, 22 bp, Homo sapiens
tctggagctggagggcaaggca

SEQ ID NO: 8073886 - DNA, 22 bp, Homo sapiens
tctggagctggcagggccctgg

SEQ ID NO: 8073887 - DNA, 22 bp, Homo sapiens
tctggagctggcagggccctgg

SEQ ID NO: 8073888 - DNA, 22 bp, Homo sapiens
tctggagcttcctcatttacag

SEQ ID NO: 8073889 - DNA, 22 bp, Homo sapiens
tctggagctggagggcaaggca

SEQ ID NO: 8073890 - DNA, 22 bp, Homo sapiens
ccagctgtttctgatgctaggc

SEQ ID NO: 8073891 - DNA, 22 bp, Homo sapiens
ccagctgtgctgttggcttgtc

SEQ ID NO: 8073892 - DNA, 22 bp, Homo sapiens
ccagctgtgcctaggagcaggg

SEQ ID NO: 8073893 - DNA, 22 bp, Homo sapiens
ccagctgtgccggggacctggg

SEQ ID NO: 8073894 - DNA, 18 bp, Homo sapiens
ccagctgtgcagcatctg

SEQ ID NO: 8073895 - DNA, 22 bp, Homo sapiens
ccagctgtctggttccagagcc

SEQ ID NO: 8073896 - DNA, 22 bp, Homo sapiens
ccagctgtcttgagaggaggca

SEQ ID NO: 8073897 - DNA, 22 bp, Homo sapiens
ccagctggtctgtgctcatgtt

SEQ ID NO: 8073898 - DNA, 22 bp, Homo sapiens
tctggagccttggatgggaaag

SEQ ID NO: 8073899 - DNA, 19 bp, Homo sapiens
tctggagctgatgcaggtg

SEQ ID NO: 8073900 - DNA, 22 bp, Homo sapiens
tctggagcgaggtccctgtctg

SEQ ID NO: 8073901 - DNA, 22 bp, Homo sapiens
tctgcctgaaccactcttggag

SEQ ID NO: 8073902 - DNA, 22 bp, Homo sapiens
tctgcctgaaattcacatgtaa

SEQ ID NO: 8073903 - DNA, 22 bp, Homo sapiens
tctgcctgaaattcacatgtaa

SEQ ID NO: 8073904 - DNA, 18 bp, Homo sapiens
ccacagcagagttcttac

SEQ ID NO: 8073905 - DNA, 22 bp, Homo sapiens
ccacagccattccagggaggct

SEQ ID NO: 8073906 - DNA, 23 bp, Homo sapiens
ccacagctatagggtagtgcagt

SEQ ID NO: 8073907 - DNA, 22 bp, Homo sapiens
ccacaatttatgtattctccta

SEQ ID NO: 8073908 - DNA, 21 bp, Homo sapiens
ccacaattctagttacatatg

SEQ ID NO: 8073909 - DNA, 22 bp, Homo sapiens
ccacaaattaggttttgcttgt

SEQ ID NO: 8073910 - DNA, 22 bp, Homo sapiens
tcctcccacataggacaatggg

SEQ ID NO: 8073911 - DNA, 22 bp, Homo sapiens
ccaaagtgctggggttacaggc

SEQ ID NO: 8073912 - DNA, 22 bp, Homo sapiens
ccaaagtgctggggttacaggc

SEQ ID NO: 8073913 - DNA, 23 bp, Homo sapiens
tcctcccaaatttcagcctcatt

SEQ ID NO: 8073914 - DNA, 23 bp, Homo sapiens
tcctcccaaatttcagcctcatt

SEQ ID NO: 8073915 - DNA, 22 bp, Homo sapiens
ccaaatgctccactgactttgg

SEQ ID NO: 8073916 - DNA, 22 bp, Homo sapiens
ccaaagtgctaggattacaggc

SEQ ID NO: 8073917 - DNA, 22 bp, Homo sapiens
ccaaagtctggagcagcagagc

SEQ ID NO: 8073918 - DNA, 22 bp, Homo sapiens
ccaaagtctgcattttaacatg

SEQ ID NO: 8073919 - DNA, 23 bp, Homo sapiens
ccaaagtcgaagtctagtccaga

SEQ ID NO: 8073920 - DNA, 22 bp, Homo sapiens
ccaaagtccatagtttacttta

SEQ ID NO: 8073921 - DNA, 22 bp, Homo sapiens
ccaaagtcctttctccacctgc

SEQ ID NO: 8073922 - DNA, 23 bp, Homo sapiens
ccaaagtcgaagtctagtccaga

SEQ ID NO: 8073923 - DNA, 22 bp, Homo sapiens
ccaaagtgctaggattacaggt

SEQ ID NO: 8073924 - DNA, 22 bp, Homo sapiens
ccaaagtgctgagattacaggt

SEQ ID NO: 8073925 - DNA, 22 bp, Homo sapiens
ccaaagtgctgggattacaggc

SEQ ID NO: 8073926 - DNA, 22 bp, Homo sapiens
ccaaagtgctgggattacaggt

SEQ ID NO: 8073927 - DNA, 22 bp, Homo sapiens
ccaaagtcagtgctcagtcgtc

SEQ ID NO: 8073928 - DNA, 22 bp, Homo sapiens
ccaaagtccacagtttacatta

SEQ ID NO: 8073929 - DNA, 22 bp, Homo sapiens
ccaaagtccatagtttacatta

SEQ ID NO: 8073930 - DNA, 22 bp, Homo sapiens
ccaaagtccatagtttacataa

SEQ ID NO: 8073931 - DNA, 22 bp, Homo sapiens
ccaaagtcagtgctcagtcgtc

SEQ ID NO: 8073932 - DNA, 22 bp, Homo sapiens
catttgaagacttagaagagga

SEQ ID NO: 8073933 - DNA, 22 bp, Homo sapiens
catttgcatatgaagaagtaag

SEQ ID NO: 8073934 - DNA, 22 bp, Homo sapiens
catttgcaaaccaacaagatga

SEQ ID NO: 8073935 - DNA, 22 bp, Homo sapiens
catttgcagagggtgacactct

SEQ ID NO: 8073936 - DNA, 22 bp, Homo sapiens
catttgcaagagataaatgttt

SEQ ID NO: 8073937 - DNA, 21 bp, Homo sapiens
tcccagggccaggtgccatca

SEQ ID NO: 8073938 - DNA, 22 bp, Homo sapiens
tcccagggcagctgtccagaag

SEQ ID NO: 8073939 - DNA, 22 bp, Homo sapiens
catttatataaaatgtccagaa

SEQ ID NO: 8073940 - DNA, 22 bp, Homo sapiens
catttatataaaatgtccagaa

SEQ ID NO: 8073941 - DNA, 22 bp, Homo sapiens
catttattagttagttcgatgt

SEQ ID NO: 8073942 - DNA, 22 bp, Homo sapiens
tcccagggtcagtggtgaggcc

SEQ ID NO: 8073943 - DNA, 22 bp, Homo sapiens
catttagagaagattacaagga

SEQ ID NO: 8073944 - DNA, 22 bp, Homo sapiens
catttacacttctaaccacaag

SEQ ID NO: 8073945 - DNA, 20 bp, Homo sapiens
tcctggtggatactgcttaa

SEQ ID NO: 8073946 - DNA, 22 bp, Homo sapiens
ccacagggtcagccactctgca

SEQ ID NO: 8073947 - DNA, 22 bp, Homo sapiens
ccacagggtgtcatcagcttga

SEQ ID NO: 8073948 - DNA, 22 bp, Homo sapiens
ccactctgattttggctccact

SEQ ID NO: 8073949 - DNA, 22 bp, Homo sapiens
ccactctgctgtgctccatgat

SEQ ID NO: 8073950 - DNA, 22 bp, Homo sapiens
ccacagtcctggcttctgtctg

SEQ ID NO: 8073951 - DNA, 22 bp, Homo sapiens
ccacagtccgggctggcaggac

SEQ ID NO: 8073952 - DNA, 22 bp, Homo sapiens
ccacagtctatgcaacaaggtc

SEQ ID NO: 8073953 - DNA, 22 bp, Homo sapiens
ccacagtctagctagaaggcat

SEQ ID NO: 8073954 - DNA, 22 bp, Homo sapiens
ccagaaggcggagattgcagtg

SEQ ID NO: 8073955 - DNA, 22 bp, Homo sapiens
ccagaagaggacacagtgtgga

SEQ ID NO: 8073956 - DNA, 22 bp, Homo sapiens
ccagaagagatcacagttcttg

SEQ ID NO: 8073957 - DNA, 22 bp, Homo sapiens
ccagaatagaaggcagctgtca

SEQ ID NO: 8073958 - DNA, 22 bp, Homo sapiens
ccagaagggctattgcagtgac

SEQ ID NO: 8073959 - DNA, 19 bp, Homo sapiens
ccagaagggcagctatgga

SEQ ID NO: 8073960 - DNA, 20 bp, Homo sapiens
ccagaaggtttgccactttc

SEQ ID NO: 8073961 - DNA, 18 bp, Homo sapiens
ccagagctggctcctcgc

SEQ ID NO: 8073962 - DNA, 18 bp, Homo sapiens
ccagagctggctcctcgc

SEQ ID NO: 8073963 - DNA, 22 bp, Homo sapiens
ccagagctgatgggcccagggt

SEQ ID NO: 8073964 - DNA, 22 bp, Homo sapiens
ccagacaggaacacacatctcc

SEQ ID NO: 8073965 - DNA, 22 bp, Homo sapiens
ccagagcctgctgagccccatt

SEQ ID NO: 8073966 - DNA, 22 bp, Homo sapiens
tctcccacagtctcccatggct

SEQ ID NO: 8073967 - DNA, 22 bp, Homo sapiens
tctcccacagccgtgcttcaag

SEQ ID NO: 8073968 - DNA, 21 bp, Homo sapiens
tctctacactttcactaggct

SEQ ID NO: 8073969 - DNA, 22 bp, Homo sapiens
ccagatgagaccacactgctgg

SEQ ID NO: 8073970 - DNA, 22 bp, Homo sapiens
tcacttcccagacggggtggca

SEQ ID NO: 8073971 - DNA, 22 bp, Homo sapiens
tcagaaaggttgagtcatgtgc

SEQ ID NO: 8073972 - DNA, 22 bp, Homo sapiens
tcagaaagtgaactgttgacat

SEQ ID NO: 8073973 - DNA, 22 bp, Homo sapiens
tcacttcccagacggggtggca

SEQ ID NO: 8073974 - DNA, 22 bp, Homo sapiens
tcactcaggctggagtgcagtg

SEQ ID NO: 8073975 - DNA, 21 bp, Homo sapiens
tcagaacaattccatgcctcc

SEQ ID NO: 8073976 - DNA, 22 bp, Homo sapiens
tcagaagctggtgtcctttgaa

SEQ ID NO: 8073977 - DNA, 22 bp, Homo sapiens
cagtgctgtgtttgctgcctgg

SEQ ID NO: 8073978 - DNA, 22 bp, Homo sapiens
cagtgctgttgggcccagagag

SEQ ID NO: 8073979 - DNA, 20 bp, Homo sapiens
tatttacaacttagagcctc

SEQ ID NO: 8073980 - DNA, 22 bp, Homo sapiens
tatttagaatgcgtgtacgtgt

SEQ ID NO: 8073981 - DNA, 22 bp, Homo sapiens
tatttagaacagacaatagaaa

SEQ ID NO: 8073982 - DNA, 22 bp, Homo sapiens
tattggaatttagttagagaat

SEQ ID NO: 8073983 - DNA, 22 bp, Homo sapiens
cagtcctgggtgcagcaggaaa

SEQ ID NO: 8073984 - DNA, 22 bp, Homo sapiens
cagtccttaaggaaacatttgt

SEQ ID NO: 8073985 - DNA, 22 bp, Homo sapiens
cagtcctgttcctggagtagtt

SEQ ID NO: 8073986 - DNA, 22 bp, Homo sapiens
cagtccttggcaagttctcagt

SEQ ID NO: 8073987 - DNA, 22 bp, Homo sapiens
cagtccttgctctgggatgatg

SEQ ID NO: 8073988 - DNA, 22 bp, Homo sapiens
cagtccttgctcaaagtctaca

SEQ ID NO: 8073989 - DNA, 22 bp, Homo sapiens
cagtccttgctatgaccctgag

SEQ ID NO: 8073990 - DNA, 22 bp, Homo sapiens
cagtccttgatccaatagtggg

SEQ ID NO: 8073991 - DNA, 22 bp, Homo sapiens
cagtccttagtctggatggctt

SEQ ID NO: 8073992 - DNA, 22 bp, Homo sapiens
cagtccttattcctatattcct

SEQ ID NO: 8073993 - DNA, 22 bp, Homo sapiens
cagtccttagattttactgcca

SEQ ID NO: 8073994 - DNA, 22 bp, Homo sapiens
cagtccttctccattaaggctc

SEQ ID NO: 8073995 - DNA, 22 bp, Homo sapiens
cagtccttccttgccccttggg

SEQ ID NO: 8073996 - DNA, 22 bp, Homo sapiens
cagtccttcattcctcctttga

SEQ ID NO: 8073997 - DNA, 22 bp, Homo sapiens
cagtcctttcaatggtgacctt

SEQ ID NO: 8073998 - DNA, 22 bp, Homo sapiens
cagtccttggcttcatccgagt

SEQ ID NO: 8073999 - DNA, 19 bp, Homo sapiens
cagtcctttccgctttctc

SEQ ID NO: 8074000 - DNA, 22 bp, Homo sapiens
cagtcctttctgaaatcctata

SEQ ID NO: 8074001 - DNA, 17 bp, Homo sapiens
cagtcgaggaggacctg

SEQ ID NO: 8074002 - DNA, 17 bp, Homo sapiens
cagtgcagagccctttc

SEQ ID NO: 8074003 - DNA, 22 bp, Homo sapiens
cagtgcagaacacatggaaaat

SEQ ID NO: 8074004 - DNA, 22 bp, Homo sapiens
cagtgatgtttctgcatcagag

SEQ ID NO: 8074005 - DNA, 22 bp, Homo sapiens
cagggtcttataaggccaattt

SEQ ID NO: 8074006 - DNA, 22 bp, Homo sapiens
caggggcagtctgtgtgcgtgg

SEQ ID NO: 8074007 - DNA, 22 bp, Homo sapiens
caggggcaggtgtgagatcatc

SEQ ID NO: 8074008 - DNA, 22 bp, Homo sapiens
caggggccaagggtccagacct

SEQ ID NO: 8074009 - DNA, 22 bp, Homo sapiens
tataagaaattgccaacctgtt

SEQ ID NO: 8074010 - DNA, 22 bp, Homo sapiens
tataatctggttttattaagag

SEQ ID NO: 8074011 - DNA, 22 bp, Homo sapiens
tattaaagagagaatcatcatc

SEQ ID NO: 8074012 - DNA, 22 bp, Homo sapiens
tattaaatatatctgttagttg

SEQ ID NO: 8074013 - DNA, 18 bp, Homo sapiens
caggtctgtctgcctccc

SEQ ID NO: 8074014 - DNA, 22 bp, Homo sapiens
caggtctggtgagagaacagtt

SEQ ID NO: 8074015 - DNA, 22 bp, Homo sapiens
catagaaaagagtaggtaatgt

SEQ ID NO: 8074016 - DNA, 22 bp, Homo sapiens
tcaggaagtataatcagattca

SEQ ID NO: 8074017 - DNA, 22 bp, Homo sapiens
tcagccccacggggtcagccaa

SEQ ID NO: 8074018 - DNA, 22 bp, Homo sapiens
tcagccctgggacccagggatg

SEQ ID NO: 8074019 - DNA, 22 bp, Homo sapiens
tcagccctgaggacagaggcag

SEQ ID NO: 8074020 - DNA, 22 bp, Homo sapiens
tcagctgaagtggagaagcaga

SEQ ID NO: 8074021 - DNA, 22 bp, Homo sapiens
tcagctgagctccagctcatag

SEQ ID NO: 8074022 - DNA, 22 bp, Homo sapiens
tcagctgagttctagagcactc

SEQ ID NO: 8074023 - DNA, 22 bp, Homo sapiens
tcagaaggtggaggttgcagtg

SEQ ID NO: 8074024 - DNA, 22 bp, Homo sapiens
tcagggcatggctgcacttggc

SEQ ID NO: 8074025 - DNA, 22 bp, Homo sapiens
tcagggattgcaaaattcatcc

SEQ ID NO: 8074026 - DNA, 20 bp, Homo sapiens
tcagggcatgggacagcccc

SEQ ID NO: 8074027 - DNA, 22 bp, Homo sapiens
tcagggcattcaagaggcctgg

SEQ ID NO: 8074028 - DNA, 22 bp, Homo sapiens
tcagggcatgtatgtttcttta

SEQ ID NO: 8074029 - DNA, 22 bp, Homo sapiens
catcacagatgttgtgtggagt

SEQ ID NO: 8074030 - DNA, 22 bp, Homo sapiens
catccaggctgaagtgcagtgg

SEQ ID NO: 8074031 - DNA, 22 bp, Homo sapiens
catccagaccgtgccatgctgc

SEQ ID NO: 8074032 - DNA, 22 bp, Homo sapiens
catccagagtccaaggctgggc

SEQ ID NO: 8074033 - DNA, 22 bp, Homo sapiens
catccagaccgtgccatgctgc

SEQ ID NO: 8074034 - DNA, 22 bp, Homo sapiens
catataatgtttgaagatgtgg

SEQ ID NO: 8074035 - DNA, 22 bp, Homo sapiens
tcaggaagtggtaaaggatgtt

SEQ ID NO: 8074036 - DNA, 22 bp, Homo sapiens
tcaggaagtctcaattagctac

SEQ ID NO: 8074037 - DNA, 22 bp, Homo sapiens
tccagcccagctcctctcagaa

SEQ ID NO: 8074038 - DNA, 20 bp, Homo sapiens
tccagcccagcagcctgaca

SEQ ID NO: 8074039 - DNA, 22 bp, Homo sapiens
catgtcttatatcctgtcttca

SEQ ID NO: 8074040 - DNA, 22 bp, Homo sapiens
catgggagctatctccatcact

SEQ ID NO: 8074041 - DNA, 22 bp, Homo sapiens
catgtctttgttatgctcacca

SEQ ID NO: 8074042 - DNA, 22 bp, Homo sapiens
catgtcttgccctgattagtag

SEQ ID NO: 8074043 - DNA, 22 bp, Homo sapiens
tccaggcaagggaggagcatgg

SEQ ID NO: 8074044 - DNA, 22 bp, Homo sapiens
tcagtttcacagtctgtgcaga

SEQ ID NO: 8074045 - DNA, 22 bp, Homo sapiens
tcaggtgggacctgctaggaca

SEQ ID NO: 8074046 - DNA, 22 bp, Homo sapiens
tcaggtggtcctaagtgccatc

SEQ ID NO: 8074047 - DNA, 22 bp, Homo sapiens
tcaggtggcttcggggagtggc

SEQ ID NO: 8074048 - DNA, 22 bp, Homo sapiens
catccccagagcagttccacta

SEQ ID NO: 8074049 - DNA, 22 bp, Homo sapiens
tgtggccttgcagcctggaggt

SEQ ID NO: 8074050 - DNA, 22 bp, Homo sapiens
tgtggaagtgccaatgacaaat

SEQ ID NO: 8074051 - DNA, 22 bp, Homo sapiens
tgtggaaggggccccatgacca

SEQ ID NO: 8074052 - DNA, 22 bp, Homo sapiens
tgtggctctcagatcctccaat

SEQ ID NO: 8074053 - DNA, 22 bp, Homo sapiens
tgtgggcaggagcacaagtcag

SEQ ID NO: 8074054 - DNA, 22 bp, Homo sapiens
tgtgtggattcatctcaaagag

SEQ ID NO: 8074055 - DNA, 19 bp, Homo sapiens
tgtgtgctgactgccagag

SEQ ID NO: 8074056 - DNA, 22 bp, Homo sapiens
tgtgtcagaggtagagatggca

SEQ ID NO: 8074057 - DNA, 22 bp, Homo sapiens
tgtgtcagaaggcaatggggat

SEQ ID NO: 8074058 - DNA, 22 bp, Homo sapiens
tgtgtgttagtctcaaagccgt

SEQ ID NO: 8074059 - DNA, 22 bp, Homo sapiens
tgtgtgtgttcctcctcagcta

SEQ ID NO: 8074060 - DNA, 22 bp, Homo sapiens
tgtgtgtgtgcgcgcacgcata

SEQ ID NO: 8074061 - DNA, 23 bp, Homo sapiens
tgtgtgtgtattctacgcaaggt

SEQ ID NO: 8074062 - DNA, 18 bp, Homo sapiens
tgttaaatgaagatttgc

SEQ ID NO: 8074063 - DNA, 22 bp, Homo sapiens
tgttcttgagcctttagaccta

SEQ ID NO: 8074064 - DNA, 22 bp, Homo sapiens
tgttctttgccagtgatttaat

SEQ ID NO: 8074065 - DNA, 22 bp, Homo sapiens
tgttcttagcaggagcatctat

SEQ ID NO: 8074066 - DNA, 22 bp, Homo sapiens
tgtttaagctgatgaggtatcg

SEQ ID NO: 8074067 - DNA, 19 bp, Homo sapiens
tgttggtgcggatgtggag

SEQ ID NO: 8074068 - DNA, 22 bp, Homo sapiens
tgtttattgctgcaattgtgcc

SEQ ID NO: 8074069 - DNA, 22 bp, Homo sapiens
tgtttattttcaggatggattg

SEQ ID NO: 8074070 - DNA, 18 bp, Homo sapiens
tgtttattctcctgacag

SEQ ID NO: 8074071 - DNA, 22 bp, Homo sapiens
tgtttattgcagtgctgggctg

SEQ ID NO: 8074072 - DNA, 22 bp, Homo sapiens
tgtttattgagtgcctactata

SEQ ID NO: 8074073 - DNA, 22 bp, Homo sapiens
tgtttatagatggccacaatga

SEQ ID NO: 8074074 - DNA, 22 bp, Homo sapiens
tgtttataccttggtataacca

SEQ ID NO: 8074075 - DNA, 22 bp, Homo sapiens
tgtttatgcatcgttaatacca

SEQ ID NO: 8074076 - DNA, 22 bp, Homo sapiens
tgtttattacagttcttggaat

SEQ ID NO: 8074077 - DNA, 22 bp, Homo sapiens
tgtttattcatggctaatgaaa

SEQ ID NO: 8074078 - DNA, 22 bp, Homo sapiens
ttaaaaccatcagctgtaagat

SEQ ID NO: 8074079 - DNA, 22 bp, Homo sapiens
ttaaaatgcagattatgactca

SEQ ID NO: 8074080 - DNA, 22 bp, Homo sapiens
ttaaaatgcagattctgattca

SEQ ID NO: 8074081 - DNA, 22 bp, Homo sapiens
ttaaaacagcgtgaatctggca

SEQ ID NO: 8074082 - DNA, 22 bp, Homo sapiens
ttaaaatttccccaccatgtat

SEQ ID NO: 8074083 - DNA, 18 bp, Homo sapiens
tgtttatttttctcttac

SEQ ID NO: 8074084 - DNA, 18 bp, Homo sapiens
tgtttatttttctcttac

SEQ ID NO: 8074085 - DNA, 20 bp, Homo sapiens
tgtttgtgtggggccttggc

SEQ ID NO: 8074086 - DNA, 22 bp, Homo sapiens
tgtctgcaaagtccagcacagg

SEQ ID NO: 8074087 - DNA, 22 bp, Homo sapiens
tgtctgccattagcccagtcca

SEQ ID NO: 8074088 - DNA, 22 bp, Homo sapiens
tgtctgagtgtgcctgggcatt

SEQ ID NO: 8074089 - DNA, 22 bp, Homo sapiens
tgtctctgccagctagcagaat

SEQ ID NO: 8074090 - DNA, 22 bp, Homo sapiens
tgtctctgaggtgagggtcagc

SEQ ID NO: 8074091 - DNA, 18 bp, Homo sapiens
tgtctctgaattccagtg

SEQ ID NO: 8074092 - DNA, 22 bp, Homo sapiens
tgtctctgagatgactcccacc

SEQ ID NO: 8074093 - DNA, 19 bp, Homo sapiens
tgtctctgaaagatgagct

SEQ ID NO: 8074094 - DNA, 22 bp, Homo sapiens
tgtctctgaacagcttactaaa

SEQ ID NO: 8074095 - DNA, 22 bp, Homo sapiens
tgtctctgaaatatgtggctcc

SEQ ID NO: 8074096 - DNA, 22 bp, Homo sapiens
tgtctctgctttccttgcaggg

SEQ ID NO: 8074097 - DNA, 22 bp, Homo sapiens
tgtctctgctttccttgcaggg

SEQ ID NO: 8074098 - DNA, 22 bp, Homo sapiens
tgtctagggagctgctcaggct

SEQ ID NO: 8074099 - DNA, 22 bp, Homo sapiens
tgtctaaatgaaaagagatgcc

SEQ ID NO: 8074100 - DNA, 22 bp, Homo sapiens
tgtctccaggggcaggccagcc

SEQ ID NO: 8074101 - DNA, 22 bp, Homo sapiens
tgtctccaaaacaatctcagat

SEQ ID NO: 8074102 - DNA, 22 bp, Homo sapiens
tgtctttgttattgtggacagg

SEQ ID NO: 8074103 - DNA, 22 bp, Homo sapiens
tgtctttaattctacatatctc

SEQ ID NO: 8074104 - DNA, 22 bp, Homo sapiens
tgtgaaaagcgtgtgttctagg

SEQ ID NO: 8074105 - DNA, 22 bp, Homo sapiens
tgtcttcatctcagacacagtt

SEQ ID NO: 8074106 - DNA, 20 bp, Homo sapiens
tgtcttcattatggtgccct

SEQ ID NO: 8074107 - DNA, 22 bp, Homo sapiens
tgtcttcatggcggaacaactt

SEQ ID NO: 8074108 - DNA, 22 bp, Homo sapiens
tgtcttcatgcctgaaagaaga

SEQ ID NO: 8074109 - DNA, 22 bp, Homo sapiens
tgtcttcattctgtatgtccag

SEQ ID NO: 8074110 - DNA, 22 bp, Homo sapiens
tgtcttcttcataaggagagtg

SEQ ID NO: 8074111 - DNA, 22 bp, Homo sapiens
tgtcttcgctacaatgaaaagg

SEQ ID NO: 8074112 - DNA, 22 bp, Homo sapiens
tgtcttgattagaatgatgggc

SEQ ID NO: 8074113 - DNA, 22 bp, Homo sapiens
tgtctttaaaattaaacacatc

SEQ ID NO: 8074114 - DNA, 22 bp, Homo sapiens
tgtctggctcattttctgcagt

SEQ ID NO: 8074115 - DNA, 22 bp, Homo sapiens
tgtctgggatgttggcagccac

SEQ ID NO: 8074116 - DNA, 22 bp, Homo sapiens
tgtcttcaaatattgaaatcct

SEQ ID NO: 8074117 - DNA, 22 bp, Homo sapiens
tgtcttcaaatattgaaatcct

SEQ ID NO: 8074118 - DNA, 22 bp, Homo sapiens
tgtcttcactcaagtctcttgg

SEQ ID NO: 8074119 - DNA, 22 bp, Homo sapiens
tgtcttcagcagtcatctgggg

SEQ ID NO: 8074120 - DNA, 22 bp, Homo sapiens
tgtcttcagcaaatgcctttct

SEQ ID NO: 8074121 - DNA, 22 bp, Homo sapiens
tgtcttcagataggcattcttc

SEQ ID NO: 8074122 - DNA, 22 bp, Homo sapiens
tgtggaaagtcaagttccagga

SEQ ID NO: 8074123 - DNA, 22 bp, Homo sapiens
tgtggaaaattggaacgttcct

SEQ ID NO: 8074124 - DNA, 22 bp, Homo sapiens
tgtgctcagccaggggcaggcc

SEQ ID NO: 8074125 - DNA, 22 bp, Homo sapiens
tgtgcctggtccctgagtcgag

SEQ ID NO: 8074126 - DNA, 22 bp, Homo sapiens
tgtgccttctcagtcctgctca

SEQ ID NO: 8074127 - DNA, 22 bp, Homo sapiens
tgtgcctgagttggctgagtac

SEQ ID NO: 8074128 - DNA, 22 bp, Homo sapiens
tgtgcctggcattctgggcttc

SEQ ID NO: 8074129 - DNA, 22 bp, Homo sapiens
tgtgccctcctgccaggggctg

SEQ ID NO: 8074130 - DNA, 18 bp, Homo sapiens
tgtgcctctgcaggacgt

SEQ ID NO: 8074131 - DNA, 22 bp, Homo sapiens
tgtgcctctgaagggcggacgg

SEQ ID NO: 8074132 - DNA, 22 bp, Homo sapiens
tgtgcagggaagggcatgctat

SEQ ID NO: 8074133 - DNA, 22 bp, Homo sapiens
tgtgactgtggacttttgtggg

SEQ ID NO: 8074134 - DNA, 22 bp, Homo sapiens
tgtgactggttgtcccgctttc

SEQ ID NO: 8074135 - DNA, 22 bp, Homo sapiens
tgtgacctcatcttaactggaa

SEQ ID NO: 8074136 - DNA, 22 bp, Homo sapiens
tgtgactaggcctgagctcttg

SEQ ID NO: 8074137 - DNA, 22 bp, Homo sapiens
tgtgagcaagattcagagattc

SEQ ID NO: 8074138 - DNA, 22 bp, Homo sapiens
tgtgagcactgtgatgctgttc

SEQ ID NO: 8074139 - DNA, 22 bp, Homo sapiens
tgtgatggttcactgggcatga

SEQ ID NO: 8074140 - DNA, 22 bp, Homo sapiens
tgtgattactgaatagaaaata

SEQ ID NO: 8074141 - DNA, 22 bp, Homo sapiens
tgtgacagaattggtctgttct

SEQ ID NO: 8074142 - DNA, 22 bp, Homo sapiens
tgtgaaagagtcttatagtttc

SEQ ID NO: 8074143 - DNA, 22 bp, Homo sapiens
tgtgaaagatactaggcagagg

SEQ ID NO: 8074144 - DNA, 22 bp, Homo sapiens
tgtgaaagcaagtctagttctc

SEQ ID NO: 8074145 - DNA, 22 bp, Homo sapiens
tgtgaaatgctattgtgacaaa

SEQ ID NO: 8074146 - DNA, 22 bp, Homo sapiens
ttattattccccaagtcattat

SEQ ID NO: 8074147 - DNA, 22 bp, Homo sapiens
ttatcttgtagagatattttcg

SEQ ID NO: 8074148 - DNA, 22 bp, Homo sapiens
ttatcttggtgttttagtaatt

SEQ ID NO: 8074149 - DNA, 22 bp, Homo sapiens
ttatcttgagtattgagattct

SEQ ID NO: 8074150 - DNA, 22 bp, Homo sapiens
ttatgaaggatcaggtacttgg

SEQ ID NO: 8074151 - DNA, 22 bp, Homo sapiens
ttatgaaagacatttctgttgg

SEQ ID NO: 8074152 - DNA, 22 bp, Homo sapiens
ttattattgattcgctctcaaa

SEQ ID NO: 8074153 - DNA, 22 bp, Homo sapiens
ttagaacactgagaaagtgatg

SEQ ID NO: 8074154 - DNA, 22 bp, Homo sapiens
ttagcaggaagagttggctgga

SEQ ID NO: 8074155 - DNA, 22 bp, Homo sapiens
ttagcatagccattgaaatatg

SEQ ID NO: 8074156 - DNA, 22 bp, Homo sapiens
ttagcagcggtcagttttgaag

SEQ ID NO: 8074157 - DNA, 22 bp, Homo sapiens
ttagggcttttctgaataggcc

SEQ ID NO: 8074158 - DNA, 22 bp, Homo sapiens
ttaggaaattccacctgtattc

SEQ ID NO: 8074159 - DNA, 22 bp, Homo sapiens
ttacatggttgttggaaatgct

SEQ ID NO: 8074160 - DNA, 22 bp, Homo sapiens
ttacatttcccccttggaggct

SEQ ID NO: 8074161 - DNA, 22 bp, Homo sapiens
ttacattttagttaacctgtga

SEQ ID NO: 8074162 - DNA, 22 bp, Homo sapiens
ttacaagattaattattggagt

SEQ ID NO: 8074163 - DNA, 22 bp, Homo sapiens
ttacaatgcactcacctttaga

SEQ ID NO: 8074164 - DNA, 22 bp, Homo sapiens
ttaataaagtatgaattggaaa

SEQ ID NO: 8074165 - DNA, 22 bp, Homo sapiens
ttaataaagtatgaattggaaa

SEQ ID NO: 8074166 - DNA, 22 bp, Homo sapiens
ttaattaaattcatgagcattg

SEQ ID NO: 8074167 - DNA, 22 bp, Homo sapiens
ttaattaactagccaaccacta

SEQ ID NO: 8074168 - DNA, 22 bp, Homo sapiens
ttaattaagagatactgcagta

SEQ ID NO: 8074169 - DNA, 22 bp, Homo sapiens
ttaattaattagttaagcatgt

SEQ ID NO: 8074170 - DNA, 22 bp, Homo sapiens
ttccagatttctacacaagacc

SEQ ID NO: 8074171 - DNA, 22 bp, Homo sapiens
ttccagatgtttaagttctgct

SEQ ID NO: 8074172 - DNA, 22 bp, Homo sapiens
ttcattcatctctaaaatgcct

SEQ ID NO: 8074173 - DNA, 23 bp, Homo sapiens
ttccagaggaagaagtcatgact

SEQ ID NO: 8074174 - DNA, 22 bp, Homo sapiens
ttcattgactggttcgttaagt

SEQ ID NO: 8074175 - DNA, 21 bp, Homo sapiens
ttcattgaactatttgtggag

SEQ ID NO: 8074176 - DNA, 22 bp, Homo sapiens
ttcattgagctgtacacttagg

SEQ ID NO: 8074177 - DNA, 23 bp, Homo sapiens
ttcattgattgcaaggagattgg

SEQ ID NO: 8074178 - DNA, 22 bp, Homo sapiens
ttcattgatagttttatgtatg

SEQ ID NO: 8074179 - DNA, 22 bp, Homo sapiens
ttcattgaaatacagtcttgac

SEQ ID NO: 8074180 - DNA, 22 bp, Homo sapiens
ttcattgaaatgtttctagctg

SEQ ID NO: 8074181 - DNA, 22 bp, Homo sapiens
ttcacattgtgcagattatggt

SEQ ID NO: 8074182 - DNA, 18 bp, Homo sapiens
ttcaccagtgtgatgggt

SEQ ID NO: 8074183 - DNA, 22 bp, Homo sapiens
ttcagccaattagaagccccac

SEQ ID NO: 8074184 - DNA, 22 bp, Homo sapiens
ttcagccagtcatcagtcttgt

SEQ ID NO: 8074185 - DNA, 21 bp, Homo sapiens
ttcagcagtcctctagagata

SEQ ID NO: 8074186 - DNA, 22 bp, Homo sapiens
ttcagcagtcgtccaggaaaag

SEQ ID NO: 8074187 - DNA, 22 bp, Homo sapiens
ttcagcagtgcagacacccagt

SEQ ID NO: 8074188 - DNA, 22 bp, Homo sapiens
ttcagcagtgcagacacccagt

SEQ ID NO: 8074189 - DNA, 22 bp, Homo sapiens
ttcacccactagagaactcagg

SEQ ID NO: 8074190 - DNA, 22 bp, Homo sapiens
tgggccagcaattgctgctcag

SEQ ID NO: 8074191 - DNA, 22 bp, Homo sapiens
tgggcagcaaagactgtgtgct

SEQ ID NO: 8074192 - DNA, 20 bp, Homo sapiens
tgggcagcactgctggctgg

SEQ ID NO: 8074193 - DNA, 20 bp, Homo sapiens
tgggcagcactgctggctgg

SEQ ID NO: 8074194 - DNA, 22 bp, Homo sapiens
tgggcagcaaagactgtgtgct

SEQ ID NO: 8074195 - DNA, 22 bp, Homo sapiens
tgggcagattaatgcagtggct

SEQ ID NO: 8074196 - DNA, 22 bp, Homo sapiens
tgggcagattaatgcagtggct

SEQ ID NO: 8074197 - DNA, 22 bp, Homo sapiens
tgggcagatgtggctctccttg

SEQ ID NO: 8074198 - DNA, 22 bp, Homo sapiens
tgggcagatgtcctctgaagtg

SEQ ID NO: 8074199 - DNA, 21 bp, Homo sapiens
tgggcagatggcagtgtggct

SEQ ID NO: 8074200 - DNA, 21 bp, Homo sapiens
tgggcagatggcagtgtggct

SEQ ID NO: 8074201 - DNA, 16 bp, Homo sapiens
tgggcagatgagaaga

SEQ ID NO: 8074202 - DNA, 22 bp, Homo sapiens
tgggcagatctttggtggctag

SEQ ID NO: 8074203 - DNA, 22 bp, Homo sapiens
tgggcagatctttggtggctag

SEQ ID NO: 8074204 - DNA, 15 bp, Homo sapiens
tgggcagatcacttg

SEQ ID NO: 8074205 - DNA, 22 bp, Homo sapiens
tgggcagagttgtgatgaactg

SEQ ID NO: 8074206 - DNA, 22 bp, Homo sapiens
tgggcacaggggaatggatgaa

SEQ ID NO: 8074207 - DNA, 22 bp, Homo sapiens
tgggcagactgagccctgtccc

SEQ ID NO: 8074208 - DNA, 22 bp, Homo sapiens
tgggcagagagtagaggcaacg

SEQ ID NO: 8074209 - DNA, 22 bp, Homo sapiens
tgggcagagtagctcagaagaa

SEQ ID NO: 8074210 - DNA, 22 bp, Homo sapiens
tgggcagaggctctgaagtcca

SEQ ID NO: 8074211 - DNA, 22 bp, Homo sapiens
tgggcagaggctctgaagtcca

SEQ ID NO: 8074212 - DNA, 22 bp, Homo sapiens
tgggcagagtcgtggggaatag

SEQ ID NO: 8074213 - DNA, 22 bp, Homo sapiens
tgggcagagtcatacaggagac

SEQ ID NO: 8074214 - DNA, 22 bp, Homo sapiens
tgggcagaggacagggaagatc

SEQ ID NO: 8074215 - DNA, 22 bp, Homo sapiens
tgggcagagatctggatcaaac

SEQ ID NO: 8074216 - DNA, 22 bp, Homo sapiens
tgggcagaggcagcagaaacct

SEQ ID NO: 8074217 - DNA, 21 bp, Homo sapiens
tgggatgggtctgggaccagc

SEQ ID NO: 8074218 - DNA, 22 bp, Homo sapiens
tgggatgggatctcgctgtgtc

SEQ ID NO: 8074219 - DNA, 22 bp, Homo sapiens
tgggatgggatctcgctgtgtc

SEQ ID NO: 8074220 - DNA, 22 bp, Homo sapiens
tgggaggcttccagaccttgct

SEQ ID NO: 8074221 - DNA, 22 bp, Homo sapiens
tgggaggcaggtaggtgatgat

SEQ ID NO: 8074222 - DNA, 23 bp, Homo sapiens
tgggatggattcaccagtgtgct

SEQ ID NO: 8074223 - DNA, 22 bp, Homo sapiens
tgggatggcatcctgggccttg

SEQ ID NO: 8074224 - DNA, 22 bp, Homo sapiens
tgggatggagcctgagtatagt

SEQ ID NO: 8074225 - DNA, 18 bp, Homo sapiens
tgggatggagagtaactg

SEQ ID NO: 8074226 - DNA, 22 bp, Homo sapiens
tgggatagtggccaggaccccc

SEQ ID NO: 8074227 - DNA, 21 bp, Homo sapiens
tgggcctgtccctcttggagg

SEQ ID NO: 8074228 - DNA, 22 bp, Homo sapiens
tgggcctgggttcctcctgggc

SEQ ID NO: 8074229 - DNA, 22 bp, Homo sapiens
tgggcctgtggcttggctctag

SEQ ID NO: 8074230 - DNA, 22 bp, Homo sapiens
tgggcctgtgatgctgggctat

SEQ ID NO: 8074231 - DNA, 20 bp, Homo sapiens
tgggcctgtggcagaagtct

SEQ ID NO: 8074232 - DNA, 20 bp, Homo sapiens
tgggcctgtggcagaagtct

SEQ ID NO: 8074233 - DNA, 22 bp, Homo sapiens
tgggcctgtggggatcttgaag

SEQ ID NO: 8074234 - DNA, 22 bp, Homo sapiens
tgggcctgttgcctgagtccat

SEQ ID NO: 8074235 - DNA, 22 bp, Homo sapiens
tgggcctgtttcccttcagggc

SEQ ID NO: 8074236 - DNA, 22 bp, Homo sapiens
tgggcctgttggggttgagtta

SEQ ID NO: 8074237 - DNA, 22 bp, Homo sapiens
tgggctctgtgccaggttggtg

SEQ ID NO: 8074238 - DNA, 22 bp, Homo sapiens
tgggctgccagctctccagatg

SEQ ID NO: 8074239 - DNA, 22 bp, Homo sapiens
tgggctgccctgatggtcctca

SEQ ID NO: 8074240 - DNA, 22 bp, Homo sapiens
tgggctgccggcaggctctgcc

SEQ ID NO: 8074241 - DNA, 22 bp, Homo sapiens
tgggctgcaccctcagcctctg

SEQ ID NO: 8074242 - DNA, 22 bp, Homo sapiens
tgggctgcaccctcagcctctg

SEQ ID NO: 8074243 - DNA, 22 bp, Homo sapiens
tgggctctctggcaggaaggct

SEQ ID NO: 8074244 - DNA, 22 bp, Homo sapiens
tgggctctcctggaggacaaca

SEQ ID NO: 8074245 - DNA, 22 bp, Homo sapiens
tgggctctgctgcgtaccagtt

SEQ ID NO: 8074246 - DNA, 20 bp, Homo sapiens
tgggctctgcttcctggagt

SEQ ID NO: 8074247 - DNA, 22 bp, Homo sapiens
tgggctctgaagtcagtctgct

SEQ ID NO: 8074248 - DNA, 22 bp, Homo sapiens
tgggctctgcatcagtgcccat

SEQ ID NO: 8074249 - DNA, 22 bp, Homo sapiens
tgggccaggtctgtgtcagctg

SEQ ID NO: 8074250 - DNA, 22 bp, Homo sapiens
tgggcctccaattccagcggga

SEQ ID NO: 8074251 - DNA, 18 bp, Homo sapiens
tgggcctgcatcctagtc

SEQ ID NO: 8074252 - DNA, 22 bp, Homo sapiens
tgggcctgattcttgaatcctg

SEQ ID NO: 8074253 - DNA, 22 bp, Homo sapiens
tgggcctgatttatcatcttca

SEQ ID NO: 8074254 - DNA, 21 bp, Homo sapiens
tgggcctgattcccagggtca

SEQ ID NO: 8074255 - DNA, 22 bp, Homo sapiens
tgggcctgccccaggcttcagc

SEQ ID NO: 8074256 - DNA, 19 bp, Homo sapiens
tgggcctgcatctgggtct

SEQ ID NO: 8074257 - DNA, 18 bp, Homo sapiens
tgggcctgcatcctagtc

SEQ ID NO: 8074258 - DNA, 23 bp, Homo sapiens
tgggcctggaaagccttagagag

SEQ ID NO: 8074259 - DNA, 22 bp, Homo sapiens
tgggcctgctggggcattttca

SEQ ID NO: 8074260 - DNA, 22 bp, Homo sapiens
tgggcctgggctcctgtcctct

SEQ ID NO: 8074261 - DNA, 22 bp, Homo sapiens
tgggcctgggctggacagcctg

SEQ ID NO: 8074262 - DNA, 22 bp, Homo sapiens
tgggcctgggtctttgctgcca

SEQ ID NO: 8074263 - DNA, 22 bp, Homo sapiens
tgggcctggggcagcccaaatc

SEQ ID NO: 8074264 - DNA, 22 bp, Homo sapiens
tgggcctgacacttactaggga

SEQ ID NO: 8074265 - DNA, 22 bp, Homo sapiens
tgggcctgactcacctgcctcc

SEQ ID NO: 8074266 - DNA, 22 bp, Homo sapiens
tgggcctgactcacctgcctcc

SEQ ID NO: 8074267 - DNA, 20 bp, Homo sapiens
tgggcctgagcctgtgggct

SEQ ID NO: 8074268 - DNA, 22 bp, Homo sapiens
tgggcctgagctcaccaggggc

SEQ ID NO: 8074269 - DNA, 22 bp, Homo sapiens
tgggcctgagtttgggaactgg

SEQ ID NO: 8074270 - DNA, 22 bp, Homo sapiens
tgggcctgaaggagctgcgccc

SEQ ID NO: 8074271 - DNA, 22 bp, Homo sapiens
tgggcctgaaattcccatttta

SEQ ID NO: 8074272 - DNA, 22 bp, Homo sapiens
tgggggagccttcacagtagct

SEQ ID NO: 8074273 - DNA, 22 bp, Homo sapiens
tggggctggcacagtctctatt

SEQ ID NO: 8074274 - DNA, 22 bp, Homo sapiens
tggggctggctattgtctccct

SEQ ID NO: 8074275 - DNA, 22 bp, Homo sapiens
tggggctggctattgtctccct

SEQ ID NO: 8074276 - DNA, 22 bp, Homo sapiens
tggggctggggatcttgagcct

SEQ ID NO: 8074277 - DNA, 22 bp, Homo sapiens
tggggctggggatcttgagcct

SEQ ID NO: 8074278 - DNA, 22 bp, Homo sapiens
tggggctgtccttagtctgaga

SEQ ID NO: 8074279 - DNA, 22 bp, Homo sapiens
tgggggagattagagcttctta

SEQ ID NO: 8074280 - DNA, 22 bp, Homo sapiens
tgggggagattagagcttctta

SEQ ID NO: 8074281 - DNA, 22 bp, Homo sapiens
tgggggagattgtgcatctcta

SEQ ID NO: 8074282 - DNA, 20 bp, Homo sapiens
tggggcctgtttctgtggtt

SEQ ID NO: 8074283 - DNA, 22 bp, Homo sapiens
tggggcctggtcagagctgcac

SEQ ID NO: 8074284 - DNA, 22 bp, Homo sapiens
tggggcctgaggtggagctgca

SEQ ID NO: 8074285 - DNA, 22 bp, Homo sapiens
tggggctgaggagcctcactct

SEQ ID NO: 8074286 - DNA, 23 bp, Homo sapiens
tggggctgatggagacggaccag

SEQ ID NO: 8074287 - DNA, 19 bp, Homo sapiens
tggggcctcctgtccctgg

SEQ ID NO: 8074288 - DNA, 22 bp, Homo sapiens
tggggaggacgggcgccttcct

SEQ ID NO: 8074289 - DNA, 22 bp, Homo sapiens
tggggacatagccagtctggct

SEQ ID NO: 8074290 - DNA, 22 bp, Homo sapiens
tggggacatagccagtctggct

SEQ ID NO: 8074291 - DNA, 22 bp, Homo sapiens
tggggagtgatgcctcggataa

SEQ ID NO: 8074292 - DNA, 17 bp, Homo sapiens
tggggatggttcatgag

SEQ ID NO: 8074293 - DNA, 22 bp, Homo sapiens
tggggaagggcaccctggagac

SEQ ID NO: 8074294 - DNA, 22 bp, Homo sapiens
tggggacaggagacttacagct

SEQ ID NO: 8074295 - DNA, 22 bp, Homo sapiens
tggggacacagaggttcgttgg

SEQ ID NO: 8074296 - DNA, 22 bp, Homo sapiens
tggggacacagagccaaactat

SEQ ID NO: 8074297 - DNA, 19 bp, Homo sapiens
tgggcttccccagggcaga

SEQ ID NO: 8074298 - DNA, 22 bp, Homo sapiens
tgggctgtggagcacctttgca

SEQ ID NO: 8074299 - DNA, 22 bp, Homo sapiens
tgggctggtgagggatcattta

SEQ ID NO: 8074300 - DNA, 22 bp, Homo sapiens
tgggctgtccagcacctgggct

SEQ ID NO: 8074301 - DNA, 22 bp, Homo sapiens
tgggctggctgaggcattcact

SEQ ID NO: 8074302 - DNA, 22 bp, Homo sapiens
tgggctggctgaacttcaacct

SEQ ID NO: 8074303 - DNA, 22 bp, Homo sapiens
tgggctggcgtggagagtttag

SEQ ID NO: 8074304 - DNA, 22 bp, Homo sapiens
tgggggtgactatctcgggaat

SEQ ID NO: 8074305 - DNA, 22 bp, Homo sapiens
tgggggtgaaagtctggacagt

SEQ ID NO: 8074306 - DNA, 23 bp, Homo sapiens
tgggggtgcacgggccacatctt

SEQ ID NO: 8074307 - DNA, 22 bp, Homo sapiens
tggggtgccgacagggagggca

SEQ ID NO: 8074308 - DNA, 22 bp, Homo sapiens
tggggtggatagaaagtgatgt

SEQ ID NO: 8074309 - DNA, 22 bp, Homo sapiens
tggggtgggcatgcgctgtcct

SEQ ID NO: 8074310 - DNA, 22 bp, Homo sapiens
tggggtggtaatacaccgttct

SEQ ID NO: 8074311 - DNA, 22 bp, Homo sapiens
tgggtagaaacaaggctggact

SEQ ID NO: 8074312 - DNA, 22 bp, Homo sapiens
tgggtagagcaggctggggctt

SEQ ID NO: 8074313 - DNA, 22 bp, Homo sapiens
tgggtagagacacagtctgggg

SEQ ID NO: 8074314 - DNA, 22 bp, Homo sapiens
tgggtagaggaattgggctacc

SEQ ID NO: 8074315 - DNA, 22 bp, Homo sapiens
tgggtctccagttcagggcagg

SEQ ID NO: 8074316 - DNA, 22 bp, Homo sapiens
tgggtctcctgtgcctgggagg

SEQ ID NO: 8074317 - DNA, 23 bp, Homo sapiens
tgggtctctagtacaggcaggca

SEQ ID NO: 8074318 - DNA, 20 bp, Homo sapiens
tgggtctgcttggcttcagt

SEQ ID NO: 8074319 - DNA, 22 bp, Homo sapiens
tgggtctgtagggctgtccaat

SEQ ID NO: 8074320 - DNA, 22 bp, Homo sapiens
tgggtggtccaggctcagcaga

SEQ ID NO: 8074321 - DNA, 22 bp, Homo sapiens
tgggtgaggatgatgaggcagc

SEQ ID NO: 8074322 - DNA, 22 bp, Homo sapiens
tgggtgaggatgatgaggcagc

SEQ ID NO: 8074323 - DNA, 22 bp, Homo sapiens
tgggtgagtgggaaaagcccag

SEQ ID NO: 8074324 - DNA, 22 bp, Homo sapiens
tggtaaagtgtactgaatatga

SEQ ID NO: 8074325 - DNA, 22 bp, Homo sapiens
tggtatgaccgtggtgcaagca

SEQ ID NO: 8074326 - DNA, 22 bp, Homo sapiens
tggtatgtaaattgtaactcaa

SEQ ID NO: 8074327 - DNA, 22 bp, Homo sapiens
tggtatggctaacgaggtcaag

SEQ ID NO: 8074328 - DNA, 22 bp, Homo sapiens
tgtatattctgcctaaaagctt

SEQ ID NO: 8074329 - DNA, 22 bp, Homo sapiens
tgtatattcactgagcaagggg

SEQ ID NO: 8074330 - DNA, 22 bp, Homo sapiens
tgtatcatatggggaagcttca

SEQ ID NO: 8074331 - DNA, 22 bp, Homo sapiens
tgtatcttcagtttgtctttcc

SEQ ID NO: 8074332 - DNA, 22 bp, Homo sapiens
tgtatctttctgtacttttatg

SEQ ID NO: 8074333 - DNA, 22 bp, Homo sapiens
tgtataaatttaaattcctgct

SEQ ID NO: 8074334 - DNA, 22 bp, Homo sapiens
tgtagctatagaggctgtacct

SEQ ID NO: 8074335 - DNA, 22 bp, Homo sapiens
tgtagccagaagtcatagggtg

SEQ ID NO: 8074336 - DNA, 22 bp, Homo sapiens
tgtagaaattagtaagatcaac

SEQ ID NO: 8074337 - DNA, 22 bp, Homo sapiens
tgtagaaagaatatgtttcata

SEQ ID NO: 8074338 - DNA, 22 bp, Homo sapiens
tgtatttaagctttacctaaaa

SEQ ID NO: 8074339 - DNA, 22 bp, Homo sapiens
tgtcacagggataccatggggc

SEQ ID NO: 8074340 - DNA, 22 bp, Homo sapiens
tgtcaccatgccagcttctgcc

SEQ ID NO: 8074341 - DNA, 22 bp, Homo sapiens
tgtcaccaccggaagaaactgc

SEQ ID NO: 8074342 - DNA, 22 bp, Homo sapiens
tgtcaaagacagaaggaaatgg

SEQ ID NO: 8074343 - DNA, 20 bp, Homo sapiens
tgtcctaatagacaagcaga

SEQ ID NO: 8074344 - DNA, 22 bp, Homo sapiens
tgtccttcttgtcttgcccaaa

SEQ ID NO: 8074345 - DNA, 22 bp, Homo sapiens
tgtcccagcagctgggttctct

SEQ ID NO: 8074346 - DNA, 22 bp, Homo sapiens
tgtccaggtggcctctgctgct

SEQ ID NO: 8074347 - DNA, 22 bp, Homo sapiens
tgtccccaggtcctctgccgtc

SEQ ID NO: 8074348 - DNA, 18 bp, Homo sapiens
tgtccctgcaaataacat

SEQ ID NO: 8074349 - DNA, 21 bp, Homo sapiens
tgtccaaggtatgcactgggg

SEQ ID NO: 8074350 - DNA, 22 bp, Homo sapiens
tgtccactttgtcagtgtcata

SEQ ID NO: 8074351 - DNA, 22 bp, Homo sapiens
tgtcatcatttgagagaagaaa

SEQ ID NO: 8074352 - DNA, 22 bp, Homo sapiens
tgtcatcaactcacagagccaa

SEQ ID NO: 8074353 - DNA, 21 bp, Homo sapiens
tgtcagaaataagcatgtgat

SEQ ID NO: 8074354 - DNA, 22 bp, Homo sapiens
tgtcactgtgctctgttcattt

SEQ ID NO: 8074355 - DNA, 22 bp, Homo sapiens
tgtcagggcatgcggtccagcc

SEQ ID NO: 8074356 - DNA, 22 bp, Homo sapiens
tggtgggggaggctgtctagca

SEQ ID NO: 8074357 - DNA, 22 bp, Homo sapiens
tggtggggtcatcgtcagatgc

SEQ ID NO: 8074358 - DNA, 22 bp, Homo sapiens
tggtggggccagacttcagctc

SEQ ID NO: 8074359 - DNA, 22 bp, Homo sapiens
tggtggggctttccttctgctt

SEQ ID NO: 8074360 - DNA, 22 bp, Homo sapiens
tggtggggattccctccctggc

SEQ ID NO: 8074361 - DNA, 16 bp, Homo sapiens
tggtggggaggacagc

SEQ ID NO: 8074362 - DNA, 22 bp, Homo sapiens
tggtggcagtctcctggctgtg

SEQ ID NO: 8074363 - DNA, 22 bp, Homo sapiens
tggtggcagctgggacagaggt

SEQ ID NO: 8074364 - DNA, 22 bp, Homo sapiens
tggtggccaattcacagggctc

SEQ ID NO: 8074365 - DNA, 22 bp, Homo sapiens
tggtggcatgatagtgtgaatg

SEQ ID NO: 8074366 - DNA, 22 bp, Homo sapiens
tggtggcagagcaagagctgga

SEQ ID NO: 8074367 - DNA, 23 bp, Homo sapiens
tggtggcagaagtagcagatgac

SEQ ID NO: 8074368 - DNA, 23 bp, Homo sapiens
tggtggcagaagtagcagatgac

SEQ ID NO: 8074369 - DNA, 22 bp, Homo sapiens
tggtggcaattcaaagacagca

SEQ ID NO: 8074370 - DNA, 23 bp, Homo sapiens
tggtgcctcagaagcagtgggct

SEQ ID NO: 8074371 - DNA, 22 bp, Homo sapiens
tggtggagctgtggccacgacc

SEQ ID NO: 8074372 - DNA, 22 bp, Homo sapiens
tggtggcaaagtacaaagtgac

SEQ ID NO: 8074373 - DNA, 21 bp, Homo sapiens
tggtggagtgtgctgagcatg

SEQ ID NO: 8074374 - DNA, 21 bp, Homo sapiens
tggtggagtgtgctgagcatg

SEQ ID NO: 8074375 - DNA, 19 bp, Homo sapiens
tggtggaggtgcacctgac

SEQ ID NO: 8074376 - DNA, 22 bp, Homo sapiens
tggtgagctctggcagtctgtg

SEQ ID NO: 8074377 - DNA, 22 bp, Homo sapiens
tggtgaagtcagcggagcccgg

SEQ ID NO: 8074378 - DNA, 18 bp, Homo sapiens
tggtgaagggtggaggag

SEQ ID NO: 8074379 - DNA, 22 bp, Homo sapiens
tggtctctgactctgaagaccc

SEQ ID NO: 8074380 - DNA, 22 bp, Homo sapiens
tggtcgggagcgagcagctatt

SEQ ID NO: 8074381 - DNA, 22 bp, Homo sapiens
tggtcctgccccgtgcacagag

SEQ ID NO: 8074382 - DNA, 22 bp, Homo sapiens
tggtcctgcccacgcccatctg

SEQ ID NO: 8074383 - DNA, 22 bp, Homo sapiens
tggtcctggggatctgcagtga

SEQ ID NO: 8074384 - DNA, 22 bp, Homo sapiens
tggtcctgagcaccagcctgac

SEQ ID NO: 8074385 - DNA, 22 bp, Homo sapiens
tggtcaggctgctctgcggcgt

SEQ ID NO: 8074386 - DNA, 22 bp, Homo sapiens
tggtccagacatttctgaggta

SEQ ID NO: 8074387 - DNA, 22 bp, Homo sapiens
tgtaacagtaagcctgtgagct

SEQ ID NO: 8074388 - DNA, 22 bp, Homo sapiens
tggtgtaatcagtttctagctc

SEQ ID NO: 8074389 - DNA, 22 bp, Homo sapiens
tggtggtctggctttatatcct

SEQ ID NO: 8074390 - DNA, 23 bp, Homo sapiens
tggtggggtcttggagacagcac

SEQ ID NO: 8074391 - DNA, 22 bp, Homo sapiens
tggtgtgggcgtggcaggcaag

SEQ ID NO: 8074392 - DNA, 22 bp, Homo sapiens
tggtgtgggcgtggcaggcaag

SEQ ID NO: 8074393 - DNA, 22 bp, Homo sapiens
tggtgtgggcagcagcaggtac

SEQ ID NO: 8074394 - DNA, 22 bp, Homo sapiens
tggttggggtctgcagccatcc

SEQ ID NO: 8074395 - DNA, 22 bp, Homo sapiens
tggttggctgagcagagtcact

SEQ ID NO: 8074396 - DNA, 22 bp, Homo sapiens
tggttgtggtcctccacatcgc

SEQ ID NO: 8074397 - DNA, 22 bp, Homo sapiens
tggtttgacaatgaggactggt

SEQ ID NO: 8074398 - DNA, 22 bp, Homo sapiens
tggacaggatctgagactgaga

SEQ ID NO: 8074399 - DNA, 22 bp, Homo sapiens
tggaatgagctggctaataacc

SEQ ID NO: 8074400 - DNA, 22 bp, Homo sapiens
tggaatgaatttggcttcctcc

SEQ ID NO: 8074401 - DNA, 22 bp, Homo sapiens
tggaatgaaaagtacttcagaa

SEQ ID NO: 8074402 - DNA, 22 bp, Homo sapiens
tggaatgttttcctaaatcaga

SEQ ID NO: 8074403 - DNA, 22 bp, Homo sapiens
tggaatttagttaattccattt

SEQ ID NO: 8074404 - DNA, 22 bp, Homo sapiens
tggaatgtttccccagcctgca

SEQ ID NO: 8074405 - DNA, 23 bp, Homo sapiens
tggaatgtttcttgtactgaatg

SEQ ID NO: 8074406 - DNA, 22 bp, Homo sapiens
tggaatgttgataaacataggc

SEQ ID NO: 8074407 - DNA, 22 bp, Homo sapiens
tggactggaatgctgatcctct

SEQ ID NO: 8074408 - DNA, 22 bp, Homo sapiens
tggactgggctaatggcagaca

SEQ ID NO: 8074409 - DNA, 17 bp, Homo sapiens
tggacccttgggcctcc

SEQ ID NO: 8074410 - DNA, 22 bp, Homo sapiens
tggacaggtgagtgactcaggg

SEQ ID NO: 8074411 - DNA, 18 bp, Homo sapiens
tggacagggtggagaaaa

SEQ ID NO: 8074412 - DNA, 22 bp, Homo sapiens
tggaagccaggcccgctcctaa

SEQ ID NO: 8074413 - DNA, 22 bp, Homo sapiens
tggaagcatcacttcttgcctg

SEQ ID NO: 8074414 - DNA, 22 bp, Homo sapiens
tggaagcagtgattcttgtctg

SEQ ID NO: 8074415 - DNA, 22 bp, Homo sapiens
tggaagcagtgattcttgtctg

SEQ ID NO: 8074416 - DNA, 22 bp, Homo sapiens
tggaagcagagagctatcacca

SEQ ID NO: 8074417 - DNA, 22 bp, Homo sapiens
tggaagcacttgggttttgttg

SEQ ID NO: 8074418 - DNA, 22 bp, Homo sapiens
tggaagagggagctgggtggcc

SEQ ID NO: 8074419 - DNA, 22 bp, Homo sapiens
tggaagcaaaatatcctttaat

SEQ ID NO: 8074420 - DNA, 22 bp, Homo sapiens
tggaagagcaggcagacaatgc

SEQ ID NO: 8074421 - DNA, 22 bp, Homo sapiens
tggaagggggaagacagctctg

SEQ ID NO: 8074422 - DNA, 16 bp, Homo sapiens
tggaaggggtctccgg

SEQ ID NO: 8074423 - DNA, 22 bp, Homo sapiens
tggaaggggagctggaaagggg

SEQ ID NO: 8074424 - DNA, 22 bp, Homo sapiens
tggaaggcaacggagtgagctg

SEQ ID NO: 8074425 - DNA, 22 bp, Homo sapiens
tggaaggagctaaggacctggg

SEQ ID NO: 8074426 - DNA, 22 bp, Homo sapiens
tgctttaacataagatatcttt

SEQ ID NO: 8074427 - DNA, 22 bp, Homo sapiens
tgctttaagacactaagtttga

SEQ ID NO: 8074428 - DNA, 22 bp, Homo sapiens
tgctttaaaatggactgttttg

SEQ ID NO: 8074429 - DNA, 22 bp, Homo sapiens
tgctttattcagggtttacccc

SEQ ID NO: 8074430 - DNA, 22 bp, Homo sapiens
tgctttgcaaataatagaatgt

SEQ ID NO: 8074431 - DNA, 22 bp, Homo sapiens
tgctttgcactgactccttcct

SEQ ID NO: 8074432 - DNA, 22 bp, Homo sapiens
tgctttatgtggctgatactca

SEQ ID NO: 8074433 - DNA, 21 bp, Homo sapiens
tgctttatgggaaaaatgtca

SEQ ID NO: 8074434 - DNA, 18 bp, Homo sapiens
tgctttatgcttatataa

SEQ ID NO: 8074435 - DNA, 22 bp, Homo sapiens
tgctttatcaaagctatagtga

SEQ ID NO: 8074436 - DNA, 22 bp, Homo sapiens
tgctttatatctctcttcttag

SEQ ID NO: 8074437 - DNA, 22 bp, Homo sapiens
tgctttatagacaaggaagtag

SEQ ID NO: 8074438 - DNA, 22 bp, Homo sapiens
tgctttataacttagtttatgg

SEQ ID NO: 8074439 - DNA, 22 bp, Homo sapiens
tgctttataaccatttctgtgg

SEQ ID NO: 8074440 - DNA, 22 bp, Homo sapiens
tgcttttaggagattaaaatta

SEQ ID NO: 8074441 - DNA, 21 bp, Homo sapiens
tggaaaaatgtggcctagtga

SEQ ID NO: 8074442 - DNA, 22 bp, Homo sapiens
tggaaaaactgagacttagaca

SEQ ID NO: 8074443 - DNA, 22 bp, Homo sapiens
tggaaaaaacccagactctaga

SEQ ID NO: 8074444 - DNA, 22 bp, Homo sapiens
tggaaaaaaattggctagcttc

SEQ ID NO: 8074445 - DNA, 22 bp, Homo sapiens
tggaaaaaaattggctagcttc

SEQ ID NO: 8074446 - DNA, 22 bp, Homo sapiens
tggaaagatgaagatgtttaag

SEQ ID NO: 8074447 - DNA, 21 bp, Homo sapiens
tggaaagattcaaagaccagg

SEQ ID NO: 8074448 - DNA, 22 bp, Homo sapiens
tggaaagaggtagaggatctgg

SEQ ID NO: 8074449 - DNA, 22 bp, Homo sapiens
tggaaagagatgttgtttctga

SEQ ID NO: 8074450 - DNA, 22 bp, Homo sapiens
tggaactgctccaaaacctcca

SEQ ID NO: 8074451 - DNA, 21 bp, Homo sapiens
tggaactggtgaaaacctcct

SEQ ID NO: 8074452 - DNA, 22 bp, Homo sapiens
tggagaagtcaaagtgaacagg

SEQ ID NO: 8074453 - DNA, 22 bp, Homo sapiens
tggagaagctgtaggtggactc

SEQ ID NO: 8074454 - DNA, 22 bp, Homo sapiens
tggagaggaaagtgcagttttg

SEQ ID NO: 8074455 - DNA, 22 bp, Homo sapiens
tggagcagccatgatgacagag

SEQ ID NO: 8074456 - DNA, 22 bp, Homo sapiens
tggagcagagatggtggccttc

SEQ ID NO: 8074457 - DNA, 22 bp, Homo sapiens
tggagcagagttcagcggggag

SEQ ID NO: 8074458 - DNA, 22 bp, Homo sapiens
tggagcagaggctgaggttggg

SEQ ID NO: 8074459 - DNA, 22 bp, Homo sapiens
tggagaggtttaaacaaaagtt

SEQ ID NO: 8074460 - DNA, 19 bp, Homo sapiens
tggagaggaaatgctgctc

SEQ ID NO: 8074461 - DNA, 22 bp, Homo sapiens
tggagaggttgaataacttgtc

SEQ ID NO: 8074462 - DNA, 22 bp, Homo sapiens
tggagaggagcaccatggccat

SEQ ID NO: 8074463 - DNA, 22 bp, Homo sapiens
tggagcagaaatttgaagccat

SEQ ID NO: 8074464 - DNA, 20 bp, Homo sapiens
tggagccacagtcaggttcc

SEQ ID NO: 8074465 - DNA, 22 bp, Homo sapiens
tggagccagcccaggcccctct

SEQ ID NO: 8074466 - DNA, 22 bp, Homo sapiens
tggagccagagcgcagcctggg

SEQ ID NO: 8074467 - DNA, 18 bp, Homo sapiens
tggagccagctctaggat

SEQ ID NO: 8074468 - DNA, 22 bp, Homo sapiens
tggagccaggagcctgggagtc

SEQ ID NO: 8074469 - DNA, 20 bp, Homo sapiens
tggagccaaggtgtgtctgg

SEQ ID NO: 8074470 - DNA, 22 bp, Homo sapiens
tggagccaaggccagttctcag

SEQ ID NO: 8074471 - DNA, 22 bp, Homo sapiens
tggagcatattctggagcttgg

SEQ ID NO: 8074472 - DNA, 22 bp, Homo sapiens
tggagcaggacggggagtggta

SEQ ID NO: 8074473 - DNA, 22 bp, Homo sapiens
tggagcaggtgccaggtgtgtg

SEQ ID NO: 8074474 - DNA, 22 bp, Homo sapiens
tggagcaggtgctcagggtaat

SEQ ID NO: 8074475 - DNA, 22 bp, Homo sapiens
tggagcagctaagcctctgaga

SEQ ID NO: 8074476 - DNA, 22 bp, Homo sapiens
tggagcagctgaacagagttga

SEQ ID NO: 8074477 - DNA, 22 bp, Homo sapiens
tggagcaggaagtctatggctg

SEQ ID NO: 8074478 - DNA, 22 bp, Homo sapiens
tggagctggaatttgagctgga

SEQ ID NO: 8074479 - DNA, 18 bp, Homo sapiens
tggagctgagtgctgtgc

SEQ ID NO: 8074480 - DNA, 20 bp, Homo sapiens
tggagctccagcgtccatgt

SEQ ID NO: 8074481 - DNA, 22 bp, Homo sapiens
tggagcctgtgtttctgcccag

SEQ ID NO: 8074482 - DNA, 22 bp, Homo sapiens
tggagccataaccctttcgtac

SEQ ID NO: 8074483 - DNA, 22 bp, Homo sapiens
tggagccatgcctggcctttcc

SEQ ID NO: 8074484 - DNA, 18 bp, Homo sapiens
tggagccattgccaccat

SEQ ID NO: 8074485 - DNA, 22 bp, Homo sapiens
tggagcccagacactggcattg

SEQ ID NO: 8074486 - DNA, 22 bp, Homo sapiens
tggagcctgagtcagcggaggc

SEQ ID NO: 8074487 - DNA, 22 bp, Homo sapiens
tggagcccagggtgagaaggag

SEQ ID NO: 8074488 - DNA, 20 bp, Homo sapiens
tggagctgtggtaaggagca

SEQ ID NO: 8074489 - DNA, 22 bp, Homo sapiens
tggagctggtaaacagtgacat

SEQ ID NO: 8074490 - DNA, 22 bp, Homo sapiens
tggaggagaatttatggtcgaa

SEQ ID NO: 8074491 - DNA, 22 bp, Homo sapiens
tggaggagaatttatggtcgaa

SEQ ID NO: 8074492 - DNA, 22 bp, Homo sapiens
tggaggagaactccctggctac

SEQ ID NO: 8074493 - DNA, 22 bp, Homo sapiens
tggaggaaaattactggggtct

SEQ ID NO: 8074494 - DNA, 19 bp, Homo sapiens
tggaggagaggaaaagtca

SEQ ID NO: 8074495 - DNA, 19 bp, Homo sapiens
tggaggagaggaaaagtca

SEQ ID NO: 8074496 - DNA, 22 bp, Homo sapiens
tggaggagaccgcattttattt

SEQ ID NO: 8074497 - DNA, 22 bp, Homo sapiens
tggaggaggatgcatttgttgt

SEQ ID NO: 8074498 - DNA, 22 bp, Homo sapiens
tggaggagggctggtgtctgta

SEQ ID NO: 8074499 - DNA, 22 bp, Homo sapiens
tggaggagggctggtgtctgta

SEQ ID NO: 8074500 - DNA, 22 bp, Homo sapiens
tggaggatgcctggggaggcct

SEQ ID NO: 8074501 - DNA, 22 bp, Homo sapiens
tggaggatgagtgtgggctctg

SEQ ID NO: 8074502 - DNA, 22 bp, Homo sapiens
tggaggatgccatccaggatac

SEQ ID NO: 8074503 - DNA, 22 bp, Homo sapiens
tggaggcaccactggctgcccg

SEQ ID NO: 8074504 - DNA, 22 bp, Homo sapiens
tggagtgaagtaaagaggacaa

SEQ ID NO: 8074505 - DNA, 23 bp, Homo sapiens
tggaggttttactgagttgagga

SEQ ID NO: 8074506 - DNA, 22 bp, Homo sapiens
tggaggtggcatctgacagctg

SEQ ID NO: 8074507 - DNA, 22 bp, Homo sapiens
tggagggctctttcacctggta

SEQ ID NO: 8074508 - DNA, 22 bp, Homo sapiens
tggagggcatctgtggtcaggc

SEQ ID NO: 8074509 - DNA, 22 bp, Homo sapiens
tggagggcatgctgtccatggg

SEQ ID NO: 8074510 - DNA, 22 bp, Homo sapiens
tggaggctggagtgcagtggcg

SEQ ID NO: 8074511 - DNA, 22 bp, Homo sapiens
tggagggaacccaggctgctct

SEQ ID NO: 8074512 - DNA, 17 bp, Homo sapiens
tgctcctgggacaagga

SEQ ID NO: 8074513 - DNA, 22 bp, Homo sapiens
tgctcctgtttcatcagctata

SEQ ID NO: 8074514 - DNA, 17 bp, Homo sapiens
tgctcctgtggcagcct

SEQ ID NO: 8074515 - DNA, 22 bp, Homo sapiens
tgctcctgggctgaagcacact

SEQ ID NO: 8074516 - DNA, 21 bp, Homo sapiens
tgctcctttaccccacaagac

SEQ ID NO: 8074517 - DNA, 22 bp, Homo sapiens
tgctccttcccttcccagtgag

SEQ ID NO: 8074518 - DNA, 22 bp, Homo sapiens
tgctctggggagctcctctgcg

SEQ ID NO: 8074519 - DNA, 22 bp, Homo sapiens
tgctctgggcaacagcctccct

SEQ ID NO: 8074520 - DNA, 23 bp, Homo sapiens
tgctctgggaggccctggagagc

SEQ ID NO: 8074521 - DNA, 22 bp, Homo sapiens
tgctctctcaggcctggcccac

SEQ ID NO: 8074522 - DNA, 22 bp, Homo sapiens
tgctcctgagcggtttccatga

SEQ ID NO: 8074523 - DNA, 22 bp, Homo sapiens
tgctcctgctgcatgcatctcc

SEQ ID NO: 8074524 - DNA, 22 bp, Homo sapiens
tgctccctgctcagagaggcca

SEQ ID NO: 8074525 - DNA, 22 bp, Homo sapiens
tgctcccaggctctgtggtctg

SEQ ID NO: 8074526 - DNA, 22 bp, Homo sapiens
tgctgaggaggtggctgtgctt

SEQ ID NO: 8074527 - DNA, 22 bp, Homo sapiens
tgctcttcaccattacatcatg

SEQ ID NO: 8074528 - DNA, 22 bp, Homo sapiens
tgctcttcacagtttcagcatc

SEQ ID NO: 8074529 - DNA, 22 bp, Homo sapiens
tgctcttcggggccactgcttg

SEQ ID NO: 8074530 - DNA, 18 bp, Homo sapiens
tgctctgtttaatgattt

SEQ ID NO: 8074531 - DNA, 22 bp, Homo sapiens
tgctctgttgtgcatgtgggat

SEQ ID NO: 8074532 - DNA, 22 bp, Homo sapiens
tgctctgtattctatggcagtt

SEQ ID NO: 8074533 - DNA, 22 bp, Homo sapiens
tgctctgtaacaaattgacatg

SEQ ID NO: 8074534 - DNA, 22 bp, Homo sapiens
tgctctgtcaagaaaagatgcc

SEQ ID NO: 8074535 - DNA, 22 bp, Homo sapiens
tgctctgtggtccaagatggct

SEQ ID NO: 8074536 - DNA, 23 bp, Homo sapiens
tgctctgtgaatagttggtgact

SEQ ID NO: 8074537 - DNA, 22 bp, Homo sapiens
tgctctggtaactcacttccat

SEQ ID NO: 8074538 - DNA, 22 bp, Homo sapiens
tgctctggtcctccctcggcgc

SEQ ID NO: 8074539 - DNA, 18 bp, Homo sapiens
tgctctggtctcacttgg

SEQ ID NO: 8074540 - DNA, 22 bp, Homo sapiens
tgctctgggtcctgggcctcct

SEQ ID NO: 8074541 - DNA, 22 bp, Homo sapiens
tgctgaggtcaccttgctgcta

SEQ ID NO: 8074542 - DNA, 22 bp, Homo sapiens
tgcctgggtgctggctggtcac

SEQ ID NO: 8074543 - DNA, 22 bp, Homo sapiens
tgcctgggttgactcttagctg

SEQ ID NO: 8074544 - DNA, 22 bp, Homo sapiens
tgcctgtgacccaaggatgcga

SEQ ID NO: 8074545 - DNA, 21 bp, Homo sapiens
tgcctggcctttgcttttcct

SEQ ID NO: 8074546 - DNA, 22 bp, Homo sapiens
tgcctttaacttaaagcatgac

SEQ ID NO: 8074547 - DNA, 22 bp, Homo sapiens
tgccttttccagttcctagaag

SEQ ID NO: 8074548 - DNA, 22 bp, Homo sapiens
tgcgaccctagccccctcactt

SEQ ID NO: 8074549 - DNA, 22 bp, Homo sapiens
tgcgttgcgctcctgcagcagg

SEQ ID NO: 8074550 - DNA, 22 bp, Homo sapiens
tgcggcaggagaaggtgttatg

SEQ ID NO: 8074551 - DNA, 22 bp, Homo sapiens
tgcggcagccaccgcgtggccc

SEQ ID NO: 8074552 - DNA, 22 bp, Homo sapiens
tgctatttaacttttatgtgta

SEQ ID NO: 8074553 - DNA, 22 bp, Homo sapiens
tgctcagcacagaccaggccag

SEQ ID NO: 8074554 - DNA, 22 bp, Homo sapiens
tgctcacaattatcagaagtat

SEQ ID NO: 8074555 - DNA, 22 bp, Homo sapiens
tgctcaatgtcttatgagactg

SEQ ID NO: 8074556 - DNA, 22 bp, Homo sapiens
tgctcactctattcacagtgcc

SEQ ID NO: 8074557 - DNA, 22 bp, Homo sapiens
tgctcactgaactcttgctgtc

SEQ ID NO: 8074558 - DNA, 22 bp, Homo sapiens
tgctcattggcgatctgaggga

SEQ ID NO: 8074559 - DNA, 19 bp, Homo sapiens
tgctcatggggacttctcc

SEQ ID NO: 8074560 - DNA, 21 bp, Homo sapiens
tgctcatgcaatgcatgtcca

SEQ ID NO: 8074561 - DNA, 22 bp, Homo sapiens
tgctcatcaacatgatgatcat

SEQ ID NO: 8074562 - DNA, 22 bp, Homo sapiens
tgctcagctggtgccagggtcc

SEQ ID NO: 8074563 - DNA, 22 bp, Homo sapiens
tgcttatttgaatttattctca

SEQ ID NO: 8074564 - DNA, 22 bp, Homo sapiens
tgcttatttaggtagatattaa

SEQ ID NO: 8074565 - DNA, 22 bp, Homo sapiens
tgcttatcgtttagtacattgc

SEQ ID NO: 8074566 - DNA, 22 bp, Homo sapiens
tgcttattaacatgtatatctc

SEQ ID NO: 8074567 - DNA, 23 bp, Homo sapiens
tgcttattcaaaaggtgctttca

SEQ ID NO: 8074568 - DNA, 22 bp, Homo sapiens
tgcttattaaacatgcatattc

SEQ ID NO: 8074569 - DNA, 22 bp, Homo sapiens
tgcttcagcactttgagagcct

SEQ ID NO: 8074570 - DNA, 22 bp, Homo sapiens
tgcttcagtcctatgggcaggt

SEQ ID NO: 8074571 - DNA, 20 bp, Homo sapiens
tgcttcattatgtgagatag

SEQ ID NO: 8074572 - DNA, 22 bp, Homo sapiens
tgcttctcccaaccagggcctg

SEQ ID NO: 8074573 - DNA, 21 bp, Homo sapiens
tgcttctctagatcaactact

SEQ ID NO: 8074574 - DNA, 23 bp, Homo sapiens
tgcttctctgcttgacagttctg

SEQ ID NO: 8074575 - DNA, 22 bp, Homo sapiens
tgctgtcttttcccaatcctgg

SEQ ID NO: 8074576 - DNA, 22 bp, Homo sapiens
tgctgtcttccaggatggtgaa

SEQ ID NO: 8074577 - DNA, 22 bp, Homo sapiens
tgctgtccctaagtctcttcaa

SEQ ID NO: 8074578 - DNA, 22 bp, Homo sapiens
tgctgtcctgctgagggatgtg

SEQ ID NO: 8074579 - DNA, 22 bp, Homo sapiens
tgctgtctgattcagggtgatt

SEQ ID NO: 8074580 - DNA, 22 bp, Homo sapiens
tgctgtctgcaacagtactaca

SEQ ID NO: 8074581 - DNA, 22 bp, Homo sapiens
tgcttaatattgtgatgtaata

SEQ ID NO: 8074582 - DNA, 22 bp, Homo sapiens
tgcttaatagtgcactggtttc

SEQ ID NO: 8074583 - DNA, 22 bp, Homo sapiens
tgcttaatgtacgtgagtgtac

SEQ ID NO: 8074584 - DNA, 22 bp, Homo sapiens
tgcttaaacacatacatacata

SEQ ID NO: 8074585 - DNA, 22 bp, Homo sapiens
tgcttaaacatccagacagtat

SEQ ID NO: 8074586 - DNA, 22 bp, Homo sapiens
tgctgggctgttcctgtccatg

SEQ ID NO: 8074587 - DNA, 22 bp, Homo sapiens
tgctgggctgttcctgtccatg

SEQ ID NO: 8074588 - DNA, 22 bp, Homo sapiens
tgctggggtctctccggtgccc

SEQ ID NO: 8074589 - DNA, 23 bp, Homo sapiens
tgctggggtagtttgtggcacag

SEQ ID NO: 8074590 - DNA, 23 bp, Homo sapiens
tgctggggtagtttgtggcacag

SEQ ID NO: 8074591 - DNA, 22 bp, Homo sapiens
tgctggggtcatggggcgcccg

SEQ ID NO: 8074592 - DNA, 22 bp, Homo sapiens
tgctggggtcatggggcgcccg

SEQ ID NO: 8074593 - DNA, 20 bp, Homo sapiens
tgctggggacatacagggtg

SEQ ID NO: 8074594 - DNA, 22 bp, Homo sapiens
tgctggggagtgattgaccatc

SEQ ID NO: 8074595 - DNA, 20 bp, Homo sapiens
tgctggggacatacagggtg

SEQ ID NO: 8074596 - DNA, 22 bp, Homo sapiens
tgctggggatccgtaccaaccc

SEQ ID NO: 8074597 - DNA, 22 bp, Homo sapiens
tgctggggcagaagagccaaga

SEQ ID NO: 8074598 - DNA, 22 bp, Homo sapiens
tgctgtcaagaaaacaagcaat

SEQ ID NO: 8074599 - DNA, 23 bp, Homo sapiens
tgctgtccaacagactggccatg

SEQ ID NO: 8074600 - DNA, 23 bp, Homo sapiens
tgctggtgtttttgggaccaggg

SEQ ID NO: 8074601 - DNA, 23 bp, Homo sapiens
tgctggtgtttttgggaccaggg

SEQ ID NO: 8074602 - DNA, 21 bp, Homo sapiens
tgctggtgagctcatgtggct

SEQ ID NO: 8074603 - DNA, 22 bp, Homo sapiens
tgctggtggagaaagtggaggt

SEQ ID NO: 8074604 - DNA, 22 bp, Homo sapiens
tgctggtggagaaagtggaggt

SEQ ID NO: 8074605 - DNA, 22 bp, Homo sapiens
tgctgcatttgcagtcctttaa

SEQ ID NO: 8074606 - DNA, 22 bp, Homo sapiens
tgctgcatagcagctcctgaaa

SEQ ID NO: 8074607 - DNA, 21 bp, Homo sapiens
tgctgccatagacctgaggga

SEQ ID NO: 8074608 - DNA, 22 bp, Homo sapiens
tgctgctcctgcctggctccca

SEQ ID NO: 8074609 - DNA, 22 bp, Homo sapiens
tgctgctccccagcacacagca

SEQ ID NO: 8074610 - DNA, 22 bp, Homo sapiens
tgctgctcttcaccatggcctc

SEQ ID NO: 8074611 - DNA, 22 bp, Homo sapiens
tgctgctctcagccaccaggaa

SEQ ID NO: 8074612 - DNA, 22 bp, Homo sapiens
tgctgctctgtaaagtgatgag

SEQ ID NO: 8074613 - DNA, 22 bp, Homo sapiens
tgctgctgggtttgacagtcac

SEQ ID NO: 8074614 - DNA, 22 bp, Homo sapiens
tgctgctgtatcatgccttcat

SEQ ID NO: 8074615 - DNA, 19 bp, Homo sapiens
tgctgctgtccttgcaggg

SEQ ID NO: 8074616 - DNA, 20 bp, Homo sapiens
tgctgctttgccactagttg

SEQ ID NO: 8074617 - DNA, 22 bp, Homo sapiens
tgctggctatttaaagaagaaa

SEQ ID NO: 8074618 - DNA, 22 bp, Homo sapiens
tgctggctcagtttgcagactc

SEQ ID NO: 8074619 - DNA, 22 bp, Homo sapiens
tgctggccaacaaggctccaag

SEQ ID NO: 8074620 - DNA, 22 bp, Homo sapiens
tgctggctactgatggcaggcc

SEQ ID NO: 8074621 - DNA, 21 bp, Homo sapiens
tgctggctgaaaggcacagag

SEQ ID NO: 8074622 - DNA, 22 bp, Homo sapiens
tgctggctgtatatgtgagagt

SEQ ID NO: 8074623 - DNA, 22 bp, Homo sapiens
tgctggctggcctggcctggac

SEQ ID NO: 8074624 - DNA, 22 bp, Homo sapiens
tgctggctgggctgctggagac

SEQ ID NO: 8074625 - DNA, 23 bp, Homo sapiens
tgctggctgtgttattgccaaca

SEQ ID NO: 8074626 - DNA, 22 bp, Homo sapiens
tgctggaggcctgactgtgttt

SEQ ID NO: 8074627 - DNA, 22 bp, Homo sapiens
tgctggaggagtttactgtggc

SEQ ID NO: 8074628 - DNA, 22 bp, Homo sapiens
tgctggaggcagtggaggtgcc

SEQ ID NO: 8074629 - DNA, 22 bp, Homo sapiens
tgctggaggggcctgaccagga

SEQ ID NO: 8074630 - DNA, 22 bp, Homo sapiens
tggcagcagcaaatggcatatc

SEQ ID NO: 8074631 - DNA, 23 bp, Homo sapiens
tggcagcagatcttaaagtgacc

SEQ ID NO: 8074632 - DNA, 22 bp, Homo sapiens
tggcagcagacatctgaggtct

SEQ ID NO: 8074633 - DNA, 22 bp, Homo sapiens
tggcagcagacaaaaggccatt

SEQ ID NO: 8074634 - DNA, 22 bp, Homo sapiens
tggcagcagacaaaaggccatt

SEQ ID NO: 8074635 - DNA, 22 bp, Homo sapiens
tggcagcagccatggaaggccc

SEQ ID NO: 8074636 - DNA, 22 bp, Homo sapiens
tggcagcagccatggaaggccc

SEQ ID NO: 8074637 - DNA, 22 bp, Homo sapiens
tggcagcagctaacttaggcag

SEQ ID NO: 8074638 - DNA, 18 bp, Homo sapiens
tggcagcaggaagccatt

SEQ ID NO: 8074639 - DNA, 18 bp, Homo sapiens
tggcagcaggaagccatt

SEQ ID NO: 8074640 - DNA, 22 bp, Homo sapiens
tggcagcagtggaggtagaaag

SEQ ID NO: 8074641 - DNA, 22 bp, Homo sapiens
tggcagcatgttatgtaaggaa

SEQ ID NO: 8074642 - DNA, 22 bp, Homo sapiens
tggcagcagggaggccagtgtt

SEQ ID NO: 8074643 - DNA, 22 bp, Homo sapiens
tggcagcagggaggccagtgtt

SEQ ID NO: 8074644 - DNA, 22 bp, Homo sapiens
tggcagcagggcccctggagga

SEQ ID NO: 8074645 - DNA, 22 bp, Homo sapiens
tggcagcagggcccctggagga

SEQ ID NO: 8074646 - DNA, 22 bp, Homo sapiens
tggcagccatcagagcaggggt

SEQ ID NO: 8074647 - DNA, 22 bp, Homo sapiens
tggcagccacatctcgtggatt

SEQ ID NO: 8074648 - DNA, 22 bp, Homo sapiens
tggcagcattttttccagaaca

SEQ ID NO: 8074649 - DNA, 19 bp, Homo sapiens
tggcagcattggtaccttg

SEQ ID NO: 8074650 - DNA, 22 bp, Homo sapiens
tggcagcattttttccagaaca

SEQ ID NO: 8074651 - DNA, 22 bp, Homo sapiens
tggcagcattaattattcaggt

SEQ ID NO: 8074652 - DNA, 19 bp, Homo sapiens
tggcagcattggtaccttg

SEQ ID NO: 8074653 - DNA, 22 bp, Homo sapiens
tggcagctacagacagaggtga

SEQ ID NO: 8074654 - DNA, 22 bp, Homo sapiens
tggcagctacagacagaggtga

SEQ ID NO: 8074655 - DNA, 22 bp, Homo sapiens
tggcagctcctggggccagcac

SEQ ID NO: 8074656 - DNA, 22 bp, Homo sapiens
tggcagctccgggtaggggctg

SEQ ID NO: 8074657 - DNA, 22 bp, Homo sapiens
tggcagagtaggatggccctgt

SEQ ID NO: 8074658 - DNA, 22 bp, Homo sapiens
tggcagagtcatcacatctgga

SEQ ID NO: 8074659 - DNA, 22 bp, Homo sapiens
tggcagagtcatcacatctgga

SEQ ID NO: 8074660 - DNA, 22 bp, Homo sapiens
tggcagagtctctcctttccag

SEQ ID NO: 8074661 - DNA, 22 bp, Homo sapiens
tggcagagtctgggcttgggca

SEQ ID NO: 8074662 - DNA, 22 bp, Homo sapiens
tggcagcacttgaacttgagcc

SEQ ID NO: 8074663 - DNA, 22 bp, Homo sapiens
tggcagcacttgaacttgagcc

SEQ ID NO: 8074664 - DNA, 22 bp, Homo sapiens
tggcagagttggaggtggaaga

SEQ ID NO: 8074665 - DNA, 22 bp, Homo sapiens
tggcagagttcgctgtgccttt

SEQ ID NO: 8074666 - DNA, 22 bp, Homo sapiens
tggcagagttcgctcctattca

SEQ ID NO: 8074667 - DNA, 21 bp, Homo sapiens
tggcagagttgagtagttatg

SEQ ID NO: 8074668 - DNA, 22 bp, Homo sapiens
tggcagagttatgggtatttat

SEQ ID NO: 8074669 - DNA, 18 bp, Homo sapiens
tggcagagtgtctgttct

SEQ ID NO: 8074670 - DNA, 22 bp, Homo sapiens
tggcagagtggaccatactcaa

SEQ ID NO: 8074671 - DNA, 22 bp, Homo sapiens
tggcaggggaggtgcttgctta

SEQ ID NO: 8074672 - DNA, 21 bp, Homo sapiens
tggcaggggtagtagtacagc

SEQ ID NO: 8074673 - DNA, 22 bp, Homo sapiens
tggcagggcctgaatcttatac

SEQ ID NO: 8074674 - DNA, 22 bp, Homo sapiens
tggcagggcctaccccaatatc

SEQ ID NO: 8074675 - DNA, 22 bp, Homo sapiens
tggcagggcctgctcatcatcc

SEQ ID NO: 8074676 - DNA, 22 bp, Homo sapiens
tggcagggagttgcaggatttc

SEQ ID NO: 8074677 - DNA, 21 bp, Homo sapiens
tggcaggcagctggaagcttg

SEQ ID NO: 8074678 - DNA, 18 bp, Homo sapiens
tggcagggaggaaatata

SEQ ID NO: 8074679 - DNA, 19 bp, Homo sapiens
tggcagggagtgatattag

SEQ ID NO: 8074680 - DNA, 22 bp, Homo sapiens
tggcaggaggttttctccagga

SEQ ID NO: 8074681 - DNA, 22 bp, Homo sapiens
tggcaggaggttttctccagga

SEQ ID NO: 8074682 - DNA, 22 bp, Homo sapiens
tggcagctgattagatggtgcc

SEQ ID NO: 8074683 - DNA, 22 bp, Homo sapiens
tggcagctgattagatggtgcc

SEQ ID NO: 8074684 - DNA, 22 bp, Homo sapiens
tggcagctgaggggaggctttg

SEQ ID NO: 8074685 - DNA, 22 bp, Homo sapiens
tggcagagaacacggctgatct

SEQ ID NO: 8074686 - DNA, 22 bp, Homo sapiens
tggcagagaacctgggctttgt

SEQ ID NO: 8074687 - DNA, 22 bp, Homo sapiens
tggcagagaataaatcttgact

SEQ ID NO: 8074688 - DNA, 23 bp, Homo sapiens
tggcagagacccagaatctacat

SEQ ID NO: 8074689 - DNA, 22 bp, Homo sapiens
tggcagagagagtgcagtcgac

SEQ ID NO: 8074690 - DNA, 22 bp, Homo sapiens
tggcagagagactctccttgat

SEQ ID NO: 8074691 - DNA, 22 bp, Homo sapiens
tggcagagctggctgcggatga

SEQ ID NO: 8074692 - DNA, 22 bp, Homo sapiens
tggcagaggaaaaagtcactgg

SEQ ID NO: 8074693 - DNA, 22 bp, Homo sapiens
tggcagagcccagactccagtc

SEQ ID NO: 8074694 - DNA, 22 bp, Homo sapiens
tggcagagcccagaactgagca

SEQ ID NO: 8074695 - DNA, 22 bp, Homo sapiens
tggcagagatgaagagttgttt

SEQ ID NO: 8074696 - DNA, 22 bp, Homo sapiens
tggcagagcaaaaagatagaat

SEQ ID NO: 8074697 - DNA, 22 bp, Homo sapiens
tggcactgccaacctgctaggt

SEQ ID NO: 8074698 - DNA, 23 bp, Homo sapiens
tggcaccaggcattctaggggta

SEQ ID NO: 8074699 - DNA, 22 bp, Homo sapiens
tggcaatgttagcaaagcattt

SEQ ID NO: 8074700 - DNA, 22 bp, Homo sapiens
tggcaaagtttatcaggaatat

SEQ ID NO: 8074701 - DNA, 22 bp, Homo sapiens
tggcaaagtatctgtcccagct

SEQ ID NO: 8074702 - DNA, 22 bp, Homo sapiens
tggcaaagtgactccttggggc

SEQ ID NO: 8074703 - DNA, 22 bp, Homo sapiens
tggcaaaggcgctcacatgcct

SEQ ID NO: 8074704 - DNA, 22 bp, Homo sapiens
tggcaaaggaacctattttaaa

SEQ ID NO: 8074705 - DNA, 22 bp, Homo sapiens
tggcaaagtaattgggtttctc

SEQ ID NO: 8074706 - DNA, 22 bp, Homo sapiens
tggcaaaggggaccatgttgaa

SEQ ID NO: 8074707 - DNA, 23 bp, Homo sapiens
tggcaaagcattcttataacagt

SEQ ID NO: 8074708 - DNA, 22 bp, Homo sapiens
tggcaaagattaccacatctac

SEQ ID NO: 8074709 - DNA, 22 bp, Homo sapiens
tggcaaagctagacattccctc

SEQ ID NO: 8074710 - DNA, 22 bp, Homo sapiens
tggcaaaggaaatgatttaaga

SEQ ID NO: 8074711 - DNA, 22 bp, Homo sapiens
tggcaaagaccgcaattacttt

SEQ ID NO: 8074712 - DNA, 22 bp, Homo sapiens
tggcaaagactgcaaggacttt

SEQ ID NO: 8074713 - DNA, 22 bp, Homo sapiens
tggcaaagacgctagctaagat

SEQ ID NO: 8074714 - DNA, 22 bp, Homo sapiens
tggcaaagatggttctcaccat

SEQ ID NO: 8074715 - DNA, 22 bp, Homo sapiens
tggcaaagatgaagcatttcgt

SEQ ID NO: 8074716 - DNA, 22 bp, Homo sapiens
tggccctgcagaactagcctgg

SEQ ID NO: 8074717 - DNA, 22 bp, Homo sapiens
tggccctgactgatgtggaggg

SEQ ID NO: 8074718 - DNA, 22 bp, Homo sapiens
tggccctgacaggtcctgggca

SEQ ID NO: 8074719 - DNA, 22 bp, Homo sapiens
tggccctcagtcttgctcctgc

SEQ ID NO: 8074720 - DNA, 22 bp, Homo sapiens
tggccctgtccctggagcctgg

SEQ ID NO: 8074721 - DNA, 22 bp, Homo sapiens
tggccctgccactcactgctga

SEQ ID NO: 8074722 - DNA, 21 bp, Homo sapiens
tggccctggccacggctgcca

SEQ ID NO: 8074723 - DNA, 20 bp, Homo sapiens
tggccctgttttctccaggc

SEQ ID NO: 8074724 - DNA, 22 bp, Homo sapiens
tggccgggccgggcgcctccac

SEQ ID NO: 8074725 - DNA, 23 bp, Homo sapiens
tggccctgtgcatgctgcttccc

SEQ ID NO: 8074726 - DNA, 22 bp, Homo sapiens
tggccctgtgtcctgctgccag

SEQ ID NO: 8074727 - DNA, 22 bp, Homo sapiens
tggcctgccttcgctgagctga

SEQ ID NO: 8074728 - DNA, 22 bp, Homo sapiens
tggcctgctttcatttgatgct

SEQ ID NO: 8074729 - DNA, 22 bp, Homo sapiens
tggcctgactgtcaggctgtat

SEQ ID NO: 8074730 - DNA, 23 bp, Homo sapiens
tggcctgcagagtttctgctggg

SEQ ID NO: 8074731 - DNA, 23 bp, Homo sapiens
tggcctgcagagtttctgctggg

SEQ ID NO: 8074732 - DNA, 22 bp, Homo sapiens
tggcctgcagaggctgtggggc

SEQ ID NO: 8074733 - DNA, 22 bp, Homo sapiens
tggcctgcctcccggcttcttt

SEQ ID NO: 8074734 - DNA, 22 bp, Homo sapiens
tggcctgccccgagatcctggc

SEQ ID NO: 8074735 - DNA, 22 bp, Homo sapiens
tggcctgcccagagcagctctg

SEQ ID NO: 8074736 - DNA, 22 bp, Homo sapiens
tggcctgcagctctcagggaag

SEQ ID NO: 8074737 - DNA, 21 bp, Homo sapiens
tggcatggaggtagcagtgtg

SEQ ID NO: 8074738 - DNA, 22 bp, Homo sapiens
tggcatggcaaccctgcaggga

SEQ ID NO: 8074739 - DNA, 22 bp, Homo sapiens
tggcatgggtggagagagcaca

SEQ ID NO: 8074740 - DNA, 22 bp, Homo sapiens
tggcatgggccagggagagctg

SEQ ID NO: 8074741 - DNA, 17 bp, Homo sapiens
tggcatcttttgctcat

SEQ ID NO: 8074742 - DNA, 22 bp, Homo sapiens
tggcagtggctcagagtgcaga

SEQ ID NO: 8074743 - DNA, 22 bp, Homo sapiens
tggcagtgttgtgccacattcc

SEQ ID NO: 8074744 - DNA, 22 bp, Homo sapiens
tggcagtgtttctaaggggctc

SEQ ID NO: 8074745 - DNA, 22 bp, Homo sapiens
tggcagtgtgtgagctgttatt

SEQ ID NO: 8074746 - DNA, 19 bp, Homo sapiens
tggcagtgtggggtatgaa

SEQ ID NO: 8074747 - DNA, 22 bp, Homo sapiens
tggcagtggcatcaccccaata

SEQ ID NO: 8074748 - DNA, 22 bp, Homo sapiens
tggcagtggcactgcccccata

SEQ ID NO: 8074749 - DNA, 22 bp, Homo sapiens
tggcagtggcgggactcagggc

SEQ ID NO: 8074750 - DNA, 22 bp, Homo sapiens
tggcagtgccccttgaccagtg

SEQ ID NO: 8074751 - DNA, 22 bp, Homo sapiens
tggcagtgctgcagtgccctta

SEQ ID NO: 8074752 - DNA, 22 bp, Homo sapiens
tggcagtggataggggagcggt

SEQ ID NO: 8074753 - DNA, 23 bp, Homo sapiens
tggcagtgatcaaaagcttacat

SEQ ID NO: 8074754 - DNA, 22 bp, Homo sapiens
tggcagtgatgcggcaggacat

SEQ ID NO: 8074755 - DNA, 18 bp, Homo sapiens
tggcagtgccaccttctc

SEQ ID NO: 8074756 - DNA, 22 bp, Homo sapiens
tggcagtgatgcttatggtttg

SEQ ID NO: 8074757 - DNA, 23 bp, Homo sapiens
tggcagtgcccagggagatgatc

SEQ ID NO: 8074758 - DNA, 22 bp, Homo sapiens
tggcagtgaaagacaattgggc

SEQ ID NO: 8074759 - DNA, 22 bp, Homo sapiens
tggcagtgaaccaaggctccaa

SEQ ID NO: 8074760 - DNA, 22 bp, Homo sapiens
tggcagtgaagctgtctttagg

SEQ ID NO: 8074761 - DNA, 18 bp, Homo sapiens
tggcagtgaggtaggcat

SEQ ID NO: 8074762 - DNA, 22 bp, Homo sapiens
tggcaggttaacttacaactgt

SEQ ID NO: 8074763 - DNA, 22 bp, Homo sapiens
tggcaggtggctctggcattct

SEQ ID NO: 8074764 - DNA, 22 bp, Homo sapiens
tggcaggtggagacagcagagc

SEQ ID NO: 8074765 - DNA, 22 bp, Homo sapiens
tggcagggtcttgctgtgttgc

SEQ ID NO: 8074766 - DNA, 22 bp, Homo sapiens
tggcagggtgccagttgcgagt

SEQ ID NO: 8074767 - DNA, 22 bp, Homo sapiens
tggcatttagagaaatgaagga

SEQ ID NO: 8074768 - DNA, 22 bp, Homo sapiens
tggccacccagctgacgccttc

SEQ ID NO: 8074769 - DNA, 22 bp, Homo sapiens
tggccagcagagttcactctct

SEQ ID NO: 8074770 - DNA, 22 bp, Homo sapiens
tggccaggggagttcccctcca

SEQ ID NO: 8074771 - DNA, 22 bp, Homo sapiens
tggccaggtgtgggttctcaga

SEQ ID NO: 8074772 - DNA, 22 bp, Homo sapiens
tggccaggtgtgggttctcaga

SEQ ID NO: 8074773 - DNA, 22 bp, Homo sapiens
tggccaggttgggctttgcagc

SEQ ID NO: 8074774 - DNA, 20 bp, Homo sapiens
tgggactgacccatctgagc

SEQ ID NO: 8074775 - DNA, 21 bp, Homo sapiens
tgggacagtgatggctcctcc

SEQ ID NO: 8074776 - DNA, 22 bp, Homo sapiens
tgggacagtgaccccagaggtc

SEQ ID NO: 8074777 - DNA, 22 bp, Homo sapiens
tgggacagttgtcctccactct

SEQ ID NO: 8074778 - DNA, 22 bp, Homo sapiens
tgggaccaagtcatttctttag

SEQ ID NO: 8074779 - DNA, 22 bp, Homo sapiens
tgggacaggttggagagaagca

SEQ ID NO: 8074780 - DNA, 22 bp, Homo sapiens
tgggaatggatgctaagtgcta

SEQ ID NO: 8074781 - DNA, 22 bp, Homo sapiens
tgggaggatcgcttgagcccag

SEQ ID NO: 8074782 - DNA, 22 bp, Homo sapiens
tgggaggagccctctgggaagg

SEQ ID NO: 8074783 - DNA, 22 bp, Homo sapiens
tgggaggaatgtcactgagcca

SEQ ID NO: 8074784 - DNA, 22 bp, Homo sapiens
tgggaggacttgtgggcttcat

SEQ ID NO: 8074785 - DNA, 22 bp, Homo sapiens
tgggagctggggttggacgtct

SEQ ID NO: 8074786 - DNA, 20 bp, Homo sapiens
tgggagctggtgaggtctca

SEQ ID NO: 8074787 - DNA, 22 bp, Homo sapiens
tgggagcaagctggtgctggag

SEQ ID NO: 8074788 - DNA, 22 bp, Homo sapiens
tgggagcaggaagcaggaagta

SEQ ID NO: 8074789 - DNA, 21 bp, Homo sapiens
tgggagagggctcagctaccc

SEQ ID NO: 8074790 - DNA, 22 bp, Homo sapiens
tgggagagtgctcaatgtgcaa

SEQ ID NO: 8074791 - DNA, 22 bp, Homo sapiens
tgggagaagcagcagccaagtg

SEQ ID NO: 8074792 - DNA, 22 bp, Homo sapiens
tggctggggcctgaatcctgca

SEQ ID NO: 8074793 - DNA, 22 bp, Homo sapiens
tggctggggccacagttttcct

SEQ ID NO: 8074794 - DNA, 22 bp, Homo sapiens
tggctggggagccccgactccc

SEQ ID NO: 8074795 - DNA, 22 bp, Homo sapiens
tggctggggagccccgactccc

SEQ ID NO: 8074796 - DNA, 22 bp, Homo sapiens
tggctgggccgggccttgtgcc

SEQ ID NO: 8074797 - DNA, 19 bp, Homo sapiens
tggctgggcgtgcctccgt

SEQ ID NO: 8074798 - DNA, 19 bp, Homo sapiens
tggctgggcgtgcctccgt

SEQ ID NO: 8074799 - DNA, 22 bp, Homo sapiens
tggctgggtgctatccagtact

SEQ ID NO: 8074800 - DNA, 22 bp, Homo sapiens
tggctggtcacatggtaggtct

SEQ ID NO: 8074801 - DNA, 22 bp, Homo sapiens
tggctggttttggtgagctccg

SEQ ID NO: 8074802 - DNA, 22 bp, Homo sapiens
tggctggtgggcctcagcctgc

SEQ ID NO: 8074803 - DNA, 21 bp, Homo sapiens
tggctggtggcagggcttctc

SEQ ID NO: 8074804 - DNA, 22 bp, Homo sapiens
tggctgtcagctgcctggtgcg

SEQ ID NO: 8074805 - DNA, 22 bp, Homo sapiens
tggctgggggtgctatagctgc

SEQ ID NO: 8074806 - DNA, 19 bp, Homo sapiens
tggctgggtgccaatggcc

SEQ ID NO: 8074807 - DNA, 22 bp, Homo sapiens
tggctgtgtcatcatagctgtg

SEQ ID NO: 8074808 - DNA, 22 bp, Homo sapiens
tggcttcaaaatctagtggtct

SEQ ID NO: 8074809 - DNA, 22 bp, Homo sapiens
tggctgggcccccacctgcctc

SEQ ID NO: 8074810 - DNA, 22 bp, Homo sapiens
tggctgggcccccacctgcctc

SEQ ID NO: 8074811 - DNA, 22 bp, Homo sapiens
tggctgggagctggaactgggc

SEQ ID NO: 8074812 - DNA, 22 bp, Homo sapiens
tggctggcagtaggctagtggc

SEQ ID NO: 8074813 - DNA, 23 bp, Homo sapiens
tggctggcagaaactgaagcatg

SEQ ID NO: 8074814 - DNA, 22 bp, Homo sapiens
tggctggccctgggagtgcaga

SEQ ID NO: 8074815 - DNA, 22 bp, Homo sapiens
tggctggcgccgggctagccac

SEQ ID NO: 8074816 - DNA, 22 bp, Homo sapiens
tggctggcaaggctggagtcag

SEQ ID NO: 8074817 - DNA, 22 bp, Homo sapiens
tggctggacagtgggcagtgga

SEQ ID NO: 8074818 - DNA, 17 bp, Homo sapiens
tggcttccctgggccac

SEQ ID NO: 8074819 - DNA, 22 bp, Homo sapiens
tggcttcctccagagcaggagg

SEQ ID NO: 8074820 - DNA, 22 bp, Homo sapiens
tggcttcctgcacagtgtctgc

SEQ ID NO: 8074821 - DNA, 22 bp, Homo sapiens
tggcttcctgcacagtgtctgc

SEQ ID NO: 8074822 - DNA, 22 bp, Homo sapiens
tggcttcctgcatggatcctct

SEQ ID NO: 8074823 - DNA, 22 bp, Homo sapiens
tggcttcctggacagatgcggt

SEQ ID NO: 8074824 - DNA, 19 bp, Homo sapiens
tggcttctgttttcatgtt

SEQ ID NO: 8074825 - DNA, 22 bp, Homo sapiens
tggcttctgggacttgtgagca

SEQ ID NO: 8074826 - DNA, 22 bp, Homo sapiens
tggcttctgctttcagtggagg

SEQ ID NO: 8074827 - DNA, 23 bp, Homo sapiens
tggcttctgccccattctctcca

SEQ ID NO: 8074828 - DNA, 22 bp, Homo sapiens
tggcttcttagaccagtggcct

SEQ ID NO: 8074829 - DNA, 22 bp, Homo sapiens
tggctccagatctgtctcctgt

SEQ ID NO: 8074830 - DNA, 22 bp, Homo sapiens
tggctcctatcaaggagtgggt

SEQ ID NO: 8074831 - DNA, 22 bp, Homo sapiens
tggctcctaggatggtgcctgg

SEQ ID NO: 8074832 - DNA, 19 bp, Homo sapiens
tggctcctgcctgccttct

SEQ ID NO: 8074833 - DNA, 20 bp, Homo sapiens
tggctcctgcggtggaacca

SEQ ID NO: 8074834 - DNA, 22 bp, Homo sapiens
tggctcctcacgtcctcagagc

SEQ ID NO: 8074835 - DNA, 20 bp, Homo sapiens
tggctcctcttggctgtggc

SEQ ID NO: 8074836 - DNA, 22 bp, Homo sapiens
tggcctggtgtctgcgaggcct

SEQ ID NO: 8074837 - DNA, 22 bp, Homo sapiens
tggcctggtgctcaggcagtag

SEQ ID NO: 8074838 - DNA, 22 bp, Homo sapiens
tggcctgggtgctgctgacatc

SEQ ID NO: 8074839 - DNA, 22 bp, Homo sapiens
tggccttcctggtgactcatga

SEQ ID NO: 8074840 - DNA, 22 bp, Homo sapiens
tggcgtgccctccagacttggc

SEQ ID NO: 8074841 - DNA, 22 bp, Homo sapiens
tggctgcagacacctatggcag

SEQ ID NO: 8074842 - DNA, 22 bp, Homo sapiens
tggctgagtttcatgcatcatg

SEQ ID NO: 8074843 - DNA, 21 bp, Homo sapiens
tggctgagtggatgcatgaat

SEQ ID NO: 8074844 - DNA, 22 bp, Homo sapiens
tggctgcagttgggccctcaga

SEQ ID NO: 8074845 - DNA, 22 bp, Homo sapiens
tggctgctgagaaggcagctgt

SEQ ID NO: 8074846 - DNA, 22 bp, Homo sapiens
tggctgcttgttttagtgaggc

SEQ ID NO: 8074847 - DNA, 21 bp, Homo sapiens
tggctgctggccctctctcca

SEQ ID NO: 8074848 - DNA, 22 bp, Homo sapiens
tggctgctgcttggtcttcttc

SEQ ID NO: 8074849 - DNA, 21 bp, Homo sapiens
tggctgagccaggtgtgtgga

SEQ ID NO: 8074850 - DNA, 22 bp, Homo sapiens
tggctgagccacttgttcagat

SEQ ID NO: 8074851 - DNA, 22 bp, Homo sapiens
tggctgaaagcctggcctgcca

SEQ ID NO: 8074852 - DNA, 23 bp, Homo sapiens
tggctctgtggatccctcaggag

SEQ ID NO: 8074853 - DNA, 22 bp, Homo sapiens
tggctctggggacagtaagtcc

SEQ ID NO: 8074854 - DNA, 22 bp, Homo sapiens
tggctctgtgcttctagtatct

SEQ ID NO: 8074855 - DNA, 22 bp, Homo sapiens
tggctctgggaatctgttgctt

SEQ ID NO: 8074856 - DNA, 22 bp, Homo sapiens
tggctctggcgtgaagcccaga

SEQ ID NO: 8074857 - DNA, 22 bp, Homo sapiens
tggctctgggcaccgtgtccac

SEQ ID NO: 8074858 - DNA, 22 bp, Homo sapiens
tggctctggattaatctaggaa

SEQ ID NO: 8074859 - DNA, 21 bp, Homo sapiens
tggctctgttcaatatatgga

SEQ ID NO: 8074860 - DNA, 23 bp, Homo sapiens
tggctctgtgtcacatacaggat

SEQ ID NO: 8074861 - DNA, 22 bp, Homo sapiens
tggctctgttcgccatcaggag

SEQ ID NO: 8074862 - DNA, 22 bp, Homo sapiens
tggctctgttgaggtatggatt

SEQ ID NO: 8074863 - DNA, 22 bp, Homo sapiens
tggctctgtttgttaactagac

SEQ ID NO: 8074864 - DNA, 22 bp, Homo sapiens
tggctctgttttatgagtacca

SEQ ID NO: 8074865 - DNA, 22 bp, Homo sapiens
tggctctgttgtgctgagccag

SEQ ID NO: 8074866 - DNA, 22 bp, Homo sapiens
tggctctgcacctcagtgtacc

SEQ ID NO: 8074867 - DNA, 22 bp, Homo sapiens
tggctctgatcagatgtccagt

SEQ ID NO: 8074868 - DNA, 22 bp, Homo sapiens
tggctctgccactaacttggta

SEQ ID NO: 8074869 - DNA, 18 bp, Homo sapiens
tggctctggacttgctcc

SEQ ID NO: 8074870 - DNA, 22 bp, Homo sapiens
tggctctgctgaacctagtgca

SEQ ID NO: 8074871 - DNA, 21 bp, Homo sapiens
tggctctgctcagagcagtcc

SEQ ID NO: 8074872 - DNA, 23 bp, Homo sapiens
tggctctgagcttcctggtggcc

SEQ ID NO: 8074873 - DNA, 17 bp, Homo sapiens
tggctctgaggctgaat

SEQ ID NO: 8074874 - DNA, 21 bp, Homo sapiens
tggctctgagcctcatggctg

SEQ ID NO: 8074875 - DNA, 22 bp, Homo sapiens
tggctccttcattctcctgcca

SEQ ID NO: 8074876 - DNA, 22 bp, Homo sapiens
tgaaggagctcaatgatgatgc

SEQ ID NO: 8074877 - DNA, 22 bp, Homo sapiens
tgaagctgtgggcagtggagcc

SEQ ID NO: 8074878 - DNA, 21 bp, Homo sapiens
tgaagcctgaggcatagcccc

SEQ ID NO: 8074879 - DNA, 22 bp, Homo sapiens
tgaagccttgtgtggcctctct

SEQ ID NO: 8074880 - DNA, 22 bp, Homo sapiens
tgaagccattactgtgttaggg

SEQ ID NO: 8074881 - DNA, 22 bp, Homo sapiens
tgaaggctgttggatggggaag

SEQ ID NO: 8074882 - DNA, 22 bp, Homo sapiens
tgaaggcctccccgagcattag

SEQ ID NO: 8074883 - DNA, 22 bp, Homo sapiens
tgaataaactatgaggaggaat

SEQ ID NO: 8074884 - DNA, 20 bp, Homo sapiens
tgaattctgggtttatctgc

SEQ ID NO: 8074885 - DNA, 22 bp, Homo sapiens
tgacacaaaggaaagcataatc

SEQ ID NO: 8074886 - DNA, 22 bp, Homo sapiens
tgaataatcttgggtattaata

SEQ ID NO: 8074887 - DNA, 22 bp, Homo sapiens
tgaatgtgatgctaaacatatg

SEQ ID NO: 8074888 - DNA, 22 bp, Homo sapiens
tgaatgcttggagtcataaaat

SEQ ID NO: 8074889 - DNA, 22 bp, Homo sapiens
tgaatctgatttccctggaggc

SEQ ID NO: 8074890 - DNA, 22 bp, Homo sapiens
tgaatctggatctatgatcaat

SEQ ID NO: 8074891 - DNA, 22 bp, Homo sapiens
tgacttgtcaaagaaatgtgtg

SEQ ID NO: 8074892 - DNA, 22 bp, Homo sapiens
tgactgtgccgtgcccctagga

SEQ ID NO: 8074893 - DNA, 22 bp, Homo sapiens
tgactgtgcaagcagagagcat

SEQ ID NO: 8074894 - DNA, 22 bp, Homo sapiens
tgactgccccttccattcctgc

SEQ ID NO: 8074895 - DNA, 22 bp, Homo sapiens
tgactgccgattgtccttctct

SEQ ID NO: 8074896 - DNA, 22 bp, Homo sapiens
tgactctgattgccttagcttg

SEQ ID NO: 8074897 - DNA, 22 bp, Homo sapiens
tgactctggggttgaccagatg

SEQ ID NO: 8074898 - DNA, 22 bp, Homo sapiens
tgacctttctttgagattcctg

SEQ ID NO: 8074899 - DNA, 22 bp, Homo sapiens
tgacctattagatttccttgcc

SEQ ID NO: 8074900 - DNA, 22 bp, Homo sapiens
tgacctcttgtcggagctccag

SEQ ID NO: 8074901 - DNA, 22 bp, Homo sapiens
tgacatttaagcctctgatttc

SEQ ID NO: 8074902 - DNA, 22 bp, Homo sapiens
tgacatttatcttctacaatga

SEQ ID NO: 8074903 - DNA, 21 bp, Homo sapiens
tgacatttccaatataaagcc

SEQ ID NO: 8074904 - DNA, 22 bp, Homo sapiens
tgacatttatcaaagaaatggt

SEQ ID NO: 8074905 - DNA, 22 bp, Homo sapiens
tgacatttatcaaagaaatggt

SEQ ID NO: 8074906 - DNA, 22 bp, Homo sapiens
tgacatttcggtgtatgtgatg

SEQ ID NO: 8074907 - DNA, 21 bp, Homo sapiens
tgacccttctagcagaacaca

SEQ ID NO: 8074908 - DNA, 22 bp, Homo sapiens
tgacccttagtgaacattagaa

SEQ ID NO: 8074909 - DNA, 18 bp, Homo sapiens
tgaccctttctccctgtg

SEQ ID NO: 8074910 - DNA, 22 bp, Homo sapiens
tgacattttatcaatatcacag

SEQ ID NO: 8074911 - DNA, 22 bp, Homo sapiens
tgacagaatgtgactctcagat

SEQ ID NO: 8074912 - DNA, 22 bp, Homo sapiens
tgacagaccactgcaactctgt

SEQ ID NO: 8074913 - DNA, 22 bp, Homo sapiens
tgacagaaagaatatgtcaatc

SEQ ID NO: 8074914 - DNA, 22 bp, Homo sapiens
tgacagggtgattatgagagct

SEQ ID NO: 8074915 - DNA, 22 bp, Homo sapiens
tgacagggctagaggcaatgca

SEQ ID NO: 8074916 - DNA, 22 bp, Homo sapiens
tgaagcaaattgtttagcctga

SEQ ID NO: 8074917 - DNA, 22 bp, Homo sapiens
tgaacaaatggaaataaccagt

SEQ ID NO: 8074918 - DNA, 23 bp, Homo sapiens
tgaacaaaggcaggagaaggcgg

SEQ ID NO: 8074919 - DNA, 22 bp, Homo sapiens
tgaaattccaggagagttaaaa

SEQ ID NO: 8074920 - DNA, 22 bp, Homo sapiens
tgaaatgtaaataggactagaa

SEQ ID NO: 8074921 - DNA, 22 bp, Homo sapiens
tgaaatgtgtaatgtggatgcc

SEQ ID NO: 8074922 - DNA, 22 bp, Homo sapiens
tgaaaggttaaaagtagtattg

SEQ ID NO: 8074923 - DNA, 22 bp, Homo sapiens
tgaaaggtgtccaatatttctc

SEQ ID NO: 8074924 - DNA, 22 bp, Homo sapiens
tgaaagcacaagttctaacagg

SEQ ID NO: 8074925 - DNA, 22 bp, Homo sapiens
tgaaagcactcacttctgctct

SEQ ID NO: 8074926 - DNA, 22 bp, Homo sapiens
tgaaagcactgattctcaactc

SEQ ID NO: 8074927 - DNA, 23 bp, Homo sapiens
tgaaatattcttttgcatgagct

SEQ ID NO: 8074928 - DNA, 22 bp, Homo sapiens
tgaaatatgctcccattcactt

SEQ ID NO: 8074929 - DNA, 22 bp, Homo sapiens
tgaaatatcattttcatctccc

SEQ ID NO: 8074930 - DNA, 22 bp, Homo sapiens
tgaaatatccagcccagcagga

SEQ ID NO: 8074931 - DNA, 22 bp, Homo sapiens
tgaaacagtctccagacttgga

SEQ ID NO: 8074932 - DNA, 22 bp, Homo sapiens
tgaaaaactttaatccataaag

SEQ ID NO: 8074933 - DNA, 22 bp, Homo sapiens
tctttttttcctgtgcagagct

SEQ ID NO: 8074934 - DNA, 22 bp, Homo sapiens
tcttttgttgcctacttattaa

SEQ ID NO: 8074935 - DNA, 22 bp, Homo sapiens
tctttggaaggagcagtttttg

SEQ ID NO: 8074936 - DNA, 22 bp, Homo sapiens
tctttgattttgttactaagac

SEQ ID NO: 8074937 - DNA, 22 bp, Homo sapiens
tctttggaattctctgcagccc

SEQ ID NO: 8074938 - DNA, 22 bp, Homo sapiens
tctttggaatgctagcattcta

SEQ ID NO: 8074939 - DNA, 22 bp, Homo sapiens
tctttggactttccaatttgtt

SEQ ID NO: 8074940 - DNA, 22 bp, Homo sapiens
tctttggagtgttatcagtaat

SEQ ID NO: 8074941 - DNA, 22 bp, Homo sapiens
tctttggatatcgctagaccgt

SEQ ID NO: 8074942 - DNA, 22 bp, Homo sapiens
tctttggattaaaatatttgta

SEQ ID NO: 8074943 - DNA, 22 bp, Homo sapiens
tcttttaagcctctggcatagg

SEQ ID NO: 8074944 - DNA, 22 bp, Homo sapiens
tcttttaacctaactagcttgg

SEQ ID NO: 8074945 - DNA, 22 bp, Homo sapiens
tcttttatagtgaattttcttg

SEQ ID NO: 8074946 - DNA, 20 bp, Homo sapiens
tctttgttaattttatctcc

SEQ ID NO: 8074947 - DNA, 22 bp, Homo sapiens
tctttgttattgctttatctat

SEQ ID NO: 8074948 - DNA, 18 bp, Homo sapiens
tctttgtttccttcttgc

SEQ ID NO: 8074949 - DNA, 22 bp, Homo sapiens
tctttgtttgcctttatcaaga

SEQ ID NO: 8074950 - DNA, 22 bp, Homo sapiens
tctttgtttgtactgttagaat

SEQ ID NO: 8074951 - DNA, 21 bp, Homo sapiens
tcttttctcagctttgtggtt

SEQ ID NO: 8074952 - DNA, 22 bp, Homo sapiens
tcttttatcctacatttagctc

SEQ ID NO: 8074953 - DNA, 22 bp, Homo sapiens
tgaggcaggagttcaggctgcg

SEQ ID NO: 8074954 - DNA, 20 bp, Homo sapiens
tgaggcaggagaatggcatg

SEQ ID NO: 8074955 - DNA, 22 bp, Homo sapiens
tgaggcaggagaatggcgggaa

SEQ ID NO: 8074956 - DNA, 22 bp, Homo sapiens
tgaggcaggaggttgagaactg

SEQ ID NO: 8074957 - DNA, 22 bp, Homo sapiens
tgaggcaggaggttgagaactg

SEQ ID NO: 8074958 - DNA, 19 bp, Homo sapiens
tgaggccaaggtcacagat

SEQ ID NO: 8074959 - DNA, 22 bp, Homo sapiens
tgaggccaagaaaagctgggtg

SEQ ID NO: 8074960 - DNA, 22 bp, Homo sapiens
tgaggccaagcctcctctgcca

SEQ ID NO: 8074961 - DNA, 22 bp, Homo sapiens
tgaggccaaaatgactcaaatg

SEQ ID NO: 8074962 - DNA, 23 bp, Homo sapiens
tgaggcaggcggatcacgaggtc

SEQ ID NO: 8074963 - DNA, 22 bp, Homo sapiens
tgaggccaggacccccagcagg

SEQ ID NO: 8074964 - DNA, 18 bp, Homo sapiens
tgaggccagagtgggcat

SEQ ID NO: 8074965 - DNA, 22 bp, Homo sapiens
tgaggccacttccccacagccc

SEQ ID NO: 8074966 - DNA, 22 bp, Homo sapiens
tgaggccacagtatcagaacag

SEQ ID NO: 8074967 - DNA, 22 bp, Homo sapiens
tgaggccaatgaccctgggcag

SEQ ID NO: 8074968 - DNA, 22 bp, Homo sapiens
tgaggccaggatcccaggctct

SEQ ID NO: 8074969 - DNA, 22 bp, Homo sapiens
tgaggaagaacaagaatttaga

SEQ ID NO: 8074970 - DNA, 22 bp, Homo sapiens
tgaggatggtcccgaggacact

SEQ ID NO: 8074971 - DNA, 22 bp, Homo sapiens
tgaggatgacgatggcaatggc

SEQ ID NO: 8074972 - DNA, 22 bp, Homo sapiens
tgaggatggttaaagaacattg

SEQ ID NO: 8074973 - DNA, 22 bp, Homo sapiens
tgaggtgaccgcagatgggaag

SEQ ID NO: 8074974 - DNA, 22 bp, Homo sapiens
tgaggtgaagagtggagctcag

SEQ ID NO: 8074975 - DNA, 18 bp, Homo sapiens
tgaggtagctttcctcct

SEQ ID NO: 8074976 - DNA, 22 bp, Homo sapiens
tgagtagagaattcagctaagg

SEQ ID NO: 8074977 - DNA, 22 bp, Homo sapiens
tgaggtggctagggaggcactc

SEQ ID NO: 8074978 - DNA, 22 bp, Homo sapiens
tgaggtggccgaggagcaggac

SEQ ID NO: 8074979 - DNA, 22 bp, Homo sapiens
tgaggtgtgtccccagggaggt

SEQ ID NO: 8074980 - DNA, 22 bp, Homo sapiens
tgaggggagaagcagcagcctg

SEQ ID NO: 8074981 - DNA, 22 bp, Homo sapiens
tgagggagtcatgattaaggaa

SEQ ID NO: 8074982 - DNA, 22 bp, Homo sapiens
tgagggagttgggtgtatagga

SEQ ID NO: 8074983 - DNA, 22 bp, Homo sapiens
tgagggagttgggtgtatagga

SEQ ID NO: 8074984 - DNA, 22 bp, Homo sapiens
tgagggagttgggtgtatagga

SEQ ID NO: 8074985 - DNA, 22 bp, Homo sapiens
tgagggactcagaattcagcct

SEQ ID NO: 8074986 - DNA, 22 bp, Homo sapiens
tgagggagcacacactgaagtg

SEQ ID NO: 8074987 - DNA, 22 bp, Homo sapiens
tgagggaggccctttgagcaga

SEQ ID NO: 8074988 - DNA, 22 bp, Homo sapiens
tgagggaggccctttgagcaga

SEQ ID NO: 8074989 - DNA, 22 bp, Homo sapiens
tgagaggcagaatggtgcctgc

SEQ ID NO: 8074990 - DNA, 22 bp, Homo sapiens
tgagaggcagaatggtgcctgc

SEQ ID NO: 8074991 - DNA, 22 bp, Homo sapiens
tgagaggtaggaaatgaacaag

SEQ ID NO: 8074992 - DNA, 19 bp, Homo sapiens
tgagaggcttaaggcagct

SEQ ID NO: 8074993 - DNA, 22 bp, Homo sapiens
tgagagagcctgaatctcttac

SEQ ID NO: 8074994 - DNA, 21 bp, Homo sapiens
tgagagagtagcaggacatat

SEQ ID NO: 8074995 - DNA, 22 bp, Homo sapiens
tgagattctgttcagaaaaatg

SEQ ID NO: 8074996 - DNA, 22 bp, Homo sapiens
tgagatggttgaccagagagca

SEQ ID NO: 8074997 - DNA, 22 bp, Homo sapiens
tgagatgtaaggtatgcttact

SEQ ID NO: 8074998 - DNA, 22 bp, Homo sapiens
tgagaaagtgggtgcctagcaa

SEQ ID NO: 8074999 - DNA, 22 bp, Homo sapiens
tgagaaccatgaaaagctgtca

SEQ ID NO: 8075000 - DNA, 23 bp, Homo sapiens
tgagaagccaggggagcgtgagg

SEQ ID NO: 8075001 - DNA, 22 bp, Homo sapiens
tgagaagatttgctcttctgag

SEQ ID NO: 8075002 - DNA, 19 bp, Homo sapiens
tgagacagaagatgagcct

SEQ ID NO: 8075003 - DNA, 22 bp, Homo sapiens
tgagacactctcgggcacattt

SEQ ID NO: 8075004 - DNA, 17 bp, Homo sapiens
tgagacagggcaggccc

SEQ ID NO: 8075005 - DNA, 22 bp, Homo sapiens
tgagctgtaaggctgtcactga

SEQ ID NO: 8075006 - DNA, 22 bp, Homo sapiens
tgagctggtcttgagtgtagct

SEQ ID NO: 8075007 - DNA, 22 bp, Homo sapiens
tgagctggtcactccttctgaa

SEQ ID NO: 8075008 - DNA, 22 bp, Homo sapiens
tgagctgcagtgagctgagatg

SEQ ID NO: 8075009 - DNA, 22 bp, Homo sapiens
tgagcttctttatttggccaga

SEQ ID NO: 8075010 - DNA, 22 bp, Homo sapiens
tgagctgtcaaggtacagtgaa

SEQ ID NO: 8075011 - DNA, 22 bp, Homo sapiens
tgagctgtagcagatgctgttg

SEQ ID NO: 8075012 - DNA, 22 bp, Homo sapiens
tgagctgtgagggtacagatat

SEQ ID NO: 8075013 - DNA, 22 bp, Homo sapiens
tgagctgtgattaactctgaga

SEQ ID NO: 8075014 - DNA, 22 bp, Homo sapiens
tgagcttcaaaatatgtgaatc

SEQ ID NO: 8075015 - DNA, 22 bp, Homo sapiens
tgagcttattcataaaagtgca

SEQ ID NO: 8075016 - DNA, 22 bp, Homo sapiens
tgagcttatacatgtgaagtca

SEQ ID NO: 8075017 - DNA, 17 bp, Homo sapiens
tgagcttcaatcaggtg

SEQ ID NO: 8075018 - DNA, 22 bp, Homo sapiens
tgagccttccttgtcatatcat

SEQ ID NO: 8075019 - DNA, 22 bp, Homo sapiens
tgagccgtggtctctgagggtg

SEQ ID NO: 8075020 - DNA, 19 bp, Homo sapiens
tgagccagggaggccatgc

SEQ ID NO: 8075021 - DNA, 22 bp, Homo sapiens
tgagcagagatgactgggcatt

SEQ ID NO: 8075022 - DNA, 22 bp, Homo sapiens
tgagcagagttgtttctcctga

SEQ ID NO: 8075023 - DNA, 22 bp, Homo sapiens
tgagcagagcagtaacaggagc

SEQ ID NO: 8075024 - DNA, 22 bp, Homo sapiens
tgagcagaggccagcacctggg

SEQ ID NO: 8075025 - DNA, 22 bp, Homo sapiens
tgagcaggactcactgcagcct

SEQ ID NO: 8075026 - DNA, 22 bp, Homo sapiens
tgagcagatttgttctaggggt

SEQ ID NO: 8075027 - DNA, 22 bp, Homo sapiens
tgagcaggcgcagcaggaggtc

SEQ ID NO: 8075028 - DNA, 22 bp, Homo sapiens
tgcagtgtttttcagggcatat

SEQ ID NO: 8075029 - DNA, 22 bp, Homo sapiens
tgcagttcaaggttgtacagct

SEQ ID NO: 8075030 - DNA, 22 bp, Homo sapiens
tgcagttctaagtagacaagtc

SEQ ID NO: 8075031 - DNA, 22 bp, Homo sapiens
tgcagttttatcacatatatag

SEQ ID NO: 8075032 - DNA, 22 bp, Homo sapiens
tgcagttttggccattgaaggc

SEQ ID NO: 8075033 - DNA, 22 bp, Homo sapiens
tgcatatacccgcatttacata

SEQ ID NO: 8075034 - DNA, 22 bp, Homo sapiens
tgcatcatgcggaactggcttt

SEQ ID NO: 8075035 - DNA, 22 bp, Homo sapiens
tgcatgcatgtgagcatgcata

SEQ ID NO: 8075036 - DNA, 22 bp, Homo sapiens
tgcatgaaatattttctgtagg

SEQ ID NO: 8075037 - DNA, 22 bp, Homo sapiens
tgcatgaacacatgtgcatgta

SEQ ID NO: 8075038 - DNA, 22 bp, Homo sapiens
tgcatgaacggagggtaagctg

SEQ ID NO: 8075039 - DNA, 22 bp, Homo sapiens
tgcatctttctgcatatgtaaa

SEQ ID NO: 8075040 - DNA, 22 bp, Homo sapiens
tgcatcttacgttttgaaaggg

SEQ ID NO: 8075041 - DNA, 22 bp, Homo sapiens
tgcattcatcatttgaaagccc

SEQ ID NO: 8075042 - DNA, 22 bp, Homo sapiens
tgcatttagttttaataaagga

SEQ ID NO: 8075043 - DNA, 22 bp, Homo sapiens
tgcattttacttacctgttagt

SEQ ID NO: 8075044 - DNA, 22 bp, Homo sapiens
tgcatttttgaggttaactcaa

SEQ ID NO: 8075045 - DNA, 22 bp, Homo sapiens
tgccacagggtcctcaggccag

SEQ ID NO: 8075046 - DNA, 22 bp, Homo sapiens
tgccacccagccaggagtggga

SEQ ID NO: 8075047 - DNA, 22 bp, Homo sapiens
tgccacctgtacatgctatctg

SEQ ID NO: 8075048 - DNA, 22 bp, Homo sapiens
tgccactggacccagaactctt

SEQ ID NO: 8075049 - DNA, 22 bp, Homo sapiens
tgccagcacaagttaagagatc

SEQ ID NO: 8075050 - DNA, 23 bp, Homo sapiens
tgccagaggcagtcacagtggtg

SEQ ID NO: 8075051 - DNA, 22 bp, Homo sapiens
tgccagcccaccttggggcctc

SEQ ID NO: 8075052 - DNA, 22 bp, Homo sapiens
tgccagccaggttctgaggcta

SEQ ID NO: 8075053 - DNA, 21 bp, Homo sapiens
tgccagcattaaacagtcatt

SEQ ID NO: 8075054 - DNA, 19 bp, Homo sapiens
tgccagcattaggctgaag

SEQ ID NO: 8075055 - DNA, 20 bp, Homo sapiens
tgcagtgtggaagactgaga

SEQ ID NO: 8075056 - DNA, 20 bp, Homo sapiens
tgcagggctgcctcccagct

SEQ ID NO: 8075057 - DNA, 20 bp, Homo sapiens
tgcagggctctgcttctctc

SEQ ID NO: 8075058 - DNA, 23 bp, Homo sapiens
tgcaggggaggcttaaagcaggt

SEQ ID NO: 8075059 - DNA, 22 bp, Homo sapiens
tgcagggcttcctcttggagtt

SEQ ID NO: 8075060 - DNA, 22 bp, Homo sapiens
tgcaggtaggcctgacttccag

SEQ ID NO: 8075061 - DNA, 22 bp, Homo sapiens
tgcaggtgaaaattatgaggat

SEQ ID NO: 8075062 - DNA, 22 bp, Homo sapiens
tgcagggcacacgcacgggtgt

SEQ ID NO: 8075063 - DNA, 22 bp, Homo sapiens
tgcagggcccttggggttgaac

SEQ ID NO: 8075064 - DNA, 22 bp, Homo sapiens
tgcagggctacaggactacaac

SEQ ID NO: 8075065 - DNA, 22 bp, Homo sapiens
tgcagggccgctggaggtcatg

SEQ ID NO: 8075066 - DNA, 22 bp, Homo sapiens
tgcagggccagactgggttgga

SEQ ID NO: 8075067 - DNA, 22 bp, Homo sapiens
tgcaggctttagccccatggct

SEQ ID NO: 8075068 - DNA, 22 bp, Homo sapiens
tgcaggctgtaatctgaggcta

SEQ ID NO: 8075069 - DNA, 22 bp, Homo sapiens
tgcaggctggcagtgctgaaat

SEQ ID NO: 8075070 - DNA, 22 bp, Homo sapiens
tgccagggtgtcaggagagcta

SEQ ID NO: 8075071 - DNA, 22 bp, Homo sapiens
tgccatccaacagttccatctt

SEQ ID NO: 8075072 - DNA, 22 bp, Homo sapiens
tgccatcctgtgtcatgctcat

SEQ ID NO: 8075073 - DNA, 22 bp, Homo sapiens
tgccatccttgaggaagggcaa

SEQ ID NO: 8075074 - DNA, 22 bp, Homo sapiens
tgccagggctgctactggctga

SEQ ID NO: 8075075 - DNA, 22 bp, Homo sapiens
tgccaggggacctagggatgtc

SEQ ID NO: 8075076 - DNA, 20 bp, Homo sapiens
tgccagggccagcagaggct

SEQ ID NO: 8075077 - DNA, 21 bp, Homo sapiens
tgccagggatttacagagcct

SEQ ID NO: 8075078 - DNA, 22 bp, Homo sapiens
tgccaggcccagctccagagct

SEQ ID NO: 8075079 - DNA, 22 bp, Homo sapiens
tgccaggccctgtgctggatgc

SEQ ID NO: 8075080 - DNA, 22 bp, Homo sapiens
tgccaggcccagctccagagct

SEQ ID NO: 8075081 - DNA, 17 bp, Homo sapiens
tgccagcctgtcccagg

SEQ ID NO: 8075082 - DNA, 18 bp, Homo sapiens
tgcccagaaaagcaggga

SEQ ID NO: 8075083 - DNA, 22 bp, Homo sapiens
tgcccacatggtgccatggcca

SEQ ID NO: 8075084 - DNA, 22 bp, Homo sapiens
tgcccacattcaaaaggtgatg

SEQ ID NO: 8075085 - DNA, 22 bp, Homo sapiens
tgcccagcactgtgccagtcac

SEQ ID NO: 8075086 - DNA, 22 bp, Homo sapiens
tgcccacaggaagacaccagcg

SEQ ID NO: 8075087 - DNA, 21 bp, Homo sapiens
tgcccacagcaaatgcagagg

SEQ ID NO: 8075088 - DNA, 22 bp, Homo sapiens
tgccattttgagatgttaatga

SEQ ID NO: 8075089 - DNA, 22 bp, Homo sapiens
tgccatttttgagtggggcctc

SEQ ID NO: 8075090 - DNA, 22 bp, Homo sapiens
tgccatttctcacatatgtatg

SEQ ID NO: 8075091 - DNA, 22 bp, Homo sapiens
tgccatggaatcacctccagct

SEQ ID NO: 8075092 - DNA, 22 bp, Homo sapiens
tgccatggaatcacctccagct

SEQ ID NO: 8075093 - DNA, 22 bp, Homo sapiens
tgccatggcctagacctgtgat

SEQ ID NO: 8075094 - DNA, 22 bp, Homo sapiens
tgccatggtgactgcaggaggt

SEQ ID NO: 8075095 - DNA, 22 bp, Homo sapiens
tgccatttactgagattagaag

SEQ ID NO: 8075096 - DNA, 22 bp, Homo sapiens
tgccccagactctgctcacctc

SEQ ID NO: 8075097 - DNA, 22 bp, Homo sapiens
tgcctggatgtgctggcctcac

SEQ ID NO: 8075098 - DNA, 22 bp, Homo sapiens
tgcctggcaactgtggtgggct

SEQ ID NO: 8075099 - DNA, 22 bp, Homo sapiens
tgcctggcaagaggggctggct

SEQ ID NO: 8075100 - DNA, 19 bp, Homo sapiens
tgcctggcaccagctccac

SEQ ID NO: 8075101 - DNA, 20 bp, Homo sapiens
tgcctgcccaggtcctgcac

SEQ ID NO: 8075102 - DNA, 22 bp, Homo sapiens
tgcctgctgattggagttgaat

SEQ ID NO: 8075103 - DNA, 22 bp, Homo sapiens
tgcctgctgctaagctctttgt

SEQ ID NO: 8075104 - DNA, 22 bp, Homo sapiens
tgcctgctgctaagctctttgt

SEQ ID NO: 8075105 - DNA, 22 bp, Homo sapiens
tgcctgccatgcagaaagctga

SEQ ID NO: 8075106 - DNA, 22 bp, Homo sapiens
tgcctgcccacgactacagcag

SEQ ID NO: 8075107 - DNA, 22 bp, Homo sapiens
tgcctccctctctgccactgga

SEQ ID NO: 8075108 - DNA, 22 bp, Homo sapiens
tgcctcagtctaaagtctctca

SEQ ID NO: 8075109 - DNA, 19 bp, Homo sapiens
tgcctcagggctttgagga

SEQ ID NO: 8075110 - DNA, 22 bp, Homo sapiens
tgcctcagctgaggccgctcca

SEQ ID NO: 8075111 - DNA, 22 bp, Homo sapiens
tgcctcagagttgtccctacca

SEQ ID NO: 8075112 - DNA, 22 bp, Homo sapiens
tgcctcagagtgggcttgctat

SEQ ID NO: 8075113 - DNA, 22 bp, Homo sapiens
tgcctcagagtgggcttgctat

SEQ ID NO: 8075114 - DNA, 22 bp, Homo sapiens
tgccctgcagaccctgcagtgt

SEQ ID NO: 8075115 - DNA, 22 bp, Homo sapiens
tgccctgcagtgagtgcgtctg

SEQ ID NO: 8075116 - DNA, 22 bp, Homo sapiens
tgccctgccaagactgagtggt

SEQ ID NO: 8075117 - DNA, 22 bp, Homo sapiens
tgccctgcttctcttgggacag

SEQ ID NO: 8075118 - DNA, 22 bp, Homo sapiens
tgccctgctgtggctctgccca

SEQ ID NO: 8075119 - DNA, 22 bp, Homo sapiens
tgcccttcctctggattgcctt

SEQ ID NO: 8075120 - DNA, 22 bp, Homo sapiens
tgccgtggggctgaggctggag

SEQ ID NO: 8075121 - DNA, 22 bp, Homo sapiens
tgcctaggaaacctcatgcttc

SEQ ID NO: 8075122 - DNA, 22 bp, Homo sapiens
tgcctcagagacctgacagtac

SEQ ID NO: 8075123 - DNA, 22 bp, Homo sapiens
tgatttatgcattatactgttg

SEQ ID NO: 8075124 - DNA, 22 bp, Homo sapiens
tgatttttagctattctgaaga

SEQ ID NO: 8075125 - DNA, 22 bp, Homo sapiens
tgcaagggtgtttgagctgccc

SEQ ID NO: 8075126 - DNA, 22 bp, Homo sapiens
tgcaaggggtttatgcagatga

SEQ ID NO: 8075127 - DNA, 22 bp, Homo sapiens
tgcaagaggtaaaatgaaagga

SEQ ID NO: 8075128 - DNA, 22 bp, Homo sapiens
tgcaagagctgtggcaaaagca

SEQ ID NO: 8075129 - DNA, 22 bp, Homo sapiens
tgcaagaggaattctagaagca

SEQ ID NO: 8075130 - DNA, 22 bp, Homo sapiens
tgcaagaggagactgtactcag

SEQ ID NO: 8075131 - DNA, 22 bp, Homo sapiens
tgcaagagacagacatgactca

SEQ ID NO: 8075132 - DNA, 22 bp, Homo sapiens
tgcaagagcagaaagaactgag

SEQ ID NO: 8075133 - DNA, 22 bp, Homo sapiens
tgcaagagcccagggccaggaa

SEQ ID NO: 8075134 - DNA, 20 bp, Homo sapiens
tgcaatgtccatgttccagg

SEQ ID NO: 8075135 - DNA, 22 bp, Homo sapiens
tgcaatttggcttccattttct

SEQ ID NO: 8075136 - DNA, 22 bp, Homo sapiens
tgattcatcagaataggagttt

SEQ ID NO: 8075137 - DNA, 22 bp, Homo sapiens
tgatttaaaagaaacattgtct

SEQ ID NO: 8075138 - DNA, 22 bp, Homo sapiens
tgatggttttattaataggacc

SEQ ID NO: 8075139 - DNA, 22 bp, Homo sapiens
tgattaaattaattaagatgag

SEQ ID NO: 8075140 - DNA, 22 bp, Homo sapiens
tgatgctgagcctgggactgac

SEQ ID NO: 8075141 - DNA, 22 bp, Homo sapiens
tgatgctgctgggagtggtgct

SEQ ID NO: 8075142 - DNA, 22 bp, Homo sapiens
tgatgcttcacgctgaatatgc

SEQ ID NO: 8075143 - DNA, 22 bp, Homo sapiens
tgatgatgtttatcttggtatt

SEQ ID NO: 8075144 - DNA, 22 bp, Homo sapiens
tgatcttttctatttatggtag

SEQ ID NO: 8075145 - DNA, 22 bp, Homo sapiens
tgatggctatccctggaagggc

SEQ ID NO: 8075146 - DNA, 22 bp, Homo sapiens
tgagtgaggaagcggtggagga

SEQ ID NO: 8075147 - DNA, 22 bp, Homo sapiens
tgagtgaaaaatttgcctggag

SEQ ID NO: 8075148 - DNA, 20 bp, Homo sapiens
tgagtgatggaggcgggtca

SEQ ID NO: 8075149 - DNA, 22 bp, Homo sapiens
tgagtgcctttgattgggcatg

SEQ ID NO: 8075150 - DNA, 19 bp, Homo sapiens
tgagtgtgtgtttctctaa

SEQ ID NO: 8075151 - DNA, 23 bp, Homo sapiens
tgagtgtgttccctgtgagattt

SEQ ID NO: 8075152 - DNA, 19 bp, Homo sapiens
tgagtgggcccctgcagac

SEQ ID NO: 8075153 - DNA, 22 bp, Homo sapiens
tgagtgggttatcaggaaaggt

SEQ ID NO: 8075154 - DNA, 22 bp, Homo sapiens
tgatatttaagcaaaaatatgg

SEQ ID NO: 8075155 - DNA, 21 bp, Homo sapiens
tgatcatttgtgtaaaggaga

SEQ ID NO: 8075156 - DNA, 22 bp, Homo sapiens
tgatcaaaacattactccacca

SEQ ID NO: 8075157 - DNA, 22 bp, Homo sapiens
tgatctttactgctgtttataa

SEQ ID NO: 8075158 - DNA, 22 bp, Homo sapiens
tgcagcagggacctctatgtga

SEQ ID NO: 8075159 - DNA, 22 bp, Homo sapiens
tgcagcagggcccaggcacaga

SEQ ID NO: 8075160 - DNA, 22 bp, Homo sapiens
tgcagcaggcacaggacggaag

SEQ ID NO: 8075161 - DNA, 22 bp, Homo sapiens
tgcagcaggcacaggacggaag

SEQ ID NO: 8075162 - DNA, 22 bp, Homo sapiens
tgcagcaggagccaggcctggt

SEQ ID NO: 8075163 - DNA, 22 bp, Homo sapiens
tgcagcaggagccaggcctggt

SEQ ID NO: 8075164 - DNA, 22 bp, Homo sapiens
tgcagcagctccaggttaccct

SEQ ID NO: 8075165 - DNA, 22 bp, Homo sapiens
tgcagcagcctcatctggtttc

SEQ ID NO: 8075166 - DNA, 22 bp, Homo sapiens
tgcagcagccaaggttctgtgc

SEQ ID NO: 8075167 - DNA, 22 bp, Homo sapiens
tgcagcagcagggaggaggctc

SEQ ID NO: 8075168 - DNA, 22 bp, Homo sapiens
tgcagcagcagggaggaggctc

SEQ ID NO: 8075169 - DNA, 22 bp, Homo sapiens
tgcagcagagtgggcctgggtg

SEQ ID NO: 8075170 - DNA, 21 bp, Homo sapiens
tgcagcagagtaagcagggga

SEQ ID NO: 8075171 - DNA, 21 bp, Homo sapiens
tgcagcagatttgggggaaga

SEQ ID NO: 8075172 - DNA, 21 bp, Homo sapiens
tgcagcagagtaagcagggga

SEQ ID NO: 8075173 - DNA, 22 bp, Homo sapiens
tgcagcagactgagtatgagaa

SEQ ID NO: 8075174 - DNA, 22 bp, Homo sapiens
tgcagcagacataatgtggatt

SEQ ID NO: 8075175 - DNA, 19 bp, Homo sapiens
tgcagccacgtgagagact

SEQ ID NO: 8075176 - DNA, 23 bp, Homo sapiens
tgcagcagggtggtctacttctc

SEQ ID NO: 8075177 - DNA, 22 bp, Homo sapiens
tgcagcccttccttcctctggg

SEQ ID NO: 8075178 - DNA, 22 bp, Homo sapiens
tgcagctctgtatgctgattat

SEQ ID NO: 8075179 - DNA, 21 bp, Homo sapiens
tgcagctgacactggtatgcc

SEQ ID NO: 8075180 - DNA, 22 bp, Homo sapiens
tgcagctgacccactccagtcc

SEQ ID NO: 8075181 - DNA, 22 bp, Homo sapiens
tgcagccttgcctcctcccagc

SEQ ID NO: 8075182 - DNA, 22 bp, Homo sapiens
tgcagctcctctggctgcctga

SEQ ID NO: 8075183 - DNA, 20 bp, Homo sapiens
tgcagctggtttcacaggga

SEQ ID NO: 8075184 - DNA, 22 bp, Homo sapiens
tgcagctgcttgattcatcttg

SEQ ID NO: 8075185 - DNA, 22 bp, Homo sapiens
tgcagctgctcttcatttcccc

SEQ ID NO: 8075186 - DNA, 22 bp, Homo sapiens
tgcagctgctggcccaggtgct

SEQ ID NO: 8075187 - DNA, 22 bp, Homo sapiens
tgcaggaaaacacctatcaccc

SEQ ID NO: 8075188 - DNA, 22 bp, Homo sapiens
tgcaggaaaaccaacacgcctt

SEQ ID NO: 8075189 - DNA, 22 bp, Homo sapiens
tgcagctgtaacagaggcctca

SEQ ID NO: 8075190 - DNA, 22 bp, Homo sapiens
tgcaggaagcaaccaggtccaa

SEQ ID NO: 8075191 - DNA, 22 bp, Homo sapiens
tgcaggaagacttcccaagcca

SEQ ID NO: 8075192 - DNA, 22 bp, Homo sapiens
tgcaggaacagaactcactccc

SEQ ID NO: 8075193 - DNA, 21 bp, Homo sapiens
tgcaggaaagtgctgcgaccc

SEQ ID NO: 8075194 - DNA, 22 bp, Homo sapiens
tgcaggaacataggttccttgg

SEQ ID NO: 8075195 - DNA, 22 bp, Homo sapiens
tgcaggaacttggttttactca

SEQ ID NO: 8075196 - DNA, 22 bp, Homo sapiens
tgcaggagcagagatggctgga

SEQ ID NO: 8075197 - DNA, 21 bp, Homo sapiens
tgcaggagtctgtgagtcagg

SEQ ID NO: 8075198 - DNA, 22 bp, Homo sapiens
tgcagcaccacacctggctaat

SEQ ID NO: 8075199 - DNA, 21 bp, Homo sapiens
tgcagcagaagtctctgtgtc

SEQ ID NO: 8075200 - DNA, 20 bp, Homo sapiens
tgcagcagaagcccatgctc

SEQ ID NO: 8075201 - DNA, 22 bp, Homo sapiens
tgcagcagaatatggctgcagg

SEQ ID NO: 8075202 - DNA, 22 bp, Homo sapiens
tgcagcagaagtgttcttctct

SEQ ID NO: 8075203 - DNA, 23 bp, Homo sapiens
tgcagagggactgaagccagctt

SEQ ID NO: 8075204 - DNA, 22 bp, Homo sapiens
tgcagaggaccattgtcctgga

SEQ ID NO: 8075205 - DNA, 22 bp, Homo sapiens
tgcagagaaaccagtggaggac

SEQ ID NO: 8075206 - DNA, 22 bp, Homo sapiens
tgcagacaagtcgtgggatctt

SEQ ID NO: 8075207 - DNA, 22 bp, Homo sapiens
tgcagaggagctggaaggctgg

SEQ ID NO: 8075208 - DNA, 21 bp, Homo sapiens
tgcacctgttcactgcagttc

SEQ ID NO: 8075209 - DNA, 22 bp, Homo sapiens
tgcacctgagaggtctctgagg

SEQ ID NO: 8075210 - DNA, 22 bp, Homo sapiens
tgcaccctcatcagtcaaatgg

SEQ ID NO: 8075211 - DNA, 22 bp, Homo sapiens
tgcagaagtgagtcatgaggaa

SEQ ID NO: 8075212 - DNA, 22 bp, Homo sapiens
tgcagaaataactcatattgca

SEQ ID NO: 8075213 - DNA, 22 bp, Homo sapiens
tcctgggctgtggccccgggca

SEQ ID NO: 8075214 - DNA, 22 bp, Homo sapiens
tcctgggcccaggctgccaggg

SEQ ID NO: 8075215 - DNA, 22 bp, Homo sapiens
tcctgggatgcataaaatatgt

SEQ ID NO: 8075216 - DNA, 22 bp, Homo sapiens
tcctgggaagagacctgagcat

SEQ ID NO: 8075217 - DNA, 22 bp, Homo sapiens
tcctggggtcctgactgcttcc

SEQ ID NO: 8075218 - DNA, 22 bp, Homo sapiens
tcctggggctctttgatgtgat

SEQ ID NO: 8075219 - DNA, 20 bp, Homo sapiens
tcctggggtaagccatggtc

SEQ ID NO: 8075220 - DNA, 22 bp, Homo sapiens
tcctggttctggaatgtttaag

SEQ ID NO: 8075221 - DNA, 22 bp, Homo sapiens
tcctggttcctaccttcagctg

SEQ ID NO: 8075222 - DNA, 22 bp, Homo sapiens
tcctggttaccaagcagctctc

SEQ ID NO: 8075223 - DNA, 22 bp, Homo sapiens
tcctggttgttgttatagtata

SEQ ID NO: 8075224 - DNA, 22 bp, Homo sapiens
tcctggtttacagagtaaacca

SEQ ID NO: 8075225 - DNA, 22 bp, Homo sapiens
tcctggtttatagactgatggc

SEQ ID NO: 8075226 - DNA, 22 bp, Homo sapiens
tcctgtcttaatgatctcgtgc

SEQ ID NO: 8075227 - DNA, 22 bp, Homo sapiens
tcctgtctgctcacagagctgg

SEQ ID NO: 8075228 - DNA, 23 bp, Homo sapiens
taagaacagacaagcatttacat

SEQ ID NO: 8075229 - DNA, 22 bp, Homo sapiens
taagaacattttcggaaagata

SEQ ID NO: 8075230 - DNA, 22 bp, Homo sapiens
tcctgctgttttctggcccaca

SEQ ID NO: 8075231 - DNA, 22 bp, Homo sapiens
tcctgcttccttgtctttagac

SEQ ID NO: 8075232 - DNA, 22 bp, Homo sapiens
tcctgctgggtctaactctggt

SEQ ID NO: 8075233 - DNA, 22 bp, Homo sapiens
tcctggaggcaaatgagcacat

SEQ ID NO: 8075234 - DNA, 22 bp, Homo sapiens
tcctggagataattgcagtgaa

SEQ ID NO: 8075235 - DNA, 22 bp, Homo sapiens
tcctggagtatttctgtggtgt

SEQ ID NO: 8075236 - DNA, 22 bp, Homo sapiens
tcctggagttgtgcagtgcaca

SEQ ID NO: 8075237 - DNA, 17 bp, Homo sapiens
tcctggctctgccactg

SEQ ID NO: 8075238 - DNA, 22 bp, Homo sapiens
tccttggctttctggagcttct

SEQ ID NO: 8075239 - DNA, 22 bp, Homo sapiens
tcctttccatgcttctagaggc

SEQ ID NO: 8075240 - DNA, 22 bp, Homo sapiens
tcctttttggtccaaggtgacc

SEQ ID NO: 8075241 - DNA, 22 bp, Homo sapiens
tcctttttatagttagagaaac

SEQ ID NO: 8075242 - DNA, 22 bp, Homo sapiens
tcctttttaagtcgttgtggta

SEQ ID NO: 8075243 - DNA, 22 bp, Homo sapiens
tctaaacattggtatggagcag

SEQ ID NO: 8075244 - DNA, 22 bp, Homo sapiens
tctaaagccttccatataacgc

SEQ ID NO: 8075245 - DNA, 22 bp, Homo sapiens
tctaaacacgtctctttgaata

SEQ ID NO: 8075246 - DNA, 22 bp, Homo sapiens
tcgtgtgtattccctctccttc

SEQ ID NO: 8075247 - DNA, 20 bp, Homo sapiens
tcgtttatttgaaattgctc

SEQ ID NO: 8075248 - DNA, 22 bp, Homo sapiens
tcgtctgtgaaattgggataag

SEQ ID NO: 8075249 - DNA, 21 bp, Homo sapiens
tccttgctattttcctcagct

SEQ ID NO: 8075250 - DNA, 22 bp, Homo sapiens
tccttggcagcagggagcatga

SEQ ID NO: 8075251 - DNA, 22 bp, Homo sapiens
tccttcctggggtctctgctgc

SEQ ID NO: 8075252 - DNA, 19 bp, Homo sapiens
tccttcagtcagatctggg

SEQ ID NO: 8075253 - DNA, 19 bp, Homo sapiens
tccttcagtcagatctggg

SEQ ID NO: 8075254 - DNA, 22 bp, Homo sapiens
tccttcagggttgaggccgact

SEQ ID NO: 8075255 - DNA, 22 bp, Homo sapiens
tccttcagggttgaggccgact

SEQ ID NO: 8075256 - DNA, 22 bp, Homo sapiens
tccttcagggggccgcctgcac

SEQ ID NO: 8075257 - DNA, 21 bp, Homo sapiens
tccttccttgaggtcctttcc

SEQ ID NO: 8075258 - DNA, 20 bp, Homo sapiens
tccttcagactttggagttg

SEQ ID NO: 8075259 - DNA, 23 bp, Homo sapiens
tccttcagagcctccctccaagc

SEQ ID NO: 8075260 - DNA, 22 bp, Homo sapiens
tccttcagaggacggcagccag

SEQ ID NO: 8075261 - DNA, 23 bp, Homo sapiens
tccttcagagcctccctccaagc

SEQ ID NO: 8075262 - DNA, 22 bp, Homo sapiens
tccttcagaaaacctcagtctt

SEQ ID NO: 8075263 - DNA, 22 bp, Homo sapiens
tccttcagaacctgtgatggaa

SEQ ID NO: 8075264 - DNA, 20 bp, Homo sapiens
tccttcagacgacaagcaag

SEQ ID NO: 8075265 - DNA, 22 bp, Homo sapiens
tccttcagaggacggcagccag

SEQ ID NO: 8075266 - DNA, 22 bp, Homo sapiens
tccttcagaggataaggaagaa

SEQ ID NO: 8075267 - DNA, 22 bp, Homo sapiens
tccttcagattcctgcttctgg

SEQ ID NO: 8075268 - DNA, 22 bp, Homo sapiens
tccttcagattcctgcttctgg

SEQ ID NO: 8075269 - DNA, 22 bp, Homo sapiens
tccttcagccatgggctctcca

SEQ ID NO: 8075270 - DNA, 22 bp, Homo sapiens
tccttcagaaaacctcagtctt

SEQ ID NO: 8075271 - DNA, 22 bp, Homo sapiens
tccttcagcttatttcttagga

SEQ ID NO: 8075272 - DNA, 22 bp, Homo sapiens
tccttcagctgctaggaaatga

SEQ ID NO: 8075273 - DNA, 22 bp, Homo sapiens
tccttcagctctctatttagat

SEQ ID NO: 8075274 - DNA, 22 bp, Homo sapiens
tccttcagcttatttcttagga

SEQ ID NO: 8075275 - DNA, 22 bp, Homo sapiens
tccttcagcttgttagagtgac

SEQ ID NO: 8075276 - DNA, 22 bp, Homo sapiens
tccttcagctactcagtttcca

SEQ ID NO: 8075277 - DNA, 22 bp, Homo sapiens
tccttcagctctctatttagat

SEQ ID NO: 8075278 - DNA, 22 bp, Homo sapiens
tccttcagctactcagtttcca

SEQ ID NO: 8075279 - DNA, 22 bp, Homo sapiens
tccttcagccatgggctctcca

SEQ ID NO: 8075280 - DNA, 22 bp, Homo sapiens
tccttcagcctcccagctcaaa

SEQ ID NO: 8075281 - DNA, 22 bp, Homo sapiens
tccttcagcctcccagctcaaa

SEQ ID NO: 8075282 - DNA, 22 bp, Homo sapiens
tccttcagggctgaccacaggc

SEQ ID NO: 8075283 - DNA, 22 bp, Homo sapiens
tccttcagggggccgcctgcac

SEQ ID NO: 8075284 - DNA, 22 bp, Homo sapiens
tccttcagggctgaccacaggc

SEQ ID NO: 8075285 - DNA, 17 bp, Homo sapiens
tccttcagggcctcaca

SEQ ID NO: 8075286 - DNA, 17 bp, Homo sapiens
tccttcagggcctcaca

SEQ ID NO: 8075287 - DNA, 23 bp, Homo sapiens
tccttcaggctcttcccctggac

SEQ ID NO: 8075288 - DNA, 22 bp, Homo sapiens
tccttcaggcctcattctcata

SEQ ID NO: 8075289 - DNA, 20 bp, Homo sapiens
tccttcaggcagggcctagt

SEQ ID NO: 8075290 - DNA, 20 bp, Homo sapiens
tccttcaggcagggcctagt

SEQ ID NO: 8075291 - DNA, 22 bp, Homo sapiens
tccttcaggcctcattctcata

SEQ ID NO: 8075292 - DNA, 22 bp, Homo sapiens
tccttagacaaagagtgggctt

SEQ ID NO: 8075293 - DNA, 22 bp, Homo sapiens
tccttaatatggaagagttctc

SEQ ID NO: 8075294 - DNA, 22 bp, Homo sapiens
tccttaattctgtgcaatatgt

SEQ ID NO: 8075295 - DNA, 21 bp, Homo sapiens
tccttatatttgaatacttta

SEQ ID NO: 8075296 - DNA, 22 bp, Homo sapiens
tctagctctgcttatcatggct

SEQ ID NO: 8075297 - DNA, 22 bp, Homo sapiens
tctaggagcatgaagggaaggc

SEQ ID NO: 8075298 - DNA, 22 bp, Homo sapiens
tctaggagtaatgagctagcac

SEQ ID NO: 8075299 - DNA, 22 bp, Homo sapiens
tctaggagaaccatcagggagg

SEQ ID NO: 8075300 - DNA, 22 bp, Homo sapiens
tctaccgaaccccctgtggcct

SEQ ID NO: 8075301 - DNA, 22 bp, Homo sapiens
tctacacatttgtaaaggcatt

SEQ ID NO: 8075302 - DNA, 22 bp, Homo sapiens
tctacacaagtgagtggcacaa

SEQ ID NO: 8075303 - DNA, 22 bp, Homo sapiens
tctataaagggccagatagtag

SEQ ID NO: 8075304 - DNA, 22 bp, Homo sapiens
tctattatggtacttatcatga

SEQ ID NO: 8075305 - DNA, 22 bp, Homo sapiens
tctatgttagagatacatccta

SEQ ID NO: 8075306 - DNA, 22 bp, Homo sapiens
tctatttaccaaatgtagttcc

SEQ ID NO: 8075307 - DNA, 22 bp, Homo sapiens
tctcaaactaacaatgattata

SEQ ID NO: 8075308 - DNA, 22 bp, Homo sapiens
tctcaaactacagtatggctgt

SEQ ID NO: 8075309 - DNA, 22 bp, Homo sapiens
tctcaaagtagctcccacagat

SEQ ID NO: 8075310 - DNA, 22 bp, Homo sapiens
tctcacagggctaggccctgcc

SEQ ID NO: 8075311 - DNA, 22 bp, Homo sapiens
tctgaagaactgagtaaacatg

SEQ ID NO: 8075312 - DNA, 22 bp, Homo sapiens
tctctttctattgcaccatgct

SEQ ID NO: 8075313 - DNA, 22 bp, Homo sapiens
tctctgtccctaggagccttgc

SEQ ID NO: 8075314 - DNA, 22 bp, Homo sapiens
tctctgtctcccgtgtgtccgg

SEQ ID NO: 8075315 - DNA, 22 bp, Homo sapiens
tctctgtctgagcctggcagac

SEQ ID NO: 8075316 - DNA, 22 bp, Homo sapiens
tctctgtctttgttgtcttcac

SEQ ID NO: 8075317 - DNA, 22 bp, Homo sapiens
tctctgtctgcacccaatcaat

SEQ ID NO: 8075318 - DNA, 22 bp, Homo sapiens
tctctgggtttttgtcctgtac

SEQ ID NO: 8075319 - DNA, 22 bp, Homo sapiens
tctctgtcacacaatctacaca

SEQ ID NO: 8075320 - DNA, 22 bp, Homo sapiens
tctctgtggcaagcatgctgct

SEQ ID NO: 8075321 - DNA, 22 bp, Homo sapiens
tctctgtgcaggatgctgagtt

SEQ ID NO: 8075322 - DNA, 22 bp, Homo sapiens
tctctgtggtgggaggctgagt

SEQ ID NO: 8075323 - DNA, 22 bp, Homo sapiens
tctcttccagtaagagtcttta

SEQ ID NO: 8075324 - DNA, 21 bp, Homo sapiens
tctctgtgtctttaagctgga

SEQ ID NO: 8075325 - DNA, 22 bp, Homo sapiens
tctcttaattttggaatagtgt

SEQ ID NO: 8075326 - DNA, 22 bp, Homo sapiens
tctcttcccctttcctttaaca

SEQ ID NO: 8075327 - DNA, 22 bp, Homo sapiens
tctcttcccggataaagtaagt

SEQ ID NO: 8075328 - DNA, 22 bp, Homo sapiens
tctcttcctagtgatgggcttt

SEQ ID NO: 8075329 - DNA, 22 bp, Homo sapiens
tctcttctgaaacctgtcttta

SEQ ID NO: 8075330 - DNA, 22 bp, Homo sapiens
tctcttcttgattttcactgga

SEQ ID NO: 8075331 - DNA, 22 bp, Homo sapiens
tctcttcttgtgttttcctgcc

SEQ ID NO: 8075332 - DNA, 22 bp, Homo sapiens
tctcttctagcttcttgtggtt

SEQ ID NO: 8075333 - DNA, 22 bp, Homo sapiens
tctctccctttccttatcagtt

SEQ ID NO: 8075334 - DNA, 22 bp, Homo sapiens
tctctcccctggccgctacgcg

SEQ ID NO: 8075335 - DNA, 22 bp, Homo sapiens
tctctcccaaatctgcagatag

SEQ ID NO: 8075336 - DNA, 22 bp, Homo sapiens
tctctccttatcattgtgttta

SEQ ID NO: 8075337 - DNA, 22 bp, Homo sapiens
tctctcagggggaaggctgaag

SEQ ID NO: 8075338 - DNA, 22 bp, Homo sapiens
tctctcagctttgagacctgct

SEQ ID NO: 8075339 - DNA, 22 bp, Homo sapiens
tctctcaggctggagtgcagtg

SEQ ID NO: 8075340 - DNA, 22 bp, Homo sapiens
tctctcagaggccagggtcctg

SEQ ID NO: 8075341 - DNA, 22 bp, Homo sapiens
tctctcaacctcggcactattg

SEQ ID NO: 8075342 - DNA, 22 bp, Homo sapiens
tctctgagtcaccgtggagacg

SEQ ID NO: 8075343 - DNA, 20 bp, Homo sapiens
tctctgctgtccacatttgc

SEQ ID NO: 8075344 - DNA, 20 bp, Homo sapiens
tctctgctgtccacatttgc

SEQ ID NO: 8075345 - DNA, 22 bp, Homo sapiens
tctctgctctgtgcctcagttt

SEQ ID NO: 8075346 - DNA, 22 bp, Homo sapiens
tctctggagctgcagatccagg

SEQ ID NO: 8075347 - DNA, 22 bp, Homo sapiens
tctctggaattttgagagtgac

SEQ ID NO: 8075348 - DNA, 22 bp, Homo sapiens
tctctggagggctccaggcggg

SEQ ID NO: 8075349 - DNA, 22 bp, Homo sapiens
tctctggagtataaccagggat

SEQ ID NO: 8075350 - DNA, 21 bp, Homo sapiens
tctctggagttagcagagaga

SEQ ID NO: 8075351 - DNA, 22 bp, Homo sapiens
tctctggaattggctgaggcaa

SEQ ID NO: 8075352 - DNA, 21 bp, Homo sapiens
tctctggaattagaccatgtt

SEQ ID NO: 8075353 - DNA, 21 bp, Homo sapiens
tctctggaattagaccatgtt

SEQ ID NO: 8075354 - DNA, 22 bp, Homo sapiens
tctctggaagcgcagatctgtt

SEQ ID NO: 8075355 - DNA, 22 bp, Homo sapiens
tctctgggtattcactgccttc

SEQ ID NO: 8075356 - DNA, 22 bp, Homo sapiens
tctctgggggtagaactcaggc

SEQ ID NO: 8075357 - DNA, 22 bp, Homo sapiens
tctctggggatggacctgggag

SEQ ID NO: 8075358 - DNA, 21 bp, Homo sapiens
tctctgggccctcctgtgggg

SEQ ID NO: 8075359 - DNA, 22 bp, Homo sapiens
tctccaagcagggctgcaaggc

SEQ ID NO: 8075360 - DNA, 22 bp, Homo sapiens
tctccaaggccctactctattt

SEQ ID NO: 8075361 - DNA, 22 bp, Homo sapiens
tctccacaagctgatgctagga

SEQ ID NO: 8075362 - DNA, 22 bp, Homo sapiens
tctcattggtatatacatgtgt

SEQ ID NO: 8075363 - DNA, 22 bp, Homo sapiens
tctcattggtatgatgtgtaga

SEQ ID NO: 8075364 - DNA, 22 bp, Homo sapiens
tctcattgtccaattgaattta

SEQ ID NO: 8075365 - DNA, 22 bp, Homo sapiens
tctcattgccttcactcttcag

SEQ ID NO: 8075366 - DNA, 22 bp, Homo sapiens
tctcattggaaaagagtttaat

SEQ ID NO: 8075367 - DNA, 22 bp, Homo sapiens
tctcatgtattgccctggtgtg

SEQ ID NO: 8075368 - DNA, 22 bp, Homo sapiens
tctcattcataccctacatgct

SEQ ID NO: 8075369 - DNA, 22 bp, Homo sapiens
tctcagggtttgtacaagtgta

SEQ ID NO: 8075370 - DNA, 20 bp, Homo sapiens
tctcagggttcagcaaagta

SEQ ID NO: 8075371 - DNA, 22 bp, Homo sapiens
tctcagggtttcctgggggctg

SEQ ID NO: 8075372 - DNA, 22 bp, Homo sapiens
tctcagggtgaggaaagaattt

SEQ ID NO: 8075373 - DNA, 22 bp, Homo sapiens
tctcaggggcctggagtcctgg

SEQ ID NO: 8075374 - DNA, 22 bp, Homo sapiens
tctcaggggattcactggcacc

SEQ ID NO: 8075375 - DNA, 22 bp, Homo sapiens
tctcagggcgcagtgaggcagt

SEQ ID NO: 8075376 - DNA, 22 bp, Homo sapiens
tctcagggcctccctctgtttc

SEQ ID NO: 8075377 - DNA, 22 bp, Homo sapiens
tctcagggaccatgatgatgac

SEQ ID NO: 8075378 - DNA, 22 bp, Homo sapiens
tctcagggagggcgagtcagcg

SEQ ID NO: 8075379 - DNA, 22 bp, Homo sapiens
tctcagggccccaaaggctagt

SEQ ID NO: 8075380 - DNA, 22 bp, Homo sapiens
tctcagggcagcaaggaagcat

SEQ ID NO: 8075381 - DNA, 22 bp, Homo sapiens
tctcaggctaccttgcacaagg

SEQ ID NO: 8075382 - DNA, 22 bp, Homo sapiens
tctcaggcccctgagtttctct

SEQ ID NO: 8075383 - DNA, 22 bp, Homo sapiens
tctcagagtttagagctgagcc

SEQ ID NO: 8075384 - DNA, 22 bp, Homo sapiens
tctcagcagggccatcctgagc

SEQ ID NO: 8075385 - DNA, 22 bp, Homo sapiens
tctcagagtgacaatgagaatt

SEQ ID NO: 8075386 - DNA, 22 bp, Homo sapiens
tctcccagaggatcccagtgga

SEQ ID NO: 8075387 - DNA, 22 bp, Homo sapiens
tctcccactggccttgtatgat

SEQ ID NO: 8075388 - DNA, 22 bp, Homo sapiens
tctcccactgcaagcccaggct

SEQ ID NO: 8075389 - DNA, 22 bp, Homo sapiens
tctcccactgcaagcccaggct

SEQ ID NO: 8075390 - DNA, 22 bp, Homo sapiens
tctcccaggtgggtgcctggag

SEQ ID NO: 8075391 - DNA, 22 bp, Homo sapiens
tctcccaggtgggtgcctggag

SEQ ID NO: 8075392 - DNA, 22 bp, Homo sapiens
tctcccaggctgccctgtggac

SEQ ID NO: 8075393 - DNA, 20 bp, Homo sapiens
tctcccaggctcagggaaga

SEQ ID NO: 8075394 - DNA, 22 bp, Homo sapiens
tctccctcattcctgcttccat

SEQ ID NO: 8075395 - DNA, 22 bp, Homo sapiens
tctcccgacccatgtgccaggg

SEQ ID NO: 8075396 - DNA, 22 bp, Homo sapiens
tctcccctgttggccaggtttt

SEQ ID NO: 8075397 - DNA, 21 bp, Homo sapiens
tctccccattcttattcccat

SEQ ID NO: 8075398 - DNA, 22 bp, Homo sapiens
tctccccaaccatggcactcac

SEQ ID NO: 8075399 - DNA, 22 bp, Homo sapiens
tctccccaaaggactcactctc

SEQ ID NO: 8075400 - DNA, 22 bp, Homo sapiens
tctccccagctgagctgccctt

SEQ ID NO: 8075401 - DNA, 22 bp, Homo sapiens
tctccccagctgagctgccctt

SEQ ID NO: 8075402 - DNA, 22 bp, Homo sapiens
tctcctttgaaagttaggactg

SEQ ID NO: 8075403 - DNA, 22 bp, Homo sapiens
tctcctgccactgcttcccatt

SEQ ID NO: 8075404 - DNA, 22 bp, Homo sapiens
tctcctgctcagaacagcctca

SEQ ID NO: 8075405 - DNA, 22 bp, Homo sapiens
tctcctgcagcgagcccgacac

SEQ ID NO: 8075406 - DNA, 22 bp, Homo sapiens
tctcctgcagtcagcagtctca

SEQ ID NO: 8075407 - DNA, 22 bp, Homo sapiens
tctcctgctcccaactgctgca

SEQ ID NO: 8075408 - DNA, 22 bp, Homo sapiens
tctcctgcttcaactgatggac

SEQ ID NO: 8075409 - DNA, 22 bp, Homo sapiens
tctcctctgcgcggcagtgccc

SEQ ID NO: 8075410 - DNA, 23 bp, Homo sapiens
tctcctcctagatacagtcatgg

SEQ ID NO: 8075411 - DNA, 22 bp, Homo sapiens
tctcctcccaggctcttccagg

SEQ ID NO: 8075412 - DNA, 22 bp, Homo sapiens
tctcctcaccaccagcagcaga

SEQ ID NO: 8075413 - DNA, 22 bp, Homo sapiens
tctggcccagcccctgaggtca

SEQ ID NO: 8075414 - DNA, 22 bp, Homo sapiens
tctggagccacaaacctcagct

SEQ ID NO: 8075415 - DNA, 21 bp, Homo sapiens
tctggagccctaagctgagaa

SEQ ID NO: 8075416 - DNA, 22 bp, Homo sapiens
tctggagatcatgtggggtgga

SEQ ID NO: 8075417 - DNA, 22 bp, Homo sapiens
tctggagcaacagagcaggaca

SEQ ID NO: 8075418 - DNA, 22 bp, Homo sapiens
tctggatggtcagctcttcctg

SEQ ID NO: 8075419 - DNA, 22 bp, Homo sapiens
tctgctggtgatgacctcataa

SEQ ID NO: 8075420 - DNA, 18 bp, Homo sapiens
tctgctgctgcgtcctgc

SEQ ID NO: 8075421 - DNA, 22 bp, Homo sapiens
tctgctgctgagcacactccta

SEQ ID NO: 8075422 - DNA, 22 bp, Homo sapiens
tctgctgctgaccaacactgtg

SEQ ID NO: 8075423 - DNA, 22 bp, Homo sapiens
tctgctgctgagcacactccta

SEQ ID NO: 8075424 - DNA, 22 bp, Homo sapiens
tctgctgctgcagctacactat

SEQ ID NO: 8075425 - DNA, 22 bp, Homo sapiens
tctgctgtctatgcaagtcctt

SEQ ID NO: 8075426 - DNA, 17 bp, Homo sapiens
tctgctctgccaatcca

SEQ ID NO: 8075427 - DNA, 22 bp, Homo sapiens
tctgctctgtggcttcagctaa

SEQ ID NO: 8075428 - DNA, 22 bp, Homo sapiens
tctgctctagttgcttcctgcc

SEQ ID NO: 8075429 - DNA, 22 bp, Homo sapiens
tctgctctccatacttccgcac

SEQ ID NO: 8075430 - DNA, 22 bp, Homo sapiens
tctgctgctacagactctctag

SEQ ID NO: 8075431 - DNA, 22 bp, Homo sapiens
tctgctgcctgcagggcagaga

SEQ ID NO: 8075432 - DNA, 22 bp, Homo sapiens
tctgctgccatgcagagcagta

SEQ ID NO: 8075433 - DNA, 22 bp, Homo sapiens
tctgctgcctcggtgtgggtac

SEQ ID NO: 8075434 - DNA, 22 bp, Homo sapiens
tctgctgcagggaaagactttc

SEQ ID NO: 8075435 - DNA, 22 bp, Homo sapiens
tctgctgccaccttgtggtgag

SEQ ID NO: 8075436 - DNA, 22 bp, Homo sapiens
tctgctgcagcaggattctctg

SEQ ID NO: 8075437 - DNA, 22 bp, Homo sapiens
tctgctgcagagctgcgggtgc

SEQ ID NO: 8075438 - DNA, 22 bp, Homo sapiens
tctgctgcacaaattcatctct

SEQ ID NO: 8075439 - DNA, 22 bp, Homo sapiens
tctgctgcacaaattcatctct

SEQ ID NO: 8075440 - DNA, 22 bp, Homo sapiens
tctgctgagtcagacctctggg

SEQ ID NO: 8075441 - DNA, 22 bp, Homo sapiens
tctggagaacttgcaagaggat

SEQ ID NO: 8075442 - DNA, 22 bp, Homo sapiens
tctggagaagcccagggagctg

SEQ ID NO: 8075443 - DNA, 22 bp, Homo sapiens
tctggagataagacagacagat

SEQ ID NO: 8075444 - DNA, 22 bp, Homo sapiens
tctggagataagacagacagat

SEQ ID NO: 8075445 - DNA, 22 bp, Homo sapiens
tctggagagtcacagtgccaga

SEQ ID NO: 8075446 - DNA, 22 bp, Homo sapiens
tctggagaggaggatgtggaca

SEQ ID NO: 8075447 - DNA, 22 bp, Homo sapiens
tctggaagttagaggaggaaag

SEQ ID NO: 8075448 - DNA, 22 bp, Homo sapiens
tctgggaaggctctgcagatat

SEQ ID NO: 8075449 - DNA, 22 bp, Homo sapiens
tctggctgctgcgtgagtgctt

SEQ ID NO: 8075450 - DNA, 22 bp, Homo sapiens
tctgggccctaaaccagctcta

SEQ ID NO: 8075451 - DNA, 21 bp, Homo sapiens
tctgggcccatgctgcctcac

SEQ ID NO: 8075452 - DNA, 22 bp, Homo sapiens
tctgggcactgctgagcctgta

SEQ ID NO: 8075453 - DNA, 22 bp, Homo sapiens
tctgggagtttctgtgggagct

SEQ ID NO: 8075454 - DNA, 23 bp, Homo sapiens
tctgggcatatctagtcacatcg

SEQ ID NO: 8075455 - DNA, 22 bp, Homo sapiens
tctgggcagttcggatcctctg

SEQ ID NO: 8075456 - DNA, 22 bp, Homo sapiens
tctgggcagccatgtgcctggc

SEQ ID NO: 8075457 - DNA, 21 bp, Homo sapiens
tctgggcagcccagtcctgag

SEQ ID NO: 8075458 - DNA, 22 bp, Homo sapiens
tctgggcagcagcagctagtag

SEQ ID NO: 8075459 - DNA, 22 bp, Homo sapiens
tctgggagacgtgtgttgtcag

SEQ ID NO: 8075460 - DNA, 22 bp, Homo sapiens
tctgggagagctgctgtcagag

SEQ ID NO: 8075461 - DNA, 22 bp, Homo sapiens
tctgggaggtactgggaggtgt

SEQ ID NO: 8075462 - DNA, 22 bp, Homo sapiens
tctgggaggtaaccatgctgat

SEQ ID NO: 8075463 - DNA, 22 bp, Homo sapiens
tctgcccaaggctgtcactaga

SEQ ID NO: 8075464 - DNA, 22 bp, Homo sapiens
tctgccacatgagggcacagca

SEQ ID NO: 8075465 - DNA, 22 bp, Homo sapiens
tctgcatgatgaacaaatgagc

SEQ ID NO: 8075466 - DNA, 22 bp, Homo sapiens
tctgcatctgtgttgagtgccc

SEQ ID NO: 8075467 - DNA, 19 bp, Homo sapiens
tctgcatggcaggaagaga

SEQ ID NO: 8075468 - DNA, 22 bp, Homo sapiens
tctgcatggagaggagatgcta

SEQ ID NO: 8075469 - DNA, 22 bp, Homo sapiens
tctgcaggtaagcgttcttgga

SEQ ID NO: 8075470 - DNA, 22 bp, Homo sapiens
tctgcaagtagatgacagtgag

SEQ ID NO: 8075471 - DNA, 18 bp, Homo sapiens
tctgcactcctgagagag

SEQ ID NO: 8075472 - DNA, 22 bp, Homo sapiens
tctgcaggaggctggctgcagg

SEQ ID NO: 8075473 - DNA, 22 bp, Homo sapiens
tctgcaggaggctggctgcagg

SEQ ID NO: 8075474 - DNA, 22 bp, Homo sapiens
tctgcaggcctcgacaaggcca

SEQ ID NO: 8075475 - DNA, 22 bp, Homo sapiens
tctgcaggactgaggcctgttt

SEQ ID NO: 8075476 - DNA, 22 bp, Homo sapiens
tctgcaggaaaaaagtgcctgg

SEQ ID NO: 8075477 - DNA, 22 bp, Homo sapiens
tctgcagcttcttgccagagag

SEQ ID NO: 8075478 - DNA, 22 bp, Homo sapiens
tctgctcagggagggtcactac

SEQ ID NO: 8075479 - DNA, 22 bp, Homo sapiens
tctgctcacatggctccatgca

SEQ ID NO: 8075480 - DNA, 22 bp, Homo sapiens
tctgcctgctaactcctgcacc

SEQ ID NO: 8075481 - DNA, 22 bp, Homo sapiens
tctgcctgctaactcctgcacc

SEQ ID NO: 8075482 - DNA, 22 bp, Homo sapiens
tctgcctggctcatggcagtga

SEQ ID NO: 8075483 - DNA, 22 bp, Homo sapiens
tctgcctggattccattctcca

SEQ ID NO: 8075484 - DNA, 22 bp, Homo sapiens
tctgcctggattccattctcca

SEQ ID NO: 8075485 - DNA, 22 bp, Homo sapiens
tctgcccactgctctgctgccc

SEQ ID NO: 8075486 - DNA, 22 bp, Homo sapiens
tctgcccactgctctgctgccc

SEQ ID NO: 8075487 - DNA, 22 bp, Homo sapiens
tctgcccctgctgggcacagag

SEQ ID NO: 8075488 - DNA, 22 bp, Homo sapiens
tctgcctgagggagctgaggaa

SEQ ID NO: 8075489 - DNA, 22 bp, Homo sapiens
tctgcctgagggagctgaggaa

SEQ ID NO: 8075490 - DNA, 22 bp, Homo sapiens
tctgcaagcgtcacatgattct

SEQ ID NO: 8075491 - DNA, 22 bp, Homo sapiens
tctgcaagctaaggaagcatct

SEQ ID NO: 8075492 - DNA, 21 bp, Homo sapiens
tctgatggtagatgagatgtg

SEQ ID NO: 8075493 - DNA, 22 bp, Homo sapiens
tctgagggcttgaggggaagta

SEQ ID NO: 8075494 - DNA, 22 bp, Homo sapiens
tctgagggtgggagaaggagct

SEQ ID NO: 8075495 - DNA, 22 bp, Homo sapiens
tctgagcttttattatcaacct

SEQ ID NO: 8075496 - DNA, 19 bp, Homo sapiens
tctgagctgatatgacatt

SEQ ID NO: 8075497 - DNA, 22 bp, Homo sapiens
tctgagctacgatgcctgtcac

SEQ ID NO: 8075498 - DNA, 22 bp, Homo sapiens
tctgagctggagcccatcacct

SEQ ID NO: 8075499 - DNA, 22 bp, Homo sapiens
tctgagagagggtcagatgcta

SEQ ID NO: 8075500 - DNA, 22 bp, Homo sapiens
tctgagacaggaagtggagggt

SEQ ID NO: 8075501 - DNA, 23 bp, Homo sapiens
tctgagagaacaatgcctcctat

SEQ ID NO: 8075502 - DNA, 22 bp, Homo sapiens
tctgagccagggtctcctccct

SEQ ID NO: 8075503 - DNA, 22 bp, Homo sapiens
tctgacagctccaggcagcaat

SEQ ID NO: 8075504 - DNA, 22 bp, Homo sapiens
tctgacatgagggctgtggaga

SEQ ID NO: 8075505 - DNA, 22 bp, Homo sapiens
tctgacattttgagaatgacat

SEQ ID NO: 8075506 - DNA, 22 bp, Homo sapiens
tctgacctgaatgaaacagatg

SEQ ID NO: 8075507 - DNA, 22 bp, Homo sapiens
tcttcaatttagaatggattta

SEQ ID NO: 8075508 - DNA, 22 bp, Homo sapiens
tcttcacaaagctgttgttaaa

SEQ ID NO: 8075509 - DNA, 22 bp, Homo sapiens
tcttcacaccgggcagcaggaa

SEQ ID NO: 8075510 - DNA, 22 bp, Homo sapiens
tcttcacatcatgttttttaat

SEQ ID NO: 8075511 - DNA, 22 bp, Homo sapiens
tcttattttagagccccgagcc

SEQ ID NO: 8075512 - DNA, 22 bp, Homo sapiens
tcttatttgcaactggctcaga

SEQ ID NO: 8075513 - DNA, 22 bp, Homo sapiens
tcttcaaactgaaaatttagaa

SEQ ID NO: 8075514 - DNA, 22 bp, Homo sapiens
tcttccaatacctagattttgg

SEQ ID NO: 8075515 - DNA, 22 bp, Homo sapiens
tcttccaatggtttctagattt

SEQ ID NO: 8075516 - DNA, 22 bp, Homo sapiens
tcttccaattagaatatttggg

SEQ ID NO: 8075517 - DNA, 18 bp, Homo sapiens
tcttccaacactgacacc

SEQ ID NO: 8075518 - DNA, 21 bp, Homo sapiens
tcttccaagggctgctgagac

SEQ ID NO: 8075519 - DNA, 22 bp, Homo sapiens
tcttccaaggtgcagatcttct

SEQ ID NO: 8075520 - DNA, 22 bp, Homo sapiens
tcttccaaggttgcacactatc

SEQ ID NO: 8075521 - DNA, 22 bp, Homo sapiens
tcttccaaaattagtctcagtt

SEQ ID NO: 8075522 - DNA, 22 bp, Homo sapiens
tcttccaaatgcagctaaagct

SEQ ID NO: 8075523 - DNA, 22 bp, Homo sapiens
tcttccaaatgaatatggtttt

SEQ ID NO: 8075524 - DNA, 22 bp, Homo sapiens
tcttcagcaactccccaatctg

SEQ ID NO: 8075525 - DNA, 22 bp, Homo sapiens
tcttcagctctgaggctctggc

SEQ ID NO: 8075526 - DNA, 22 bp, Homo sapiens
tcttcatgttgcttattctggg

SEQ ID NO: 8075527 - DNA, 22 bp, Homo sapiens
tcttcatgccaaatgagttttg

SEQ ID NO: 8075528 - DNA, 22 bp, Homo sapiens
tcttcatggtctggttctccag

SEQ ID NO: 8075529 - DNA, 23 bp, Homo sapiens
tcttcatgcccaggccttggtgc

SEQ ID NO: 8075530 - DNA, 22 bp, Homo sapiens
tcttcttcctccacagggccca

SEQ ID NO: 8075531 - DNA, 22 bp, Homo sapiens
tcttcttcctcatttatacata

SEQ ID NO: 8075532 - DNA, 22 bp, Homo sapiens
tcttcttcctcatttatacata

SEQ ID NO: 8075533 - DNA, 22 bp, Homo sapiens
tcttctctacaccagcagcccc

SEQ ID NO: 8075534 - DNA, 23 bp, Homo sapiens
tcttcctgaactatcaggcacat

SEQ ID NO: 8075535 - DNA, 22 bp, Homo sapiens
tcttcctgaaaccctgttccag

SEQ ID NO: 8075536 - DNA, 22 bp, Homo sapiens
tcttcctctagatctgaggccc

SEQ ID NO: 8075537 - DNA, 22 bp, Homo sapiens
tcttcctctctaattgatcaga

SEQ ID NO: 8075538 - DNA, 22 bp, Homo sapiens
tctttacttgtgtattgtatat

SEQ ID NO: 8075539 - DNA, 22 bp, Homo sapiens
tctttaatcataaccaagatgg

SEQ ID NO: 8075540 - DNA, 22 bp, Homo sapiens
tctttaatgtgattgtaattat

SEQ ID NO: 8075541 - DNA, 22 bp, Homo sapiens
tcttgggattgccctgcagttc

SEQ ID NO: 8075542 - DNA, 22 bp, Homo sapiens
tcttgggaggagcacctgcctg

SEQ ID NO: 8075543 - DNA, 22 bp, Homo sapiens
tcttggctggtcatttaaaatc

SEQ ID NO: 8075544 - DNA, 22 bp, Homo sapiens
tcttggagaatggcagagaagc

SEQ ID NO: 8075545 - DNA, 22 bp, Homo sapiens
tcttggagactcttgtatattt

SEQ ID NO: 8075546 - DNA, 18 bp, Homo sapiens
tcttggagtaatgatcaa

SEQ ID NO: 8075547 - DNA, 22 bp, Homo sapiens
tcttgcttgatacatggaggaa

SEQ ID NO: 8075548 - DNA, 19 bp, Homo sapiens
tcttgatgaggtttctcca

SEQ ID NO: 8075549 - DNA, 22 bp, Homo sapiens
tctttgatgtggttaattatga

SEQ ID NO: 8075550 - DNA, 22 bp, Homo sapiens
tctttgatcagcctttcactga

SEQ ID NO: 8075551 - DNA, 22 bp, Homo sapiens
tctttcctactttattgtgaac

SEQ ID NO: 8075552 - DNA, 22 bp, Homo sapiens
tctttcctagaggctgatgagt

SEQ ID NO: 8075553 - DNA, 22 bp, Homo sapiens
tctttcctaggtgatatgcaat

SEQ ID NO: 8075554 - DNA, 22 bp, Homo sapiens
tctttcctaggtgatatgcaat

SEQ ID NO: 8075555 - DNA, 22 bp, Homo sapiens
tctttcctactttattgtgaac

SEQ ID NO: 8075556 - DNA, 21 bp, Homo sapiens
tctttcctgcccagttgccct

SEQ ID NO: 8075557 - DNA, 17 bp, Homo sapiens
tctttcctgccatgctc

SEQ ID NO: 8075558 - DNA, 23 bp, Homo sapiens
tctttcctcagcacacaccaaga

SEQ ID NO: 8075559 - DNA, 22 bp, Homo sapiens
tctttcctctgagctcctgtag

SEQ ID NO: 8075560 - DNA, 22 bp, Homo sapiens
tctttcctgtaactgctgttca

SEQ ID NO: 8075561 - DNA, 22 bp, Homo sapiens
tctttccttagaataattcttt

SEQ ID NO: 8075562 - DNA, 22 bp, Homo sapiens
tctttcggccatagcgatgatt

SEQ ID NO: 8075563 - DNA, 22 bp, Homo sapiens
tctttataaaagtcattatgtc

SEQ ID NO: 8075564 - DNA, 22 bp, Homo sapiens
tctttatcaagtctgttctttg

SEQ ID NO: 8075565 - DNA, 22 bp, Homo sapiens
tctttatgtttgaaagtacaat

SEQ ID NO: 8075566 - DNA, 22 bp, Homo sapiens
tctttagtgacagttgtgcaag

SEQ ID NO: 8075567 - DNA, 22 bp, Homo sapiens
tctttagaaacttttcttcatg

SEQ ID NO: 8075568 - DNA, 22 bp, Homo sapiens
tctttagagctcagaaatacag

SEQ ID NO: 8075569 - DNA, 22 bp, Homo sapiens
tctttattgctactggtttgtc

SEQ ID NO: 8075570 - DNA, 22 bp, Homo sapiens
tctttattgctactggtttgtc

SEQ ID NO: 8075571 - DNA, 22 bp, Homo sapiens
tctttcatgtatatgcaaccta

SEQ ID NO: 8075572 - DNA, 22 bp, Homo sapiens
tctgttcttggtgcagctggga

SEQ ID NO: 8075573 - DNA, 22 bp, Homo sapiens
tctgttatatgttttttctaaa

SEQ ID NO: 8075574 - DNA, 22 bp, Homo sapiens
tctgttgcaatgtgcatggtga

SEQ ID NO: 8075575 - DNA, 22 bp, Homo sapiens
tctgtttatgcatatttaaaac

SEQ ID NO: 8075576 - DNA, 18 bp, Homo sapiens
tctgtgttctgtcattgc

SEQ ID NO: 8075577 - DNA, 22 bp, Homo sapiens
tctgtgtttaaaagatatgtcc

SEQ ID NO: 8075578 - DNA, 22 bp, Homo sapiens
tctgtgttttaaacagtagaaa

SEQ ID NO: 8075579 - DNA, 22 bp, Homo sapiens
tctgtgtgaccataagccagct

SEQ ID NO: 8075580 - DNA, 22 bp, Homo sapiens
tctgtgtgggatagtttgagga

SEQ ID NO: 8075581 - DNA, 22 bp, Homo sapiens
tcttaaaccacaaaattcagag

SEQ ID NO: 8075582 - DNA, 22 bp, Homo sapiens
tcttaaactttgctgtaattct

SEQ ID NO: 8075583 - DNA, 22 bp, Homo sapiens
tctgtgctgtctcagagaaagc

SEQ ID NO: 8075584 - DNA, 22 bp, Homo sapiens
tctgtgctcttctcagtatcac

SEQ ID NO: 8075585 - DNA, 22 bp, Homo sapiens
tctgtggattttagtgttcatg

SEQ ID NO: 8075586 - DNA, 22 bp, Homo sapiens
tctgtgacttgcgggaggagaa

SEQ ID NO: 8075587 - DNA, 22 bp, Homo sapiens
tctgtgagtactttaacgagag

SEQ ID NO: 8075588 - DNA, 22 bp, Homo sapiens
tctgtctgagggagtgacattt

SEQ ID NO: 8075589 - DNA, 22 bp, Homo sapiens
tctgtctgcacctaagcacagt

SEQ ID NO: 8075590 - DNA, 22 bp, Homo sapiens
tctgtctgcgcttgccctggtg

SEQ ID NO: 8075591 - DNA, 22 bp, Homo sapiens
tctgtctgctcatttacctcag

SEQ ID NO: 8075592 - DNA, 22 bp, Homo sapiens
tctgtctttgtcaggaccagag

SEQ ID NO: 8075593 - DNA, 22 bp, Homo sapiens
tctgggggcgaccagggactgc

SEQ ID NO: 8075594 - DNA, 22 bp, Homo sapiens
tctgggctttacactgtgctta

SEQ ID NO: 8075595 - DNA, 22 bp, Homo sapiens
tctgggcttggattggctctgc

SEQ ID NO: 8075596 - DNA, 17 bp, Homo sapiens
tctgggcttcagtggtc

SEQ ID NO: 8075597 - DNA, 22 bp, Homo sapiens
tctgggtggcttcagaggccac

SEQ ID NO: 8075598 - DNA, 22 bp, Homo sapiens
tctgggtggctgccaatctgcc

SEQ ID NO: 8075599 - DNA, 22 bp, Homo sapiens
tctgggtgctacaaacagtatt

SEQ ID NO: 8075600 - DNA, 22 bp, Homo sapiens
tctgggtgccctttgctctgtt

SEQ ID NO: 8075601 - DNA, 22 bp, Homo sapiens
tctgggtgccactgtctgtaca

SEQ ID NO: 8075602 - DNA, 22 bp, Homo sapiens
tctgggtgatgaaatgcactgt

SEQ ID NO: 8075603 - DNA, 22 bp, Homo sapiens
tctgtaaaacttctttgtaaat

SEQ ID NO: 8075604 - DNA, 22 bp, Homo sapiens
tctgggtgtcactcctgcctgc

SEQ ID NO: 8075605 - DNA, 22 bp, Homo sapiens
tctgggtgtagggcctggcaac

SEQ ID NO: 8075606 - DNA, 22 bp, Homo sapiens
tctgtcaaggcaactgcatttt

SEQ ID NO: 8075607 - DNA, 22 bp, Homo sapiens
tctgtagcaagtgagaggcatt

SEQ ID NO: 8075608 - DNA, 22 bp, Homo sapiens
tctgtaaatcctgctcagcaac

SEQ ID NO: 8075609 - DNA, 20 bp, Homo sapiens
tctgtaaagactccagaagc

SEQ ID NO: 8075610 - DNA, 22 bp, Homo sapiens
tctgtcctgtttcctcctgaca

SEQ ID NO: 8075611 - DNA, 21 bp, Homo sapiens
tctgtctctccactgccctgc

SEQ ID NO: 8075612 - DNA, 22 bp, Homo sapiens
tctgtctgacagggtatgaact

SEQ ID NO: 8075613 - DNA, 22 bp, Homo sapiens
tctgtccattcagccatccatc

SEQ ID NO: 8075614 - DNA, 17 bp, Homo sapiens
tctgtccagggagtgtg

SEQ ID NO: 8075615 - DNA, 22 bp, Homo sapiens
tctgtccattttccattttggc

SEQ ID NO: 8075616 - DNA, 22 bp, Homo sapiens
ttccaggaaaacagttggaagt

SEQ ID NO: 8075617 - DNA, 22 bp, Homo sapiens
aagtctctctgtgtgggataag

SEQ ID NO: 8075618 - DNA, 22 bp, Homo sapiens
aagtctctcatggctgacagca

SEQ ID NO: 8075619 - DNA, 22 bp, Homo sapiens
aagtctctcacatatctggtcc

SEQ ID NO: 8075620 - DNA, 22 bp, Homo sapiens
aagtctctaagactgtgccatc

SEQ ID NO: 8075621 - DNA, 22 bp, Homo sapiens
aagtctctggcaaatgatcttg

SEQ ID NO: 8075622 - DNA, 22 bp, Homo sapiens
aagtctctgactcacacaatgt

SEQ ID NO: 8075623 - DNA, 22 bp, Homo sapiens
aagtctctgatgtgtgttaggt

SEQ ID NO: 8075624 - DNA, 18 bp, Homo sapiens
aagtctctgaaagctttt

SEQ ID NO: 8075625 - DNA, 22 bp, Homo sapiens
aagtctcttcctctgccaaaga

SEQ ID NO: 8075626 - DNA, 22 bp, Homo sapiens
aagtctcttagtaatatccaac

SEQ ID NO: 8075627 - DNA, 22 bp, Homo sapiens
aagtctctggttgcttgcatgg

SEQ ID NO: 8075628 - DNA, 22 bp, Homo sapiens
aagtctctggtgatgcaggaaa

SEQ ID NO: 8075629 - DNA, 22 bp, Homo sapiens
aagtctctttacctctccaggc

SEQ ID NO: 8075630 - DNA, 22 bp, Homo sapiens
aagtctctttgggtactttatt

SEQ ID NO: 8075631 - DNA, 22 bp, Homo sapiens
actcactgggtcccggaagccc

SEQ ID NO: 8075632 - DNA, 22 bp, Homo sapiens
actcactttccattcaagcacc

SEQ ID NO: 8075633 - DNA, 22 bp, Homo sapiens
actatacattgaatgttaaggt

SEQ ID NO: 8075634 - DNA, 22 bp, Homo sapiens
actcactgcactttgaaatgtg

SEQ ID NO: 8075635 - DNA, 22 bp, Homo sapiens
actatacagtatgtacgtgcac

SEQ ID NO: 8075636 - DNA, 22 bp, Homo sapiens
actataacctgttagaatagat

SEQ ID NO: 8075637 - DNA, 22 bp, Homo sapiens
actataacccatggaatataag

SEQ ID NO: 8075638 - DNA, 23 bp, Homo sapiens
actataaagttgttctgatttac

SEQ ID NO: 8075639 - DNA, 22 bp, Homo sapiens
actatacaccaaaatattaagg

SEQ ID NO: 8075640 - DNA, 22 bp, Homo sapiens
actagttttccataatatagga

SEQ ID NO: 8075641 - DNA, 22 bp, Homo sapiens
actataaaaggataaaccagaa

SEQ ID NO: 8075642 - DNA, 22 bp, Homo sapiens
actataaaaggataaaccagaa

SEQ ID NO: 8075643 - DNA, 22 bp, Homo sapiens
aatacctttcctgccattcact

SEQ ID NO: 8075644 - DNA, 22 bp, Homo sapiens
aatacagaggaaacatttaata

SEQ ID NO: 8075645 - DNA, 22 bp, Homo sapiens
aatacagaggcttccagtaaaa

SEQ ID NO: 8075646 - DNA, 22 bp, Homo sapiens
actggcctatcagcatgagtct

SEQ ID NO: 8075647 - DNA, 23 bp, Homo sapiens
actggacagagtggacgaggctg

SEQ ID NO: 8075648 - DNA, 22 bp, Homo sapiens
actggacatttctagaaagcag

SEQ ID NO: 8075649 - DNA, 22 bp, Homo sapiens
agaacaaaattagaggagtgca

SEQ ID NO: 8075650 - DNA, 22 bp, Homo sapiens
agaaatactttgtaaatctcac

SEQ ID NO: 8075651 - DNA, 22 bp, Homo sapiens
aatcagttgtccaaagttcaca

SEQ ID NO: 8075652 - DNA, 22 bp, Homo sapiens
aatcagagccctctgagcttca

SEQ ID NO: 8075653 - DNA, 22 bp, Homo sapiens
aatcagaatttattgaatcttt

SEQ ID NO: 8075654 - DNA, 22 bp, Homo sapiens
aatatagttctggtattgttaa

SEQ ID NO: 8075655 - DNA, 22 bp, Homo sapiens
actgttcatattcttagaaatt

SEQ ID NO: 8075656 - DNA, 22 bp, Homo sapiens
actgttcatcctttttgaacaa

SEQ ID NO: 8075657 - DNA, 21 bp, Homo sapiens
actgttcatctgttcagaagc

SEQ ID NO: 8075658 - DNA, 22 bp, Homo sapiens
aatatagttctagaaatatttt

SEQ ID NO: 8075659 - DNA, 22 bp, Homo sapiens
aatatagaatcactttccttca

SEQ ID NO: 8075660 - DNA, 22 bp, Homo sapiens
aatataattttattcctagagt

SEQ ID NO: 8075661 - DNA, 22 bp, Homo sapiens
aatactgaattagttgagacaa

SEQ ID NO: 8075662 - DNA, 22 bp, Homo sapiens
aatactgaaagtattttcaaat

SEQ ID NO: 8075663 - DNA, 22 bp, Homo sapiens
aatactagttattaaagctttt

SEQ ID NO: 8075664 - DNA, 22 bp, Homo sapiens
actttcttaggctgtataaatg

SEQ ID NO: 8075665 - DNA, 22 bp, Homo sapiens
actttcttggtcccatgtttga

SEQ ID NO: 8075666 - DNA, 22 bp, Homo sapiens
actttcttggtcccatgtttga

SEQ ID NO: 8075667 - DNA, 22 bp, Homo sapiens
actttcttcttatgcattaagg

SEQ ID NO: 8075668 - DNA, 22 bp, Homo sapiens
actttaaaactgatcatcagag

SEQ ID NO: 8075669 - DNA, 22 bp, Homo sapiens
actttaaaaagagccttctaac

SEQ ID NO: 8075670 - DNA, 22 bp, Homo sapiens
aaggctgggaaacatgcaggcc

SEQ ID NO: 8075671 - DNA, 22 bp, Homo sapiens
acatttctcttgatgtctctat

SEQ ID NO: 8075672 - DNA, 21 bp, Homo sapiens
aaggctggagatgcaggtctg

SEQ ID NO: 8075673 - DNA, 22 bp, Homo sapiens
aaggcagagtctatcttggaag

SEQ ID NO: 8075674 - DNA, 22 bp, Homo sapiens
acccagagtcagacagccatgg

SEQ ID NO: 8075675 - DNA, 22 bp, Homo sapiens
acccagagtcatgtttattccc

SEQ ID NO: 8075676 - DNA, 22 bp, Homo sapiens
acccagagtgtctgtctcagtc

SEQ ID NO: 8075677 - DNA, 22 bp, Homo sapiens
acccagaggtgtctagcaagct

SEQ ID NO: 8075678 - DNA, 22 bp, Homo sapiens
acccagagtaacagatggattc

SEQ ID NO: 8075679 - DNA, 22 bp, Homo sapiens
acccagagctgggcttggcaaa

SEQ ID NO: 8075680 - DNA, 22 bp, Homo sapiens
accgaagacactggtggttaag

SEQ ID NO: 8075681 - DNA, 19 bp, Homo sapiens
acccagagccctttgcagg

SEQ ID NO: 8075682 - DNA, 22 bp, Homo sapiens
acccagagcccttagcacagac

SEQ ID NO: 8075683 - DNA, 22 bp, Homo sapiens
acagtctttaatttctttgtgg

SEQ ID NO: 8075684 - DNA, 22 bp, Homo sapiens
acagtcttgcacttctatcagc

SEQ ID NO: 8075685 - DNA, 22 bp, Homo sapiens
acagtctttcagtaataatact

SEQ ID NO: 8075686 - DNA, 22 bp, Homo sapiens
acagtctttagagtattgtcct

SEQ ID NO: 8075687 - DNA, 22 bp, Homo sapiens
acagtgttcttgatattacagt

SEQ ID NO: 8075688 - DNA, 22 bp, Homo sapiens
acagtgttgaggtgcttgtttc

SEQ ID NO: 8075689 - DNA, 22 bp, Homo sapiens
acagtgtttatgtacagattgt

SEQ ID NO: 8075690 - DNA, 22 bp, Homo sapiens
acagtgtttggcaatgcatgca

SEQ ID NO: 8075691 - DNA, 22 bp, Homo sapiens
acatatgtatatgtacacagtc

SEQ ID NO: 8075692 - DNA, 22 bp, Homo sapiens
aagccaacatgattactataat

SEQ ID NO: 8075693 - DNA, 22 bp, Homo sapiens
aagcatttttgaaatggtagga

SEQ ID NO: 8075694 - DNA, 22 bp, Homo sapiens
aagctaagtggaagtcttatca

SEQ ID NO: 8075695 - DNA, 19 bp, Homo sapiens
aagctaagacctgaaggtt

SEQ ID NO: 8075696 - DNA, 22 bp, Homo sapiens
aagctatacaatgcacaaatga

SEQ ID NO: 8075697 - DNA, 22 bp, Homo sapiens
aagctaggcctcagtttcctga

SEQ ID NO: 8075698 - DNA, 22 bp, Homo sapiens
aagcattttagataaagcatca

SEQ ID NO: 8075699 - DNA, 22 bp, Homo sapiens
aagcattttgccacttgaagtt

SEQ ID NO: 8075700 - DNA, 22 bp, Homo sapiens
aagcattttgttttaagaatga

SEQ ID NO: 8075701 - DNA, 22 bp, Homo sapiens
aagcatttttcacagcaacagc

SEQ ID NO: 8075702 - DNA, 19 bp, Homo sapiens
acagggcagcaataggata

SEQ ID NO: 8075703 - DNA, 22 bp, Homo sapiens
acagggcagcaactttgtgcct

SEQ ID NO: 8075704 - DNA, 22 bp, Homo sapiens
acagggcagagggcagttggta

SEQ ID NO: 8075705 - DNA, 22 bp, Homo sapiens
acagggcagagtgaaatgctat

SEQ ID NO: 8075706 - DNA, 22 bp, Homo sapiens
acagggcagagaggcaggcttg

SEQ ID NO: 8075707 - DNA, 22 bp, Homo sapiens
acagggcagaaatgttgcatct

SEQ ID NO: 8075708 - DNA, 22 bp, Homo sapiens
aagctcaggaaagagtctggtt

SEQ ID NO: 8075709 - DNA, 17 bp, Homo sapiens
acagggcagaaacagct

SEQ ID NO: 8075710 - DNA, 22 bp, Homo sapiens
aattaaattggtttagagagga

SEQ ID NO: 8075711 - DNA, 23 bp, Homo sapiens
aattaaattgctagatccagggc

SEQ ID NO: 8075712 - DNA, 22 bp, Homo sapiens
aattaaatgacaggggaagatg

SEQ ID NO: 8075713 - DNA, 22 bp, Homo sapiens
agagcagtcaggctaggacact

SEQ ID NO: 8075714 - DNA, 22 bp, Homo sapiens
aattctgatgaataaatcatcc

SEQ ID NO: 8075715 - DNA, 22 bp, Homo sapiens
agagccagttacaactgtggag

SEQ ID NO: 8075716 - DNA, 22 bp, Homo sapiens
aatgggaggattttctctcttg

SEQ ID NO: 8075717 - DNA, 22 bp, Homo sapiens
agacaattgttctaagtaaaaa

SEQ ID NO: 8075718 - DNA, 22 bp, Homo sapiens
agacaattaaaaaattatgctt

SEQ ID NO: 8075719 - DNA, 22 bp, Homo sapiens
aatggtaaatgtaacagcattc

SEQ ID NO: 8075720 - DNA, 22 bp, Homo sapiens
acaagagagacactaggaatgt

SEQ ID NO: 8075721 - DNA, 22 bp, Homo sapiens
acaagactgtgctctaagagtg

SEQ ID NO: 8075722 - DNA, 22 bp, Homo sapiens
acaagagattatctacagatga

SEQ ID NO: 8075723 - DNA, 22 bp, Homo sapiens
acaagagattatctacagatga

SEQ ID NO: 8075724 - DNA, 22 bp, Homo sapiens
acaacaatctaccctagcttct

SEQ ID NO: 8075725 - DNA, 22 bp, Homo sapiens
acaatagacaaagtgaatggct

SEQ ID NO: 8075726 - DNA, 22 bp, Homo sapiens
acaatgaagataatgttgcagt

SEQ ID NO: 8075727 - DNA, 22 bp, Homo sapiens
acaatgaagctccactgagctt

SEQ ID NO: 8075728 - DNA, 22 bp, Homo sapiens
acaatgaagggagacacttgct

SEQ ID NO: 8075729 - DNA, 22 bp, Homo sapiens
acaatgaatatcatgaagtact

SEQ ID NO: 8075730 - DNA, 22 bp, Homo sapiens
acaatgcaataggagctagaaa

SEQ ID NO: 8075731 - DNA, 19 bp, Homo sapiens
aattctgtttcagcagatc

SEQ ID NO: 8075732 - DNA, 20 bp, Homo sapiens
aattctgtcttttctgctgc

SEQ ID NO: 8075733 - DNA, 22 bp, Homo sapiens
aattcttgttgttagtatattt

SEQ ID NO: 8075734 - DNA, 22 bp, Homo sapiens
aattgctagactatactgtaat

SEQ ID NO: 8075735 - DNA, 22 bp, Homo sapiens
aattgcttgtttctttaactga

SEQ ID NO: 8075736 - DNA, 22 bp, Homo sapiens
agaggccctctctgctcagtct

SEQ ID NO: 8075737 - DNA, 22 bp, Homo sapiens
acaaaggttgggtcaattgtcc

SEQ ID NO: 8075738 - DNA, 22 bp, Homo sapiens
acaaagtaggtcatcaaagctc

SEQ ID NO: 8075739 - DNA, 22 bp, Homo sapiens
acaaagtagtcaaagtagatga

SEQ ID NO: 8075740 - DNA, 22 bp, Homo sapiens
acaaagtaggaagattagctga

SEQ ID NO: 8075741 - DNA, 22 bp, Homo sapiens
acaaagtaagggctaatgagca

SEQ ID NO: 8075742 - DNA, 23 bp, Homo sapiens
acaaagtaattcctgcttccaaa

SEQ ID NO: 8075743 - DNA, 22 bp, Homo sapiens
acaaagcttagacctaagagat

SEQ ID NO: 8075744 - DNA, 22 bp, Homo sapiens
acagacagacagattgcatatg

SEQ ID NO: 8075745 - DNA, 20 bp, Homo sapiens
acagaaagagagaatgtcag

SEQ ID NO: 8075746 - DNA, 22 bp, Homo sapiens
acagaaagaaggtgtatttgag

SEQ ID NO: 8075747 - DNA, 22 bp, Homo sapiens
acagaaagaccttgtaacactt

SEQ ID NO: 8075748 - DNA, 22 bp, Homo sapiens
acacttttgtgtatatccagtt

SEQ ID NO: 8075749 - DNA, 22 bp, Homo sapiens
acacttttgtttgaagtctcca

SEQ ID NO: 8075750 - DNA, 20 bp, Homo sapiens
acagatatttgattttcagt

SEQ ID NO: 8075751 - DNA, 22 bp, Homo sapiens
acagatgagttagaataggcag

SEQ ID NO: 8075752 - DNA, 22 bp, Homo sapiens
acagatgtggagtttgcatgat

SEQ ID NO: 8075753 - DNA, 22 bp, Homo sapiens
acagatgttagcaatgatgatg

SEQ ID NO: 8075754 - DNA, 22 bp, Homo sapiens
acagatgtaccttagtgatggg

SEQ ID NO: 8075755 - DNA, 22 bp, Homo sapiens
acagcacaatctgagtcccaga

SEQ ID NO: 8075756 - DNA, 22 bp, Homo sapiens
acagcacagagtggtatggctg

SEQ ID NO: 8075757 - DNA, 19 bp, Homo sapiens
acagcacagaaatatttca

SEQ ID NO: 8075758 - DNA, 22 bp, Homo sapiens
acagcacaggagttgaatgggc

SEQ ID NO: 8075759 - DNA, 22 bp, Homo sapiens
agctcctgcccaggaaggctct

SEQ ID NO: 8075760 - DNA, 22 bp, Homo sapiens
acacagaagatctcttaatgct

SEQ ID NO: 8075761 - DNA, 21 bp, Homo sapiens
acaatgcatggaactcatggc

SEQ ID NO: 8075762 - DNA, 22 bp, Homo sapiens
acaatgcatacctagcagctca

SEQ ID NO: 8075763 - DNA, 23 bp, Homo sapiens
acacatgtttatgcttgggggca

SEQ ID NO: 8075764 - DNA, 22 bp, Homo sapiens
acacatgtttccaaaagcaccc

SEQ ID NO: 8075765 - DNA, 22 bp, Homo sapiens
acacattaacctttgaaattct

SEQ ID NO: 8075766 - DNA, 22 bp, Homo sapiens
acacatgtgattctaagacagc

SEQ ID NO: 8075767 - DNA, 22 bp, Homo sapiens
acacatgtatgttttgtatttg

SEQ ID NO: 8075768 - DNA, 22 bp, Homo sapiens
acacatgtatgttttgtatttg

SEQ ID NO: 8075769 - DNA, 20 bp, Homo sapiens
acacatgtcaagctaaaggc

SEQ ID NO: 8075770 - DNA, 22 bp, Homo sapiens
acacatgtatggcacttacatt

SEQ ID NO: 8075771 - DNA, 22 bp, Homo sapiens
acacatgtacagattagtattt

SEQ ID NO: 8075772 - DNA, 19 bp, Homo sapiens
acacatgtaacagtttttc

SEQ ID NO: 8075773 - DNA, 22 bp, Homo sapiens
acactctgctctgagcttcagg

SEQ ID NO: 8075774 - DNA, 22 bp, Homo sapiens
acacattataggcaatcaaaag

SEQ ID NO: 8075775 - DNA, 22 bp, Homo sapiens
acactgaatgtttaagaacttg

SEQ ID NO: 8075776 - DNA, 22 bp, Homo sapiens
aaagactctaggtagcttataa

SEQ ID NO: 8075777 - DNA, 22 bp, Homo sapiens
aaagactagcatttatatgtac

SEQ ID NO: 8075778 - DNA, 22 bp, Homo sapiens
aaagactaagaagagtattatt

SEQ ID NO: 8075779 - DNA, 22 bp, Homo sapiens
aaagacttggcttatgatttgc

SEQ ID NO: 8075780 - DNA, 22 bp, Homo sapiens
aaagactgaggggaaagtgatg

SEQ ID NO: 8075781 - DNA, 22 bp, Homo sapiens
aaagactggtgtgttacatata

SEQ ID NO: 8075782 - DNA, 22 bp, Homo sapiens
aaagatcagtctgaagcaacat

SEQ ID NO: 8075783 - DNA, 22 bp, Homo sapiens
aaagagcaagggctttgaggct

SEQ ID NO: 8075784 - DNA, 22 bp, Homo sapiens
aaagagcaagctgagatttgaa

SEQ ID NO: 8075785 - DNA, 22 bp, Homo sapiens
aaagagcaagctgagatttgaa

SEQ ID NO: 8075786 - DNA, 22 bp, Homo sapiens
aaagatcatgctgttttgtgat

SEQ ID NO: 8075787 - DNA, 22 bp, Homo sapiens
aaatagtcctgggaatagtact

SEQ ID NO: 8075788 - DNA, 22 bp, Homo sapiens
aaatagttcagcttgtaaaccc

SEQ ID NO: 8075789 - DNA, 22 bp, Homo sapiens
aaatagttcagccacggtgact

SEQ ID NO: 8075790 - DNA, 22 bp, Homo sapiens
aaacttttcctgctcttgtcct

SEQ ID NO: 8075791 - DNA, 22 bp, Homo sapiens
aaactttcatgtatctctttca

SEQ ID NO: 8075792 - DNA, 22 bp, Homo sapiens
aaacttctctccctactttgtg

SEQ ID NO: 8075793 - DNA, 22 bp, Homo sapiens
aaagaaacctatcagccacatg

SEQ ID NO: 8075794 - DNA, 22 bp, Homo sapiens
aaactttttattctaatgtcta

SEQ ID NO: 8075795 - DNA, 22 bp, Homo sapiens
aaacttttttaggttcataggc

SEQ ID NO: 8075796 - DNA, 22 bp, Homo sapiens
aaagaacaaatgatatatggtt

SEQ ID NO: 8075797 - DNA, 21 bp, Homo sapiens
aaacatctctgcttttgtgtc

SEQ ID NO: 8075798 - DNA, 22 bp, Homo sapiens
aaacactgtgggacatcttact

SEQ ID NO: 8075799 - DNA, 22 bp, Homo sapiens
aaacagataatgctataaatgg

SEQ ID NO: 8075800 - DNA, 22 bp, Homo sapiens
aaactgtaatgcaggatcaaga

SEQ ID NO: 8075801 - DNA, 22 bp, Homo sapiens
aaactgtatgttgagatgacag

SEQ ID NO: 8075802 - DNA, 22 bp, Homo sapiens
aaacatgtaagttcagatcacc

SEQ ID NO: 8075803 - DNA, 22 bp, Homo sapiens
aaacatggccattcagactgtg

SEQ ID NO: 8075804 - DNA, 22 bp, Homo sapiens
aaacattcactctcaattttag

SEQ ID NO: 8075805 - DNA, 22 bp, Homo sapiens
aaacatgttttctgaatatttt

SEQ ID NO: 8075806 - DNA, 22 bp, Homo sapiens
aaaactttcagggatacagaaa

SEQ ID NO: 8075807 - DNA, 22 bp, Homo sapiens
aaaattatggagtatcccaaag

SEQ ID NO: 8075808 - DNA, 22 bp, Homo sapiens
aaaattattcatggcttttgga

SEQ ID NO: 8075809 - DNA, 22 bp, Homo sapiens
aaaaagtttcaactgccaactc

SEQ ID NO: 8075810 - DNA, 22 bp, Homo sapiens
aaaaagcttaaatgagcagttc

SEQ ID NO: 8075811 - DNA, 22 bp, Homo sapiens
aaaaagcttaaatgagcagttc

SEQ ID NO: 8075812 - DNA, 21 bp, Homo sapiens
aaaaagctggggcatgcatgc

SEQ ID NO: 8075813 - DNA, 22 bp, Homo sapiens
aaaaagggatttgtgatccagg

SEQ ID NO: 8075814 - DNA, 22 bp, Homo sapiens
aaaacctgattgaattctattt

SEQ ID NO: 8075815 - DNA, 22 bp, Homo sapiens
aaaacctcagttctgctcttaa

SEQ ID NO: 8075816 - DNA, 22 bp, Homo sapiens
aaaacccttctgcagactctga

SEQ ID NO: 8075817 - DNA, 22 bp, Homo sapiens
aaaactctgcagttagtttcta

SEQ ID NO: 8075818 - DNA, 22 bp, Homo sapiens
aaaacgttatgcattgtttatc

SEQ ID NO: 8075819 - DNA, 22 bp, Homo sapiens
aaaaggcagtgcaagagagggt

SEQ ID NO: 8075820 - DNA, 22 bp, Homo sapiens
aaacaccaagagctagctatta

SEQ ID NO: 8075821 - DNA, 22 bp, Homo sapiens
aaagagctgatagcatctgttt

SEQ ID NO: 8075822 - DNA, 22 bp, Homo sapiens
aaacacaagaggcagggtacag

SEQ ID NO: 8075823 - DNA, 17 bp, Homo sapiens
aaaattctgtaaagagg

SEQ ID NO: 8075824 - DNA, 22 bp, Homo sapiens
aaacagtattatcaatatattt

SEQ ID NO: 8075825 - DNA, 22 bp, Homo sapiens
aaaatatgtataactcttctgc

SEQ ID NO: 8075826 - DNA, 18 bp, Homo sapiens
aaactggcttggcctgtg

SEQ ID NO: 8075827 - DNA, 22 bp, Homo sapiens
aaaggcagagttgttggaggca

SEQ ID NO: 8075828 - DNA, 22 bp, Homo sapiens
aaaggcaggctttcacatctca

SEQ ID NO: 8075829 - DNA, 23 bp, Homo sapiens
aaaggcaggcctaggacatattg

SEQ ID NO: 8075830 - DNA, 22 bp, Homo sapiens
aaaggcaggactgcagcatagg

SEQ ID NO: 8075831 - DNA, 22 bp, Homo sapiens
aaagcctcccaggttatgagta

SEQ ID NO: 8075832 - DNA, 22 bp, Homo sapiens
aagaacataaacagaaggacag

SEQ ID NO: 8075833 - DNA, 23 bp, Homo sapiens
aactgtcttgcaagtgtgatacc

SEQ ID NO: 8075834 - DNA, 22 bp, Homo sapiens
aactgtcttaataacaaaagct

SEQ ID NO: 8075835 - DNA, 22 bp, Homo sapiens
aactgtaaggcttagaacagca

SEQ ID NO: 8075836 - DNA, 22 bp, Homo sapiens
aactgtaagagaataaatgtgt

SEQ ID NO: 8075837 - DNA, 22 bp, Homo sapiens
aactgtaagaaataaaattctg

SEQ ID NO: 8075838 - DNA, 22 bp, Homo sapiens
aactgtaagacaaatgacttct

SEQ ID NO: 8075839 - DNA, 22 bp, Homo sapiens
aactgtaaaggttgagtggtaa

SEQ ID NO: 8075840 - DNA, 22 bp, Homo sapiens
aactgtaatttttacatagtaa

SEQ ID NO: 8075841 - DNA, 22 bp, Homo sapiens
aactgtaagtggttggaagaag

SEQ ID NO: 8075842 - DNA, 22 bp, Homo sapiens
aactgtaatgaattgttcatga

SEQ ID NO: 8075843 - DNA, 19 bp, Homo sapiens
aactgtaattaatacccta

SEQ ID NO: 8075844 - DNA, 22 bp, Homo sapiens
aacacttctgttgataataagc

SEQ ID NO: 8075845 - DNA, 22 bp, Homo sapiens
aaagatttatgaagttcaatta

SEQ ID NO: 8075846 - DNA, 22 bp, Homo sapiens
aaagatttaagaataatttgtg

SEQ ID NO: 8075847 - DNA, 22 bp, Homo sapiens
aaagattatggcattgaaatac

SEQ ID NO: 8075848 - DNA, 22 bp, Homo sapiens
aaagatttcagaagcctgtgcc

SEQ ID NO: 8075849 - DNA, 22 bp, Homo sapiens
aaagatttgagttctgcttata

SEQ ID NO: 8075850 - DNA, 22 bp, Homo sapiens
aaagattatggcattgaaatac

SEQ ID NO: 8075851 - DNA, 22 bp, Homo sapiens
aaagcactcgttagtatttctg

SEQ ID NO: 8075852 - DNA, 22 bp, Homo sapiens
aaagcactgcacatatatttgc

SEQ ID NO: 8075853 - DNA, 22 bp, Homo sapiens
aaagcactttgagactgacagg

SEQ ID NO: 8075854 - DNA, 22 bp, Homo sapiens
aaagcagaactgagagagctgg

SEQ ID NO: 8075855 - DNA, 22 bp, Homo sapiens
aaagcagagatcatggcttgta

SEQ ID NO: 8075856 - DNA, 22 bp, Homo sapiens
aaagcagactgatttgcatcac

SEQ ID NO: 8075857 - DNA, 22 bp, Homo sapiens
aacataaatttgaagtggcaaa

SEQ ID NO: 8075858 - DNA, 22 bp, Homo sapiens
aaagcagaggtgatatgactta

SEQ ID NO: 8075859 - DNA, 22 bp, Homo sapiens
aaagcagaggttgcagtgagct

SEQ ID NO: 8075860 - DNA, 23 bp, Homo sapiens
aacatactgtttaatattcacag

SEQ ID NO: 8075861 - DNA, 22 bp, Homo sapiens
aagattaaaggggagacaagct

SEQ ID NO: 8075862 - DNA, 22 bp, Homo sapiens
aagatcaagtgtactttatgta

SEQ ID NO: 8075863 - DNA, 22 bp, Homo sapiens
aagatatgaggtcacctgctgg

SEQ ID NO: 8075864 - DNA, 22 bp, Homo sapiens
aagattctcactgctcaacttt

SEQ ID NO: 8075865 - DNA, 22 bp, Homo sapiens
aaatgcatggtaaatgattgcc

SEQ ID NO: 8075866 - DNA, 22 bp, Homo sapiens
aaatgcatgtagaataatagag

SEQ ID NO: 8075867 - DNA, 22 bp, Homo sapiens
aagactcttgcctaatacatct

SEQ ID NO: 8075868 - DNA, 22 bp, Homo sapiens
aaagtttacagtgcacatgggt

SEQ ID NO: 8075869 - DNA, 22 bp, Homo sapiens
aaagtttacagtgcacatgggt

SEQ ID NO: 8075870 - DNA, 22 bp, Homo sapiens
aaagtttaggctttgaaaccag

SEQ ID NO: 8075871 - DNA, 22 bp, Homo sapiens
aagactagggtgtgtttaatct

SEQ ID NO: 8075872 - DNA, 22 bp, Homo sapiens
aaagttttagaactaggaagca

SEQ ID NO: 8075873 - DNA, 22 bp, Homo sapiens
aaagttttagaactaggaagca

SEQ ID NO: 8075874 - DNA, 22 bp, Homo sapiens
aaagtttgttatatgataagga

SEQ ID NO: 8075875 - DNA, 22 bp, Homo sapiens
aatgaacaacactgaaggaaga

SEQ ID NO: 8075876 - DNA, 22 bp, Homo sapiens
aacctgttttgattaacaagta

SEQ ID NO: 8075877 - DNA, 22 bp, Homo sapiens
aacctcaggctctctggacaat

SEQ ID NO: 8075878 - DNA, 22 bp, Homo sapiens
aacatgttgctttaataatatt

SEQ ID NO: 8075879 - DNA, 22 bp, Homo sapiens
aatgaattgcagtactgacttg

SEQ ID NO: 8075880 - DNA, 22 bp, Homo sapiens
aacatgtatcgctttttaatat

SEQ ID NO: 8075881 - DNA, 22 bp, Homo sapiens
aacatgtctgggtattcacaag

SEQ ID NO: 8075882 - DNA, 22 bp, Homo sapiens
aacatgtaaccagcattcatct

SEQ ID NO: 8075883 - DNA, 22 bp, Homo sapiens
aatagattcatggttaagagca

SEQ ID NO: 8075884 - DNA, 22 bp, Homo sapiens
aatagactccagggtctatttt

SEQ ID NO: 8075885 - DNA, 22 bp, Homo sapiens
aatagactttgtataatttccc

SEQ ID NO: 8075886 - DNA, 22 bp, Homo sapiens
aatagatactacttagatgtag

SEQ ID NO: 8075887 - DNA, 20 bp, Homo sapiens
aatacatgagcacactttca

SEQ ID NO: 8075888 - DNA, 19 bp, Homo sapiens
aacatctgtaactattttc

SEQ ID NO: 8075889 - DNA, 22 bp, Homo sapiens
aacagctagtggtctagacttt

SEQ ID NO: 8075890 - DNA, 22 bp, Homo sapiens
aacagctagtaccaatccacta

SEQ ID NO: 8075891 - DNA, 22 bp, Homo sapiens
aagtgtcaatatttttgtaggt

SEQ ID NO: 8075892 - DNA, 22 bp, Homo sapiens
aacatatcataggatgtcattg

SEQ ID NO: 8075893 - DNA, 23 bp, Homo sapiens
aaattattgctcttcaattgcct

SEQ ID NO: 8075894 - DNA, 22 bp, Homo sapiens
aaattattttcagaatggagaa

SEQ ID NO: 8075895 - DNA, 22 bp, Homo sapiens
aaattcaattaactttcatgct

SEQ ID NO: 8075896 - DNA, 22 bp, Homo sapiens
aaattattcaaaaagctgtgtt

SEQ ID NO: 8075897 - DNA, 22 bp, Homo sapiens
aaggcagatataaagactagag

SEQ ID NO: 8075898 - DNA, 22 bp, Homo sapiens
aaggcagcaccgcctcctgaaa

SEQ ID NO: 8075899 - DNA, 22 bp, Homo sapiens
aaggcagcaagaattccaggtt

SEQ ID NO: 8075900 - DNA, 22 bp, Homo sapiens
aaggcagccagatcctttgggt

SEQ ID NO: 8075901 - DNA, 22 bp, Homo sapiens
aaatgtcagaggaacatattga

SEQ ID NO: 8075902 - DNA, 22 bp, Homo sapiens
aaatgtccttagagaaaagtca

SEQ ID NO: 8075903 - DNA, 22 bp, Homo sapiens
aaatgcatttcactaatgtttc

SEQ ID NO: 8075904 - DNA, 22 bp, Homo sapiens
aaatgcatttttaattagaccc

SEQ ID NO: 8075905 - DNA, 22 bp, Homo sapiens
aaatgcatttttaattagaccc

SEQ ID NO: 8075906 - DNA, 22 bp, Homo sapiens
aaatgcatgtatgtaatatgct

SEQ ID NO: 8075907 - DNA, 22 bp, Homo sapiens
aacagaaaaggtaggtggcttt

SEQ ID NO: 8075908 - DNA, 22 bp, Homo sapiens
aacagaatagttgatgtacagt

SEQ ID NO: 8075909 - DNA, 22 bp, Homo sapiens
aacagaatagttgatgtacagt

SEQ ID NO: 8075910 - DNA, 22 bp, Homo sapiens
aacagaatatcaaaagattatg

SEQ ID NO: 8075911 - DNA, 22 bp, Homo sapiens
aacacaatcttccagtttgctg

SEQ ID NO: 8075912 - DNA, 22 bp, Homo sapiens
aacacagaagtgccaagagcca

SEQ ID NO: 8075913 - DNA, 22 bp, Homo sapiens
aacacagaagtgccaagagcca

SEQ ID NO: 8075914 - DNA, 22 bp, Homo sapiens
aacacaggaggctatgttttct

SEQ ID NO: 8075915 - DNA, 22 bp, Homo sapiens
aaatttcttgaggctctctagc

SEQ ID NO: 8075916 - DNA, 22 bp, Homo sapiens
aaatttctgttgttttgagcca

SEQ ID NO: 8075917 - DNA, 22 bp, Homo sapiens
aaatttctaagtcaagaagaac

SEQ ID NO: 8075918 - DNA, 22 bp, Homo sapiens
aaatttctggaagtgtcagagt

SEQ ID NO: 8075919 - DNA, 22 bp, Homo sapiens
aagcaatttgacagtacatatc

SEQ ID NO: 8075920 - DNA, 22 bp, Homo sapiens
acagcagagccagtggctctag

SEQ ID NO: 8075921 - DNA, 22 bp, Homo sapiens
acagcaaaagacaagaacttaa

SEQ ID NO: 8075922 - DNA, 22 bp, Homo sapiens
acagcaaaagacaagaacttaa

SEQ ID NO: 8075923 - DNA, 22 bp, Homo sapiens
aagcagctggaagagtaagatg

SEQ ID NO: 8075924 - DNA, 21 bp, Homo sapiens
aagcagcttaataaagtatgt

SEQ ID NO: 8075925 - DNA, 22 bp, Homo sapiens
acacatgataagaaagtttaaa

SEQ ID NO: 8075926 - DNA, 22 bp, Homo sapiens
aagagcaggacagaatcagaac

SEQ ID NO: 8075927 - DNA, 22 bp, Homo sapiens
acacatatatacatatttgtgc

SEQ ID NO: 8075928 - DNA, 22 bp, Homo sapiens
acacatgaaataatattatgca

SEQ ID NO: 8075929 - DNA, 22 bp, Homo sapiens
aattttaagcatatgactggtt

SEQ ID NO: 8075930 - DNA, 22 bp, Homo sapiens
aattttaatcagtggtgctgag

SEQ ID NO: 8075931 - DNA, 22 bp, Homo sapiens
aattttacaaaatacctccgat

SEQ ID NO: 8075932 - DNA, 22 bp, Homo sapiens
aagactttcaaacctatgtttg

SEQ ID NO: 8075933 - DNA, 20 bp, Homo sapiens
acacaaagcaatggagtaca

SEQ ID NO: 8075934 - DNA, 22 bp, Homo sapiens
acacaaagctattgagtgtcat

SEQ ID NO: 8075935 - DNA, 22 bp, Homo sapiens
acacaaagttggatgacaaaat

SEQ ID NO: 8075936 - DNA, 21 bp, Homo sapiens
acacaaacctcctcagcctgg

SEQ ID NO: 8075937 - DNA, 22 bp, Homo sapiens
aagagcaagtgggtagtgaagc

SEQ ID NO: 8075938 - DNA, 22 bp, Homo sapiens
aagagcagattcctagtggagc

SEQ ID NO: 8075939 - DNA, 22 bp, Homo sapiens
acacaaagttggatgacaaaat

SEQ ID NO: 8075940 - DNA, 22 bp, Homo sapiens
aagagacagagccatgtttcta

SEQ ID NO: 8075941 - DNA, 22 bp, Homo sapiens
acacaaaatcaaagtcctaggc

SEQ ID NO: 8075942 - DNA, 22 bp, Homo sapiens
aagaacagattcagcctgaact

SEQ ID NO: 8075943 - DNA, 22 bp, Homo sapiens
aatttcactggaaaagataatt

SEQ ID NO: 8075944 - DNA, 22 bp, Homo sapiens
aagaaattaaggaatgcaacga

SEQ ID NO: 8075945 - DNA, 22 bp, Homo sapiens
aagaacaactgctttaaaagca

SEQ ID NO: 8075946 - DNA, 22 bp, Homo sapiens
aattcctttggatcttctggag

SEQ ID NO: 8075947 - DNA, 22 bp, Homo sapiens
aattctcaggtaaaagttaagt

SEQ ID NO: 8075948 - DNA, 22 bp, Homo sapiens
aattctcaggaatttcatctgt

SEQ ID NO: 8075949 - DNA, 20 bp, Homo sapiens
aagaaacttgaaagtacaag

SEQ ID NO: 8075950 - DNA, 22 bp, Homo sapiens
aactttctgtctgagctgcaga

SEQ ID NO: 8075951 - DNA, 22 bp, Homo sapiens
aactggtagctgattaagtata

SEQ ID NO: 8075952 - DNA, 22 bp, Homo sapiens
aatggctttgacattttcaaat

SEQ ID NO: 8075953 - DNA, 22 bp, Homo sapiens
aagaaactgaaagtggcttcat

SEQ ID NO: 8075954 - DNA, 22 bp, Homo sapiens
aagaaaagaaacctgaggcttt

SEQ ID NO: 8075955 - DNA, 22 bp, Homo sapiens
aagaaaaggtaaccgcttatct

SEQ ID NO: 8075956 - DNA, 22 bp, Homo sapiens
aagaaaacatgatctaatttaa

SEQ ID NO: 8075957 - DNA, 22 bp, Homo sapiens
aagaaaacaatgacttgccagc

SEQ ID NO: 8075958 - DNA, 22 bp, Homo sapiens
aggctggcagccacctcagcag

SEQ ID NO: 8075959 - DNA, 22 bp, Homo sapiens
aggctggcaaggcagatgtgtg

SEQ ID NO: 8075960 - DNA, 22 bp, Homo sapiens
acatttttattcatcaaagcag

SEQ ID NO: 8075961 - DNA, 22 bp, Homo sapiens
accaaaaagatatgttgaagcc

SEQ ID NO: 8075962 - DNA, 22 bp, Homo sapiens
agggaagaggcaaggtttatgg

SEQ ID NO: 8075963 - DNA, 20 bp, Homo sapiens
agggcagcttgaggagccgg

SEQ ID NO: 8075964 - DNA, 22 bp, Homo sapiens
agggcagtgggaaagcctgctc

SEQ ID NO: 8075965 - DNA, 17 bp, Homo sapiens
accattctttttactgc

SEQ ID NO: 8075966 - DNA, 22 bp, Homo sapiens
aggcagggaccagttgttttct

SEQ ID NO: 8075967 - DNA, 22 bp, Homo sapiens
aggcagggctgggattagactc

SEQ ID NO: 8075968 - DNA, 22 bp, Homo sapiens
aggcagggctcatttcttaggc

SEQ ID NO: 8075969 - DNA, 22 bp, Homo sapiens
aggcctgcctggagcctggctg

SEQ ID NO: 8075970 - DNA, 22 bp, Homo sapiens
acatggcaaaagggactttaca

SEQ ID NO: 8075971 - DNA, 22 bp, Homo sapiens
acatttaacctttgaggaactg

SEQ ID NO: 8075972 - DNA, 22 bp, Homo sapiens
acatttaagttaaaacctcagt

SEQ ID NO: 8075973 - DNA, 22 bp, Homo sapiens
acatttaaccaaactgtttaat

SEQ ID NO: 8075974 - DNA, 19 bp, Homo sapiens
acatttaaattcagatctc

SEQ ID NO: 8075975 - DNA, 22 bp, Homo sapiens
acatttacagtgctagacaatc

SEQ ID NO: 8075976 - DNA, 22 bp, Homo sapiens
acaggtggcactgctgttactc

SEQ ID NO: 8075977 - DNA, 22 bp, Homo sapiens
acagggcacctgaggtaggaag

SEQ ID NO: 8075978 - DNA, 22 bp, Homo sapiens
acagggcaacctctgggagact

SEQ ID NO: 8075979 - DNA, 22 bp, Homo sapiens
acagggagtgcaattcatattg

SEQ ID NO: 8075980 - DNA, 22 bp, Homo sapiens
acaggtggcttccattttctaa

SEQ ID NO: 8075981 - DNA, 21 bp, Homo sapiens
acagtaaattccctgcaaaga

SEQ ID NO: 8075982 - DNA, 21 bp, Homo sapiens
acagtaaattccctgcaaaga

SEQ ID NO: 8075983 - DNA, 22 bp, Homo sapiens
acagtacaagcaatgcattttt

SEQ ID NO: 8075984 - DNA, 22 bp, Homo sapiens
acataaaggtgactaacatctt

SEQ ID NO: 8075985 - DNA, 22 bp, Homo sapiens
acagttttttcaacattggaat

SEQ ID NO: 8075986 - DNA, 21 bp, Homo sapiens
acagttttaaggagcacatgg

SEQ ID NO: 8075987 - DNA, 22 bp, Homo sapiens
aggcagcatgggcccagagtcc

SEQ ID NO: 8075988 - DNA, 22 bp, Homo sapiens
aggcagcatgggccccagctcc

SEQ ID NO: 8075989 - DNA, 22 bp, Homo sapiens
aggcagcattcaggggtgatga

SEQ ID NO: 8075990 - DNA, 16 bp, Homo sapiens
aggcagcatgttagtg

SEQ ID NO: 8075991 - DNA, 21 bp, Homo sapiens
aggcagcatctgatttatatg

SEQ ID NO: 8075992 - DNA, 22 bp, Homo sapiens
aggcagcatgctctgcttctac

SEQ ID NO: 8075993 - DNA, 22 bp, Homo sapiens
aggcagcaattgaaatcattgt

SEQ ID NO: 8075994 - DNA, 19 bp, Homo sapiens
aggcagcacccagtccttg

SEQ ID NO: 8075995 - DNA, 22 bp, Homo sapiens
aggcagcagtgataagatagga

SEQ ID NO: 8075996 - DNA, 22 bp, Homo sapiens
aggcagcatccagaggagaatg

SEQ ID NO: 8075997 - DNA, 22 bp, Homo sapiens
acagtgatgagggaattttgtg

SEQ ID NO: 8075998 - DNA, 22 bp, Homo sapiens
acagttcaagacatcagtatga

SEQ ID NO: 8075999 - DNA, 22 bp, Homo sapiens
acagttcaagcaagtttctgtt

SEQ ID NO: 8076000 - DNA, 22 bp, Homo sapiens
acagttattttcccagcattta

SEQ ID NO: 8076001 - DNA, 22 bp, Homo sapiens
acagttcagacaagtgttccat

SEQ ID NO: 8076002 - DNA, 22 bp, Homo sapiens
acagttcactttttatatcaaa

SEQ ID NO: 8076003 - DNA, 22 bp, Homo sapiens
acagttcaagtcttagacaaca

SEQ ID NO: 8076004 - DNA, 23 bp, Homo sapiens
acagttatagctgtgaataacat

SEQ ID NO: 8076005 - DNA, 22 bp, Homo sapiens
acagttatatacatgtagctgt

SEQ ID NO: 8076006 - DNA, 22 bp, Homo sapiens
acagttattctttatgcaacca

SEQ ID NO: 8076007 - DNA, 22 bp, Homo sapiens
acagttatctttgaaatagaga

SEQ ID NO: 8076008 - DNA, 22 bp, Homo sapiens
acagttacattccagcaacatc

SEQ ID NO: 8076009 - DNA, 19 bp, Homo sapiens
aggaatggaattaattctg

SEQ ID NO: 8076010 - DNA, 22 bp, Homo sapiens
agctgctcacagggattcatgc

SEQ ID NO: 8076011 - DNA, 22 bp, Homo sapiens
agctgcaggcccatgctcagtc

SEQ ID NO: 8076012 - DNA, 22 bp, Homo sapiens
acagctgccaagacagagcagg

SEQ ID NO: 8076013 - DNA, 22 bp, Homo sapiens
acagctgcacttgaagcaggtt

SEQ ID NO: 8076014 - DNA, 22 bp, Homo sapiens
acagctctgggtgcaggaggtg

SEQ ID NO: 8076015 - DNA, 22 bp, Homo sapiens
atatgaaaatgttttagctgta

SEQ ID NO: 8076016 - DNA, 22 bp, Homo sapiens
agaaaataaattgatggtggaa

SEQ ID NO: 8076017 - DNA, 22 bp, Homo sapiens
atatcttttagagcaagcttgt

SEQ ID NO: 8076018 - DNA, 22 bp, Homo sapiens
agaaaatttaaagagacacaca

SEQ ID NO: 8076019 - DNA, 22 bp, Homo sapiens
atatcctttactgtgtcacaga

SEQ ID NO: 8076020 - DNA, 22 bp, Homo sapiens
atatcctttgtgtaggcaattt

SEQ ID NO: 8076021 - DNA, 22 bp, Homo sapiens
actttgtataagacaataaaga

SEQ ID NO: 8076022 - DNA, 22 bp, Homo sapiens
atatataacctggataaggctt

SEQ ID NO: 8076023 - DNA, 22 bp, Homo sapiens
atatattcttaaagaatctgac

SEQ ID NO: 8076024 - DNA, 22 bp, Homo sapiens
atcactgagcttcagtgctggc

SEQ ID NO: 8076025 - DNA, 22 bp, Homo sapiens
atcatttatgccccaattagat

SEQ ID NO: 8076026 - DNA, 22 bp, Homo sapiens
atcatttacaatgaaagcctga

SEQ ID NO: 8076027 - DNA, 22 bp, Homo sapiens
atcatttagtggggcattggaa

SEQ ID NO: 8076028 - DNA, 22 bp, Homo sapiens
atcatttacaaactcagcattg

SEQ ID NO: 8076029 - DNA, 22 bp, Homo sapiens
atcatttaaaacaagtctctat

SEQ ID NO: 8076030 - DNA, 22 bp, Homo sapiens
agtttacacttttgattcttat

SEQ ID NO: 8076031 - DNA, 22 bp, Homo sapiens
actgtaaaatacataagtattg

SEQ ID NO: 8076032 - DNA, 22 bp, Homo sapiens
actgtaaaagaaggtctttgca

SEQ ID NO: 8076033 - DNA, 22 bp, Homo sapiens
actgtaaaagaaggtctttgca

SEQ ID NO: 8076034 - DNA, 22 bp, Homo sapiens
actgtaaaatacataagtattg

SEQ ID NO: 8076035 - DNA, 22 bp, Homo sapiens
actgtaaaatgagatatgtata

SEQ ID NO: 8076036 - DNA, 22 bp, Homo sapiens
actgtaaagagaactgtgggct

SEQ ID NO: 8076037 - DNA, 22 bp, Homo sapiens
actgtaaagaagtaagtatggg

SEQ ID NO: 8076038 - DNA, 22 bp, Homo sapiens
actgtaaaacaggtttcatcat

SEQ ID NO: 8076039 - DNA, 22 bp, Homo sapiens
actgtaaaacaggtttcatcat

SEQ ID NO: 8076040 - DNA, 22 bp, Homo sapiens
actgtaaaactgctttggaaac

SEQ ID NO: 8076041 - DNA, 22 bp, Homo sapiens
actgtaaaactgctttggaaac

SEQ ID NO: 8076042 - DNA, 22 bp, Homo sapiens
actggtttttctcatgaaaatg

SEQ ID NO: 8076043 - DNA, 22 bp, Homo sapiens
agtttatagcccagattcatgg

SEQ ID NO: 8076044 - DNA, 22 bp, Homo sapiens
agtttacccactgttgaaatta

SEQ ID NO: 8076045 - DNA, 22 bp, Homo sapiens
agtttacttgaatgatgaattc

SEQ ID NO: 8076046 - DNA, 22 bp, Homo sapiens
agtttacatgacgtgtatttca

SEQ ID NO: 8076047 - DNA, 22 bp, Homo sapiens
actgtctttattagaatcttat

SEQ ID NO: 8076048 - DNA, 22 bp, Homo sapiens
actgtcttcaaatgaatatatt

SEQ ID NO: 8076049 - DNA, 20 bp, Homo sapiens
actgtgaatgctgaattagc

SEQ ID NO: 8076050 - DNA, 22 bp, Homo sapiens
actgtaaattttggttgcaggt

SEQ ID NO: 8076051 - DNA, 22 bp, Homo sapiens
actgtaaattacataagaacag

SEQ ID NO: 8076052 - DNA, 22 bp, Homo sapiens
actgtaaattacataagaacag

SEQ ID NO: 8076053 - DNA, 22 bp, Homo sapiens
actgtaaattacataagaacag

SEQ ID NO: 8076054 - DNA, 22 bp, Homo sapiens
actgtaaaggtgattagaagtt

SEQ ID NO: 8076055 - DNA, 22 bp, Homo sapiens
actgtaaaggtttgtagcccag

SEQ ID NO: 8076056 - DNA, 22 bp, Homo sapiens
actgtaaagttacgatcaagtt

SEQ ID NO: 8076057 - DNA, 22 bp, Homo sapiens
actgtaaaggtgattagaagtt

SEQ ID NO: 8076058 - DNA, 22 bp, Homo sapiens
actgtaaaggtttgtagcccag

SEQ ID NO: 8076059 - DNA, 22 bp, Homo sapiens
actgtaaagaggtgtatcttta

SEQ ID NO: 8076060 - DNA, 22 bp, Homo sapiens
actgtaaagaggtgtatcttta

SEQ ID NO: 8076061 - DNA, 22 bp, Homo sapiens
actgtaaagcttttctcatgcg

SEQ ID NO: 8076062 - DNA, 22 bp, Homo sapiens
actgtaaaggtgattagaagtt

SEQ ID NO: 8076063 - DNA, 22 bp, Homo sapiens
actgtaaagcttttctcatgcg

SEQ ID NO: 8076064 - DNA, 22 bp, Homo sapiens
agtttcccaagcagatatcatc

SEQ ID NO: 8076065 - DNA, 22 bp, Homo sapiens
agtttcccttgcaaacccattt

SEQ ID NO: 8076066 - DNA, 19 bp, Homo sapiens
agtttccctggagacatca

SEQ ID NO: 8076067 - DNA, 22 bp, Homo sapiens
agtttcctcatctgtaaaatga

SEQ ID NO: 8076068 - DNA, 22 bp, Homo sapiens
agtttcctcatgttaatatgga

SEQ ID NO: 8076069 - DNA, 22 bp, Homo sapiens
actgttaaagtaattaattgtc

SEQ ID NO: 8076070 - DNA, 22 bp, Homo sapiens
actgtgtttcacctgagtatgg

SEQ ID NO: 8076071 - DNA, 22 bp, Homo sapiens
acttagaattaaatatttttgg

SEQ ID NO: 8076072 - DNA, 22 bp, Homo sapiens
acttggaaccgaggacctttat

SEQ ID NO: 8076073 - DNA, 22 bp, Homo sapiens
acttcttttcaaatcatgcaaa

SEQ ID NO: 8076074 - DNA, 22 bp, Homo sapiens
acttcagtgtggtataaaacgt

SEQ ID NO: 8076075 - DNA, 20 bp, Homo sapiens
actggacactgaggtgagct

SEQ ID NO: 8076076 - DNA, 22 bp, Homo sapiens
actgctgcaggtccagcccctt

SEQ ID NO: 8076077 - DNA, 21 bp, Homo sapiens
actgcacactatgtgaattga

SEQ ID NO: 8076078 - DNA, 22 bp, Homo sapiens
actgcacagaagaaactatcaa

SEQ ID NO: 8076079 - DNA, 22 bp, Homo sapiens
actgcacagaaccttagaatat

SEQ ID NO: 8076080 - DNA, 22 bp, Homo sapiens
actgcacaaggcctggacacac

SEQ ID NO: 8076081 - DNA, 22 bp, Homo sapiens
actgcaaaaatgggtgcattca

SEQ ID NO: 8076082 - DNA, 22 bp, Homo sapiens
actgcaaagccagatattatca

SEQ ID NO: 8076083 - DNA, 22 bp, Homo sapiens
actgatttcagggatgagaaga

SEQ ID NO: 8076084 - DNA, 23 bp, Homo sapiens
actgattaacatgtgtgatattc

SEQ ID NO: 8076085 - DNA, 22 bp, Homo sapiens
actgattaaaaacagacattta

SEQ ID NO: 8076086 - DNA, 22 bp, Homo sapiens
agtctgggaggcttataaacag

SEQ ID NO: 8076087 - DNA, 22 bp, Homo sapiens
agtctcttggcattctgaaaca

SEQ ID NO: 8076088 - DNA, 22 bp, Homo sapiens
agtctcttgcacattgtattaa

SEQ ID NO: 8076089 - DNA, 22 bp, Homo sapiens
agtctcttcgagccgcagggct

SEQ ID NO: 8076090 - DNA, 22 bp, Homo sapiens
agtctcttccttcaaggctggt

SEQ ID NO: 8076091 - DNA, 19 bp, Homo sapiens
agtctcttcggaggaggtt

SEQ ID NO: 8076092 - DNA, 22 bp, Homo sapiens
actgaaaatgaattagaaacag

SEQ ID NO: 8076093 - DNA, 22 bp, Homo sapiens
agtctcttaaagacagtgttga

SEQ ID NO: 8076094 - DNA, 23 bp, Homo sapiens
acctggctgctcaacctgcaggg

SEQ ID NO: 8076095 - DNA, 22 bp, Homo sapiens
aggtagcagcctagcagggact

SEQ ID NO: 8076096 - DNA, 22 bp, Homo sapiens
acctgttttcagaaaatgcaga

SEQ ID NO: 8076097 - DNA, 22 bp, Homo sapiens
accttaaaggccgaagtaaaga

SEQ ID NO: 8076098 - DNA, 19 bp, Homo sapiens
accttcagagtggcacaaa

SEQ ID NO: 8076099 - DNA, 22 bp, Homo sapiens
accttcaggtgagcacacagat

SEQ ID NO: 8076100 - DNA, 22 bp, Homo sapiens
acgttgttctgcaatacccaag

SEQ ID NO: 8076101 - DNA, 22 bp, Homo sapiens
acgttttattcccatgcagcat

SEQ ID NO: 8076102 - DNA, 22 bp, Homo sapiens
actaaagctcacagagttgaac

SEQ ID NO: 8076103 - DNA, 22 bp, Homo sapiens
actaaagatgtctaaatatatt

SEQ ID NO: 8076104 - DNA, 22 bp, Homo sapiens
actaaagaagccaaagttttct

SEQ ID NO: 8076105 - DNA, 22 bp, Homo sapiens
actatactgtctcttatagata

SEQ ID NO: 8076106 - DNA, 22 bp, Homo sapiens
actagttagaaatgcttttcat

SEQ ID NO: 8076107 - DNA, 22 bp, Homo sapiens
actaaatacacacatttgttca

SEQ ID NO: 8076108 - DNA, 22 bp, Homo sapiens
actatagctcgggttataatgt

SEQ ID NO: 8076109 - DNA, 22 bp, Homo sapiens
actatatacacattatcttgtt

SEQ ID NO: 8076110 - DNA, 22 bp, Homo sapiens
actattagcatatcatgaatgg

SEQ ID NO: 8076111 - DNA, 22 bp, Homo sapiens
actcacaggactctgcatatag

SEQ ID NO: 8076112 - DNA, 22 bp, Homo sapiens
actcacagcatgagcttggcag

SEQ ID NO: 8076113 - DNA, 22 bp, Homo sapiens
actcacagaataggcatgatgg

SEQ ID NO: 8076114 - DNA, 22 bp, Homo sapiens
actcacagactgcaggtttatt

SEQ ID NO: 8076115 - DNA, 18 bp, Homo sapiens
actcacagcagaagaagg

SEQ ID NO: 8076116 - DNA, 22 bp, Homo sapiens
actcacagcagactatgaggga

SEQ ID NO: 8076117 - DNA, 22 bp, Homo sapiens
atggagtttggggtcaaatact

SEQ ID NO: 8076118 - DNA, 22 bp, Homo sapiens
atggaaaaggctgatttcatta

SEQ ID NO: 8076119 - DNA, 22 bp, Homo sapiens
atggaaaagggtctttcatttc

SEQ ID NO: 8076120 - DNA, 19 bp, Homo sapiens
atggaaaatgccagactga

SEQ ID NO: 8076121 - DNA, 19 bp, Homo sapiens
atggaaaattgtactcaat

SEQ ID NO: 8076122 - DNA, 22 bp, Homo sapiens
atgcaggggcagcagagcctgg

SEQ ID NO: 8076123 - DNA, 22 bp, Homo sapiens
atgcagggcagagtacgttagc

SEQ ID NO: 8076124 - DNA, 22 bp, Homo sapiens
atgcagggattaaatgactgcc

SEQ ID NO: 8076125 - DNA, 22 bp, Homo sapiens
atgcaggggccgcctggccagg

SEQ ID NO: 8076126 - DNA, 22 bp, Homo sapiens
atgcaggggctgtgttttgggt

SEQ ID NO: 8076127 - DNA, 22 bp, Homo sapiens
atgcagggttatttcaaaaata

SEQ ID NO: 8076128 - DNA, 22 bp, Homo sapiens
atgcagggtctccgtgtgacga

SEQ ID NO: 8076129 - DNA, 23 bp, Homo sapiens
atgcagggttacagggctgactt

SEQ ID NO: 8076130 - DNA, 22 bp, Homo sapiens
atgcagggttctgggctagaga

SEQ ID NO: 8076131 - DNA, 20 bp, Homo sapiens
atgtaaaattataaggctga

SEQ ID NO: 8076132 - DNA, 22 bp, Homo sapiens
atgtaaactttaccagctctga

SEQ ID NO: 8076133 - DNA, 22 bp, Homo sapiens
atgtcccaagatacagctagag

SEQ ID NO: 8076134 - DNA, 21 bp, Homo sapiens
atgtcaaatgctttattttat

SEQ ID NO: 8076135 - DNA, 22 bp, Homo sapiens
agacacagtgagtttctttccc

SEQ ID NO: 8076136 - DNA, 23 bp, Homo sapiens
agacacataggagcagctattgg

SEQ ID NO: 8076137 - DNA, 22 bp, Homo sapiens
atgcagggaaaagagatattat

SEQ ID NO: 8076138 - DNA, 22 bp, Homo sapiens
atgcagggacctttgctttggt

SEQ ID NO: 8076139 - DNA, 22 bp, Homo sapiens
atgcagggaggtaagaggtgcc

SEQ ID NO: 8076140 - DNA, 22 bp, Homo sapiens
agacagtaataaaataggtaag

SEQ ID NO: 8076141 - DNA, 22 bp, Homo sapiens
agacagtatgatatatgaatac

SEQ ID NO: 8076142 - DNA, 22 bp, Homo sapiens
agacacagcaataactactgtt

SEQ ID NO: 8076143 - DNA, 21 bp, Homo sapiens
agaattaaattggatttgtgt

SEQ ID NO: 8076144 - DNA, 22 bp, Homo sapiens
agaagattatgaattagagcag

SEQ ID NO: 8076145 - DNA, 22 bp, Homo sapiens
atcttatgttgtattcaaaatc

SEQ ID NO: 8076146 - DNA, 23 bp, Homo sapiens
agaagcaatgctttttttcctct

SEQ ID NO: 8076147 - DNA, 22 bp, Homo sapiens
agaagcaaggtctgtcagtata

SEQ ID NO: 8076148 - DNA, 20 bp, Homo sapiens
agaaggcattcctcattctt

SEQ ID NO: 8076149 - DNA, 22 bp, Homo sapiens
agaagtttgttatgtaaacaaa

SEQ ID NO: 8076150 - DNA, 22 bp, Homo sapiens
agaatataaagataattctgtt

SEQ ID NO: 8076151 - DNA, 22 bp, Homo sapiens
atgttaaatggtttattattaa

SEQ ID NO: 8076152 - DNA, 22 bp, Homo sapiens
atgttaaatagccatttgtttg

SEQ ID NO: 8076153 - DNA, 20 bp, Homo sapiens
atgttaaatagcatttagag

SEQ ID NO: 8076154 - DNA, 22 bp, Homo sapiens
attaaagttgaaattgaactga

SEQ ID NO: 8076155 - DNA, 22 bp, Homo sapiens
attagcaagttgttatcctttg

SEQ ID NO: 8076156 - DNA, 22 bp, Homo sapiens
attagcaaggttcatgagaaga

SEQ ID NO: 8076157 - DNA, 22 bp, Homo sapiens
attagcaactgtcttgaaaaca

SEQ ID NO: 8076158 - DNA, 22 bp, Homo sapiens
attagcaaattctaattcacta

SEQ ID NO: 8076159 - DNA, 22 bp, Homo sapiens
attagattgtaaatgttttcac

SEQ ID NO: 8076160 - DNA, 22 bp, Homo sapiens
attagcaaaacaacttttctat

SEQ ID NO: 8076161 - DNA, 22 bp, Homo sapiens
attagcaagttttccagctaat

SEQ ID NO: 8076162 - DNA, 22 bp, Homo sapiens
attagcaatcacgcagtcattt

SEQ ID NO: 8076163 - DNA, 22 bp, Homo sapiens
attagcaatctgaaaattgcgg

SEQ ID NO: 8076164 - DNA, 22 bp, Homo sapiens
attagcacataagaggtatagg

SEQ ID NO: 8076165 - DNA, 22 bp, Homo sapiens
attagcatattaaatagtcatt

SEQ ID NO: 8076166 - DNA, 22 bp, Homo sapiens
attaaacaatgtaaagttcttg

SEQ ID NO: 8076167 - DNA, 22 bp, Homo sapiens
attaaacaatgtaaagttcttg

SEQ ID NO: 8076168 - DNA, 22 bp, Homo sapiens
atgttttaccctttgcacaaac

SEQ ID NO: 8076169 - DNA, 22 bp, Homo sapiens
attaaacaatgtaaagttcttg

SEQ ID NO: 8076170 - DNA, 22 bp, Homo sapiens
attaaagtgaagttctcagatg

SEQ ID NO: 8076171 - DNA, 22 bp, Homo sapiens
attaaagtgaagttctcagatg

SEQ ID NO: 8076172 - DNA, 22 bp, Homo sapiens
attaaagaaacccagcatgtga

SEQ ID NO: 8076173 - DNA, 22 bp, Homo sapiens
atgtttgttgatcatttatgaa

SEQ ID NO: 8076174 - DNA, 22 bp, Homo sapiens
attctggacaatgagaaactgg

SEQ ID NO: 8076175 - DNA, 22 bp, Homo sapiens
attcagcattggcaccatggat

SEQ ID NO: 8076176 - DNA, 22 bp, Homo sapiens
attcagcattcattatgcgcca

SEQ ID NO: 8076177 - DNA, 22 bp, Homo sapiens
attcagcaaacatttattatct

SEQ ID NO: 8076178 - DNA, 22 bp, Homo sapiens
attcagcacaatttggccaata

SEQ ID NO: 8076179 - DNA, 22 bp, Homo sapiens
attcagcaagctatgggacagg

SEQ ID NO: 8076180 - DNA, 22 bp, Homo sapiens
attatacaaggctggtgcctaa

SEQ ID NO: 8076181 - DNA, 22 bp, Homo sapiens
attatacattttgtgtagagat

SEQ ID NO: 8076182 - DNA, 22 bp, Homo sapiens
attcaaagcccagtaaacattg

SEQ ID NO: 8076183 - DNA, 22 bp, Homo sapiens
attcacactttacttctttcca

SEQ ID NO: 8076184 - DNA, 22 bp, Homo sapiens
agatttcagatgctcggcagtt

SEQ ID NO: 8076185 - DNA, 22 bp, Homo sapiens
agatttcaggttggggcagaag

SEQ ID NO: 8076186 - DNA, 22 bp, Homo sapiens
agcaaacagtgtgctaagaaat

SEQ ID NO: 8076187 - DNA, 20 bp, Homo sapiens
agcaaacaggctccaccaga

SEQ ID NO: 8076188 - DNA, 22 bp, Homo sapiens
agcaaacagtgtgctaagaaat

SEQ ID NO: 8076189 - DNA, 20 bp, Homo sapiens
agcaaaatgcaagattttca

SEQ ID NO: 8076190 - DNA, 22 bp, Homo sapiens
agcaaacagatgtctcctttag

SEQ ID NO: 8076191 - DNA, 22 bp, Homo sapiens
agcaaacacaagaggtaatttc

SEQ ID NO: 8076192 - DNA, 22 bp, Homo sapiens
agcaaaataaggtaatttattg

SEQ ID NO: 8076193 - DNA, 22 bp, Homo sapiens
agatgaaagatttttatagaga

SEQ ID NO: 8076194 - DNA, 18 bp, Homo sapiens
agatgaaagcaaatgaca

SEQ ID NO: 8076195 - DNA, 22 bp, Homo sapiens
atttagcaagagtacaaaataa

SEQ ID NO: 8076196 - DNA, 17 bp, Homo sapiens
atttagcaagtagacag

SEQ ID NO: 8076197 - DNA, 22 bp, Homo sapiens
atttagacaacaagccttctcc

SEQ ID NO: 8076198 - DNA, 22 bp, Homo sapiens
atttagacatgtatctgatagc

SEQ ID NO: 8076199 - DNA, 22 bp, Homo sapiens
atttagacaccagcttgtaagg

SEQ ID NO: 8076200 - DNA, 22 bp, Homo sapiens
atttattgaacactgactatgt

SEQ ID NO: 8076201 - DNA, 22 bp, Homo sapiens
atttagtgtatcaatgtgatat

SEQ ID NO: 8076202 - DNA, 22 bp, Homo sapiens
atttagtgtgcctgggaatctg

SEQ ID NO: 8076203 - DNA, 22 bp, Homo sapiens
atttagtgtattctaatatgtg

SEQ ID NO: 8076204 - DNA, 22 bp, Homo sapiens
atttagtgtgtattgctattat

SEQ ID NO: 8076205 - DNA, 22 bp, Homo sapiens
atttagtgaccagcactagaaa

SEQ ID NO: 8076206 - DNA, 22 bp, Homo sapiens
atttagtgccttagccctcagg

SEQ ID NO: 8076207 - DNA, 22 bp, Homo sapiens
atttagtgatgcagtggattat

SEQ ID NO: 8076208 - DNA, 22 bp, Homo sapiens
atttagtgacctgaactgaaac

SEQ ID NO: 8076209 - DNA, 22 bp, Homo sapiens
atttagtggctgtaatcacctt

SEQ ID NO: 8076210 - DNA, 22 bp, Homo sapiens
atttattatgggatttggctca

SEQ ID NO: 8076211 - DNA, 22 bp, Homo sapiens
atttagtaagtacttgttgaat

SEQ ID NO: 8076212 - DNA, 22 bp, Homo sapiens
atttagtgaaacccataaagca

SEQ ID NO: 8076213 - DNA, 18 bp, Homo sapiens
atttaatgaactgaaagc

SEQ ID NO: 8076214 - DNA, 23 bp, Homo sapiens
atttaatgctgagttgaatgtta

SEQ ID NO: 8076215 - DNA, 22 bp, Homo sapiens
atttaatgggtagacattgtta

SEQ ID NO: 8076216 - DNA, 22 bp, Homo sapiens
atttaatgggtagacattgtta

SEQ ID NO: 8076217 - DNA, 22 bp, Homo sapiens
attcttcatttactgttacttg

SEQ ID NO: 8076218 - DNA, 22 bp, Homo sapiens
attcttcattgttgattcatgt

SEQ ID NO: 8076219 - DNA, 22 bp, Homo sapiens
agcagacaccaggagtaaagaa

SEQ ID NO: 8076220 - DNA, 22 bp, Homo sapiens
agcagcaagcagtgcacgggtt

SEQ ID NO: 8076221 - DNA, 22 bp, Homo sapiens
caacttcagggaaacatgaagc

SEQ ID NO: 8076222 - DNA, 22 bp, Homo sapiens
caatgaaagcaactgcctataa

SEQ ID NO: 8076223 - DNA, 22 bp, Homo sapiens
caaggcaggcagttcacttgag

SEQ ID NO: 8076224 - DNA, 22 bp, Homo sapiens
caaggcagttccccagagggct

SEQ ID NO: 8076225 - DNA, 22 bp, Homo sapiens
attttctgtaactatttctata

SEQ ID NO: 8076226 - DNA, 22 bp, Homo sapiens
agcacaaaaacattcccagagt

SEQ ID NO: 8076227 - DNA, 22 bp, Homo sapiens
agcaaacattcagcagattggc

SEQ ID NO: 8076228 - DNA, 22 bp, Homo sapiens
attttctatgttgtaattgtta

SEQ ID NO: 8076229 - DNA, 22 bp, Homo sapiens
attttctatgttgtaattgtta

SEQ ID NO: 8076230 - DNA, 22 bp, Homo sapiens
attttctctcaaaccttaaaat

SEQ ID NO: 8076231 - DNA, 22 bp, Homo sapiens
caaatgatccttgcaagctgtg

SEQ ID NO: 8076232 - DNA, 22 bp, Homo sapiens
caaatgatactgtttttagtct

SEQ ID NO: 8076233 - DNA, 22 bp, Homo sapiens
caatgataatggctgtatttat

SEQ ID NO: 8076234 - DNA, 22 bp, Homo sapiens
cacagggcctggggcagctgct

SEQ ID NO: 8076235 - DNA, 22 bp, Homo sapiens
caccagggctctgagctctgaa

SEQ ID NO: 8076236 - DNA, 22 bp, Homo sapiens
caccagggacaatgctaggggt

SEQ ID NO: 8076237 - DNA, 22 bp, Homo sapiens
agcataacacccgacactcagg

SEQ ID NO: 8076238 - DNA, 22 bp, Homo sapiens
agcataaactcagggacacaca

SEQ ID NO: 8076239 - DNA, 22 bp, Homo sapiens
cacagtatttgtttttctgagt

SEQ ID NO: 8076240 - DNA, 22 bp, Homo sapiens
cagaggctaagatgagtgggtg

SEQ ID NO: 8076241 - DNA, 22 bp, Homo sapiens
agcctttaacacttcacattga

SEQ ID NO: 8076242 - DNA, 22 bp, Homo sapiens
cactgaaatattaatatcttat

SEQ ID NO: 8076243 - DNA, 22 bp, Homo sapiens
cactgaaatcgaaaaatgtagg

SEQ ID NO: 8076244 - DNA, 22 bp, Homo sapiens
cactgaaaggcaatgctgacag

SEQ ID NO: 8076245 - DNA, 22 bp, Homo sapiens
agccacagagcaggagaccttt

SEQ ID NO: 8076246 - DNA, 22 bp, Homo sapiens
agccacagaggttgatgtggtt

SEQ ID NO: 8076247 - DNA, 22 bp, Homo sapiens
agccacagcctgacttaactgt

SEQ ID NO: 8076248 - DNA, 22 bp, Homo sapiens
cagaagcattccagcaaatagt

SEQ ID NO: 8076249 - DNA, 23 bp, Homo sapiens
cagagctggctcagagctgcctg

SEQ ID NO: 8076250 - DNA, 22 bp, Homo sapiens
agcccctgtttttccagtcaga

SEQ ID NO: 8076251 - DNA, 20 bp, Homo sapiens
agccagggttctggatgcac

SEQ ID NO: 8076252 - DNA, 22 bp, Homo sapiens
cagggccagccgcagcatccac

SEQ ID NO: 8076253 - DNA, 22 bp, Homo sapiens
cagggccagagagggctggctg

SEQ ID NO: 8076254 - DNA, 22 bp, Homo sapiens
cagggccagccatcctgctggg

SEQ ID NO: 8076255 - DNA, 22 bp, Homo sapiens
aggaacaagggagccttttctc

SEQ ID NO: 8076256 - DNA, 22 bp, Homo sapiens
aggaacaggcctcgttttctat

SEQ ID NO: 8076257 - DNA, 22 bp, Homo sapiens
caggcctgggcttcggggctga

SEQ ID NO: 8076258 - DNA, 22 bp, Homo sapiens
agctgttttactggttgtataa

SEQ ID NO: 8076259 - DNA, 22 bp, Homo sapiens
agcttaaagccgccatctagta

SEQ ID NO: 8076260 - DNA, 22 bp, Homo sapiens
agctggccagcacctccaggtc

SEQ ID NO: 8076261 - DNA, 22 bp, Homo sapiens
agctgctcattggcgtagttga

SEQ ID NO: 8076262 - DNA, 21 bp, Homo sapiens
agctgctccagggagctcagg

SEQ ID NO: 8076263 - DNA, 22 bp, Homo sapiens
agctgctccaatttttaccatt

SEQ ID NO: 8076264 - DNA, 22 bp, Homo sapiens
agctgctccctatcctttcctt

SEQ ID NO: 8076265 - DNA, 22 bp, Homo sapiens
agctgctccaacccagcgggct

SEQ ID NO: 8076266 - DNA, 22 bp, Homo sapiens
agctgctcattcccagcacatg

SEQ ID NO: 8076267 - DNA, 22 bp, Homo sapiens
agctgctctgggaaacagaagt

SEQ ID NO: 8076268 - DNA, 22 bp, Homo sapiens
agctgctctgataaacctactt

SEQ ID NO: 8076269 - DNA, 22 bp, Homo sapiens
agctgctctgagccctgattct

SEQ ID NO: 8076270 - DNA, 22 bp, Homo sapiens
agctgctcttgggtgacttcaa

SEQ ID NO: 8076271 - DNA, 22 bp, Homo sapiens
agctgctcttcatttcccccca

SEQ ID NO: 8076272 - DNA, 20 bp, Homo sapiens
agctgctctcatccagacct

SEQ ID NO: 8076273 - DNA, 22 bp, Homo sapiens
agctgctctcagcagttccagg

SEQ ID NO: 8076274 - DNA, 22 bp, Homo sapiens
agctgctcctttcctgcaggcg

SEQ ID NO: 8076275 - DNA, 22 bp, Homo sapiens
agctgctcgaagccggtggccc

SEQ ID NO: 8076276 - DNA, 22 bp, Homo sapiens
agctgctccttggctgtggttc

SEQ ID NO: 8076277 - DNA, 22 bp, Homo sapiens
agctgctctacatgatggggaa

SEQ ID NO: 8076278 - DNA, 22 bp, Homo sapiens
agctgctctcactggacgcctg

SEQ ID NO: 8076279 - DNA, 22 bp, Homo sapiens
agctgctctttgaaggacactt

SEQ ID NO: 8076280 - DNA, 22 bp, Homo sapiens
agctgctgaatgacactgcaag

SEQ ID NO: 8076281 - DNA, 22 bp, Homo sapiens
cagctcctgcctgggcagctgt

SEQ ID NO: 8076282 - DNA, 22 bp, Homo sapiens
agctctgccttgacaccttctc

SEQ ID NO: 8076283 - DNA, 22 bp, Homo sapiens
agctctgcctaggttccacgat

SEQ ID NO: 8076284 - DNA, 23 bp, Homo sapiens
cagcttctttgggattctttata

SEQ ID NO: 8076285 - DNA, 22 bp, Homo sapiens
cagcttttgcagacttcttgcc

SEQ ID NO: 8076286 - DNA, 22 bp, Homo sapiens
agctgcagtaaagctctccagg

SEQ ID NO: 8076287 - DNA, 22 bp, Homo sapiens
agctgcagggcttgggtttccc

SEQ ID NO: 8076288 - DNA, 21 bp, Homo sapiens
agctgcagtcaagccagaggt

SEQ ID NO: 8076289 - DNA, 20 bp, Homo sapiens
cattcctgaggaattcatgt

SEQ ID NO: 8076290 - DNA, 22 bp, Homo sapiens
cattcaaagcaggaaaggcctt

SEQ ID NO: 8076291 - DNA, 22 bp, Homo sapiens
cattcaaacattaatttattca

SEQ ID NO: 8076292 - DNA, 22 bp, Homo sapiens
cattcaaaagctccatgtttgt

SEQ ID NO: 8076293 - DNA, 22 bp, Homo sapiens
aggcagcatttgaatccaggtc

SEQ ID NO: 8076294 - DNA, 19 bp, Homo sapiens
aggcagcattctggggctt

SEQ ID NO: 8076295 - DNA, 22 bp, Homo sapiens
aggcagcatttctgcttatcca

SEQ ID NO: 8076296 - DNA, 22 bp, Homo sapiens
aggcagcagtcatgaggaaaga

SEQ ID NO: 8076297 - DNA, 22 bp, Homo sapiens
aggcagcagactgttaatcaga

SEQ ID NO: 8076298 - DNA, 22 bp, Homo sapiens
aggcagcagaaaacaaatggtt

SEQ ID NO: 8076299 - DNA, 22 bp, Homo sapiens
aggcagcagaggttgaggaaag

SEQ ID NO: 8076300 - DNA, 18 bp, Homo sapiens
aggcagcagcatcttctc

SEQ ID NO: 8076301 - DNA, 22 bp, Homo sapiens
aggcagcagccacaaggcctga

SEQ ID NO: 8076302 - DNA, 22 bp, Homo sapiens
aggcagcagcttgctggttgcc

SEQ ID NO: 8076303 - DNA, 22 bp, Homo sapiens
catgcaggcacccagagcccac

SEQ ID NO: 8076304 - DNA, 22 bp, Homo sapiens
cagtctctgccacttctaagct

SEQ ID NO: 8076305 - DNA, 22 bp, Homo sapiens
cagtctctcttgtagtgcagct

SEQ ID NO: 8076306 - DNA, 22 bp, Homo sapiens
cagtctctctgaagtattaaga

SEQ ID NO: 8076307 - DNA, 22 bp, Homo sapiens
cagtctctttatccaccaagcc

SEQ ID NO: 8076308 - DNA, 22 bp, Homo sapiens
cagtctcttgcttcattagttg

SEQ ID NO: 8076309 - DNA, 22 bp, Homo sapiens
cagtctcttttcagctccatcc

SEQ ID NO: 8076310 - DNA, 22 bp, Homo sapiens
cagtctctggtgagttgacagt

SEQ ID NO: 8076311 - DNA, 22 bp, Homo sapiens
cagtctctggcagctgctggcc

SEQ ID NO: 8076312 - DNA, 22 bp, Homo sapiens
cagtctctgggaaagaggacag

SEQ ID NO: 8076313 - DNA, 22 bp, Homo sapiens
cagtctctgtgccagatcctgg

SEQ ID NO: 8076314 - DNA, 22 bp, Homo sapiens
cagtctctgtcatctcatggga

SEQ ID NO: 8076315 - DNA, 22 bp, Homo sapiens
aggacagcatatgggaaccagt

SEQ ID NO: 8076316 - DNA, 22 bp, Homo sapiens
aggacagcccttgagagcacat

SEQ ID NO: 8076317 - DNA, 22 bp, Homo sapiens
aggagaaaacagtgttttgcct

SEQ ID NO: 8076318 - DNA, 22 bp, Homo sapiens
cagtcctgagctcctgggctga

SEQ ID NO: 8076319 - DNA, 21 bp, Homo sapiens
cagtcctgcaaataattcttt

SEQ ID NO: 8076320 - DNA, 22 bp, Homo sapiens
cagtcctgcccaggctgacaga

SEQ ID NO: 8076321 - DNA, 22 bp, Homo sapiens
cagtcctgagccaatcatgatg

SEQ ID NO: 8076322 - DNA, 22 bp, Homo sapiens
cagtcctgaatactggacggtg

SEQ ID NO: 8076323 - DNA, 22 bp, Homo sapiens
cagtccatatgccataattctt

SEQ ID NO: 8076324 - DNA, 22 bp, Homo sapiens
cagtcctgggcacagccctggg

SEQ ID NO: 8076325 - DNA, 20 bp, Homo sapiens
cagtcctgccccttggggac

SEQ ID NO: 8076326 - DNA, 22 bp, Homo sapiens
cagtcctgctagtgtgaaaagc

SEQ ID NO: 8076327 - DNA, 22 bp, Homo sapiens
aggagaggggtaggattaattt

SEQ ID NO: 8076328 - DNA, 22 bp, Homo sapiens
ccccagtggttgcaacagcaga

SEQ ID NO: 8076329 - DNA, 21 bp, Homo sapiens
ccccatggagtacagttgggc

SEQ ID NO: 8076330 - DNA, 22 bp, Homo sapiens
ccccagggtcagtgtgtggagg

SEQ ID NO: 8076331 - DNA, 22 bp, Homo sapiens
ccccaggtggatggctcgcata

SEQ ID NO: 8076332 - DNA, 19 bp, Homo sapiens
ccccagggtaggctagggg

SEQ ID NO: 8076333 - DNA, 22 bp, Homo sapiens
ccccagggactggtttcatgga

SEQ ID NO: 8076334 - DNA, 22 bp, Homo sapiens
ccagttttgccatggtaacact

SEQ ID NO: 8076335 - DNA, 22 bp, Homo sapiens
ccagtttttccagtgctttctg

SEQ ID NO: 8076336 - DNA, 22 bp, Homo sapiens
ccatcttctcttgaacctcctt

SEQ ID NO: 8076337 - DNA, 18 bp, Homo sapiens
cctcacagacttccatgt

SEQ ID NO: 8076338 - DNA, 22 bp, Homo sapiens
cctcccagtgccggggccggct

SEQ ID NO: 8076339 - DNA, 22 bp, Homo sapiens
cctccccacccacggctggtgg

SEQ ID NO: 8076340 - DNA, 22 bp, Homo sapiens
cctccaggataagtcagggcct

SEQ ID NO: 8076341 - DNA, 22 bp, Homo sapiens
agggcagccatgagccttcagg

SEQ ID NO: 8076342 - DNA, 22 bp, Homo sapiens
agggcagccattgagggattct

SEQ ID NO: 8076343 - DNA, 22 bp, Homo sapiens
agggcagcccttctgggagggc

SEQ ID NO: 8076344 - DNA, 22 bp, Homo sapiens
agggcagcagctgtccctgaga

SEQ ID NO: 8076345 - DNA, 22 bp, Homo sapiens
agggcagcagctcctcctagct

SEQ ID NO: 8076346 - DNA, 22 bp, Homo sapiens
agggcagcattgcctttctcca

SEQ ID NO: 8076347 - DNA, 22 bp, Homo sapiens
agggcagcctctcagcctaggt

SEQ ID NO: 8076348 - DNA, 22 bp, Homo sapiens
agggcagcctgagtgctggccc

SEQ ID NO: 8076349 - DNA, 22 bp, Homo sapiens
agggcagctaaggtgctgactg

SEQ ID NO: 8076350 - DNA, 22 bp, Homo sapiens
agggcagcggtgcttgtgttat

SEQ ID NO: 8076351 - DNA, 22 bp, Homo sapiens
agggcagctagctgtagaaaga

SEQ ID NO: 8076352 - DNA, 22 bp, Homo sapiens
agggcagctggaaggtggcttc

SEQ ID NO: 8076353 - DNA, 22 bp, Homo sapiens
agggcagctctcacctctggcc

SEQ ID NO: 8076354 - DNA, 22 bp, Homo sapiens
agggcagctgtgagccactgtg

SEQ ID NO: 8076355 - DNA, 22 bp, Homo sapiens
aggcctcaggaaggtaaagaag

SEQ ID NO: 8076356 - DNA, 22 bp, Homo sapiens
ccagttcatacacttagaaatt

SEQ ID NO: 8076357 - DNA, 22 bp, Homo sapiens
ccagtgagatatctgggcatta

SEQ ID NO: 8076358 - DNA, 22 bp, Homo sapiens
aggcccagttatcctacttgtt

SEQ ID NO: 8076359 - DNA, 23 bp, Homo sapiens
aggccagcgcagacaccgagcac

SEQ ID NO: 8076360 - DNA, 22 bp, Homo sapiens
aggccagctgttactagagcca

SEQ ID NO: 8076361 - DNA, 22 bp, Homo sapiens
aggcattttctgtatggacaga

SEQ ID NO: 8076362 - DNA, 22 bp, Homo sapiens
aggcatttttattgtccttaaa

SEQ ID NO: 8076363 - DNA, 22 bp, Homo sapiens
aggcagtggctgagaccagggg

SEQ ID NO: 8076364 - DNA, 22 bp, Homo sapiens
aggcagccctgtgctggatgct

SEQ ID NO: 8076365 - DNA, 22 bp, Homo sapiens
aggcagcccacaggacacagga

SEQ ID NO: 8076366 - DNA, 22 bp, Homo sapiens
aggcaggttggtgagaagactg

SEQ ID NO: 8076367 - DNA, 22 bp, Homo sapiens
aggcatttgagtccatgggtga

SEQ ID NO: 8076368 - DNA, 22 bp, Homo sapiens
ccactggcttttcctaggtctc

SEQ ID NO: 8076369 - DNA, 22 bp, Homo sapiens
ccactgctctgccaggagctgg

SEQ ID NO: 8076370 - DNA, 23 bp, Homo sapiens
aggcagtgggggccactttgctt

SEQ ID NO: 8076371 - DNA, 22 bp, Homo sapiens
atatgagagaggaaagatttta

SEQ ID NO: 8076372 - DNA, 22 bp, Homo sapiens
atatccaagaaacaattaattc

SEQ ID NO: 8076373 - DNA, 22 bp, Homo sapiens
atatatctgcagtactgaagaa

SEQ ID NO: 8076374 - DNA, 22 bp, Homo sapiens
atatatcatgagtaaaacttga

SEQ ID NO: 8076375 - DNA, 22 bp, Homo sapiens
atatatcatgagtaaaacttga

SEQ ID NO: 8076376 - DNA, 22 bp, Homo sapiens
atatatcatgagtaaaacttga

SEQ ID NO: 8076377 - DNA, 20 bp, Homo sapiens
ctgggcaggtgtttgatctc

SEQ ID NO: 8076378 - DNA, 22 bp, Homo sapiens
ctgggcaggtatacaaaaaatg

SEQ ID NO: 8076379 - DNA, 22 bp, Homo sapiens
ctgggcagtgcagctatagaac

SEQ ID NO: 8076380 - DNA, 22 bp, Homo sapiens
ctgggcagtgggcaagttgtat

SEQ ID NO: 8076381 - DNA, 22 bp, Homo sapiens
ctgggcagtatgaatattcaaa

SEQ ID NO: 8076382 - DNA, 22 bp, Homo sapiens
ctgggcaggatacttcatggga

SEQ ID NO: 8076383 - DNA, 22 bp, Homo sapiens
atatgcaagcacatagaatact

SEQ ID NO: 8076384 - DNA, 22 bp, Homo sapiens
ctgggcagtggtggcatctttg

SEQ ID NO: 8076385 - DNA, 22 bp, Homo sapiens
ctgggcagtggtggcccttccc

SEQ ID NO: 8076386 - DNA, 22 bp, Homo sapiens
ctgggcagttcgctttcgtttt

SEQ ID NO: 8076387 - DNA, 22 bp, Homo sapiens
atatggctaggttactaaactg

SEQ ID NO: 8076388 - DNA, 21 bp, Homo sapiens
atatggctcagagctggtact

SEQ ID NO: 8076389 - DNA, 20 bp, Homo sapiens
atatggctccgttcagtcgg

SEQ ID NO: 8076390 - DNA, 22 bp, Homo sapiens
atatggctctggctctgccttg

SEQ ID NO: 8076391 - DNA, 22 bp, Homo sapiens
atatggctcttccaaactgaga

SEQ ID NO: 8076392 - DNA, 22 bp, Homo sapiens
atatggctgtgtttatagccat

SEQ ID NO: 8076393 - DNA, 20 bp, Homo sapiens
atatggctgtgtgttgggag

SEQ ID NO: 8076394 - DNA, 22 bp, Homo sapiens
atatggctggagcctctgcctt

SEQ ID NO: 8076395 - DNA, 22 bp, Homo sapiens
atatggctgttgcacatctaag

SEQ ID NO: 8076396 - DNA, 23 bp, Homo sapiens
atatggctgttgtgtgttaacat

SEQ ID NO: 8076397 - DNA, 22 bp, Homo sapiens
atatggctgttggtagccaaca

SEQ ID NO: 8076398 - DNA, 22 bp, Homo sapiens
atatggcttttctgtagtagtt

SEQ ID NO: 8076399 - DNA, 22 bp, Homo sapiens
atatggctgtttcactagctga

SEQ ID NO: 8076400 - DNA, 22 bp, Homo sapiens
atatggcttatttatagagcaa

SEQ ID NO: 8076401 - DNA, 22 bp, Homo sapiens
atatggcttgtagcatgaataa

SEQ ID NO: 8076402 - DNA, 22 bp, Homo sapiens
atatgtttttcacaggtttaag

SEQ ID NO: 8076403 - DNA, 20 bp, Homo sapiens
atataataaattttggttac

SEQ ID NO: 8076404 - DNA, 22 bp, Homo sapiens
atataatacaacctgctaagtg

SEQ ID NO: 8076405 - DNA, 22 bp, Homo sapiens
atataaagtgtttagaaagctg

SEQ ID NO: 8076406 - DNA, 22 bp, Homo sapiens
atataacatacatacagaaaag

SEQ ID NO: 8076407 - DNA, 20 bp, Homo sapiens
atataataaattttggttac

SEQ ID NO: 8076408 - DNA, 22 bp, Homo sapiens
atatatacaactagattaaaag

SEQ ID NO: 8076409 - DNA, 22 bp, Homo sapiens
ctgtctgtttctgattcaacct

SEQ ID NO: 8076410 - DNA, 22 bp, Homo sapiens
ctgtcttctaccttcaacctcc

SEQ ID NO: 8076411 - DNA, 22 bp, Homo sapiens
ctgtgattgttagttcctatac

SEQ ID NO: 8076412 - DNA, 22 bp, Homo sapiens
atcatgttaaatatttcaatct

SEQ ID NO: 8076413 - DNA, 22 bp, Homo sapiens
atcacagtctttttcttaagta

SEQ ID NO: 8076414 - DNA, 22 bp, Homo sapiens
atcacagtgtagaccttttaaa

SEQ ID NO: 8076415 - DNA, 22 bp, Homo sapiens
atcacatatttaagaaacatgt

SEQ ID NO: 8076416 - DNA, 22 bp, Homo sapiens
atccacagtcttagccatcaaa

SEQ ID NO: 8076417 - DNA, 22 bp, Homo sapiens
atccacagggtgtgttaagatg

SEQ ID NO: 8076418 - DNA, 22 bp, Homo sapiens
atccacaggagggtttggaaaa

SEQ ID NO: 8076419 - DNA, 22 bp, Homo sapiens
atccacagagaggaagaatagt

SEQ ID NO: 8076420 - DNA, 22 bp, Homo sapiens
atcattttgtgacaatgcctgt

SEQ ID NO: 8076421 - DNA, 22 bp, Homo sapiens
atcatgttgtatgtaatctttt

SEQ ID NO: 8076422 - DNA, 22 bp, Homo sapiens
ataaaggccaaaatttgcattt

SEQ ID NO: 8076423 - DNA, 17 bp, Homo sapiens
ataaaggcaagtattat

SEQ ID NO: 8076424 - DNA, 22 bp, Homo sapiens
agtttgtatgccaacagcaaag

SEQ ID NO: 8076425 - DNA, 22 bp, Homo sapiens
agtttgtatcaatttgctttat

SEQ ID NO: 8076426 - DNA, 22 bp, Homo sapiens
agtttgtaacctaagattcagg

SEQ ID NO: 8076427 - DNA, 22 bp, Homo sapiens
agtttgtaataatgaaggaagt

SEQ ID NO: 8076428 - DNA, 22 bp, Homo sapiens
agtttggaagagaaaaatattt

SEQ ID NO: 8076429 - DNA, 22 bp, Homo sapiens
agtttggacaaaagactcctta

SEQ ID NO: 8076430 - DNA, 22 bp, Homo sapiens
agttgtcccggtctagccactt

SEQ ID NO: 8076431 - DNA, 22 bp, Homo sapiens
agttgtaacagattctaacata

SEQ ID NO: 8076432 - DNA, 21 bp, Homo sapiens
agttgctgctgctgcaggtga

SEQ ID NO: 8076433 - DNA, 23 bp, Homo sapiens
agttctttccaatgtcctcctct

SEQ ID NO: 8076434 - DNA, 22 bp, Homo sapiens
ctgaggcctctctccttggctt

SEQ ID NO: 8076435 - DNA, 22 bp, Homo sapiens
ctgaggcctctttccttggctt

SEQ ID NO: 8076436 - DNA, 22 bp, Homo sapiens
ctgaggcctcgttggctggaac

SEQ ID NO: 8076437 - DNA, 22 bp, Homo sapiens
ctgaggcctctcccactccagc

SEQ ID NO: 8076438 - DNA, 22 bp, Homo sapiens
ctgaggcctctctcctgggctt

SEQ ID NO: 8076439 - DNA, 22 bp, Homo sapiens
ctgcttctagcaccaagtccct

SEQ ID NO: 8076440 - DNA, 18 bp, Homo sapiens
ctgcttctgtctgccagt

SEQ ID NO: 8076441 - DNA, 22 bp, Homo sapiens
ataaatatcactgttgtccctc

SEQ ID NO: 8076442 - DNA, 22 bp, Homo sapiens
atacagaagttttccacttatt

SEQ ID NO: 8076443 - DNA, 22 bp, Homo sapiens
atacagaattcactacagtttc

SEQ ID NO: 8076444 - DNA, 22 bp, Homo sapiens
atacagaagttttccacttatt

SEQ ID NO: 8076445 - DNA, 22 bp, Homo sapiens
atacagaattcactacagtttc

SEQ ID NO: 8076446 - DNA, 22 bp, Homo sapiens
atacagaattcactacagtttc

SEQ ID NO: 8076447 - DNA, 22 bp, Homo sapiens
atactgaaaaagaagtgttgaa

SEQ ID NO: 8076448 - DNA, 22 bp, Homo sapiens
cctgccctatgaccagcttcac

SEQ ID NO: 8076449 - DNA, 22 bp, Homo sapiens
cctggctcttcagaggttccta

SEQ ID NO: 8076450 - DNA, 22 bp, Homo sapiens
cctgctctgccaagtcctcttt

SEQ ID NO: 8076451 - DNA, 22 bp, Homo sapiens
cctggacacccattccttggct

SEQ ID NO: 8076452 - DNA, 22 bp, Homo sapiens
aggtgccattgcttgccagttt

SEQ ID NO: 8076453 - DNA, 22 bp, Homo sapiens
aggtgctggagtctgggcagga

SEQ ID NO: 8076454 - DNA, 22 bp, Homo sapiens
cgctccaagcttgatgggacca

SEQ ID NO: 8076455 - DNA, 22 bp, Homo sapiens
cggccgcagcagtgtcggccca

SEQ ID NO: 8076456 - DNA, 22 bp, Homo sapiens
agtatatcacatgtagtaatgg

SEQ ID NO: 8076457 - DNA, 19 bp, Homo sapiens
ctctggagcagacactgga

SEQ ID NO: 8076458 - DNA, 22 bp, Homo sapiens
ctctgtctatcccattctgtgc

SEQ ID NO: 8076459 - DNA, 22 bp, Homo sapiens
ctcttgggatttgcaggctcag

SEQ ID NO: 8076460 - DNA, 22 bp, Homo sapiens
ctcttgggatacactgccatag

SEQ ID NO: 8076461 - DNA, 22 bp, Homo sapiens
ctcttgggtgggcagtgggcct

SEQ ID NO: 8076462 - DNA, 22 bp, Homo sapiens
ctcttctttagtccagaccatc

SEQ ID NO: 8076463 - DNA, 22 bp, Homo sapiens
ctcgagtttccacagtttgcat

SEQ ID NO: 8076464 - DNA, 22 bp, Homo sapiens
ctccttggttcaaatgataaaa

SEQ ID NO: 8076465 - DNA, 22 bp, Homo sapiens
ctccttggccgttaatgtcaca

SEQ ID NO: 8076466 - DNA, 22 bp, Homo sapiens
ctcagagggttgaaggtgctct

SEQ ID NO: 8076467 - DNA, 22 bp, Homo sapiens
agtcccagatctacaggaggga

SEQ ID NO: 8076468 - DNA, 22 bp, Homo sapiens
agtatgaagatgatgaaaaata

SEQ ID NO: 8076469 - DNA, 22 bp, Homo sapiens
agtatctttacttaaatagtca

SEQ ID NO: 8076470 - DNA, 22 bp, Homo sapiens
agtatcagcagagcttaaaaga

SEQ ID NO: 8076471 - DNA, 22 bp, Homo sapiens
ctcagggacgttagaggacagg

SEQ ID NO: 8076472 - DNA, 23 bp, Homo sapiens
agtctctatggcaattcctttac

SEQ ID NO: 8076473 - DNA, 22 bp, Homo sapiens
agtctccagaaatatagcagtg

SEQ ID NO: 8076474 - DNA, 22 bp, Homo sapiens
agtctctagtcatttcacctct

SEQ ID NO: 8076475 - DNA, 20 bp, Homo sapiens
agtgaatttaaataatattc

SEQ ID NO: 8076476 - DNA, 22 bp, Homo sapiens
agtgaattgttgccacagagac

SEQ ID NO: 8076477 - DNA, 22 bp, Homo sapiens
agtgaatttcatgtaagtgtgt

SEQ ID NO: 8076478 - DNA, 22 bp, Homo sapiens
agtgaattctgcactactgaag

SEQ ID NO: 8076479 - DNA, 22 bp, Homo sapiens
agtgaattctccacccagtagg

SEQ ID NO: 8076480 - DNA, 22 bp, Homo sapiens
ctcagtgggcccatggcgtcct

SEQ ID NO: 8076481 - DNA, 22 bp, Homo sapiens
cagcaggcccaggtgctggtga

SEQ ID NO: 8076482 - DNA, 22 bp, Homo sapiens
gtatccatgggggattggttcc

SEQ ID NO: 8076483 - DNA, 22 bp, Homo sapiens
gtatatgtgtgggcctgcatat

SEQ ID NO: 8076484 - DNA, 22 bp, Homo sapiens
ggttcctggcagatgtagggct

SEQ ID NO: 8076485 - DNA, 23 bp, Homo sapiens
ggttcctgagcagggatctggaa

SEQ ID NO: 8076486 - DNA, 22 bp, Homo sapiens
cagcaataatgtctacaaatct

SEQ ID NO: 8076487 - DNA, 22 bp, Homo sapiens
cagcaaggcattctgtggatta

SEQ ID NO: 8076488 - DNA, 22 bp, Homo sapiens
cagcaaggccattggatgcagt

SEQ ID NO: 8076489 - DNA, 22 bp, Homo sapiens
cagcatgttcttgtctcactgg

SEQ ID NO: 8076490 - DNA, 22 bp, Homo sapiens
gtattttaagtgactactaggt

SEQ ID NO: 8076491 - DNA, 22 bp, Homo sapiens
gtattttacttacgcatgactt

SEQ ID NO: 8076492 - DNA, 22 bp, Homo sapiens
gggcactgtgttcagagtgcag

SEQ ID NO: 8076493 - DNA, 22 bp, Homo sapiens
cagagctgcgctttttcctggt

SEQ ID NO: 8076494 - DNA, 22 bp, Homo sapiens
cagaggccccagaactagctct

SEQ ID NO: 8076495 - DNA, 21 bp, Homo sapiens
cagaggcctatcacagactcc

SEQ ID NO: 8076496 - DNA, 22 bp, Homo sapiens
cagaggcctcacttccagccag

SEQ ID NO: 8076497 - DNA, 22 bp, Homo sapiens
cagaggccatatttcttcactc

SEQ ID NO: 8076498 - DNA, 22 bp, Homo sapiens
cagaggccagtggacaagggcc

SEQ ID NO: 8076499 - DNA, 22 bp, Homo sapiens
cagaggcccagtgagagggctg

SEQ ID NO: 8076500 - DNA, 22 bp, Homo sapiens
cagaggccacctgtggccactg

SEQ ID NO: 8076501 - DNA, 22 bp, Homo sapiens
cagaggccagggggctcacaaa

SEQ ID NO: 8076502 - DNA, 22 bp, Homo sapiens
cagaggccaggctgcctgactg

SEQ ID NO: 8076503 - DNA, 22 bp, Homo sapiens
cagaggcctggcttggacacct

SEQ ID NO: 8076504 - DNA, 22 bp, Homo sapiens
cagaggccttcaatactcattt

SEQ ID NO: 8076505 - DNA, 22 bp, Homo sapiens
gggactgggagatcctcctggc

SEQ ID NO: 8076506 - DNA, 22 bp, Homo sapiens
cagacaggcaggtgagagctcc

SEQ ID NO: 8076507 - DNA, 22 bp, Homo sapiens
cactggctaaagataagctcaa

SEQ ID NO: 8076508 - DNA, 22 bp, Homo sapiens
cactggctgagcttctctaggg

SEQ ID NO: 8076509 - DNA, 22 bp, Homo sapiens
cagaaggtttacactggactgt

SEQ ID NO: 8076510 - DNA, 19 bp, Homo sapiens
gggacaccagaagaacaag

SEQ ID NO: 8076511 - DNA, 22 bp, Homo sapiens
gggacacaggtatctcaaatga

SEQ ID NO: 8076512 - DNA, 22 bp, Homo sapiens
gggactggaactactggtgcag

SEQ ID NO: 8076513 - DNA, 22 bp, Homo sapiens
gggactggcacagggctgggag

SEQ ID NO: 8076514 - DNA, 22 bp, Homo sapiens
cacactgtcaggtaaataacac

SEQ ID NO: 8076515 - DNA, 22 bp, Homo sapiens
cacagcttagaaaagaagccat

SEQ ID NO: 8076516 - DNA, 17 bp, Homo sapiens
ggcagagctgacagggc

SEQ ID NO: 8076517 - DNA, 22 bp, Homo sapiens
cacagtgtggcaaatttcaact

SEQ ID NO: 8076518 - DNA, 22 bp, Homo sapiens
cacagtgtgactgaccttcagc

SEQ ID NO: 8076519 - DNA, 22 bp, Homo sapiens
cacagtgtctgtgcttcagtgt

SEQ ID NO: 8076520 - DNA, 22 bp, Homo sapiens
cactggaccaaggaaactcttc

SEQ ID NO: 8076521 - DNA, 22 bp, Homo sapiens
ggctagggagacagagggcatg

SEQ ID NO: 8076522 - DNA, 22 bp, Homo sapiens
cactgcactccagcttgggtga

SEQ ID NO: 8076523 - DNA, 22 bp, Homo sapiens
cacccaggttggagtgcagtgg

SEQ ID NO: 8076524 - DNA, 19 bp, Homo sapiens
caccccagtcctctttccc

SEQ ID NO: 8076525 - DNA, 22 bp, Homo sapiens
caccccccaattctgccagctg

SEQ ID NO: 8076526 - DNA, 22 bp, Homo sapiens
cacccccaggagctccagggac

SEQ ID NO: 8076527 - DNA, 20 bp, Homo sapiens
caccagtcatgagtcaatac

SEQ ID NO: 8076528 - DNA, 16 bp, Homo sapiens
caccagtccttcctgc

SEQ ID NO: 8076529 - DNA, 22 bp, Homo sapiens
ggcagccagagggcagctggat

SEQ ID NO: 8076530 - DNA, 22 bp, Homo sapiens
caccatctagcagagagatgga

SEQ ID NO: 8076531 - DNA, 22 bp, Homo sapiens
cacaaaagtaggaggcaggcgg

SEQ ID NO: 8076532 - DNA, 22 bp, Homo sapiens
gctgtctcgcctgacactggct

SEQ ID NO: 8076533 - DNA, 22 bp, Homo sapiens
gctgtctccatagctgtgtgtc

SEQ ID NO: 8076534 - DNA, 22 bp, Homo sapiens
gctgtaaataagcttacttgaa

SEQ ID NO: 8076535 - DNA, 22 bp, Homo sapiens
gctgtaaataagcttacttgaa

SEQ ID NO: 8076536 - DNA, 21 bp, Homo sapiens
gctgtctctggctcctgggaa

SEQ ID NO: 8076537 - DNA, 20 bp, Homo sapiens
gctgtggcaagtgctcactg

SEQ ID NO: 8076538 - DNA, 22 bp, Homo sapiens
cacaataaatgtttgctgatga

SEQ ID NO: 8076539 - DNA, 22 bp, Homo sapiens
cacaattagcagctctttattt

SEQ ID NO: 8076540 - DNA, 22 bp, Homo sapiens
cacaattagcagctctttattt

SEQ ID NO: 8076541 - DNA, 22 bp, Homo sapiens
ggaaaaggccattgtttctctg

SEQ ID NO: 8076542 - DNA, 22 bp, Homo sapiens
cacaaggttctgtaaaatcaaa

SEQ ID NO: 8076543 - DNA, 21 bp, Homo sapiens
ggaaaattcagagtgcaattt

SEQ ID NO: 8076544 - DNA, 22 bp, Homo sapiens
ggaaaatgggaacctgaagcca

SEQ ID NO: 8076545 - DNA, 22 bp, Homo sapiens
ggaaaagtgttaaggtgttgat

SEQ ID NO: 8076546 - DNA, 22 bp, Homo sapiens
cacaaagtgggtggaaaactaa

SEQ ID NO: 8076547 - DNA, 22 bp, Homo sapiens
cacaattattatctctttctac

SEQ ID NO: 8076548 - DNA, 19 bp, Homo sapiens
cacaattatgagacactta

SEQ ID NO: 8076549 - DNA, 22 bp, Homo sapiens
caagatatcaatgacatagtat

SEQ ID NO: 8076550 - DNA, 22 bp, Homo sapiens
caagaggctaaactgggctatt

SEQ ID NO: 8076551 - DNA, 22 bp, Homo sapiens
gctgctggccccacatgctcca

SEQ ID NO: 8076552 - DNA, 22 bp, Homo sapiens
caacagtttatagtgttatctt

SEQ ID NO: 8076553 - DNA, 22 bp, Homo sapiens
caacatcagtcctcatgagaca

SEQ ID NO: 8076554 - DNA, 22 bp, Homo sapiens
caacatatgctttcatgaggta

SEQ ID NO: 8076555 - DNA, 22 bp, Homo sapiens
caacatatgattttgtatataa

SEQ ID NO: 8076556 - DNA, 22 bp, Homo sapiens
caacatgtgttagacaatagac

SEQ ID NO: 8076557 - DNA, 22 bp, Homo sapiens
gctgcaggtttgtctagtctgg

SEQ ID NO: 8076558 - DNA, 22 bp, Homo sapiens
caaagtaactgcctttccaatt

SEQ ID NO: 8076559 - DNA, 22 bp, Homo sapiens
caaagtaatttggagatatata

SEQ ID NO: 8076560 - DNA, 22 bp, Homo sapiens
caaagtatatttcatagtctca

SEQ ID NO: 8076561 - DNA, 17 bp, Homo sapiens
gctcctgcaggtcagga

SEQ ID NO: 8076562 - DNA, 18 bp, Homo sapiens
gctcctggaccaggtcac

SEQ ID NO: 8076563 - DNA, 22 bp, Homo sapiens
gctgcagcaagccctccagggg

SEQ ID NO: 8076564 - DNA, 22 bp, Homo sapiens
gctgcagagtgatgaagtgggg

SEQ ID NO: 8076565 - DNA, 22 bp, Homo sapiens
gctgcagacttctcatctcatt

SEQ ID NO: 8076566 - DNA, 22 bp, Homo sapiens
atgaagcagatttattactcac

SEQ ID NO: 8076567 - DNA, 22 bp, Homo sapiens
atgaagcagaatttcccactct

SEQ ID NO: 8076568 - DNA, 22 bp, Homo sapiens
atgaagcaattagaaacttgaa

SEQ ID NO: 8076569 - DNA, 22 bp, Homo sapiens
gaaagcaagttgactgcagaat

SEQ ID NO: 8076570 - DNA, 22 bp, Homo sapiens
atgatacaagcaaaactaatca

SEQ ID NO: 8076571 - DNA, 22 bp, Homo sapiens
atgattttttctaacacagtcg

SEQ ID NO: 8076572 - DNA, 22 bp, Homo sapiens
atgatttttcagcagaggatct

SEQ ID NO: 8076573 - DNA, 22 bp, Homo sapiens
atgatttttcagcagaggatct

SEQ ID NO: 8076574 - DNA, 22 bp, Homo sapiens
atgcagaagaaaccatggcttc

SEQ ID NO: 8076575 - DNA, 22 bp, Homo sapiens
atgcagaagcagaacttacaca

SEQ ID NO: 8076576 - DNA, 22 bp, Homo sapiens
atgcacttcaagcatctctctg

SEQ ID NO: 8076577 - DNA, 22 bp, Homo sapiens
atgcacttgcgtgtttgcaaat

SEQ ID NO: 8076578 - DNA, 22 bp, Homo sapiens
atgcactttctagagattctga

SEQ ID NO: 8076579 - DNA, 20 bp, Homo sapiens
atgcaaatcccaaaatcagg

SEQ ID NO: 8076580 - DNA, 22 bp, Homo sapiens
atgcaaacattcgcttgtctct

SEQ ID NO: 8076581 - DNA, 22 bp, Homo sapiens
atgcaaaataaggcagaaacat

SEQ ID NO: 8076582 - DNA, 22 bp, Homo sapiens
atcttttttgtcttggtcactg

SEQ ID NO: 8076583 - DNA, 22 bp, Homo sapiens
atctttttgacatggtgatggt

SEQ ID NO: 8076584 - DNA, 22 bp, Homo sapiens
atctttttatctgtttggaaca

SEQ ID NO: 8076585 - DNA, 22 bp, Homo sapiens
atctttttactaacactgctta

SEQ ID NO: 8076586 - DNA, 22 bp, Homo sapiens
atgaaataaatacccacacata

SEQ ID NO: 8076587 - DNA, 18 bp, Homo sapiens
cttgttcttctcttggcg

SEQ ID NO: 8076588 - DNA, 22 bp, Homo sapiens
cttgtttaaataagatagcagt

SEQ ID NO: 8076589 - DNA, 22 bp, Homo sapiens
cttgtttaaataagatagcagt

SEQ ID NO: 8076590 - DNA, 22 bp, Homo sapiens
cttgtttaagccgctgttaagc

SEQ ID NO: 8076591 - DNA, 22 bp, Homo sapiens
cttgtggccaatgtttgttata

SEQ ID NO: 8076592 - DNA, 22 bp, Homo sapiens
cttgtgttgtacattctatggg

SEQ ID NO: 8076593 - DNA, 20 bp, Homo sapiens
cttgttaaatatgcaggtag

SEQ ID NO: 8076594 - DNA, 22 bp, Homo sapiens
cttgttatctgaaccaaaatta

SEQ ID NO: 8076595 - DNA, 22 bp, Homo sapiens
cttttagctgcaagtgttcaca

SEQ ID NO: 8076596 - DNA, 22 bp, Homo sapiens
cttttagctgtttccatggcaa

SEQ ID NO: 8076597 - DNA, 22 bp, Homo sapiens
atgaaattaatcaacacataca

SEQ ID NO: 8076598 - DNA, 22 bp, Homo sapiens
cttttacatttgttgaagagta

SEQ ID NO: 8076599 - DNA, 22 bp, Homo sapiens
cttttcatgagtctgttatggg

SEQ ID NO: 8076600 - DNA, 22 bp, Homo sapiens
cttttcagagctgagatcaccg

SEQ ID NO: 8076601 - DNA, 22 bp, Homo sapiens
atctagaagtggcatgaattac

SEQ ID NO: 8076602 - DNA, 22 bp, Homo sapiens
cttgctcacagtacctggcttg

SEQ ID NO: 8076603 - DNA, 22 bp, Homo sapiens
cttggtaaaactgtcttaaatt

SEQ ID NO: 8076604 - DNA, 22 bp, Homo sapiens
cttgtaaaaggtacattatgct

SEQ ID NO: 8076605 - DNA, 22 bp, Homo sapiens
cttgtaaaaggtacattatgct

SEQ ID NO: 8076606 - DNA, 19 bp, Homo sapiens
cttgtaaagggctgtttct

SEQ ID NO: 8076607 - DNA, 22 bp, Homo sapiens
cttgtaaatgcagattctgatt

SEQ ID NO: 8076608 - DNA, 20 bp, Homo sapiens
atcttcttggccagcttgct

SEQ ID NO: 8076609 - DNA, 22 bp, Homo sapiens
cttgtaactcctatttactatg

SEQ ID NO: 8076610 - DNA, 18 bp, Homo sapiens
gagaaagtttgggcagaa

SEQ ID NO: 8076611 - DNA, 21 bp, Homo sapiens
atggaaaaacaggtagagcat

SEQ ID NO: 8076612 - DNA, 18 bp, Homo sapiens
gacactgagcattttgag

SEQ ID NO: 8076613 - DNA, 22 bp, Homo sapiens
gacagcaacactcaattctgca

SEQ ID NO: 8076614 - DNA, 22 bp, Homo sapiens
gacagcaaagcagagccaaggc

SEQ ID NO: 8076615 - DNA, 22 bp, Homo sapiens
atggcccagactcagactggtg

SEQ ID NO: 8076616 - DNA, 22 bp, Homo sapiens
gagaacagaagcattcctaatt

SEQ ID NO: 8076617 - DNA, 22 bp, Homo sapiens
gagaacagagataattttactt

SEQ ID NO: 8076618 - DNA, 22 bp, Homo sapiens
gagaacagatttttctgctgtc

SEQ ID NO: 8076619 - DNA, 23 bp, Homo sapiens
gagaacagccacagagagctgtg

SEQ ID NO: 8076620 - DNA, 22 bp, Homo sapiens
gagaggaaagatatatacttct

SEQ ID NO: 8076621 - DNA, 22 bp, Homo sapiens
gaggctgctgagagccctgttt

SEQ ID NO: 8076622 - DNA, 22 bp, Homo sapiens
gaggctgccccttcctcagctg

SEQ ID NO: 8076623 - DNA, 23 bp, Homo sapiens
gaggcctggccctgccacatctc

SEQ ID NO: 8076624 - DNA, 22 bp, Homo sapiens
atgtctttataaatgtataatg

SEQ ID NO: 8076625 - DNA, 22 bp, Homo sapiens
gaggctgctgttagccctgggc

SEQ ID NO: 8076626 - DNA, 22 bp, Homo sapiens
atggtcaggcaaggagggctgg

SEQ ID NO: 8076627 - DNA, 22 bp, Homo sapiens
atggtattctctaactcagctt

SEQ ID NO: 8076628 - DNA, 22 bp, Homo sapiens
atggtacatagtttaaataagg

SEQ ID NO: 8076629 - DNA, 22 bp, Homo sapiens
caaactttcagttataacatga

SEQ ID NO: 8076630 - DNA, 22 bp, Homo sapiens
caaacttacgtagtcttactac

SEQ ID NO: 8076631 - DNA, 22 bp, Homo sapiens
gcgcacatgttcagatgtgtga

SEQ ID NO: 8076632 - DNA, 22 bp, Homo sapiens
caaaccttgttccagtcaactc

SEQ ID NO: 8076633 - DNA, 22 bp, Homo sapiens
caaactatttacaatggaatca

SEQ ID NO: 8076634 - DNA, 22 bp, Homo sapiens
caaaacattctctgcagcaggg

SEQ ID NO: 8076635 - DNA, 22 bp, Homo sapiens
attttttagaacctggcctgat

SEQ ID NO: 8076636 - DNA, 22 bp, Homo sapiens
caaaaagcttaggtaacaagcc

SEQ ID NO: 8076637 - DNA, 22 bp, Homo sapiens
atttctcagtgaaatgacaggc

SEQ ID NO: 8076638 - DNA, 21 bp, Homo sapiens
gcctccagccagatggcctcc

SEQ ID NO: 8076639 - DNA, 22 bp, Homo sapiens
gcctgctgaagccagagtgtgt

SEQ ID NO: 8076640 - DNA, 22 bp, Homo sapiens
gcctggctgaggcctctgctaa

SEQ ID NO: 8076641 - DNA, 22 bp, Homo sapiens
gcctggaggaatgtagctgagg

SEQ ID NO: 8076642 - DNA, 22 bp, Homo sapiens
atttcagattcgagaggaagtg

SEQ ID NO: 8076643 - DNA, 22 bp, Homo sapiens
atttcaggccaccagatgtctt

SEQ ID NO: 8076644 - DNA, 22 bp, Homo sapiens
atttcatggcagactttaaccc

SEQ ID NO: 8076645 - DNA, 21 bp, Homo sapiens
atttcatggtgcttttaagaa

SEQ ID NO: 8076646 - DNA, 22 bp, Homo sapiens
atttcatgtgaagaagagataa

SEQ ID NO: 8076647 - DNA, 22 bp, Homo sapiens
atttccttgcaacttaggcatg

SEQ ID NO: 8076648 - DNA, 18 bp, Homo sapiens
atttctactactataaag

SEQ ID NO: 8076649 - DNA, 22 bp, Homo sapiens
atttcagactgtgttggaaaat

SEQ ID NO: 8076650 - DNA, 22 bp, Homo sapiens
atttcagaatgtcctaatttag

SEQ ID NO: 8076651 - DNA, 22 bp, Homo sapiens
atttattggatgcttacttggg

SEQ ID NO: 8076652 - DNA, 19 bp, Homo sapiens
atttactgcctaaaatctc

SEQ ID NO: 8076653 - DNA, 22 bp, Homo sapiens
atttactctggctggaatacaa

SEQ ID NO: 8076654 - DNA, 21 bp, Homo sapiens
atttacaaaacagtcccttcc

SEQ ID NO: 8076655 - DNA, 22 bp, Homo sapiens
atttacacattcataagatttc

SEQ ID NO: 8076656 - DNA, 22 bp, Homo sapiens
atttaatgtcgagctattgtag

SEQ ID NO: 8076657 - DNA, 22 bp, Homo sapiens
atttaatgtcgagctattgtag

SEQ ID NO: 8076658 - DNA, 22 bp, Homo sapiens
atttaattaatcatggtgaatt

SEQ ID NO: 8076659 - DNA, 22 bp, Homo sapiens
atttaattgttcttctggctat

SEQ ID NO: 8076660 - DNA, 22 bp, Homo sapiens
atttaattaatcatggtgaatt

SEQ ID NO: 8076661 - DNA, 22 bp, Homo sapiens
atttaatttggagagagaaacc

SEQ ID NO: 8076662 - DNA, 22 bp, Homo sapiens
atttaatttgtgtctttagctg

SEQ ID NO: 8076663 - DNA, 22 bp, Homo sapiens
atttaatttatagatgtggata

SEQ ID NO: 8076664 - DNA, 22 bp, Homo sapiens
atgtgttaatgtcaaccagaaa

SEQ ID NO: 8076665 - DNA, 22 bp, Homo sapiens
atgtgttagtttgtgattatac

SEQ ID NO: 8076666 - DNA, 22 bp, Homo sapiens
atgtgtttataattactcaatc

SEQ ID NO: 8076667 - DNA, 22 bp, Homo sapiens
atgtgtttgtcctgcagaaata

SEQ ID NO: 8076668 - DNA, 22 bp, Homo sapiens
atgtgtttgtacctttaaatat

SEQ ID NO: 8076669 - DNA, 22 bp, Homo sapiens
atgttaaaaaccagtacagttg

SEQ ID NO: 8076670 - DNA, 22 bp, Homo sapiens
atgttttccccaaatgatcttc

SEQ ID NO: 8076671 - DNA, 22 bp, Homo sapiens
atgttttgattggttaggtctg

SEQ ID NO: 8076672 - DNA, 22 bp, Homo sapiens
atgttttatgcttcagatgagg

SEQ ID NO: 8076673 - DNA, 22 bp, Homo sapiens
atgttttatattttgcagcagt

SEQ ID NO: 8076674 - DNA, 22 bp, Homo sapiens
attaaatactgcaggctaagca

SEQ ID NO: 8076675 - DNA, 22 bp, Homo sapiens
atgtttttggcttcaagtttct

SEQ ID NO: 8076676 - DNA, 22 bp, Homo sapiens
attaaaactaaaatgcctgatt

SEQ ID NO: 8076677 - DNA, 22 bp, Homo sapiens
atgtttttgagatacaaacaga

SEQ ID NO: 8076678 - DNA, 22 bp, Homo sapiens
atgtttttgagatacaaacaga

SEQ ID NO: 8076679 - DNA, 22 bp, Homo sapiens
attaaattagcaaactgtgaaa

SEQ ID NO: 8076680 - DNA, 22 bp, Homo sapiens
attaatatacactgttagcatg

SEQ ID NO: 8076681 - DNA, 20 bp, Homo sapiens
attaatgaatacattttgat

SEQ ID NO: 8076682 - DNA, 22 bp, Homo sapiens
attaattgggaacttgttgaaa

SEQ ID NO: 8076683 - DNA, 22 bp, Homo sapiens
attaattgggaacttgttgaaa

SEQ ID NO: 8076684 - DNA, 22 bp, Homo sapiens
attacaataatacatgctcatt

SEQ ID NO: 8076685 - DNA, 22 bp, Homo sapiens
attagagagagcatattactgg

SEQ ID NO: 8076686 - DNA, 22 bp, Homo sapiens
attattcaatcatattaaaagt

SEQ ID NO: 8076687 - DNA, 22 bp, Homo sapiens
attattcaatgttatttcagtg

SEQ ID NO: 8076688 - DNA, 22 bp, Homo sapiens
attattcttatgtcatcatggc

SEQ ID NO: 8076689 - DNA, 22 bp, Homo sapiens
attattcatggtcttccacaat

SEQ ID NO: 8076690 - DNA, 22 bp, Homo sapiens
gcaaggctgttgctgctgcaag

SEQ ID NO: 8076691 - DNA, 22 bp, Homo sapiens
attagaattatgcttgctaatg

SEQ ID NO: 8076692 - DNA, 22 bp, Homo sapiens
attcttcagcaggggacactat

SEQ ID NO: 8076693 - DNA, 22 bp, Homo sapiens
attgcacttcagcctgggtgac

SEQ ID NO: 8076694 - DNA, 22 bp, Homo sapiens
attgcactccggcctgggtgac

SEQ ID NO: 8076695 - DNA, 22 bp, Homo sapiens
attgctgggaatatttagccca

SEQ ID NO: 8076696 - DNA, 22 bp, Homo sapiens
attgctggctgccatcttgccc

SEQ ID NO: 8076697 - DNA, 22 bp, Homo sapiens
attctagagtttcaatccaagg

SEQ ID NO: 8076698 - DNA, 22 bp, Homo sapiens
attcttaattccaaagactgag

SEQ ID NO: 8076699 - DNA, 22 bp, Homo sapiens
attcttaattccaaagactgag

SEQ ID NO: 8076700 - DNA, 22 bp, Homo sapiens
attcttaattgccatgctgtat

SEQ ID NO: 8076701 - DNA, 22 bp, Homo sapiens
attcttaattgccatgctgtat

SEQ ID NO: 8076702 - DNA, 22 bp, Homo sapiens
attcagttaaaaactgtacttc

SEQ ID NO: 8076703 - DNA, 22 bp, Homo sapiens
attcagttactctagacacttc

SEQ ID NO: 8076704 - DNA, 22 bp, Homo sapiens
attcagttaagggtcttgagat

SEQ ID NO: 8076705 - DNA, 22 bp, Homo sapiens
attcagttagatcatcctaatt

SEQ ID NO: 8076706 - DNA, 22 bp, Homo sapiens
attcagttagccacagctattc

SEQ ID NO: 8076707 - DNA, 22 bp, Homo sapiens
attcagttccttgagggtatag

SEQ ID NO: 8076708 - DNA, 22 bp, Homo sapiens
attcagttatttactttgctat

SEQ ID NO: 8076709 - DNA, 22 bp, Homo sapiens
attcagttagtagatttggtca

SEQ ID NO: 8076710 - DNA, 22 bp, Homo sapiens
attcagttattcagagaaggga

SEQ ID NO: 8076711 - DNA, 22 bp, Homo sapiens
attccttgtttcactgaaaagg

SEQ ID NO: 8076712 - DNA, 21 bp, Homo sapiens
attctagacaacactgaaatc

SEQ ID NO: 8076713 - DNA, 22 bp, Homo sapiens
attctactgcttggaatatctt

SEQ ID NO: 8076714 - DNA, 22 bp, Homo sapiens
attctactcattgatctatata

SEQ ID NO: 8076715 - DNA, 22 bp, Homo sapiens
attctacacctctctcatttag

SEQ ID NO: 8076716 - DNA, 22 bp, Homo sapiens
tcaggtggcttcggggagtggc

SEQ ID NO: 8076717 - DNA, 22 bp, Homo sapiens
tcaggtgggacctgctaggaca

SEQ ID NO: 8076718 - DNA, 22 bp, Homo sapiens
tcaggtgggcgttccggtgcgg

SEQ ID NO: 8076719 - DNA, 21 bp, Homo sapiens
catcttaattgaaagcagaga

SEQ ID NO: 8076720 - DNA, 22 bp, Homo sapiens
catcttaacaggtctctgaggg

SEQ ID NO: 8076721 - DNA, 22 bp, Homo sapiens
catcttaaccctcagcctccca

SEQ ID NO: 8076722 - DNA, 17 bp, Homo sapiens
catcttaactatggact

SEQ ID NO: 8076723 - DNA, 22 bp, Homo sapiens
catcttaataaatctcctccct

SEQ ID NO: 8076724 - DNA, 22 bp, Homo sapiens
tcagtttaagatgactaacaat

SEQ ID NO: 8076725 - DNA, 22 bp, Homo sapiens
tcagttctgctagaaaaacagt

SEQ ID NO: 8076726 - DNA, 22 bp, Homo sapiens
catgatataaagtagtagataa

SEQ ID NO: 8076727 - DNA, 22 bp, Homo sapiens
catgatctggtcctactgtggg

SEQ ID NO: 8076728 - DNA, 22 bp, Homo sapiens
catgattatgtgttagagtttg

SEQ ID NO: 8076729 - DNA, 22 bp, Homo sapiens
tcatttgttgaactttagtgcg

SEQ ID NO: 8076730 - DNA, 22 bp, Homo sapiens
tccagccaggatggcccaggga

SEQ ID NO: 8076731 - DNA, 18 bp, Homo sapiens
tccagcccacattttctg

SEQ ID NO: 8076732 - DNA, 21 bp, Homo sapiens
tccagccagtaaatgctcagc

SEQ ID NO: 8076733 - DNA, 22 bp, Homo sapiens
catggcttagaagttccagccc

SEQ ID NO: 8076734 - DNA, 22 bp, Homo sapiens
catgatttactaaaatttgttt

SEQ ID NO: 8076735 - DNA, 22 bp, Homo sapiens
catgatttactaaaatttgttt

SEQ ID NO: 8076736 - DNA, 22 bp, Homo sapiens
tcatttttagcgcgcaaaagtt

SEQ ID NO: 8076737 - DNA, 22 bp, Homo sapiens
catatcaaagagaaggatagga

SEQ ID NO: 8076738 - DNA, 20 bp, Homo sapiens
catatatacctagaagtgga

SEQ ID NO: 8076739 - DNA, 22 bp, Homo sapiens
tcagggcattcaagaggcctgg

SEQ ID NO: 8076740 - DNA, 20 bp, Homo sapiens
tcagggcatgggacagcccc

SEQ ID NO: 8076741 - DNA, 22 bp, Homo sapiens
tcagggcatgtatgtttcttta

SEQ ID NO: 8076742 - DNA, 22 bp, Homo sapiens
tcagggcatggctgcacttggc

SEQ ID NO: 8076743 - DNA, 22 bp, Homo sapiens
cagtttatatgtcagagctgta

SEQ ID NO: 8076744 - DNA, 22 bp, Homo sapiens
cagtttctgttttaaatagcag

SEQ ID NO: 8076745 - DNA, 22 bp, Homo sapiens
cagtttcttcatctgcagaatc

SEQ ID NO: 8076746 - DNA, 22 bp, Homo sapiens
cagtttcttagtgacacaaatc

SEQ ID NO: 8076747 - DNA, 22 bp, Homo sapiens
cagtttcttagtgacacaaatc

SEQ ID NO: 8076748 - DNA, 22 bp, Homo sapiens
tcagccccacggggtcagccaa

SEQ ID NO: 8076749 - DNA, 22 bp, Homo sapiens
catactttttagatctgccttc

SEQ ID NO: 8076750 - DNA, 22 bp, Homo sapiens
catacattttgcatatttacca

SEQ ID NO: 8076751 - DNA, 22 bp, Homo sapiens
cataatttttttaagtcagaac

SEQ ID NO: 8076752 - DNA, 22 bp, Homo sapiens
tatggcttctcagtcatgaaaa

SEQ ID NO: 8076753 - DNA, 22 bp, Homo sapiens
tatggcttctgctttcttgact

SEQ ID NO: 8076754 - DNA, 22 bp, Homo sapiens
tatggcttccaggctggccagg

SEQ ID NO: 8076755 - DNA, 22 bp, Homo sapiens
tatggcttctataaggaagctt

SEQ ID NO: 8076756 - DNA, 23 bp, Homo sapiens
tatggcttacagtgctttaggta

SEQ ID NO: 8076757 - DNA, 22 bp, Homo sapiens
tatggcttaggagagtttaact

SEQ ID NO: 8076758 - DNA, 22 bp, Homo sapiens
tatggcttcattgtgctccgca

SEQ ID NO: 8076759 - DNA, 22 bp, Homo sapiens
tatggcttatgctgaacacctg

SEQ ID NO: 8076760 - DNA, 22 bp, Homo sapiens
tatggcatttagaaatgtcaga

SEQ ID NO: 8076761 - DNA, 22 bp, Homo sapiens
tatggcttaaaatttcagcatg

SEQ ID NO: 8076762 - DNA, 22 bp, Homo sapiens
tattggaaggaagcaagagagg

SEQ ID NO: 8076763 - DNA, 22 bp, Homo sapiens
tatgttttaggaattaattgtt

SEQ ID NO: 8076764 - DNA, 22 bp, Homo sapiens
tatgtgtacaaatcagtaagtg

SEQ ID NO: 8076765 - DNA, 22 bp, Homo sapiens
tataagtgacagattatccaaa

SEQ ID NO: 8076766 - DNA, 22 bp, Homo sapiens
tagttttagtcccattttacag

SEQ ID NO: 8076767 - DNA, 22 bp, Homo sapiens
caggggccggctgtccgtgccc

SEQ ID NO: 8076768 - DNA, 22 bp, Homo sapiens
caggggcctgtcctggcttctg

SEQ ID NO: 8076769 - DNA, 22 bp, Homo sapiens
tatacagatggaaagatacaca

SEQ ID NO: 8076770 - DNA, 22 bp, Homo sapiens
tatacagtgcctcttccattag

SEQ ID NO: 8076771 - DNA, 22 bp, Homo sapiens
tatacagattaacagatttaaa

SEQ ID NO: 8076772 - DNA, 22 bp, Homo sapiens
tatacagctatggcaagacaaa

SEQ ID NO: 8076773 - DNA, 21 bp, Homo sapiens
tatacagtaattaagtggtat

SEQ ID NO: 8076774 - DNA, 22 bp, Homo sapiens
cagtgatgtttctgcatcagag

SEQ ID NO: 8076775 - DNA, 22 bp, Homo sapiens
cagtctctaaatcaatctgaat

SEQ ID NO: 8076776 - DNA, 22 bp, Homo sapiens
cagtctcatagttgtttcttat

SEQ ID NO: 8076777 - DNA, 22 bp, Homo sapiens
cagtccttattcctatattcct

SEQ ID NO: 8076778 - DNA, 22 bp, Homo sapiens
cagtcctgtgttaaacaagagc

SEQ ID NO: 8076779 - DNA, 22 bp, Homo sapiens
cagtccttagattttactgcca

SEQ ID NO: 8076780 - DNA, 22 bp, Homo sapiens
cagtcctgtctttatgacttca

SEQ ID NO: 8076781 - DNA, 20 bp, Homo sapiens
cagtcctgtccctgctgccc

SEQ ID NO: 8076782 - DNA, 22 bp, Homo sapiens
cagtcctgtgtcccttggtggg

SEQ ID NO: 8076783 - DNA, 22 bp, Homo sapiens
cagtcctgggtgcagcaggaaa

SEQ ID NO: 8076784 - DNA, 22 bp, Homo sapiens
cagtcctggggaccaggctgag

SEQ ID NO: 8076785 - DNA, 20 bp, Homo sapiens
tatttacaacttagagcctc

SEQ ID NO: 8076786 - DNA, 19 bp, Homo sapiens
cagtgctgttcattcagtg

SEQ ID NO: 8076787 - DNA, 22 bp, Homo sapiens
cagtgctgtgtttgctgcctgg

SEQ ID NO: 8076788 - DNA, 22 bp, Homo sapiens
tcaccattggcaattataaaac

SEQ ID NO: 8076789 - DNA, 22 bp, Homo sapiens
tcaccaggctggagtgcagtgg

SEQ ID NO: 8076790 - DNA, 22 bp, Homo sapiens
tcaccaggctagagtgcagtgg

SEQ ID NO: 8076791 - DNA, 22 bp, Homo sapiens
cagtgctgttgtaagctcattg

SEQ ID NO: 8076792 - DNA, 22 bp, Homo sapiens
cagtgctggtgtaggctgacca

SEQ ID NO: 8076793 - DNA, 22 bp, Homo sapiens
cagtgctggaggggtgcttgca

SEQ ID NO: 8076794 - DNA, 22 bp, Homo sapiens
cagtgctgagagcctggccagg

SEQ ID NO: 8076795 - DNA, 22 bp, Homo sapiens
tcagaaatcttgtcaaggcatc

SEQ ID NO: 8076796 - DNA, 22 bp, Homo sapiens
tcagaaagtgaactgttgacat

SEQ ID NO: 8076797 - DNA, 22 bp, Homo sapiens
tcagaaaggttgagtcatgtgc

SEQ ID NO: 8076798 - DNA, 22 bp, Homo sapiens
ccagaggacttgggggctgaat

SEQ ID NO: 8076799 - DNA, 22 bp, Homo sapiens
tctccattttatagataatgaa

SEQ ID NO: 8076800 - DNA, 22 bp, Homo sapiens
ccagaggaattgggaaacatgt

SEQ ID NO: 8076801 - DNA, 22 bp, Homo sapiens
ccagacagcagttaaaggacat

SEQ ID NO: 8076802 - DNA, 22 bp, Homo sapiens
ccagaatagaatgaaagaaggg

SEQ ID NO: 8076803 - DNA, 22 bp, Homo sapiens
ccagaagaggacacagtgtgga

SEQ ID NO: 8076804 - DNA, 22 bp, Homo sapiens
ccagaagcaaaacagacagttt

SEQ ID NO: 8076805 - DNA, 22 bp, Homo sapiens
ccagaagcttctacacaggaga

SEQ ID NO: 8076806 - DNA, 21 bp, Homo sapiens
ccagaagctgcttgcaggcta

SEQ ID NO: 8076807 - DNA, 22 bp, Homo sapiens
ccactctgctgtgctccatgat

SEQ ID NO: 8076808 - DNA, 23 bp, Homo sapiens
ccacctggactctgggcaggtgc

SEQ ID NO: 8076809 - DNA, 18 bp, Homo sapiens
tcctggtggagaagtggt

SEQ ID NO: 8076810 - DNA, 22 bp, Homo sapiens
tcctggggagggttctggctcc

SEQ ID NO: 8076811 - DNA, 22 bp, Homo sapiens
tcctggtgaggctagaagtgtc

SEQ ID NO: 8076812 - DNA, 19 bp, Homo sapiens
catttagaagtacatatta

SEQ ID NO: 8076813 - DNA, 22 bp, Homo sapiens
catttagttatactaaaacatt

SEQ ID NO: 8076814 - DNA, 22 bp, Homo sapiens
tcccagggtcagtggtgaggcc

SEQ ID NO: 8076815 - DNA, 22 bp, Homo sapiens
tcccagggggatgaacactgcc

SEQ ID NO: 8076816 - DNA, 22 bp, Homo sapiens
tcccagggtatcctgtagtaaa

SEQ ID NO: 8076817 - DNA, 22 bp, Homo sapiens
tcccagggctctagagtgctgg

SEQ ID NO: 8076818 - DNA, 22 bp, Homo sapiens
tcccagggccgcaaacgagttt

SEQ ID NO: 8076819 - DNA, 22 bp, Homo sapiens
tcccagggcttttctcatgctt

SEQ ID NO: 8076820 - DNA, 22 bp, Homo sapiens
catttatataaaatgtccagaa

SEQ ID NO: 8076821 - DNA, 22 bp, Homo sapiens
tcccagggcagctgtccagaag

SEQ ID NO: 8076822 - DNA, 22 bp, Homo sapiens
tcccagggcactcaccctccct

SEQ ID NO: 8076823 - DNA, 21 bp, Homo sapiens
tcccagggccaggtgccatca

SEQ ID NO: 8076824 - DNA, 21 bp, Homo sapiens
ccaaatagcctccattaacag

SEQ ID NO: 8076825 - DNA, 22 bp, Homo sapiens
tcctccccaaagcccagcctgg

SEQ ID NO: 8076826 - DNA, 22 bp, Homo sapiens
ccacaaagttgctgagtttctg

SEQ ID NO: 8076827 - DNA, 22 bp, Homo sapiens
ccacaaagaatgggggaagcat

SEQ ID NO: 8076828 - DNA, 23 bp, Homo sapiens
ccaattcagatattggcttgtgc

SEQ ID NO: 8076829 - DNA, 22 bp, Homo sapiens
ccaattcacctcctatgcacat

SEQ ID NO: 8076830 - DNA, 22 bp, Homo sapiens
ccaattcacttccaaccccttc

SEQ ID NO: 8076831 - DNA, 23 bp, Homo sapiens
ccaattcatggcagatttgaaga

SEQ ID NO: 8076832 - DNA, 21 bp, Homo sapiens
ccacaattctagttacatatg

SEQ ID NO: 8076833 - DNA, 22 bp, Homo sapiens
ccacacagggggatgagttatt

SEQ ID NO: 8076834 - DNA, 22 bp, Homo sapiens
ccacagccattccagggaggct

SEQ ID NO: 8076835 - DNA, 22 bp, Homo sapiens
ccacagattatttctaaacagg

SEQ ID NO: 8076836 - DNA, 22 bp, Homo sapiens
tcctgccagcccacagactcat

SEQ ID NO: 8076837 - DNA, 22 bp, Homo sapiens
tcctgcccacagctgctggaca

SEQ ID NO: 8076838 - DNA, 22 bp, Homo sapiens
tctgcctgaaccactcttggag

SEQ ID NO: 8076839 - DNA, 22 bp, Homo sapiens
tctgctaacaatattgcagact

SEQ ID NO: 8076840 - DNA, 22 bp, Homo sapiens
tctgctaaatagatttggcaat

SEQ ID NO: 8076841 - DNA, 22 bp, Homo sapiens
ccagctgggtccctgctggggc

SEQ ID NO: 8076842 - DNA, 22 bp, Homo sapiens
tctgtcttggccagccatctgg

SEQ ID NO: 8076843 - DNA, 22 bp, Homo sapiens
ccagccccgggaacctggccgt

SEQ ID NO: 8076844 - DNA, 22 bp, Homo sapiens
ccagccactgggccactgccag

SEQ ID NO: 8076845 - DNA, 20 bp, Homo sapiens
tctcttggcttgggggacac

SEQ ID NO: 8076846 - DNA, 22 bp, Homo sapiens
tctctcttcagagataccttgc

SEQ ID NO: 8076847 - DNA, 22 bp, Homo sapiens
tctctcttcaacccttaactag

SEQ ID NO: 8076848 - DNA, 22 bp, Homo sapiens
tctctcttctttgttaagaatg

SEQ ID NO: 8076849 - DNA, 22 bp, Homo sapiens
tctctcttcatgcttttagaat

SEQ ID NO: 8076850 - DNA, 22 bp, Homo sapiens
tctctcttgtcaccccatctgc

SEQ ID NO: 8076851 - DNA, 22 bp, Homo sapiens
ccagctctcagcgggagactca

SEQ ID NO: 8076852 - DNA, 22 bp, Homo sapiens
ccagctctagccccatgtggct

SEQ ID NO: 8076853 - DNA, 22 bp, Homo sapiens
ccagctctcaaggctccctggg

SEQ ID NO: 8076854 - DNA, 22 bp, Homo sapiens
ccagctcctcttgtctctagca

SEQ ID NO: 8076855 - DNA, 22 bp, Homo sapiens
ccagcctggagggcagtggtgg

SEQ ID NO: 8076856 - DNA, 22 bp, Homo sapiens
ccagctcatctcagtgaaatgc

SEQ ID NO: 8076857 - DNA, 18 bp, Homo sapiens
gtttggcataactgatgc

SEQ ID NO: 8076858 - DNA, 19 bp, Homo sapiens
gtttggcagcaaatcagac

SEQ ID NO: 8076859 - DNA, 22 bp, Homo sapiens
gtttggaatagcagtaaacatt

SEQ ID NO: 8076860 - DNA, 21 bp, Homo sapiens
gtttggaacagaccctgggga

SEQ ID NO: 8076861 - DNA, 22 bp, Homo sapiens
gtttggaagttaagtgcagcag

SEQ ID NO: 8076862 - DNA, 22 bp, Homo sapiens
gtttggaatgagtcctgccatt

SEQ ID NO: 8076863 - DNA, 22 bp, Homo sapiens
caggaagcatctggctagctaa

SEQ ID NO: 8076864 - DNA, 22 bp, Homo sapiens
gtttgtaaccagaacagagagt

SEQ ID NO: 8076865 - DNA, 22 bp, Homo sapiens
caggaagctgagctgcactgca

SEQ ID NO: 8076866 - DNA, 22 bp, Homo sapiens
caggacaaagccctttgagaaa

SEQ ID NO: 8076867 - DNA, 22 bp, Homo sapiens
taaaatcaccaaaagcaggtgg

SEQ ID NO: 8076868 - DNA, 22 bp, Homo sapiens
taaaatcatgacagattgacat

SEQ ID NO: 8076869 - DNA, 22 bp, Homo sapiens
taaaaagttgaaaggacttatc

SEQ ID NO: 8076870 - DNA, 22 bp, Homo sapiens
taaaaagcagctgagattttct

SEQ ID NO: 8076871 - DNA, 22 bp, Homo sapiens
taaaaagtagtgagaatggcgc

SEQ ID NO: 8076872 - DNA, 22 bp, Homo sapiens
taaaccaagtgtccatattagt

SEQ ID NO: 8076873 - DNA, 18 bp, Homo sapiens
taaaccagatgacagttg

SEQ ID NO: 8076874 - DNA, 22 bp, Homo sapiens
taaaccaagtgtccatattagt

SEQ ID NO: 8076875 - DNA, 22 bp, Homo sapiens
taaactcttctgtagaatcaga

SEQ ID NO: 8076876 - DNA, 22 bp, Homo sapiens
taaactatctgtgtttgaagtt

SEQ ID NO: 8076877 - DNA, 22 bp, Homo sapiens
taaatgtgaccttcattttata

SEQ ID NO: 8076878 - DNA, 22 bp, Homo sapiens
taaagtccttgaaccggatgta

SEQ ID NO: 8076879 - DNA, 22 bp, Homo sapiens
taaagcatttttgaaattatga

SEQ ID NO: 8076880 - DNA, 22 bp, Homo sapiens
taaagcatgtttcagtaaggtt

SEQ ID NO: 8076881 - DNA, 22 bp, Homo sapiens
taaagcatgtgttagaagtgca

SEQ ID NO: 8076882 - DNA, 22 bp, Homo sapiens
taaagcatgtactgtgtgctag

SEQ ID NO: 8076883 - DNA, 22 bp, Homo sapiens
taaagcatgtttcagtaaggtt

SEQ ID NO: 8076884 - DNA, 22 bp, Homo sapiens
taaatatcagtccagctcttcc

SEQ ID NO: 8076885 - DNA, 22 bp, Homo sapiens
taaagcagtgcaaaagcgtttt

SEQ ID NO: 8076886 - DNA, 22 bp, Homo sapiens
taaagcataatgaatatctaga

SEQ ID NO: 8076887 - DNA, 22 bp, Homo sapiens
caggagatgtaagacttctgtt

SEQ ID NO: 8076888 - DNA, 22 bp, Homo sapiens
taacatttaaatttttcacata

SEQ ID NO: 8076889 - DNA, 22 bp, Homo sapiens
taacattgtcagttcaactgct

SEQ ID NO: 8076890 - DNA, 22 bp, Homo sapiens
caggatattacctaatatttga

SEQ ID NO: 8076891 - DNA, 22 bp, Homo sapiens
taacatttgctgtctcctatgt

SEQ ID NO: 8076892 - DNA, 22 bp, Homo sapiens
taacatttaaatttttcacata

SEQ ID NO: 8076893 - DNA, 22 bp, Homo sapiens
taagacacgggctgatctaaag

SEQ ID NO: 8076894 - DNA, 22 bp, Homo sapiens
taagattacagtgagaaataaa

SEQ ID NO: 8076895 - DNA, 22 bp, Homo sapiens
caggcagaaagtattctgtgta

SEQ ID NO: 8076896 - DNA, 22 bp, Homo sapiens
taattgtacgatgttaaatcag

SEQ ID NO: 8076897 - DNA, 22 bp, Homo sapiens
taatttactcagatgttcaatc

SEQ ID NO: 8076898 - DNA, 22 bp, Homo sapiens
taatttacttgcaaataacaat

SEQ ID NO: 8076899 - DNA, 22 bp, Homo sapiens
taattgtgggaaggcttttaat

SEQ ID NO: 8076900 - DNA, 22 bp, Homo sapiens
taattgtcctcggtccaaatga

SEQ ID NO: 8076901 - DNA, 22 bp, Homo sapiens
taattgtatggagaaggctgca

SEQ ID NO: 8076902 - DNA, 22 bp, Homo sapiens
caggcagaaggaagtaccaggc

SEQ ID NO: 8076903 - DNA, 17 bp, Homo sapiens
caggcagacatgtaagc

SEQ ID NO: 8076904 - DNA, 22 bp, Homo sapiens
tacagtaacatgttgtacaagc

SEQ ID NO: 8076905 - DNA, 22 bp, Homo sapiens
tacaggttacacttttaaaagt

SEQ ID NO: 8076906 - DNA, 22 bp, Homo sapiens
tacagtaaagctgctatgaatt

SEQ ID NO: 8076907 - DNA, 22 bp, Homo sapiens
tacatatttgtctttgtactgt

SEQ ID NO: 8076908 - DNA, 22 bp, Homo sapiens
tacagtttgttacattgttagt

SEQ ID NO: 8076909 - DNA, 22 bp, Homo sapiens
tacaaatgggttaaaatatagt

SEQ ID NO: 8076910 - DNA, 22 bp, Homo sapiens
tacaaactccgaagtttgtacc

SEQ ID NO: 8076911 - DNA, 22 bp, Homo sapiens
tacaagtttcaaagagatcatg

SEQ ID NO: 8076912 - DNA, 21 bp, Homo sapiens
tacaagttgcttttgaagtcc

SEQ ID NO: 8076913 - DNA, 22 bp, Homo sapiens
cagctctggcagagcccaaccc

SEQ ID NO: 8076914 - DNA, 22 bp, Homo sapiens
cagctctggctttggggagctt

SEQ ID NO: 8076915 - DNA, 20 bp, Homo sapiens
gtggcctgtcctgttgtggg

SEQ ID NO: 8076916 - DNA, 22 bp, Homo sapiens
cagctcttggagcctccagtaa

SEQ ID NO: 8076917 - DNA, 22 bp, Homo sapiens
gtggcgagtgcagcagatgcag

SEQ ID NO: 8076918 - DNA, 22 bp, Homo sapiens
gtggctttcatttcaggatgtg

SEQ ID NO: 8076919 - DNA, 22 bp, Homo sapiens
gtggctttataggaagaggaac

SEQ ID NO: 8076920 - DNA, 22 bp, Homo sapiens
gtggctttgtttccaaatgaaa

SEQ ID NO: 8076921 - DNA, 22 bp, Homo sapiens
gtggctttggaattgtagactc

SEQ ID NO: 8076922 - DNA, 22 bp, Homo sapiens
gtgggcaggccccaaagcaggg

SEQ ID NO: 8076923 - DNA, 22 bp, Homo sapiens
gtgggcaggagtgagcaacagg

SEQ ID NO: 8076924 - DNA, 22 bp, Homo sapiens
gtgggcaggccctaggcgattt

SEQ ID NO: 8076925 - DNA, 22 bp, Homo sapiens
gtgggcaggtaggcaccagcta

SEQ ID NO: 8076926 - DNA, 22 bp, Homo sapiens
gtgggcagggttgctttctccg

SEQ ID NO: 8076927 - DNA, 22 bp, Homo sapiens
gtgggcagtcatgaaatctaga

SEQ ID NO: 8076928 - DNA, 22 bp, Homo sapiens
gtgggcagtgcctgacggatga

SEQ ID NO: 8076929 - DNA, 22 bp, Homo sapiens
gtgggcagtggggtcttctgcc

SEQ ID NO: 8076930 - DNA, 22 bp, Homo sapiens
cagctggctccacctctgggct

SEQ ID NO: 8076931 - DNA, 22 bp, Homo sapiens
cagctgctctggtggtctctcc

SEQ ID NO: 8076932 - DNA, 22 bp, Homo sapiens
cagctgctgaggaaggggttgg

SEQ ID NO: 8076933 - DNA, 22 bp, Homo sapiens
cagctgctcttctggcctgtca

SEQ ID NO: 8076934 - DNA, 22 bp, Homo sapiens
cagctgcttactagctgtgtga

SEQ ID NO: 8076935 - DNA, 22 bp, Homo sapiens
cagctgctggctccgggctaag

SEQ ID NO: 8076936 - DNA, 22 bp, Homo sapiens
cagctgctgcccttggctgcag

SEQ ID NO: 8076937 - DNA, 22 bp, Homo sapiens
gtgtctttattcctctatgttt

SEQ ID NO: 8076938 - DNA, 22 bp, Homo sapiens
cagctgtctaagttgagcagga

SEQ ID NO: 8076939 - DNA, 22 bp, Homo sapiens
cagctggctgcggtgaggggac

SEQ ID NO: 8076940 - DNA, 20 bp, Homo sapiens
gtgtgtgctccatgcatgct

SEQ ID NO: 8076941 - DNA, 22 bp, Homo sapiens
gtgtgtgccaactttatgtgca

SEQ ID NO: 8076942 - DNA, 22 bp, Homo sapiens
gtgtgtgcaagaggtttattga

SEQ ID NO: 8076943 - DNA, 22 bp, Homo sapiens
gttaaacaataactggcacaca

SEQ ID NO: 8076944 - DNA, 22 bp, Homo sapiens
gttaaagaagaatagttccttt

SEQ ID NO: 8076945 - DNA, 22 bp, Homo sapiens
gttaaagagtttggctttcttc

SEQ ID NO: 8076946 - DNA, 22 bp, Homo sapiens
gttaaagagtttggctttcttc

SEQ ID NO: 8076947 - DNA, 22 bp, Homo sapiens
cagctttctttccataaggttt

SEQ ID NO: 8076948 - DNA, 22 bp, Homo sapiens
cagctttacctttaggagtaac

SEQ ID NO: 8076949 - DNA, 22 bp, Homo sapiens
cagcttctatttatctttgtgt

SEQ ID NO: 8076950 - DNA, 22 bp, Homo sapiens
gttattatttctctccttgcta

SEQ ID NO: 8076951 - DNA, 22 bp, Homo sapiens
gtttcctttaatagtgatattg

SEQ ID NO: 8076952 - DNA, 21 bp, Homo sapiens
gtttacaaggctttgctcctg

SEQ ID NO: 8076953 - DNA, 22 bp, Homo sapiens
gtttacaacatgccaactgggc

SEQ ID NO: 8076954 - DNA, 22 bp, Homo sapiens
gtttacaacatcttgtccttca

SEQ ID NO: 8076955 - DNA, 22 bp, Homo sapiens
gtttacatgcatgcaagaatga

SEQ ID NO: 8076956 - DNA, 22 bp, Homo sapiens
gtttacatgcagaaaatcaatg

SEQ ID NO: 8076957 - DNA, 22 bp, Homo sapiens
caggaacaatcttactactatt

SEQ ID NO: 8076958 - DNA, 22 bp, Homo sapiens
caggaaatggctgaataaattc

SEQ ID NO: 8076959 - DNA, 22 bp, Homo sapiens
gttcttaaagattcatcaagca

SEQ ID NO: 8076960 - DNA, 22 bp, Homo sapiens
tgtcatggacagattagatgag

SEQ ID NO: 8076961 - DNA, 22 bp, Homo sapiens
tgtcatggactggatttctgct

SEQ ID NO: 8076962 - DNA, 22 bp, Homo sapiens
tgtcatggagcttatattccag

SEQ ID NO: 8076963 - DNA, 17 bp, Homo sapiens
tgtcatggctatggttg

SEQ ID NO: 8076964 - DNA, 22 bp, Homo sapiens
tgtcatggtatttgtgagctgc

SEQ ID NO: 8076965 - DNA, 22 bp, Homo sapiens
tgtcatgggtctaaacattgat

SEQ ID NO: 8076966 - DNA, 22 bp, Homo sapiens
tgtcatggtgctatttaattag

SEQ ID NO: 8076967 - DNA, 22 bp, Homo sapiens
tgtcatgtggcaattaaagcag

SEQ ID NO: 8076968 - DNA, 22 bp, Homo sapiens
tgtatgtatgcatcttttatgt

SEQ ID NO: 8076969 - DNA, 22 bp, Homo sapiens
tgtaaacatgctgaggctggag

SEQ ID NO: 8076970 - DNA, 22 bp, Homo sapiens
tgtaaactgcttctcaccaagg

SEQ ID NO: 8076971 - DNA, 22 bp, Homo sapiens
tgtaaactgagggtagctgatt

SEQ ID NO: 8076972 - DNA, 22 bp, Homo sapiens
tgtaaactgtagaaaatacttt

SEQ ID NO: 8076973 - DNA, 22 bp, Homo sapiens
tgtaaacttttgcatactgctt

SEQ ID NO: 8076974 - DNA, 22 bp, Homo sapiens
tgtcccagatcacaggagggga

SEQ ID NO: 8076975 - DNA, 23 bp, Homo sapiens
tgtcccagagggagggataggct

SEQ ID NO: 8076976 - DNA, 22 bp, Homo sapiens
tgtcccagatactggacataga

SEQ ID NO: 8076977 - DNA, 22 bp, Homo sapiens
tgtcccagacataagtggacat

SEQ ID NO: 8076978 - DNA, 22 bp, Homo sapiens
tgtcccagcactttgggagtct

SEQ ID NO: 8076979 - DNA, 22 bp, Homo sapiens
cctggctcctgcctctgcaggg

SEQ ID NO: 8076980 - DNA, 22 bp, Homo sapiens
cctggctccctgcacagggctc

SEQ ID NO: 8076981 - DNA, 22 bp, Homo sapiens
cctggctcgctgacctcagggg

SEQ ID NO: 8076982 - DNA, 22 bp, Homo sapiens
cctggctctagaggccactcct

SEQ ID NO: 8076983 - DNA, 22 bp, Homo sapiens
cctggcctcagcctagggctga

SEQ ID NO: 8076984 - DNA, 22 bp, Homo sapiens
cctggcctgctcggctcttaag

SEQ ID NO: 8076985 - DNA, 22 bp, Homo sapiens
cctggctcccccatcatagctg

SEQ ID NO: 8076986 - DNA, 22 bp, Homo sapiens
cctggctcccggaacagggtct

SEQ ID NO: 8076987 - DNA, 22 bp, Homo sapiens
tgtctcttactttgattcttgg

SEQ ID NO: 8076988 - DNA, 22 bp, Homo sapiens
tgtcctgcaattaaggaagaca

SEQ ID NO: 8076989 - DNA, 22 bp, Homo sapiens
tgtcctgcccaaggtcacatac

SEQ ID NO: 8076990 - DNA, 22 bp, Homo sapiens
tgtcctgccagcccggactgtg

SEQ ID NO: 8076991 - DNA, 22 bp, Homo sapiens
tgtcctgcaggctcataggctc

SEQ ID NO: 8076992 - DNA, 22 bp, Homo sapiens
tgtcctgcggactatcaggctt

SEQ ID NO: 8076993 - DNA, 19 bp, Homo sapiens
tgtcctgctcgtgaaattc

SEQ ID NO: 8076994 - DNA, 19 bp, Homo sapiens
cctggctctgagcccagcc

SEQ ID NO: 8076995 - DNA, 22 bp, Homo sapiens
cctggctcttctgtgtcagccc

SEQ ID NO: 8076996 - DNA, 22 bp, Homo sapiens
cctggctgaacaaagtccctcc

SEQ ID NO: 8076997 - DNA, 22 bp, Homo sapiens
cctggctgagggacctcgggta

SEQ ID NO: 8076998 - DNA, 22 bp, Homo sapiens
tgtctttacttagaagttcagg

SEQ ID NO: 8076999 - DNA, 20 bp, Homo sapiens
cctggctgcattcaggacgg

SEQ ID NO: 8077000 - DNA, 22 bp, Homo sapiens
tgtgaggataaaaaggaaggag

SEQ ID NO: 8077001 - DNA, 22 bp, Homo sapiens
tgtgaagcatagattctgtaga

SEQ ID NO: 8077002 - DNA, 22 bp, Homo sapiens
tgtctttctatctctagattta

SEQ ID NO: 8077003 - DNA, 22 bp, Homo sapiens
cctggctgcattttgctggatg

SEQ ID NO: 8077004 - DNA, 22 bp, Homo sapiens
cctggctgtggcggtgctctca

SEQ ID NO: 8077005 - DNA, 22 bp, Homo sapiens
cctgggagccgactgactgtgc

SEQ ID NO: 8077006 - DNA, 22 bp, Homo sapiens
cctgggagagtctgtggtctcc

SEQ ID NO: 8077007 - DNA, 22 bp, Homo sapiens
cctgggagagccatctgtggcc

SEQ ID NO: 8077008 - DNA, 22 bp, Homo sapiens
tgtgcttactttgaattatata

SEQ ID NO: 8077009 - DNA, 19 bp, Homo sapiens
tgtgcttatgtttagatat

SEQ ID NO: 8077010 - DNA, 22 bp, Homo sapiens
tgtgttcattagcattgccttg

SEQ ID NO: 8077011 - DNA, 19 bp, Homo sapiens
cctgggcctccatcacccc

SEQ ID NO: 8077012 - DNA, 22 bp, Homo sapiens
cctgggaggcagaggttgcagt

SEQ ID NO: 8077013 - DNA, 22 bp, Homo sapiens
tgtggcagggatactgaggcag

SEQ ID NO: 8077014 - DNA, 20 bp, Homo sapiens
tgtggcaggatgagggcgga

SEQ ID NO: 8077015 - DNA, 22 bp, Homo sapiens
tgtggcaggatgcggaagatgc

SEQ ID NO: 8077016 - DNA, 22 bp, Homo sapiens
tgtggcaggcattctgaggctg

SEQ ID NO: 8077017 - DNA, 22 bp, Homo sapiens
tgtggcaggaagagcttctgag

SEQ ID NO: 8077018 - DNA, 22 bp, Homo sapiens
cctgggaggcggaggttgcagt

SEQ ID NO: 8077019 - DNA, 22 bp, Homo sapiens
cctgggaggcggaggttgcagg

SEQ ID NO: 8077020 - DNA, 22 bp, Homo sapiens
cccagcctgtgacagccgtcct

SEQ ID NO: 8077021 - DNA, 22 bp, Homo sapiens
tgcagggaggccccgcagccct

SEQ ID NO: 8077022 - DNA, 22 bp, Homo sapiens
tgcagggagctctggggtgcag

SEQ ID NO: 8077023 - DNA, 22 bp, Homo sapiens
tgcagggaatctgtggctggac

SEQ ID NO: 8077024 - DNA, 22 bp, Homo sapiens
tgcagggaatgcttgcagcatg

SEQ ID NO: 8077025 - DNA, 22 bp, Homo sapiens
cccaggaggttgaggctgcagt

SEQ ID NO: 8077026 - DNA, 22 bp, Homo sapiens
cccaggaggtggaggctgcagt

SEQ ID NO: 8077027 - DNA, 22 bp, Homo sapiens
tgccaagtgcttacttggccct

SEQ ID NO: 8077028 - DNA, 22 bp, Homo sapiens
cccagggatgtggcagatgtta

SEQ ID NO: 8077029 - DNA, 22 bp, Homo sapiens
cccagggaggcccaggctctgc

SEQ ID NO: 8077030 - DNA, 22 bp, Homo sapiens
tgctgaatgggatatgttgagc

SEQ ID NO: 8077031 - DNA, 22 bp, Homo sapiens
tgctgaattaaactctatgtgg

SEQ ID NO: 8077032 - DNA, 21 bp, Homo sapiens
tgctgaatctgccatattttc

SEQ ID NO: 8077033 - DNA, 22 bp, Homo sapiens
tgctgaatgctgcatgccgtat

SEQ ID NO: 8077034 - DNA, 22 bp, Homo sapiens
ccccaggcctgttggatggcgc

SEQ ID NO: 8077035 - DNA, 22 bp, Homo sapiens
cccccagtctgaacagcagctg

SEQ ID NO: 8077036 - DNA, 22 bp, Homo sapiens
cccccagccagcagtgctcagc

SEQ ID NO: 8077037 - DNA, 22 bp, Homo sapiens
ccccagggaagctttgcttact

SEQ ID NO: 8077038 - DNA, 22 bp, Homo sapiens
cccccaccgtgttcctgctcgg

SEQ ID NO: 8077039 - DNA, 19 bp, Homo sapiens
ccctcaggtctgagcagtc

SEQ ID NO: 8077040 - DNA, 22 bp, Homo sapiens
ccctcaggatgcagtggaagtg

SEQ ID NO: 8077041 - DNA, 22 bp, Homo sapiens
tggcagcacggcatccactctc

SEQ ID NO: 8077042 - DNA, 22 bp, Homo sapiens
tggcagcactaggtactgagct

SEQ ID NO: 8077043 - DNA, 22 bp, Homo sapiens
tggcagcacattgacccgggct

SEQ ID NO: 8077044 - DNA, 22 bp, Homo sapiens
tggcagcaccagcagtgtcctt

SEQ ID NO: 8077045 - DNA, 21 bp, Homo sapiens
tggcagcacccacaccctctg

SEQ ID NO: 8077046 - DNA, 22 bp, Homo sapiens
tggcagcacaaggtggcccatg

SEQ ID NO: 8077047 - DNA, 22 bp, Homo sapiens
tggcagcaatttgtgatgttga

SEQ ID NO: 8077048 - DNA, 22 bp, Homo sapiens
tggcagattctggttgatactt

SEQ ID NO: 8077049 - DNA, 22 bp, Homo sapiens
tggcagcaaaaccagaatcaga

SEQ ID NO: 8077050 - DNA, 22 bp, Homo sapiens
tggcagcaagttcttgggaggt

SEQ ID NO: 8077051 - DNA, 22 bp, Homo sapiens
tggcagcaattagctagagctg

SEQ ID NO: 8077052 - DNA, 22 bp, Homo sapiens
tggcagcaatagaaatataatc

SEQ ID NO: 8077053 - DNA, 20 bp, Homo sapiens
cctatcagactttttaaata

SEQ ID NO: 8077054 - DNA, 22 bp, Homo sapiens
tggctgctactgagggggtctg

SEQ ID NO: 8077055 - DNA, 22 bp, Homo sapiens
cctctgggtgggaggccgggcg

SEQ ID NO: 8077056 - DNA, 22 bp, Homo sapiens
tggcccgaagatccgagggtca

SEQ ID NO: 8077057 - DNA, 22 bp, Homo sapiens
cctatggtgttggaactgatca

SEQ ID NO: 8077058 - DNA, 22 bp, Homo sapiens
cctcggctgggccttggccact

SEQ ID NO: 8077059 - DNA, 22 bp, Homo sapiens
ctggcagtgcccagtcactgtt

SEQ ID NO: 8077060 - DNA, 22 bp, Homo sapiens
ctggcagtggggcctcagtgtt

SEQ ID NO: 8077061 - DNA, 22 bp, Homo sapiens
ctggctctaagtgtcagctccc

SEQ ID NO: 8077062 - DNA, 22 bp, Homo sapiens
ctggctctgaccgcgctggcct

SEQ ID NO: 8077063 - DNA, 22 bp, Homo sapiens
ctggctctcgctgggagtactt

SEQ ID NO: 8077064 - DNA, 22 bp, Homo sapiens
ctggcctgggagctgctagcgt

SEQ ID NO: 8077065 - DNA, 22 bp, Homo sapiens
ctggcctggcgcagtggctcac

SEQ ID NO: 8077066 - DNA, 22 bp, Homo sapiens
ctggcctgaggccgccttcaga

SEQ ID NO: 8077067 - DNA, 22 bp, Homo sapiens
ctggcctgatctcatgctgtcc

SEQ ID NO: 8077068 - DNA, 22 bp, Homo sapiens
ctggcctgctgggtgaggtcct

SEQ ID NO: 8077069 - DNA, 22 bp, Homo sapiens
ctggcctgcagatcccagggtc

SEQ ID NO: 8077070 - DNA, 22 bp, Homo sapiens
ctggcctggagcctctgggtgg

SEQ ID NO: 8077071 - DNA, 22 bp, Homo sapiens
ctggcccagagagcagagctta

SEQ ID NO: 8077072 - DNA, 22 bp, Homo sapiens
ctggcccaggctcctggggcac

SEQ ID NO: 8077073 - DNA, 20 bp, Homo sapiens
ctggcccaggatgatggcgc

SEQ ID NO: 8077074 - DNA, 22 bp, Homo sapiens
ctggcccaggagagcaggcatt

SEQ ID NO: 8077075 - DNA, 22 bp, Homo sapiens
ctggacactggggatgcgcagt

SEQ ID NO: 8077076 - DNA, 22 bp, Homo sapiens
ctggacacactggagtctggca

SEQ ID NO: 8077077 - DNA, 22 bp, Homo sapiens
ctgctttgcatagctgccagag

SEQ ID NO: 8077078 - DNA, 22 bp, Homo sapiens
ctgcctggaccggcagccctcc

SEQ ID NO: 8077079 - DNA, 22 bp, Homo sapiens
ctgcctggaatgccagcttctc

SEQ ID NO: 8077080 - DNA, 22 bp, Homo sapiens
ctgcctggcatagtctggtcga

SEQ ID NO: 8077081 - DNA, 22 bp, Homo sapiens
ctgcctgggccatgcccagtcc

SEQ ID NO: 8077082 - DNA, 22 bp, Homo sapiens
ctgcctggctaaactcaagtcg

SEQ ID NO: 8077083 - DNA, 19 bp, Homo sapiens
tttgtgaagaaaatgatgc

SEQ ID NO: 8077084 - DNA, 22 bp, Homo sapiens
tttgtgaacttaggcaattagg

SEQ ID NO: 8077085 - DNA, 22 bp, Homo sapiens
tttgtacatcctaattctgagt

SEQ ID NO: 8077086 - DNA, 22 bp, Homo sapiens
tttgtcttggcctcagttttct

SEQ ID NO: 8077087 - DNA, 22 bp, Homo sapiens
ctctgggcaggacgccaggcct

SEQ ID NO: 8077088 - DNA, 22 bp, Homo sapiens
tttttaatgcagtctgagacat

SEQ ID NO: 8077089 - DNA, 22 bp, Homo sapiens
tttttaagagtctggaaatagt

SEQ ID NO: 8077090 - DNA, 22 bp, Homo sapiens
tttttaagctcctttgatgtca

SEQ ID NO: 8077091 - DNA, 22 bp, Homo sapiens
tttttaacctaccttaagagca

SEQ ID NO: 8077092 - DNA, 22 bp, Homo sapiens
ctctttttcacctctgtcagcg

SEQ ID NO: 8077093 - DNA, 22 bp, Homo sapiens
ctctttttcagccttaccaaag

SEQ ID NO: 8077094 - DNA, 22 bp, Homo sapiens
ctctttttcagccttaccaaag

SEQ ID NO: 8077095 - DNA, 22 bp, Homo sapiens
ctcttttagagatgaaaattgg

SEQ ID NO: 8077096 - DNA, 22 bp, Homo sapiens
ctcttttcaaacctgtttatgg

SEQ ID NO: 8077097 - DNA, 22 bp, Homo sapiens
ctcttttaattgtcataacaac

SEQ ID NO: 8077098 - DNA, 22 bp, Homo sapiens
tttttaatgcagtctgagacat

SEQ ID NO: 8077099 - DNA, 19 bp, Homo sapiens
tttttaatgggctggagca

SEQ ID NO: 8077100 - DNA, 22 bp, Homo sapiens
ctgccatgtagtctatggggcg

SEQ ID NO: 8077101 - DNA, 22 bp, Homo sapiens
ctgccatggtgtcccttttgca

SEQ ID NO: 8077102 - DNA, 22 bp, Homo sapiens
ctgccatgctcttttatgaaga

SEQ ID NO: 8077103 - DNA, 20 bp, Homo sapiens
ctgccatgattgatagagtg

SEQ ID NO: 8077104 - DNA, 22 bp, Homo sapiens
ctgcagcaagagaagtgctgac

SEQ ID NO: 8077105 - DNA, 22 bp, Homo sapiens
ctgcagcagtgtgtctcatttt

SEQ ID NO: 8077106 - DNA, 22 bp, Homo sapiens
ctgcagcatgacttatgtctgg

SEQ ID NO: 8077107 - DNA, 21 bp, Homo sapiens
ctgattgattgtcctgactct

SEQ ID NO: 8077108 - DNA, 22 bp, Homo sapiens
ctgatttacatatacaaaagat

SEQ ID NO: 8077109 - DNA, 22 bp, Homo sapiens
ctgcagaaatatggatgtgata

SEQ ID NO: 8077110 - DNA, 22 bp, Homo sapiens
ctgatgcctctcttcttggctt

SEQ ID NO: 8077111 - DNA, 22 bp, Homo sapiens
ctgatctgtcctcctcagagcc

SEQ ID NO: 8077112 - DNA, 20 bp, Homo sapiens
ttccttttcgcctctctccc

SEQ ID NO: 8077113 - DNA, 22 bp, Homo sapiens
ttccttttgcaaggtcctctag

SEQ ID NO: 8077114 - DNA, 22 bp, Homo sapiens
ttcctttcccttgcttctgtgc

SEQ ID NO: 8077115 - DNA, 22 bp, Homo sapiens
ttcctttgggaaatcactaagg

SEQ ID NO: 8077116 - DNA, 22 bp, Homo sapiens
ttcctttccctcacagcctcgg

SEQ ID NO: 8077117 - DNA, 22 bp, Homo sapiens
ttcttcctcacactctcaccca

SEQ ID NO: 8077118 - DNA, 22 bp, Homo sapiens
ttcttggagataaattcttaca

SEQ ID NO: 8077119 - DNA, 22 bp, Homo sapiens
ctattttaacttgattacctct

SEQ ID NO: 8077120 - DNA, 22 bp, Homo sapiens
ctattttaacttgattacctct

SEQ ID NO: 8077121 - DNA, 22 bp, Homo sapiens
ctagggagggatgttggcatga

SEQ ID NO: 8077122 - DNA, 22 bp, Homo sapiens
ctcagaggggatgcaatcttgc

SEQ ID NO: 8077123 - DNA, 22 bp, Homo sapiens
ctatttttctgtaccctaattt

SEQ ID NO: 8077124 - DNA, 22 bp, Homo sapiens
ttcttgtatataaaaatcattt

SEQ ID NO: 8077125 - DNA, 22 bp, Homo sapiens
ttctttaaaatagtgagaaaga

SEQ ID NO: 8077126 - DNA, 22 bp, Homo sapiens
ttcttgtttattaagatataaa

SEQ ID NO: 8077127 - DNA, 22 bp, Homo sapiens
ctattttaagaggccattaggt

SEQ ID NO: 8077128 - DNA, 22 bp, Homo sapiens
ctattttaagaggccattaggt

SEQ ID NO: 8077129 - DNA, 22 bp, Homo sapiens
ctattttctgtctctatagagt

SEQ ID NO: 8077130 - DNA, 22 bp, Homo sapiens
ttgactagaattatttaatcga

SEQ ID NO: 8077131 - DNA, 22 bp, Homo sapiens
ttgactttatgtgtatgtttac

SEQ ID NO: 8077132 - DNA, 22 bp, Homo sapiens
ttgactttaaagctttgtctct

SEQ ID NO: 8077133 - DNA, 22 bp, Homo sapiens
ttgacttttcttggtcacatga

SEQ ID NO: 8077134 - DNA, 19 bp, Homo sapiens
ttcattctcttattgttgt

SEQ ID NO: 8077135 - DNA, 22 bp, Homo sapiens
ttcattctgcagttctcagctc

SEQ ID NO: 8077136 - DNA, 22 bp, Homo sapiens
ttcagaaaggataattggaagg

SEQ ID NO: 8077137 - DNA, 22 bp, Homo sapiens
ttcagaaaaaacttcaataagt

SEQ ID NO: 8077138 - DNA, 22 bp, Homo sapiens
ttccaaatgttggacaactgta

SEQ ID NO: 8077139 - DNA, 22 bp, Homo sapiens
ttcccacagttcagaacaaagg

SEQ ID NO: 8077140 - DNA, 22 bp, Homo sapiens
ctaagaaaatagaagcatgcta

SEQ ID NO: 8077141 - DNA, 22 bp, Homo sapiens
ctacaaaagtaattgtggtttt

SEQ ID NO: 8077142 - DNA, 22 bp, Homo sapiens
ctaaggcttggcttaattaatt

SEQ ID NO: 8077143 - DNA, 19 bp, Homo sapiens
ctctccagctccagtagct

SEQ ID NO: 8077144 - DNA, 22 bp, Homo sapiens
tttcagttagctgagacccagg

SEQ ID NO: 8077145 - DNA, 22 bp, Homo sapiens
tttcagttcacctgggaacccg

SEQ ID NO: 8077146 - DNA, 20 bp, Homo sapiens
tttcagttatcttgaccttc

SEQ ID NO: 8077147 - DNA, 22 bp, Homo sapiens
tttcagttcagtttattatatc

SEQ ID NO: 8077148 - DNA, 22 bp, Homo sapiens
tttcagttcagtttattatatc

SEQ ID NO: 8077149 - DNA, 22 bp, Homo sapiens
tttcagttactgctatatcatt

SEQ ID NO: 8077150 - DNA, 22 bp, Homo sapiens
tttcagttaagtggctagtccc

SEQ ID NO: 8077151 - DNA, 22 bp, Homo sapiens
tttcagtttaagtaactgctat

SEQ ID NO: 8077152 - DNA, 22 bp, Homo sapiens
tttcagttgtgccggcccctct

SEQ ID NO: 8077153 - DNA, 22 bp, Homo sapiens
tttcagttgttttagctctgtg

SEQ ID NO: 8077154 - DNA, 22 bp, Homo sapiens
tttcagttgtcctgttaatagc

SEQ ID NO: 8077155 - DNA, 20 bp, Homo sapiens
tttcagttggttaatggcat

SEQ ID NO: 8077156 - DNA, 23 bp, Homo sapiens
tttcagttccagaaaaggggagc

SEQ ID NO: 8077157 - DNA, 23 bp, Homo sapiens
tttcagttgagaatgcacggacc

SEQ ID NO: 8077158 - DNA, 22 bp, Homo sapiens
tttcagttctgtacaagtccag

SEQ ID NO: 8077159 - DNA, 22 bp, Homo sapiens
tttcagttcatgtattccgagt

SEQ ID NO: 8077160 - DNA, 22 bp, Homo sapiens
tttcagttcatctgtgaagatt

SEQ ID NO: 8077161 - DNA, 22 bp, Homo sapiens
tttcagttgccaagctaattct

SEQ ID NO: 8077162 - DNA, 22 bp, Homo sapiens
tttcagttgattgcttgggtta

SEQ ID NO: 8077163 - DNA, 22 bp, Homo sapiens
tttcagttgcagtggttgtcta

SEQ ID NO: 8077164 - DNA, 22 bp, Homo sapiens
tttagacacactttgtatattt

SEQ ID NO: 8077165 - DNA, 22 bp, Homo sapiens
tttagacaggggcaaaataagg

SEQ ID NO: 8077166 - DNA, 22 bp, Homo sapiens
tttacatgtaatgttatacaaa

SEQ ID NO: 8077167 - DNA, 22 bp, Homo sapiens
tttaacagatgctatgtctacc

SEQ ID NO: 8077168 - DNA, 22 bp, Homo sapiens
tttacacatacctctttaaagt

SEQ ID NO: 8077169 - DNA, 22 bp, Homo sapiens
tttaacagatgctatgtctacc

SEQ ID NO: 8077170 - DNA, 22 bp, Homo sapiens
tttacacatacctctttaaagt

SEQ ID NO: 8077171 - DNA, 22 bp, Homo sapiens
tttacagttaagaaatgttacc

SEQ ID NO: 8077172 - DNA, 22 bp, Homo sapiens
tttacatgagtagcagatgttc

SEQ ID NO: 8077173 - DNA, 22 bp, Homo sapiens
tttaaatttagaagaaacactg

SEQ ID NO: 8077174 - DNA, 22 bp, Homo sapiens
tttaaattatagttaatgtctg

SEQ ID NO: 8077175 - DNA, 22 bp, Homo sapiens
tttaaaaggggtattaagtcca

SEQ ID NO: 8077176 - DNA, 22 bp, Homo sapiens
tttaaaaccaaagaaagcctct

SEQ ID NO: 8077177 - DNA, 22 bp, Homo sapiens
ctcatcagaaatacctgacaaa

SEQ ID NO: 8077178 - DNA, 22 bp, Homo sapiens
ttggccacactcactagagccc

SEQ ID NO: 8077179 - DNA, 22 bp, Homo sapiens
ttgggcagcattgcagttccct

SEQ ID NO: 8077180 - DNA, 22 bp, Homo sapiens
ttgggcaggaacagatgcttga

SEQ ID NO: 8077181 - DNA, 22 bp, Homo sapiens
ttgggcaggctggcagactgct

SEQ ID NO: 8077182 - DNA, 23 bp, Homo sapiens
ttgggcaggagagtaatgtgatc

SEQ ID NO: 8077183 - DNA, 22 bp, Homo sapiens
ttgggcaggcacatagagttta

SEQ ID NO: 8077184 - DNA, 22 bp, Homo sapiens
ttgggcaggatgacaccacttg

SEQ ID NO: 8077185 - DNA, 22 bp, Homo sapiens
ttgggcagaggccaggaggatg

SEQ ID NO: 8077186 - DNA, 22 bp, Homo sapiens
ttgggcagatgtttcctgtgga

SEQ ID NO: 8077187 - DNA, 22 bp, Homo sapiens
ttgggcagaggctgtgcagagg

SEQ ID NO: 8077188 - DNA, 22 bp, Homo sapiens
ttggaaaacttacacagagctg

SEQ ID NO: 8077189 - DNA, 22 bp, Homo sapiens
ttgcttttaatctttgtacatc

SEQ ID NO: 8077190 - DNA, 22 bp, Homo sapiens
ctcagtttcctcaactgcaaaa

SEQ ID NO: 8077191 - DNA, 22 bp, Homo sapiens
ctcagtttctggataagctggg

SEQ ID NO: 8077192 - DNA, 22 bp, Homo sapiens
ctcagtttcttactctgtataa

SEQ ID NO: 8077193 - DNA, 22 bp, Homo sapiens
ctcagtttctgacattaaaatc

SEQ ID NO: 8077194 - DNA, 22 bp, Homo sapiens
ctcagtttcttcatattgtagg

SEQ ID NO: 8077195 - DNA, 22 bp, Homo sapiens
ctcagtttttttaagagccatg

SEQ ID NO: 8077196 - DNA, 22 bp, Homo sapiens
ctcagttttaagactactcttt

SEQ ID NO: 8077197 - DNA, 22 bp, Homo sapiens
ctcagttttgaaaaggtaagct

SEQ ID NO: 8077198 - DNA, 22 bp, Homo sapiens
ctccagggggcatccacacagc

SEQ ID NO: 8077199 - DNA, 22 bp, Homo sapiens
ctccagggaggtctgcaggact

SEQ ID NO: 8077200 - DNA, 22 bp, Homo sapiens
ctccagggcagcatggcagtgg

SEQ ID NO: 8077201 - DNA, 22 bp, Homo sapiens
ctccagtcctagtctcttgctt

SEQ ID NO: 8077202 - DNA, 22 bp, Homo sapiens
tttaaaaaactagtctgagtct

SEQ ID NO: 8077203 - DNA, 22 bp, Homo sapiens
tttaaaaaactagtctgagtct

SEQ ID NO: 8077204 - DNA, 22 bp, Homo sapiens
ttgttaaaactccattggtttg

SEQ ID NO: 8077205 - DNA, 22 bp, Homo sapiens
ttgttaaaatgcatattctggt

SEQ ID NO: 8077206 - DNA, 22 bp, Homo sapiens
ttgttaaatggatgcagaataa

SEQ ID NO: 8077207 - DNA, 22 bp, Homo sapiens
ttgttaaaggcaaaacaagcac

SEQ ID NO: 8077208 - DNA, 22 bp, Homo sapiens
gccctctgctcagctcctcagc

SEQ ID NO: 8077209 - DNA, 21 bp, Homo sapiens
gccctcaggggaggatggcct

SEQ ID NO: 8077210 - DNA, 22 bp, Homo sapiens
gccataaattgctggtcaaaat

SEQ ID NO: 8077211 - DNA, 22 bp, Homo sapiens
gccagtggtgagattccctggg

SEQ ID NO: 8077212 - DNA, 22 bp, Homo sapiens
gccagtgggacccgctgtgggc

SEQ ID NO: 8077213 - DNA, 22 bp, Homo sapiens
gccagtggtcagtgggagggtg

SEQ ID NO: 8077214 - DNA, 22 bp, Homo sapiens
gccagtggtcagctacgcttag

SEQ ID NO: 8077215 - DNA, 22 bp, Homo sapiens
gccagtggtcactgaggaagaa

SEQ ID NO: 8077216 - DNA, 22 bp, Homo sapiens
gccagtgggtagttggagctgg

SEQ ID NO: 8077217 - DNA, 22 bp, Homo sapiens
gccagtgggtagttggagctgg

SEQ ID NO: 8077218 - DNA, 18 bp, Homo sapiens
gccagtgggtccaggtgc

SEQ ID NO: 8077219 - DNA, 22 bp, Homo sapiens
gccagtggtagaggggaggccg

SEQ ID NO: 8077220 - DNA, 22 bp, Homo sapiens
gccatgggtctgctggctcagc

SEQ ID NO: 8077221 - DNA, 22 bp, Homo sapiens
gcctggcttttgcctcatgttc

SEQ ID NO: 8077222 - DNA, 22 bp, Homo sapiens
gcctgggacccttagctcttgg

SEQ ID NO: 8077223 - DNA, 23 bp, Homo sapiens
gcctctggagccccagtgctcag

SEQ ID NO: 8077224 - DNA, 22 bp, Homo sapiens
gctgctgctgaggatgcacctg

SEQ ID NO: 8077225 - DNA, 22 bp, Homo sapiens
gctgctgcctgtagccagggtg

SEQ ID NO: 8077226 - DNA, 21 bp, Homo sapiens
gctgctgcccctagtgaggcc

SEQ ID NO: 8077227 - DNA, 22 bp, Homo sapiens
gctgctgcaagagccagctctt

SEQ ID NO: 8077228 - DNA, 22 bp, Homo sapiens
gctgctctgtgacagcctccgg

SEQ ID NO: 8077229 - DNA, 22 bp, Homo sapiens
gctgctctgggtctgcccagct

SEQ ID NO: 8077230 - DNA, 22 bp, Homo sapiens
gctggccttgtgtctgaggaag

SEQ ID NO: 8077231 - DNA, 22 bp, Homo sapiens
gctggcctgggcagcctgtcgg

SEQ ID NO: 8077232 - DNA, 22 bp, Homo sapiens
gctggcctgggctcaagaccag

SEQ ID NO: 8077233 - DNA, 22 bp, Homo sapiens
gctggcctgcgagggcaggctg

SEQ ID NO: 8077234 - DNA, 22 bp, Homo sapiens
gctggcctgctgggcaccaccg

SEQ ID NO: 8077235 - DNA, 22 bp, Homo sapiens
gctggcctctacaggccggcca

SEQ ID NO: 8077236 - DNA, 22 bp, Homo sapiens
gctggcctgaccagccacaggc

SEQ ID NO: 8077237 - DNA, 22 bp, Homo sapiens
gctggcctgcaaagcccggctg

SEQ ID NO: 8077238 - DNA, 22 bp, Homo sapiens
gctggcctcgcaggcaggatgt

SEQ ID NO: 8077239 - DNA, 21 bp, Homo sapiens
gctgaagacaaattctcttag

SEQ ID NO: 8077240 - DNA, 22 bp, Homo sapiens
gctcctgggtgtggctgcccct

SEQ ID NO: 8077241 - DNA, 22 bp, Homo sapiens
gctcactgcaacctccgccttc

SEQ ID NO: 8077242 - DNA, 22 bp, Homo sapiens
gctcactgcaacctctgcttcc

SEQ ID NO: 8077243 - DNA, 22 bp, Homo sapiens
gctcactgcaacctctgcctcc

SEQ ID NO: 8077244 - DNA, 22 bp, Homo sapiens
gctcactgcaagctccgcctcc

SEQ ID NO: 8077245 - DNA, 22 bp, Homo sapiens
gctcactgcaagctctgcctcc

SEQ ID NO: 8077246 - DNA, 22 bp, Homo sapiens
gctcactgccattctctagatg

SEQ ID NO: 8077247 - DNA, 22 bp, Homo sapiens
gctcactggcctgaagaggacg

SEQ ID NO: 8077248 - DNA, 22 bp, Homo sapiens
gctcactgcctgggcaacaaga

SEQ ID NO: 8077249 - DNA, 22 bp, Homo sapiens
gctcctggccagcacagggccc

SEQ ID NO: 8077250 - DNA, 22 bp, Homo sapiens
gctccaggagctcacagctcgc

SEQ ID NO: 8077251 - DNA, 22 bp, Homo sapiens
gctccaggaggatgaccttcct

SEQ ID NO: 8077252 - DNA, 22 bp, Homo sapiens
gcagggcaaacccaggtgttca

SEQ ID NO: 8077253 - DNA, 22 bp, Homo sapiens
gcagggaaacaggtgctaagga

SEQ ID NO: 8077254 - DNA, 22 bp, Homo sapiens
gcagggcacagacagtgccaag

SEQ ID NO: 8077255 - DNA, 22 bp, Homo sapiens
gcagggcagaaggtgctgagga

SEQ ID NO: 8077256 - DNA, 22 bp, Homo sapiens
gcagggcagacctccagcctat

SEQ ID NO: 8077257 - DNA, 22 bp, Homo sapiens
gcagggcagagggagaatctct

SEQ ID NO: 8077258 - DNA, 20 bp, Homo sapiens
gcagggcaagggatatgaaa

SEQ ID NO: 8077259 - DNA, 22 bp, Homo sapiens
gcagggcaatgatcccgagagg

SEQ ID NO: 8077260 - DNA, 22 bp, Homo sapiens
gcagggcacaaggacgcacagg

SEQ ID NO: 8077261 - DNA, 22 bp, Homo sapiens
gcagggcacacaagaatgataa

SEQ ID NO: 8077262 - DNA, 22 bp, Homo sapiens
gcagggcaaatgtggaaaggag

SEQ ID NO: 8077263 - DNA, 22 bp, Homo sapiens
gcagggtgacgttgcccacctc

SEQ ID NO: 8077264 - DNA, 22 bp, Homo sapiens
gcagggcagccacaggccccct

SEQ ID NO: 8077265 - DNA, 22 bp, Homo sapiens
gcaggagccaggccgagctggt

SEQ ID NO: 8077266 - DNA, 22 bp, Homo sapiens
gccagaggctcaggttgccatg

SEQ ID NO: 8077267 - DNA, 20 bp, Homo sapiens
gccagaggccggcaggggct

SEQ ID NO: 8077268 - DNA, 22 bp, Homo sapiens
gccacaggctccagcatcagta

SEQ ID NO: 8077269 - DNA, 22 bp, Homo sapiens
gccacaggcacttaagggctgg

SEQ ID NO: 8077270 - DNA, 22 bp, Homo sapiens
gccacaggaaagcaccctggag

SEQ ID NO: 8077271 - DNA, 22 bp, Homo sapiens
gcatgttttgcaacaagtgacc

SEQ ID NO: 8077272 - DNA, 22 bp, Homo sapiens
gcagggtgatagtgaggctcag

SEQ ID NO: 8077273 - DNA, 22 bp, Homo sapiens
gcagggtgatagtgaggctcag

SEQ ID NO: 8077274 - DNA, 22 bp, Homo sapiens
gcagggtggatggcagggccag

SEQ ID NO: 8077275 - DNA, 19 bp, Homo sapiens
gcagggtggcagagctctt

SEQ ID NO: 8077276 - DNA, 22 bp, Homo sapiens
gcaggtgggagccgctgcctga

SEQ ID NO: 8077277 - DNA, 22 bp, Homo sapiens
gcaggtggggctgctaccagaa

SEQ ID NO: 8077278 - DNA, 22 bp, Homo sapiens
gcaggtggtcactcatccccag

SEQ ID NO: 8077279 - DNA, 22 bp, Homo sapiens
gcaggtggttaaggtcccatgt

SEQ ID NO: 8077280 - DNA, 22 bp, Homo sapiens
gcaggtggtggcgcgcgccctg

SEQ ID NO: 8077281 - DNA, 19 bp, Homo sapiens
gcaggtgtgaatccgtaga

SEQ ID NO: 8077282 - DNA, 22 bp, Homo sapiens
gcaggtgtcagtccccaaggtg

SEQ ID NO: 8077283 - DNA, 22 bp, Homo sapiens
gcagtaagttaatagtgctggt

SEQ ID NO: 8077284 - DNA, 22 bp, Homo sapiens
gattttcatttgcactctagaa

SEQ ID NO: 8077285 - DNA, 22 bp, Homo sapiens
gattttcattatagctagtttc

SEQ ID NO: 8077286 - DNA, 22 bp, Homo sapiens
gattttcatgataaacttgtga

SEQ ID NO: 8077287 - DNA, 22 bp, Homo sapiens
gcaaaaaatgcttgttgcttag

SEQ ID NO: 8077288 - DNA, 22 bp, Homo sapiens
gatttttatataaagtgagaaa

SEQ ID NO: 8077289 - DNA, 22 bp, Homo sapiens
gcaaacatgtgctcattttgtg

SEQ ID NO: 8077290 - DNA, 22 bp, Homo sapiens
gcacaaagatgaatacagaatg

SEQ ID NO: 8077291 - DNA, 22 bp, Homo sapiens
gcacaaaggtggaaggaggaag

SEQ ID NO: 8077292 - DNA, 19 bp, Homo sapiens
gcaattcagtagtacaaaa

SEQ ID NO: 8077293 - DNA, 19 bp, Homo sapiens
gcaattcagaagcacctgt

SEQ ID NO: 8077294 - DNA, 22 bp, Homo sapiens
gcaattatatcaccagagatct

SEQ ID NO: 8077295 - DNA, 22 bp, Homo sapiens
gcagaaagcttagagggtttgc

SEQ ID NO: 8077296 - DNA, 22 bp, Homo sapiens
gcagaaagctccttgcgatctg

SEQ ID NO: 8077297 - DNA, 21 bp, Homo sapiens
gcagaaaggaatcttaggtcc

SEQ ID NO: 8077298 - DNA, 22 bp, Homo sapiens
gcacttttcaaagcttcctgtg

SEQ ID NO: 8077299 - DNA, 22 bp, Homo sapiens
gcacccaggcttgggcagcaac

SEQ ID NO: 8077300 - DNA, 22 bp, Homo sapiens
gattctttactcagattttgtt

SEQ ID NO: 8077301 - DNA, 22 bp, Homo sapiens
gattctttggcctttattgaca

SEQ ID NO: 8077302 - DNA, 22 bp, Homo sapiens
gattattttgtgcaataatcgg

SEQ ID NO: 8077303 - DNA, 22 bp, Homo sapiens
gattcaaagttaatgaagatgc

SEQ ID NO: 8077304 - DNA, 21 bp, Homo sapiens
gattaaatttaagctacatgc

SEQ ID NO: 8077305 - DNA, 21 bp, Homo sapiens
gatttagtggctgttctacct

SEQ ID NO: 8077306 - DNA, 22 bp, Homo sapiens
gatttagtgctgaaatccctgg

SEQ ID NO: 8077307 - DNA, 22 bp, Homo sapiens
gattgcaaatcattacaaagga

SEQ ID NO: 8077308 - DNA, 22 bp, Homo sapiens
gatgtaatagatatagattgct

SEQ ID NO: 8077309 - DNA, 22 bp, Homo sapiens
gatggtctttgtctctgataag

SEQ ID NO: 8077310 - DNA, 22 bp, Homo sapiens
gatgggcagcacagctggccaa

SEQ ID NO: 8077311 - DNA, 22 bp, Homo sapiens
gatggcttccttctcactgtgt

SEQ ID NO: 8077312 - DNA, 22 bp, Homo sapiens
gatgctgactttccgctgccac

SEQ ID NO: 8077313 - DNA, 22 bp, Homo sapiens
gatgctgactggtgtttgcctt

SEQ ID NO: 8077314 - DNA, 22 bp, Homo sapiens
gatgctgaccagctgtttcctt

SEQ ID NO: 8077315 - DNA, 22 bp, Homo sapiens
gactgggtcctctgcttatggt

SEQ ID NO: 8077316 - DNA, 22 bp, Homo sapiens
gacttgggctgagggccagcag

SEQ ID NO: 8077317 - DNA, 22 bp, Homo sapiens
gacttgggcttgggcgtgggtt

SEQ ID NO: 8077318 - DNA, 22 bp, Homo sapiens
gacttgggtggattgtgactct

SEQ ID NO: 8077319 - DNA, 22 bp, Homo sapiens
gacttgggggaagatgtggctg

SEQ ID NO: 8077320 - DNA, 22 bp, Homo sapiens
gacttaatttccactttctgct

SEQ ID NO: 8077321 - DNA, 22 bp, Homo sapiens
gacttaatgcttcattacctta

SEQ ID NO: 8077322 - DNA, 22 bp, Homo sapiens
gagacacaggcacagaagaggc

SEQ ID NO: 8077323 - DNA, 17 bp, Homo sapiens
gagagctgctgcttccg

SEQ ID NO: 8077324 - DNA, 22 bp, Homo sapiens
gaagggaaggaaagaaccagca

SEQ ID NO: 8077325 - DNA, 22 bp, Homo sapiens
gaagggaactgggtctccttgt

SEQ ID NO: 8077326 - DNA, 22 bp, Homo sapiens
gaagggaaattcagatcttcag

SEQ ID NO: 8077327 - DNA, 22 bp, Homo sapiens
gaagtacaaaggacatggaaac

SEQ ID NO: 8077328 - DNA, 22 bp, Homo sapiens
gaagttactctcgttaaatatg

SEQ ID NO: 8077329 - DNA, 22 bp, Homo sapiens
gaagggaaagtgacttacccga

SEQ ID NO: 8077330 - DNA, 22 bp, Homo sapiens
gaaggctgcgaggggagtgccg

SEQ ID NO: 8077331 - DNA, 22 bp, Homo sapiens
gaactgtttctggtgaaagagt

SEQ ID NO: 8077332 - DNA, 22 bp, Homo sapiens
gaactgtttttaagtcctaaga

SEQ ID NO: 8077333 - DNA, 23 bp, Homo sapiens
gaactgttgatgaatagaatata

SEQ ID NO: 8077334 - DNA, 22 bp, Homo sapiens
gaattgctaaccaattcaaaat

SEQ ID NO: 8077335 - DNA, 22 bp, Homo sapiens
gaattgctgaatcatatgttta

SEQ ID NO: 8077336 - DNA, 22 bp, Homo sapiens
gaattctttgatcttaatcttg

SEQ ID NO: 8077337 - DNA, 22 bp, Homo sapiens
gaattctttaggtgaatttcta

SEQ ID NO: 8077338 - DNA, 22 bp, Homo sapiens
gaattcttctgtctttaactga

SEQ ID NO: 8077339 - DNA, 22 bp, Homo sapiens
gaattcaagtgcaatggtatat

SEQ ID NO: 8077340 - DNA, 22 bp, Homo sapiens
gaattcaatttcttggtctttg

SEQ ID NO: 8077341 - DNA, 22 bp, Homo sapiens
gaattcaaatattaaacacgac

SEQ ID NO: 8077342 - DNA, 22 bp, Homo sapiens
gaagttcactggctacattcca

SEQ ID NO: 8077343 - DNA, 21 bp, Homo sapiens
gaagttcatgatctttctgct

SEQ ID NO: 8077344 - DNA, 22 bp, Homo sapiens
gacacaggattcctggctctgc

SEQ ID NO: 8077345 - DNA, 22 bp, Homo sapiens
gacacagggacgtgctctgcct

SEQ ID NO: 8077346 - DNA, 22 bp, Homo sapiens
cttgggggccattaaggggcct

SEQ ID NO: 8077347 - DNA, 22 bp, Homo sapiens
ctttacaacctaagttgaagct

SEQ ID NO: 8077348 - DNA, 22 bp, Homo sapiens
ctttacaattcaagggaactct

SEQ ID NO: 8077349 - DNA, 22 bp, Homo sapiens
ctttagtggttagtttaggcca

SEQ ID NO: 8077350 - DNA, 22 bp, Homo sapiens
ctttagtggtattttagcaagt

SEQ ID NO: 8077351 - DNA, 22 bp, Homo sapiens
ctttagtggaagggtggttaat

SEQ ID NO: 8077352 - DNA, 22 bp, Homo sapiens
ctttagtgagtgtggagctaga

SEQ ID NO: 8077353 - DNA, 22 bp, Homo sapiens
ctttagtgttcaacccagataa

SEQ ID NO: 8077354 - DNA, 22 bp, Homo sapiens
ctttagtgttgttgtgaggatt

SEQ ID NO: 8077355 - DNA, 21 bp, Homo sapiens
ctttagtgaaaaggggctaac

SEQ ID NO: 8077356 - DNA, 22 bp, Homo sapiens
ctttggcagcctctgctattga

SEQ ID NO: 8077357 - DNA, 22 bp, Homo sapiens
cttctttcccaggcatgtttta

SEQ ID NO: 8077358 - DNA, 22 bp, Homo sapiens
cttcttttcatggcttgggaag

SEQ ID NO: 8077359 - DNA, 22 bp, Homo sapiens
cttgaaatccagatttcagagg

SEQ ID NO: 8077360 - DNA, 22 bp, Homo sapiens
cttcttttgaagggcgttgtgt

SEQ ID NO: 8077361 - DNA, 22 bp, Homo sapiens
cttctcttcctttgtcaactga

SEQ ID NO: 8077362 - DNA, 22 bp, Homo sapiens
cttctcttcccagggacacagg

SEQ ID NO: 8077363 - DNA, 22 bp, Homo sapiens
cttctcttggtagttcttgttg

SEQ ID NO: 8077364 - DNA, 22 bp, Homo sapiens
ctggctggtctgagcagtcgca

SEQ ID NO: 8077365 - DNA, 22 bp, Homo sapiens
ctggctgtaacattttgccata

SEQ ID NO: 8077366 - DNA, 22 bp, Homo sapiens
ctggctgtgaaatggcagtgtc

SEQ ID NO: 8077367 - DNA, 22 bp, Homo sapiens
cttctcggggttcccgcgccct

SEQ ID NO: 8077368 - DNA, 22 bp, Homo sapiens
ctggctggtcatcagcagtacg

SEQ ID NO: 8077369 - DNA, 22 bp, Homo sapiens
gaaatacaaagccagccatttt

SEQ ID NO: 8077370 - DNA, 22 bp, Homo sapiens
gaaataattctgtgtctgaaca

SEQ ID NO: 8077371 - DNA, 22 bp, Homo sapiens
gaaagttttctcacacagtaat

SEQ ID NO: 8077372 - DNA, 22 bp, Homo sapiens
gaaataacagctctggaagagt

SEQ ID NO: 8077373 - DNA, 22 bp, Homo sapiens
gaaagtttcttcattaagatgt

SEQ ID NO: 8077374 - DNA, 22 bp, Homo sapiens
gaaagttttcatatataccaaa

SEQ ID NO: 8077375 - DNA, 22 bp, Homo sapiens
gaacacagcagggataaccact

SEQ ID NO: 8077376 - DNA, 22 bp, Homo sapiens
gaaatacaattttgtcccagct

SEQ ID NO: 8077377 - DNA, 22 bp, Homo sapiens
gaaatacaaatgcctagatcct

SEQ ID NO: 8077378 - DNA, 22 bp, Homo sapiens
gaacacagtttagaaaatgctg

SEQ ID NO: 8077379 - DNA, 22 bp, Homo sapiens
gaacacagtttagaaaatgctg

SEQ ID NO: 8077380 - DNA, 22 bp, Homo sapiens
gaacagatgcctgattcatagg

SEQ ID NO: 8077381 - DNA, 22 bp, Homo sapiens
gaactatatcttcaagaaaatg

SEQ ID NO: 8077382 - DNA, 22 bp, Homo sapiens
ctttgttatctgtaaatggtta

SEQ ID NO: 8077383 - DNA, 22 bp, Homo sapiens
cttttaatgggagcagtatttg

SEQ ID NO: 8077384 - DNA, 17 bp, Homo sapiens
cttttaatttacttccc

SEQ ID NO: 8077385 - DNA, 22 bp, Homo sapiens
cttttacactcatctgggaggg

SEQ ID NO: 8077386 - DNA, 22 bp, Homo sapiens
cttttaatgagcattgctgtct

SEQ ID NO: 8077387 - DNA, 22 bp, Homo sapiens
cttttaagggataataagatgt

SEQ ID NO: 8077388 - DNA, 22 bp, Homo sapiens
gaaagttcacacatccacatgg

SEQ ID NO: 8077389 - DNA, 22 bp, Homo sapiens
gaaagtttataggttatataat

SEQ ID NO: 8077390 - DNA, 22 bp, Homo sapiens
gaaagtttctcacacatgcaga

SEQ ID NO: 8077391 - DNA, 22 bp, Homo sapiens
gatcttctttctctgtagaggt

SEQ ID NO: 8077392 - DNA, 22 bp, Homo sapiens
gatctgggctggagactgagaa

SEQ ID NO: 8077393 - DNA, 22 bp, Homo sapiens
gatgcagaaagtagacaccatc

SEQ ID NO: 8077394 - DNA, 22 bp, Homo sapiens
gatgattttatgtcttgtcatt

SEQ ID NO: 8077395 - DNA, 22 bp, Homo sapiens
gataatatctggtttattcacc

SEQ ID NO: 8077396 - DNA, 21 bp, Homo sapiens
gatacagagggccactgattg

SEQ ID NO: 8077397 - DNA, 22 bp, Homo sapiens
gatataaattaatcaagtgcaa

SEQ ID NO: 8077398 - DNA, 22 bp, Homo sapiens
gataccagagcccaaagcagca

SEQ ID NO: 8077399 - DNA, 22 bp, Homo sapiens
gatatttttagtatttctgcct

SEQ ID NO: 8077400 - DNA, 22 bp, Homo sapiens
gatatttttgcagacacctggg

SEQ ID NO: 8077401 - DNA, 18 bp, Homo sapiens
gatatataggaggaaagt

SEQ ID NO: 8077402 - DNA, 22 bp, Homo sapiens
gatattttcgcagggagaattc

SEQ ID NO: 8077403 - DNA, 22 bp, Homo sapiens
gatattttcagtctcctttcaa

SEQ ID NO: 8077404 - DNA, 22 bp, Homo sapiens
gatattttcattcggatgctca

SEQ ID NO: 8077405 - DNA, 22 bp, Homo sapiens
gatatttttaggtgatgcaggc

SEQ ID NO: 8077406 - DNA, 22 bp, Homo sapiens
gatattttgagaaatcctatga

SEQ ID NO: 8077407 - DNA, 22 bp, Homo sapiens
gagtttaatcattgttctatcc

SEQ ID NO: 8077408 - DNA, 22 bp, Homo sapiens
gagttttaacctcagctctctg

SEQ ID NO: 8077409 - DNA, 22 bp, Homo sapiens
gagttttaaagctggggaagag

SEQ ID NO: 8077410 - DNA, 22 bp, Homo sapiens
gagttttaatgagctgctgtgg

SEQ ID NO: 8077411 - DNA, 22 bp, Homo sapiens
gagttttatttggtgctaagta

SEQ ID NO: 8077412 - DNA, 22 bp, Homo sapiens
gataaaagaggaaatttgttca

SEQ ID NO: 8077413 - DNA, 22 bp, Homo sapiens
gataaagcaaggatgactgaag

SEQ ID NO: 8077414 - DNA, 22 bp, Homo sapiens
gagtgccaagagaagaggctgg

SEQ ID NO: 8077415 - DNA, 22 bp, Homo sapiens
gagtgccagatggacctcttgg

SEQ ID NO: 8077416 - DNA, 22 bp, Homo sapiens
gagtgccatgtgttacctctgg

SEQ ID NO: 8077417 - DNA, 22 bp, Homo sapiens
gagtctctgggagggaaagaag

SEQ ID NO: 8077418 - DNA, 22 bp, Homo sapiens
gagtctctttgccagtcctaag

SEQ ID NO: 8077419 - DNA, 18 bp, Homo sapiens
gagtctttgttactgctg

SEQ ID NO: 8077420 - DNA, 22 bp, Homo sapiens
gagtcctttgttccttgccaca

SEQ ID NO: 8077421 - DNA, 22 bp, Homo sapiens
gagtccttttctctgtccactg

SEQ ID NO: 8077422 - DNA, 22 bp, Homo sapiens
gagtccttttgtgccacaggga

SEQ ID NO: 8077423 - DNA, 22 bp, Homo sapiens
gagtctaagtagaatgtgaaaa

SEQ ID NO: 8077424 - DNA, 22 bp, Homo sapiens
gagtctctggaggggtcagacc

SEQ ID NO: 8077425 - DNA, 22 bp, Homo sapiens
gagtctctgctatgttttctct

SEQ ID NO: 8077426 - DNA, 22 bp, Homo sapiens
gagtctctagtctggtcctggc

SEQ ID NO: 8077427 - DNA, 22 bp, Homo sapiens
gagtctctgaccagggtgccaa

SEQ ID NO: 8077428 - DNA, 22 bp, Homo sapiens
gagtctctcatgcagttacagt

SEQ ID NO: 8077429 - DNA, 21 bp, Homo sapiens
gagtccttccaatgtcctcag

SEQ ID NO: 8077430 - DNA, 22 bp, Homo sapiens
gagtccttccagcaggcattta

SEQ ID NO: 8077431 - DNA, 22 bp, Homo sapiens
gagtcctcaacggggagaggcg

SEQ ID NO: 8077432 - DNA, 22 bp, Homo sapiens
gaggtggggttttgttcttgaa

SEQ ID NO: 8077433 - DNA, 22 bp, Homo sapiens
gagggcagagtctaatgatgca

SEQ ID NO: 8077434 - DNA, 22 bp, Homo sapiens
gagggcagtgaattttgaagct

SEQ ID NO: 8077435 - DNA, 22 bp, Homo sapiens
gaggctgggggctgccttcctc

SEQ ID NO: 8077436 - DNA, 16 bp, Homo sapiens
gagggcagaggcggaa

SEQ ID NO: 8077437 - DNA, 22 bp, Homo sapiens
gaggaggcttccgggaggcacg

SEQ ID NO: 8077438 - DNA, 22 bp, Homo sapiens
gaggcagaggttgcagtgagct

SEQ ID NO: 8077439 - DNA, 22 bp, Homo sapiens
gaggcccagtggagggccatgg

SEQ ID NO: 8077440 - DNA, 22 bp, Homo sapiens
gaggcctgaaaggggacctatg

SEQ ID NO: 8077441 - DNA, 22 bp, Homo sapiens
gagctggctccgccatgctgct

SEQ ID NO: 8077442 - DNA, 22 bp, Homo sapiens
gagctggcaggaggctccccga

SEQ ID NO: 8077443 - DNA, 22 bp, Homo sapiens
gagatataacctaaaggtcact

SEQ ID NO: 8077444 - DNA, 22 bp, Homo sapiens
gagataaatttttgataaatat

SEQ ID NO: 8077445 - DNA, 22 bp, Homo sapiens
gagataatgatgctaacccagt

SEQ ID NO: 8077446 - DNA, 22 bp, Homo sapiens
ggctgcaaataacaactagctt

SEQ ID NO: 8077447 - DNA, 22 bp, Homo sapiens
ggctgcagagctggtgccctgg

SEQ ID NO: 8077448 - DNA, 22 bp, Homo sapiens
ggctgccttcagactccagctt

SEQ ID NO: 8077449 - DNA, 22 bp, Homo sapiens
ggctgcctgggagccctcctct

SEQ ID NO: 8077450 - DNA, 22 bp, Homo sapiens
ggctgcaggcagaggctgtctg

SEQ ID NO: 8077451 - DNA, 22 bp, Homo sapiens
ggctggcctcagggtcctcgct

SEQ ID NO: 8077452 - DNA, 22 bp, Homo sapiens
ggctgctctgccttccagctgg

SEQ ID NO: 8077453 - DNA, 22 bp, Homo sapiens
ggctgctcttcttggcgacctc

SEQ ID NO: 8077454 - DNA, 22 bp, Homo sapiens
ggctgctctgcacaggggctgg

SEQ ID NO: 8077455 - DNA, 22 bp, Homo sapiens
ggctgctctgagagtgggtttt

SEQ ID NO: 8077456 - DNA, 22 bp, Homo sapiens
ggctgctctccatcccaggcct

SEQ ID NO: 8077457 - DNA, 22 bp, Homo sapiens
ggctgctcggcagctcctgagc

SEQ ID NO: 8077458 - DNA, 22 bp, Homo sapiens
ggctgctcggagcctcctgtga

SEQ ID NO: 8077459 - DNA, 22 bp, Homo sapiens
ggctggcttgccaagctcaggg

SEQ ID NO: 8077460 - DNA, 22 bp, Homo sapiens
gggaagagaggaggtggtttcg

SEQ ID NO: 8077461 - DNA, 22 bp, Homo sapiens
ggctcctggaaagccctcgctc

SEQ ID NO: 8077462 - DNA, 23 bp, Homo sapiens
ggctcctgcttcatgtcccacct

SEQ ID NO: 8077463 - DNA, 22 bp, Homo sapiens
ggctcctgcacctgtccctctg

SEQ ID NO: 8077464 - DNA, 22 bp, Homo sapiens
ggccttggctcctgcagggagt

SEQ ID NO: 8077465 - DNA, 22 bp, Homo sapiens
ggccttgggaggagggtcagaa

SEQ ID NO: 8077466 - DNA, 22 bp, Homo sapiens
ggccttcctggcggctcagggt

SEQ ID NO: 8077467 - DNA, 22 bp, Homo sapiens
ggccttggagtcctccactgga

SEQ ID NO: 8077468 - DNA, 22 bp, Homo sapiens
ggccttggaaagatacccagct

SEQ ID NO: 8077469 - DNA, 22 bp, Homo sapiens
ggcctgggcccactgtcaagag

SEQ ID NO: 8077470 - DNA, 22 bp, Homo sapiens
ggccctctggcttccgcatggg

SEQ ID NO: 8077471 - DNA, 22 bp, Homo sapiens
ggccctcttttatccatcataa

SEQ ID NO: 8077472 - DNA, 22 bp, Homo sapiens
ggccccagttcactcctggccg

SEQ ID NO: 8077473 - DNA, 22 bp, Homo sapiens
ggccccagattctgggctgggt

SEQ ID NO: 8077474 - DNA, 20 bp, Homo sapiens
gggcagatgtttttatgttg

SEQ ID NO: 8077475 - DNA, 18 bp, Homo sapiens
gggcagcacagcagcctc

SEQ ID NO: 8077476 - DNA, 22 bp, Homo sapiens
gggcagcacagacagtgaaggc

SEQ ID NO: 8077477 - DNA, 22 bp, Homo sapiens
gggcagcaaatctgagtctggt

SEQ ID NO: 8077478 - DNA, 20 bp, Homo sapiens
gggcagcaagacatttgaca

SEQ ID NO: 8077479 - DNA, 22 bp, Homo sapiens
gggcagcactcatacctatatt

SEQ ID NO: 8077480 - DNA, 22 bp, Homo sapiens
gggcagcacgtttcaggaggat

SEQ ID NO: 8077481 - DNA, 21 bp, Homo sapiens
gggcagcacgtcattcctgtg

SEQ ID NO: 8077482 - DNA, 22 bp, Homo sapiens
gggcagcagaattggacagaaa

SEQ ID NO: 8077483 - DNA, 22 bp, Homo sapiens
gggcagcctcggtgcctgctgc

SEQ ID NO: 8077484 - DNA, 22 bp, Homo sapiens
gggaggctcagtggtgtcctct

SEQ ID NO: 8077485 - DNA, 22 bp, Homo sapiens
gggaggctggctctggccacag

SEQ ID NO: 8077486 - DNA, 23 bp, Homo sapiens
gggggctggttgactctctgcag

SEQ ID NO: 8077487 - DNA, 22 bp, Homo sapiens
gggggctgtcctgtgcattgta

SEQ ID NO: 8077488 - DNA, 22 bp, Homo sapiens
gggggcttggcccggtctggtt

SEQ ID NO: 8077489 - DNA, 22 bp, Homo sapiens
gggggctggaatatccatcaac

SEQ ID NO: 8077490 - DNA, 22 bp, Homo sapiens
gggggctggactttcccacaca

SEQ ID NO: 8077491 - DNA, 22 bp, Homo sapiens
gggggctgaggctgttctgagg

SEQ ID NO: 8077492 - DNA, 22 bp, Homo sapiens
gggggctgatcatttactgggc

SEQ ID NO: 8077493 - DNA, 16 bp, Homo sapiens
gggggctgcaagcttc

SEQ ID NO: 8077494 - DNA, 22 bp, Homo sapiens
ggggggtgctgatcagtggagc

SEQ ID NO: 8077495 - DNA, 22 bp, Homo sapiens
ggggggctgttctggacaggaa

SEQ ID NO: 8077496 - DNA, 20 bp, Homo sapiens
ggggggcttcagggcctgtg

SEQ ID NO: 8077497 - DNA, 22 bp, Homo sapiens
gggctgcttttaagggtctcag

SEQ ID NO: 8077498 - DNA, 22 bp, Homo sapiens
gggctagcctcttccctgctcc

SEQ ID NO: 8077499 - DNA, 22 bp, Homo sapiens
ggaggctgctgcctcacgtggg

SEQ ID NO: 8077500 - DNA, 22 bp, Homo sapiens
ggcagagacaccgaatgactct

SEQ ID NO: 8077501 - DNA, 22 bp, Homo sapiens
ggcagacacaaaaacataaggt

SEQ ID NO: 8077502 - DNA, 22 bp, Homo sapiens
ggcagctgtgaagtgcctcaca

SEQ ID NO: 8077503 - DNA, 22 bp, Homo sapiens
ggcaggcagatggctgcaccaa

SEQ ID NO: 8077504 - DNA, 22 bp, Homo sapiens
ggcaggtgaggcatgtgcctgg

SEQ ID NO: 8077505 - DNA, 22 bp, Homo sapiens
gcttcattaatagaattagtat

SEQ ID NO: 8077506 - DNA, 22 bp, Homo sapiens
ggaggccatgaggctctaggtg

SEQ ID NO: 8077507 - DNA, 22 bp, Homo sapiens
ggaggccaccatggagtcactt

SEQ ID NO: 8077508 - DNA, 22 bp, Homo sapiens
ggagacacagagcaacaaaata

SEQ ID NO: 8077509 - DNA, 22 bp, Homo sapiens
ggaagtatttgtttttgcatcc

SEQ ID NO: 8077510 - DNA, 22 bp, Homo sapiens
ggaatactaaaggaagcaattg

SEQ ID NO: 8077511 - DNA, 22 bp, Homo sapiens
ggaatactaaaggaagcaattg

SEQ ID NO: 8077512 - DNA, 22 bp, Homo sapiens
ggaatactatgacacacaggtg

SEQ ID NO: 8077513 - DNA, 22 bp, Homo sapiens
ggaatactttgttgtcttccaa

SEQ ID NO: 8077514 - DNA, 22 bp, Homo sapiens
ggaataaaaattgtttactgta

SEQ ID NO: 8077515 - DNA, 22 bp, Homo sapiens
ggaatatagccagtaacagtca

SEQ ID NO: 8077516 - DNA, 22 bp, Homo sapiens
taacagcagggttacaggcatt

SEQ ID NO: 8077517 - DNA, 22 bp, Homo sapiens
taacagcagggttacaggcatt

SEQ ID NO: 8077518 - DNA, 22 bp, Homo sapiens
taaatagaatctaaactgctca

SEQ ID NO: 8077519 - DNA, 22 bp, Homo sapiens
taaatacttttactccactgat

SEQ ID NO: 8077520 - DNA, 16 bp, Homo sapiens
taaatctgtgatcaca

SEQ ID NO: 8077521 - DNA, 19 bp, Homo sapiens
taaatctgtattcttcaaa

SEQ ID NO: 8077522 - DNA, 22 bp, Homo sapiens
taaatccttatcttctttgaat

SEQ ID NO: 8077523 - DNA, 22 bp, Homo sapiens
taaatgataataatgctagtgt

SEQ ID NO: 8077524 - DNA, 22 bp, Homo sapiens
taacactggcttttgctgaggc

SEQ ID NO: 8077525 - DNA, 21 bp, Homo sapiens
taaagctagaaccttagcttt

SEQ ID NO: 8077526 - DNA, 22 bp, Homo sapiens
taaagcagtatgatggaaggat

SEQ ID NO: 8077527 - DNA, 22 bp, Homo sapiens
taaagcaggtgctcagtgacca

SEQ ID NO: 8077528 - DNA, 22 bp, Homo sapiens
taaagcttgtattgcaatattt

SEQ ID NO: 8077529 - DNA, 22 bp, Homo sapiens
taaagctgaaatgattatgaca

SEQ ID NO: 8077530 - DNA, 22 bp, Homo sapiens
taaatacttttactccactgat

SEQ ID NO: 8077531 - DNA, 22 bp, Homo sapiens
taaaggcacggagttgttatgg

SEQ ID NO: 8077532 - DNA, 22 bp, Homo sapiens
gtttaataatgttgaattacta

SEQ ID NO: 8077533 - DNA, 22 bp, Homo sapiens
gttctccaggggctgttcatct

SEQ ID NO: 8077534 - DNA, 22 bp, Homo sapiens
gttgtttgtaatgacaggagac

SEQ ID NO: 8077535 - DNA, 22 bp, Homo sapiens
gttcaaaggcctgtggaaaggg

SEQ ID NO: 8077536 - DNA, 21 bp, Homo sapiens
gttattttaagtgagctttgc

SEQ ID NO: 8077537 - DNA, 22 bp, Homo sapiens
gttattttaacttctcagtaat

SEQ ID NO: 8077538 - DNA, 21 bp, Homo sapiens
gtgtcatggttgactttggca

SEQ ID NO: 8077539 - DNA, 22 bp, Homo sapiens
gtgtcctggagcccccagttca

SEQ ID NO: 8077540 - DNA, 22 bp, Homo sapiens
gtgtgtattattgcatacacat

SEQ ID NO: 8077541 - DNA, 22 bp, Homo sapiens
gtgggggcaggcagtgctagga

SEQ ID NO: 8077542 - DNA, 22 bp, Homo sapiens
gtgggggctggaaatcttgcca

SEQ ID NO: 8077543 - DNA, 22 bp, Homo sapiens
gtgggggcagtgggcttcgagc

SEQ ID NO: 8077544 - DNA, 22 bp, Homo sapiens
gtgggcagagcaagggaactca

SEQ ID NO: 8077545 - DNA, 20 bp, Homo sapiens
gtgggcagagcaccacctgg

SEQ ID NO: 8077546 - DNA, 22 bp, Homo sapiens
gtgggcagaattgaatctttaa

SEQ ID NO: 8077547 - DNA, 22 bp, Homo sapiens
gtgggcagaacatttgtaggct

SEQ ID NO: 8077548 - DNA, 22 bp, Homo sapiens
gtgggcagacagtgctttgcag

SEQ ID NO: 8077549 - DNA, 22 bp, Homo sapiens
gtgggcagacatgatagaagga

SEQ ID NO: 8077550 - DNA, 22 bp, Homo sapiens
gtgggcagcaccagggaagtgt

SEQ ID NO: 8077551 - DNA, 20 bp, Homo sapiens
gtgggcagcaggcatactgg

SEQ ID NO: 8077552 - DNA, 22 bp, Homo sapiens
gtgggcagattatagatgatgc

SEQ ID NO: 8077553 - DNA, 22 bp, Homo sapiens
gtgggcagattaatttctcaat

SEQ ID NO: 8077554 - DNA, 22 bp, Homo sapiens
gtgggcagaggagagaacatta

SEQ ID NO: 8077555 - DNA, 22 bp, Homo sapiens
gtgggcagatacatttgatatg

SEQ ID NO: 8077556 - DNA, 20 bp, Homo sapiens
gtgggcagatgtgtgcatgg

SEQ ID NO: 8077557 - DNA, 22 bp, Homo sapiens
gtgggcagccccttcaaggcca

SEQ ID NO: 8077558 - DNA, 22 bp, Homo sapiens
gtgggcagcctcctttattttc

SEQ ID NO: 8077559 - DNA, 22 bp, Homo sapiens
gtgggcaggaggccctgccctg

SEQ ID NO: 8077560 - DNA, 22 bp, Homo sapiens
gtgggcaggaggccctgccctg

SEQ ID NO: 8077561 - DNA, 22 bp, Homo sapiens
gtgggcagcctgtccggagacc

SEQ ID NO: 8077562 - DNA, 22 bp, Homo sapiens
gtgggcagtgtgtcagtatctt

SEQ ID NO: 8077563 - DNA, 22 bp, Homo sapiens
gtgggcagttcaattctgggag

SEQ ID NO: 8077564 - DNA, 22 bp, Homo sapiens
gtgggcagtggtttgcgcggtc

SEQ ID NO: 8077565 - DNA, 22 bp, Homo sapiens
gtgggcagttggtgattctcgt

SEQ ID NO: 8077566 - DNA, 22 bp, Homo sapiens
gtgtaagtatctttgtatcttt

SEQ ID NO: 8077567 - DNA, 22 bp, Homo sapiens
gtggtcaggggctgtggctatg

SEQ ID NO: 8077568 - DNA, 22 bp, Homo sapiens
gtggtcaggggctgaggtgccc

SEQ ID NO: 8077569 - DNA, 22 bp, Homo sapiens
gtggtcagccccggtgagccct

SEQ ID NO: 8077570 - DNA, 22 bp, Homo sapiens
gtggtatttatgacagtgcccg

SEQ ID NO: 8077571 - DNA, 22 bp, Homo sapiens
gtggtcagagatgacagtgggt

SEQ ID NO: 8077572 - DNA, 22 bp, Homo sapiens
gtggtcagaaatctcagtggca

SEQ ID NO: 8077573 - DNA, 22 bp, Homo sapiens
gtgggggctggctcgtcctgtg

SEQ ID NO: 8077574 - DNA, 22 bp, Homo sapiens
gtatgtgaggttggtttccagg

SEQ ID NO: 8077575 - DNA, 22 bp, Homo sapiens
gtccagggaaatagcgacaggg

SEQ ID NO: 8077576 - DNA, 22 bp, Homo sapiens
gtccagtgacaagtagctggcc

SEQ ID NO: 8077577 - DNA, 22 bp, Homo sapiens
gtccagtgtgtttatcttggat

SEQ ID NO: 8077578 - DNA, 19 bp, Homo sapiens
gtccagtgttttccagtca

SEQ ID NO: 8077579 - DNA, 20 bp, Homo sapiens
gtccagtgggccttcatttc

SEQ ID NO: 8077580 - DNA, 22 bp, Homo sapiens
gtcctgggtccccgcaggtcag

SEQ ID NO: 8077581 - DNA, 22 bp, Homo sapiens
gtcccaggtgcccagtgggcag

SEQ ID NO: 8077582 - DNA, 22 bp, Homo sapiens
gtcccagggaggttcagggctt

SEQ ID NO: 8077583 - DNA, 19 bp, Homo sapiens
gtctctgctccagggtctc

SEQ ID NO: 8077584 - DNA, 22 bp, Homo sapiens
gtctgcatattagatttgtttt

SEQ ID NO: 8077585 - DNA, 22 bp, Homo sapiens
gtctgccagcaccataaattag

SEQ ID NO: 8077586 - DNA, 22 bp, Homo sapiens
ggtgtcagtgagagcacagtac

SEQ ID NO: 8077587 - DNA, 22 bp, Homo sapiens
ggtgcaggaaaattacctggag

SEQ ID NO: 8077588 - DNA, 22 bp, Homo sapiens
ggtgcaggcggtggggcaagta

SEQ ID NO: 8077589 - DNA, 22 bp, Homo sapiens
ggtgcaggagcggggtgctcgg

SEQ ID NO: 8077590 - DNA, 22 bp, Homo sapiens
ggtggcagcatggtcccagtgt

SEQ ID NO: 8077591 - DNA, 22 bp, Homo sapiens
ggtgagggtaaatataggcaaa

SEQ ID NO: 8077592 - DNA, 21 bp, Homo sapiens
gtatatcagcagtgaattcaa

SEQ ID NO: 8077593 - DNA, 22 bp, Homo sapiens
gtatatcagacactcatatgta

SEQ ID NO: 8077594 - DNA, 22 bp, Homo sapiens
gtatatcaggcagaatgttctc

SEQ ID NO: 8077595 - DNA, 22 bp, Homo sapiens
gtatatcaggcagaatgttctc

SEQ ID NO: 8077596 - DNA, 22 bp, Homo sapiens
gtatatcaccccaagcagctga

SEQ ID NO: 8077597 - DNA, 22 bp, Homo sapiens
gtaaactgaattggatactgtg

SEQ ID NO: 8077598 - DNA, 22 bp, Homo sapiens
gtaaagcaggtagttgggacac

SEQ ID NO: 8077599 - DNA, 22 bp, Homo sapiens
gtacagaatgcttggtaaggca

SEQ ID NO: 8077600 - DNA, 22 bp, Homo sapiens
gtacagcacagagcatcgcaca

SEQ ID NO: 8077601 - DNA, 22 bp, Homo sapiens
gtggcaggggcgggctgttccg

SEQ ID NO: 8077602 - DNA, 22 bp, Homo sapiens
gtggcagggctttgctgttctt

SEQ ID NO: 8077603 - DNA, 22 bp, Homo sapiens
gtggcaggatcacggctcactg

SEQ ID NO: 8077604 - DNA, 22 bp, Homo sapiens
gtggcccaggcttggcgctggc

SEQ ID NO: 8077605 - DNA, 22 bp, Homo sapiens
gtggccaggacattgccaggca

SEQ ID NO: 8077606 - DNA, 22 bp, Homo sapiens
gtggccaggccgactgccaggc

SEQ ID NO: 8077607 - DNA, 22 bp, Homo sapiens
gtggccagaagactgcaatgct

SEQ ID NO: 8077608 - DNA, 22 bp, Homo sapiens
gtggccagccagggtgctgatg

SEQ ID NO: 8077609 - DNA, 22 bp, Homo sapiens
gtggccagcaagtgctgcctct

SEQ ID NO: 8077610 - DNA, 22 bp, Homo sapiens
gtggccagaggtcccatgtgtc

SEQ ID NO: 8077611 - DNA, 22 bp, Homo sapiens
gtgggagtggggaagcagagtg

SEQ ID NO: 8077612 - DNA, 22 bp, Homo sapiens
gtggctgcatcggggtgaccag

SEQ ID NO: 8077613 - DNA, 22 bp, Homo sapiens
gtggctgtatagccaagtcaga

SEQ ID NO: 8077614 - DNA, 22 bp, Homo sapiens
gtggcctggagtttgatgtagg

SEQ ID NO: 8077615 - DNA, 19 bp, Homo sapiens
gtggcctgcgctgggtgcg

SEQ ID NO: 8077616 - DNA, 22 bp, Homo sapiens
gtggcctgagcttcagagttgg

SEQ ID NO: 8077617 - DNA, 22 bp, Homo sapiens
gtggcctgccagcagatggcgc

SEQ ID NO: 8077618 - DNA, 22 bp, Homo sapiens
gtggcctggatagactccatct

SEQ ID NO: 8077619 - DNA, 22 bp, Homo sapiens
gtggcctggggtttgttctgag

SEQ ID NO: 8077620 - DNA, 22 bp, Homo sapiens
gtggaattcaaaatgtaggcat

SEQ ID NO: 8077621 - DNA, 22 bp, Homo sapiens
gtgcctttgagaagtttctctg

SEQ ID NO: 8077622 - DNA, 22 bp, Homo sapiens
gtgcctgccccactcctcagca

SEQ ID NO: 8077623 - DNA, 22 bp, Homo sapiens
gtgaaggccgtccttggggact

SEQ ID NO: 8077624 - DNA, 22 bp, Homo sapiens
gtggcacattggtagggtctgt

SEQ ID NO: 8077625 - DNA, 20 bp, Homo sapiens
tctgtaaagactccagaagc

SEQ ID NO: 8077626 - DNA, 22 bp, Homo sapiens
tctgtaaagactccaaaagcca

SEQ ID NO: 8077627 - DNA, 22 bp, Homo sapiens
tctgtaaacacccgtaagcttt

SEQ ID NO: 8077628 - DNA, 22 bp, Homo sapiens
tctgtaaacacccgtaagcttt

SEQ ID NO: 8077629 - DNA, 22 bp, Homo sapiens
tctgtaaagccctggtacctgg

SEQ ID NO: 8077630 - DNA, 22 bp, Homo sapiens
tctgtaaagtctgtgtaaagtc

SEQ ID NO: 8077631 - DNA, 22 bp, Homo sapiens
tctgtaaagtctgtgtaaagtc

SEQ ID NO: 8077632 - DNA, 22 bp, Homo sapiens
tctgtaaagccctggtacctgg

SEQ ID NO: 8077633 - DNA, 22 bp, Homo sapiens
tctgtaaagatgtttatacctt

SEQ ID NO: 8077634 - DNA, 20 bp, Homo sapiens
tctgtaaagactccagaagc

SEQ ID NO: 8077635 - DNA, 22 bp, Homo sapiens
tctgtaaatcctgctcagcaac

SEQ ID NO: 8077636 - DNA, 22 bp, Homo sapiens
tctgtaaatcctgctcagcaac

SEQ ID NO: 8077637 - DNA, 22 bp, Homo sapiens
tctgtaaatctactaagagctc

SEQ ID NO: 8077638 - DNA, 22 bp, Homo sapiens
tctgtaaatctactaagagctc

SEQ ID NO: 8077639 - DNA, 22 bp, Homo sapiens
tctgtaaaacttctttgtaaat

SEQ ID NO: 8077640 - DNA, 22 bp, Homo sapiens
tctgtaaaacttctttgtaaat

SEQ ID NO: 8077641 - DNA, 22 bp, Homo sapiens
tctgtaaaacaatattgtattc

SEQ ID NO: 8077642 - DNA, 22 bp, Homo sapiens
tctgtaaaacaatattgtattc

SEQ ID NO: 8077643 - DNA, 22 bp, Homo sapiens
tctgtaaaattagtataattgt

SEQ ID NO: 8077644 - DNA, 22 bp, Homo sapiens
tctgtaaaattagtataattgt

SEQ ID NO: 8077645 - DNA, 22 bp, Homo sapiens
tctgtaaacaccatgttagagt

SEQ ID NO: 8077646 - DNA, 22 bp, Homo sapiens
tctgtaaacaccatgttagagt

SEQ ID NO: 8077647 - DNA, 22 bp, Homo sapiens
tctgggggttaagtgaggacaa

SEQ ID NO: 8077648 - DNA, 22 bp, Homo sapiens
tctgggggcgaccagggactgc

SEQ ID NO: 8077649 - DNA, 22 bp, Homo sapiens
tctgggggaggaggcatggccc

SEQ ID NO: 8077650 - DNA, 22 bp, Homo sapiens
tcttaaaagtatgccaattgga

SEQ ID NO: 8077651 - DNA, 22 bp, Homo sapiens
tctgttttgtaccagatacagc

SEQ ID NO: 8077652 - DNA, 22 bp, Homo sapiens
tctgttttgcataatgttcttt

SEQ ID NO: 8077653 - DNA, 22 bp, Homo sapiens
tctgtttattcaatttctatat

SEQ ID NO: 8077654 - DNA, 22 bp, Homo sapiens
tcttatcttatacctaacagcc

SEQ ID NO: 8077655 - DNA, 22 bp, Homo sapiens
tcttaaatgactgataagagga

SEQ ID NO: 8077656 - DNA, 20 bp, Homo sapiens
tcttaaatccccagggccat

SEQ ID NO: 8077657 - DNA, 22 bp, Homo sapiens
tcttaacagtgctacagagcag

SEQ ID NO: 8077658 - DNA, 22 bp, Homo sapiens
tctgttatatgttttttctaaa

SEQ ID NO: 8077659 - DNA, 22 bp, Homo sapiens
tctgtttatatgtttttcagac

SEQ ID NO: 8077660 - DNA, 22 bp, Homo sapiens
tctgtttatatttcaaaccttc

SEQ ID NO: 8077661 - DNA, 22 bp, Homo sapiens
tctgtttagatgctttatctgt

SEQ ID NO: 8077662 - DNA, 22 bp, Homo sapiens
tctgttgcatatgctgctgggt

SEQ ID NO: 8077663 - DNA, 22 bp, Homo sapiens
tctgtttaatgggaatgatact

SEQ ID NO: 8077664 - DNA, 22 bp, Homo sapiens
tctttcaatgagcattctttcc

SEQ ID NO: 8077665 - DNA, 22 bp, Homo sapiens
tctttcccagtagctctcccag

SEQ ID NO: 8077666 - DNA, 22 bp, Homo sapiens
tctttcccagtagctctcccag

SEQ ID NO: 8077667 - DNA, 22 bp, Homo sapiens
tctttcccgccagagcatgagt

SEQ ID NO: 8077668 - DNA, 22 bp, Homo sapiens
tctttcccctacatttggttaa

SEQ ID NO: 8077669 - DNA, 22 bp, Homo sapiens
tctttagctagaaatactctaa

SEQ ID NO: 8077670 - DNA, 22 bp, Homo sapiens
tctttctacatcatttgcttct

SEQ ID NO: 8077671 - DNA, 22 bp, Homo sapiens
tctttcccttagaacattaaca

SEQ ID NO: 8077672 - DNA, 22 bp, Homo sapiens
tctttcccttagaacattaaca

SEQ ID NO: 8077673 - DNA, 17 bp, Homo sapiens
tctttccctgggagatg

SEQ ID NO: 8077674 - DNA, 22 bp, Homo sapiens
tctttccctgtgttagcctgta

SEQ ID NO: 8077675 - DNA, 22 bp, Homo sapiens
tctttcttacaaagaaaacggt

SEQ ID NO: 8077676 - DNA, 22 bp, Homo sapiens
tctttctagtggcctctattct

SEQ ID NO: 8077677 - DNA, 22 bp, Homo sapiens
tcttggactcaaaattgcctta

SEQ ID NO: 8077678 - DNA, 22 bp, Homo sapiens
tcttggaatctccatagagtga

SEQ ID NO: 8077679 - DNA, 22 bp, Homo sapiens
tcttggaagcctcaagatactc

SEQ ID NO: 8077680 - DNA, 22 bp, Homo sapiens
tcttggccccaaccctctattt

SEQ ID NO: 8077681 - DNA, 22 bp, Homo sapiens
tctttacaagtcacattttctg

SEQ ID NO: 8077682 - DNA, 22 bp, Homo sapiens
tctttaatgtactttctttcac

SEQ ID NO: 8077683 - DNA, 22 bp, Homo sapiens
tcttgggccaatattctgggta

SEQ ID NO: 8077684 - DNA, 21 bp, Homo sapiens
tcttggggaggagggctgcac

SEQ ID NO: 8077685 - DNA, 22 bp, Homo sapiens
tcttcctctctaattgatcaga

SEQ ID NO: 8077686 - DNA, 22 bp, Homo sapiens
tcttccttaaatgtttggtaga

SEQ ID NO: 8077687 - DNA, 22 bp, Homo sapiens
tcttccttctttgatgacaagg

SEQ ID NO: 8077688 - DNA, 22 bp, Homo sapiens
tcttccttgctccttgtcactt

SEQ ID NO: 8077689 - DNA, 22 bp, Homo sapiens
tcttctcccatctccaggcagg

SEQ ID NO: 8077690 - DNA, 22 bp, Homo sapiens
tcttctcctttgccatgtgttt

SEQ ID NO: 8077691 - DNA, 22 bp, Homo sapiens
tcttctgtattgttaactcagg

SEQ ID NO: 8077692 - DNA, 22 bp, Homo sapiens
tcttctcccatcggccgcaggg

SEQ ID NO: 8077693 - DNA, 22 bp, Homo sapiens
tcttctgttttagattgcatac

SEQ ID NO: 8077694 - DNA, 20 bp, Homo sapiens
tcttctgttgccttgttctg

SEQ ID NO: 8077695 - DNA, 22 bp, Homo sapiens
tcttatgtcaagaatgaatatt

SEQ ID NO: 8077696 - DNA, 22 bp, Homo sapiens
tctgacattagattaattggaa

SEQ ID NO: 8077697 - DNA, 22 bp, Homo sapiens
tctgatgtaggcttttctggga

SEQ ID NO: 8077698 - DNA, 22 bp, Homo sapiens
tctgatgcaatgtaagtcttgg

SEQ ID NO: 8077699 - DNA, 22 bp, Homo sapiens
tctgatttactggaaaaaagga

SEQ ID NO: 8077700 - DNA, 22 bp, Homo sapiens
tctgattagctccatttgctaa

SEQ ID NO: 8077701 - DNA, 22 bp, Homo sapiens
tctgcctgagggagctgaggaa

SEQ ID NO: 8077702 - DNA, 22 bp, Homo sapiens
tctgcctgccagtctggtcctc

SEQ ID NO: 8077703 - DNA, 21 bp, Homo sapiens
tctgcctgagactttgctggt

SEQ ID NO: 8077704 - DNA, 22 bp, Homo sapiens
tctgcctgaggactgacaccag

SEQ ID NO: 8077705 - DNA, 22 bp, Homo sapiens
tctgcccctgctgggcacagag

SEQ ID NO: 8077706 - DNA, 18 bp, Homo sapiens
tctgccccagccgcactg

SEQ ID NO: 8077707 - DNA, 22 bp, Homo sapiens
tctgcctggattccattctcca

SEQ ID NO: 8077708 - DNA, 22 bp, Homo sapiens
tctgcctggcggactcccggaa

SEQ ID NO: 8077709 - DNA, 22 bp, Homo sapiens
tctgcctgctaactcctgcacc

SEQ ID NO: 8077710 - DNA, 22 bp, Homo sapiens
tctgccttctatcttttgtctg

SEQ ID NO: 8077711 - DNA, 22 bp, Homo sapiens
tctgcctgtggatacatgctct

SEQ ID NO: 8077712 - DNA, 22 bp, Homo sapiens
tctgcaggaaaaaagtgcctgg

SEQ ID NO: 8077713 - DNA, 22 bp, Homo sapiens
tctgcaggaagctggcggctga

SEQ ID NO: 8077714 - DNA, 22 bp, Homo sapiens
tctgcaggagagtgccctagag

SEQ ID NO: 8077715 - DNA, 22 bp, Homo sapiens
tctgcaggcctcgacaaggcca

SEQ ID NO: 8077716 - DNA, 22 bp, Homo sapiens
tctgcaggatgcaaagtgtaca

SEQ ID NO: 8077717 - DNA, 22 bp, Homo sapiens
tctgcaggatggatgctcagaa

SEQ ID NO: 8077718 - DNA, 22 bp, Homo sapiens
tctgcaggaggctggctgcagg

SEQ ID NO: 8077719 - DNA, 22 bp, Homo sapiens
tctgcaggagcagggcgtggag

SEQ ID NO: 8077720 - DNA, 22 bp, Homo sapiens
tctgcaggtagagctcaggaat

SEQ ID NO: 8077721 - DNA, 22 bp, Homo sapiens
tctgcagggtcccagcctcagc

SEQ ID NO: 8077722 - DNA, 22 bp, Homo sapiens
tctgcagggcccttggctcctg

SEQ ID NO: 8077723 - DNA, 22 bp, Homo sapiens
tctgcaggcttggagtggcagc

SEQ ID NO: 8077724 - DNA, 22 bp, Homo sapiens
tctgcaggcttataggatgggt

SEQ ID NO: 8077725 - DNA, 22 bp, Homo sapiens
tctgcaggtcacgctccagcct

SEQ ID NO: 8077726 - DNA, 22 bp, Homo sapiens
tctgcaggtgggcccctagaat

SEQ ID NO: 8077727 - DNA, 22 bp, Homo sapiens
tctgcatattgttaatggaatg

SEQ ID NO: 8077728 - DNA, 22 bp, Homo sapiens
tctgcatattgttaatggaatg

SEQ ID NO: 8077729 - DNA, 22 bp, Homo sapiens
tctgccatgctaacttcagtat

SEQ ID NO: 8077730 - DNA, 22 bp, Homo sapiens
tctgccatgcacccggacagct

SEQ ID NO: 8077731 - DNA, 22 bp, Homo sapiens
tctgccatcttacatggtcact

SEQ ID NO: 8077732 - DNA, 22 bp, Homo sapiens
tctgccatcttaattctctttt

SEQ ID NO: 8077733 - DNA, 22 bp, Homo sapiens
tctgccattgatgagctggcat

SEQ ID NO: 8077734 - DNA, 22 bp, Homo sapiens
tctgccatgtgaggatatagga

SEQ ID NO: 8077735 - DNA, 22 bp, Homo sapiens
tctgccatgggtatttaggatt

SEQ ID NO: 8077736 - DNA, 18 bp, Homo sapiens
tctgccatgtgaggacac

SEQ ID NO: 8077737 - DNA, 22 bp, Homo sapiens
tctgccatcaagatgctctggc

SEQ ID NO: 8077738 - DNA, 22 bp, Homo sapiens
tctgccatcaagatgctctggc

SEQ ID NO: 8077739 - DNA, 22 bp, Homo sapiens
tctgggaggtactgggaggtgt

SEQ ID NO: 8077740 - DNA, 22 bp, Homo sapiens
tctgggaggggctgccattgct

SEQ ID NO: 8077741 - DNA, 22 bp, Homo sapiens
tctgggagtgtgtctggccatc

SEQ ID NO: 8077742 - DNA, 22 bp, Homo sapiens
tctgggagtaaggcctaggcat

SEQ ID NO: 8077743 - DNA, 22 bp, Homo sapiens
tctgggagagcacgtggctgac

SEQ ID NO: 8077744 - DNA, 21 bp, Homo sapiens
tctgggcagcccagtcctgag

SEQ ID NO: 8077745 - DNA, 19 bp, Homo sapiens
tctgggcagggccagcacc

SEQ ID NO: 8077746 - DNA, 22 bp, Homo sapiens
tctgggcagcctcaggccaggg

SEQ ID NO: 8077747 - DNA, 22 bp, Homo sapiens
tctgggcactgctgagcctgta

SEQ ID NO: 8077748 - DNA, 22 bp, Homo sapiens
tctgctgtaaagaatttctgcc

SEQ ID NO: 8077749 - DNA, 22 bp, Homo sapiens
tctcctttgaaagttaggactg

SEQ ID NO: 8077750 - DNA, 22 bp, Homo sapiens
tctcctttcttttaaaatgtca

SEQ ID NO: 8077751 - DNA, 21 bp, Homo sapiens
tctcgttgtatggtcttgggg

SEQ ID NO: 8077752 - DNA, 21 bp, Homo sapiens
tctcctgggtccaacccatgc

SEQ ID NO: 8077753 - DNA, 22 bp, Homo sapiens
tctcctggccctgtcgccatct

SEQ ID NO: 8077754 - DNA, 20 bp, Homo sapiens
tctcctggtgacagtaccca

SEQ ID NO: 8077755 - DNA, 18 bp, Homo sapiens
tctccttccaaatcttca

SEQ ID NO: 8077756 - DNA, 22 bp, Homo sapiens
tctcccccagtctctacagcag

SEQ ID NO: 8077757 - DNA, 19 bp, Homo sapiens
tctcccagctgagaagggc

SEQ ID NO: 8077758 - DNA, 22 bp, Homo sapiens
tctcccaggtgggtgcctggag

SEQ ID NO: 8077759 - DNA, 22 bp, Homo sapiens
tctccaggttcagtcgatggaa

SEQ ID NO: 8077760 - DNA, 22 bp, Homo sapiens
tctccaggtggggtcacctttt

SEQ ID NO: 8077761 - DNA, 22 bp, Homo sapiens
tctccaggtagatatgtcagga

SEQ ID NO: 8077762 - DNA, 22 bp, Homo sapiens
tctccaggtagatatgtcagga

SEQ ID NO: 8077763 - DNA, 22 bp, Homo sapiens
tctccaggggcagggtctggag

SEQ ID NO: 8077764 - DNA, 22 bp, Homo sapiens
tctccagggcagagaatagcaa

SEQ ID NO: 8077765 - DNA, 22 bp, Homo sapiens
tctccaggggctgctgtgccac

SEQ ID NO: 8077766 - DNA, 22 bp, Homo sapiens
tctccaggtaaatggcatcctg

SEQ ID NO: 8077767 - DNA, 22 bp, Homo sapiens
tctccaggctttttgtgaattg

SEQ ID NO: 8077768 - DNA, 22 bp, Homo sapiens
tctccagggaggtagcccagtg

SEQ ID NO: 8077769 - DNA, 22 bp, Homo sapiens
tctccagggactgaggctggag

SEQ ID NO: 8077770 - DNA, 22 bp, Homo sapiens
tctccaggcttaatctcagctt

SEQ ID NO: 8077771 - DNA, 22 bp, Homo sapiens
tctcagggcagcaaggaagcat

SEQ ID NO: 8077772 - DNA, 22 bp, Homo sapiens
tctcacagtgagcctgaggtcg

SEQ ID NO: 8077773 - DNA, 22 bp, Homo sapiens
tctcacagtatgaattgttcac

SEQ ID NO: 8077774 - DNA, 22 bp, Homo sapiens
tctcacaggtgcacgtggctgt

SEQ ID NO: 8077775 - DNA, 22 bp, Homo sapiens
tctcacagggctaggccctgcc

SEQ ID NO: 8077776 - DNA, 20 bp, Homo sapiens
tctcacaggggcttttctct

SEQ ID NO: 8077777 - DNA, 22 bp, Homo sapiens
tctcacagttgtccactgaaaa

SEQ ID NO: 8077778 - DNA, 22 bp, Homo sapiens
tctcacagttgtcccttgtgag

SEQ ID NO: 8077779 - DNA, 19 bp, Homo sapiens
tctcacagtttccttgcct

SEQ ID NO: 8077780 - DNA, 22 bp, Homo sapiens
tctcacagtgcaggtctgtctc

SEQ ID NO: 8077781 - DNA, 22 bp, Homo sapiens
tctcactgcaaatattatgtat

SEQ ID NO: 8077782 - DNA, 22 bp, Homo sapiens
tctcactgatttgagaccaagg

SEQ ID NO: 8077783 - DNA, 22 bp, Homo sapiens
tctcactgggtataaatgagta

SEQ ID NO: 8077784 - DNA, 22 bp, Homo sapiens
tctcactgggtcacagcagagg

SEQ ID NO: 8077785 - DNA, 21 bp, Homo sapiens
tctcactgtctgctttgttta

SEQ ID NO: 8077786 - DNA, 22 bp, Homo sapiens
tctcagggcgcagtgaggcagt

SEQ ID NO: 8077787 - DNA, 23 bp, Homo sapiens
tctcatttcccttgatctatctt

SEQ ID NO: 8077788 - DNA, 22 bp, Homo sapiens
tctccacaagctttctcctttt

SEQ ID NO: 8077789 - DNA, 22 bp, Homo sapiens
tctccaaatagttatatttaga

SEQ ID NO: 8077790 - DNA, 22 bp, Homo sapiens
tctccaggactgagctccagcc

SEQ ID NO: 8077791 - DNA, 22 bp, Homo sapiens
tctccaggagaaatatgaagga

SEQ ID NO: 8077792 - DNA, 22 bp, Homo sapiens
tctccaggcactacctgggtaa

SEQ ID NO: 8077793 - DNA, 22 bp, Homo sapiens
tctccaggagcaagtcacccag

SEQ ID NO: 8077794 - DNA, 22 bp, Homo sapiens
tctccaggcacttggctgctac

SEQ ID NO: 8077795 - DNA, 22 bp, Homo sapiens
tctctggggaaaaggctgatac

SEQ ID NO: 8077796 - DNA, 22 bp, Homo sapiens
tctctgaagaatcgatgattct

SEQ ID NO: 8077797 - DNA, 22 bp, Homo sapiens
tctctgaaggggagctgtttaa

SEQ ID NO: 8077798 - DNA, 22 bp, Homo sapiens
tctctgaaggctgtgttgatgg

SEQ ID NO: 8077799 - DNA, 22 bp, Homo sapiens
tctctgaagctcaattgagata

SEQ ID NO: 8077800 - DNA, 22 bp, Homo sapiens
tctctctcctagtttttagtgg

SEQ ID NO: 8077801 - DNA, 19 bp, Homo sapiens
tctcttctccctggtttta

SEQ ID NO: 8077802 - DNA, 22 bp, Homo sapiens
tctcttcttgattttcactgga

SEQ ID NO: 8077803 - DNA, 22 bp, Homo sapiens
tctcttctgaaacctgtcttta

SEQ ID NO: 8077804 - DNA, 22 bp, Homo sapiens
tctcttctaacactagaaattc

SEQ ID NO: 8077805 - DNA, 22 bp, Homo sapiens
tctctttaagtataatcttata

SEQ ID NO: 8077806 - DNA, 22 bp, Homo sapiens
tctcttcttgtgttttcctgcc

SEQ ID NO: 8077807 - DNA, 22 bp, Homo sapiens
tctcttttctttctggataaaa

SEQ ID NO: 8077808 - DNA, 20 bp, Homo sapiens
tctcttttagcttacagctg

SEQ ID NO: 8077809 - DNA, 17 bp, Homo sapiens
tctgaagccagtctgct

SEQ ID NO: 8077810 - DNA, 22 bp, Homo sapiens
tctcacagctctgctgcatgct

SEQ ID NO: 8077811 - DNA, 19 bp, Homo sapiens
tctcacagctctactatgt

SEQ ID NO: 8077812 - DNA, 23 bp, Homo sapiens
tctcacagcgatctaggaagagg

SEQ ID NO: 8077813 - DNA, 22 bp, Homo sapiens
tctcacagcaggggccaggtct

SEQ ID NO: 8077814 - DNA, 22 bp, Homo sapiens
tctcacagcattatccagggca

SEQ ID NO: 8077815 - DNA, 22 bp, Homo sapiens
tctcacagcatcattgctcatg

SEQ ID NO: 8077816 - DNA, 22 bp, Homo sapiens
tctcacagccatttctccctct

SEQ ID NO: 8077817 - DNA, 22 bp, Homo sapiens
tctcacagcctctggaggtagt

SEQ ID NO: 8077818 - DNA, 22 bp, Homo sapiens
tctcacagaggcttgggctcat

SEQ ID NO: 8077819 - DNA, 20 bp, Homo sapiens
tctcacagacatcgtctcat

SEQ ID NO: 8077820 - DNA, 22 bp, Homo sapiens
tctcacagatcagcagggggct

SEQ ID NO: 8077821 - DNA, 15 bp, Homo sapiens
tctcacagatcagtc

SEQ ID NO: 8077822 - DNA, 22 bp, Homo sapiens
tctcacagcagagaagggacat

SEQ ID NO: 8077823 - DNA, 22 bp, Homo sapiens
tctatttttatagttgaagtgc

SEQ ID NO: 8077824 - DNA, 22 bp, Homo sapiens
tctatttctgggtttgtgtggt

SEQ ID NO: 8077825 - DNA, 22 bp, Homo sapiens
tctattttatactcaaatcttc

SEQ ID NO: 8077826 - DNA, 22 bp, Homo sapiens
tctattttatactcaaatcttc

SEQ ID NO: 8077827 - DNA, 22 bp, Homo sapiens
tctatttaccaaatgtagttcc

SEQ ID NO: 8077828 - DNA, 22 bp, Homo sapiens
tctattacttaccactaattca

SEQ ID NO: 8077829 - DNA, 22 bp, Homo sapiens
tctattacttaccactaattca

SEQ ID NO: 8077830 - DNA, 22 bp, Homo sapiens
tctataaagggccagatagtag

SEQ ID NO: 8077831 - DNA, 22 bp, Homo sapiens
tctataaaactcaagagcaatt

SEQ ID NO: 8077832 - DNA, 22 bp, Homo sapiens
tctagggagctctagcagtggt

SEQ ID NO: 8077833 - DNA, 22 bp, Homo sapiens
tctacaaagaagaattaatgtc

SEQ ID NO: 8077834 - DNA, 22 bp, Homo sapiens
tctaatgggtaaatatttttat

SEQ ID NO: 8077835 - DNA, 22 bp, Homo sapiens
tctaagaaatcagatgatgagg

SEQ ID NO: 8077836 - DNA, 22 bp, Homo sapiens
tctaaattctttcctgggttga

SEQ ID NO: 8077837 - DNA, 22 bp, Homo sapiens
tctaaattactttgggcagtat

SEQ ID NO: 8077838 - DNA, 23 bp, Homo sapiens
tctacccacactgctctagaagg

SEQ ID NO: 8077839 - DNA, 22 bp, Homo sapiens
tctactttataagtatataagt

SEQ ID NO: 8077840 - DNA, 22 bp, Homo sapiens
tctagctgccccgaggcagggt

SEQ ID NO: 8077841 - DNA, 22 bp, Homo sapiens
tctagcaagctcgtgctcaagg

SEQ ID NO: 8077842 - DNA, 22 bp, Homo sapiens
tccttcaactttttacttgccc

SEQ ID NO: 8077843 - DNA, 22 bp, Homo sapiens
tccttacatgcttccttataca

SEQ ID NO: 8077844 - DNA, 22 bp, Homo sapiens
tccttctctggtttttactgta

SEQ ID NO: 8077845 - DNA, 22 bp, Homo sapiens
tccttggcaagacacagcacag

SEQ ID NO: 8077846 - DNA, 22 bp, Homo sapiens
tccttgccctaaatgtctgtgt

SEQ ID NO: 8077847 - DNA, 22 bp, Homo sapiens
tccttggaagagcattcccagg

SEQ ID NO: 8077848 - DNA, 22 bp, Homo sapiens
tccttcttcatgaagatatatg

SEQ ID NO: 8077849 - DNA, 19 bp, Homo sapiens
tcgtggggaggtgggcagc

SEQ ID NO: 8077850 - DNA, 22 bp, Homo sapiens
tctaaaatgcagatctactggt

SEQ ID NO: 8077851 - DNA, 22 bp, Homo sapiens
tcctttttaagtcgttgtggta

SEQ ID NO: 8077852 - DNA, 22 bp, Homo sapiens
tccttttttatgaagctttgag

SEQ ID NO: 8077853 - DNA, 22 bp, Homo sapiens
tcgaaccacgtagtaaacaaca

SEQ ID NO: 8077854 - DNA, 22 bp, Homo sapiens
tccttttccctgaaggtattta

SEQ ID NO: 8077855 - DNA, 22 bp, Homo sapiens
tccttggctctttgataaatac

SEQ ID NO: 8077856 - DNA, 22 bp, Homo sapiens
tccttgggaaacatcatgtaat

SEQ ID NO: 8077857 - DNA, 22 bp, Homo sapiens
tcctttcttgtgtatcaaatgg

SEQ ID NO: 8077858 - DNA, 22 bp, Homo sapiens
tcctttctccttccgacttcat

SEQ ID NO: 8077859 - DNA, 22 bp, Homo sapiens
tcctggctctgctgcctcctag

SEQ ID NO: 8077860 - DNA, 22 bp, Homo sapiens
tcctggctcgattgctaccaat

SEQ ID NO: 8077861 - DNA, 22 bp, Homo sapiens
tcctggctctaagtcctgagtg

SEQ ID NO: 8077862 - DNA, 22 bp, Homo sapiens
tcctggcctcgctgtccacctt

SEQ ID NO: 8077863 - DNA, 23 bp, Homo sapiens
taagaacagacaagcatttacat

SEQ ID NO: 8077864 - DNA, 17 bp, Homo sapiens
tcctgtgggtgcagcag

SEQ ID NO: 8077865 - DNA, 22 bp, Homo sapiens
tcctggggctctttgatgtgat

SEQ ID NO: 8077866 - DNA, 22 bp, Homo sapiens
tcctggggctgcaaggcctgtc

SEQ ID NO: 8077867 - DNA, 22 bp, Homo sapiens
tcctggggccaggcacctctgg

SEQ ID NO: 8077868 - DNA, 22 bp, Homo sapiens
tcctggggccagcactggtgga

SEQ ID NO: 8077869 - DNA, 19 bp, Homo sapiens
tcctggggatgtggtcacc

SEQ ID NO: 8077870 - DNA, 22 bp, Homo sapiens
tcctggggtcctgactgcttcc

SEQ ID NO: 8077871 - DNA, 22 bp, Homo sapiens
tcctggggtgtgttttgctgct

SEQ ID NO: 8077872 - DNA, 22 bp, Homo sapiens
tcctgggaccgagggaagagct

SEQ ID NO: 8077873 - DNA, 22 bp, Homo sapiens
tcctggcttttcttggctcatc

SEQ ID NO: 8077874 - DNA, 22 bp, Homo sapiens
tcctggcttctgtctccttatt

SEQ ID NO: 8077875 - DNA, 22 bp, Homo sapiens
tcctggctgcaccagtgaccct

SEQ ID NO: 8077876 - DNA, 22 bp, Homo sapiens
tcctggctgagttcccaagtcg

SEQ ID NO: 8077877 - DNA, 22 bp, Homo sapiens
tcctggcttccactcctctgtt

SEQ ID NO: 8077878 - DNA, 22 bp, Homo sapiens
tcctggcttcctgctcttgtca

SEQ ID NO: 8077879 - DNA, 22 bp, Homo sapiens
tcctggcttccacacctgtcat

SEQ ID NO: 8077880 - DNA, 22 bp, Homo sapiens
tgcagaaataaagatattatca

SEQ ID NO: 8077881 - DNA, 22 bp, Homo sapiens
tgcagaaacaagccatcattca

SEQ ID NO: 8077882 - DNA, 22 bp, Homo sapiens
tgcagaaggcctgacattgcac

SEQ ID NO: 8077883 - DNA, 22 bp, Homo sapiens
tgcagaagatggtctgagcacc

SEQ ID NO: 8077884 - DNA, 22 bp, Homo sapiens
tgcagaagcagagccggtggcc

SEQ ID NO: 8077885 - DNA, 22 bp, Homo sapiens
tgcagaagaaaacagctgtgtg

SEQ ID NO: 8077886 - DNA, 19 bp, Homo sapiens
tgcagaagacacagtggtg

SEQ ID NO: 8077887 - DNA, 22 bp, Homo sapiens
tgcagcaagaccggatatgtcg

SEQ ID NO: 8077888 - DNA, 22 bp, Homo sapiens
tgcagcaagaaggcactgtctg

SEQ ID NO: 8077889 - DNA, 22 bp, Homo sapiens
tgcagcaacaagatagaatggc

SEQ ID NO: 8077890 - DNA, 22 bp, Homo sapiens
tgcagcaatttgcagtaattta

SEQ ID NO: 8077891 - DNA, 18 bp, Homo sapiens
tgcagcaagtgctaaata

SEQ ID NO: 8077892 - DNA, 22 bp, Homo sapiens
tgcagatgagggatgaaaatga

SEQ ID NO: 8077893 - DNA, 23 bp, Homo sapiens
tgatctctcttgggaggcaatat

SEQ ID NO: 8077894 - DNA, 22 bp, Homo sapiens
tgatatttgctgactgcattgt

SEQ ID NO: 8077895 - DNA, 22 bp, Homo sapiens
tgagtgcctaccaagtgctgga

SEQ ID NO: 8077896 - DNA, 22 bp, Homo sapiens
tgagtgaggctgggcagtccct

SEQ ID NO: 8077897 - DNA, 22 bp, Homo sapiens
tgattaaaatttaacttagtta

SEQ ID NO: 8077898 - DNA, 23 bp, Homo sapiens
tgattacaagggccaaagaaagg

SEQ ID NO: 8077899 - DNA, 22 bp, Homo sapiens
tgattctgatcatcatcatggt

SEQ ID NO: 8077900 - DNA, 22 bp, Homo sapiens
tgcacacacaggagtctcctcc

SEQ ID NO: 8077901 - DNA, 22 bp, Homo sapiens
tgcacacagtggacaagtcttg

SEQ ID NO: 8077902 - DNA, 22 bp, Homo sapiens
tgcaaatttctttagtacataa

SEQ ID NO: 8077903 - DNA, 23 bp, Homo sapiens
tgcaacaatgaggaaagctactg

SEQ ID NO: 8077904 - DNA, 22 bp, Homo sapiens
tgattttcatgggtgatctttg

SEQ ID NO: 8077905 - DNA, 22 bp, Homo sapiens
tgcaaaaactgcaattgctttt

SEQ ID NO: 8077906 - DNA, 22 bp, Homo sapiens
tgcaaaatgacttctgaaaaga

SEQ ID NO: 8077907 - DNA, 22 bp, Homo sapiens
tgcaaaataatgaacgattttt

SEQ ID NO: 8077908 - DNA, 22 bp, Homo sapiens
tgcaaaagaatatagatattgt

SEQ ID NO: 8077909 - DNA, 22 bp, Homo sapiens
tgcaaactattggtagagatgg

SEQ ID NO: 8077910 - DNA, 22 bp, Homo sapiens
tgcaaacaactgtttaatgctg

SEQ ID NO: 8077911 - DNA, 22 bp, Homo sapiens
tgcaaacagaaagtttattgtg

SEQ ID NO: 8077912 - DNA, 20 bp, Homo sapiens
tgcaaacacagagtgtatga

SEQ ID NO: 8077913 - DNA, 20 bp, Homo sapiens
tgcaaacacagagtgtatga

SEQ ID NO: 8077914 - DNA, 19 bp, Homo sapiens
tgcaaattctaaaaactga

SEQ ID NO: 8077915 - DNA, 22 bp, Homo sapiens
tgcaaatttaatgaaactatgt

SEQ ID NO: 8077916 - DNA, 22 bp, Homo sapiens
tgccctgggaacacagatgcca

SEQ ID NO: 8077917 - DNA, 22 bp, Homo sapiens
tgccctgggacatgcagcggag

SEQ ID NO: 8077918 - DNA, 22 bp, Homo sapiens
tgccctggcacacacacagctg

SEQ ID NO: 8077919 - DNA, 22 bp, Homo sapiens
tgcctcaggcacctggcaggtt

SEQ ID NO: 8077920 - DNA, 22 bp, Homo sapiens
tgcctccctggcaagtctctcc

SEQ ID NO: 8077921 - DNA, 19 bp, Homo sapiens
tgcctggcaccagctccac

SEQ ID NO: 8077922 - DNA, 22 bp, Homo sapiens
tgcctggcaccccagtctgcac

SEQ ID NO: 8077923 - DNA, 22 bp, Homo sapiens
tgccccagacctactgaatggg

SEQ ID NO: 8077924 - DNA, 22 bp, Homo sapiens
tgccccagactctgctcacctc

SEQ ID NO: 8077925 - DNA, 20 bp, Homo sapiens
tgccccaggcctgcacctgc

SEQ ID NO: 8077926 - DNA, 22 bp, Homo sapiens
tgcccccagacagaatccagtt

SEQ ID NO: 8077927 - DNA, 22 bp, Homo sapiens
tgcccaggtttgagtgcccaag

SEQ ID NO: 8077928 - DNA, 23 bp, Homo sapiens
tgcccagtgcctttgcccatgca

SEQ ID NO: 8077929 - DNA, 22 bp, Homo sapiens
tgcccaggctcctcgcagcctt

SEQ ID NO: 8077930 - DNA, 22 bp, Homo sapiens
tgcccagggtggagtgcagcgg

SEQ ID NO: 8077931 - DNA, 22 bp, Homo sapiens
tgccatgtttaaagttgaaggg

SEQ ID NO: 8077932 - DNA, 22 bp, Homo sapiens
tgccatttgctggttttctgat

SEQ ID NO: 8077933 - DNA, 22 bp, Homo sapiens
tgcccaaggatccattggctgg

SEQ ID NO: 8077934 - DNA, 21 bp, Homo sapiens
tgccagggatttacagagcct

SEQ ID NO: 8077935 - DNA, 20 bp, Homo sapiens
tgccagggccagcagaggct

SEQ ID NO: 8077936 - DNA, 22 bp, Homo sapiens
tgccagggtcctgagggccttg

SEQ ID NO: 8077937 - DNA, 22 bp, Homo sapiens
tgccatcactgaacttctgaaa

SEQ ID NO: 8077938 - DNA, 22 bp, Homo sapiens
tgccagggtgtcaggagagcta

SEQ ID NO: 8077939 - DNA, 22 bp, Homo sapiens
tgcagggaaagtgttggcagca

SEQ ID NO: 8077940 - DNA, 22 bp, Homo sapiens
tgcagggaaagggcactgggct

SEQ ID NO: 8077941 - DNA, 22 bp, Homo sapiens
tgcagggaagtcccagctcctg

SEQ ID NO: 8077942 - DNA, 22 bp, Homo sapiens
tgcagggaagcaagggtggctc

SEQ ID NO: 8077943 - DNA, 22 bp, Homo sapiens
tgcagggaatccagtctagggt

SEQ ID NO: 8077944 - DNA, 22 bp, Homo sapiens
tgcagggaacttggacagctag

SEQ ID NO: 8077945 - DNA, 22 bp, Homo sapiens
tgcagggcatagggtccagttt

SEQ ID NO: 8077946 - DNA, 22 bp, Homo sapiens
tgcagggcatctttgaagtgtg

SEQ ID NO: 8077947 - DNA, 22 bp, Homo sapiens
tgcagggctacaggactacaac

SEQ ID NO: 8077948 - DNA, 22 bp, Homo sapiens
tgcagggcacggtgcgcgtggg

SEQ ID NO: 8077949 - DNA, 22 bp, Homo sapiens
tgcagggcagatatgactgtag

SEQ ID NO: 8077950 - DNA, 22 bp, Homo sapiens
tgcagggcagtggaggttgagt

SEQ ID NO: 8077951 - DNA, 22 bp, Homo sapiens
tgcagggattgttggcatccat

SEQ ID NO: 8077952 - DNA, 21 bp, Homo sapiens
tgcagggatctttctgcctga

SEQ ID NO: 8077953 - DNA, 23 bp, Homo sapiens
tgcaggggaggcttaaagcaggt

SEQ ID NO: 8077954 - DNA, 20 bp, Homo sapiens
tgcagggctgcctcccagct

SEQ ID NO: 8077955 - DNA, 22 bp, Homo sapiens
tgcagggtcccgaagggaagac

SEQ ID NO: 8077956 - DNA, 22 bp, Homo sapiens
tgcagggtctctgcaaatgagg

SEQ ID NO: 8077957 - DNA, 22 bp, Homo sapiens
tgcagggtggagcggaagcgga

SEQ ID NO: 8077958 - DNA, 22 bp, Homo sapiens
tgcagtggtggtaaagatgctc

SEQ ID NO: 8077959 - DNA, 20 bp, Homo sapiens
tgcaggtgtgtccaagcact

SEQ ID NO: 8077960 - DNA, 22 bp, Homo sapiens
tgccacagttgtttgtgctcta

SEQ ID NO: 8077961 - DNA, 22 bp, Homo sapiens
tgccacaggcaatccctgcacg

SEQ ID NO: 8077962 - DNA, 22 bp, Homo sapiens
tgccacagggtcctcaggccag

SEQ ID NO: 8077963 - DNA, 22 bp, Homo sapiens
tgcatttttgaggttaactcaa

SEQ ID NO: 8077964 - DNA, 22 bp, Homo sapiens
tgcattttacttacctgttagt

SEQ ID NO: 8077965 - DNA, 22 bp, Homo sapiens
tgcattttcttccaccaatatc

SEQ ID NO: 8077966 - DNA, 22 bp, Homo sapiens
tgcattttcttccaccaatatc

SEQ ID NO: 8077967 - DNA, 22 bp, Homo sapiens
tgcatttagttttaataaagga

SEQ ID NO: 8077968 - DNA, 22 bp, Homo sapiens
tgcatttatttgaattgatcta

SEQ ID NO: 8077969 - DNA, 22 bp, Homo sapiens
tgcatttaactagaatattaat

SEQ ID NO: 8077970 - DNA, 22 bp, Homo sapiens
tgcatttaagaaaacatgagtc

SEQ ID NO: 8077971 - DNA, 22 bp, Homo sapiens
tgcatttagttatgagaaaaac

SEQ ID NO: 8077972 - DNA, 18 bp, Homo sapiens
tgcatttagtacatctag

SEQ ID NO: 8077973 - DNA, 22 bp, Homo sapiens
tgcatttacctggaggtcattt

SEQ ID NO: 8077974 - DNA, 22 bp, Homo sapiens
tgcattctgaacgtaaatgtga

SEQ ID NO: 8077975 - DNA, 22 bp, Homo sapiens
tgcattctgaacgtaaatgtga

SEQ ID NO: 8077976 - DNA, 22 bp, Homo sapiens
tgcattctgacttagttaatat

SEQ ID NO: 8077977 - DNA, 22 bp, Homo sapiens
tgcatgtatttaaagttgcaat

SEQ ID NO: 8077978 - DNA, 22 bp, Homo sapiens
tgcatctttctgcatatgtaaa

SEQ ID NO: 8077979 - DNA, 22 bp, Homo sapiens
tgcatgatagagatggtattag

SEQ ID NO: 8077980 - DNA, 22 bp, Homo sapiens
tgcatacatgtttgtgtatttt

SEQ ID NO: 8077981 - DNA, 22 bp, Homo sapiens
tgcatacacacatcaaatgttt

SEQ ID NO: 8077982 - DNA, 22 bp, Homo sapiens
tgcatacataaagtgctatcat

SEQ ID NO: 8077983 - DNA, 21 bp, Homo sapiens
tgcagttttgcttgatctctg

SEQ ID NO: 8077984 - DNA, 22 bp, Homo sapiens
tgcataaaatatgagaaatgta

SEQ ID NO: 8077985 - DNA, 21 bp, Homo sapiens
tgcataaagaaatacaaatac

SEQ ID NO: 8077986 - DNA, 22 bp, Homo sapiens
tgagcattggatcaaatgactt

SEQ ID NO: 8077987 - DNA, 22 bp, Homo sapiens
tgagctgacacccaatcatact

SEQ ID NO: 8077988 - DNA, 22 bp, Homo sapiens
tgagacaataaggctgagaagc

SEQ ID NO: 8077989 - DNA, 22 bp, Homo sapiens
tgagacaacctaattaaacacc

SEQ ID NO: 8077990 - DNA, 22 bp, Homo sapiens
tgagaacagttggaagcagtca

SEQ ID NO: 8077991 - DNA, 22 bp, Homo sapiens
tgagatgaataactcctgctaa

SEQ ID NO: 8077992 - DNA, 22 bp, Homo sapiens
tgagagggttcccaggggtttc

SEQ ID NO: 8077993 - DNA, 22 bp, Homo sapiens
tgagtcacatccatttttgtgt

SEQ ID NO: 8077994 - DNA, 22 bp, Homo sapiens
tgaggggcagagaggtgtccag

SEQ ID NO: 8077995 - DNA, 22 bp, Homo sapiens
tgaggcaggagaatcacatgaa

SEQ ID NO: 8077996 - DNA, 22 bp, Homo sapiens
tgaggcaggagttcaggctgcg

SEQ ID NO: 8077997 - DNA, 23 bp, Homo sapiens
tgaggcaggcggatcacgaggtc

SEQ ID NO: 8077998 - DNA, 22 bp, Homo sapiens
tcttttatctgttgtgtaacaa

SEQ ID NO: 8077999 - DNA, 22 bp, Homo sapiens
tcttttattaggctgaaatggg

SEQ ID NO: 8078000 - DNA, 22 bp, Homo sapiens
tcttttaaaagccctgctgtct

SEQ ID NO: 8078001 - DNA, 21 bp, Homo sapiens
tcttttaacaccaggaattcc

SEQ ID NO: 8078002 - DNA, 18 bp, Homo sapiens
tctttgtttccttcttgc

SEQ ID NO: 8078003 - DNA, 22 bp, Homo sapiens
tcttttagagcatttctgattc

SEQ ID NO: 8078004 - DNA, 22 bp, Homo sapiens
tcttttagtaataaatatttgt

SEQ ID NO: 8078005 - DNA, 22 bp, Homo sapiens
tcttttagctctgcaaggaaag

SEQ ID NO: 8078006 - DNA, 22 bp, Homo sapiens
tcttttaagcctctggcatagg

SEQ ID NO: 8078007 - DNA, 22 bp, Homo sapiens
tcttttagaaaagttgaatgta

SEQ ID NO: 8078008 - DNA, 22 bp, Homo sapiens
tcttttaacctaactagcttgg

SEQ ID NO: 8078009 - DNA, 21 bp, Homo sapiens
tcttttaacaccaggaattcc

SEQ ID NO: 8078010 - DNA, 22 bp, Homo sapiens
tctttgcagttctgattaaata

SEQ ID NO: 8078011 - DNA, 22 bp, Homo sapiens
tctttgcaggccaaattgttaa

SEQ ID NO: 8078012 - DNA, 22 bp, Homo sapiens
tctttgcagtggtgaataaaga

SEQ ID NO: 8078013 - DNA, 23 bp, Homo sapiens
tctttttaagagatctagtgacg

SEQ ID NO: 8078014 - DNA, 22 bp, Homo sapiens
tctttttatattgacaaaaggt

SEQ ID NO: 8078015 - DNA, 22 bp, Homo sapiens
tctttttatattgacaaaaggt

SEQ ID NO: 8078016 - DNA, 22 bp, Homo sapiens
tctttttcttattcccacactg

SEQ ID NO: 8078017 - DNA, 22 bp, Homo sapiens
tgaaaaactttaatccataaag

SEQ ID NO: 8078018 - DNA, 22 bp, Homo sapiens
tgaaaatatagttttccagact

SEQ ID NO: 8078019 - DNA, 22 bp, Homo sapiens
tgaaaatatagttttccagact

SEQ ID NO: 8078020 - DNA, 22 bp, Homo sapiens
tgaaaagtcttatattgtctga

SEQ ID NO: 8078021 - DNA, 19 bp, Homo sapiens
tgaaacaaacttaaaagga

SEQ ID NO: 8078022 - DNA, 19 bp, Homo sapiens
tgaaacaaacttaaaagga

SEQ ID NO: 8078023 - DNA, 22 bp, Homo sapiens
tgaaacttctaatatgaatagt

SEQ ID NO: 8078024 - DNA, 22 bp, Homo sapiens
tgaaacttttgaggttcttcca

SEQ ID NO: 8078025 - DNA, 22 bp, Homo sapiens
tgaaatacacaaatttagtaag

SEQ ID NO: 8078026 - DNA, 23 bp, Homo sapiens
tgaaagcaatgggtctatagtat

SEQ ID NO: 8078027 - DNA, 22 bp, Homo sapiens
tgaaagcacaagttctaacagg

SEQ ID NO: 8078028 - DNA, 22 bp, Homo sapiens
tgaaagttattactgatgatgt

SEQ ID NO: 8078029 - DNA, 22 bp, Homo sapiens
tgaaagttcaataccaatttgg

SEQ ID NO: 8078030 - DNA, 23 bp, Homo sapiens
tgaaagttctgaagagatcatgc

SEQ ID NO: 8078031 - DNA, 21 bp, Homo sapiens
tgaaagttggagtcaaatgta

SEQ ID NO: 8078032 - DNA, 22 bp, Homo sapiens
tgaaagttgcacataagagaat

SEQ ID NO: 8078033 - DNA, 21 bp, Homo sapiens
tgaaatctgatgggacaaatg

SEQ ID NO: 8078034 - DNA, 22 bp, Homo sapiens
tgaaatcatctgccaataagtt

SEQ ID NO: 8078035 - DNA, 22 bp, Homo sapiens
tgaaattccaggagagttaaaa

SEQ ID NO: 8078036 - DNA, 22 bp, Homo sapiens
tgaacaaatggaaataaccagt

SEQ ID NO: 8078037 - DNA, 22 bp, Homo sapiens
tgaacttagtgggaatatctct

SEQ ID NO: 8078038 - DNA, 22 bp, Homo sapiens
tgaactgtggccagtaattaat

SEQ ID NO: 8078039 - DNA, 22 bp, Homo sapiens
tgaactttcacaagaatatgct

SEQ ID NO: 8078040 - DNA, 22 bp, Homo sapiens
tgaacccttgtagaggatggag

SEQ ID NO: 8078041 - DNA, 22 bp, Homo sapiens
tgaaccctgacctctggaagga

SEQ ID NO: 8078042 - DNA, 22 bp, Homo sapiens
tgaacccttaggattttatttg

SEQ ID NO: 8078043 - DNA, 20 bp, Homo sapiens
tgaagattttgtgtttagaa

SEQ ID NO: 8078044 - DNA, 22 bp, Homo sapiens
tgaagcaggcattgactgatga

SEQ ID NO: 8078045 - DNA, 22 bp, Homo sapiens
tgacagaaagagtattaaagat

SEQ ID NO: 8078046 - DNA, 22 bp, Homo sapiens
tgacagattttgatggctaata

SEQ ID NO: 8078047 - DNA, 22 bp, Homo sapiens
tgacatttgagagagatataca

SEQ ID NO: 8078048 - DNA, 22 bp, Homo sapiens
tgacatttatcaaagaaatggt

SEQ ID NO: 8078049 - DNA, 21 bp, Homo sapiens
tgacatttccaatataaagcc

SEQ ID NO: 8078050 - DNA, 22 bp, Homo sapiens
tgacatttatcttctacaatga

SEQ ID NO: 8078051 - DNA, 22 bp, Homo sapiens
tgacattccgcagtaaggttaa

SEQ ID NO: 8078052 - DNA, 22 bp, Homo sapiens
tgacattctgttaagtctcata

SEQ ID NO: 8078053 - DNA, 22 bp, Homo sapiens
tgacatttaatccctaaatatt

SEQ ID NO: 8078054 - DNA, 22 bp, Homo sapiens
tgactaattatgttactaatca

SEQ ID NO: 8078055 - DNA, 22 bp, Homo sapiens
tgactgtacctctaacacctga

SEQ ID NO: 8078056 - DNA, 22 bp, Homo sapiens
tgactgtgtgattaaggcttca

SEQ ID NO: 8078057 - DNA, 22 bp, Homo sapiens
tgacttcaaggttcagcacctt

SEQ ID NO: 8078058 - DNA, 22 bp, Homo sapiens
tgaatgagaacactgaaagagg

SEQ ID NO: 8078059 - DNA, 22 bp, Homo sapiens
tgaatgagtcaatcatttagct

SEQ ID NO: 8078060 - DNA, 22 bp, Homo sapiens
tgaatgtaggtctaatatccca

SEQ ID NO: 8078061 - DNA, 22 bp, Homo sapiens
tgaattcaaattgtgcctatta

SEQ ID NO: 8078062 - DNA, 22 bp, Homo sapiens
tgaattatcttgtaattttgaa

SEQ ID NO: 8078063 - DNA, 22 bp, Homo sapiens
tgaatacactaaaaatcacttt

SEQ ID NO: 8078064 - DNA, 22 bp, Homo sapiens
tgaatacaggaaaatatactga

SEQ ID NO: 8078065 - DNA, 22 bp, Homo sapiens
tgaatactatttcataatgtgg

SEQ ID NO: 8078066 - DNA, 22 bp, Homo sapiens
tgaatatgttcctcacaagttc

SEQ ID NO: 8078067 - DNA, 22 bp, Homo sapiens
tgacacaaacaagatatttgcc

SEQ ID NO: 8078068 - DNA, 23 bp, Homo sapiens
tgaattttggcatattctgaaat

SEQ ID NO: 8078069 - DNA, 22 bp, Homo sapiens
tgaattctggctcttctgttta

SEQ ID NO: 8078070 - DNA, 20 bp, Homo sapiens
tgaattctgggtttatctgc

SEQ ID NO: 8078071 - DNA, 22 bp, Homo sapiens
tgaattctggccctctcactta

SEQ ID NO: 8078072 - DNA, 22 bp, Homo sapiens
tgaattcacctgaaagtctgga

SEQ ID NO: 8078073 - DNA, 22 bp, Homo sapiens
tgaattcaggggctattatatt

SEQ ID NO: 8078074 - DNA, 22 bp, Homo sapiens
tgaattcttatgaaagtgcttg

SEQ ID NO: 8078075 - DNA, 22 bp, Homo sapiens
tgaatttaaaataaatgtagtt

SEQ ID NO: 8078076 - DNA, 21 bp, Homo sapiens
tgaatttccctctatcattct

SEQ ID NO: 8078077 - DNA, 22 bp, Homo sapiens
tgaatttatcaaagattcttaa

SEQ ID NO: 8078078 - DNA, 22 bp, Homo sapiens
tgaagctagcaggaagagcagg

SEQ ID NO: 8078079 - DNA, 22 bp, Homo sapiens
tgaagcagttctcagaagtggg

SEQ ID NO: 8078080 - DNA, 22 bp, Homo sapiens
tgaagctgtgggcagtggagcc

SEQ ID NO: 8078081 - DNA, 22 bp, Homo sapiens
tgaagctgtccttgataggggc

SEQ ID NO: 8078082 - DNA, 22 bp, Homo sapiens
tgaagctgtaggcatgggcagc

SEQ ID NO: 8078083 - DNA, 22 bp, Homo sapiens
tgaagctggaagttaggtagac

SEQ ID NO: 8078084 - DNA, 22 bp, Homo sapiens
tggctccttccgcagcatgcct

SEQ ID NO: 8078085 - DNA, 23 bp, Homo sapiens
tggctctgagaggttcagatgct

SEQ ID NO: 8078086 - DNA, 17 bp, Homo sapiens
tggctctgaggctgaat

SEQ ID NO: 8078087 - DNA, 22 bp, Homo sapiens
tggctctgttgtgctgagccag

SEQ ID NO: 8078088 - DNA, 22 bp, Homo sapiens
tggctctgtttgttaactagac

SEQ ID NO: 8078089 - DNA, 23 bp, Homo sapiens
tggctctgtgtcacatacaggat

SEQ ID NO: 8078090 - DNA, 22 bp, Homo sapiens
tggctctggattaatctaggaa

SEQ ID NO: 8078091 - DNA, 22 bp, Homo sapiens
tggctctggggacagtaagtcc

SEQ ID NO: 8078092 - DNA, 22 bp, Homo sapiens
tggctctttctgtctgggatcc

SEQ ID NO: 8078093 - DNA, 22 bp, Homo sapiens
tggctgctgcagacagacagga

SEQ ID NO: 8078094 - DNA, 22 bp, Homo sapiens
tggctgctgcttggtcttcttc

SEQ ID NO: 8078095 - DNA, 18 bp, Homo sapiens
tggctgctggagtagggt

SEQ ID NO: 8078096 - DNA, 22 bp, Homo sapiens
tggctgctgctcactcagcctc

SEQ ID NO: 8078097 - DNA, 22 bp, Homo sapiens
tggctgcttgttttagtgaggc

SEQ ID NO: 8078098 - DNA, 22 bp, Homo sapiens
tggctgctgtgggtagagggat

SEQ ID NO: 8078099 - DNA, 22 bp, Homo sapiens
tggctgctctcttccccagggt

SEQ ID NO: 8078100 - DNA, 22 bp, Homo sapiens
tggctgcagtgcttgagatgtc

SEQ ID NO: 8078101 - DNA, 22 bp, Homo sapiens
tggcggaatgtgagattacctg

SEQ ID NO: 8078102 - DNA, 22 bp, Homo sapiens
tggcgcagtttctctgctgcct

SEQ ID NO: 8078103 - DNA, 22 bp, Homo sapiens
tggcctgtcactgcccagggct

SEQ ID NO: 8078104 - DNA, 22 bp, Homo sapiens
tggcctgggtgctgctgacatc

SEQ ID NO: 8078105 - DNA, 22 bp, Homo sapiens
tggcctggtaccacatagattt

SEQ ID NO: 8078106 - DNA, 22 bp, Homo sapiens
tggcctggctcacagtgagatt

SEQ ID NO: 8078107 - DNA, 22 bp, Homo sapiens
tggcctgggtcacaccagggtc

SEQ ID NO: 8078108 - DNA, 22 bp, Homo sapiens
tggcctggtccttgtcaaggca

SEQ ID NO: 8078109 - DNA, 22 bp, Homo sapiens
tggcctggttgttgctgccgtt

SEQ ID NO: 8078110 - DNA, 22 bp, Homo sapiens
tggctcctcacgtcctcagagc

SEQ ID NO: 8078111 - DNA, 22 bp, Homo sapiens
tggctcctaatgctgcccagac

SEQ ID NO: 8078112 - DNA, 22 bp, Homo sapiens
tgggaaacagtgatgccaagaa

SEQ ID NO: 8078113 - DNA, 22 bp, Homo sapiens
tggctttgatggacagaggtca

SEQ ID NO: 8078114 - DNA, 19 bp, Homo sapiens
tggcttctggcaacagatg

SEQ ID NO: 8078115 - DNA, 22 bp, Homo sapiens
tggctgtgtccctgtccagagt

SEQ ID NO: 8078116 - DNA, 22 bp, Homo sapiens
tggctgtgggatgagagcctca

SEQ ID NO: 8078117 - DNA, 22 bp, Homo sapiens
tggctgtgtcatcatagctgtg

SEQ ID NO: 8078118 - DNA, 22 bp, Homo sapiens
tggctgtcagtaccttgacatc

SEQ ID NO: 8078119 - DNA, 22 bp, Homo sapiens
tggctgtcagtcgcctgcattc

SEQ ID NO: 8078120 - DNA, 22 bp, Homo sapiens
tggctgtcttcctggttcatgt

SEQ ID NO: 8078121 - DNA, 22 bp, Homo sapiens
tgggagaacactgctctggatg

SEQ ID NO: 8078122 - DNA, 22 bp, Homo sapiens
tgggaggaatgtcactgagcca

SEQ ID NO: 8078123 - DNA, 22 bp, Homo sapiens
tgggacatctgtgaagctgaat

SEQ ID NO: 8078124 - DNA, 21 bp, Homo sapiens
tgggacagtgatggctcctcc

SEQ ID NO: 8078125 - DNA, 22 bp, Homo sapiens
tgggaagagttagagacagctg

SEQ ID NO: 8078126 - DNA, 22 bp, Homo sapiens
tggccactcctccctgcaggct

SEQ ID NO: 8078127 - DNA, 22 bp, Homo sapiens
tggcatttagaaaacaacatgt

SEQ ID NO: 8078128 - DNA, 22 bp, Homo sapiens
tggcatttcagtattttcataa

SEQ ID NO: 8078129 - DNA, 22 bp, Homo sapiens
tggcatttcctcagtgctcaga

SEQ ID NO: 8078130 - DNA, 23 bp, Homo sapiens
tggcatttctatactggcaagtg

SEQ ID NO: 8078131 - DNA, 22 bp, Homo sapiens
tggcagggtgccagttgcgagt

SEQ ID NO: 8078132 - DNA, 22 bp, Homo sapiens
tggcagggtcttgctgtgttgc

SEQ ID NO: 8078133 - DNA, 22 bp, Homo sapiens
tggcagggtacaccttaacacc

SEQ ID NO: 8078134 - DNA, 23 bp, Homo sapiens
tggcagtgatcaaaagcttacat

SEQ ID NO: 8078135 - DNA, 22 bp, Homo sapiens
tggcagtgccccttgaccagtg

SEQ ID NO: 8078136 - DNA, 22 bp, Homo sapiens
tggcagtgatgcggcaggacat

SEQ ID NO: 8078137 - DNA, 22 bp, Homo sapiens
tggcagtgttgtgccacattcc

SEQ ID NO: 8078138 - DNA, 22 bp, Homo sapiens
tggcagtttcatgtgattcaac

SEQ ID NO: 8078139 - DNA, 22 bp, Homo sapiens
tggcagttattaatcaagtctt

SEQ ID NO: 8078140 - DNA, 22 bp, Homo sapiens
tggcatggcaaccctgcaggga

SEQ ID NO: 8078141 - DNA, 22 bp, Homo sapiens
tggcctgccccgagatcctggc

SEQ ID NO: 8078142 - DNA, 22 bp, Homo sapiens
tggcctgcctcccggcttcttt

SEQ ID NO: 8078143 - DNA, 22 bp, Homo sapiens
tggcctgcagaggctgtggggc

SEQ ID NO: 8078144 - DNA, 22 bp, Homo sapiens
tggcctgcagctctcagggaag

SEQ ID NO: 8078145 - DNA, 23 bp, Homo sapiens
tggcctgcagagtttctgctggg

SEQ ID NO: 8078146 - DNA, 22 bp, Homo sapiens
tggcctgcaaagtcttcttgct

SEQ ID NO: 8078147 - DNA, 22 bp, Homo sapiens
tggcctgccttcgctgagctga

SEQ ID NO: 8078148 - DNA, 22 bp, Homo sapiens
tggcctgctcacagtcagatgg

SEQ ID NO: 8078149 - DNA, 22 bp, Homo sapiens
tggcctggaaaaatgcagatgg

SEQ ID NO: 8078150 - DNA, 23 bp, Homo sapiens
tggcctggagagaaaagatgagt

SEQ ID NO: 8078151 - DNA, 22 bp, Homo sapiens
tggcctggccacatccagcagg

SEQ ID NO: 8078152 - DNA, 22 bp, Homo sapiens
tggccctcagtcttgctcctgc

SEQ ID NO: 8078153 - DNA, 22 bp, Homo sapiens
tggcccaggtgcaagagacaga

SEQ ID NO: 8078154 - DNA, 22 bp, Homo sapiens
tggccatgaaggaggcagcaga

SEQ ID NO: 8078155 - DNA, 22 bp, Homo sapiens
tggcccagggtctacagcctca

SEQ ID NO: 8078156 - DNA, 22 bp, Homo sapiens
tggcaatatccacaattacttt

SEQ ID NO: 8078157 - DNA, 22 bp, Homo sapiens
tggcactgacagggtgctcaag

SEQ ID NO: 8078158 - DNA, 22 bp, Homo sapiens
tggcactgcctggcagggcccc

SEQ ID NO: 8078159 - DNA, 22 bp, Homo sapiens
tggcactggaatcgtagccttg

SEQ ID NO: 8078160 - DNA, 22 bp, Homo sapiens
tggcacttccgtctgccttgtg

SEQ ID NO: 8078161 - DNA, 22 bp, Homo sapiens
tggcagggagttcgttcacaac

SEQ ID NO: 8078162 - DNA, 18 bp, Homo sapiens
tggcagggaggaaatata

SEQ ID NO: 8078163 - DNA, 22 bp, Homo sapiens
tggcagggagccaccggtcatg

SEQ ID NO: 8078164 - DNA, 22 bp, Homo sapiens
tggcagggagttgcaggatttc

SEQ ID NO: 8078165 - DNA, 22 bp, Homo sapiens
tggcagggcctaccccaatatc

SEQ ID NO: 8078166 - DNA, 19 bp, Homo sapiens
tggcagggagtgatattag

SEQ ID NO: 8078167 - DNA, 22 bp, Homo sapiens
tggcagggcctgctcatcatcc

SEQ ID NO: 8078168 - DNA, 21 bp, Homo sapiens
tggcaggggtagtagtacagc

SEQ ID NO: 8078169 - DNA, 22 bp, Homo sapiens
tggcaggggaggtgcttgctta

SEQ ID NO: 8078170 - DNA, 22 bp, Homo sapiens
tggcagggcctgaatcttatac

SEQ ID NO: 8078171 - DNA, 18 bp, Homo sapiens
tggcaggggcagtacgcc

SEQ ID NO: 8078172 - DNA, 22 bp, Homo sapiens
tggcagcacttgaacttgagcc

SEQ ID NO: 8078173 - DNA, 22 bp, Homo sapiens
tggcagcagacaaaaggccatt

SEQ ID NO: 8078174 - DNA, 22 bp, Homo sapiens
tggcagcagaacatgaaaccca

SEQ ID NO: 8078175 - DNA, 19 bp, Homo sapiens
tggcagcattggtaccttg

SEQ ID NO: 8078176 - DNA, 22 bp, Homo sapiens
tggcagcattaattattcaggt

SEQ ID NO: 8078177 - DNA, 22 bp, Homo sapiens
tggcagcattttttccagaaca

SEQ ID NO: 8078178 - DNA, 22 bp, Homo sapiens
tggcagcagggcccctggagga

SEQ ID NO: 8078179 - DNA, 22 bp, Homo sapiens
tggcagcagggaggccagtgtt

SEQ ID NO: 8078180 - DNA, 22 bp, Homo sapiens
tggcagcatgttatgtaaggaa

SEQ ID NO: 8078181 - DNA, 22 bp, Homo sapiens
tggcagcatgtcccggcctcag

SEQ ID NO: 8078182 - DNA, 22 bp, Homo sapiens
tggcagcagtggaggtagaaag

SEQ ID NO: 8078183 - DNA, 22 bp, Homo sapiens
tggcagcataaagcatttagct

SEQ ID NO: 8078184 - DNA, 22 bp, Homo sapiens
tggcagcagtagccaccccagc

SEQ ID NO: 8078185 - DNA, 18 bp, Homo sapiens
tggcagcaggaagccatt

SEQ ID NO: 8078186 - DNA, 22 bp, Homo sapiens
tggcagcagctaacttaggcag

SEQ ID NO: 8078187 - DNA, 22 bp, Homo sapiens
tggcagcagccatggaaggccc

SEQ ID NO: 8078188 - DNA, 22 bp, Homo sapiens
tggcagcagacatctgaggtct

SEQ ID NO: 8078189 - DNA, 23 bp, Homo sapiens
tggcagcagatcttaaagtgacc

SEQ ID NO: 8078190 - DNA, 22 bp, Homo sapiens
tggcagcagcaaatggcatatc

SEQ ID NO: 8078191 - DNA, 22 bp, Homo sapiens
tgctggcttatttagtaaatgt

SEQ ID NO: 8078192 - DNA, 22 bp, Homo sapiens
tgctggctgcagtgctgtcaaa

SEQ ID NO: 8078193 - DNA, 22 bp, Homo sapiens
tgctgctgttgacggctgtcca

SEQ ID NO: 8078194 - DNA, 22 bp, Homo sapiens
tgctgctgtatcatgccttcat

SEQ ID NO: 8078195 - DNA, 22 bp, Homo sapiens
tgctgctgtagctaggctttct

SEQ ID NO: 8078196 - DNA, 22 bp, Homo sapiens
tgctgctgcttctgtacagcct

SEQ ID NO: 8078197 - DNA, 20 bp, Homo sapiens
tgctgctgcctccgcctctg

SEQ ID NO: 8078198 - DNA, 22 bp, Homo sapiens
tgctgctctcagccaccaggaa

SEQ ID NO: 8078199 - DNA, 22 bp, Homo sapiens
tgctgctctggccaggaactgc

SEQ ID NO: 8078200 - DNA, 22 bp, Homo sapiens
tgctgctcttcaccatggcctc

SEQ ID NO: 8078201 - DNA, 22 bp, Homo sapiens
tgctgctcctgcctggctccca

SEQ ID NO: 8078202 - DNA, 21 bp, Homo sapiens
tgctgctcctctgggcttcca

SEQ ID NO: 8078203 - DNA, 22 bp, Homo sapiens
tgctgctcgccacggcccaggg

SEQ ID NO: 8078204 - DNA, 22 bp, Homo sapiens
tgctgctctgtaaagtgatgag

SEQ ID NO: 8078205 - DNA, 22 bp, Homo sapiens
tgctgtcaatttagtttacctg

SEQ ID NO: 8078206 - DNA, 22 bp, Homo sapiens
tgcttaaaccctgatcatgtgt

SEQ ID NO: 8078207 - DNA, 22 bp, Homo sapiens
tgcttaaagctgctcagttgta

SEQ ID NO: 8078208 - DNA, 22 bp, Homo sapiens
tgcttaaacacatacatacata

SEQ ID NO: 8078209 - DNA, 22 bp, Homo sapiens
tgcttaaacatccagacagtat

SEQ ID NO: 8078210 - DNA, 22 bp, Homo sapiens
tgcttataaagatattagtttc

SEQ ID NO: 8078211 - DNA, 22 bp, Homo sapiens
tgcttctgaaatgcaggtcttc

SEQ ID NO: 8078212 - DNA, 22 bp, Homo sapiens
tgcttctgaaatgcaggtcttc

SEQ ID NO: 8078213 - DNA, 22 bp, Homo sapiens
tgcttctgacatgttcttggtt

SEQ ID NO: 8078214 - DNA, 22 bp, Homo sapiens
tgcttctgactgggtcagttga

SEQ ID NO: 8078215 - DNA, 22 bp, Homo sapiens
tgcttctgactgggtcagttga

SEQ ID NO: 8078216 - DNA, 22 bp, Homo sapiens
tgcttctgatgtgagcagcccc

SEQ ID NO: 8078217 - DNA, 21 bp, Homo sapiens
tgctcacagatgtgctcagtg

SEQ ID NO: 8078218 - DNA, 18 bp, Homo sapiens
tgctcacactgacctctg

SEQ ID NO: 8078219 - DNA, 22 bp, Homo sapiens
tgctcacagcccagaacataat

SEQ ID NO: 8078220 - DNA, 22 bp, Homo sapiens
tgctataagctccacgctgtag

SEQ ID NO: 8078221 - DNA, 22 bp, Homo sapiens
tgctatttgtgtaatggtaaat

SEQ ID NO: 8078222 - DNA, 22 bp, Homo sapiens
tgctattttgttttcagtccat

SEQ ID NO: 8078223 - DNA, 22 bp, Homo sapiens
tgccttttgttagggctgccag

SEQ ID NO: 8078224 - DNA, 22 bp, Homo sapiens
tgccttttgaagcctcacaggt

SEQ ID NO: 8078225 - DNA, 22 bp, Homo sapiens
tgccttttgtatgcaggccatg

SEQ ID NO: 8078226 - DNA, 22 bp, Homo sapiens
tgcgatgcaacagcttggcgga

SEQ ID NO: 8078227 - DNA, 22 bp, Homo sapiens
tgccttttccagttcctagaag

SEQ ID NO: 8078228 - DNA, 22 bp, Homo sapiens
tgccttttccagtttctagggg

SEQ ID NO: 8078229 - DNA, 22 bp, Homo sapiens
tgccttttctgtagctctggaa

SEQ ID NO: 8078230 - DNA, 22 bp, Homo sapiens
tgccttttccagcttccagagg

SEQ ID NO: 8078231 - DNA, 22 bp, Homo sapiens
tgccttttatggctagcctcag

SEQ ID NO: 8078232 - DNA, 22 bp, Homo sapiens
tgccttttccagcttccaggag

SEQ ID NO: 8078233 - DNA, 22 bp, Homo sapiens
tgccttttaccttgtaattctg

SEQ ID NO: 8078234 - DNA, 22 bp, Homo sapiens
tgccttttagtgctcaataaag

SEQ ID NO: 8078235 - DNA, 20 bp, Homo sapiens
tgccttttatacctttaaac

SEQ ID NO: 8078236 - DNA, 20 bp, Homo sapiens
tgcctttcctgtttcatctt

SEQ ID NO: 8078237 - DNA, 22 bp, Homo sapiens
tgccttcttgaatatggttctt

SEQ ID NO: 8078238 - DNA, 22 bp, Homo sapiens
tgccttcttgaatatggttctt

SEQ ID NO: 8078239 - DNA, 22 bp, Homo sapiens
tgcctggccctgacagccctgg

SEQ ID NO: 8078240 - DNA, 22 bp, Homo sapiens
tgcctgggctcggtagccatcg

SEQ ID NO: 8078241 - DNA, 22 bp, Homo sapiens
tgcctgtctctgactgccatta

SEQ ID NO: 8078242 - DNA, 22 bp, Homo sapiens
tgctgagtcgtattatttttta

SEQ ID NO: 8078243 - DNA, 22 bp, Homo sapiens
tgctctggtaactcacttccat

SEQ ID NO: 8078244 - DNA, 22 bp, Homo sapiens
tgctgaagggaaggtcttgaat

SEQ ID NO: 8078245 - DNA, 22 bp, Homo sapiens
tgctcccaggctctgtggtctg

SEQ ID NO: 8078246 - DNA, 22 bp, Homo sapiens
tgctcccatgtgtgggtacaga

SEQ ID NO: 8078247 - DNA, 22 bp, Homo sapiens
tgctcctgaggttggagatcca

SEQ ID NO: 8078248 - DNA, 22 bp, Homo sapiens
tgctcctgagtgtgcaggagat

SEQ ID NO: 8078249 - DNA, 22 bp, Homo sapiens
tgctcctgacagagtccatatg

SEQ ID NO: 8078250 - DNA, 22 bp, Homo sapiens
tgctcctgaacacagccctatg

SEQ ID NO: 8078251 - DNA, 22 bp, Homo sapiens
tgctcctgggctgaagcacact

SEQ ID NO: 8078252 - DNA, 17 bp, Homo sapiens
tgctcctgggacaagga

SEQ ID NO: 8078253 - DNA, 17 bp, Homo sapiens
tgctcctgtggcagcct

SEQ ID NO: 8078254 - DNA, 22 bp, Homo sapiens
tggagggcatgctgtccatggg

SEQ ID NO: 8078255 - DNA, 18 bp, Homo sapiens
tggagggcttgctgcagc

SEQ ID NO: 8078256 - DNA, 22 bp, Homo sapiens
tggatacagaagccttggctgt

SEQ ID NO: 8078257 - DNA, 22 bp, Homo sapiens
tggataaaacgttctgaaaaac

SEQ ID NO: 8078258 - DNA, 22 bp, Homo sapiens
tggaaattaacttggtacatat

SEQ ID NO: 8078259 - DNA, 22 bp, Homo sapiens
tggaaattaaaattcctcttaa

SEQ ID NO: 8078260 - DNA, 22 bp, Homo sapiens
tggaaattgctattaccgatga

SEQ ID NO: 8078261 - DNA, 22 bp, Homo sapiens
tggaaattactaacacttagag

SEQ ID NO: 8078262 - DNA, 22 bp, Homo sapiens
tggaaatttattcatcattcat

SEQ ID NO: 8078263 - DNA, 22 bp, Homo sapiens
tggaaatttatcaagatataca

SEQ ID NO: 8078264 - DNA, 22 bp, Homo sapiens
tggaaattttgaacagtttcta

SEQ ID NO: 8078265 - DNA, 22 bp, Homo sapiens
tggaacaaattacaattaactt

SEQ ID NO: 8078266 - DNA, 22 bp, Homo sapiens
tggaacaagacagcatagagct

SEQ ID NO: 8078267 - DNA, 22 bp, Homo sapiens
tggaacaacatgctggaaaatt

SEQ ID NO: 8078268 - DNA, 22 bp, Homo sapiens
tggaaatacttgccataaaact

SEQ ID NO: 8078269 - DNA, 22 bp, Homo sapiens
tggaaatagctccagttaagca

SEQ ID NO: 8078270 - DNA, 22 bp, Homo sapiens
tggaaacagatcataactaagc

SEQ ID NO: 8078271 - DNA, 19 bp, Homo sapiens
tggaaaatggattgaatca

SEQ ID NO: 8078272 - DNA, 22 bp, Homo sapiens
tggaaaatgtgactattctaaa

SEQ ID NO: 8078273 - DNA, 22 bp, Homo sapiens
tggaaacaaagtcataagctca

SEQ ID NO: 8078274 - DNA, 22 bp, Homo sapiens
tggaaacaaagtcataagctca

SEQ ID NO: 8078275 - DNA, 17 bp, Homo sapiens
tggaaacaaaacttatt

SEQ ID NO: 8078276 - DNA, 22 bp, Homo sapiens
tggaaaattagtagtgaaaggc

SEQ ID NO: 8078277 - DNA, 22 bp, Homo sapiens
tggaaaatatttaggtgaatga

SEQ ID NO: 8078278 - DNA, 22 bp, Homo sapiens
tggaaaatcaggggacattgat

SEQ ID NO: 8078279 - DNA, 22 bp, Homo sapiens
tggaaaaaacccagactctaga

SEQ ID NO: 8078280 - DNA, 22 bp, Homo sapiens
tgctttttagtactgtcttatt

SEQ ID NO: 8078281 - DNA, 22 bp, Homo sapiens
tgctttttgcaccctttgccgt

SEQ ID NO: 8078282 - DNA, 21 bp, Homo sapiens
tgctttctaaaaatactattg

SEQ ID NO: 8078283 - DNA, 22 bp, Homo sapiens
tgctttaagacactaagtttga

SEQ ID NO: 8078284 - DNA, 22 bp, Homo sapiens
tgctttaagagattgttagtac

SEQ ID NO: 8078285 - DNA, 22 bp, Homo sapiens
tgcttctgggtcccagcctggc

SEQ ID NO: 8078286 - DNA, 22 bp, Homo sapiens
tgcttctggggacaggctgcct

SEQ ID NO: 8078287 - DNA, 22 bp, Homo sapiens
tggaataaaatgtcagttctta

SEQ ID NO: 8078288 - DNA, 22 bp, Homo sapiens
tggaataaagcagctttagttc

SEQ ID NO: 8078289 - DNA, 22 bp, Homo sapiens
tggaataactcaccaaggtcat

SEQ ID NO: 8078290 - DNA, 22 bp, Homo sapiens
tggaataaggaatctttcagaa

SEQ ID NO: 8078291 - DNA, 23 bp, Homo sapiens
tggaataataaggtacattaaca

SEQ ID NO: 8078292 - DNA, 22 bp, Homo sapiens
tggacccaccccagggcctgct

SEQ ID NO: 8078293 - DNA, 22 bp, Homo sapiens
tggacccaggcaggtctgtcct

SEQ ID NO: 8078294 - DNA, 22 bp, Homo sapiens
tggaattttgtattagctttga

SEQ ID NO: 8078295 - DNA, 22 bp, Homo sapiens
tggacacatcactgcagccact

SEQ ID NO: 8078296 - DNA, 22 bp, Homo sapiens
tggacacatcactgcagccact

SEQ ID NO: 8078297 - DNA, 22 bp, Homo sapiens
tggacacagtaggagctgcgca

SEQ ID NO: 8078298 - DNA, 21 bp, Homo sapiens
tggtttgcggccaaagttaaa

SEQ ID NO: 8078299 - DNA, 22 bp, Homo sapiens
tggtttttggtgttcacagagg

SEQ ID NO: 8078300 - DNA, 22 bp, Homo sapiens
tgtaaaataccattccttgtca

SEQ ID NO: 8078301 - DNA, 22 bp, Homo sapiens
tgtaaagtatctgtgagctctc

SEQ ID NO: 8078302 - DNA, 22 bp, Homo sapiens
tgtaaagattagattacatgaa

SEQ ID NO: 8078303 - DNA, 22 bp, Homo sapiens
tgtaaacaaatgcattcttgct

SEQ ID NO: 8078304 - DNA, 18 bp, Homo sapiens
tgtaaacactttcattct

SEQ ID NO: 8078305 - DNA, 20 bp, Homo sapiens
tgtaaataggcattgtagtt

SEQ ID NO: 8078306 - DNA, 22 bp, Homo sapiens
tgtaaataatgcatgtaaatca

SEQ ID NO: 8078307 - DNA, 22 bp, Homo sapiens
tgtaaagttttattgttccttc

SEQ ID NO: 8078308 - DNA, 23 bp, Homo sapiens
tgtaacaatttcatatacatgca

SEQ ID NO: 8078309 - DNA, 22 bp, Homo sapiens
tgtaacaaaataccttggattg

SEQ ID NO: 8078310 - DNA, 23 bp, Homo sapiens
tgtaaattttgtagtcacatttt

SEQ ID NO: 8078311 - DNA, 21 bp, Homo sapiens
tgtaacaaaatactgcagatt

SEQ ID NO: 8078312 - DNA, 22 bp, Homo sapiens
tgtaacaacatttgatttttag

SEQ ID NO: 8078313 - DNA, 22 bp, Homo sapiens
tgtaacaaatacccttgaagtt

SEQ ID NO: 8078314 - DNA, 22 bp, Homo sapiens
tgtaacaacatttgatttttag

SEQ ID NO: 8078315 - DNA, 23 bp, Homo sapiens
tgtaacaattcccagcctttgcc

SEQ ID NO: 8078316 - DNA, 23 bp, Homo sapiens
tgtaacaattcccagcctttgcc

SEQ ID NO: 8078317 - DNA, 22 bp, Homo sapiens
tgtacaaagttaaacctatata

SEQ ID NO: 8078318 - DNA, 22 bp, Homo sapiens
tgtacaaagagtatagctttga

SEQ ID NO: 8078319 - DNA, 22 bp, Homo sapiens
tgtacaaagagtatagctttga

SEQ ID NO: 8078320 - DNA, 22 bp, Homo sapiens
tgtacagactgtatttacaagt

SEQ ID NO: 8078321 - DNA, 22 bp, Homo sapiens
tgtacacatggtgtacactccc

SEQ ID NO: 8078322 - DNA, 22 bp, Homo sapiens
tgtacaatcttggtccctttat

SEQ ID NO: 8078323 - DNA, 22 bp, Homo sapiens
tgtacaaattcagttctagggt

SEQ ID NO: 8078324 - DNA, 22 bp, Homo sapiens
tggtcagtacctggtcaccata

SEQ ID NO: 8078325 - DNA, 21 bp, Homo sapiens
tggtcagtatttcagttacat

SEQ ID NO: 8078326 - DNA, 22 bp, Homo sapiens
tggtcaggtacctctggctgtc

SEQ ID NO: 8078327 - DNA, 22 bp, Homo sapiens
tggtcaggggcttctgagctgt

SEQ ID NO: 8078328 - DNA, 22 bp, Homo sapiens
tggtcctggtagcggtgtgctt

SEQ ID NO: 8078329 - DNA, 22 bp, Homo sapiens
tggtgactgattggtgttctct

SEQ ID NO: 8078330 - DNA, 22 bp, Homo sapiens
tggtgcagttcccagggccggg

SEQ ID NO: 8078331 - DNA, 22 bp, Homo sapiens
tggtgcagtagagctgtctggg

SEQ ID NO: 8078332 - DNA, 22 bp, Homo sapiens
tggtgcagtccaaagggagcag

SEQ ID NO: 8078333 - DNA, 22 bp, Homo sapiens
tggtgcaggccaagctgcgagc

SEQ ID NO: 8078334 - DNA, 22 bp, Homo sapiens
tggtgcagatgcaggtcactgg

SEQ ID NO: 8078335 - DNA, 22 bp, Homo sapiens
tggtgcaggtgttgatgcagga

SEQ ID NO: 8078336 - DNA, 22 bp, Homo sapiens
tggtgcagtagaaggccgactt

SEQ ID NO: 8078337 - DNA, 23 bp, Homo sapiens
tggtgggccctgcttgctcactg

SEQ ID NO: 8078338 - DNA, 22 bp, Homo sapiens
tggtgggcacagtgcccaggct

SEQ ID NO: 8078339 - DNA, 22 bp, Homo sapiens
tgtcagggcatgcggtccagcc

SEQ ID NO: 8078340 - DNA, 22 bp, Homo sapiens
tgtcagggatttccaactcccc

SEQ ID NO: 8078341 - DNA, 22 bp, Homo sapiens
tgtcagggctggacacagctgc

SEQ ID NO: 8078342 - DNA, 22 bp, Homo sapiens
tgtcacctctttggctgcagct

SEQ ID NO: 8078343 - DNA, 22 bp, Homo sapiens
tgtcactttggccaagccattg

SEQ ID NO: 8078344 - DNA, 22 bp, Homo sapiens
tgtcagtgttttatgtgccctt

SEQ ID NO: 8078345 - DNA, 22 bp, Homo sapiens
tgtcagttcagtgattacaaaa

SEQ ID NO: 8078346 - DNA, 22 bp, Homo sapiens
tgtcagttcagtgattacaaaa

SEQ ID NO: 8078347 - DNA, 22 bp, Homo sapiens
tgtcagtgtgcaccgggaggcc

SEQ ID NO: 8078348 - DNA, 22 bp, Homo sapiens
tgtcagttctcacttacataaa

SEQ ID NO: 8078349 - DNA, 20 bp, Homo sapiens
tgtcagtgcctgaggcacag

SEQ ID NO: 8078350 - DNA, 22 bp, Homo sapiens
tgtcagtggacctggagaggcc

SEQ ID NO: 8078351 - DNA, 22 bp, Homo sapiens
tgtcagtggtcatagtagaaaa

SEQ ID NO: 8078352 - DNA, 22 bp, Homo sapiens
tgtcagtggtaaggttgggagt

SEQ ID NO: 8078353 - DNA, 22 bp, Homo sapiens
tgtcagtgctatagtgggaata

SEQ ID NO: 8078354 - DNA, 22 bp, Homo sapiens
tgtcagtggtagacccagaggt

SEQ ID NO: 8078355 - DNA, 22 bp, Homo sapiens
tgtcagtgtaactcttatagca

SEQ ID NO: 8078356 - DNA, 22 bp, Homo sapiens
tgtcagtgtatacatacagtat

SEQ ID NO: 8078357 - DNA, 22 bp, Homo sapiens
tgtcagtgtctatgaagaattt

SEQ ID NO: 8078358 - DNA, 22 bp, Homo sapiens
tgtcagtgtctgaggttttata

SEQ ID NO: 8078359 - DNA, 22 bp, Homo sapiens
tgtcagtgacagatttatgatc

SEQ ID NO: 8078360 - DNA, 22 bp, Homo sapiens
tgtcagtgaaaaattgtgatag

SEQ ID NO: 8078361 - DNA, 22 bp, Homo sapiens
tgtcagtgaactggaaggcctg

SEQ ID NO: 8078362 - DNA, 22 bp, Homo sapiens
tgtcagtgagttagttgcaagt

SEQ ID NO: 8078363 - DNA, 22 bp, Homo sapiens
tgtcagtgacctagcacggtgc

SEQ ID NO: 8078364 - DNA, 22 bp, Homo sapiens
tgtcagtgagttgggtcctgag

SEQ ID NO: 8078365 - DNA, 22 bp, Homo sapiens
tgtcagtgccaactttgctggt

SEQ ID NO: 8078366 - DNA, 22 bp, Homo sapiens
tgtcagtgcacagatggttgat

SEQ ID NO: 8078367 - DNA, 22 bp, Homo sapiens
tgtcagtgatttgtagggaatt

SEQ ID NO: 8078368 - DNA, 19 bp, Homo sapiens
tgtcagtgatacatgcttt

SEQ ID NO: 8078369 - DNA, 22 bp, Homo sapiens
tgtcatgagttatttcatagga

SEQ ID NO: 8078370 - DNA, 20 bp, Homo sapiens
tgtcatttatttatcaaatg

SEQ ID NO: 8078371 - DNA, 20 bp, Homo sapiens
tgtcattggcgtggttggct

SEQ ID NO: 8078372 - DNA, 21 bp, Homo sapiens
tgtccaaggtatgcactgggg

SEQ ID NO: 8078373 - DNA, 22 bp, Homo sapiens
tgtccaatgccctttccacatg

SEQ ID NO: 8078374 - DNA, 22 bp, Homo sapiens
tgtcatttcctgaatgctgagt

SEQ ID NO: 8078375 - DNA, 22 bp, Homo sapiens
tgtcccatggataccaggctat

SEQ ID NO: 8078376 - DNA, 17 bp, Homo sapiens
tgtcccaggctcaacgc

SEQ ID NO: 8078377 - DNA, 22 bp, Homo sapiens
tgtcccagggaaggcccagcac

SEQ ID NO: 8078378 - DNA, 22 bp, Homo sapiens
tgtcccagtcaaggctgtcatc

SEQ ID NO: 8078379 - DNA, 22 bp, Homo sapiens
tgtcccagttcccagggttgct

SEQ ID NO: 8078380 - DNA, 22 bp, Homo sapiens
tgtcccagtttatctgggactg

SEQ ID NO: 8078381 - DNA, 22 bp, Homo sapiens
tgtcctttgtgtatctatagta

SEQ ID NO: 8078382 - DNA, 22 bp, Homo sapiens
tgtcctggggcgacttggggcc

SEQ ID NO: 8078383 - DNA, 22 bp, Homo sapiens
tgtatttttaggaatgcgctat

SEQ ID NO: 8078384 - DNA, 22 bp, Homo sapiens
tgtcaaagcctgaatcacatag

SEQ ID NO: 8078385 - DNA, 22 bp, Homo sapiens
tgtatttgagttatgaaagaga

SEQ ID NO: 8078386 - DNA, 22 bp, Homo sapiens
tgtattttctgaagataatcaa

SEQ ID NO: 8078387 - DNA, 22 bp, Homo sapiens
tgtattttcagagtggcatttc

SEQ ID NO: 8078388 - DNA, 22 bp, Homo sapiens
tgtattttgtgaggatcactct

SEQ ID NO: 8078389 - DNA, 22 bp, Homo sapiens
tgtagaaattagtaagatcaac

SEQ ID NO: 8078390 - DNA, 22 bp, Homo sapiens
tgtataaatttaaattcctgct

SEQ ID NO: 8078391 - DNA, 22 bp, Homo sapiens
tgtataacttgtggttatgaat

SEQ ID NO: 8078392 - DNA, 22 bp, Homo sapiens
tgtatacaagtcgtgtaaactt

SEQ ID NO: 8078393 - DNA, 22 bp, Homo sapiens
tgtatacaaattggaatcagat

SEQ ID NO: 8078394 - DNA, 22 bp, Homo sapiens
tgtatacacgtaccttttcttt

SEQ ID NO: 8078395 - DNA, 21 bp, Homo sapiens
tgtatacacgtgttgaaaaca

SEQ ID NO: 8078396 - DNA, 22 bp, Homo sapiens
tgtatacaggcataagagatac

SEQ ID NO: 8078397 - DNA, 22 bp, Homo sapiens
tgtatacatgtgttcatgcatg

SEQ ID NO: 8078398 - DNA, 22 bp, Homo sapiens
tgtatctttctactgtctagtt

SEQ ID NO: 8078399 - DNA, 22 bp, Homo sapiens
tggtatgaccgtggtgcaagca

SEQ ID NO: 8078400 - DNA, 22 bp, Homo sapiens
tggtatttgtcattcgagttct

SEQ ID NO: 8078401 - DNA, 22 bp, Homo sapiens
tggtaaggtcttcactcagatt

SEQ ID NO: 8078402 - DNA, 22 bp, Homo sapiens
tggtaaggattgtagaaacgaa

SEQ ID NO: 8078403 - DNA, 22 bp, Homo sapiens
tgggtcctcgtcttccaaggca

SEQ ID NO: 8078404 - DNA, 20 bp, Homo sapiens
tggggtctagttggcctggg

SEQ ID NO: 8078405 - DNA, 22 bp, Homo sapiens
tgggggtgaaagtctggacagt

SEQ ID NO: 8078406 - DNA, 22 bp, Homo sapiens
tgggggctgtgcacaggctcac

SEQ ID NO: 8078407 - DNA, 22 bp, Homo sapiens
tgggggctttatgtaatgcaca

SEQ ID NO: 8078408 - DNA, 22 bp, Homo sapiens
tgggctgccggcaggctctgcc

SEQ ID NO: 8078409 - DNA, 18 bp, Homo sapiens
tgggctgcctggcctctg

SEQ ID NO: 8078410 - DNA, 22 bp, Homo sapiens
tggggaaggcggagcttgcagc

SEQ ID NO: 8078411 - DNA, 23 bp, Homo sapiens
tggggctgatggagacggaccag

SEQ ID NO: 8078412 - DNA, 22 bp, Homo sapiens
tggggctggcacagtctctatt

SEQ ID NO: 8078413 - DNA, 22 bp, Homo sapiens
tggggctgaggagcctcactct

SEQ ID NO: 8078414 - DNA, 22 bp, Homo sapiens
tggggctggggatcttgagcct

SEQ ID NO: 8078415 - DNA, 22 bp, Homo sapiens
tggggctgtcccggtttggcga

SEQ ID NO: 8078416 - DNA, 22 bp, Homo sapiens
tggggctgtccttagtctgaga

SEQ ID NO: 8078417 - DNA, 22 bp, Homo sapiens
tggggctggctattgtctccct

SEQ ID NO: 8078418 - DNA, 22 bp, Homo sapiens
tgggggcatggaccagcctggc

SEQ ID NO: 8078419 - DNA, 22 bp, Homo sapiens
tgggggctagaacccagggatt

SEQ ID NO: 8078420 - DNA, 22 bp, Homo sapiens
tgggggctccaggctccaggga

SEQ ID NO: 8078421 - DNA, 22 bp, Homo sapiens
tgggggctgagtaagatgagat

SEQ ID NO: 8078422 - DNA, 22 bp, Homo sapiens
tgggggctgggatgtcactttc

SEQ ID NO: 8078423 - DNA, 22 bp, Homo sapiens
tgggccagtcctgcctaaggtg

SEQ ID NO: 8078424 - DNA, 17 bp, Homo sapiens
tgggccagtagaaggga

SEQ ID NO: 8078425 - DNA, 22 bp, Homo sapiens
tgggctgcaccctcagcctctg

SEQ ID NO: 8078426 - DNA, 22 bp, Homo sapiens
tgggctgcagagcccggccttc

SEQ ID NO: 8078427 - DNA, 22 bp, Homo sapiens
tgggctgcactgctctttatcg

SEQ ID NO: 8078428 - DNA, 22 bp, Homo sapiens
tgggctgcactccattttctgc

SEQ ID NO: 8078429 - DNA, 22 bp, Homo sapiens
tgggctgcacctttgtaaatct

SEQ ID NO: 8078430 - DNA, 22 bp, Homo sapiens
tgggctgcaggggttgagagct

SEQ ID NO: 8078431 - DNA, 22 bp, Homo sapiens
tgggctgccctgatggtcctca

SEQ ID NO: 8078432 - DNA, 22 bp, Homo sapiens
tgggctgccagctctccagatg

SEQ ID NO: 8078433 - DNA, 22 bp, Homo sapiens
tgggctgcccaaggtggccatg

SEQ ID NO: 8078434 - DNA, 23 bp, Homo sapiens
tgggcgaggcaggagtggagcac

SEQ ID NO: 8078435 - DNA, 22 bp, Homo sapiens
tgggcgaggcccagggctgcgt

SEQ ID NO: 8078436 - DNA, 22 bp, Homo sapiens
tgggcaagggacaggcctggct

SEQ ID NO: 8078437 - DNA, 22 bp, Homo sapiens
tgggcagatctttggtggctag

SEQ ID NO: 8078438 - DNA, 20 bp, Homo sapiens
tgggcagcactgctggctgg

SEQ ID NO: 8078439 - DNA, 22 bp, Homo sapiens
tgggcagcaaagactgtgtgct

SEQ ID NO: 8078440 - DNA, 22 bp, Homo sapiens
tgggcagcagcaaagccagact

SEQ ID NO: 8078441 - DNA, 22 bp, Homo sapiens
tgggcagcatcctccacagtca

SEQ ID NO: 8078442 - DNA, 22 bp, Homo sapiens
tgggcagcagaaccaggccgac

SEQ ID NO: 8078443 - DNA, 22 bp, Homo sapiens
tgggcaggggccctgcttccgt

SEQ ID NO: 8078444 - DNA, 22 bp, Homo sapiens
tgggcagggatctcttttgcaa

SEQ ID NO: 8078445 - DNA, 22 bp, Homo sapiens
tgggcagccatcccagcctctc

SEQ ID NO: 8078446 - DNA, 19 bp, Homo sapiens
tgggcagctccctctgtcc

SEQ ID NO: 8078447 - DNA, 23 bp, Homo sapiens
tgggcagcttctgcatgcccacc

SEQ ID NO: 8078448 - DNA, 22 bp, Homo sapiens
tgggcagcttccacttagttag

SEQ ID NO: 8078449 - DNA, 22 bp, Homo sapiens
tgggcagggagctggaaccaca

SEQ ID NO: 8078450 - DNA, 22 bp, Homo sapiens
tgggccagcactgggtgctcat

SEQ ID NO: 8078451 - DNA, 22 bp, Homo sapiens
tgggcagggtctctgttatcag

SEQ ID NO: 8078452 - DNA, 22 bp, Homo sapiens
tgggcaggtgctattttccatg

SEQ ID NO: 8078453 - DNA, 19 bp, Homo sapiens
tgggcaggttcagtaatgg

SEQ ID NO: 8078454 - DNA, 19 bp, Homo sapiens
tgggcagtgccagggctta

SEQ ID NO: 8078455 - DNA, 22 bp, Homo sapiens
tgggcaggttgttatttgacat

SEQ ID NO: 8078456 - DNA, 22 bp, Homo sapiens
tgggcagtgagaaaggtcaggt

SEQ ID NO: 8078457 - DNA, 22 bp, Homo sapiens
ttatttggatttagcttatcaa

SEQ ID NO: 8078458 - DNA, 22 bp, Homo sapiens
ttccagaggcctgggcacactc

SEQ ID NO: 8078459 - DNA, 22 bp, Homo sapiens
ttccagagtcagccactgggag

SEQ ID NO: 8078460 - DNA, 22 bp, Homo sapiens
ttccagagtgactgtgccactt

SEQ ID NO: 8078461 - DNA, 22 bp, Homo sapiens
ttccagcttagagcatcatgtt

SEQ ID NO: 8078462 - DNA, 22 bp, Homo sapiens
ttaattaattagttaagcatgt

SEQ ID NO: 8078463 - DNA, 22 bp, Homo sapiens
ttaattaactagccaaccacta

SEQ ID NO: 8078464 - DNA, 22 bp, Homo sapiens
ttaattaaattcatgagcattg

SEQ ID NO: 8078465 - DNA, 22 bp, Homo sapiens
ttaatgttttaagttatagaga

SEQ ID NO: 8078466 - DNA, 22 bp, Homo sapiens
ttacaacaaaggcacgtgcatg

SEQ ID NO: 8078467 - DNA, 22 bp, Homo sapiens
ttacaaagttctgagttcaaac

SEQ ID NO: 8078468 - DNA, 22 bp, Homo sapiens
ttacaaagtgttatgataaaca

SEQ ID NO: 8078469 - DNA, 22 bp, Homo sapiens
ttacaaagtgctgcaccatttt

SEQ ID NO: 8078470 - DNA, 22 bp, Homo sapiens
ttacaaaggtagttttgtctat

SEQ ID NO: 8078471 - DNA, 22 bp, Homo sapiens
ttacaactgaagctaatgtgct

SEQ ID NO: 8078472 - DNA, 17 bp, Homo sapiens
ttacaacaattcatgag

SEQ ID NO: 8078473 - DNA, 22 bp, Homo sapiens
ttacaacagacacatattctaa

SEQ ID NO: 8078474 - DNA, 22 bp, Homo sapiens
ttaataaagtatgaattggaaa

SEQ ID NO: 8078475 - DNA, 22 bp, Homo sapiens
ttaataacattgtgtatcaccc

SEQ ID NO: 8078476 - DNA, 22 bp, Homo sapiens
ttaatacaagcatatgcacaca

SEQ ID NO: 8078477 - DNA, 22 bp, Homo sapiens
ttaatggactaggcagttgtaa

SEQ ID NO: 8078478 - DNA, 22 bp, Homo sapiens
ttaatggaaatatgtttatacc

SEQ ID NO: 8078479 - DNA, 22 bp, Homo sapiens
ttaatgcttgtctagatcttct

SEQ ID NO: 8078480 - DNA, 22 bp, Homo sapiens
ttaatggattggaggtttcaat

SEQ ID NO: 8078481 - DNA, 22 bp, Homo sapiens
ttaatgtcaacatttctgaaga

SEQ ID NO: 8078482 - DNA, 22 bp, Homo sapiens
ttaatacagtctccagaagtaa

SEQ ID NO: 8078483 - DNA, 22 bp, Homo sapiens
ttaatacagaagcaagacactg

SEQ ID NO: 8078484 - DNA, 22 bp, Homo sapiens
ttaatacagtctccagaagtaa

SEQ ID NO: 8078485 - DNA, 22 bp, Homo sapiens
ttaatacactatatgatcacat

SEQ ID NO: 8078486 - DNA, 22 bp, Homo sapiens
ttaaagagaactcaatgaatga

SEQ ID NO: 8078487 - DNA, 22 bp, Homo sapiens
ttaaagagaaagtgtttgtctt

SEQ ID NO: 8078488 - DNA, 22 bp, Homo sapiens
ttaaaccatagtttaacataag

SEQ ID NO: 8078489 - DNA, 23 bp, Homo sapiens
ttaaacttcagtgcagaacactc

SEQ ID NO: 8078490 - DNA, 22 bp, Homo sapiens
ttaaagaggtagttaggtttaa

SEQ ID NO: 8078491 - DNA, 22 bp, Homo sapiens
ttaaagcaaccatcaatttgga

SEQ ID NO: 8078492 - DNA, 22 bp, Homo sapiens
ttaaagatgcagctttagagaa

SEQ ID NO: 8078493 - DNA, 22 bp, Homo sapiens
ttaaagcaggcatcattcctca

SEQ ID NO: 8078494 - DNA, 22 bp, Homo sapiens
ttaaagcactaaatgatgaggg

SEQ ID NO: 8078495 - DNA, 22 bp, Homo sapiens
ttacaattgagtctattgtatg

SEQ ID NO: 8078496 - DNA, 22 bp, Homo sapiens
ttacacttttgacaaacctgag

SEQ ID NO: 8078497 - DNA, 22 bp, Homo sapiens
ttacagaaaagggctttaagag

SEQ ID NO: 8078498 - DNA, 22 bp, Homo sapiens
ttacagaatgtgccatttggtc

SEQ ID NO: 8078499 - DNA, 22 bp, Homo sapiens
ttacagaatgtgccatttggtc

SEQ ID NO: 8078500 - DNA, 21 bp, Homo sapiens
ttacagaatccatgggaagtc

SEQ ID NO: 8078501 - DNA, 22 bp, Homo sapiens
ttacagaaaatgtgttttaact

SEQ ID NO: 8078502 - DNA, 22 bp, Homo sapiens
ttacagatacatttcttttgtt

SEQ ID NO: 8078503 - DNA, 22 bp, Homo sapiens
ttacagcagcagggacagacta

SEQ ID NO: 8078504 - DNA, 22 bp, Homo sapiens
ttacagcagtgggaaggagtca

SEQ ID NO: 8078505 - DNA, 22 bp, Homo sapiens
ttacagcatttaatgagatctg

SEQ ID NO: 8078506 - DNA, 22 bp, Homo sapiens
ttacagatggatctagcaaaat

SEQ ID NO: 8078507 - DNA, 22 bp, Homo sapiens
ttacagatggcagtttcttgag

SEQ ID NO: 8078508 - DNA, 22 bp, Homo sapiens
ttacagattcaagctctttgaa

SEQ ID NO: 8078509 - DNA, 17 bp, Homo sapiens
ttacagcagcaatagag

SEQ ID NO: 8078510 - DNA, 22 bp, Homo sapiens
ttacagcacagtgcttttactg

SEQ ID NO: 8078511 - DNA, 18 bp, Homo sapiens
ttacagcagcaacaggaa

SEQ ID NO: 8078512 - DNA, 21 bp, Homo sapiens
ttacagcaatgttagcaggaa

SEQ ID NO: 8078513 - DNA, 22 bp, Homo sapiens
ttacagcaaagtgcgcagacct

SEQ ID NO: 8078514 - DNA, 22 bp, Homo sapiens
ttacagcacagtgcttttactg

SEQ ID NO: 8078515 - DNA, 22 bp, Homo sapiens
ttaggtaaggatggtgacagta

SEQ ID NO: 8078516 - DNA, 22 bp, Homo sapiens
ttagcagatttcatgtacattt

SEQ ID NO: 8078517 - DNA, 22 bp, Homo sapiens
ttagcaaacatcttcgtgtgag

SEQ ID NO: 8078518 - DNA, 22 bp, Homo sapiens
ttagcaaacctggactacagat

SEQ ID NO: 8078519 - DNA, 17 bp, Homo sapiens
ttagcaaaatagcactt

SEQ ID NO: 8078520 - DNA, 22 bp, Homo sapiens
ttagatttgtagtgagttcaga

SEQ ID NO: 8078521 - DNA, 22 bp, Homo sapiens
ttagaaccataatgaatcaatg

SEQ ID NO: 8078522 - DNA, 22 bp, Homo sapiens
ttagaacatctgtgtctttatg

SEQ ID NO: 8078523 - DNA, 22 bp, Homo sapiens
ttagataatgtagagatatgag

SEQ ID NO: 8078524 - DNA, 22 bp, Homo sapiens
ttagaaatgtcacagatctgat

SEQ ID NO: 8078525 - DNA, 22 bp, Homo sapiens
ttattcatcagtgcattaattt

SEQ ID NO: 8078526 - DNA, 22 bp, Homo sapiens
ttattcattaacagggaccaaa

SEQ ID NO: 8078527 - DNA, 22 bp, Homo sapiens
ttatcttggtgttttagtaatt

SEQ ID NO: 8078528 - DNA, 22 bp, Homo sapiens
ttattattccccaagtcattat

SEQ ID NO: 8078529 - DNA, 18 bp, Homo sapiens
ttatgcaaaactgttttc

SEQ ID NO: 8078530 - DNA, 22 bp, Homo sapiens
ttatgatttgccacagattggt

SEQ ID NO: 8078531 - DNA, 22 bp, Homo sapiens
ttatattagttagacttgctgt

SEQ ID NO: 8078532 - DNA, 23 bp, Homo sapiens
tgtgaattgaggacatcaaaagc

SEQ ID NO: 8078533 - DNA, 22 bp, Homo sapiens
tgtgaataccttgaattcatca

SEQ ID NO: 8078534 - DNA, 22 bp, Homo sapiens
tgtgatttattgaaaagagctt

SEQ ID NO: 8078535 - DNA, 22 bp, Homo sapiens
tgtgatttccagccattaaaaa

SEQ ID NO: 8078536 - DNA, 22 bp, Homo sapiens
tgtgagtctaggtcagggtgtt

SEQ ID NO: 8078537 - DNA, 22 bp, Homo sapiens
tgtgagttgctcttttgctact

SEQ ID NO: 8078538 - DNA, 22 bp, Homo sapiens
tgtgactggttgtcccgctttc

SEQ ID NO: 8078539 - DNA, 22 bp, Homo sapiens
tgtgcaatcatattttaaaatg

SEQ ID NO: 8078540 - DNA, 22 bp, Homo sapiens
tgtgcctttcatcatgcttttg

SEQ ID NO: 8078541 - DNA, 22 bp, Homo sapiens
tgtgcgtcctgtgcgcacactg

SEQ ID NO: 8078542 - DNA, 22 bp, Homo sapiens
tgtgccttatgaattctttctg

SEQ ID NO: 8078543 - DNA, 22 bp, Homo sapiens
tgtcttaacataaaaggaaatc

SEQ ID NO: 8078544 - DNA, 22 bp, Homo sapiens
tgtcttggccactaggagtgcc

SEQ ID NO: 8078545 - DNA, 22 bp, Homo sapiens
tgtcttggctctggagggggat

SEQ ID NO: 8078546 - DNA, 22 bp, Homo sapiens
tgtcttctgtattcaagtctat

SEQ ID NO: 8078547 - DNA, 22 bp, Homo sapiens
tgtgaaaagcgtgtgttctagg

SEQ ID NO: 8078548 - DNA, 22 bp, Homo sapiens
tgtctttttactatgttcaatc

SEQ ID NO: 8078549 - DNA, 22 bp, Homo sapiens
tgtcttttctactgtaagcata

SEQ ID NO: 8078550 - DNA, 22 bp, Homo sapiens
tgtctccaactcactgtatact

SEQ ID NO: 8078551 - DNA, 22 bp, Homo sapiens
tgtctgaaaggctttttctcac

SEQ ID NO: 8078552 - DNA, 22 bp, Homo sapiens
tgtctgatgatagtgtctctcc

SEQ ID NO: 8078553 - DNA, 22 bp, Homo sapiens
tgtttgtggaatattctttaag

SEQ ID NO: 8078554 - DNA, 18 bp, Homo sapiens
tgtttatttttctcttac

SEQ ID NO: 8078555 - DNA, 22 bp, Homo sapiens
tgtttcaactgttaagatatgc

SEQ ID NO: 8078556 - DNA, 22 bp, Homo sapiens
tgttttaagagcgcactttata

SEQ ID NO: 8078557 - DNA, 22 bp, Homo sapiens
tgttttaatctcccattgctct

SEQ ID NO: 8078558 - DNA, 22 bp, Homo sapiens
tgttttaagggtcaactgtcac

SEQ ID NO: 8078559 - DNA, 22 bp, Homo sapiens
tgttttatttctccaagaggga

SEQ ID NO: 8078560 - DNA, 22 bp, Homo sapiens
tgttttatgagccatataacct

SEQ ID NO: 8078561 - DNA, 17 bp, Homo sapiens
ttaaaccataaagaagg

SEQ ID NO: 8078562 - DNA, 22 bp, Homo sapiens
ttaaaccatagtttaacataag

SEQ ID NO: 8078563 - DNA, 22 bp, Homo sapiens
ttaaaccacaaggcaagttttg

SEQ ID NO: 8078564 - DNA, 22 bp, Homo sapiens
ttaaacagaggtagcagactgg

SEQ ID NO: 8078565 - DNA, 22 bp, Homo sapiens
ttaaacagacagtaaatgaaac

SEQ ID NO: 8078566 - DNA, 22 bp, Homo sapiens
tgtttttttatatacctgaagt

SEQ ID NO: 8078567 - DNA, 22 bp, Homo sapiens
ttaaaaaccatcttcctttcct

SEQ ID NO: 8078568 - DNA, 22 bp, Homo sapiens
ttaaaatgcagattctgattca

SEQ ID NO: 8078569 - DNA, 22 bp, Homo sapiens
ttaaaaccatcagctgtaagat

SEQ ID NO: 8078570 - DNA, 22 bp, Homo sapiens
ttaaaacagcgtgaatctggca

SEQ ID NO: 8078571 - DNA, 22 bp, Homo sapiens
ttaaaaccatcagctgtaagat

SEQ ID NO: 8078572 - DNA, 22 bp, Homo sapiens
tgtttatgtgtgtgcatatata

SEQ ID NO: 8078573 - DNA, 21 bp, Homo sapiens
tgtttatggaaaagagacaaa

SEQ ID NO: 8078574 - DNA, 22 bp, Homo sapiens
tgtttaaatagaacatactgca

SEQ ID NO: 8078575 - DNA, 22 bp, Homo sapiens
tgttcttaagactggaagttac

SEQ ID NO: 8078576 - DNA, 22 bp, Homo sapiens
tgttctttcagttagacacagt

SEQ ID NO: 8078577 - DNA, 22 bp, Homo sapiens
tgttctttggcttcctttccgt

SEQ ID NO: 8078578 - DNA, 18 bp, Homo sapiens
tgttaaatgaagatttgc

SEQ ID NO: 8078579 - DNA, 22 bp, Homo sapiens
tgttaaggagacacatgaaaaa

SEQ ID NO: 8078580 - DNA, 22 bp, Homo sapiens
tgtgtgtgtaaaagcatttata

SEQ ID NO: 8078581 - DNA, 22 bp, Homo sapiens
tgtgtgtgtgcgcgcacgcata

SEQ ID NO: 8078582 - DNA, 22 bp, Homo sapiens
tgtgtgtgtaaaagcatttata

SEQ ID NO: 8078583 - DNA, 21 bp, Homo sapiens
tgtgtgtgcaggcacacacac

SEQ ID NO: 8078584 - DNA, 22 bp, Homo sapiens
tgtgttaagtatttgatacact

SEQ ID NO: 8078585 - DNA, 22 bp, Homo sapiens
tgttaaaaattcagctctagat

SEQ ID NO: 8078586 - DNA, 22 bp, Homo sapiens
tgttaaaaattcagctctagat

SEQ ID NO: 8078587 - DNA, 22 bp, Homo sapiens
tgttaaacctagtacaggtcct

SEQ ID NO: 8078588 - DNA, 22 bp, Homo sapiens
tgtgtatttctggaacagacta

SEQ ID NO: 8078589 - DNA, 22 bp, Homo sapiens
tgtgtgctaatgtatgctctaa

SEQ ID NO: 8078590 - DNA, 22 bp, Homo sapiens
aacagtttgggtaggtatgtag

SEQ ID NO: 8078591 - DNA, 22 bp, Homo sapiens
aacatttcagcacctgattcct

SEQ ID NO: 8078592 - DNA, 22 bp, Homo sapiens
aactataatggggttaggaaat

SEQ ID NO: 8078593 - DNA, 22 bp, Homo sapiens
aactatacatatttacatagac

SEQ ID NO: 8078594 - DNA, 22 bp, Homo sapiens
aacagtttcctgactcctatga

SEQ ID NO: 8078595 - DNA, 22 bp, Homo sapiens
aacagtttcagttactgatgag

SEQ ID NO: 8078596 - DNA, 22 bp, Homo sapiens
aagtttgcggggaaagaacaca

SEQ ID NO: 8078597 - DNA, 22 bp, Homo sapiens
aagtttggaatgatagagacct

SEQ ID NO: 8078598 - DNA, 21 bp, Homo sapiens
aagtttggaagaaagcaaggg

SEQ ID NO: 8078599 - DNA, 20 bp, Homo sapiens
aagtttggagtcaggagacc

SEQ ID NO: 8078600 - DNA, 22 bp, Homo sapiens
aagtttctttattagcttgtcc

SEQ ID NO: 8078601 - DNA, 22 bp, Homo sapiens
aagtttctgatattgttaaagc

SEQ ID NO: 8078602 - DNA, 20 bp, Homo sapiens
aacactgaggcctactcttc

SEQ ID NO: 8078603 - DNA, 20 bp, Homo sapiens
aacactgagggctactcttc

SEQ ID NO: 8078604 - DNA, 22 bp, Homo sapiens
aacactgagggaaaagagatag

SEQ ID NO: 8078605 - DNA, 22 bp, Homo sapiens
aagtatttcgttctgaaaaagt

SEQ ID NO: 8078606 - DNA, 22 bp, Homo sapiens
aagttgatttaaactactagtc

SEQ ID NO: 8078607 - DNA, 22 bp, Homo sapiens
aagttcttgtatttgcctttct

SEQ ID NO: 8078608 - DNA, 22 bp, Homo sapiens
aagttctttcatatcttaatta

SEQ ID NO: 8078609 - DNA, 23 bp, Homo sapiens
aagttcttttagatgtcttcgtg

SEQ ID NO: 8078610 - DNA, 22 bp, Homo sapiens
aagttctttgccagacacgtgt

SEQ ID NO: 8078611 - DNA, 22 bp, Homo sapiens
aagttcttgagccctattctag

SEQ ID NO: 8078612 - DNA, 20 bp, Homo sapiens
aagttacattgtattgtacc

SEQ ID NO: 8078613 - DNA, 22 bp, Homo sapiens
aacaatgagtcctctgaggtta

SEQ ID NO: 8078614 - DNA, 22 bp, Homo sapiens
aacaatcaagtttctaaatgac

SEQ ID NO: 8078615 - DNA, 22 bp, Homo sapiens
aacaatcaagtttctaaatgac

SEQ ID NO: 8078616 - DNA, 22 bp, Homo sapiens
aacaatctccaagaccaatgtg

SEQ ID NO: 8078617 - DNA, 20 bp, Homo sapiens
aacaatctagaagctattct

SEQ ID NO: 8078618 - DNA, 22 bp, Homo sapiens
aacaatctgttcgatagaaaat

SEQ ID NO: 8078619 - DNA, 22 bp, Homo sapiens
aacaatgaccacacaatgtact

SEQ ID NO: 8078620 - DNA, 22 bp, Homo sapiens
aacaataattgcggttctctat

SEQ ID NO: 8078621 - DNA, 22 bp, Homo sapiens
aacaataactagacatgccatg

SEQ ID NO: 8078622 - DNA, 22 bp, Homo sapiens
aacaagttgttgaaaataatta

SEQ ID NO: 8078623 - DNA, 19 bp, Homo sapiens
aacaagtaggaatggaaga

SEQ ID NO: 8078624 - DNA, 22 bp, Homo sapiens
aaatttctaagcagccacttcc

SEQ ID NO: 8078625 - DNA, 22 bp, Homo sapiens
aagccagtgggcatagcagttg

SEQ ID NO: 8078626 - DNA, 22 bp, Homo sapiens
aagccagttagcacatcattgc

SEQ ID NO: 8078627 - DNA, 22 bp, Homo sapiens
aagccattcccatagacttcag

SEQ ID NO: 8078628 - DNA, 22 bp, Homo sapiens
aagccatggtagaaaactcagt

SEQ ID NO: 8078629 - DNA, 22 bp, Homo sapiens
aagctgattctaaaatttatta

SEQ ID NO: 8078630 - DNA, 22 bp, Homo sapiens
aagctgatgtcccagtttgaag

SEQ ID NO: 8078631 - DNA, 22 bp, Homo sapiens
aagctggcctgtacctgctgag

SEQ ID NO: 8078632 - DNA, 22 bp, Homo sapiens
aagctttagagatgagttcctt

SEQ ID NO: 8078633 - DNA, 22 bp, Homo sapiens
aagctttaagtgtcagtcagcc

SEQ ID NO: 8078634 - DNA, 22 bp, Homo sapiens
aagctttatgacttggagacag

SEQ ID NO: 8078635 - DNA, 22 bp, Homo sapiens
aagctttatgatctctcagcta

SEQ ID NO: 8078636 - DNA, 22 bp, Homo sapiens
aaattgcattgagctgcttatt

SEQ ID NO: 8078637 - DNA, 22 bp, Homo sapiens
aaattgttgatctacagtaagg

SEQ ID NO: 8078638 - DNA, 22 bp, Homo sapiens
aaatttaaaaagcagcattgca

SEQ ID NO: 8078639 - DNA, 22 bp, Homo sapiens
aaattattatgcccctctataa

SEQ ID NO: 8078640 - DNA, 22 bp, Homo sapiens
aaattattataggcagagctga

SEQ ID NO: 8078641 - DNA, 22 bp, Homo sapiens
aaattattacaagctagttggc

SEQ ID NO: 8078642 - DNA, 22 bp, Homo sapiens
aaattataggtgccaccttgga

SEQ ID NO: 8078643 - DNA, 22 bp, Homo sapiens
aagacaaaggggtccttggatg

SEQ ID NO: 8078644 - DNA, 22 bp, Homo sapiens
aagacaacagagatgacagact

SEQ ID NO: 8078645 - DNA, 22 bp, Homo sapiens
aattcacaaaagttagatccat

SEQ ID NO: 8078646 - DNA, 22 bp, Homo sapiens
aattcacaaaaccagattgctt

SEQ ID NO: 8078647 - DNA, 22 bp, Homo sapiens
aattcaaattacaatagttgtt

SEQ ID NO: 8078648 - DNA, 22 bp, Homo sapiens
aattcaaagccgcttgggaatc

SEQ ID NO: 8078649 - DNA, 22 bp, Homo sapiens
aattcaaagactagaattttgc

SEQ ID NO: 8078650 - DNA, 22 bp, Homo sapiens
aattcaaattacaatagttgtt

SEQ ID NO: 8078651 - DNA, 22 bp, Homo sapiens
aattcaaattacaatagttgtt

SEQ ID NO: 8078652 - DNA, 23 bp, Homo sapiens
aattcaaattcagtgtgactagg

SEQ ID NO: 8078653 - DNA, 22 bp, Homo sapiens
aattcaaatttgagtttgtgat

SEQ ID NO: 8078654 - DNA, 23 bp, Homo sapiens
aattcaaattcagtgtgactagg

SEQ ID NO: 8078655 - DNA, 22 bp, Homo sapiens
aattcaaggatctgttaaatct

SEQ ID NO: 8078656 - DNA, 22 bp, Homo sapiens
aattcaacagtcagttatctca

SEQ ID NO: 8078657 - DNA, 22 bp, Homo sapiens
aattagaagctgttagcaaaat

SEQ ID NO: 8078658 - DNA, 22 bp, Homo sapiens
aattagcatttcccatataaat

SEQ ID NO: 8078659 - DNA, 22 bp, Homo sapiens
acaagaatgtagattagttaag

SEQ ID NO: 8078660 - DNA, 22 bp, Homo sapiens
acaactttaatgggtttcagct

SEQ ID NO: 8078661 - DNA, 22 bp, Homo sapiens
acaactttctgggttatctgat

SEQ ID NO: 8078662 - DNA, 22 bp, Homo sapiens
acaactctcagttaaataaaga

SEQ ID NO: 8078663 - DNA, 22 bp, Homo sapiens
acaacaaaatcactagtcttcc

SEQ ID NO: 8078664 - DNA, 22 bp, Homo sapiens
aagacaatcctggacagtcagc

SEQ ID NO: 8078665 - DNA, 22 bp, Homo sapiens
aagacacaaagcttcccttttc

SEQ ID NO: 8078666 - DNA, 22 bp, Homo sapiens
aagacaatttgatactagttgc

SEQ ID NO: 8078667 - DNA, 22 bp, Homo sapiens
aatgtcttttcccttactttcc

SEQ ID NO: 8078668 - DNA, 22 bp, Homo sapiens
aactttctgaaaagcttgatca

SEQ ID NO: 8078669 - DNA, 22 bp, Homo sapiens
aactttctctggatggcttcct

SEQ ID NO: 8078670 - DNA, 22 bp, Homo sapiens
aattagaaccagaagccatatt

SEQ ID NO: 8078671 - DNA, 22 bp, Homo sapiens
aatgttattacacttgtgaaat

SEQ ID NO: 8078672 - DNA, 22 bp, Homo sapiens
aactttcagaatcctatgcatt

SEQ ID NO: 8078673 - DNA, 22 bp, Homo sapiens
aactttcaggcaatgaatattt

SEQ ID NO: 8078674 - DNA, 22 bp, Homo sapiens
aatgtattttgggagtttcttt

SEQ ID NO: 8078675 - DNA, 20 bp, Homo sapiens
aactcctagcctcaagtgat

SEQ ID NO: 8078676 - DNA, 22 bp, Homo sapiens
aactcttaattttcatgaaatg

SEQ ID NO: 8078677 - DNA, 22 bp, Homo sapiens
acactacagggagaagactcac

SEQ ID NO: 8078678 - DNA, 22 bp, Homo sapiens
acacacagagtttatacaggca

SEQ ID NO: 8078679 - DNA, 21 bp, Homo sapiens
aagaggcatcactatttgtgt

SEQ ID NO: 8078680 - DNA, 22 bp, Homo sapiens
aagcaaacaggagaagagctgt

SEQ ID NO: 8078681 - DNA, 22 bp, Homo sapiens
aagcaaaaggttacacttctgg

SEQ ID NO: 8078682 - DNA, 22 bp, Homo sapiens
acagaagagcacatttagtatg

SEQ ID NO: 8078683 - DNA, 22 bp, Homo sapiens
acagaagaccaagaaagcttcc

SEQ ID NO: 8078684 - DNA, 22 bp, Homo sapiens
aagattttctcaactgtatttg

SEQ ID NO: 8078685 - DNA, 22 bp, Homo sapiens
aagattttcagtgcctaaaaca

SEQ ID NO: 8078686 - DNA, 22 bp, Homo sapiens
aagattttcagtgcctaaaaca

SEQ ID NO: 8078687 - DNA, 22 bp, Homo sapiens
aagattttcagctaatggtgca

SEQ ID NO: 8078688 - DNA, 22 bp, Homo sapiens
aagattttctcaactgtatttg

SEQ ID NO: 8078689 - DNA, 22 bp, Homo sapiens
aagatttttttccacagactca

SEQ ID NO: 8078690 - DNA, 22 bp, Homo sapiens
aagcaaaaggttacacttctgg

SEQ ID NO: 8078691 - DNA, 20 bp, Homo sapiens
aagatactccagaaattaaa

SEQ ID NO: 8078692 - DNA, 22 bp, Homo sapiens
aagatagcttggaaaagtacag

SEQ ID NO: 8078693 - DNA, 22 bp, Homo sapiens
aagatacattttcttcagagaa

SEQ ID NO: 8078694 - DNA, 22 bp, Homo sapiens
aagatacatcaaagcaaattgg

SEQ ID NO: 8078695 - DNA, 19 bp, Homo sapiens
acagaaatgtaagtgagac

SEQ ID NO: 8078696 - DNA, 22 bp, Homo sapiens
aagatatagataaaactatgca

SEQ ID NO: 8078697 - DNA, 22 bp, Homo sapiens
aaaagtctgctctcatttcaga

SEQ ID NO: 8078698 - DNA, 22 bp, Homo sapiens
aaaagtctgctctcatttcaga

SEQ ID NO: 8078699 - DNA, 22 bp, Homo sapiens
aaaagtctctctgagtaaaagt

SEQ ID NO: 8078700 - DNA, 22 bp, Homo sapiens
aaaagtctgctttctattatca

SEQ ID NO: 8078701 - DNA, 22 bp, Homo sapiens
aaaagtctctctgagtaaaagt

SEQ ID NO: 8078702 - DNA, 22 bp, Homo sapiens
aaaagtattttggatctcagat

SEQ ID NO: 8078703 - DNA, 22 bp, Homo sapiens
aaaaagacagaggatgaggcag

SEQ ID NO: 8078704 - DNA, 20 bp, Homo sapiens
aaaaagacaaaacgagttgg

SEQ ID NO: 8078705 - DNA, 22 bp, Homo sapiens
aaaaagatgtcctgaagtttag

SEQ ID NO: 8078706 - DNA, 22 bp, Homo sapiens
aaaaatgaattcttcagtggca

SEQ ID NO: 8078707 - DNA, 22 bp, Homo sapiens
aaacaaagccagggaagttatg

SEQ ID NO: 8078708 - DNA, 22 bp, Homo sapiens
aaacacacctttggaactgtga

SEQ ID NO: 8078709 - DNA, 22 bp, Homo sapiens
aaacaacatggtgggtgtgtag

SEQ ID NO: 8078710 - DNA, 22 bp, Homo sapiens
aaaagtgtccagattatgaaga

SEQ ID NO: 8078711 - DNA, 22 bp, Homo sapiens
aaaagtcttgtcaaggttccca

SEQ ID NO: 8078712 - DNA, 22 bp, Homo sapiens
aaaagtcttggggaaggccagg

SEQ ID NO: 8078713 - DNA, 22 bp, Homo sapiens
aaaatagctatggaatgtcact

SEQ ID NO: 8078714 - DNA, 22 bp, Homo sapiens
aaaattcattcctcagactgcc

SEQ ID NO: 8078715 - DNA, 22 bp, Homo sapiens
aaacatcttctcttgattcttt

SEQ ID NO: 8078716 - DNA, 22 bp, Homo sapiens
aaacacagggatatatattcca

SEQ ID NO: 8078717 - DNA, 20 bp, Homo sapiens
aaacacagcctctctttaca

SEQ ID NO: 8078718 - DNA, 22 bp, Homo sapiens
aaaccattgcatctttcttaat

SEQ ID NO: 8078719 - DNA, 22 bp, Homo sapiens
aaagatctatgggcatttagct

SEQ ID NO: 8078720 - DNA, 22 bp, Homo sapiens
aaagaagcataggctagacttc

SEQ ID NO: 8078721 - DNA, 22 bp, Homo sapiens
aaacttgtggtggagaagccta

SEQ ID NO: 8078722 - DNA, 22 bp, Homo sapiens
aaagaactattaacgaggaagc

SEQ ID NO: 8078723 - DNA, 22 bp, Homo sapiens
aaacttcttgctgcattttctg

SEQ ID NO: 8078724 - DNA, 23 bp, Homo sapiens
aaacttgctatggctgaaatcat

SEQ ID NO: 8078725 - DNA, 22 bp, Homo sapiens
aaacttgagtcacttctcttcc

SEQ ID NO: 8078726 - DNA, 22 bp, Homo sapiens
aaatactgtagataatagagtt

SEQ ID NO: 8078727 - DNA, 22 bp, Homo sapiens
aaactaaacctggcttagtaag

SEQ ID NO: 8078728 - DNA, 22 bp, Homo sapiens
aaatagaattaactagctactg

SEQ ID NO: 8078729 - DNA, 22 bp, Homo sapiens
aaatcatgttggcacaataaaa

SEQ ID NO: 8078730 - DNA, 22 bp, Homo sapiens
aaatgctaaatgcagcaagtag

SEQ ID NO: 8078731 - DNA, 22 bp, Homo sapiens
aaatacagattccagggtctta

SEQ ID NO: 8078732 - DNA, 22 bp, Homo sapiens
aaacagttttttaagtctctag

SEQ ID NO: 8078733 - DNA, 22 bp, Homo sapiens
aaacagttttctcatttagtgt

SEQ ID NO: 8078734 - DNA, 22 bp, Homo sapiens
aaagtcatttagccttatctcc

SEQ ID NO: 8078735 - DNA, 22 bp, Homo sapiens
aaagtccaattttgttcaggct

SEQ ID NO: 8078736 - DNA, 22 bp, Homo sapiens
aaacactggtatgatgtatagt

SEQ ID NO: 8078737 - DNA, 22 bp, Homo sapiens
aaacactggtatgatgtatagt

SEQ ID NO: 8078738 - DNA, 22 bp, Homo sapiens
aaagatgtcatacacattaaga

SEQ ID NO: 8078739 - DNA, 22 bp, Homo sapiens
aaagcaatgcccgttcattatc

SEQ ID NO: 8078740 - DNA, 22 bp, Homo sapiens
aaagcaatcagattcagatgtc

SEQ ID NO: 8078741 - DNA, 22 bp, Homo sapiens
aaaggcatggatagtgaattca

SEQ ID NO: 8078742 - DNA, 22 bp, Homo sapiens
aacattcaaaacccagttcagt

SEQ ID NO: 8078743 - DNA, 22 bp, Homo sapiens
aacagtcctgtgctctttcatt

SEQ ID NO: 8078744 - DNA, 22 bp, Homo sapiens
aacagtatatgaaatgttagga

SEQ ID NO: 8078745 - DNA, 22 bp, Homo sapiens
aacagtatgtgagatttacaca

SEQ ID NO: 8078746 - DNA, 22 bp, Homo sapiens
aactgaaacttaggaagtaatc

SEQ ID NO: 8078747 - DNA, 22 bp, Homo sapiens
aactgaaatcaatcagtgattc

SEQ ID NO: 8078748 - DNA, 22 bp, Homo sapiens
aacttgcttcaacttatttcac

SEQ ID NO: 8078749 - DNA, 22 bp, Homo sapiens
aactatactctgtaaatgtgct

SEQ ID NO: 8078750 - DNA, 22 bp, Homo sapiens
aactatgtgatatcatccttgc

SEQ ID NO: 8078751 - DNA, 22 bp, Homo sapiens
aactatttttggagctaactct

SEQ ID NO: 8078752 - DNA, 22 bp, Homo sapiens
aactcaaagatgcatgacgctt

SEQ ID NO: 8078753 - DNA, 22 bp, Homo sapiens
aactcaaagatgcatgacgctt

SEQ ID NO: 8078754 - DNA, 22 bp, Homo sapiens
aactcactttgtggcttctgaa

SEQ ID NO: 8078755 - DNA, 22 bp, Homo sapiens
aactcactttgtggcttctgaa

SEQ ID NO: 8078756 - DNA, 22 bp, Homo sapiens
aaagcaatagagggtaagactg

SEQ ID NO: 8078757 - DNA, 22 bp, Homo sapiens
aaatgggtttgattctcagcca

SEQ ID NO: 8078758 - DNA, 23 bp, Homo sapiens
aacacaaagctgattccagtggc

SEQ ID NO: 8078759 - DNA, 22 bp, Homo sapiens
aacacaaagaagctgcaggatc

SEQ ID NO: 8078760 - DNA, 22 bp, Homo sapiens
aacaatgtgaagtgctgttcag

SEQ ID NO: 8078761 - DNA, 22 bp, Homo sapiens
aacaattactaccaaggcctgt

SEQ ID NO: 8078762 - DNA, 22 bp, Homo sapiens
aacaattatcatatacattgca

SEQ ID NO: 8078763 - DNA, 22 bp, Homo sapiens
aacacattggaagccaagaatg

SEQ ID NO: 8078764 - DNA, 22 bp, Homo sapiens
aaatatgaatgataagagttat

SEQ ID NO: 8078765 - DNA, 22 bp, Homo sapiens
aaatatccataagcacatctat

SEQ ID NO: 8078766 - DNA, 22 bp, Homo sapiens
aagcaactccctcctcattttt

SEQ ID NO: 8078767 - DNA, 22 bp, Homo sapiens
aagcatggtggatgatacagtg

SEQ ID NO: 8078768 - DNA, 19 bp, Homo sapiens
aagcatggtgcctcacctc

SEQ ID NO: 8078769 - DNA, 22 bp, Homo sapiens
aagcagcacagtaatattggtg

SEQ ID NO: 8078770 - DNA, 22 bp, Homo sapiens
aagccacttggggaaagatgga

SEQ ID NO: 8078771 - DNA, 22 bp, Homo sapiens
aagaaagtgggtaatatgattt

SEQ ID NO: 8078772 - DNA, 22 bp, Homo sapiens
aagaaagtgtggagagcctagc

SEQ ID NO: 8078773 - DNA, 22 bp, Homo sapiens
aagaaagggctattgttctcca

SEQ ID NO: 8078774 - DNA, 22 bp, Homo sapiens
aagaaagtgatgagctacagat

SEQ ID NO: 8078775 - DNA, 22 bp, Homo sapiens
aagaaagtgctttgtaaattat

SEQ ID NO: 8078776 - DNA, 22 bp, Homo sapiens
aagaaagtgctttgtaaattat

SEQ ID NO: 8078777 - DNA, 22 bp, Homo sapiens
aacttttaaaatacacagacaa

SEQ ID NO: 8078778 - DNA, 22 bp, Homo sapiens
aacttttacaaattgtcatcat

SEQ ID NO: 8078779 - DNA, 22 bp, Homo sapiens
aactttctttcacagaagtatc

SEQ ID NO: 8078780 - DNA, 22 bp, Homo sapiens
aactttctttgcatctaagttt

SEQ ID NO: 8078781 - DNA, 22 bp, Homo sapiens
aagaggaatgggtgtgtttatg

SEQ ID NO: 8078782 - DNA, 22 bp, Homo sapiens
aagagccaagcagtcatcaata

SEQ ID NO: 8078783 - DNA, 22 bp, Homo sapiens
agattatctcctgattttaagg

SEQ ID NO: 8078784 - DNA, 19 bp, Homo sapiens
agattattgcacattcatg

SEQ ID NO: 8078785 - DNA, 22 bp, Homo sapiens
agattcaaagtgaagaacttaa

SEQ ID NO: 8078786 - DNA, 22 bp, Homo sapiens
agattagcctaaaaatgtatag

SEQ ID NO: 8078787 - DNA, 21 bp, Homo sapiens
agattataaagaaccttctta

SEQ ID NO: 8078788 - DNA, 22 bp, Homo sapiens
agattagcttgtgtacaaaggt

SEQ ID NO: 8078789 - DNA, 22 bp, Homo sapiens
agattacagaagaataagtaga

SEQ ID NO: 8078790 - DNA, 22 bp, Homo sapiens
agatatcaccagttttacatac

SEQ ID NO: 8078791 - DNA, 22 bp, Homo sapiens
agatatgagattttcaaacaag

SEQ ID NO: 8078792 - DNA, 22 bp, Homo sapiens
agatccttaatttaatcacatc

SEQ ID NO: 8078793 - DNA, 22 bp, Homo sapiens
agatccttttctattgtttcga

SEQ ID NO: 8078794 - DNA, 22 bp, Homo sapiens
agagtaaagtacttggaatacc

SEQ ID NO: 8078795 - DNA, 22 bp, Homo sapiens
agagtaaagtacttggaatacc

SEQ ID NO: 8078796 - DNA, 22 bp, Homo sapiens
acaaaaagctccattactgtcc

SEQ ID NO: 8078797 - DNA, 22 bp, Homo sapiens
acaaaaaccgtggattcagcat

SEQ ID NO: 8078798 - DNA, 22 bp, Homo sapiens
aatttcaaactaataggaacca

SEQ ID NO: 8078799 - DNA, 22 bp, Homo sapiens
aatttcaaagctcactggcata

SEQ ID NO: 8078800 - DNA, 22 bp, Homo sapiens
aatttcaagtggcatctttgat

SEQ ID NO: 8078801 - DNA, 22 bp, Homo sapiens
aatttcaagtcttgaagaagta

SEQ ID NO: 8078802 - DNA, 22 bp, Homo sapiens
aatttatttcctgccagtacac

SEQ ID NO: 8078803 - DNA, 22 bp, Homo sapiens
agaggccaatagtaggtggcat

SEQ ID NO: 8078804 - DNA, 22 bp, Homo sapiens
agaggccacaccagcctcccgt

SEQ ID NO: 8078805 - DNA, 22 bp, Homo sapiens
agagcaggcataaagctttgaa

SEQ ID NO: 8078806 - DNA, 22 bp, Homo sapiens
agagcagctggggcagagacca

SEQ ID NO: 8078807 - DNA, 22 bp, Homo sapiens
agagcagctgtgacatggacag

SEQ ID NO: 8078808 - DNA, 22 bp, Homo sapiens
aattcacaggaggtatttgtcc

SEQ ID NO: 8078809 - DNA, 22 bp, Homo sapiens
agaatttcaaatggaagtttta

SEQ ID NO: 8078810 - DNA, 21 bp, Homo sapiens
agaataatggtatcatttgct

SEQ ID NO: 8078811 - DNA, 22 bp, Homo sapiens
agaataaatgctacctatcaca

SEQ ID NO: 8078812 - DNA, 22 bp, Homo sapiens
agaagtttgttatgtaaacaaa

SEQ ID NO: 8078813 - DNA, 23 bp, Homo sapiens
aatgctggaaattcaggcatgat

SEQ ID NO: 8078814 - DNA, 22 bp, Homo sapiens
aatgaaacatatttaggaataa

SEQ ID NO: 8078815 - DNA, 22 bp, Homo sapiens
aatgaaaattggaccctagaac

SEQ ID NO: 8078816 - DNA, 22 bp, Homo sapiens
aatgaaacatatttaggaataa

SEQ ID NO: 8078817 - DNA, 22 bp, Homo sapiens
aatgctttgagggaagatgaaa

SEQ ID NO: 8078818 - DNA, 22 bp, Homo sapiens
aatgctttttgcgaaatgtgca

SEQ ID NO: 8078819 - DNA, 22 bp, Homo sapiens
agactgaataggaaagagggaa

SEQ ID NO: 8078820 - DNA, 22 bp, Homo sapiens
agagaaacccttcagtgttttg

SEQ ID NO: 8078821 - DNA, 22 bp, Homo sapiens
agatttctgtcaccttctatgc

SEQ ID NO: 8078822 - DNA, 22 bp, Homo sapiens
agatttggcagtataaattctg

SEQ ID NO: 8078823 - DNA, 22 bp, Homo sapiens
acacacagaaggaagccccact

SEQ ID NO: 8078824 - DNA, 21 bp, Homo sapiens
agatttgtcccttcccattta

SEQ ID NO: 8078825 - DNA, 22 bp, Homo sapiens
agcagaaaattggaaatgacaa

SEQ ID NO: 8078826 - DNA, 22 bp, Homo sapiens
agcactttgggagataaagctg

SEQ ID NO: 8078827 - DNA, 23 bp, Homo sapiens
acacagaagaagacccaaggaag

SEQ ID NO: 8078828 - DNA, 22 bp, Homo sapiens
acacagaacctcatagcctctc

SEQ ID NO: 8078829 - DNA, 22 bp, Homo sapiens
acacagaacctcatagcctctc

SEQ ID NO: 8078830 - DNA, 22 bp, Homo sapiens
agcagaaccacagcactgttga

SEQ ID NO: 8078831 - DNA, 22 bp, Homo sapiens
agcatttaagcttctgcaaagc

SEQ ID NO: 8078832 - DNA, 22 bp, Homo sapiens
agcatttaagggtggatacagg

SEQ ID NO: 8078833 - DNA, 22 bp, Homo sapiens
agcatttaatcctacatagatc

SEQ ID NO: 8078834 - DNA, 22 bp, Homo sapiens
acagaacagagggttttagaat

SEQ ID NO: 8078835 - DNA, 22 bp, Homo sapiens
acagaacatggatttttgaagt

SEQ ID NO: 8078836 - DNA, 22 bp, Homo sapiens
acagaactggaattggaactca

SEQ ID NO: 8078837 - DNA, 22 bp, Homo sapiens
acagaactgtgatctcataaat

SEQ ID NO: 8078838 - DNA, 22 bp, Homo sapiens
agcctggccctgctgaactctg

SEQ ID NO: 8078839 - DNA, 22 bp, Homo sapiens
agcctggcggtcgtcggtcagg

SEQ ID NO: 8078840 - DNA, 22 bp, Homo sapiens
agcctggctgggaagagcctct

SEQ ID NO: 8078841 - DNA, 22 bp, Homo sapiens
agcctggctgtaacctcatggt

SEQ ID NO: 8078842 - DNA, 22 bp, Homo sapiens
acaggtctggtctgggtgggac

SEQ ID NO: 8078843 - DNA, 22 bp, Homo sapiens
acaggtcaacgagagcaggcaa

SEQ ID NO: 8078844 - DNA, 22 bp, Homo sapiens
acaggtacaagggattaggatg

SEQ ID NO: 8078845 - DNA, 22 bp, Homo sapiens
acaggcttcagatgtattaact

SEQ ID NO: 8078846 - DNA, 22 bp, Homo sapiens
acagtgtcatcagtttctcaac

SEQ ID NO: 8078847 - DNA, 22 bp, Homo sapiens
acagtctttctacattctgtgc

SEQ ID NO: 8078848 - DNA, 22 bp, Homo sapiens
acagtgccctatgaacagctct

SEQ ID NO: 8078849 - DNA, 22 bp, Homo sapiens
acaggcagagaactcagccaga

SEQ ID NO: 8078850 - DNA, 22 bp, Homo sapiens
acagcttttatgggaccagcca

SEQ ID NO: 8078851 - DNA, 20 bp, Homo sapiens
acagatgaggaaaatgaagt

SEQ ID NO: 8078852 - DNA, 22 bp, Homo sapiens
acagatttgatctgagaacaaa

SEQ ID NO: 8078853 - DNA, 22 bp, Homo sapiens
acagatttttggtaaataattt

SEQ ID NO: 8078854 - DNA, 22 bp, Homo sapiens
acataatggacaataatgcatc

SEQ ID NO: 8078855 - DNA, 22 bp, Homo sapiens
acataagtgcacaataaatatt

SEQ ID NO: 8078856 - DNA, 22 bp, Homo sapiens
acataagttatggataaaatgt

SEQ ID NO: 8078857 - DNA, 22 bp, Homo sapiens
acattctgggtgatgttcttca

SEQ ID NO: 8078858 - DNA, 22 bp, Homo sapiens
acattctattctgcaggacaag

SEQ ID NO: 8078859 - DNA, 22 bp, Homo sapiens
acattctgtgagtcatgtttta

SEQ ID NO: 8078860 - DNA, 22 bp, Homo sapiens
accacagggtaaagttagatat

SEQ ID NO: 8078861 - DNA, 22 bp, Homo sapiens
aagggcagcttaaattggtagc

SEQ ID NO: 8078862 - DNA, 22 bp, Homo sapiens
aagggcagctgacagatgctta

SEQ ID NO: 8078863 - DNA, 22 bp, Homo sapiens
aaggttgcagcagtgttgatga

SEQ ID NO: 8078864 - DNA, 22 bp, Homo sapiens
actgactgtggatggcagcagc

SEQ ID NO: 8078865 - DNA, 22 bp, Homo sapiens
actgactgtcagtggaaggcta

SEQ ID NO: 8078866 - DNA, 22 bp, Homo sapiens
aagttttattggctatagcact

SEQ ID NO: 8078867 - DNA, 22 bp, Homo sapiens
aagttttattggctatagcact

SEQ ID NO: 8078868 - DNA, 22 bp, Homo sapiens
aagttttattggaacatagcca

SEQ ID NO: 8078869 - DNA, 22 bp, Homo sapiens
aagttttatgggaagatgtgca

SEQ ID NO: 8078870 - DNA, 21 bp, Homo sapiens
aagttttatgttgccatttgt

SEQ ID NO: 8078871 - DNA, 22 bp, Homo sapiens
aataacagaaacttgagcatca

SEQ ID NO: 8078872 - DNA, 22 bp, Homo sapiens
aataacagagtcttcaagatag

SEQ ID NO: 8078873 - DNA, 22 bp, Homo sapiens
aataaagtgtattctttgtcat

SEQ ID NO: 8078874 - DNA, 22 bp, Homo sapiens
aataaagtagcgtttaaggtgc

SEQ ID NO: 8078875 - DNA, 22 bp, Homo sapiens
aataaagtagcgtttaaggtgc

SEQ ID NO: 8078876 - DNA, 22 bp, Homo sapiens
aataaagcctgtctctttagag

SEQ ID NO: 8078877 - DNA, 22 bp, Homo sapiens
aataaagcagggtccttgcact

SEQ ID NO: 8078878 - DNA, 22 bp, Homo sapiens
aataaagcatgaggcatttatc

SEQ ID NO: 8078879 - DNA, 18 bp, Homo sapiens
aataaagcaggatttctc

SEQ ID NO: 8078880 - DNA, 20 bp, Homo sapiens
aataaagcaacgagcgagct

SEQ ID NO: 8078881 - DNA, 22 bp, Homo sapiens
aataaagcacttgggttggtaa

SEQ ID NO: 8078882 - DNA, 22 bp, Homo sapiens
actcagttccatattggtaagt

SEQ ID NO: 8078883 - DNA, 22 bp, Homo sapiens
aagttttaacaagtacttacta

SEQ ID NO: 8078884 - DNA, 22 bp, Homo sapiens
aagttttaacaagtacttacta

SEQ ID NO: 8078885 - DNA, 22 bp, Homo sapiens
aagttttactgaggacacatgt

SEQ ID NO: 8078886 - DNA, 22 bp, Homo sapiens
aagtttggtccttctaagaaga

SEQ ID NO: 8078887 - DNA, 18 bp, Homo sapiens
acctggctgtgtgagctg

SEQ ID NO: 8078888 - DNA, 20 bp, Homo sapiens
acctggcttcctcttggcat

SEQ ID NO: 8078889 - DNA, 22 bp, Homo sapiens
acctggcttctaatcatggctc

SEQ ID NO: 8078890 - DNA, 22 bp, Homo sapiens
acctggcttcaaccatcatttg

SEQ ID NO: 8078891 - DNA, 22 bp, Homo sapiens
acctggcttccaatctaggagc

SEQ ID NO: 8078892 - DNA, 22 bp, Homo sapiens
acctggcttcagagtctggcca

SEQ ID NO: 8078893 - DNA, 18 bp, Homo sapiens
aagtaacagaagagcaca

SEQ ID NO: 8078894 - DNA, 22 bp, Homo sapiens
aagtctcttttcttcctgtatt

SEQ ID NO: 8078895 - DNA, 22 bp, Homo sapiens
accttgttgtaggtacaaaaga

SEQ ID NO: 8078896 - DNA, 22 bp, Homo sapiens
aataactggcacatatcacata

SEQ ID NO: 8078897 - DNA, 22 bp, Homo sapiens
aataacaggctcatcagatgct

SEQ ID NO: 8078898 - DNA, 22 bp, Homo sapiens
aataacagggttgatttgcaat

SEQ ID NO: 8078899 - DNA, 22 bp, Homo sapiens
aataacagtgccatgaaattga

SEQ ID NO: 8078900 - DNA, 22 bp, Homo sapiens
aatactgtctttcacagatatt

SEQ ID NO: 8078901 - DNA, 22 bp, Homo sapiens
aatactttgccaagttcgaaga

SEQ ID NO: 8078902 - DNA, 22 bp, Homo sapiens
acttatatttgctttatgcttc

SEQ ID NO: 8078903 - DNA, 22 bp, Homo sapiens
acttatttcatggatcataatg

SEQ ID NO: 8078904 - DNA, 20 bp, Homo sapiens
acttagtttttctcacagga

SEQ ID NO: 8078905 - DNA, 22 bp, Homo sapiens
aatatcttggcccaactccaga

SEQ ID NO: 8078906 - DNA, 22 bp, Homo sapiens
aatattagtttctcaagagaga

SEQ ID NO: 8078907 - DNA, 22 bp, Homo sapiens
agaaaataatttcttggctggt

SEQ ID NO: 8078908 - DNA, 22 bp, Homo sapiens
agaaaattactccagagacaag

SEQ ID NO: 8078909 - DNA, 23 bp, Homo sapiens
agaaaccactgaagagatccagt

SEQ ID NO: 8078910 - DNA, 17 bp, Homo sapiens
aatctgtttacagtcag

SEQ ID NO: 8078911 - DNA, 22 bp, Homo sapiens
aatcttttaggggatcctgagg

SEQ ID NO: 8078912 - DNA, 22 bp, Homo sapiens
aatctttaaggactcagtctct

SEQ ID NO: 8078913 - DNA, 22 bp, Homo sapiens
agcacctgtggctcatgctcgt

SEQ ID NO: 8078914 - DNA, 20 bp, Homo sapiens
caataatttacttccctatt

SEQ ID NO: 8078915 - DNA, 22 bp, Homo sapiens
caatacaattaccagttaatca

SEQ ID NO: 8078916 - DNA, 22 bp, Homo sapiens
agcatgatgtagaatcactgga

SEQ ID NO: 8078917 - DNA, 22 bp, Homo sapiens
agcagtgaaacagctgcatatg

SEQ ID NO: 8078918 - DNA, 22 bp, Homo sapiens
agcatggacagtggcagcagtg

SEQ ID NO: 8078919 - DNA, 22 bp, Homo sapiens
agcatggcctcccgggcctggc

SEQ ID NO: 8078920 - DNA, 22 bp, Homo sapiens
agcatggccatctgggccgtcc

SEQ ID NO: 8078921 - DNA, 22 bp, Homo sapiens
cactgtttttatgtaatcagtg

SEQ ID NO: 8078922 - DNA, 22 bp, Homo sapiens
cactgttttattccaacatagg

SEQ ID NO: 8078923 - DNA, 22 bp, Homo sapiens
cacagcaatagctaactgatac

SEQ ID NO: 8078924 - DNA, 22 bp, Homo sapiens
agcagggaggtctagcacgtgg

SEQ ID NO: 8078925 - DNA, 22 bp, Homo sapiens
cacagcaagagctaaatgacca

SEQ ID NO: 8078926 - DNA, 22 bp, Homo sapiens
agccccagtccgctgcgggcgg

SEQ ID NO: 8078927 - DNA, 17 bp, Homo sapiens
agcccccactcccaagt

SEQ ID NO: 8078928 - DNA, 22 bp, Homo sapiens
agccagtggaattcccaggggt

SEQ ID NO: 8078929 - DNA, 22 bp, Homo sapiens
cagagaacattcagagctgtag

SEQ ID NO: 8078930 - DNA, 22 bp, Homo sapiens
cagagaactccagtggctggcg

SEQ ID NO: 8078931 - DNA, 22 bp, Homo sapiens
cagagacatccatgttagttgg

SEQ ID NO: 8078932 - DNA, 22 bp, Homo sapiens
cagagacattaagtgccatgat

SEQ ID NO: 8078933 - DNA, 22 bp, Homo sapiens
agccagcaggtgcagaattcca

SEQ ID NO: 8078934 - DNA, 21 bp, Homo sapiens
agccagcaacacagcatctcc

SEQ ID NO: 8078935 - DNA, 22 bp, Homo sapiens
agctaagtggaaaatgcagtta

SEQ ID NO: 8078936 - DNA, 22 bp, Homo sapiens
agcctgggcatgggacgggagg

SEQ ID NO: 8078937 - DNA, 22 bp, Homo sapiens
agcctgggcaacaacacagcga

SEQ ID NO: 8078938 - DNA, 19 bp, Homo sapiens
agcctggctttgctctgct

SEQ ID NO: 8078939 - DNA, 22 bp, Homo sapiens
agcctggcttagctctctcact

SEQ ID NO: 8078940 - DNA, 22 bp, Homo sapiens
agcctggccactcagggcctga

SEQ ID NO: 8078941 - DNA, 19 bp, Homo sapiens
agctcctgattgtgcctcg

SEQ ID NO: 8078942 - DNA, 22 bp, Homo sapiens
agctcctggatgaggcttatgt

SEQ ID NO: 8078943 - DNA, 22 bp, Homo sapiens
agctcctggaggtgcgcactcg

SEQ ID NO: 8078944 - DNA, 22 bp, Homo sapiens
agctcctgtggcagctcttctg

SEQ ID NO: 8078945 - DNA, 22 bp, Homo sapiens
agctcctgggcacctctttcac

SEQ ID NO: 8078946 - DNA, 22 bp, Homo sapiens
agctcctgggggttccaagcag

SEQ ID NO: 8078947 - DNA, 17 bp, Homo sapiens
agctcctggggtcttta

SEQ ID NO: 8078948 - DNA, 18 bp, Homo sapiens
agctcctggtctcaggga

SEQ ID NO: 8078949 - DNA, 23 bp, Homo sapiens
agctcctgtaaggtggtcgtcac

SEQ ID NO: 8078950 - DNA, 22 bp, Homo sapiens
agagccaggcaggcaatgttga

SEQ ID NO: 8078951 - DNA, 21 bp, Homo sapiens
agagcacaggtggacaatgct

SEQ ID NO: 8078952 - DNA, 22 bp, Homo sapiens
agagctggctggtagccctgat

SEQ ID NO: 8078953 - DNA, 22 bp, Homo sapiens
agagagcctgagtggcagctat

SEQ ID NO: 8078954 - DNA, 22 bp, Homo sapiens
agagaagtgagcttgttcactc

SEQ ID NO: 8078955 - DNA, 22 bp, Homo sapiens
agactgtaattgacatgtcagc

SEQ ID NO: 8078956 - DNA, 22 bp, Homo sapiens
atgcatattttctactatatcg

SEQ ID NO: 8078957 - DNA, 22 bp, Homo sapiens
agacagacacatggtaacagat

SEQ ID NO: 8078958 - DNA, 22 bp, Homo sapiens
atgatacattgcaaaattttaa

SEQ ID NO: 8078959 - DNA, 22 bp, Homo sapiens
atgatatagagagtagattaaa

SEQ ID NO: 8078960 - DNA, 22 bp, Homo sapiens
atgcctttaagagatactgagg

SEQ ID NO: 8078961 - DNA, 22 bp, Homo sapiens
atgcctttatcaggaggtaaat

SEQ ID NO: 8078962 - DNA, 20 bp, Homo sapiens
atgcctttgatagtcaggct

SEQ ID NO: 8078963 - DNA, 22 bp, Homo sapiens
atgcctttgccacagattagga

SEQ ID NO: 8078964 - DNA, 22 bp, Homo sapiens
atgcctttctctgtagaaagaa

SEQ ID NO: 8078965 - DNA, 22 bp, Homo sapiens
atgcctttctggtgttcttcct

SEQ ID NO: 8078966 - DNA, 22 bp, Homo sapiens
atgcctttggcattatttcttg

SEQ ID NO: 8078967 - DNA, 22 bp, Homo sapiens
atgcctttgttgaccactataa

SEQ ID NO: 8078968 - DNA, 22 bp, Homo sapiens
atgccttttcgggtacttctct

SEQ ID NO: 8078969 - DNA, 22 bp, Homo sapiens
agacaacaccaaatgctagtgt

SEQ ID NO: 8078970 - DNA, 22 bp, Homo sapiens
agacacattttacattaactgt

SEQ ID NO: 8078971 - DNA, 22 bp, Homo sapiens
atctgcttagaattcattgtcc

SEQ ID NO: 8078972 - DNA, 22 bp, Homo sapiens
atgaagcattacaggatgacag

SEQ ID NO: 8078973 - DNA, 19 bp, Homo sapiens
atgaagcattgtttttgta

SEQ ID NO: 8078974 - DNA, 22 bp, Homo sapiens
atgaagcagttaaggtgcatga

SEQ ID NO: 8078975 - DNA, 22 bp, Homo sapiens
atctgcttgaaacttcttatac

SEQ ID NO: 8078976 - DNA, 22 bp, Homo sapiens
atctgcttcgcgccaatttcat

SEQ ID NO: 8078977 - DNA, 21 bp, Homo sapiens
atctgcttaggtttgttcaga

SEQ ID NO: 8078978 - DNA, 22 bp, Homo sapiens
agaatatcgtagcatattatct

SEQ ID NO: 8078979 - DNA, 22 bp, Homo sapiens
agaatatatgactgcaagacta

SEQ ID NO: 8078980 - DNA, 22 bp, Homo sapiens
agaatatatgactgcaagacta

SEQ ID NO: 8078981 - DNA, 22 bp, Homo sapiens
agaatatgatcggaatacagat

SEQ ID NO: 8078982 - DNA, 22 bp, Homo sapiens
agaatatagttaccaaattctg

SEQ ID NO: 8078983 - DNA, 22 bp, Homo sapiens
agaatatagttaccaaattctg

SEQ ID NO: 8078984 - DNA, 22 bp, Homo sapiens
atgaagctgaaaaaggcatata

SEQ ID NO: 8078985 - DNA, 22 bp, Homo sapiens
agatattaccagcagtctatgc

SEQ ID NO: 8078986 - DNA, 22 bp, Homo sapiens
agatataataatttacaagtgt

SEQ ID NO: 8078987 - DNA, 22 bp, Homo sapiens
agatattttgtgtgatgtttca

SEQ ID NO: 8078988 - DNA, 22 bp, Homo sapiens
agatcagagtggattgtgctgc

SEQ ID NO: 8078989 - DNA, 22 bp, Homo sapiens
agatcagatctccttttgcatt

SEQ ID NO: 8078990 - DNA, 22 bp, Homo sapiens
agatcatagcacaaaagtgaca

SEQ ID NO: 8078991 - DNA, 22 bp, Homo sapiens
agatcatactacttgtactaaa

SEQ ID NO: 8078992 - DNA, 22 bp, Homo sapiens
agatcagagatgctaaaagagc

SEQ ID NO: 8078993 - DNA, 22 bp, Homo sapiens
agatcagactttgtgactagga

SEQ ID NO: 8078994 - DNA, 22 bp, Homo sapiens
agatcagacacggcttgtgacg

SEQ ID NO: 8078995 - DNA, 22 bp, Homo sapiens
agatcatattgtaactttattg

SEQ ID NO: 8078996 - DNA, 22 bp, Homo sapiens
agatcatatgaaaaatttcaag

SEQ ID NO: 8078997 - DNA, 22 bp, Homo sapiens
agatggccccaggtgcccaggg

SEQ ID NO: 8078998 - DNA, 22 bp, Homo sapiens
caaagattttagaatttgcaat

SEQ ID NO: 8078999 - DNA, 22 bp, Homo sapiens
caaagatatgacatggaaaatg

SEQ ID NO: 8079000 - DNA, 22 bp, Homo sapiens
caaagataatcacagaataccc

SEQ ID NO: 8079001 - DNA, 22 bp, Homo sapiens
caaagataatcacagaataccc

SEQ ID NO: 8079002 - DNA, 22 bp, Homo sapiens
caaaccagtaggaagtctatta

SEQ ID NO: 8079003 - DNA, 22 bp, Homo sapiens
attttaaccctcttatatatac

SEQ ID NO: 8079004 - DNA, 23 bp, Homo sapiens
attttagctgaatgacttcttta

SEQ ID NO: 8079005 - DNA, 22 bp, Homo sapiens
attttcagaacattcattcact

SEQ ID NO: 8079006 - DNA, 22 bp, Homo sapiens
attttcaccctgaatatattga

SEQ ID NO: 8079007 - DNA, 22 bp, Homo sapiens
agcaacacgcagtagtatacga

SEQ ID NO: 8079008 - DNA, 18 bp, Homo sapiens
agagtatacagacaacaa

SEQ ID NO: 8079009 - DNA, 22 bp, Homo sapiens
agagtgccactgacaggtccct

SEQ ID NO: 8079010 - DNA, 22 bp, Homo sapiens
agagtgcccaagcctggcaggg

SEQ ID NO: 8079011 - DNA, 22 bp, Homo sapiens
agagtgccctgctctgagctct

SEQ ID NO: 8079012 - DNA, 22 bp, Homo sapiens
agagtgcatgttttatctttgt

SEQ ID NO: 8079013 - DNA, 22 bp, Homo sapiens
agagtgcatgacatgatcttgg

SEQ ID NO: 8079014 - DNA, 22 bp, Homo sapiens
agagctgggaccgtctggaagt

SEQ ID NO: 8079015 - DNA, 21 bp, Homo sapiens
attacagcagtggccaaatgc

SEQ ID NO: 8079016 - DNA, 22 bp, Homo sapiens
attacacaggctggctctttga

SEQ ID NO: 8079017 - DNA, 22 bp, Homo sapiens
attacacagcggttactactag

SEQ ID NO: 8079018 - DNA, 22 bp, Homo sapiens
attacacagcggttactactag

SEQ ID NO: 8079019 - DNA, 22 bp, Homo sapiens
agaggccaccttctcttgagaa

SEQ ID NO: 8079020 - DNA, 22 bp, Homo sapiens
agaggccagaaggcgcaccccg

SEQ ID NO: 8079021 - DNA, 22 bp, Homo sapiens
agaggccagcccaggccaccga

SEQ ID NO: 8079022 - DNA, 22 bp, Homo sapiens
agaggccagctagcgggccatc

SEQ ID NO: 8079023 - DNA, 23 bp, Homo sapiens
acatacataagcaccacattttg

SEQ ID NO: 8079024 - DNA, 22 bp, Homo sapiens
acataacaatcataggacatag

SEQ ID NO: 8079025 - DNA, 22 bp, Homo sapiens
acataacaatcataggacatag

SEQ ID NO: 8079026 - DNA, 19 bp, Homo sapiens
aggcaaccaatgaggcaaa

SEQ ID NO: 8079027 - DNA, 22 bp, Homo sapiens
aggagacagccaggggcctgag

SEQ ID NO: 8079028 - DNA, 22 bp, Homo sapiens
agcttcagatttatctttctgt

SEQ ID NO: 8079029 - DNA, 22 bp, Homo sapiens
aggaaaaacctgttaatggtag

SEQ ID NO: 8079030 - DNA, 22 bp, Homo sapiens
agcttttacataatgatcttga

SEQ ID NO: 8079031 - DNA, 22 bp, Homo sapiens
agcttttattggctgtcatttg

SEQ ID NO: 8079032 - DNA, 22 bp, Homo sapiens
agcttcaggtggtcttgtttct

SEQ ID NO: 8079033 - DNA, 22 bp, Homo sapiens
agcttcagttttctattgttaa

SEQ ID NO: 8079034 - DNA, 22 bp, Homo sapiens
agctggccttagtgagcacctg

SEQ ID NO: 8079035 - DNA, 20 bp, Homo sapiens
agctggcctgtcctaggcct

SEQ ID NO: 8079036 - DNA, 22 bp, Homo sapiens
acagccccccgctcagtttcca

SEQ ID NO: 8079037 - DNA, 22 bp, Homo sapiens
agctgctggtttaagggatggg

SEQ ID NO: 8079038 - DNA, 22 bp, Homo sapiens
agctgctgggatacagtagtga

SEQ ID NO: 8079039 - DNA, 21 bp, Homo sapiens
agctgctgtggccagaatcca

SEQ ID NO: 8079040 - DNA, 22 bp, Homo sapiens
agctgctgtttcttgcacgtat

SEQ ID NO: 8079041 - DNA, 22 bp, Homo sapiens
agctgctcaggagagccaggtc

SEQ ID NO: 8079042 - DNA, 22 bp, Homo sapiens
agctgctcagatcccggggaag

SEQ ID NO: 8079043 - DNA, 22 bp, Homo sapiens
agctgctcattactttctgttg

SEQ ID NO: 8079044 - DNA, 22 bp, Homo sapiens
agctgcagcttcctagtccagc

SEQ ID NO: 8079045 - DNA, 22 bp, Homo sapiens
agctgcagccctcctgcatggc

SEQ ID NO: 8079046 - DNA, 22 bp, Homo sapiens
aggcccagggctgctctctgaa

SEQ ID NO: 8079047 - DNA, 22 bp, Homo sapiens
aggccagcctcaggcagggacc

SEQ ID NO: 8079048 - DNA, 18 bp, Homo sapiens
aggcatggtggtgcgcac

SEQ ID NO: 8079049 - DNA, 22 bp, Homo sapiens
acattcatgtcccacttctagc

SEQ ID NO: 8079050 - DNA, 22 bp, Homo sapiens
acattctaacattgtacagata

SEQ ID NO: 8079051 - DNA, 22 bp, Homo sapiens
acattcctgaggaaatacattc

SEQ ID NO: 8079052 - DNA, 22 bp, Homo sapiens
accaggaggcctggagcacaaa

SEQ ID NO: 8079053 - DNA, 22 bp, Homo sapiens
accaaggctaaaataacatgtt

SEQ ID NO: 8079054 - DNA, 22 bp, Homo sapiens
accaggagtagaatatctgtga

SEQ ID NO: 8079055 - DNA, 22 bp, Homo sapiens
accagtaagatcctgtacatac

SEQ ID NO: 8079056 - DNA, 21 bp, Homo sapiens
accagtccctagtcttatcct

SEQ ID NO: 8079057 - DNA, 22 bp, Homo sapiens
accagtggaattattctgtggt

SEQ ID NO: 8079058 - DNA, 22 bp, Homo sapiens
accagtggatactgcttgcttt

SEQ ID NO: 8079059 - DNA, 22 bp, Homo sapiens
accagtggatgaatgctggacc

SEQ ID NO: 8079060 - DNA, 22 bp, Homo sapiens
accagtgggaagtggaaaatga

SEQ ID NO: 8079061 - DNA, 22 bp, Homo sapiens
accagtgggtgtcattccctta

SEQ ID NO: 8079062 - DNA, 22 bp, Homo sapiens
accagttctttctctgtttctg

SEQ ID NO: 8079063 - DNA, 23 bp, Homo sapiens
acccatctctcctgtcatgcaga

SEQ ID NO: 8079064 - DNA, 22 bp, Homo sapiens
acccagggaccccgctgacgcc

SEQ ID NO: 8079065 - DNA, 22 bp, Homo sapiens
acccagggtagagtgcagtggc

SEQ ID NO: 8079066 - DNA, 22 bp, Homo sapiens
acccagagcagagcttggcttc

SEQ ID NO: 8079067 - DNA, 22 bp, Homo sapiens
acccagagatggacctggctgc

SEQ ID NO: 8079068 - DNA, 22 bp, Homo sapiens
acccagagaactgtgccttgag

SEQ ID NO: 8079069 - DNA, 22 bp, Homo sapiens
acccagggttcctgggtcccag

SEQ ID NO: 8079070 - DNA, 22 bp, Homo sapiens
acccagggtcaccccgtagggt

SEQ ID NO: 8079071 - DNA, 19 bp, Homo sapiens
acccagggttgatgtccag

SEQ ID NO: 8079072 - DNA, 22 bp, Homo sapiens
acccagtgttgggcagaactgt

SEQ ID NO: 8079073 - DNA, 18 bp, Homo sapiens
acccagtttgaaggaaag

SEQ ID NO: 8079074 - DNA, 22 bp, Homo sapiens
acccagtgacatcctttacctg

SEQ ID NO: 8079075 - DNA, 22 bp, Homo sapiens
acccagtgagcccgaccgatgg

SEQ ID NO: 8079076 - DNA, 22 bp, Homo sapiens
acccagggtttgagctctgcag

SEQ ID NO: 8079077 - DNA, 22 bp, Homo sapiens
acttttttataaggaagaagat

SEQ ID NO: 8079078 - DNA, 22 bp, Homo sapiens
actttttagtttcctcaaacat

SEQ ID NO: 8079079 - DNA, 22 bp, Homo sapiens
acttttgaagaattatgcaaaa

SEQ ID NO: 8079080 - DNA, 22 bp, Homo sapiens
actttttacagggtgtatacca

SEQ ID NO: 8079081 - DNA, 22 bp, Homo sapiens
atatttttccatgtgggactct

SEQ ID NO: 8079082 - DNA, 21 bp, Homo sapiens
atatttttgtttggactgtca

SEQ ID NO: 8079083 - DNA, 22 bp, Homo sapiens
agaaagcactctgtcttttacc

SEQ ID NO: 8079084 - DNA, 22 bp, Homo sapiens
agaaagcaccctgcactttctg

SEQ ID NO: 8079085 - DNA, 22 bp, Homo sapiens
agaaagcacagcgggtccattt

SEQ ID NO: 8079086 - DNA, 20 bp, Homo sapiens
atcaaaatcctattgaggtt

SEQ ID NO: 8079087 - DNA, 22 bp, Homo sapiens
agaaagcagcatttatgatctc

SEQ ID NO: 8079088 - DNA, 22 bp, Homo sapiens
agaaagcagcatttatgatctc

SEQ ID NO: 8079089 - DNA, 22 bp, Homo sapiens
agaaagcactctgtcttttacc

SEQ ID NO: 8079090 - DNA, 22 bp, Homo sapiens
agaaagcatctccattgtaggt

SEQ ID NO: 8079091 - DNA, 22 bp, Homo sapiens
agaaatcatgtcttatttctat

SEQ ID NO: 8079092 - DNA, 22 bp, Homo sapiens
agaaggcactcacactggcacg

SEQ ID NO: 8079093 - DNA, 22 bp, Homo sapiens
agaaggcagaaagtccaggtat

SEQ ID NO: 8079094 - DNA, 22 bp, Homo sapiens
agaagccaacagggcaggagag

SEQ ID NO: 8079095 - DNA, 22 bp, Homo sapiens
agaagccaattctgtgtgagtc

SEQ ID NO: 8079096 - DNA, 22 bp, Homo sapiens
agaagccaatcagctctctgct

SEQ ID NO: 8079097 - DNA, 22 bp, Homo sapiens
agaacatatctgttttctaact

SEQ ID NO: 8079098 - DNA, 22 bp, Homo sapiens
agttttatggctcaacctaata

SEQ ID NO: 8079099 - DNA, 22 bp, Homo sapiens
agttttatggctcaacctaata

SEQ ID NO: 8079100 - DNA, 22 bp, Homo sapiens
agttttatctgtaagctgttca

SEQ ID NO: 8079101 - DNA, 21 bp, Homo sapiens
agttttatattataagctaaa

SEQ ID NO: 8079102 - DNA, 22 bp, Homo sapiens
agtttctagcaaggattgttga

SEQ ID NO: 8079103 - DNA, 22 bp, Homo sapiens
actgtttaggaggcttatatgc

SEQ ID NO: 8079104 - DNA, 22 bp, Homo sapiens
actgtttagtaaattgaaatgg

SEQ ID NO: 8079105 - DNA, 22 bp, Homo sapiens
agttttatggctcaacctaata

SEQ ID NO: 8079106 - DNA, 22 bp, Homo sapiens
agttttatgtagacaattcatt

SEQ ID NO: 8079107 - DNA, 23 bp, Homo sapiens
agtttttaatggtcatagctgag

SEQ ID NO: 8079108 - DNA, 23 bp, Homo sapiens
agtttttaatggtcatagctgag

SEQ ID NO: 8079109 - DNA, 21 bp, Homo sapiens
agtttttactcttaactgtgg

SEQ ID NO: 8079110 - DNA, 18 bp, Homo sapiens
agtttttaggaagaaatg

SEQ ID NO: 8079111 - DNA, 22 bp, Homo sapiens
acttccttttcaaccatacagc

SEQ ID NO: 8079112 - DNA, 21 bp, Homo sapiens
ataaagttttacaggaatgca

SEQ ID NO: 8079113 - DNA, 22 bp, Homo sapiens
acttaaaaagaatcttttcacg

SEQ ID NO: 8079114 - DNA, 22 bp, Homo sapiens
acttaaaaacagatccagcagg

SEQ ID NO: 8079115 - DNA, 22 bp, Homo sapiens
acttaaaaacagatccagcagg

SEQ ID NO: 8079116 - DNA, 19 bp, Homo sapiens
acttaaacctagaaaatgc

SEQ ID NO: 8079117 - DNA, 22 bp, Homo sapiens
ataaagtcaaggcattttatga

SEQ ID NO: 8079118 - DNA, 22 bp, Homo sapiens
atacatcatgctccatatattt

SEQ ID NO: 8079119 - DNA, 22 bp, Homo sapiens
atacatcatttcccatcaatcg

SEQ ID NO: 8079120 - DNA, 22 bp, Homo sapiens
atagatacattgttatatttgt

SEQ ID NO: 8079121 - DNA, 22 bp, Homo sapiens
atagatacattaggtaacttgt

SEQ ID NO: 8079122 - DNA, 22 bp, Homo sapiens
atagatacttaactgaaatctt

SEQ ID NO: 8079123 - DNA, 22 bp, Homo sapiens
atagatatttgagttgtttcca

SEQ ID NO: 8079124 - DNA, 22 bp, Homo sapiens
atagatattagcaaaattttat

SEQ ID NO: 8079125 - DNA, 23 bp, Homo sapiens
acttttcaattagctatgcttaa

SEQ ID NO: 8079126 - DNA, 22 bp, Homo sapiens
acttttcaaatgggaaactcag

SEQ ID NO: 8079127 - DNA, 22 bp, Homo sapiens
atacaaaaattagccgggagta

SEQ ID NO: 8079128 - DNA, 22 bp, Homo sapiens
atacaaaatatatactggagac

SEQ ID NO: 8079129 - DNA, 22 bp, Homo sapiens
actttaaaactgatcatcagag

SEQ ID NO: 8079130 - DNA, 22 bp, Homo sapiens
actttaaagcagaatggctatg

SEQ ID NO: 8079131 - DNA, 22 bp, Homo sapiens
atacatcaatttcttagttatc

SEQ ID NO: 8079132 - DNA, 22 bp, Homo sapiens
atacatcacctatatattcaca

SEQ ID NO: 8079133 - DNA, 22 bp, Homo sapiens
accttttatgtaaatatatgtt

SEQ ID NO: 8079134 - DNA, 22 bp, Homo sapiens
acgatatctgtaatattttatt

SEQ ID NO: 8079135 - DNA, 22 bp, Homo sapiens
aggtgacaggacaggagctggt

SEQ ID NO: 8079136 - DNA, 22 bp, Homo sapiens
aggtgactggtttatctggcag

SEQ ID NO: 8079137 - DNA, 22 bp, Homo sapiens
actactttgggccatttgttta

SEQ ID NO: 8079138 - DNA, 22 bp, Homo sapiens
agtaccaagacataagattttt

SEQ ID NO: 8079139 - DNA, 23 bp, Homo sapiens
agtacattcgaaaaattctgtga

SEQ ID NO: 8079140 - DNA, 22 bp, Homo sapiens
agtatacagtaatgacatatct

SEQ ID NO: 8079141 - DNA, 22 bp, Homo sapiens
agtatacaaataaatgtgtaat

SEQ ID NO: 8079142 - DNA, 22 bp, Homo sapiens
agtagaaagttgcaggaggaat

SEQ ID NO: 8079143 - DNA, 22 bp, Homo sapiens
actgcccattatggtagtcact

SEQ ID NO: 8079144 - DNA, 22 bp, Homo sapiens
actgcccagaagagatgaaagt

SEQ ID NO: 8079145 - DNA, 20 bp, Homo sapiens
actgggcatacctgtcctgt

SEQ ID NO: 8079146 - DNA, 23 bp, Homo sapiens
agtgaagctggttagtgatgacc

SEQ ID NO: 8079147 - DNA, 22 bp, Homo sapiens
agtgaagctggagaaaggcagt

SEQ ID NO: 8079148 - DNA, 22 bp, Homo sapiens
agtgaagctaacctgctgattt

SEQ ID NO: 8079149 - DNA, 22 bp, Homo sapiens
agtgaagccccgatgcgttttg

SEQ ID NO: 8079150 - DNA, 22 bp, Homo sapiens
agtgaagcctgctgaaagtggc

SEQ ID NO: 8079151 - DNA, 22 bp, Homo sapiens
actgcacagatgaagctgtaaa

SEQ ID NO: 8079152 - DNA, 22 bp, Homo sapiens
actctgcaatgtggcaagaaca

SEQ ID NO: 8079153 - DNA, 22 bp, Homo sapiens
actctgaaatagaggctggtgg

SEQ ID NO: 8079154 - DNA, 22 bp, Homo sapiens
agtgaactctcagtaaataaat

SEQ ID NO: 8079155 - DNA, 22 bp, Homo sapiens
agtgtctttgtcaaattacagg

SEQ ID NO: 8079156 - DNA, 22 bp, Homo sapiens
agtggccatccctcaggtaggc

SEQ ID NO: 8079157 - DNA, 21 bp, Homo sapiens
ctctggagtttgaaggctggg

SEQ ID NO: 8079158 - DNA, 18 bp, Homo sapiens
agtgtttatttaggtgaa

SEQ ID NO: 8079159 - DNA, 22 bp, Homo sapiens
agtgtttattgtgtgccacaca

SEQ ID NO: 8079160 - DNA, 22 bp, Homo sapiens
agtgtttatggaatcttagtta

SEQ ID NO: 8079161 - DNA, 22 bp, Homo sapiens
agtgtttatggaatcttagtta

SEQ ID NO: 8079162 - DNA, 22 bp, Homo sapiens
agttccttacatgtactgttaa

SEQ ID NO: 8079163 - DNA, 22 bp, Homo sapiens
agtgccaggagcaaggagctcc

SEQ ID NO: 8079164 - DNA, 22 bp, Homo sapiens
agtgccagagacgtgcacttta

SEQ ID NO: 8079165 - DNA, 22 bp, Homo sapiens
agtgccagctccacacagcagc

SEQ ID NO: 8079166 - DNA, 22 bp, Homo sapiens
agtgcattgcatctctgcttca

SEQ ID NO: 8079167 - DNA, 19 bp, Homo sapiens
agtgcattttatgtttcaa

SEQ ID NO: 8079168 - DNA, 22 bp, Homo sapiens
agtgatttcatcattttatcaa

SEQ ID NO: 8079169 - DNA, 22 bp, Homo sapiens
agtggcagtggggcagggccct

SEQ ID NO: 8079170 - DNA, 22 bp, Homo sapiens
agtggcatccctttaacagggt

SEQ ID NO: 8079171 - DNA, 22 bp, Homo sapiens
agtggacccggaacagaggccc

SEQ ID NO: 8079172 - DNA, 21 bp, Homo sapiens
ctcacagtctgttttccttgc

SEQ ID NO: 8079173 - DNA, 22 bp, Homo sapiens
agtctattttgcttattctatg

SEQ ID NO: 8079174 - DNA, 22 bp, Homo sapiens
agtctatttcagtcttactagt

SEQ ID NO: 8079175 - DNA, 22 bp, Homo sapiens
agtctatttccccttctcttga

SEQ ID NO: 8079176 - DNA, 22 bp, Homo sapiens
agtctatttttggttcttcggg

SEQ ID NO: 8079177 - DNA, 22 bp, Homo sapiens
agtctttattcactattgataa

SEQ ID NO: 8079178 - DNA, 18 bp, Homo sapiens
agtctttatttctttcat

SEQ ID NO: 8079179 - DNA, 22 bp, Homo sapiens
agtcttttattcaaggctaagt

SEQ ID NO: 8079180 - DNA, 22 bp, Homo sapiens
agtgaaaacctaatcatgcagt

SEQ ID NO: 8079181 - DNA, 22 bp, Homo sapiens
agtgaaatagcatttatgaagc

SEQ ID NO: 8079182 - DNA, 22 bp, Homo sapiens
agtgatcagcttgaagtagttt

SEQ ID NO: 8079183 - DNA, 21 bp, Homo sapiens
cctgaggtttctggcctctgt

SEQ ID NO: 8079184 - DNA, 22 bp, Homo sapiens
aggtcacttggtgttattcagc

SEQ ID NO: 8079185 - DNA, 22 bp, Homo sapiens
aggtcagctgtgtgtgcatgag

SEQ ID NO: 8079186 - DNA, 22 bp, Homo sapiens
aggtcagctgctgataggcagc

SEQ ID NO: 8079187 - DNA, 22 bp, Homo sapiens
aggtcagacagggtgtctttct

SEQ ID NO: 8079188 - DNA, 22 bp, Homo sapiens
aggtcagccctctctgggcagg

SEQ ID NO: 8079189 - DNA, 22 bp, Homo sapiens
cctgggagggcaagtgctgatg

SEQ ID NO: 8079190 - DNA, 22 bp, Homo sapiens
cctgggaggctgtgggtctgct

SEQ ID NO: 8079191 - DNA, 22 bp, Homo sapiens
cctgggaggtggaggttgcagt

SEQ ID NO: 8079192 - DNA, 22 bp, Homo sapiens
cctgggaggtggaggttgcagc

SEQ ID NO: 8079193 - DNA, 22 bp, Homo sapiens
cctgggaggctgaggctgcagt

SEQ ID NO: 8079194 - DNA, 22 bp, Homo sapiens
cctgtttatctatctagagatg

SEQ ID NO: 8079195 - DNA, 22 bp, Homo sapiens
cctgtttattgtgaagaaccca

SEQ ID NO: 8079196 - DNA, 22 bp, Homo sapiens
cctgtttacatcatcaaggact

SEQ ID NO: 8079197 - DNA, 22 bp, Homo sapiens
cctgtttagtgaggtgaggagt

SEQ ID NO: 8079198 - DNA, 22 bp, Homo sapiens
ccttccagagttcagtctgccc

SEQ ID NO: 8079199 - DNA, 22 bp, Homo sapiens
cctgggggccaggaaggtgtga

SEQ ID NO: 8079200 - DNA, 20 bp, Homo sapiens
aggtcctggttctctgggat

SEQ ID NO: 8079201 - DNA, 22 bp, Homo sapiens
aggtcctgatgatctctgagag

SEQ ID NO: 8079202 - DNA, 20 bp, Homo sapiens
aggtcctgggactggcagag

SEQ ID NO: 8079203 - DNA, 22 bp, Homo sapiens
aggtcctgggagttctagtgtg

SEQ ID NO: 8079204 - DNA, 21 bp, Homo sapiens
aggtgcagaggcctcactcac

SEQ ID NO: 8079205 - DNA, 22 bp, Homo sapiens
aggtgcagctggtggagtctgg

SEQ ID NO: 8079206 - DNA, 22 bp, Homo sapiens
ccttccaggagtctctgcaggt

SEQ ID NO: 8079207 - DNA, 20 bp, Homo sapiens
ccttctccagcttgttcttg

SEQ ID NO: 8079208 - DNA, 22 bp, Homo sapiens
agtaaacagtaggaactgagaa

SEQ ID NO: 8079209 - DNA, 22 bp, Homo sapiens
ccttctctactcctgatgcatg

SEQ ID NO: 8079210 - DNA, 22 bp, Homo sapiens
agtaaagcagagttgcagtaca

SEQ ID NO: 8079211 - DNA, 22 bp, Homo sapiens
agtaaagcagagttgcagtaca

SEQ ID NO: 8079212 - DNA, 22 bp, Homo sapiens
agtaaataacagagaaaatggg

SEQ ID NO: 8079213 - DNA, 22 bp, Homo sapiens
agtaaataacagagaaaatggg

SEQ ID NO: 8079214 - DNA, 22 bp, Homo sapiens
agtaaagtaccaaagtgtgagt

SEQ ID NO: 8079215 - DNA, 22 bp, Homo sapiens
agtagccattcttttatttctt

SEQ ID NO: 8079216 - DNA, 22 bp, Homo sapiens
agtaacaagtgccaacgttaga

SEQ ID NO: 8079217 - DNA, 22 bp, Homo sapiens
agtaacaaatagctgcctttaa

SEQ ID NO: 8079218 - DNA, 22 bp, Homo sapiens
agtaacaaatgcatctgggcat

SEQ ID NO: 8079219 - DNA, 22 bp, Homo sapiens
agtacatacttcaaatgtactt

SEQ ID NO: 8079220 - DNA, 22 bp, Homo sapiens
ctattctagattacagtataaa

SEQ ID NO: 8079221 - DNA, 22 bp, Homo sapiens
ctatatttcttggctttaaaca

SEQ ID NO: 8079222 - DNA, 22 bp, Homo sapiens
ctatcaaacagccattaatata

SEQ ID NO: 8079223 - DNA, 22 bp, Homo sapiens
ctatatcataaatctgaagagg

SEQ ID NO: 8079224 - DNA, 22 bp, Homo sapiens
ctatatcatcattacctgcacc

SEQ ID NO: 8079225 - DNA, 22 bp, Homo sapiens
ctaggaaagacacagagagttt

SEQ ID NO: 8079226 - DNA, 22 bp, Homo sapiens
ctaggaaatgaatacagtacac

SEQ ID NO: 8079227 - DNA, 23 bp, Homo sapiens
atataaacaccagatagattgta

SEQ ID NO: 8079228 - DNA, 22 bp, Homo sapiens
atataaagaagtggaaaatgag

SEQ ID NO: 8079229 - DNA, 22 bp, Homo sapiens
atataaagagcttagtatagtg

SEQ ID NO: 8079230 - DNA, 22 bp, Homo sapiens
atataaagtgtttagaaagctg

SEQ ID NO: 8079231 - DNA, 22 bp, Homo sapiens
atataaagagcttagtatagtg

SEQ ID NO: 8079232 - DNA, 22 bp, Homo sapiens
ctggctctttcctagctaggct

SEQ ID NO: 8079233 - DNA, 22 bp, Homo sapiens
ctggcctgtgggctgtctccgg

SEQ ID NO: 8079234 - DNA, 19 bp, Homo sapiens
ctggcctgtgtcctgtgct

SEQ ID NO: 8079235 - DNA, 22 bp, Homo sapiens
ctggcctcggcagcaggaacag

SEQ ID NO: 8079236 - DNA, 22 bp, Homo sapiens
ctggcctctctgagcagggagc

SEQ ID NO: 8079237 - DNA, 22 bp, Homo sapiens
atatacagggagaaacagctta

SEQ ID NO: 8079238 - DNA, 22 bp, Homo sapiens
atatacaggtggtatgtgtaaa

SEQ ID NO: 8079239 - DNA, 22 bp, Homo sapiens
atatacagggagaaacagctta

SEQ ID NO: 8079240 - DNA, 22 bp, Homo sapiens
atatacaggtggtatgtgtaaa

SEQ ID NO: 8079241 - DNA, 22 bp, Homo sapiens
atatacttggagactatcattg

SEQ ID NO: 8079242 - DNA, 22 bp, Homo sapiens
ctgggagctggatgccctgccc

SEQ ID NO: 8079243 - DNA, 20 bp, Homo sapiens
atataccatcccacaacagg

SEQ ID NO: 8079244 - DNA, 20 bp, Homo sapiens
atacacatgcagacagatgc

SEQ ID NO: 8079245 - DNA, 22 bp, Homo sapiens
ctggcacacagcaggctctcag

SEQ ID NO: 8079246 - DNA, 22 bp, Homo sapiens
atacatgtgggtctaaacatat

SEQ ID NO: 8079247 - DNA, 22 bp, Homo sapiens
atacatgatcactgtattataa

SEQ ID NO: 8079248 - DNA, 22 bp, Homo sapiens
ctggcctcagagggtcatggtg

SEQ ID NO: 8079249 - DNA, 22 bp, Homo sapiens
ataaagctatttttaattctgt

SEQ ID NO: 8079250 - DNA, 22 bp, Homo sapiens
ctgctgggcagaggctgcatga

SEQ ID NO: 8079251 - DNA, 19 bp, Homo sapiens
atacacatacgtaaactga

SEQ ID NO: 8079252 - DNA, 19 bp, Homo sapiens
atacacatacgtaaactga

SEQ ID NO: 8079253 - DNA, 22 bp, Homo sapiens
ataaagcaaataggactattgc

SEQ ID NO: 8079254 - DNA, 22 bp, Homo sapiens
ataaagcatactttgtatgact

SEQ ID NO: 8079255 - DNA, 22 bp, Homo sapiens
ataaagcatctagtctgtcact

SEQ ID NO: 8079256 - DNA, 22 bp, Homo sapiens
ataaagcatgcttgtttggaga

SEQ ID NO: 8079257 - DNA, 22 bp, Homo sapiens
ataaagctaagacttacatgaa

SEQ ID NO: 8079258 - DNA, 22 bp, Homo sapiens
ataaagctaagacttacatgaa

SEQ ID NO: 8079259 - DNA, 22 bp, Homo sapiens
ataaagaggatgtatttacagc

SEQ ID NO: 8079260 - DNA, 22 bp, Homo sapiens
ataaactcatgccaagaaatga

SEQ ID NO: 8079261 - DNA, 22 bp, Homo sapiens
ataaaccagaagtaaaagctac

SEQ ID NO: 8079262 - DNA, 22 bp, Homo sapiens
ataaactgaagggaacactgag

SEQ ID NO: 8079263 - DNA, 22 bp, Homo sapiens
ctgcagggagaggggacagcct

SEQ ID NO: 8079264 - DNA, 22 bp, Homo sapiens
ctgcagggaactgaggcccaga

SEQ ID NO: 8079265 - DNA, 22 bp, Homo sapiens
ctgcagggaccacaagcaggtt

SEQ ID NO: 8079266 - DNA, 22 bp, Homo sapiens
ctgcagggacccaagtctttgg

SEQ ID NO: 8079267 - DNA, 22 bp, Homo sapiens
ataaaacttattagaattgtgt

SEQ ID NO: 8079268 - DNA, 22 bp, Homo sapiens
ataaaaatgagggcggtagcta

SEQ ID NO: 8079269 - DNA, 22 bp, Homo sapiens
ataaaaccaaagcagcagtgtt

SEQ ID NO: 8079270 - DNA, 22 bp, Homo sapiens
ataaaaaggacagatgtggtct

SEQ ID NO: 8079271 - DNA, 22 bp, Homo sapiens
agttttgtaattctcaaaaata

SEQ ID NO: 8079272 - DNA, 22 bp, Homo sapiens
atcagcatctttaacaattacc

SEQ ID NO: 8079273 - DNA, 22 bp, Homo sapiens
atcagcattcccaaatgatgtg

SEQ ID NO: 8079274 - DNA, 21 bp, Homo sapiens
atcagcatcacgtcagtgtcc

SEQ ID NO: 8079275 - DNA, 22 bp, Homo sapiens
ctgtaacagatatcatttagca

SEQ ID NO: 8079276 - DNA, 22 bp, Homo sapiens
ctgtaacagatatcatttagca

SEQ ID NO: 8079277 - DNA, 22 bp, Homo sapiens
atcacaatcttcaaatcgattc

SEQ ID NO: 8079278 - DNA, 22 bp, Homo sapiens
atcacaaaggtctcagagcaca

SEQ ID NO: 8079279 - DNA, 20 bp, Homo sapiens
ctgtaaactgcgtctgtaat

SEQ ID NO: 8079280 - DNA, 22 bp, Homo sapiens
atcataaagtgctatctgattg

SEQ ID NO: 8079281 - DNA, 22 bp, Homo sapiens
atcagtttttattaatgtagct

SEQ ID NO: 8079282 - DNA, 22 bp, Homo sapiens
atcagtttctgtgaagaacaca

SEQ ID NO: 8079283 - DNA, 22 bp, Homo sapiens
atcagtttaactgtcaagagcc

SEQ ID NO: 8079284 - DNA, 22 bp, Homo sapiens
ctgggaggtggaggttgcattg

SEQ ID NO: 8079285 - DNA, 22 bp, Homo sapiens
ctgggggcaagcagacagctgt

SEQ ID NO: 8079286 - DNA, 22 bp, Homo sapiens
ctgggggcaatggtcagagtgt

SEQ ID NO: 8079287 - DNA, 22 bp, Homo sapiens
ctggtccagtggatgctgaggg

SEQ ID NO: 8079288 - DNA, 22 bp, Homo sapiens
ctggtcaggctgaactgccaca

SEQ ID NO: 8079289 - DNA, 18 bp, Homo sapiens
atattcaagaagacagag

SEQ ID NO: 8079290 - DNA, 22 bp, Homo sapiens
atattattttccctggagttgt

SEQ ID NO: 8079291 - DNA, 22 bp, Homo sapiens
atattcaaattacatttactaa

SEQ ID NO: 8079292 - DNA, 22 bp, Homo sapiens
atattcaaattacatttactaa

SEQ ID NO: 8079293 - DNA, 22 bp, Homo sapiens
atctccttggatcacgtttagt

SEQ ID NO: 8079294 - DNA, 22 bp, Homo sapiens
cttctgattagcaagtttgtat

SEQ ID NO: 8079295 - DNA, 22 bp, Homo sapiens
cttctgttactgttagctgaag

SEQ ID NO: 8079296 - DNA, 22 bp, Homo sapiens
cttcttaaattggattgctatt

SEQ ID NO: 8079297 - DNA, 22 bp, Homo sapiens
cttcttaatcccttatatattt

SEQ ID NO: 8079298 - DNA, 22 bp, Homo sapiens
cttcttaatgacagattaaaat

SEQ ID NO: 8079299 - DNA, 22 bp, Homo sapiens
atctgtgagtatttttgtttat

SEQ ID NO: 8079300 - DNA, 22 bp, Homo sapiens
atctgttatgaaatttggttgt

SEQ ID NO: 8079301 - DNA, 22 bp, Homo sapiens
cttaataataggtgaggctatg

SEQ ID NO: 8079302 - DNA, 22 bp, Homo sapiens
atccattctatgtgaaatgtcc

SEQ ID NO: 8079303 - DNA, 22 bp, Homo sapiens
cttagatgaagtcacagaaccc

SEQ ID NO: 8079304 - DNA, 22 bp, Homo sapiens
cttagcaagcattcaagtgcct

SEQ ID NO: 8079305 - DNA, 22 bp, Homo sapiens
cttagcaagaatcagctgctgg

SEQ ID NO: 8079306 - DNA, 22 bp, Homo sapiens
cttattatggcatgtaagtggg

SEQ ID NO: 8079307 - DNA, 22 bp, Homo sapiens
cttattataaaatcctgtttga

SEQ ID NO: 8079308 - DNA, 22 bp, Homo sapiens
agctttcagttactaatgaagg

SEQ ID NO: 8079309 - DNA, 22 bp, Homo sapiens
agcttctggaaggcaaggcttg

SEQ ID NO: 8079310 - DNA, 22 bp, Homo sapiens
aggaaaatggaccagagttgtt

SEQ ID NO: 8079311 - DNA, 22 bp, Homo sapiens
cagggacattggtggccaggtt

SEQ ID NO: 8079312 - DNA, 22 bp, Homo sapiens
cagggactgagatccagactgt

SEQ ID NO: 8079313 - DNA, 22 bp, Homo sapiens
cagggactacagccagccctcc

SEQ ID NO: 8079314 - DNA, 22 bp, Homo sapiens
agctttctcttctttagaaagt

SEQ ID NO: 8079315 - DNA, 22 bp, Homo sapiens
agctgccgatgcccagctgcat

SEQ ID NO: 8079316 - DNA, 22 bp, Homo sapiens
agctgccagatgacagtgctat

SEQ ID NO: 8079317 - DNA, 22 bp, Homo sapiens
caggaaatatctcaacacttta

SEQ ID NO: 8079318 - DNA, 22 bp, Homo sapiens
caggaaatgctatcatagctga

SEQ ID NO: 8079319 - DNA, 21 bp, Homo sapiens
agctgggcctcagcctgcagt

SEQ ID NO: 8079320 - DNA, 22 bp, Homo sapiens
caggcagagtcagattagactt

SEQ ID NO: 8079321 - DNA, 20 bp, Homo sapiens
caggcagaggatgctgacca

SEQ ID NO: 8079322 - DNA, 22 bp, Homo sapiens
agctggtctgctgcatggagtg

SEQ ID NO: 8079323 - DNA, 22 bp, Homo sapiens
agctggtcctaattgagccatt

SEQ ID NO: 8079324 - DNA, 22 bp, Homo sapiens
aggaattactcatctgtggtat

SEQ ID NO: 8079325 - DNA, 22 bp, Homo sapiens
cagtgagggcattcagtgctgg

SEQ ID NO: 8079326 - DNA, 22 bp, Homo sapiens
cagtgagggaagatctcagcac

SEQ ID NO: 8079327 - DNA, 17 bp, Homo sapiens
cagtgaggcctttcctc

SEQ ID NO: 8079328 - DNA, 22 bp, Homo sapiens
cagttcaggtgcattagtaatc

SEQ ID NO: 8079329 - DNA, 22 bp, Homo sapiens
cagttccatcttcatctttccc

SEQ ID NO: 8079330 - DNA, 19 bp, Homo sapiens
cagttccagcttcttgacc

SEQ ID NO: 8079331 - DNA, 22 bp, Homo sapiens
cagttcatccccatgttttcaa

SEQ ID NO: 8079332 - DNA, 22 bp, Homo sapiens
cagttcatagtcttcatgtctc

SEQ ID NO: 8079333 - DNA, 22 bp, Homo sapiens
cagttcaagagaaatactactg

SEQ ID NO: 8079334 - DNA, 22 bp, Homo sapiens
cagttcacactgtgctatctgc

SEQ ID NO: 8079335 - DNA, 22 bp, Homo sapiens
cagttattatcttagagagaca

SEQ ID NO: 8079336 - DNA, 22 bp, Homo sapiens
cagttcctcaaaggttaaatgt

SEQ ID NO: 8079337 - DNA, 19 bp, Homo sapiens
catatttttgggctggcat

SEQ ID NO: 8079338 - DNA, 22 bp, Homo sapiens
ccaaactgtttcgtatttatgc

SEQ ID NO: 8079339 - DNA, 22 bp, Homo sapiens
ccaaactgggccagtcagctgt

SEQ ID NO: 8079340 - DNA, 22 bp, Homo sapiens
ccaaaataacagcccaattcac

SEQ ID NO: 8079341 - DNA, 22 bp, Homo sapiens
ccagggctccattgctcatcct

SEQ ID NO: 8079342 - DNA, 19 bp, Homo sapiens
ccagggctccaagctgagt

SEQ ID NO: 8079343 - DNA, 22 bp, Homo sapiens
ccattttattagtgacatttag

SEQ ID NO: 8079344 - DNA, 22 bp, Homo sapiens
aggctggcgacatctggcgggc

SEQ ID NO: 8079345 - DNA, 22 bp, Homo sapiens
aggctggccctactggctgcct

SEQ ID NO: 8079346 - DNA, 22 bp, Homo sapiens
aggctgcttccttacgtggctg

SEQ ID NO: 8079347 - DNA, 22 bp, Homo sapiens
aggctgctcagtagatggagct

SEQ ID NO: 8079348 - DNA, 22 bp, Homo sapiens
ccagaagaaaaagctggtatta

SEQ ID NO: 8079349 - DNA, 22 bp, Homo sapiens
ccagaaagttcagctgtgaatg

SEQ ID NO: 8079350 - DNA, 22 bp, Homo sapiens
ccagaaagataggaaatcaagt

SEQ ID NO: 8079351 - DNA, 22 bp, Homo sapiens
ccagaaagactttttaggtacg

SEQ ID NO: 8079352 - DNA, 22 bp, Homo sapiens
aggccactcagggggccaagat

SEQ ID NO: 8079353 - DNA, 22 bp, Homo sapiens
aggcctggcctgggcggcattg

SEQ ID NO: 8079354 - DNA, 22 bp, Homo sapiens
aggcctggcctttatgttcaag

SEQ ID NO: 8079355 - DNA, 22 bp, Homo sapiens
aggcctggcatgagacctgaga

SEQ ID NO: 8079356 - DNA, 18 bp, Homo sapiens
aggcctgggaagctgagg

SEQ ID NO: 8079357 - DNA, 22 bp, Homo sapiens
aggcctgggacgggagccgtga

SEQ ID NO: 8079358 - DNA, 22 bp, Homo sapiens
ccagctcttttggctgagtgag

SEQ ID NO: 8079359 - DNA, 22 bp, Homo sapiens
agggctgctttgctaaatatgg

SEQ ID NO: 8079360 - DNA, 22 bp, Homo sapiens
agggctgcttacctggaatggc

SEQ ID NO: 8079361 - DNA, 22 bp, Homo sapiens
agggctgctgaggaagccttgc

SEQ ID NO: 8079362 - DNA, 22 bp, Homo sapiens
agggctgccatttctggcccaa

SEQ ID NO: 8079363 - DNA, 22 bp, Homo sapiens
agggctgctgctccgggcccag

SEQ ID NO: 8079364 - DNA, 22 bp, Homo sapiens
agggctgcatctgcctggtgaa

SEQ ID NO: 8079365 - DNA, 22 bp, Homo sapiens
cccaggcttttctcttgcccca

SEQ ID NO: 8079366 - DNA, 22 bp, Homo sapiens
cccagttttctgattgaagagc

SEQ ID NO: 8079367 - DNA, 22 bp, Homo sapiens
cccaggaggtcaaggctgcagt

SEQ ID NO: 8079368 - DNA, 23 bp, Homo sapiens
cccaggctacaaattatgctctg

SEQ ID NO: 8079369 - DNA, 22 bp, Homo sapiens
cccaggagcttctctctgcctc

SEQ ID NO: 8079370 - DNA, 22 bp, Homo sapiens
ccccagagtgagggattgagtg

SEQ ID NO: 8079371 - DNA, 18 bp, Homo sapiens
cccatgttgccagtcagc

SEQ ID NO: 8079372 - DNA, 17 bp, Homo sapiens
cccatgagcccactccc

SEQ ID NO: 8079373 - DNA, 22 bp, Homo sapiens
cccatgattcaattgtctccat

SEQ ID NO: 8079374 - DNA, 22 bp, Homo sapiens
gccaccttccaaaataatcaca

SEQ ID NO: 8079375 - DNA, 22 bp, Homo sapiens
attgtttctgctttatttaggg

SEQ ID NO: 8079376 - DNA, 22 bp, Homo sapiens
attgtttacactaacttcataa

SEQ ID NO: 8079377 - DNA, 22 bp, Homo sapiens
attgtttccccggaattattca

SEQ ID NO: 8079378 - DNA, 22 bp, Homo sapiens
gcagtgccgaccatccttccca

SEQ ID NO: 8079379 - DNA, 22 bp, Homo sapiens
attgttaatgttgcactaaggt

SEQ ID NO: 8079380 - DNA, 22 bp, Homo sapiens
gcaggtggatattgctacttga

SEQ ID NO: 8079381 - DNA, 22 bp, Homo sapiens
gcagggtgaaggtcacatagaa

SEQ ID NO: 8079382 - DNA, 22 bp, Homo sapiens
attgtaaagtactgtgtacaat

SEQ ID NO: 8079383 - DNA, 22 bp, Homo sapiens
attgtaaaagtattctaagatt

SEQ ID NO: 8079384 - DNA, 22 bp, Homo sapiens
gcagggtaggtgacaggtagtc

SEQ ID NO: 8079385 - DNA, 22 bp, Homo sapiens
gcagggtacattgggatgggat

SEQ ID NO: 8079386 - DNA, 22 bp, Homo sapiens
gcagggtccatggaggcagccc

SEQ ID NO: 8079387 - DNA, 22 bp, Homo sapiens
gcagggtataatacttaggtga

SEQ ID NO: 8079388 - DNA, 22 bp, Homo sapiens
gcagggtcttgagaggcagcca

SEQ ID NO: 8079389 - DNA, 22 bp, Homo sapiens
gcagggaggtttgctgacctgg

SEQ ID NO: 8079390 - DNA, 22 bp, Homo sapiens
gcagggatgctgaggctcagtg

SEQ ID NO: 8079391 - DNA, 22 bp, Homo sapiens
gcagggattgtgcagggggcta

SEQ ID NO: 8079392 - DNA, 22 bp, Homo sapiens
gcagggattgtcaatgctgctc

SEQ ID NO: 8079393 - DNA, 22 bp, Homo sapiens
gcaggggtagtgtcttcctgag

SEQ ID NO: 8079394 - DNA, 22 bp, Homo sapiens
gcagggaggaagagatgcttcc

SEQ ID NO: 8079395 - DNA, 22 bp, Homo sapiens
gcagggagggcctttcatgaca

SEQ ID NO: 8079396 - DNA, 22 bp, Homo sapiens
gcacaggctgttggccttcaga

SEQ ID NO: 8079397 - DNA, 22 bp, Homo sapiens
gcactggggtcatagcctccag

SEQ ID NO: 8079398 - DNA, 22 bp, Homo sapiens
gcaaaaattccagggacgactc

SEQ ID NO: 8079399 - DNA, 20 bp, Homo sapiens
gcaaaataggctctgttggt

SEQ ID NO: 8079400 - DNA, 22 bp, Homo sapiens
gcagaggctgtagggaaggttg

SEQ ID NO: 8079401 - DNA, 22 bp, Homo sapiens
gcagaatagggcataactttgc

SEQ ID NO: 8079402 - DNA, 22 bp, Homo sapiens
gcagaatactgagagctgattg

SEQ ID NO: 8079403 - DNA, 22 bp, Homo sapiens
gcagaatacattttgttttcct

SEQ ID NO: 8079404 - DNA, 22 bp, Homo sapiens
gcaggagagtctgtgccaggtt

SEQ ID NO: 8079405 - DNA, 22 bp, Homo sapiens
attttactaagtggatatctgt

SEQ ID NO: 8079406 - DNA, 22 bp, Homo sapiens
attttacataaggaaggtttaa

SEQ ID NO: 8079407 - DNA, 23 bp, Homo sapiens
attttacaggtcagttccttgaa

SEQ ID NO: 8079408 - DNA, 23 bp, Homo sapiens
attttacaggtcagttccttgaa

SEQ ID NO: 8079409 - DNA, 22 bp, Homo sapiens
attttgaagggaattgaagttc

SEQ ID NO: 8079410 - DNA, 22 bp, Homo sapiens
gcctggctcacagagcagcctt

SEQ ID NO: 8079411 - DNA, 22 bp, Homo sapiens
gcctggctccctctgcagctcc

SEQ ID NO: 8079412 - DNA, 22 bp, Homo sapiens
attttgaaaagcatttgagtaa

SEQ ID NO: 8079413 - DNA, 22 bp, Homo sapiens
attttgaaaagcatttgagtaa

SEQ ID NO: 8079414 - DNA, 22 bp, Homo sapiens
atttgccttggtgatttgtaaa

SEQ ID NO: 8079415 - DNA, 22 bp, Homo sapiens
atttgcctttcgaatcaacagg

SEQ ID NO: 8079416 - DNA, 22 bp, Homo sapiens
atttgccttgtgatttgtaagt

SEQ ID NO: 8079417 - DNA, 23 bp, Homo sapiens
attttaaccttgactaacatgca

SEQ ID NO: 8079418 - DNA, 22 bp, Homo sapiens
attttaataagattcccaagta

SEQ ID NO: 8079419 - DNA, 22 bp, Homo sapiens
attttaataagatccatttggt

SEQ ID NO: 8079420 - DNA, 22 bp, Homo sapiens
attttaaggcttatttaaaggc

SEQ ID NO: 8079421 - DNA, 18 bp, Homo sapiens
gccagagggcccaaggtc

SEQ ID NO: 8079422 - DNA, 18 bp, Homo sapiens
gccagagggaagcaggtg

SEQ ID NO: 8079423 - DNA, 22 bp, Homo sapiens
gccagagggattcctggtgtgt

SEQ ID NO: 8079424 - DNA, 22 bp, Homo sapiens
gctctgaagggtgagctgttcg

SEQ ID NO: 8079425 - DNA, 22 bp, Homo sapiens
gctctgaacttccaccttttca

SEQ ID NO: 8079426 - DNA, 22 bp, Homo sapiens
caaattaccctcaacatctaga

SEQ ID NO: 8079427 - DNA, 22 bp, Homo sapiens
caaatgaagtccaaagggctta

SEQ ID NO: 8079428 - DNA, 22 bp, Homo sapiens
gctatttttgagccatttataa

SEQ ID NO: 8079429 - DNA, 22 bp, Homo sapiens
gcctggctcctaagagcacaac

SEQ ID NO: 8079430 - DNA, 22 bp, Homo sapiens
gcctggctcctaaggactggct

SEQ ID NO: 8079431 - DNA, 21 bp, Homo sapiens
gcctggctctcactggcctgg

SEQ ID NO: 8079432 - DNA, 22 bp, Homo sapiens
gcctggctctgagggagctcct

SEQ ID NO: 8079433 - DNA, 22 bp, Homo sapiens
gctcctggatgttcaagtcggc

SEQ ID NO: 8079434 - DNA, 22 bp, Homo sapiens
gctctgaaaaatggaggttggc

SEQ ID NO: 8079435 - DNA, 22 bp, Homo sapiens
gagttatagatggactattatt

SEQ ID NO: 8079436 - DNA, 22 bp, Homo sapiens
gagttattgagtatagaatgta

SEQ ID NO: 8079437 - DNA, 23 bp, Homo sapiens
gagtgcagaatagacatgcagtg

SEQ ID NO: 8079438 - DNA, 22 bp, Homo sapiens
atgtttcaagagaaaaagagac

SEQ ID NO: 8079439 - DNA, 22 bp, Homo sapiens
atgtttcaccagcaaattacct

SEQ ID NO: 8079440 - DNA, 22 bp, Homo sapiens
atgtttcaccagttttataaga

SEQ ID NO: 8079441 - DNA, 22 bp, Homo sapiens
atgtttattgttttaagctgct

SEQ ID NO: 8079442 - DNA, 21 bp, Homo sapiens
gagtgcaggtctgatgccatc

SEQ ID NO: 8079443 - DNA, 22 bp, Homo sapiens
atgtttaattatctgggttttg

SEQ ID NO: 8079444 - DNA, 22 bp, Homo sapiens
atgtttcatcagtaaggttttg

SEQ ID NO: 8079445 - DNA, 22 bp, Homo sapiens
atgtttcaggcgaactaacatg

SEQ ID NO: 8079446 - DNA, 22 bp, Homo sapiens
atgtttcaggcgaactaacatg

SEQ ID NO: 8079447 - DNA, 22 bp, Homo sapiens
gagggcagaaaattatgcggtg

SEQ ID NO: 8079448 - DNA, 22 bp, Homo sapiens
gaggtacatgaggatacacagg

SEQ ID NO: 8079449 - DNA, 22 bp, Homo sapiens
gaggccacagtcctgaggcatc

SEQ ID NO: 8079450 - DNA, 22 bp, Homo sapiens
gaggccacagctatcagggaca

SEQ ID NO: 8079451 - DNA, 22 bp, Homo sapiens
atgtacaaaatgccactgaatt

SEQ ID NO: 8079452 - DNA, 22 bp, Homo sapiens
atgtaactgaaggaaatgcatg

SEQ ID NO: 8079453 - DNA, 22 bp, Homo sapiens
atgtaacaggtgaagctctgag

SEQ ID NO: 8079454 - DNA, 22 bp, Homo sapiens
atgtaacacccacttttatagc

SEQ ID NO: 8079455 - DNA, 22 bp, Homo sapiens
atgtaacaggcacgggtggata

SEQ ID NO: 8079456 - DNA, 22 bp, Homo sapiens
atgtcacagtgttgctggaagt

SEQ ID NO: 8079457 - DNA, 22 bp, Homo sapiens
atgtatttgaaatttgagacat

SEQ ID NO: 8079458 - DNA, 22 bp, Homo sapiens
atgtacaacctgcatgacagtc

SEQ ID NO: 8079459 - DNA, 22 bp, Homo sapiens
gagcctgggactgggggtcatg

SEQ ID NO: 8079460 - DNA, 17 bp, Homo sapiens
gagcagggatgcggttc

SEQ ID NO: 8079461 - DNA, 22 bp, Homo sapiens
gagaggctgactggctgtcctg

SEQ ID NO: 8079462 - DNA, 22 bp, Homo sapiens
atgctttctcttagttcattga

SEQ ID NO: 8079463 - DNA, 22 bp, Homo sapiens
gactttcttgcagaaatattcc

SEQ ID NO: 8079464 - DNA, 21 bp, Homo sapiens
gactttcttaccagatttttg

SEQ ID NO: 8079465 - DNA, 22 bp, Homo sapiens
gaagcagagcctaaggcagaca

SEQ ID NO: 8079466 - DNA, 22 bp, Homo sapiens
atgccccagtgtgtgcttcctt

SEQ ID NO: 8079467 - DNA, 22 bp, Homo sapiens
atgcaaatgctagagaatgttg

SEQ ID NO: 8079468 - DNA, 19 bp, Homo sapiens
gaacaatttgttagctctc

SEQ ID NO: 8079469 - DNA, 22 bp, Homo sapiens
gaaaactattggcctagaacaa

SEQ ID NO: 8079470 - DNA, 22 bp, Homo sapiens
gaaaactaacggaaaagttagg

SEQ ID NO: 8079471 - DNA, 22 bp, Homo sapiens
gaaaataggctgcatctccttc

SEQ ID NO: 8079472 - DNA, 22 bp, Homo sapiens
atgaatgatgccagttgaaatg

SEQ ID NO: 8079473 - DNA, 22 bp, Homo sapiens
atgaagcagcgttgtagagtga

SEQ ID NO: 8079474 - DNA, 22 bp, Homo sapiens
atgaagcaggcacagcttcagg

SEQ ID NO: 8079475 - DNA, 22 bp, Homo sapiens
gtaagagcactgtctcctgctg

SEQ ID NO: 8079476 - DNA, 22 bp, Homo sapiens
ggtgcagagtccacagaaagct

SEQ ID NO: 8079477 - DNA, 22 bp, Homo sapiens
cagatacattaaaatgatgatt

SEQ ID NO: 8079478 - DNA, 22 bp, Homo sapiens
cagatactgtaaaatttcagta

SEQ ID NO: 8079479 - DNA, 22 bp, Homo sapiens
cagatatattcatttgcagtgc

SEQ ID NO: 8079480 - DNA, 22 bp, Homo sapiens
cagatataaatggatgtggtag

SEQ ID NO: 8079481 - DNA, 22 bp, Homo sapiens
cagatacaggtttttgttagat

SEQ ID NO: 8079482 - DNA, 22 bp, Homo sapiens
cagaggctgctctgggtggcat

SEQ ID NO: 8079483 - DNA, 22 bp, Homo sapiens
ggggtctgggttgctcggcctt

SEQ ID NO: 8079484 - DNA, 22 bp, Homo sapiens
cagaagcagattctaaagcaag

SEQ ID NO: 8079485 - DNA, 22 bp, Homo sapiens
cagagagcttagtgtgctgcat

SEQ ID NO: 8079486 - DNA, 19 bp, Homo sapiens
gtcctgcaactggctctcc

SEQ ID NO: 8079487 - DNA, 22 bp, Homo sapiens
gtgaagttttagtatatgtaga

SEQ ID NO: 8079488 - DNA, 22 bp, Homo sapiens
gtgaataattttttagtataag

SEQ ID NO: 8079489 - DNA, 21 bp, Homo sapiens
gtgaattaattatatgcctta

SEQ ID NO: 8079490 - DNA, 22 bp, Homo sapiens
gtctttctatgcatagagcaga

SEQ ID NO: 8079491 - DNA, 22 bp, Homo sapiens
gtctttcttaaacaacagaaca

SEQ ID NO: 8079492 - DNA, 22 bp, Homo sapiens
gtctttctgccatgtgaagaga

SEQ ID NO: 8079493 - DNA, 22 bp, Homo sapiens
gtctttctgccatgtgaagaga

SEQ ID NO: 8079494 - DNA, 22 bp, Homo sapiens
cagctcctgaggactgctggga

SEQ ID NO: 8079495 - DNA, 19 bp, Homo sapiens
ggctcctgtggctgcagcc

SEQ ID NO: 8079496 - DNA, 19 bp, Homo sapiens
ggctcctggggctcagccc

SEQ ID NO: 8079497 - DNA, 22 bp, Homo sapiens
ggctcctgggggtgctcctgcc

SEQ ID NO: 8079498 - DNA, 22 bp, Homo sapiens
ggctgcagcagagggactcacg

SEQ ID NO: 8079499 - DNA, 22 bp, Homo sapiens
ggctgcagccctcgcctagcca

SEQ ID NO: 8079500 - DNA, 22 bp, Homo sapiens
ggctgcagattgtagtctgtta

SEQ ID NO: 8079501 - DNA, 22 bp, Homo sapiens
ggctgcagatagccagccacca

SEQ ID NO: 8079502 - DNA, 22 bp, Homo sapiens
ggctgctcaaggactctgatcg

SEQ ID NO: 8079503 - DNA, 22 bp, Homo sapiens
ggctgcggatctaaggctggga

SEQ ID NO: 8079504 - DNA, 18 bp, Homo sapiens
ggctgctcgctctccccg

SEQ ID NO: 8079505 - DNA, 22 bp, Homo sapiens
ggctgctcctttaccctggcag

SEQ ID NO: 8079506 - DNA, 18 bp, Homo sapiens
ggctgctcctctccctac

SEQ ID NO: 8079507 - DNA, 21 bp, Homo sapiens
ggctgctcacctaggtcccaa

SEQ ID NO: 8079508 - DNA, 22 bp, Homo sapiens
ggctgctcacgcagccctccct

SEQ ID NO: 8079509 - DNA, 22 bp, Homo sapiens
ggctgctcacgcagccctccct

SEQ ID NO: 8079510 - DNA, 22 bp, Homo sapiens
cagaacagacttaacagggctg

SEQ ID NO: 8079511 - DNA, 22 bp, Homo sapiens
ggctgggagctggacaggccgg

SEQ ID NO: 8079512 - DNA, 19 bp, Homo sapiens
ggcttcagggagttagcat

SEQ ID NO: 8079513 - DNA, 22 bp, Homo sapiens
cagaacaggtcatgcttgctgt

SEQ ID NO: 8079514 - DNA, 22 bp, Homo sapiens
cagaacagtcgcctgcatggat

SEQ ID NO: 8079515 - DNA, 20 bp, Homo sapiens
cagaacagtctgagaggcca

SEQ ID NO: 8079516 - DNA, 22 bp, Homo sapiens
cacccaggacaggccagatgtg

SEQ ID NO: 8079517 - DNA, 22 bp, Homo sapiens
cacccaggctagagtgcagtgg

SEQ ID NO: 8079518 - DNA, 22 bp, Homo sapiens
ggccactttcatagcaagtgtg

SEQ ID NO: 8079519 - DNA, 21 bp, Homo sapiens
ggccccagcccatgggttctc

SEQ ID NO: 8079520 - DNA, 22 bp, Homo sapiens
ggccccaggcctttggtctggc

SEQ ID NO: 8079521 - DNA, 22 bp, Homo sapiens
ggatatatgcatgttatcattt

SEQ ID NO: 8079522 - DNA, 22 bp, Homo sapiens
cacatttctggaattgacttgg

SEQ ID NO: 8079523 - DNA, 22 bp, Homo sapiens
ggcaggtgccttctgtgctagc

SEQ ID NO: 8079524 - DNA, 22 bp, Homo sapiens
ggaacacagtgccttacaaact

SEQ ID NO: 8079525 - DNA, 22 bp, Homo sapiens
caatgtatcaaccagaaagttc

SEQ ID NO: 8079526 - DNA, 22 bp, Homo sapiens
caatggaagaatctgacctgca

SEQ ID NO: 8079527 - DNA, 16 bp, Homo sapiens
gctgtaaaaggattca

SEQ ID NO: 8079528 - DNA, 22 bp, Homo sapiens
gctgtaaagaacattaggaatc

SEQ ID NO: 8079529 - DNA, 22 bp, Homo sapiens
gctgggctcaccaggccactag

SEQ ID NO: 8079530 - DNA, 22 bp, Homo sapiens
caagttcacttgtctacaaggg

SEQ ID NO: 8079531 - DNA, 22 bp, Homo sapiens
caagttcacgttgctttttgag

SEQ ID NO: 8079532 - DNA, 22 bp, Homo sapiens
caagttcattgtagcattattg

SEQ ID NO: 8079533 - DNA, 22 bp, Homo sapiens
gctgggcccagatcccaggatc

SEQ ID NO: 8079534 - DNA, 22 bp, Homo sapiens
gctgggccccatccctcgagca

SEQ ID NO: 8079535 - DNA, 22 bp, Homo sapiens
gctgggccctgggtgccctagc

SEQ ID NO: 8079536 - DNA, 22 bp, Homo sapiens
gctgggccgacctgggctgcag

SEQ ID NO: 8079537 - DNA, 22 bp, Homo sapiens
caaatttaagttagaaagcaat

SEQ ID NO: 8079538 - DNA, 22 bp, Homo sapiens
ggacaattcagtgatttgggga

SEQ ID NO: 8079539 - DNA, 22 bp, Homo sapiens
cacagcaaaggcttcggctgat

SEQ ID NO: 8079540 - DNA, 22 bp, Homo sapiens
cacagcaaagacactctcaact

SEQ ID NO: 8079541 - DNA, 22 bp, Homo sapiens
cacagagacagatctattttgc

SEQ ID NO: 8079542 - DNA, 22 bp, Homo sapiens
ggaggagacagtaaaaagcacg

SEQ ID NO: 8079543 - DNA, 22 bp, Homo sapiens
tatgcaaactaagttgtttcct

SEQ ID NO: 8079544 - DNA, 22 bp, Homo sapiens
tatgcaaatgactggtatgttt

SEQ ID NO: 8079545 - DNA, 22 bp, Homo sapiens
tatgcaaatgactggtatgttt

SEQ ID NO: 8079546 - DNA, 22 bp, Homo sapiens
caggtgggctgcctctccagct

SEQ ID NO: 8079547 - DNA, 22 bp, Homo sapiens
caggtggggggcttccgagcct

SEQ ID NO: 8079548 - DNA, 22 bp, Homo sapiens
caggtggggcgccctcaggcag

SEQ ID NO: 8079549 - DNA, 22 bp, Homo sapiens
cagtaaaagatggaaatagaat

SEQ ID NO: 8079550 - DNA, 22 bp, Homo sapiens
tatgtacatgttaaagggcaaa

SEQ ID NO: 8079551 - DNA, 22 bp, Homo sapiens
cagggccaccgtgtttgctgct

SEQ ID NO: 8079552 - DNA, 20 bp, Homo sapiens
cagggccacgctccaaggca

SEQ ID NO: 8079553 - DNA, 22 bp, Homo sapiens
cagggccaccctctgctgggtg

SEQ ID NO: 8079554 - DNA, 22 bp, Homo sapiens
cagggccaagttggtgcctttt

SEQ ID NO: 8079555 - DNA, 22 bp, Homo sapiens
tagtaacagatttatacagtct

SEQ ID NO: 8079556 - DNA, 22 bp, Homo sapiens
cagggctgctggccgtgccctc

SEQ ID NO: 8079557 - DNA, 22 bp, Homo sapiens
tagttttacatcagccattgtt

SEQ ID NO: 8079558 - DNA, 22 bp, Homo sapiens
tagttttagcagcaatgggatg

SEQ ID NO: 8079559 - DNA, 22 bp, Homo sapiens
tagttttacttgcgatgataat

SEQ ID NO: 8079560 - DNA, 22 bp, Homo sapiens
tatataactactattttgctca

SEQ ID NO: 8079561 - DNA, 22 bp, Homo sapiens
tagttttagtcccattttacag

SEQ ID NO: 8079562 - DNA, 22 bp, Homo sapiens
tatataattttctgccatatcc

SEQ ID NO: 8079563 - DNA, 22 bp, Homo sapiens
tatatacaaggtaggtttaggt

SEQ ID NO: 8079564 - DNA, 22 bp, Homo sapiens
tatatatatgcacacacaccta

SEQ ID NO: 8079565 - DNA, 22 bp, Homo sapiens
tatattcaatgattagtatcag

SEQ ID NO: 8079566 - DNA, 22 bp, Homo sapiens
tatattcaatgattagtatcag

SEQ ID NO: 8079567 - DNA, 22 bp, Homo sapiens
tatattcattttaaagccatct

SEQ ID NO: 8079568 - DNA, 22 bp, Homo sapiens
tatatagaaaagcagatgttgg

SEQ ID NO: 8079569 - DNA, 22 bp, Homo sapiens
tcaaaggaatttgattttgatg

SEQ ID NO: 8079570 - DNA, 22 bp, Homo sapiens
tcaaaagaaacaccatgttcct

SEQ ID NO: 8079571 - DNA, 21 bp, Homo sapiens
tcaaagcacatatttgcacat

SEQ ID NO: 8079572 - DNA, 22 bp, Homo sapiens
cagtcttttgtatattagcaga

SEQ ID NO: 8079573 - DNA, 22 bp, Homo sapiens
cagtctttgttcccattactga

SEQ ID NO: 8079574 - DNA, 22 bp, Homo sapiens
cagtctttgacaagccctttca

SEQ ID NO: 8079575 - DNA, 22 bp, Homo sapiens
cagtctttgatgcatcctagcc

SEQ ID NO: 8079576 - DNA, 19 bp, Homo sapiens
tcaaattcctaagttctgg

SEQ ID NO: 8079577 - DNA, 22 bp, Homo sapiens
cagtcccagggttggttcagct

SEQ ID NO: 8079578 - DNA, 22 bp, Homo sapiens
cagtcccatctcccaggtggct

SEQ ID NO: 8079579 - DNA, 22 bp, Homo sapiens
cagtctctctccttgcaggcgt

SEQ ID NO: 8079580 - DNA, 23 bp, Homo sapiens
cagtctctccccggacagcaaaa

SEQ ID NO: 8079581 - DNA, 22 bp, Homo sapiens
cagtctctcagctttcagctgt

SEQ ID NO: 8079582 - DNA, 22 bp, Homo sapiens
tcacattcatggtgctaataaa

SEQ ID NO: 8079583 - DNA, 22 bp, Homo sapiens
cagtggcacccacgggctgggc

SEQ ID NO: 8079584 - DNA, 22 bp, Homo sapiens
cagtggcaagtccggtattgaa

SEQ ID NO: 8079585 - DNA, 22 bp, Homo sapiens
tcacatggcgagctttaaaata

SEQ ID NO: 8079586 - DNA, 22 bp, Homo sapiens
tacacagactcttcaattcaga

SEQ ID NO: 8079587 - DNA, 22 bp, Homo sapiens
tacacagactcttcaattcaga

SEQ ID NO: 8079588 - DNA, 22 bp, Homo sapiens
tacacagatttaaaagcaggga

SEQ ID NO: 8079589 - DNA, 22 bp, Homo sapiens
tacacagggagagattggaaac

SEQ ID NO: 8079590 - DNA, 22 bp, Homo sapiens
tacacaggctgcctctttgcat

SEQ ID NO: 8079591 - DNA, 22 bp, Homo sapiens
cagctctgccacttcctagcta

SEQ ID NO: 8079592 - DNA, 22 bp, Homo sapiens
caggccaccagatacatgcccc

SEQ ID NO: 8079593 - DNA, 22 bp, Homo sapiens
tacagacattcaattttgaccc

SEQ ID NO: 8079594 - DNA, 22 bp, Homo sapiens
tacagacatttactccactcct

SEQ ID NO: 8079595 - DNA, 22 bp, Homo sapiens
tacagtttgtatggtcaggaat

SEQ ID NO: 8079596 - DNA, 22 bp, Homo sapiens
tacagtttcccagcagatgcaa

SEQ ID NO: 8079597 - DNA, 22 bp, Homo sapiens
tacagtttctcattatgctctc

SEQ ID NO: 8079598 - DNA, 22 bp, Homo sapiens
tacagtttctgtccttgtggag

SEQ ID NO: 8079599 - DNA, 22 bp, Homo sapiens
tacagtttaacactttggagaa

SEQ ID NO: 8079600 - DNA, 22 bp, Homo sapiens
tacagttcacagtatcataaat

SEQ ID NO: 8079601 - DNA, 22 bp, Homo sapiens
tacagccatcatgtatgtatat

SEQ ID NO: 8079602 - DNA, 22 bp, Homo sapiens
cagggatgaccagagggatgtg

SEQ ID NO: 8079603 - DNA, 22 bp, Homo sapiens
cagggatgagagatggcacaga

SEQ ID NO: 8079604 - DNA, 22 bp, Homo sapiens
cagggatgagcagatggagcaa

SEQ ID NO: 8079605 - DNA, 22 bp, Homo sapiens
cagggatgctgcttaggcagtt

SEQ ID NO: 8079606 - DNA, 22 bp, Homo sapiens
cagggcaggacagatacattac

SEQ ID NO: 8079607 - DNA, 22 bp, Homo sapiens
cagggcagtttgtgcctatgag

SEQ ID NO: 8079608 - DNA, 22 bp, Homo sapiens
caggctgcagcagcagtggccc

SEQ ID NO: 8079609 - DNA, 22 bp, Homo sapiens
tagaacagcatttggctattaa

SEQ ID NO: 8079610 - DNA, 22 bp, Homo sapiens
tagaaatgttggtattaacatt

SEQ ID NO: 8079611 - DNA, 22 bp, Homo sapiens
tcacttattgctcatctcatgc

SEQ ID NO: 8079612 - DNA, 22 bp, Homo sapiens
tcacttatgccagctctggaag

SEQ ID NO: 8079613 - DNA, 22 bp, Homo sapiens
tcacttagatggggatcatcac

SEQ ID NO: 8079614 - DNA, 22 bp, Homo sapiens
catcaatgtgcagagatgaacg

SEQ ID NO: 8079615 - DNA, 22 bp, Homo sapiens
tcataacactggtgattaagaa

SEQ ID NO: 8079616 - DNA, 22 bp, Homo sapiens
catcatactgtttacactcaaa

SEQ ID NO: 8079617 - DNA, 22 bp, Homo sapiens
catcagttcccaggcccagaca

SEQ ID NO: 8079618 - DNA, 22 bp, Homo sapiens
tccagcaaagtgataggatttc

SEQ ID NO: 8079619 - DNA, 22 bp, Homo sapiens
catgggctcttctggactgcac

SEQ ID NO: 8079620 - DNA, 22 bp, Homo sapiens
catgtaaagcacttcataacag

SEQ ID NO: 8079621 - DNA, 22 bp, Homo sapiens
catgtaaagaatttcacacaag

SEQ ID NO: 8079622 - DNA, 22 bp, Homo sapiens
tccaagatctacagcagtttag

SEQ ID NO: 8079623 - DNA, 23 bp, Homo sapiens
catgtacagagtttgataaagtg

SEQ ID NO: 8079624 - DNA, 22 bp, Homo sapiens
cattacaaacatgttaagattt

SEQ ID NO: 8079625 - DNA, 22 bp, Homo sapiens
cattacaaccccaaattacaaa

SEQ ID NO: 8079626 - DNA, 22 bp, Homo sapiens
tccagggcaggtgctgggctct

SEQ ID NO: 8079627 - DNA, 22 bp, Homo sapiens
tccagggcagtgactacagcgg

SEQ ID NO: 8079628 - DNA, 22 bp, Homo sapiens
tccagggccaagtcatggaacc

SEQ ID NO: 8079629 - DNA, 22 bp, Homo sapiens
tccagggcatgctcagactcag

SEQ ID NO: 8079630 - DNA, 22 bp, Homo sapiens
tccaggggtaccggccaggcag

SEQ ID NO: 8079631 - DNA, 22 bp, Homo sapiens
tctcagtgggaagggcacagtt

SEQ ID NO: 8079632 - DNA, 22 bp, Homo sapiens
tctatacacacaaagaatgctt

SEQ ID NO: 8079633 - DNA, 23 bp, Homo sapiens
tctatacatactgcagcctctgg

SEQ ID NO: 8079634 - DNA, 22 bp, Homo sapiens
tctataaatgcagatatgtgtg

SEQ ID NO: 8079635 - DNA, 22 bp, Homo sapiens
tctataaattatgcagtctcag

SEQ ID NO: 8079636 - DNA, 21 bp, Homo sapiens
tctataactatagtgacagat

SEQ ID NO: 8079637 - DNA, 22 bp, Homo sapiens
tctatacaagtttcactttgac

SEQ ID NO: 8079638 - DNA, 22 bp, Homo sapiens
ccagcacacagtgggtgcccag

SEQ ID NO: 8079639 - DNA, 22 bp, Homo sapiens
tctctgggataaactgggccag

SEQ ID NO: 8079640 - DNA, 22 bp, Homo sapiens
ccagaggtgaacaggaggctgt

SEQ ID NO: 8079641 - DNA, 22 bp, Homo sapiens
ccagaggctgggttcacctcag

SEQ ID NO: 8079642 - DNA, 22 bp, Homo sapiens
ccagaggctggggaaggataca

SEQ ID NO: 8079643 - DNA, 22 bp, Homo sapiens
ccagagggagccaccagggtgt

SEQ ID NO: 8079644 - DNA, 22 bp, Homo sapiens
ccagaggctggcagccagctga

SEQ ID NO: 8079645 - DNA, 22 bp, Homo sapiens
ccagagcctcaacacaggtcct

SEQ ID NO: 8079646 - DNA, 22 bp, Homo sapiens
ccagagagggcgccacctggag

SEQ ID NO: 8079647 - DNA, 22 bp, Homo sapiens
tcctgactctggtgtcctctac

SEQ ID NO: 8079648 - DNA, 22 bp, Homo sapiens
ccaaaaattagatacacatata

SEQ ID NO: 8079649 - DNA, 22 bp, Homo sapiens
ccaaaaattagatacacatata

SEQ ID NO: 8079650 - DNA, 22 bp, Homo sapiens
tcctgacttggctgttggccct

SEQ ID NO: 8079651 - DNA, 22 bp, Homo sapiens
cattttactgactcttgaatta

SEQ ID NO: 8079652 - DNA, 21 bp, Homo sapiens
catttcatgattatagaaatg

SEQ ID NO: 8079653 - DNA, 22 bp, Homo sapiens
tcctggctccactgagcaggcc

SEQ ID NO: 8079654 - DNA, 22 bp, Homo sapiens
tcctggctcaggcccctggtgc

SEQ ID NO: 8079655 - DNA, 22 bp, Homo sapiens
ccacaggcggagtggcgggcag

SEQ ID NO: 8079656 - DNA, 22 bp, Homo sapiens
ccacagggataggaatggggct

SEQ ID NO: 8079657 - DNA, 22 bp, Homo sapiens
ccacaggctgctgcaggtcccg

SEQ ID NO: 8079658 - DNA, 22 bp, Homo sapiens
ccaagaggaccttgccagggca

SEQ ID NO: 8079659 - DNA, 22 bp, Homo sapiens
ccaagaggcagaatgcagagaa

SEQ ID NO: 8079660 - DNA, 22 bp, Homo sapiens
ccaagaatgataggtgtgagca

SEQ ID NO: 8079661 - DNA, 22 bp, Homo sapiens
ccaaattaaatcatacagacag

SEQ ID NO: 8079662 - DNA, 22 bp, Homo sapiens
tcctggagccacggagctttca

SEQ ID NO: 8079663 - DNA, 22 bp, Homo sapiens
ccaagagggttgccctgagcgt

SEQ ID NO: 8079664 - DNA, 22 bp, Homo sapiens
ccaagaggggcagagggctgca

SEQ ID NO: 8079665 - DNA, 19 bp, Homo sapiens
tggcagggagagtttgaag

SEQ ID NO: 8079666 - DNA, 22 bp, Homo sapiens
tggcagggaatacagatgttta

SEQ ID NO: 8079667 - DNA, 22 bp, Homo sapiens
ccctccccacaaagcttcacac

SEQ ID NO: 8079668 - DNA, 22 bp, Homo sapiens
ccccaggcagggcctaacagag

SEQ ID NO: 8079669 - DNA, 22 bp, Homo sapiens
tgctgctcaatgagatgccatc

SEQ ID NO: 8079670 - DNA, 22 bp, Homo sapiens
tgctgctcacacacagtgaatg

SEQ ID NO: 8079671 - DNA, 22 bp, Homo sapiens
tgctgctccccagcacacagca

SEQ ID NO: 8079672 - DNA, 22 bp, Homo sapiens
tgctgctcagaacccctgggct

SEQ ID NO: 8079673 - DNA, 22 bp, Homo sapiens
tgctgctcatcagattttaaaa

SEQ ID NO: 8079674 - DNA, 22 bp, Homo sapiens
cccagtggcttttgcccaggtt

SEQ ID NO: 8079675 - DNA, 22 bp, Homo sapiens
tgctgctccatctgaccattcc

SEQ ID NO: 8079676 - DNA, 22 bp, Homo sapiens
tgctgctcaagctgcagcaaaa

SEQ ID NO: 8079677 - DNA, 22 bp, Homo sapiens
cccagtggtgctggcatctgtg

SEQ ID NO: 8079678 - DNA, 22 bp, Homo sapiens
cccagtggtttgcagaaccaag

SEQ ID NO: 8079679 - DNA, 22 bp, Homo sapiens
cccagtggggaaatagctagct

SEQ ID NO: 8079680 - DNA, 22 bp, Homo sapiens
cccagtggggagctgaggttca

SEQ ID NO: 8079681 - DNA, 22 bp, Homo sapiens
cccagtgggtcactgcatctca

SEQ ID NO: 8079682 - DNA, 22 bp, Homo sapiens
cccagtggggagcttctgcctt

SEQ ID NO: 8079683 - DNA, 20 bp, Homo sapiens
cccagtgtccagccttgcca

SEQ ID NO: 8079684 - DNA, 22 bp, Homo sapiens
tgctcaggagcttagagcacag

SEQ ID NO: 8079685 - DNA, 22 bp, Homo sapiens
tgctacttttgaaatcttcctt

SEQ ID NO: 8079686 - DNA, 22 bp, Homo sapiens
tgctaattcaaagggtagttag

SEQ ID NO: 8079687 - DNA, 21 bp, Homo sapiens
tgctaagtgtcacatgtctgc

SEQ ID NO: 8079688 - DNA, 22 bp, Homo sapiens
tgcagggctaagtcagagcctg

SEQ ID NO: 8079689 - DNA, 20 bp, Homo sapiens
cccagtgaagcatggaagag

SEQ ID NO: 8079690 - DNA, 22 bp, Homo sapiens
cccagtggctgtccccatgggc

SEQ ID NO: 8079691 - DNA, 22 bp, Homo sapiens
cccagtggagataggagtgtgg

SEQ ID NO: 8079692 - DNA, 22 bp, Homo sapiens
cccagtggaaggagtagaagac

SEQ ID NO: 8079693 - DNA, 22 bp, Homo sapiens
cccagtggcaaagcagcttaga

SEQ ID NO: 8079694 - DNA, 22 bp, Homo sapiens
cccagtggcccagcatgtggtg

SEQ ID NO: 8079695 - DNA, 22 bp, Homo sapiens
tgctctggaccatgactatgtg

SEQ ID NO: 8079696 - DNA, 22 bp, Homo sapiens
cctgcctcccagaggtcctcta

SEQ ID NO: 8079697 - DNA, 22 bp, Homo sapiens
tggtaattatggatacttaaat

SEQ ID NO: 8079698 - DNA, 22 bp, Homo sapiens
tggtaattaatttgataggttc

SEQ ID NO: 8079699 - DNA, 22 bp, Homo sapiens
cctgccactgtaggtgacagtt

SEQ ID NO: 8079700 - DNA, 22 bp, Homo sapiens
cctgcaggttgcagaggcggaa

SEQ ID NO: 8079701 - DNA, 22 bp, Homo sapiens
cctgcaggggagagacttctag

SEQ ID NO: 8079702 - DNA, 19 bp, Homo sapiens
cctgcagggatgagaggtt

SEQ ID NO: 8079703 - DNA, 22 bp, Homo sapiens
cctgcaggtaaggctaactgcc

SEQ ID NO: 8079704 - DNA, 22 bp, Homo sapiens
cctgcaggtccccggatgcgca

SEQ ID NO: 8079705 - DNA, 22 bp, Homo sapiens
tgggcaggatgcgttgattctt

SEQ ID NO: 8079706 - DNA, 22 bp, Homo sapiens
tgggcaggcaagtgaatacctt

SEQ ID NO: 8079707 - DNA, 22 bp, Homo sapiens
cctgcagggaatcgaggcagaa

SEQ ID NO: 8079708 - DNA, 22 bp, Homo sapiens
tggcatttctgttagactctca

SEQ ID NO: 8079709 - DNA, 22 bp, Homo sapiens
tggcagtgtcctactggttggt

SEQ ID NO: 8079710 - DNA, 22 bp, Homo sapiens
tggcagtggtgtctgcacaggc

SEQ ID NO: 8079711 - DNA, 22 bp, Homo sapiens
cctccagggcagacggggagca

SEQ ID NO: 8079712 - DNA, 22 bp, Homo sapiens
tggcattttgtagctgtgtatc

SEQ ID NO: 8079713 - DNA, 22 bp, Homo sapiens
tggcattttagacatgatggtg

SEQ ID NO: 8079714 - DNA, 22 bp, Homo sapiens
tggcatttgggctggcttttct

SEQ ID NO: 8079715 - DNA, 22 bp, Homo sapiens
tgggcaggagagaagctaaaga

SEQ ID NO: 8079716 - DNA, 22 bp, Homo sapiens
tgggacaggaggcctctggaga

SEQ ID NO: 8079717 - DNA, 22 bp, Homo sapiens
tcttgcagaaataagtttaaat

SEQ ID NO: 8079718 - DNA, 22 bp, Homo sapiens
tcttttcttgcattattgcact

SEQ ID NO: 8079719 - DNA, 22 bp, Homo sapiens
ccaggcttcctaatgtgtgcag

SEQ ID NO: 8079720 - DNA, 17 bp, Homo sapiens
tgaaacaccaagactgt

SEQ ID NO: 8079721 - DNA, 22 bp, Homo sapiens
tgaaacactttcaattacatat

SEQ ID NO: 8079722 - DNA, 17 bp, Homo sapiens
ccagggaggggccgcgc

SEQ ID NO: 8079723 - DNA, 23 bp, Homo sapiens
ccagggaggttgattggttaccc

SEQ ID NO: 8079724 - DNA, 22 bp, Homo sapiens
ccagggagggtcctgtggcttc

SEQ ID NO: 8079725 - DNA, 22 bp, Homo sapiens
tgaaatgatgtacaagaaggca

SEQ ID NO: 8079726 - DNA, 22 bp, Homo sapiens
ccagggcacgttgggacagtac

SEQ ID NO: 8079727 - DNA, 22 bp, Homo sapiens
ccagggcagggaccacgtgtct

SEQ ID NO: 8079728 - DNA, 22 bp, Homo sapiens
ccagggcaggagaaagactcac

SEQ ID NO: 8079729 - DNA, 22 bp, Homo sapiens
ccagggcaggggctggagttca

SEQ ID NO: 8079730 - DNA, 22 bp, Homo sapiens
ccagggcaattatttggagggt

SEQ ID NO: 8079731 - DNA, 22 bp, Homo sapiens
ccagggcaataggaacactttt

SEQ ID NO: 8079732 - DNA, 22 bp, Homo sapiens
ccagggcaaatgagatcatagc

SEQ ID NO: 8079733 - DNA, 22 bp, Homo sapiens
ccagggcaacgctgtctcagag

SEQ ID NO: 8079734 - DNA, 22 bp, Homo sapiens
ccagggctgagctgtgaccatg

SEQ ID NO: 8079735 - DNA, 22 bp, Homo sapiens
ccagggctctgcttctgccatg

SEQ ID NO: 8079736 - DNA, 22 bp, Homo sapiens
ccagggctcgggtgcttagtca

SEQ ID NO: 8079737 - DNA, 22 bp, Homo sapiens
ccagggctctatgagggtggag

SEQ ID NO: 8079738 - DNA, 22 bp, Homo sapiens
ccagggcagtgggagaaggtgc

SEQ ID NO: 8079739 - DNA, 22 bp, Homo sapiens
ccagggcatcacatccagtgtt

SEQ ID NO: 8079740 - DNA, 22 bp, Homo sapiens
ccagggcatcctcacatcgcag

SEQ ID NO: 8079741 - DNA, 22 bp, Homo sapiens
tcttcctcatgaattctcgtat

SEQ ID NO: 8079742 - DNA, 22 bp, Homo sapiens
tcttctgatgccagtaaccatg

SEQ ID NO: 8079743 - DNA, 22 bp, Homo sapiens
ccaggaggctctgactggaccc

SEQ ID NO: 8079744 - DNA, 22 bp, Homo sapiens
tctgttcttctccactgtatgt

SEQ ID NO: 8079745 - DNA, 22 bp, Homo sapiens
tctgttcttaaagcattcttgc

SEQ ID NO: 8079746 - DNA, 22 bp, Homo sapiens
ccagtgccttttgtgggtttgt

SEQ ID NO: 8079747 - DNA, 22 bp, Homo sapiens
ccagtgctcttaaaggtcataa

SEQ ID NO: 8079748 - DNA, 22 bp, Homo sapiens
ccagtgctcattcaagtcctta

SEQ ID NO: 8079749 - DNA, 22 bp, Homo sapiens
ccagtgctgaatgaggaggtct

SEQ ID NO: 8079750 - DNA, 22 bp, Homo sapiens
ccagtgcttctttgctagctgg

SEQ ID NO: 8079751 - DNA, 22 bp, Homo sapiens
ccagtgcccagtctccctggtc

SEQ ID NO: 8079752 - DNA, 22 bp, Homo sapiens
ccagtgcctatctcctctggga

SEQ ID NO: 8079753 - DNA, 22 bp, Homo sapiens
ccagtgcctatccttctcctgt

SEQ ID NO: 8079754 - DNA, 19 bp, Homo sapiens
ccagtgccggcgctgggga

SEQ ID NO: 8079755 - DNA, 17 bp, Homo sapiens
ccagtgcctgtggcaac

SEQ ID NO: 8079756 - DNA, 22 bp, Homo sapiens
ccagtgcctgtgggcatggtgc

SEQ ID NO: 8079757 - DNA, 18 bp, Homo sapiens
ccagtgccaagagtggca

SEQ ID NO: 8079758 - DNA, 22 bp, Homo sapiens
ccagtgcccagctgcccaggca

SEQ ID NO: 8079759 - DNA, 22 bp, Homo sapiens
ccagggctgctgggggagttga

SEQ ID NO: 8079760 - DNA, 22 bp, Homo sapiens
ccagggctgctgtgggactcca

SEQ ID NO: 8079761 - DNA, 22 bp, Homo sapiens
ccagggctgctcattggctggt

SEQ ID NO: 8079762 - DNA, 22 bp, Homo sapiens
tgagtcctgctctgggcagggt

SEQ ID NO: 8079763 - DNA, 22 bp, Homo sapiens
tgagtctcaactgggaattgat

SEQ ID NO: 8079764 - DNA, 22 bp, Homo sapiens
tgagtcctgtctttgtcactta

SEQ ID NO: 8079765 - DNA, 22 bp, Homo sapiens
tgagtcctggctttgggatgta

SEQ ID NO: 8079766 - DNA, 22 bp, Homo sapiens
tgagtctccagcgaagtaggat

SEQ ID NO: 8079767 - DNA, 22 bp, Homo sapiens
tgagtctcccaagtagttggaa

SEQ ID NO: 8079768 - DNA, 21 bp, Homo sapiens
tgagtctctcagcttcaggta

SEQ ID NO: 8079769 - DNA, 22 bp, Homo sapiens
tgagtctctgcactaaggagag

SEQ ID NO: 8079770 - DNA, 22 bp, Homo sapiens
tgagttttttcaacatatgaag

SEQ ID NO: 8079771 - DNA, 23 bp, Homo sapiens
ccatatctctgtactgaatgtgg

SEQ ID NO: 8079772 - DNA, 22 bp, Homo sapiens
ccatcatttgatacagctgtct

SEQ ID NO: 8079773 - DNA, 22 bp, Homo sapiens
cccagaggaggatctcggcccg

SEQ ID NO: 8079774 - DNA, 22 bp, Homo sapiens
cccagaggaggcaaagctctgt

SEQ ID NO: 8079775 - DNA, 22 bp, Homo sapiens
cccagaggctgagttgggagca

SEQ ID NO: 8079776 - DNA, 22 bp, Homo sapiens
cccagagggaagggaatgaggt

SEQ ID NO: 8079777 - DNA, 22 bp, Homo sapiens
cccagagggctgaggatatgaa

SEQ ID NO: 8079778 - DNA, 22 bp, Homo sapiens
tgcagggatcctagctgaagag

SEQ ID NO: 8079779 - DNA, 22 bp, Homo sapiens
tgcaatatttggcactgagatg

SEQ ID NO: 8079780 - DNA, 22 bp, Homo sapiens
tgcaatatcagattcaacacat

SEQ ID NO: 8079781 - DNA, 22 bp, Homo sapiens
tgcaaatattgggacagtctag

SEQ ID NO: 8079782 - DNA, 22 bp, Homo sapiens
tgcaataaagtgctataaatcc

SEQ ID NO: 8079783 - DNA, 22 bp, Homo sapiens
tgcactttatttcctctcacac

SEQ ID NO: 8079784 - DNA, 18 bp, Homo sapiens
gaaagccatgcagcagtg

SEQ ID NO: 8079785 - DNA, 22 bp, Homo sapiens
gaaacacatgcagctccataga

SEQ ID NO: 8079786 - DNA, 17 bp, Homo sapiens
ctttgcagcagacatgt

SEQ ID NO: 8079787 - DNA, 22 bp, Homo sapiens
cttttcttactcccgcaaggca

SEQ ID NO: 8079788 - DNA, 22 bp, Homo sapiens
cttgttttctaaaacatcattt

SEQ ID NO: 8079789 - DNA, 22 bp, Homo sapiens
ctttgaaaacacacgaatagac

SEQ ID NO: 8079790 - DNA, 22 bp, Homo sapiens
ctttgaaaacttaaataacagc

SEQ ID NO: 8079791 - DNA, 22 bp, Homo sapiens
ctttctttgtccaccaacaatg

SEQ ID NO: 8079792 - DNA, 22 bp, Homo sapiens
ctttaagagatcaccaatcaca

SEQ ID NO: 8079793 - DNA, 22 bp, Homo sapiens
ctttaaggtgatgagagatgct

SEQ ID NO: 8079794 - DNA, 22 bp, Homo sapiens
ctttacaaattagctctcggga

SEQ ID NO: 8079795 - DNA, 22 bp, Homo sapiens
ctttacaaatagggagggagtg

SEQ ID NO: 8079796 - DNA, 22 bp, Homo sapiens
ctttacaaactataaagtgcgg

SEQ ID NO: 8079797 - DNA, 22 bp, Homo sapiens
ctttacaaagcaattttgtctc

SEQ ID NO: 8079798 - DNA, 22 bp, Homo sapiens
ctgtttttcagaaggtaaggga

SEQ ID NO: 8079799 - DNA, 18 bp, Homo sapiens
cttaaactgtccccagta

SEQ ID NO: 8079800 - DNA, 22 bp, Homo sapiens
ctgttttataaagtccaaaagt

SEQ ID NO: 8079801 - DNA, 22 bp, Homo sapiens
ctgtttgcccacatttttatta

SEQ ID NO: 8079802 - DNA, 22 bp, Homo sapiens
ctgtttaatgaggtgtaacaac

SEQ ID NO: 8079803 - DNA, 22 bp, Homo sapiens
ctgtttaatgaggtgtaacaac

SEQ ID NO: 8079804 - DNA, 22 bp, Homo sapiens
cttaattacccaatgtggtagg

SEQ ID NO: 8079805 - DNA, 22 bp, Homo sapiens
cttaaattttcatctacaagaa

SEQ ID NO: 8079806 - DNA, 22 bp, Homo sapiens
cttaattactgtccaatatgca

SEQ ID NO: 8079807 - DNA, 22 bp, Homo sapiens
cttaaattggatgagttaagtt

SEQ ID NO: 8079808 - DNA, 22 bp, Homo sapiens
cttaaattttcatctacaagaa

SEQ ID NO: 8079809 - DNA, 22 bp, Homo sapiens
cttaaagagtatttaatataat

SEQ ID NO: 8079810 - DNA, 22 bp, Homo sapiens
cttaaagtctatcctttctaga

SEQ ID NO: 8079811 - DNA, 22 bp, Homo sapiens
cttaaagtattggtttaaccaa

SEQ ID NO: 8079812 - DNA, 22 bp, Homo sapiens
cttagcaatttaactgactcta

SEQ ID NO: 8079813 - DNA, 22 bp, Homo sapiens
cttacagtgatcaacacaaaga

SEQ ID NO: 8079814 - DNA, 22 bp, Homo sapiens
cttcagttagtttcatgtgagc

SEQ ID NO: 8079815 - DNA, 22 bp, Homo sapiens
cttcagttagagtttacaaagt

SEQ ID NO: 8079816 - DNA, 22 bp, Homo sapiens
cttcagttagccaattcaggtc

SEQ ID NO: 8079817 - DNA, 22 bp, Homo sapiens
cttcatttccatccaactggga

SEQ ID NO: 8079818 - DNA, 22 bp, Homo sapiens
cttcatttggagaactgtgctt

SEQ ID NO: 8079819 - DNA, 22 bp, Homo sapiens
cttatacagatcaagggaaaag

SEQ ID NO: 8079820 - DNA, 22 bp, Homo sapiens
cttcctgttgtcacagtctgcg

SEQ ID NO: 8079821 - DNA, 22 bp, Homo sapiens
ctggtcagagcaactgctcaca

SEQ ID NO: 8079822 - DNA, 22 bp, Homo sapiens
ctgtaaaatgaacctagtcatc

SEQ ID NO: 8079823 - DNA, 22 bp, Homo sapiens
ctgtaaaactgcttaagtatgc

SEQ ID NO: 8079824 - DNA, 22 bp, Homo sapiens
ctgtaaaactgcttaagtatgc

SEQ ID NO: 8079825 - DNA, 22 bp, Homo sapiens
ctgtaaaacactgtagtatctg

SEQ ID NO: 8079826 - DNA, 22 bp, Homo sapiens
ctgtacaatgttacctatttat

SEQ ID NO: 8079827 - DNA, 22 bp, Homo sapiens
ctgtcagtagaccccaagctag

SEQ ID NO: 8079828 - DNA, 22 bp, Homo sapiens
ctgtattttcatgcctacgtac

SEQ ID NO: 8079829 - DNA, 22 bp, Homo sapiens
ctgtattttttaagaatatctc

SEQ ID NO: 8079830 - DNA, 22 bp, Homo sapiens
ctgtcaaattcataacacttat

SEQ ID NO: 8079831 - DNA, 22 bp, Homo sapiens
ctgtagttgggcattataatag

SEQ ID NO: 8079832 - DNA, 22 bp, Homo sapiens
ctgtatacatggtccatgttat

SEQ ID NO: 8079833 - DNA, 22 bp, Homo sapiens
ctgggacagctgagacaggaga

SEQ ID NO: 8079834 - DNA, 22 bp, Homo sapiens
ctgggacatagatcagcctttt

SEQ ID NO: 8079835 - DNA, 22 bp, Homo sapiens
ctgggagattgaggccatggtg

SEQ ID NO: 8079836 - DNA, 22 bp, Homo sapiens
ctgggagatctgttgggactgg

SEQ ID NO: 8079837 - DNA, 22 bp, Homo sapiens
ctgggagatgactcagagcagg

SEQ ID NO: 8079838 - DNA, 22 bp, Homo sapiens
ctgggcagagctaacacctgag

SEQ ID NO: 8079839 - DNA, 22 bp, Homo sapiens
ctgggcagcctcacacaatgtt

SEQ ID NO: 8079840 - DNA, 22 bp, Homo sapiens
ctgggcagcacatcatcgtatc

SEQ ID NO: 8079841 - DNA, 22 bp, Homo sapiens
ctgggcagagtccggaagatgg

SEQ ID NO: 8079842 - DNA, 22 bp, Homo sapiens
ctgggcagaattttaggatggc

SEQ ID NO: 8079843 - DNA, 22 bp, Homo sapiens
ctgggcagctccataccaccca

SEQ ID NO: 8079844 - DNA, 22 bp, Homo sapiens
ctgggcagctaccaccactgct

SEQ ID NO: 8079845 - DNA, 22 bp, Homo sapiens
ctgggcagctgtatcagggagt

SEQ ID NO: 8079846 - DNA, 22 bp, Homo sapiens
ctgggcagctgtgcaaacaata

SEQ ID NO: 8079847 - DNA, 22 bp, Homo sapiens
ctgggagccctgactagcctgg

SEQ ID NO: 8079848 - DNA, 22 bp, Homo sapiens
ctgggccttatgagtacctgga

SEQ ID NO: 8079849 - DNA, 22 bp, Homo sapiens
gagctgcttctgtgtgccgggt

SEQ ID NO: 8079850 - DNA, 22 bp, Homo sapiens
gagctgctggaagtggagccct

SEQ ID NO: 8079851 - DNA, 22 bp, Homo sapiens
gagctgctggcctcctgcggga

SEQ ID NO: 8079852 - DNA, 22 bp, Homo sapiens
gaggcaggccctgaatgagtca

SEQ ID NO: 8079853 - DNA, 22 bp, Homo sapiens
gaggcagggtgttgattacaga

SEQ ID NO: 8079854 - DNA, 22 bp, Homo sapiens
gaggcagggtgttgattacaga

SEQ ID NO: 8079855 - DNA, 22 bp, Homo sapiens
gaggcaggcactgttatcagca

SEQ ID NO: 8079856 - DNA, 22 bp, Homo sapiens
gagggctgatgttgccacctca

SEQ ID NO: 8079857 - DNA, 22 bp, Homo sapiens
gagggctgtggggcatgaccag

SEQ ID NO: 8079858 - DNA, 22 bp, Homo sapiens
gaatgagtagagtataaacaaa

SEQ ID NO: 8079859 - DNA, 22 bp, Homo sapiens
gaatgagtattctttataggat

SEQ ID NO: 8079860 - DNA, 22 bp, Homo sapiens
gaatgagttaatatttgcttgg

SEQ ID NO: 8079861 - DNA, 22 bp, Homo sapiens
gaatgataaatggaagcagcat

SEQ ID NO: 8079862 - DNA, 22 bp, Homo sapiens
gaatgatatattagcagatttt

SEQ ID NO: 8079863 - DNA, 22 bp, Homo sapiens
gaatgatagagctgccttcgga

SEQ ID NO: 8079864 - DNA, 22 bp, Homo sapiens
gacacagttctgttctagtagg

SEQ ID NO: 8079865 - DNA, 22 bp, Homo sapiens
gacacagtaatgtgtttcatct

SEQ ID NO: 8079866 - DNA, 22 bp, Homo sapiens
gacacagttacttattttgcct

SEQ ID NO: 8079867 - DNA, 22 bp, Homo sapiens
gacacagtagccagtgcagtga

SEQ ID NO: 8079868 - DNA, 19 bp, Homo sapiens
gacacagttggttcctttg

SEQ ID NO: 8079869 - DNA, 22 bp, Homo sapiens
gacagacaggaggcattcaggg

SEQ ID NO: 8079870 - DNA, 22 bp, Homo sapiens
gaatatttgtaattactgttga

SEQ ID NO: 8079871 - DNA, 22 bp, Homo sapiens
gaatattttcagtacagatggt

SEQ ID NO: 8079872 - DNA, 22 bp, Homo sapiens
gaagcagtttctgtaatgaaat

SEQ ID NO: 8079873 - DNA, 22 bp, Homo sapiens
gaagcagtatcctgacagcacc

SEQ ID NO: 8079874 - DNA, 22 bp, Homo sapiens
gaagggaatttggagggtttca

SEQ ID NO: 8079875 - DNA, 22 bp, Homo sapiens
gaaggcaggtttttcaaaactg

SEQ ID NO: 8079876 - DNA, 22 bp, Homo sapiens
gaaggcaggcttctgattaggt

SEQ ID NO: 8079877 - DNA, 22 bp, Homo sapiens
gaaggcagggaatgtggtgcta

SEQ ID NO: 8079878 - DNA, 22 bp, Homo sapiens
gaagccactatagatattctaa

SEQ ID NO: 8079879 - DNA, 22 bp, Homo sapiens
gacagcaagagacagagcatcc

SEQ ID NO: 8079880 - DNA, 21 bp, Homo sapiens
gacagcaactgtagtcctctt

SEQ ID NO: 8079881 - DNA, 22 bp, Homo sapiens
gacagcaatgacggggcagctg

SEQ ID NO: 8079882 - DNA, 22 bp, Homo sapiens
gactctgtgggaggaggctcag

SEQ ID NO: 8079883 - DNA, 22 bp, Homo sapiens
gaccacagtccagtcatcatgg

SEQ ID NO: 8079884 - DNA, 22 bp, Homo sapiens
gagaaactaacatctgaaggtg

SEQ ID NO: 8079885 - DNA, 22 bp, Homo sapiens
gagaaactgaaacatagggcca

SEQ ID NO: 8079886 - DNA, 22 bp, Homo sapiens
gagaaactgctctgattctgca

SEQ ID NO: 8079887 - DNA, 20 bp, Homo sapiens
gagactggatctggagagac

SEQ ID NO: 8079888 - DNA, 22 bp, Homo sapiens
gagactgggggcttggcctttt

SEQ ID NO: 8079889 - DNA, 22 bp, Homo sapiens
gagagaaccctaaatgagatat

SEQ ID NO: 8079890 - DNA, 22 bp, Homo sapiens
gagagaaatgtgcagtttgggc

SEQ ID NO: 8079891 - DNA, 22 bp, Homo sapiens
tttcttgagtgatgcttagtgt

SEQ ID NO: 8079892 - DNA, 22 bp, Homo sapiens
tttcttaaatatttgcaggaca

SEQ ID NO: 8079893 - DNA, 22 bp, Homo sapiens
tttcttaatttgagttccacta

SEQ ID NO: 8079894 - DNA, 22 bp, Homo sapiens
ctctggagtcaggcagccctgg

SEQ ID NO: 8079895 - DNA, 22 bp, Homo sapiens
ctctggaggttgagcccagcaa

SEQ ID NO: 8079896 - DNA, 22 bp, Homo sapiens
ctctggaggcagcaccagccag

SEQ ID NO: 8079897 - DNA, 22 bp, Homo sapiens
tttctgataattttgtgaaatc

SEQ ID NO: 8079898 - DNA, 22 bp, Homo sapiens
tttctcacccaagagttatttt

SEQ ID NO: 8079899 - DNA, 22 bp, Homo sapiens
tttctctagctattcattaaat

SEQ ID NO: 8079900 - DNA, 20 bp, Homo sapiens
ctctcacagctccctcagcc

SEQ ID NO: 8079901 - DNA, 22 bp, Homo sapiens
ctctatttatggcatctttatg

SEQ ID NO: 8079902 - DNA, 22 bp, Homo sapiens
tttcaaataccataaacctaat

SEQ ID NO: 8079903 - DNA, 22 bp, Homo sapiens
tttcaaataccataaacctaat

SEQ ID NO: 8079904 - DNA, 22 bp, Homo sapiens
ctctaagtgtcaaacagatatg

SEQ ID NO: 8079905 - DNA, 22 bp, Homo sapiens
ctctaaatgtggtctgcagata

SEQ ID NO: 8079906 - DNA, 22 bp, Homo sapiens
tttacacaaaagatagcacacc

SEQ ID NO: 8079907 - DNA, 22 bp, Homo sapiens
tttacacaaaagatagcacacc

SEQ ID NO: 8079908 - DNA, 22 bp, Homo sapiens
tttacaattggttttctctaat

SEQ ID NO: 8079909 - DNA, 22 bp, Homo sapiens
tttacaattggttttctctaat

SEQ ID NO: 8079910 - DNA, 22 bp, Homo sapiens
tttacacataaatgtgtagaca

SEQ ID NO: 8079911 - DNA, 22 bp, Homo sapiens
tttacacaaaatgttagtagat

SEQ ID NO: 8079912 - DNA, 22 bp, Homo sapiens
tttacacagaggacactgggct

SEQ ID NO: 8079913 - DNA, 22 bp, Homo sapiens
ctcccagggccatcgagtcact

SEQ ID NO: 8079914 - DNA, 22 bp, Homo sapiens
ctccccaggttcaggaggtggg

SEQ ID NO: 8079915 - DNA, 22 bp, Homo sapiens
ttgtttaatgcctcatacatct

SEQ ID NO: 8079916 - DNA, 22 bp, Homo sapiens
ttgtttaatgcctcatacatct

SEQ ID NO: 8079917 - DNA, 22 bp, Homo sapiens
ttgtttaatgcctcatacatct

SEQ ID NO: 8079918 - DNA, 22 bp, Homo sapiens
ttgtttaatatcgtgaagtact

SEQ ID NO: 8079919 - DNA, 22 bp, Homo sapiens
ctccccagctcgcgggtgacgg

SEQ ID NO: 8079920 - DNA, 22 bp, Homo sapiens
ctccctggctttgtcctgaggc

SEQ ID NO: 8079921 - DNA, 22 bp, Homo sapiens
ctgcctctggcctcaggcccag

SEQ ID NO: 8079922 - DNA, 20 bp, Homo sapiens
ctgccctgccctgggtcctg

SEQ ID NO: 8079923 - DNA, 22 bp, Homo sapiens
ctgcaggggctggagttggctt

SEQ ID NO: 8079924 - DNA, 20 bp, Homo sapiens
ctgctgccctgtcagcctct

SEQ ID NO: 8079925 - DNA, 19 bp, Homo sapiens
ctgctctccttgacttgga

SEQ ID NO: 8079926 - DNA, 22 bp, Homo sapiens
ctgctcctctgaggtagccaca

SEQ ID NO: 8079927 - DNA, 22 bp, Homo sapiens
ctgaatatcatttacatttgga

SEQ ID NO: 8079928 - DNA, 22 bp, Homo sapiens
ttttctcaggtgcttatctaag

SEQ ID NO: 8079929 - DNA, 22 bp, Homo sapiens
ttttctcccgctggctgctctt

SEQ ID NO: 8079930 - DNA, 22 bp, Homo sapiens
tttttctagctcaaagattcta

SEQ ID NO: 8079931 - DNA, 22 bp, Homo sapiens
tttttctagaccttaaaggcca

SEQ ID NO: 8079932 - DNA, 22 bp, Homo sapiens
tttttctagctcaaagattcta

SEQ ID NO: 8079933 - DNA, 19 bp, Homo sapiens
tttttacaagtaggtgtga

SEQ ID NO: 8079934 - DNA, 22 bp, Homo sapiens
tttttctgtctcttacattgca

SEQ ID NO: 8079935 - DNA, 20 bp, Homo sapiens
tttttctgggcttccatagc

SEQ ID NO: 8079936 - DNA, 22 bp, Homo sapiens
ctgaaacattgcaataacaaag

SEQ ID NO: 8079937 - DNA, 22 bp, Homo sapiens
cctgtaaatagtttcttctgac

SEQ ID NO: 8079938 - DNA, 22 bp, Homo sapiens
ttaaaatctaaagcagttgtct

SEQ ID NO: 8079939 - DNA, 22 bp, Homo sapiens
ttaaaatctaaagcagttgtct

SEQ ID NO: 8079940 - DNA, 22 bp, Homo sapiens
ttaagctagtgaagtccctcaa

SEQ ID NO: 8079941 - DNA, 22 bp, Homo sapiens
ttaagctaattagttccagcat

SEQ ID NO: 8079942 - DNA, 19 bp, Homo sapiens
ttaagctaagatactagta

SEQ ID NO: 8079943 - DNA, 22 bp, Homo sapiens
ttaagctatacattgttagagt

SEQ ID NO: 8079944 - DNA, 22 bp, Homo sapiens
ttaatatgttgaaatttattag

SEQ ID NO: 8079945 - DNA, 18 bp, Homo sapiens
cctgtggctcagcccaca

SEQ ID NO: 8079946 - DNA, 22 bp, Homo sapiens
cctgtggcgggggccagtgcct

SEQ ID NO: 8079947 - DNA, 22 bp, Homo sapiens
ttacaatagttccttcttttgt

SEQ ID NO: 8079948 - DNA, 22 bp, Homo sapiens
ttacaatagttccttcttttgt

SEQ ID NO: 8079949 - DNA, 22 bp, Homo sapiens
ttaatgcagctctaccacacag

SEQ ID NO: 8079950 - DNA, 22 bp, Homo sapiens
ttaatgatacctatgttaattt

SEQ ID NO: 8079951 - DNA, 19 bp, Homo sapiens
tgtttcttcctccatctga

SEQ ID NO: 8079952 - DNA, 22 bp, Homo sapiens
tgtttcttctcacacaaactca

SEQ ID NO: 8079953 - DNA, 22 bp, Homo sapiens
tgtttcttgagagtattaccct

SEQ ID NO: 8079954 - DNA, 22 bp, Homo sapiens
tgtttctaggtcaataattttt

SEQ ID NO: 8079955 - DNA, 22 bp, Homo sapiens
tggttcctcaagcgctggcggc

SEQ ID NO: 8079956 - DNA, 19 bp, Homo sapiens
tgttgccaggtatcatgtt

SEQ ID NO: 8079957 - DNA, 22 bp, Homo sapiens
ttattattttgtgtacagcaaa

SEQ ID NO: 8079958 - DNA, 22 bp, Homo sapiens
ttattattgtgacctgagaatg

SEQ ID NO: 8079959 - DNA, 22 bp, Homo sapiens
ttatttttaaaagttcacacag

SEQ ID NO: 8079960 - DNA, 22 bp, Homo sapiens
ttcaaaaaggtatgttcaagtc

SEQ ID NO: 8079961 - DNA, 22 bp, Homo sapiens
ttcaaaaaggtatgttcaagtc

SEQ ID NO: 8079962 - DNA, 22 bp, Homo sapiens
ttatttttaaaagttcacacag

SEQ ID NO: 8079963 - DNA, 17 bp, Homo sapiens
ttattttttgggctgag

SEQ ID NO: 8079964 - DNA, 22 bp, Homo sapiens
cctttaaatggatgttcaactg

SEQ ID NO: 8079965 - DNA, 22 bp, Homo sapiens
cctttaaagactgcataacttc

SEQ ID NO: 8079966 - DNA, 22 bp, Homo sapiens
ccttggggaactggacgtgctg

SEQ ID NO: 8079967 - DNA, 22 bp, Homo sapiens
ttaccattttataagttaaagt

SEQ ID NO: 8079968 - DNA, 22 bp, Homo sapiens
ccttcttcaccagtttacctga

SEQ ID NO: 8079969 - DNA, 23 bp, Homo sapiens
ccttctgttaaccatctgggggg

SEQ ID NO: 8079970 - DNA, 22 bp, Homo sapiens
ccttctgtctccctcatattga

SEQ ID NO: 8079971 - DNA, 22 bp, Homo sapiens
ccttctgtgtgcccacgtttat

SEQ ID NO: 8079972 - DNA, 22 bp, Homo sapiens
ttacagaagtattgagagatcc

SEQ ID NO: 8079973 - DNA, 22 bp, Homo sapiens
ttacagaagagaaagaattcag

SEQ ID NO: 8079974 - DNA, 22 bp, Homo sapiens
ttacagaagagtaacttggcaa

SEQ ID NO: 8079975 - DNA, 22 bp, Homo sapiens
ttacagaactgtcttgaaattt

SEQ ID NO: 8079976 - DNA, 22 bp, Homo sapiens
ttacagaactgtcttgaaattt

SEQ ID NO: 8079977 - DNA, 20 bp, Homo sapiens
ttacagaaatgatgttattt

SEQ ID NO: 8079978 - DNA, 23 bp, Homo sapiens
ttacagaaagtatgcttttgttt

SEQ ID NO: 8079979 - DNA, 22 bp, Homo sapiens
ttgcaaaaactgcaattacttt

SEQ ID NO: 8079980 - DNA, 22 bp, Homo sapiens
ttgcaaaaactgcaattacttt

SEQ ID NO: 8079981 - DNA, 22 bp, Homo sapiens
ttgcaaaaaccacaattacttt

SEQ ID NO: 8079982 - DNA, 22 bp, Homo sapiens
ttgcaaaaaccacaattacttt

SEQ ID NO: 8079983 - DNA, 22 bp, Homo sapiens
ttgctgattgtagcatgatgat

SEQ ID NO: 8079984 - DNA, 16 bp, Homo sapiens
ttgccgcacaggtcgc

SEQ ID NO: 8079985 - DNA, 22 bp, Homo sapiens
ttgcactttatagaaacttttg

SEQ ID NO: 8079986 - DNA, 22 bp, Homo sapiens
ttgcacttatcctagcaaaagg

SEQ ID NO: 8079987 - DNA, 22 bp, Homo sapiens
ttgcctatgtaactttatattt

SEQ ID NO: 8079988 - DNA, 22 bp, Homo sapiens
ttcttaatcccacaaatcttca

SEQ ID NO: 8079989 - DNA, 22 bp, Homo sapiens
ttcttaatacctattttctacc

SEQ ID NO: 8079990 - DNA, 22 bp, Homo sapiens
ttcttacaaacaagatcattga

SEQ ID NO: 8079991 - DNA, 22 bp, Homo sapiens
ttcttaatggcaaaggatttta

SEQ ID NO: 8079992 - DNA, 22 bp, Homo sapiens
ttcttaactggaaaatgtcaga

SEQ ID NO: 8079993 - DNA, 20 bp, Homo sapiens
ttcttaaagacctcactttg

SEQ ID NO: 8079994 - DNA, 22 bp, Homo sapiens
ctataaatctacccagcattgg

SEQ ID NO: 8079995 - DNA, 22 bp, Homo sapiens
ctataaatctacccagcattgg

SEQ ID NO: 8079996 - DNA, 22 bp, Homo sapiens
ctataaatctacccagcattgg

SEQ ID NO: 8079997 - DNA, 22 bp, Homo sapiens
ttctctttttgcatctcaacct

SEQ ID NO: 8079998 - DNA, 22 bp, Homo sapiens
ttctgtccgcttgtttgttaga

SEQ ID NO: 8079999 - DNA, 22 bp, Homo sapiens
ttctgtcccactggtctgtttg

SEQ ID NO: 8080000 - DNA, 22 bp, Homo sapiens
ttcttaaaattcaagctaggtt

SEQ ID NO: 8080001 - DNA, 22 bp, Homo sapiens
ttctgaaagccaattcattgaa

SEQ ID NO: 8080002 - DNA, 22 bp, Homo sapiens
ttctgaaagtctttttaagtta

SEQ ID NO: 8080003 - DNA, 22 bp, Homo sapiens
ctacattaaattggcttactta

SEQ ID NO: 8080004 - DNA, 22 bp, Homo sapiens
ctacagttcttaattaagtagt

SEQ ID NO: 8080005 - DNA, 22 bp, Homo sapiens
ttctaccagaccccagacttgt

SEQ ID NO: 8080006 - DNA, 22 bp, Homo sapiens
ctaaattatcatgagaattatg

SEQ ID NO: 8080007 - DNA, 22 bp, Homo sapiens
ttcctttttacataatcacatt

SEQ ID NO: 8080008 - DNA, 22 bp, Homo sapiens
ttctacagaataaatgtttaca

SEQ ID NO: 8080009 - DNA, 22 bp, Homo sapiens
ttctcatatgcactctatttga

SEQ ID NO: 8080010 - DNA, 22 bp, Homo sapiens
ttctcatacaggatctcttatt

SEQ ID NO: 8080011 - DNA, 22 bp, Homo sapiens
ttctcctttgtaattctcatcc

SEQ ID NO: 8080012 - DNA, 21 bp, Homo sapiens
ttctccttcttgatccaagca

SEQ ID NO: 8080013 - DNA, 22 bp, Homo sapiens
ctagtgtttggaagtcatagcc

SEQ ID NO: 8080014 - DNA, 22 bp, Homo sapiens
ttccactctccagtcaatttca

SEQ ID NO: 8080015 - DNA, 22 bp, Homo sapiens
ctaaatgatggatttaaacttt

SEQ ID NO: 8080016 - DNA, 22 bp, Homo sapiens
cgtgaattctttccctgtcact

SEQ ID NO: 8080017 - DNA, 22 bp, Homo sapiens
cgtgaattttccgtcgctaact

SEQ ID NO: 8080018 - DNA, 22 bp, Homo sapiens
ttccaccaggagatatttcaaa

SEQ ID NO: 8080019 - DNA, 22 bp, Homo sapiens
ttccaaattaaaatgtacaatg

SEQ ID NO: 8080020 - DNA, 22 bp, Homo sapiens
ttcagtttcaagtccctctggg

SEQ ID NO: 8080021 - DNA, 22 bp, Homo sapiens
ttcagtttcagtcttgcaaaaa

SEQ ID NO: 8080022 - DNA, 22 bp, Homo sapiens
ttcagtttccacttacatttaa

SEQ ID NO: 8080023 - DNA, 22 bp, Homo sapiens
ttcagtttgaattctgtagaac

SEQ ID NO: 8080024 - DNA, 18 bp, Homo sapiens
ttcagtttctagttcctt

SEQ ID NO: 8080025 - DNA, 22 bp, Homo sapiens
ttcagtttcttccctgtgaaat

SEQ ID NO: 8080026 - DNA, 22 bp, Homo sapiens
ttcagtttcgttatctatgaga

SEQ ID NO: 8080027 - DNA, 22 bp, Homo sapiens
ttcagtttcgttatctatgaga

SEQ ID NO: 8080028 - DNA, 19 bp, Homo sapiens
ttcagtttcctcatctgga

SEQ ID NO: 8080029 - DNA, 22 bp, Homo sapiens
gggagctgagctctgagccacg

SEQ ID NO: 8080030 - DNA, 19 bp, Homo sapiens
gggcagtggcactagggag

SEQ ID NO: 8080031 - DNA, 22 bp, Homo sapiens
gggcagtgttgctctcaaagtc

SEQ ID NO: 8080032 - DNA, 22 bp, Homo sapiens
gggcagtgattttccttagagg

SEQ ID NO: 8080033 - DNA, 22 bp, Homo sapiens
gggcagtgacaaaggggatgaa

SEQ ID NO: 8080034 - DNA, 23 bp, Homo sapiens
gggcaggtttttataggcttcag

SEQ ID NO: 8080035 - DNA, 22 bp, Homo sapiens
ggcgtgctgcccgggcctgctg

SEQ ID NO: 8080036 - DNA, 22 bp, Homo sapiens
ggctaattttcagtgttcatag

SEQ ID NO: 8080037 - DNA, 22 bp, Homo sapiens
ggctctggtgtgaagcagcctc

SEQ ID NO: 8080038 - DNA, 17 bp, Homo sapiens
ggctctgggtgtcacat

SEQ ID NO: 8080039 - DNA, 22 bp, Homo sapiens
ggctcctgagaatgggccatca

SEQ ID NO: 8080040 - DNA, 22 bp, Homo sapiens
ggctcctgaggaccaggcacag

SEQ ID NO: 8080041 - DNA, 22 bp, Homo sapiens
ggctctgggtctgtggggagcg

SEQ ID NO: 8080042 - DNA, 22 bp, Homo sapiens
ggctctggggttggcccatctc

SEQ ID NO: 8080043 - DNA, 22 bp, Homo sapiens
ggctctggggggaagtctgttg

SEQ ID NO: 8080044 - DNA, 22 bp, Homo sapiens
ggctctgggcctccaaggtctg

SEQ ID NO: 8080045 - DNA, 22 bp, Homo sapiens
ggctggtcacaccactgcaggg

SEQ ID NO: 8080046 - DNA, 22 bp, Homo sapiens
ggctggtctcagtgctgggttc

SEQ ID NO: 8080047 - DNA, 21 bp, Homo sapiens
ggctggtcgcgtgcatgtctc

SEQ ID NO: 8080048 - DNA, 22 bp, Homo sapiens
ggctggtcctttctctgtccta

SEQ ID NO: 8080049 - DNA, 17 bp, Homo sapiens
ggctgtgccaggtgaga

SEQ ID NO: 8080050 - DNA, 22 bp, Homo sapiens
ggctgcttgtcagcagctggcc

SEQ ID NO: 8080051 - DNA, 22 bp, Homo sapiens
ggctggaatagagactgactgg

SEQ ID NO: 8080052 - DNA, 22 bp, Homo sapiens
ggctgctgtttcagagactgtt

SEQ ID NO: 8080053 - DNA, 22 bp, Homo sapiens
ggctgctggggacgtgggagag

SEQ ID NO: 8080054 - DNA, 22 bp, Homo sapiens
ggcagggtggccctccagtgag

SEQ ID NO: 8080055 - DNA, 22 bp, Homo sapiens
ggcagggtggcagaggctcaga

SEQ ID NO: 8080056 - DNA, 17 bp, Homo sapiens
ggcagggtgctgggtat

SEQ ID NO: 8080057 - DNA, 22 bp, Homo sapiens
ggcagggtttctccattctgcc

SEQ ID NO: 8080058 - DNA, 22 bp, Homo sapiens
ggcagggtgtggagttgggaca

SEQ ID NO: 8080059 - DNA, 22 bp, Homo sapiens
ggcagggtgcctggctcctgtt

SEQ ID NO: 8080060 - DNA, 22 bp, Homo sapiens
ggcagggtccacacctgggaaa

SEQ ID NO: 8080061 - DNA, 22 bp, Homo sapiens
ggcagggtaaaccgaggtaagt

SEQ ID NO: 8080062 - DNA, 22 bp, Homo sapiens
ggcaggggtggccttcctttgg

SEQ ID NO: 8080063 - DNA, 22 bp, Homo sapiens
ggcaggaggaagagttagcacc

SEQ ID NO: 8080064 - DNA, 23 bp, Homo sapiens
ggcatgcaatggacagagctgga

SEQ ID NO: 8080065 - DNA, 22 bp, Homo sapiens
ggcatgcttgccatgggccagt

SEQ ID NO: 8080066 - DNA, 21 bp, Homo sapiens
ggcatcccaggccagtgactg

SEQ ID NO: 8080067 - DNA, 22 bp, Homo sapiens
ggcatccctagaatagccaggt

SEQ ID NO: 8080068 - DNA, 22 bp, Homo sapiens
ggcctgctctggctgtggtcag

SEQ ID NO: 8080069 - DNA, 22 bp, Homo sapiens
ggcctgctctggctgtggtcag

SEQ ID NO: 8080070 - DNA, 22 bp, Homo sapiens
ggcctgcttctcagtgagcttg

SEQ ID NO: 8080071 - DNA, 22 bp, Homo sapiens
ggcctcacccatcggtgccttt

SEQ ID NO: 8080072 - DNA, 22 bp, Homo sapiens
ggcactgccccctgcccaggac

SEQ ID NO: 8080073 - DNA, 22 bp, Homo sapiens
ggcactgggtgagggtcactgg

SEQ ID NO: 8080074 - DNA, 22 bp, Homo sapiens
ggcagaagataggacagggaat

SEQ ID NO: 8080075 - DNA, 22 bp, Homo sapiens
ggcagccagcgggtggacgcgc

SEQ ID NO: 8080076 - DNA, 22 bp, Homo sapiens
ggcagccatgctccaggtgcag

SEQ ID NO: 8080077 - DNA, 22 bp, Homo sapiens
ggagcacagccttgccagtacc

SEQ ID NO: 8080078 - DNA, 22 bp, Homo sapiens
gtgcacactcttggggcacttt

SEQ ID NO: 8080079 - DNA, 22 bp, Homo sapiens
gtgcccaggggccagctgccgg

SEQ ID NO: 8080080 - DNA, 22 bp, Homo sapiens
gtgatttagtgttaagtatgtt

SEQ ID NO: 8080081 - DNA, 22 bp, Homo sapiens
gtgatttagtgagaggcagctg

SEQ ID NO: 8080082 - DNA, 22 bp, Homo sapiens
gtgctggtatatgactgagttt

SEQ ID NO: 8080083 - DNA, 22 bp, Homo sapiens
gtcttcttgtgttgcctgtctt

SEQ ID NO: 8080084 - DNA, 22 bp, Homo sapiens
gtcttcttttcagtctgcttgt

SEQ ID NO: 8080085 - DNA, 22 bp, Homo sapiens
gtctcctgagactgcagtcacc

SEQ ID NO: 8080086 - DNA, 22 bp, Homo sapiens
gtctcctgcccccggtgcttgg

SEQ ID NO: 8080087 - DNA, 22 bp, Homo sapiens
gtcctctgcccaggtcaaggtt

SEQ ID NO: 8080088 - DNA, 22 bp, Homo sapiens
gtcatttattctggtcaattca

SEQ ID NO: 8080089 - DNA, 22 bp, Homo sapiens
gtcatttaggtctgtcagaaat

SEQ ID NO: 8080090 - DNA, 22 bp, Homo sapiens
gtcatttatcatcagaagtcat

SEQ ID NO: 8080091 - DNA, 22 bp, Homo sapiens
gtcatttaaaagggaacacatg

SEQ ID NO: 8080092 - DNA, 23 bp, Homo sapiens
gtcagggctggggtcagagtgac

SEQ ID NO: 8080093 - DNA, 22 bp, Homo sapiens
gtcagtggtagggctagttcag

SEQ ID NO: 8080094 - DNA, 22 bp, Homo sapiens
gtcacaggtgtggaggtgctgg

SEQ ID NO: 8080095 - DNA, 22 bp, Homo sapiens
gtcaatcagaaatcatgttaca

SEQ ID NO: 8080096 - DNA, 22 bp, Homo sapiens
gtcaattagctaaaatttggta

SEQ ID NO: 8080097 - DNA, 22 bp, Homo sapiens
gtaaatttcccgggccatttaa

SEQ ID NO: 8080098 - DNA, 22 bp, Homo sapiens
gtaacaaacggttccaagatgc

SEQ ID NO: 8080099 - DNA, 22 bp, Homo sapiens
ggtgggcagctcttggcaggca

SEQ ID NO: 8080100 - DNA, 22 bp, Homo sapiens
gtcaacaaggtttgcttatctt

SEQ ID NO: 8080101 - DNA, 22 bp, Homo sapiens
gtcaacaagtagttttcttcca

SEQ ID NO: 8080102 - DNA, 22 bp, Homo sapiens
gtcaacaattccagtttttact

SEQ ID NO: 8080103 - DNA, 22 bp, Homo sapiens
ggtcagggggatctgtgaggta

SEQ ID NO: 8080104 - DNA, 22 bp, Homo sapiens
ggtcagggctcttccagtggct

SEQ ID NO: 8080105 - DNA, 22 bp, Homo sapiens
ggtagccaaagagcctgggccc

SEQ ID NO: 8080106 - DNA, 22 bp, Homo sapiens
gggtcagggctggctgtcgtca

SEQ ID NO: 8080107 - DNA, 22 bp, Homo sapiens
gggtcaggaagaattctgccaa

SEQ ID NO: 8080108 - DNA, 22 bp, Homo sapiens
gggtcaggcctcaaggtgggct

SEQ ID NO: 8080109 - DNA, 22 bp, Homo sapiens
gggtcagggctgcctgggctca

SEQ ID NO: 8080110 - DNA, 22 bp, Homo sapiens
ggtaataaaattgtgtcaaaca

SEQ ID NO: 8080111 - DNA, 22 bp, Homo sapiens
ggtaaattttatgtgatgaaac

SEQ ID NO: 8080112 - DNA, 22 bp, Homo sapiens
ggtaacaaccctacaaatccac

SEQ ID NO: 8080113 - DNA, 22 bp, Homo sapiens
ggtaacaaggccgatagaaaca

SEQ ID NO: 8080114 - DNA, 22 bp, Homo sapiens
ggtgcccaaggaaggttgccgt

SEQ ID NO: 8080115 - DNA, 22 bp, Homo sapiens
ggtgcccagcgaagtggctgtg

SEQ ID NO: 8080116 - DNA, 22 bp, Homo sapiens
ggtgccacataaatggagagag

SEQ ID NO: 8080117 - DNA, 22 bp, Homo sapiens
ggtcttgctatgttgcccaggc

SEQ ID NO: 8080118 - DNA, 20 bp, Homo sapiens
ggtgcaggtaacgctgtgct

SEQ ID NO: 8080119 - DNA, 22 bp, Homo sapiens
ggtgaattgaccaaaatcagac

SEQ ID NO: 8080120 - DNA, 22 bp, Homo sapiens
ggtgaattctaggagatctgac

SEQ ID NO: 8080121 - DNA, 22 bp, Homo sapiens
ggtgaattctcagcttttacaa

SEQ ID NO: 8080122 - DNA, 22 bp, Homo sapiens
ggtgaattctaggagatctgac

SEQ ID NO: 8080123 - DNA, 22 bp, Homo sapiens
ggtgaattaatgatggtaaggc

SEQ ID NO: 8080124 - DNA, 22 bp, Homo sapiens
ggtgcagggagaggcaggcccc

SEQ ID NO: 8080125 - DNA, 22 bp, Homo sapiens
gggggactggaccgtcctgggt

SEQ ID NO: 8080126 - DNA, 22 bp, Homo sapiens
ggggcaggaggtgttctctttt

SEQ ID NO: 8080127 - DNA, 22 bp, Homo sapiens
ggggcaggagcccttcttcagc

SEQ ID NO: 8080128 - DNA, 22 bp, Homo sapiens
gggggactaactggatcctgga

SEQ ID NO: 8080129 - DNA, 22 bp, Homo sapiens
ggggcagctcccgagggcagga

SEQ ID NO: 8080130 - DNA, 22 bp, Homo sapiens
gggcctgcaggttctgagaggc

SEQ ID NO: 8080131 - DNA, 22 bp, Homo sapiens
gggcatgcctgagcctgccact

SEQ ID NO: 8080132 - DNA, 22 bp, Homo sapiens
gcacaggcatcaggctttttct

SEQ ID NO: 8080133 - DNA, 22 bp, Homo sapiens
gcacagcttcctctttctctga

SEQ ID NO: 8080134 - DNA, 22 bp, Homo sapiens
gcagcatgtgccttaaatcatt

SEQ ID NO: 8080135 - DNA, 22 bp, Homo sapiens
gcagcatgttgaaagggccaca

SEQ ID NO: 8080136 - DNA, 22 bp, Homo sapiens
gcagggctaggtcttctagggc

SEQ ID NO: 8080137 - DNA, 22 bp, Homo sapiens
gcagggctattggaaggagatg

SEQ ID NO: 8080138 - DNA, 22 bp, Homo sapiens
gcagggcggcccagagcaggcc

SEQ ID NO: 8080139 - DNA, 22 bp, Homo sapiens
gcagggctaatggggcaagtag

SEQ ID NO: 8080140 - DNA, 22 bp, Homo sapiens
gcaggagctggaaagtgatgtt

SEQ ID NO: 8080141 - DNA, 22 bp, Homo sapiens
gcatcttcacacaaagccagtg

SEQ ID NO: 8080142 - DNA, 22 bp, Homo sapiens
gcatttctgtgcatacacatga

SEQ ID NO: 8080143 - DNA, 22 bp, Homo sapiens
gcagtcagacaggaggagctcc

SEQ ID NO: 8080144 - DNA, 22 bp, Homo sapiens
gcagtcagtaaggcagccagaa

SEQ ID NO: 8080145 - DNA, 22 bp, Homo sapiens
gcagggctccactgtggccaag

SEQ ID NO: 8080146 - DNA, 22 bp, Homo sapiens
gcagggctcattgccaggcatt

SEQ ID NO: 8080147 - DNA, 22 bp, Homo sapiens
gcattttaatgaggtttatgag

SEQ ID NO: 8080148 - DNA, 22 bp, Homo sapiens
gcattttaataagattcatagg

SEQ ID NO: 8080149 - DNA, 22 bp, Homo sapiens
gccagcccagctccaggggaaa

SEQ ID NO: 8080150 - DNA, 22 bp, Homo sapiens
gcccagtgtctaggaggtgaac

SEQ ID NO: 8080151 - DNA, 22 bp, Homo sapiens
gcccatcttctagcagctgtta

SEQ ID NO: 8080152 - DNA, 22 bp, Homo sapiens
gcccaggggcagcgcatagtgg

SEQ ID NO: 8080153 - DNA, 22 bp, Homo sapiens
gcccagggcttcaaagagagaa

SEQ ID NO: 8080154 - DNA, 22 bp, Homo sapiens
gcccaggggagtagtcaattta

SEQ ID NO: 8080155 - DNA, 22 bp, Homo sapiens
gcccagggctgcaagtggacgc

SEQ ID NO: 8080156 - DNA, 22 bp, Homo sapiens
gcccagggcgatggtcggggcc

SEQ ID NO: 8080157 - DNA, 22 bp, Homo sapiens
gcccagggcagggcaagagtga

SEQ ID NO: 8080158 - DNA, 23 bp, Homo sapiens
gcccagggactgggaatcagtgg

SEQ ID NO: 8080159 - DNA, 22 bp, Homo sapiens
gcctcagagggccctagggaca

SEQ ID NO: 8080160 - DNA, 22 bp, Homo sapiens
gcctcagacactgcctgggtgt

SEQ ID NO: 8080161 - DNA, 22 bp, Homo sapiens
gccaggagaatgctagcagagg

SEQ ID NO: 8080162 - DNA, 22 bp, Homo sapiens
gcccactggctggagtgctggt

SEQ ID NO: 8080163 - DNA, 22 bp, Homo sapiens
gccagtggcttgccaggcagga

SEQ ID NO: 8080164 - DNA, 22 bp, Homo sapiens
gccagtggcatgcggcagggac

SEQ ID NO: 8080165 - DNA, 22 bp, Homo sapiens
gccagtggatgaggacttaact

SEQ ID NO: 8080166 - DNA, 22 bp, Homo sapiens
gccagtggagcacatggtgaag

SEQ ID NO: 8080167 - DNA, 22 bp, Homo sapiens
gccagtggaggacccatggaga

SEQ ID NO: 8080168 - DNA, 22 bp, Homo sapiens
gccagtggccctctggagaagg

SEQ ID NO: 8080169 - DNA, 22 bp, Homo sapiens
gccagtggagactgaaacccat

SEQ ID NO: 8080170 - DNA, 22 bp, Homo sapiens
gctggctccaaaagcaggggct

SEQ ID NO: 8080171 - DNA, 21 bp, Homo sapiens
gctggctcaaatgcttgtgtc

SEQ ID NO: 8080172 - DNA, 22 bp, Homo sapiens
gctggctgccaatttcagagct

SEQ ID NO: 8080173 - DNA, 22 bp, Homo sapiens
gctggctcggatttgaacagga

SEQ ID NO: 8080174 - DNA, 22 bp, Homo sapiens
gctggctcccattggtccttcc

SEQ ID NO: 8080175 - DNA, 21 bp, Homo sapiens
gctggctctctgacgtgcttt

SEQ ID NO: 8080176 - DNA, 22 bp, Homo sapiens
gctggctcgggaagcaggggat

SEQ ID NO: 8080177 - DNA, 22 bp, Homo sapiens
gctgggaggatctctccctgtc

SEQ ID NO: 8080178 - DNA, 22 bp, Homo sapiens
gctggtcactctgggagctgct

SEQ ID NO: 8080179 - DNA, 22 bp, Homo sapiens
gctgtgaacatgcacatggagt

SEQ ID NO: 8080180 - DNA, 22 bp, Homo sapiens
gctgtgaagaacctagtgaacc

SEQ ID NO: 8080181 - DNA, 22 bp, Homo sapiens
gctgtgaaacctcagtgatagt

SEQ ID NO: 8080182 - DNA, 22 bp, Homo sapiens
gctgtgaattattcttaactgg

SEQ ID NO: 8080183 - DNA, 22 bp, Homo sapiens
gctgtgaatctgaagactaaaa

SEQ ID NO: 8080184 - DNA, 22 bp, Homo sapiens
gctgtgaagaggccactgcatg

SEQ ID NO: 8080185 - DNA, 22 bp, Homo sapiens
gctgtgcagccaagtgcctctg

SEQ ID NO: 8080186 - DNA, 21 bp, Homo sapiens
gctgtgcaggtgcccctgctc

SEQ ID NO: 8080187 - DNA, 22 bp, Homo sapiens
gctgtgcaggtccccactgcct

SEQ ID NO: 8080188 - DNA, 22 bp, Homo sapiens
gcttcctgagaaacaatctgat

SEQ ID NO: 8080189 - DNA, 18 bp, Homo sapiens
gcttcctgaaagctgccc

SEQ ID NO: 8080190 - DNA, 22 bp, Homo sapiens
ggaagccagagtgctgggcagg

SEQ ID NO: 8080191 - DNA, 22 bp, Homo sapiens
ggaacataccgaaaatacttaa

SEQ ID NO: 8080192 - DNA, 22 bp, Homo sapiens
ggagaggagctattgggggctc

SEQ ID NO: 8080193 - DNA, 23 bp, Homo sapiens
gctgcagctgtggatgttctcag

SEQ ID NO: 8080194 - DNA, 22 bp, Homo sapiens
gctgcaggagattttgagagtc

SEQ ID NO: 8080195 - DNA, 22 bp, Homo sapiens
gctgcaggagctggagctgtgg

SEQ ID NO: 8080196 - DNA, 22 bp, Homo sapiens
gctgcaggatgaggctctgctc

SEQ ID NO: 8080197 - DNA, 22 bp, Homo sapiens
gctgcagggggtgggcgtctcc

SEQ ID NO: 8080198 - DNA, 22 bp, Homo sapiens
gctgcaggttgggcaacagagt

SEQ ID NO: 8080199 - DNA, 22 bp, Homo sapiens
gctgccagctcactctcctgag

SEQ ID NO: 8080200 - DNA, 20 bp, Homo sapiens
gctgccagggcggagacatc

SEQ ID NO: 8080201 - DNA, 20 bp, Homo sapiens
gctgaaggggtgggtttgtt

SEQ ID NO: 8080202 - DNA, 22 bp, Homo sapiens
gctgaaggtatgagttttatct

SEQ ID NO: 8080203 - DNA, 22 bp, Homo sapiens
gctgaaggtggttttcaagtat

SEQ ID NO: 8080204 - DNA, 21 bp, Homo sapiens
gctgaaggtgggttgtacagg

SEQ ID NO: 8080205 - DNA, 22 bp, Homo sapiens
gctgatagactgaatgttggga

SEQ ID NO: 8080206 - DNA, 23 bp, Homo sapiens
gctctggcagcttgtgtcagcac

SEQ ID NO: 8080207 - DNA, 17 bp, Homo sapiens
gctctgccccagcctct

SEQ ID NO: 8080208 - DNA, 17 bp, Homo sapiens
gctctgcctctcccacc

SEQ ID NO: 8080209 - DNA, 22 bp, Homo sapiens
gctctgccttctcactgggttc

SEQ ID NO: 8080210 - DNA, 22 bp, Homo sapiens
gctcctggtctggagcttcaag

SEQ ID NO: 8080211 - DNA, 22 bp, Homo sapiens
gcctggcttcccttggagcatt

SEQ ID NO: 8080212 - DNA, 21 bp, Homo sapiens
gcctggcttcacaggcactga

SEQ ID NO: 8080213 - DNA, 22 bp, Homo sapiens
gcctggcttgccagccctggcg

SEQ ID NO: 8080214 - DNA, 22 bp, Homo sapiens
gcctggcttggggctcagtggt

SEQ ID NO: 8080215 - DNA, 22 bp, Homo sapiens
gcctggctggtagagggggctc

SEQ ID NO: 8080216 - DNA, 22 bp, Homo sapiens
gcctggctggtcactgcctggc

SEQ ID NO: 8080217 - DNA, 22 bp, Homo sapiens
gcctggctgcttagcctacttc

SEQ ID NO: 8080218 - DNA, 22 bp, Homo sapiens
gcctggctgggcaccaggggag

SEQ ID NO: 8080219 - DNA, 22 bp, Homo sapiens
gcctggctgggctgaatgctta

SEQ ID NO: 8080220 - DNA, 19 bp, Homo sapiens
gcctggctgggatgagccc

SEQ ID NO: 8080221 - DNA, 22 bp, Homo sapiens
gcctggctgccggccttggcaa

SEQ ID NO: 8080222 - DNA, 22 bp, Homo sapiens
gcctggctagttagtgtcaggt

SEQ ID NO: 8080223 - DNA, 22 bp, Homo sapiens
gcctggctgctcagccactcac

SEQ ID NO: 8080224 - DNA, 22 bp, Homo sapiens
gcctcagggataggatgagcat

SEQ ID NO: 8080225 - DNA, 22 bp, Homo sapiens
gcctggtggtgtgctcaagtgg

SEQ ID NO: 8080226 - DNA, 22 bp, Homo sapiens
gcctggtgataagcagtgacct

SEQ ID NO: 8080227 - DNA, 22 bp, Homo sapiens
gcctggggccagcttgggctga

SEQ ID NO: 8080228 - DNA, 22 bp, Homo sapiens
gccttctgatatctcttggcat

SEQ ID NO: 8080229 - DNA, 22 bp, Homo sapiens
gccttttttgttgctctgtcac

SEQ ID NO: 8080230 - DNA, 22 bp, Homo sapiens
gcggcaggaagagcgcagcccc

SEQ ID NO: 8080231 - DNA, 22 bp, Homo sapiens
gctcacagccggctggcagggg

SEQ ID NO: 8080232 - DNA, 22 bp, Homo sapiens
gctcacaggcagtgttgggaga

SEQ ID NO: 8080233 - DNA, 22 bp, Homo sapiens
gctcacagcccaggccagcgtg

SEQ ID NO: 8080234 - DNA, 22 bp, Homo sapiens
gctcacagagggtgcttaatac

SEQ ID NO: 8080235 - DNA, 22 bp, Homo sapiens
gctcacagaacttctcttccca

SEQ ID NO: 8080236 - DNA, 23 bp, Homo sapiens
gctcacagaatgttgaagggaat

SEQ ID NO: 8080237 - DNA, 22 bp, Homo sapiens
gctcacagaagtgttttttcca

SEQ ID NO: 8080238 - DNA, 23 bp, Homo sapiens
gctcacagggtgtaactcctagt

SEQ ID NO: 8080239 - DNA, 22 bp, Homo sapiens
gctcacaggtctgtggctattg

SEQ ID NO: 8080240 - DNA, 22 bp, Homo sapiens
gctcacaggggcagacgagttg

SEQ ID NO: 8080241 - DNA, 22 bp, Homo sapiens
gctcacagtacagtgctggctc

SEQ ID NO: 8080242 - DNA, 22 bp, Homo sapiens
gctcacagtctgctgagtgcag

SEQ ID NO: 8080243 - DNA, 22 bp, Homo sapiens
gctcacagtctggcatagtctc

SEQ ID NO: 8080244 - DNA, 22 bp, Homo sapiens
gctcactgcaacctccacctcc

SEQ ID NO: 8080245 - DNA, 22 bp, Homo sapiens
gctcacagttctatttttcatg

SEQ ID NO: 8080246 - DNA, 22 bp, Homo sapiens
tacttgctgggtgtaattttct

SEQ ID NO: 8080247 - DNA, 22 bp, Homo sapiens
tactgtaatgagattagcttcc

SEQ ID NO: 8080248 - DNA, 22 bp, Homo sapiens
tactgtaatgagattagcttcc

SEQ ID NO: 8080249 - DNA, 22 bp, Homo sapiens
tactgtaatcagggcttaggta

SEQ ID NO: 8080250 - DNA, 22 bp, Homo sapiens
tactgtaatcagggcttaggta

SEQ ID NO: 8080251 - DNA, 22 bp, Homo sapiens
tactgtaaactgtaacttcctt

SEQ ID NO: 8080252 - DNA, 22 bp, Homo sapiens
tactgtaagtcaaatgaaacat

SEQ ID NO: 8080253 - DNA, 22 bp, Homo sapiens
tactgtaaaagacaggcttcct

SEQ ID NO: 8080254 - DNA, 22 bp, Homo sapiens
tacttattggttcagaagttta

SEQ ID NO: 8080255 - DNA, 22 bp, Homo sapiens
tactggaaggctggaagtcagg

SEQ ID NO: 8080256 - DNA, 22 bp, Homo sapiens
tacattccacaagcattgcttt

SEQ ID NO: 8080257 - DNA, 22 bp, Homo sapiens
taccttcaggctgccctttgat

SEQ ID NO: 8080258 - DNA, 22 bp, Homo sapiens
taccttttgcttattatgacac

SEQ ID NO: 8080259 - DNA, 22 bp, Homo sapiens
tactgaaagactgaatatttag

SEQ ID NO: 8080260 - DNA, 22 bp, Homo sapiens
tactgaatatgttttcaagtct

SEQ ID NO: 8080261 - DNA, 22 bp, Homo sapiens
tactgaaatggcagatatataa

SEQ ID NO: 8080262 - DNA, 22 bp, Homo sapiens
tacatacaagatgtgtttaaaa

SEQ ID NO: 8080263 - DNA, 22 bp, Homo sapiens
tacagtttttcactgaagatgt

SEQ ID NO: 8080264 - DNA, 22 bp, Homo sapiens
tacagtttttattcatgacaag

SEQ ID NO: 8080265 - DNA, 22 bp, Homo sapiens
tacagtttttattcatgacaag

SEQ ID NO: 8080266 - DNA, 22 bp, Homo sapiens
tacagtttgttacattgttagt

SEQ ID NO: 8080267 - DNA, 22 bp, Homo sapiens
tacagcacttaattaccttgag

SEQ ID NO: 8080268 - DNA, 22 bp, Homo sapiens
tacagcactgtgcatagtggtt

SEQ ID NO: 8080269 - DNA, 22 bp, Homo sapiens
tacatacagccaagtatgaagt

SEQ ID NO: 8080270 - DNA, 22 bp, Homo sapiens
tacatacatggtggaatggtta

SEQ ID NO: 8080271 - DNA, 22 bp, Homo sapiens
tacatacacaaatatactgttt

SEQ ID NO: 8080272 - DNA, 22 bp, Homo sapiens
tacatacaagcattcaatttta

SEQ ID NO: 8080273 - DNA, 22 bp, Homo sapiens
tacattcatggtgacttgtatg

SEQ ID NO: 8080274 - DNA, 22 bp, Homo sapiens
taagttttctggaataacttgg

SEQ ID NO: 8080275 - DNA, 21 bp, Homo sapiens
taagttctgatccctatcaac

SEQ ID NO: 8080276 - DNA, 22 bp, Homo sapiens
taagttctgagtaaatactgtt

SEQ ID NO: 8080277 - DNA, 22 bp, Homo sapiens
taagttgtattcccttgctttt

SEQ ID NO: 8080278 - DNA, 22 bp, Homo sapiens
taagttcagagttctcatttgt

SEQ ID NO: 8080279 - DNA, 22 bp, Homo sapiens
taatttctaattcattttcagt

SEQ ID NO: 8080280 - DNA, 22 bp, Homo sapiens
taatgcaatttagcaaagtttt

SEQ ID NO: 8080281 - DNA, 21 bp, Homo sapiens
taatgcaaggaactaatgtca

SEQ ID NO: 8080282 - DNA, 22 bp, Homo sapiens
taatgcaaggaattccaagtag

SEQ ID NO: 8080283 - DNA, 22 bp, Homo sapiens
taatgactgtaccaaggcttca

SEQ ID NO: 8080284 - DNA, 22 bp, Homo sapiens
tacaatgaccatattatgtaag

SEQ ID NO: 8080285 - DNA, 22 bp, Homo sapiens
taatttctggagggagaaagag

SEQ ID NO: 8080286 - DNA, 20 bp, Homo sapiens
taatttgatatctataagtt

SEQ ID NO: 8080287 - DNA, 22 bp, Homo sapiens
taattttccactctgtttatct

SEQ ID NO: 8080288 - DNA, 22 bp, Homo sapiens
tacacatgatcatttagtagca

SEQ ID NO: 8080289 - DNA, 21 bp, Homo sapiens
tacacaaagcgtggtccagag

SEQ ID NO: 8080290 - DNA, 22 bp, Homo sapiens
tacacaaaggcactctgttgtt

SEQ ID NO: 8080291 - DNA, 22 bp, Homo sapiens
tacaatgttaaggaaagagaga

SEQ ID NO: 8080292 - DNA, 22 bp, Homo sapiens
gtttcttaaaagaggagttaga

SEQ ID NO: 8080293 - DNA, 22 bp, Homo sapiens
gtttcttaaatgtagcaggacc

SEQ ID NO: 8080294 - DNA, 22 bp, Homo sapiens
gtttcttaatagcaggggccaa

SEQ ID NO: 8080295 - DNA, 22 bp, Homo sapiens
gtttcttaagttacaaaatctt

SEQ ID NO: 8080296 - DNA, 22 bp, Homo sapiens
gtttcttagacagacattatct

SEQ ID NO: 8080297 - DNA, 22 bp, Homo sapiens
gttttacacacctatgaaagac

SEQ ID NO: 8080298 - DNA, 22 bp, Homo sapiens
gttttagtgggtggccactgat

SEQ ID NO: 8080299 - DNA, 23 bp, Homo sapiens
gttttacaggtgagaaaatggag

SEQ ID NO: 8080300 - DNA, 22 bp, Homo sapiens
gtttccttttggaattagagct

SEQ ID NO: 8080301 - DNA, 22 bp, Homo sapiens
gtttcctttgccagtaaatggg

SEQ ID NO: 8080302 - DNA, 22 bp, Homo sapiens
gtttacaaatattttaaatggt

SEQ ID NO: 8080303 - DNA, 22 bp, Homo sapiens
gtttagtgtttcaagactcttt

SEQ ID NO: 8080304 - DNA, 20 bp, Homo sapiens
gtttagtgatgaatagggga

SEQ ID NO: 8080305 - DNA, 22 bp, Homo sapiens
gtttagtgggacagtttaaagt

SEQ ID NO: 8080306 - DNA, 22 bp, Homo sapiens
gtttagcaataaaaacacatga

SEQ ID NO: 8080307 - DNA, 22 bp, Homo sapiens
gtttaattttaggttgtcaagc

SEQ ID NO: 8080308 - DNA, 22 bp, Homo sapiens
gttcctgttgatttcccaggag

SEQ ID NO: 8080309 - DNA, 18 bp, Homo sapiens
gttcccagatggtgctga

SEQ ID NO: 8080310 - DNA, 22 bp, Homo sapiens
gtgttaaacatgttcacagcat

SEQ ID NO: 8080311 - DNA, 22 bp, Homo sapiens
gtgttaaatgcaatcacatgca

SEQ ID NO: 8080312 - DNA, 22 bp, Homo sapiens
gttataaaatgcacagttgttt

SEQ ID NO: 8080313 - DNA, 22 bp, Homo sapiens
gttcatttttagaatgctagta

SEQ ID NO: 8080314 - DNA, 23 bp, Homo sapiens
gttcattttattgtctgattgct

SEQ ID NO: 8080315 - DNA, 22 bp, Homo sapiens
gttcatttttactttgatctac

SEQ ID NO: 8080316 - DNA, 22 bp, Homo sapiens
gttaggtagaagtttactttga

SEQ ID NO: 8080317 - DNA, 22 bp, Homo sapiens
taaacagttaacatgccagaat

SEQ ID NO: 8080318 - DNA, 22 bp, Homo sapiens
taaacagttaacatgccagaat

SEQ ID NO: 8080319 - DNA, 22 bp, Homo sapiens
gttttataggctgttgctatat

SEQ ID NO: 8080320 - DNA, 22 bp, Homo sapiens
gttttataattgcttcataaga

SEQ ID NO: 8080321 - DNA, 22 bp, Homo sapiens
gttttatatgtctctgctgaca

SEQ ID NO: 8080322 - DNA, 22 bp, Homo sapiens
gttttataggtgaaatattact

SEQ ID NO: 8080323 - DNA, 23 bp, Homo sapiens
gttttcaacacaataaatgtaac

SEQ ID NO: 8080324 - DNA, 21 bp, Homo sapiens
taaataataagttgctgagat

SEQ ID NO: 8080325 - DNA, 22 bp, Homo sapiens
taaagtttatttgaacatctct

SEQ ID NO: 8080326 - DNA, 22 bp, Homo sapiens
taaagtttatttgaacatctct

SEQ ID NO: 8080327 - DNA, 22 bp, Homo sapiens
taaagtttatttgaacatctct

SEQ ID NO: 8080328 - DNA, 22 bp, Homo sapiens
taaagtttgtagcaattgatat

SEQ ID NO: 8080329 - DNA, 22 bp, Homo sapiens
taaagacaataggaaagttgtt

SEQ ID NO: 8080330 - DNA, 21 bp, Homo sapiens
taaagaagatgaatgtgatca

SEQ ID NO: 8080331 - DNA, 22 bp, Homo sapiens
taagataaggaacattctgtga

SEQ ID NO: 8080332 - DNA, 22 bp, Homo sapiens
taagataataagtatgtctatg

SEQ ID NO: 8080333 - DNA, 22 bp, Homo sapiens
taagataataccatgggccagg

SEQ ID NO: 8080334 - DNA, 22 bp, Homo sapiens
taagatgcattataccacagag

SEQ ID NO: 8080335 - DNA, 22 bp, Homo sapiens
taagataatccattataatgtt

SEQ ID NO: 8080336 - DNA, 22 bp, Homo sapiens
taagaaactgtcacagtactat

SEQ ID NO: 8080337 - DNA, 22 bp, Homo sapiens
taacttctgcacagaaaatttg

SEQ ID NO: 8080338 - DNA, 22 bp, Homo sapiens
taactgtagttataaagctatc

SEQ ID NO: 8080339 - DNA, 22 bp, Homo sapiens
taacacaaaagaatatgtgtgt

SEQ ID NO: 8080340 - DNA, 22 bp, Homo sapiens
taacaatttgcttcatttgttt

SEQ ID NO: 8080341 - DNA, 22 bp, Homo sapiens
taacaattctcaaaagagggga

SEQ ID NO: 8080342 - DNA, 22 bp, Homo sapiens
taaatacagtcatttgagccat

SEQ ID NO: 8080343 - DNA, 22 bp, Homo sapiens
taacaaaggttgccaaactaag

SEQ ID NO: 8080344 - DNA, 22 bp, Homo sapiens
taacaatacccattctaattac

SEQ ID NO: 8080345 - DNA, 22 bp, Homo sapiens
taacacagtgtctaccattatt

SEQ ID NO: 8080346 - DNA, 22 bp, Homo sapiens
tagtggctgcagggctgtttga

SEQ ID NO: 8080347 - DNA, 22 bp, Homo sapiens
tagtctctaggaggggaaaaga

SEQ ID NO: 8080348 - DNA, 22 bp, Homo sapiens
tagtatatctttagtacatagt

SEQ ID NO: 8080349 - DNA, 22 bp, Homo sapiens
tagaataagttgatgatatatg

SEQ ID NO: 8080350 - DNA, 22 bp, Homo sapiens
tagaagttaggaaataggaata

SEQ ID NO: 8080351 - DNA, 22 bp, Homo sapiens
tagaagttgaactaaaaatatt

SEQ ID NO: 8080352 - DNA, 22 bp, Homo sapiens
tagaagttcatgcgaattattt

SEQ ID NO: 8080353 - DNA, 22 bp, Homo sapiens
tagaagttatgataataatagt

SEQ ID NO: 8080354 - DNA, 22 bp, Homo sapiens
tactttctgtccttctgttaaa

SEQ ID NO: 8080355 - DNA, 22 bp, Homo sapiens
tacttgctgttagtattttaca

SEQ ID NO: 8080356 - DNA, 22 bp, Homo sapiens
tactttcatgggttttctttat

SEQ ID NO: 8080357 - DNA, 22 bp, Homo sapiens
tactttcttgttcctttcataa

SEQ ID NO: 8080358 - DNA, 22 bp, Homo sapiens
tagcaaaaactgcagttacttt

SEQ ID NO: 8080359 - DNA, 22 bp, Homo sapiens
tagcaaaaaaactggcatctcc

SEQ ID NO: 8080360 - DNA, 22 bp, Homo sapiens
tagcaaaaactgcagttacttt

SEQ ID NO: 8080361 - DNA, 22 bp, Homo sapiens
tagcaaaagccacgattacttt

SEQ ID NO: 8080362 - DNA, 22 bp, Homo sapiens
tagcaaaagccacgattacttt

SEQ ID NO: 8080363 - DNA, 22 bp, Homo sapiens
tagattttgcatttctaacaag

SEQ ID NO: 8080364 - DNA, 22 bp, Homo sapiens
tagattttaggagattttactg

SEQ ID NO: 8080365 - DNA, 18 bp, Homo sapiens
tagattaaaattgaattc

SEQ ID NO: 8080366 - DNA, 22 bp, Homo sapiens
tagattaacagttttgttgaag

SEQ ID NO: 8080367 - DNA, 22 bp, Homo sapiens
tagatgtgttgcctggagttgt

SEQ ID NO: 8080368 - DNA, 22 bp, Homo sapiens
tagatgtgtagggctccagcta

SEQ ID NO: 8080369 - DNA, 22 bp, Homo sapiens
tagatgttgaagtcatatttgg

SEQ ID NO: 8080370 - DNA, 22 bp, Homo sapiens
tatattagtgagatttatccat

SEQ ID NO: 8080371 - DNA, 22 bp, Homo sapiens
tatattacctgcctgatctata

SEQ ID NO: 8080372 - DNA, 22 bp, Homo sapiens
tatattaaagtgctttgcagtg

SEQ ID NO: 8080373 - DNA, 22 bp, Homo sapiens
tatattaaatgaccagttttaa

SEQ ID NO: 8080374 - DNA, 22 bp, Homo sapiens
tatagcaaggacataatatgct

SEQ ID NO: 8080375 - DNA, 22 bp, Homo sapiens
tatagcaagctctttgtaacca

SEQ ID NO: 8080376 - DNA, 22 bp, Homo sapiens
tatagcaagcaggacagtctca

SEQ ID NO: 8080377 - DNA, 22 bp, Homo sapiens
tatactgagtgtgttaatgatg

SEQ ID NO: 8080378 - DNA, 22 bp, Homo sapiens
tatagaagagacatgtgcatag

SEQ ID NO: 8080379 - DNA, 22 bp, Homo sapiens
tatacagataatgaagaccaag

SEQ ID NO: 8080380 - DNA, 22 bp, Homo sapiens
tatacagatatctaagatgtaa

SEQ ID NO: 8080381 - DNA, 22 bp, Homo sapiens
tataccaaaatatcagaaaggg

SEQ ID NO: 8080382 - DNA, 20 bp, Homo sapiens
tatactaacatatatctgtt

SEQ ID NO: 8080383 - DNA, 22 bp, Homo sapiens
tagttaaagagatccacattcc

SEQ ID NO: 8080384 - DNA, 22 bp, Homo sapiens
tagtgtttagtacatatgcata

SEQ ID NO: 8080385 - DNA, 22 bp, Homo sapiens
tagtgtttgggaattgtagaga

SEQ ID NO: 8080386 - DNA, 22 bp, Homo sapiens
tatattcaacaggctaatgtca

SEQ ID NO: 8080387 - DNA, 22 bp, Homo sapiens
tatattcaacaggctaatgtca

SEQ ID NO: 8080388 - DNA, 22 bp, Homo sapiens
tatattttagacaccctcacgc

SEQ ID NO: 8080389 - DNA, 20 bp, Homo sapiens
tatattttctctttggcctt

SEQ ID NO: 8080390 - DNA, 22 bp, Homo sapiens
tatcaaaaggagttgaaagggg

SEQ ID NO: 8080391 - DNA, 22 bp, Homo sapiens
tatcaactgagattaaatattt

SEQ ID NO: 8080392 - DNA, 22 bp, Homo sapiens
tatcaagagtctctacattaat

SEQ ID NO: 8080393 - DNA, 22 bp, Homo sapiens
tatctttctgtcctagattctg

SEQ ID NO: 8080394 - DNA, 22 bp, Homo sapiens
tatcttaaatgcatgatagaca

SEQ ID NO: 8080395 - DNA, 22 bp, Homo sapiens
tatttgtccaggtaaatttcag

SEQ ID NO: 8080396 - DNA, 22 bp, Homo sapiens
tatttgtgagactgactgaagt

SEQ ID NO: 8080397 - DNA, 22 bp, Homo sapiens
tattttcattctgtgtgactgt

SEQ ID NO: 8080398 - DNA, 22 bp, Homo sapiens
tattttcattctgtgtgactgt

SEQ ID NO: 8080399 - DNA, 22 bp, Homo sapiens
tattttcatcttgtccttggat

SEQ ID NO: 8080400 - DNA, 22 bp, Homo sapiens
tattttcatcttgtccttggat

SEQ ID NO: 8080401 - DNA, 22 bp, Homo sapiens
tattttcaccttctctggatat

SEQ ID NO: 8080402 - DNA, 22 bp, Homo sapiens
tattttcaccttctctggatat

SEQ ID NO: 8080403 - DNA, 22 bp, Homo sapiens
tattgtacatggttatgcagga

SEQ ID NO: 8080404 - DNA, 22 bp, Homo sapiens
tatttcactcagtataccatag

SEQ ID NO: 8080405 - DNA, 22 bp, Homo sapiens
tatttcaagaacttctatccat

SEQ ID NO: 8080406 - DNA, 22 bp, Homo sapiens
tatttcaagaacttctatccat

SEQ ID NO: 8080407 - DNA, 22 bp, Homo sapiens
tatttcaccttactaagctgtg

SEQ ID NO: 8080408 - DNA, 22 bp, Homo sapiens
tatgtttaaatgtatgtgtatg

SEQ ID NO: 8080409 - DNA, 22 bp, Homo sapiens
tatgtgttttggatttagaatg

SEQ ID NO: 8080410 - DNA, 22 bp, Homo sapiens
tatgtgttatttggtatacatt

SEQ ID NO: 8080411 - DNA, 22 bp, Homo sapiens
tattcaaagtgcgaggtcaggg

SEQ ID NO: 8080412 - DNA, 22 bp, Homo sapiens
tattgacttttaaagtgatata

SEQ ID NO: 8080413 - DNA, 22 bp, Homo sapiens
tattgacttgggcattgagaga

SEQ ID NO: 8080414 - DNA, 22 bp, Homo sapiens
tattgactaaattggaaagaat

SEQ ID NO: 8080415 - DNA, 22 bp, Homo sapiens
tattgagacttccagtatatga

SEQ ID NO: 8080416 - DNA, 22 bp, Homo sapiens
tattcagagggttgaattttta

SEQ ID NO: 8080417 - DNA, 22 bp, Homo sapiens
tcatccatatagaaagatgatt

SEQ ID NO: 8080418 - DNA, 22 bp, Homo sapiens
tcatatttgggggtgtgtgttt

SEQ ID NO: 8080419 - DNA, 22 bp, Homo sapiens
tcataaaacacaccaggtagtt

SEQ ID NO: 8080420 - DNA, 22 bp, Homo sapiens
tcagtttttctatactttgtag

SEQ ID NO: 8080421 - DNA, 22 bp, Homo sapiens
tcagtttttacggtcacaggga

SEQ ID NO: 8080422 - DNA, 22 bp, Homo sapiens
tcagtttttgtttgccagatag

SEQ ID NO: 8080423 - DNA, 22 bp, Homo sapiens
tcagttttctcatttatgagat

SEQ ID NO: 8080424 - DNA, 22 bp, Homo sapiens
tcagttttctcatctgtgaaat

SEQ ID NO: 8080425 - DNA, 22 bp, Homo sapiens
tcagttttctcatctgtaattt

SEQ ID NO: 8080426 - DNA, 22 bp, Homo sapiens
tcagttttcatttcatgagcag

SEQ ID NO: 8080427 - DNA, 22 bp, Homo sapiens
tcagttttgaaaacattgaatg

SEQ ID NO: 8080428 - DNA, 22 bp, Homo sapiens
tcagttttgattcctggttctc

SEQ ID NO: 8080429 - DNA, 23 bp, Homo sapiens
tcagttttggctgttcagtgttg

SEQ ID NO: 8080430 - DNA, 22 bp, Homo sapiens
tcagttttgtatgttgtaagtc

SEQ ID NO: 8080431 - DNA, 22 bp, Homo sapiens
tcagtttttaaatgatataatt

SEQ ID NO: 8080432 - DNA, 22 bp, Homo sapiens
tcagtttttaagagttatgcga

SEQ ID NO: 8080433 - DNA, 22 bp, Homo sapiens
tcagttttaaggtttgagaatt

SEQ ID NO: 8080434 - DNA, 19 bp, Homo sapiens
tcagttttagtcatcagtt

SEQ ID NO: 8080435 - DNA, 22 bp, Homo sapiens
tcagttttcaatttcatcagag

SEQ ID NO: 8080436 - DNA, 22 bp, Homo sapiens
tcagttctaacagtttagaaca

SEQ ID NO: 8080437 - DNA, 22 bp, Homo sapiens
tcagtgggaggccattgaatgg

SEQ ID NO: 8080438 - DNA, 22 bp, Homo sapiens
tcagttatagatacttttacca

SEQ ID NO: 8080439 - DNA, 23 bp, Homo sapiens
tcagttattggtgataaagctgg

SEQ ID NO: 8080440 - DNA, 22 bp, Homo sapiens
tcagttatcattgctgtaaatt

SEQ ID NO: 8080441 - DNA, 21 bp, Homo sapiens
tcagggcagctgctcttcaga

SEQ ID NO: 8080442 - DNA, 22 bp, Homo sapiens
tcagggcagcctaaggcacctc

SEQ ID NO: 8080443 - DNA, 16 bp, Homo sapiens
tcagggcagaatggca

SEQ ID NO: 8080444 - DNA, 22 bp, Homo sapiens
tcagggcagaatccaaagaatt

SEQ ID NO: 8080445 - DNA, 22 bp, Homo sapiens
tcagggcacgtttctgcaatgc

SEQ ID NO: 8080446 - DNA, 22 bp, Homo sapiens
tcagggcactgtcacctgatat

SEQ ID NO: 8080447 - DNA, 22 bp, Homo sapiens
tcaggtggagacctccttggcc

SEQ ID NO: 8080448 - DNA, 22 bp, Homo sapiens
tcaggtcatctgtctctgggct

SEQ ID NO: 8080449 - DNA, 22 bp, Homo sapiens
tcagggcacaggcctgtgggtt

SEQ ID NO: 8080450 - DNA, 22 bp, Homo sapiens
tcagggcaatgtccctcagaag

SEQ ID NO: 8080451 - DNA, 22 bp, Homo sapiens
tcagggcacattctgcagtggc

SEQ ID NO: 8080452 - DNA, 22 bp, Homo sapiens
tcagggcaccaaaaaagatgcc

SEQ ID NO: 8080453 - DNA, 22 bp, Homo sapiens
tcagggcaagtctcagaaggtt

SEQ ID NO: 8080454 - DNA, 22 bp, Homo sapiens
tcagggcaagattggttaataa

SEQ ID NO: 8080455 - DNA, 22 bp, Homo sapiens
tcagggcaaagggcagagtttg

SEQ ID NO: 8080456 - DNA, 22 bp, Homo sapiens
tcagggagagcctgtctgacgt

SEQ ID NO: 8080457 - DNA, 22 bp, Homo sapiens
tcagggcaaaagggaaaccatt

SEQ ID NO: 8080458 - DNA, 22 bp, Homo sapiens
tcagaggctggaagagcctcct

SEQ ID NO: 8080459 - DNA, 22 bp, Homo sapiens
tcagaggcttctggccagtctg

SEQ ID NO: 8080460 - DNA, 22 bp, Homo sapiens
tcagctttctcaaagaagctgg

SEQ ID NO: 8080461 - DNA, 22 bp, Homo sapiens
tcagctttccttgctttagatt

SEQ ID NO: 8080462 - DNA, 22 bp, Homo sapiens
tcacagcagtaaagaaaacact

SEQ ID NO: 8080463 - DNA, 22 bp, Homo sapiens
tcacacaggtttgcaatgattt

SEQ ID NO: 8080464 - DNA, 22 bp, Homo sapiens
tcacacataaaaagaagactag

SEQ ID NO: 8080465 - DNA, 22 bp, Homo sapiens
tcacagaatgtctagcataatt

SEQ ID NO: 8080466 - DNA, 22 bp, Homo sapiens
tcacagaatagcactgtaagcg

SEQ ID NO: 8080467 - DNA, 22 bp, Homo sapiens
tcacagaatagcactgtaagcg

SEQ ID NO: 8080468 - DNA, 18 bp, Homo sapiens
tcacagaatattgagtgg

SEQ ID NO: 8080469 - DNA, 22 bp, Homo sapiens
tcacagaatctctgataagtct

SEQ ID NO: 8080470 - DNA, 22 bp, Homo sapiens
tcacagaatgtcagagttgggg

SEQ ID NO: 8080471 - DNA, 20 bp, Homo sapiens
tcacagaatgcctgaagaag

SEQ ID NO: 8080472 - DNA, 22 bp, Homo sapiens
tcaattactaaccaaataatgt

SEQ ID NO: 8080473 - DNA, 22 bp, Homo sapiens
tcaattaagaggctaagttact

SEQ ID NO: 8080474 - DNA, 22 bp, Homo sapiens
tcaattatgccattgcaatatt

SEQ ID NO: 8080475 - DNA, 22 bp, Homo sapiens
tcaattcacagctctgctattt

SEQ ID NO: 8080476 - DNA, 22 bp, Homo sapiens
tcaattcagactgagaaatgat

SEQ ID NO: 8080477 - DNA, 22 bp, Homo sapiens
tcaattcagtccaacagtaatt

SEQ ID NO: 8080478 - DNA, 22 bp, Homo sapiens
tcaattcaattgcatttctgtg

SEQ ID NO: 8080479 - DNA, 22 bp, Homo sapiens
tcaattcaattgaacagttact

SEQ ID NO: 8080480 - DNA, 22 bp, Homo sapiens
tcaattcaacacatgcacattg

SEQ ID NO: 8080481 - DNA, 22 bp, Homo sapiens
tcaattcatagagttgacacag

SEQ ID NO: 8080482 - DNA, 22 bp, Homo sapiens
tcaattctagagccttacattg

SEQ ID NO: 8080483 - DNA, 22 bp, Homo sapiens
tcaattctgcctctaaatattt

SEQ ID NO: 8080484 - DNA, 22 bp, Homo sapiens
tcacacagcttggagttatggt

SEQ ID NO: 8080485 - DNA, 22 bp, Homo sapiens
tcacacagggtcggaaagagtg

SEQ ID NO: 8080486 - DNA, 22 bp, Homo sapiens
tcacacagattggtagagctga

SEQ ID NO: 8080487 - DNA, 22 bp, Homo sapiens
tcaaacatgttagcagtctgtg

SEQ ID NO: 8080488 - DNA, 22 bp, Homo sapiens
tcaaacatccccaccagggact

SEQ ID NO: 8080489 - DNA, 22 bp, Homo sapiens
tcaaaagtttcacatagagata

SEQ ID NO: 8080490 - DNA, 22 bp, Homo sapiens
tcaaaaatggtctttgagctgc

SEQ ID NO: 8080491 - DNA, 22 bp, Homo sapiens
tcaaaaatgttttatattggta

SEQ ID NO: 8080492 - DNA, 22 bp, Homo sapiens
tcaaaattagtgaccaaaggca

SEQ ID NO: 8080493 - DNA, 22 bp, Homo sapiens
tcaaaatcaaagatacttgaaa

SEQ ID NO: 8080494 - DNA, 22 bp, Homo sapiens
tcaaacagaaattgttcatgct

SEQ ID NO: 8080495 - DNA, 22 bp, Homo sapiens
tcacctgtattaatacagaact

SEQ ID NO: 8080496 - DNA, 22 bp, Homo sapiens
tcactaatgagctaaggaaaag

SEQ ID NO: 8080497 - DNA, 22 bp, Homo sapiens
tcactggtgtgagaggagcaaa

SEQ ID NO: 8080498 - DNA, 21 bp, Homo sapiens
tcagaactggtgcagatgaat

SEQ ID NO: 8080499 - DNA, 20 bp, Homo sapiens
tcagaggctgccagctgggg

SEQ ID NO: 8080500 - DNA, 22 bp, Homo sapiens
tcagaggctcactgtctacttt

SEQ ID NO: 8080501 - DNA, 22 bp, Homo sapiens
tcagaggcctatgtctacaact

SEQ ID NO: 8080502 - DNA, 22 bp, Homo sapiens
tcagaggccaaactgagcaggg

SEQ ID NO: 8080503 - DNA, 22 bp, Homo sapiens
tcagaggcatcattcatagtta

SEQ ID NO: 8080504 - DNA, 19 bp, Homo sapiens
tcccttctatagtaataaa

SEQ ID NO: 8080505 - DNA, 22 bp, Homo sapiens
tccgagggctggacgcaggggc

SEQ ID NO: 8080506 - DNA, 22 bp, Homo sapiens
tcctcagtctctaaggcctcag

SEQ ID NO: 8080507 - DNA, 22 bp, Homo sapiens
tccagaaaaagtaatttatttg

SEQ ID NO: 8080508 - DNA, 22 bp, Homo sapiens
tcatgtgtctgccagtgtttat

SEQ ID NO: 8080509 - DNA, 22 bp, Homo sapiens
tcatgtttttgccatatgactc

SEQ ID NO: 8080510 - DNA, 22 bp, Homo sapiens
tcatgttttaatgcctttttct

SEQ ID NO: 8080511 - DNA, 22 bp, Homo sapiens
tcatgtttggagtttgctcact

SEQ ID NO: 8080512 - DNA, 22 bp, Homo sapiens
tcatgtttgagactaatttttc

SEQ ID NO: 8080513 - DNA, 22 bp, Homo sapiens
tccacagcacaaagccagtgtg

SEQ ID NO: 8080514 - DNA, 22 bp, Homo sapiens
tccagaaaattttacagtgcct

SEQ ID NO: 8080515 - DNA, 22 bp, Homo sapiens
tccagaaatgcaagccaggtgt

SEQ ID NO: 8080516 - DNA, 22 bp, Homo sapiens
tccagccacgtattatctcact

SEQ ID NO: 8080517 - DNA, 22 bp, Homo sapiens
tcccagcactgtaattctttgg

SEQ ID NO: 8080518 - DNA, 22 bp, Homo sapiens
tcccagagtgtgggcatcaagg

SEQ ID NO: 8080519 - DNA, 22 bp, Homo sapiens
tcccagagttcaatgggaaggt

SEQ ID NO: 8080520 - DNA, 22 bp, Homo sapiens
tcccagagtgagccaggggcag

SEQ ID NO: 8080521 - DNA, 21 bp, Homo sapiens
tcccagagtgcttgggactgc

SEQ ID NO: 8080522 - DNA, 22 bp, Homo sapiens
tcccagagtcttctcctgtaat

SEQ ID NO: 8080523 - DNA, 22 bp, Homo sapiens
tcccagagtcagaggtggggcc

SEQ ID NO: 8080524 - DNA, 22 bp, Homo sapiens
tccagtggtttgaaaggggtgt

SEQ ID NO: 8080525 - DNA, 22 bp, Homo sapiens
tccaggcccatagacacttctc

SEQ ID NO: 8080526 - DNA, 22 bp, Homo sapiens
tccagtcctgggagcctttctg

SEQ ID NO: 8080527 - DNA, 22 bp, Homo sapiens
tccagtccttgcctctgtcagg

SEQ ID NO: 8080528 - DNA, 20 bp, Homo sapiens
tccagtccccacttgctcct

SEQ ID NO: 8080529 - DNA, 22 bp, Homo sapiens
tccagtcccattacccacattt

SEQ ID NO: 8080530 - DNA, 22 bp, Homo sapiens
tccagtcccttgcctccacagc

SEQ ID NO: 8080531 - DNA, 22 bp, Homo sapiens
tccagtgggttgctgagggagg

SEQ ID NO: 8080532 - DNA, 22 bp, Homo sapiens
tccagtgggtctggcaagacca

SEQ ID NO: 8080533 - DNA, 20 bp, Homo sapiens
tccagtggcctgaatctgga

SEQ ID NO: 8080534 - DNA, 22 bp, Homo sapiens
tccagtggcttcctggaaaaaa

SEQ ID NO: 8080535 - DNA, 21 bp, Homo sapiens
tccagtggggatctctgatat

SEQ ID NO: 8080536 - DNA, 22 bp, Homo sapiens
tccagtggctttgctgctttaa

SEQ ID NO: 8080537 - DNA, 22 bp, Homo sapiens
tccagtggtggtttgaagggca

SEQ ID NO: 8080538 - DNA, 21 bp, Homo sapiens
tccagtggtgtctagaatgtg

SEQ ID NO: 8080539 - DNA, 22 bp, Homo sapiens
tccagtggtagtaaagaggtct

SEQ ID NO: 8080540 - DNA, 22 bp, Homo sapiens
tccagtggtacatggagacact

SEQ ID NO: 8080541 - DNA, 22 bp, Homo sapiens
tccagtggtggctcccggacct

SEQ ID NO: 8080542 - DNA, 15 bp, Homo sapiens
tccagtggaggcact

SEQ ID NO: 8080543 - DNA, 22 bp, Homo sapiens
tccagtggcactggagactaga

SEQ ID NO: 8080544 - DNA, 22 bp, Homo sapiens
tccagtggcaccttggccctca

SEQ ID NO: 8080545 - DNA, 22 bp, Homo sapiens
tccagtggagtgtgggggtgaa

SEQ ID NO: 8080546 - DNA, 22 bp, Homo sapiens
tccagtggcaggcggtgaggtc

SEQ ID NO: 8080547 - DNA, 22 bp, Homo sapiens
tccagtgctggaccagagcacc

SEQ ID NO: 8080548 - DNA, 22 bp, Homo sapiens
tccagtggaaattgtgttcatt

SEQ ID NO: 8080549 - DNA, 22 bp, Homo sapiens
tccagtggaacagatgttgcct

SEQ ID NO: 8080550 - DNA, 22 bp, Homo sapiens
tccagtgctgtttccaatgtaa

SEQ ID NO: 8080551 - DNA, 22 bp, Homo sapiens
tccagtccactgccttgctctt

SEQ ID NO: 8080552 - DNA, 20 bp, Homo sapiens
tccagggcaactagagtgtg

SEQ ID NO: 8080553 - DNA, 20 bp, Homo sapiens
tccagggcaaactcatcacc

SEQ ID NO: 8080554 - DNA, 22 bp, Homo sapiens
ttttttccaacttaagacttca

SEQ ID NO: 8080555 - DNA, 22 bp, Homo sapiens
ttttttcctgagccttgtggtc

SEQ ID NO: 8080556 - DNA, 22 bp, Homo sapiens
tttgaaagttcttctgacacta

SEQ ID NO: 8080557 - DNA, 22 bp, Homo sapiens
tttctatatgaggagctaaagt

SEQ ID NO: 8080558 - DNA, 21 bp, Homo sapiens
tttgaaagtgggtgattcttt

SEQ ID NO: 8080559 - DNA, 22 bp, Homo sapiens
tttctagaggctccaggggagt

SEQ ID NO: 8080560 - DNA, 22 bp, Homo sapiens
tttctagactcaaagaggatat

SEQ ID NO: 8080561 - DNA, 22 bp, Homo sapiens
tttctagctgacaaaaatgttt

SEQ ID NO: 8080562 - DNA, 22 bp, Homo sapiens
tttggccaggtctggaaacagt

SEQ ID NO: 8080563 - DNA, 22 bp, Homo sapiens
tttggccacttcatagatcatt

SEQ ID NO: 8080564 - DNA, 22 bp, Homo sapiens
tttggccatatctatactcagc

SEQ ID NO: 8080565 - DNA, 22 bp, Homo sapiens
tttgtcatgtccttaactgtct

SEQ ID NO: 8080566 - DNA, 22 bp, Homo sapiens
tttgtcatgttttgtaatgtct

SEQ ID NO: 8080567 - DNA, 22 bp, Homo sapiens
tttgtcattctgtgtatttaaa

SEQ ID NO: 8080568 - DNA, 22 bp, Homo sapiens
tttgtcatttccctgattaaag

SEQ ID NO: 8080569 - DNA, 22 bp, Homo sapiens
tttgtcatatagactattgtga

SEQ ID NO: 8080570 - DNA, 22 bp, Homo sapiens
tttgtcataactctgctgcaag

SEQ ID NO: 8080571 - DNA, 19 bp, Homo sapiens
tttgtcatggtgagttgtt

SEQ ID NO: 8080572 - DNA, 22 bp, Homo sapiens
tttgtcatcccttttgaaactg

SEQ ID NO: 8080573 - DNA, 22 bp, Homo sapiens
tttgtcatgctttccttatgga

SEQ ID NO: 8080574 - DNA, 22 bp, Homo sapiens
tttgtcatcagttattaatatg

SEQ ID NO: 8080575 - DNA, 22 bp, Homo sapiens
tttgtcatatcacacaattttg

SEQ ID NO: 8080576 - DNA, 22 bp, Homo sapiens
tttgtcatattgaaggtgctta

SEQ ID NO: 8080577 - DNA, 22 bp, Homo sapiens
tttgtcatcccttttgaaactg

SEQ ID NO: 8080578 - DNA, 22 bp, Homo sapiens
tttgctgaatagattgtaaact

SEQ ID NO: 8080579 - DNA, 22 bp, Homo sapiens
tttgtcttccccctttaatcag

SEQ ID NO: 8080580 - DNA, 22 bp, Homo sapiens
tttgtcttatccaatctctcag

SEQ ID NO: 8080581 - DNA, 22 bp, Homo sapiens
tttgtgcagataggagacaatc

SEQ ID NO: 8080582 - DNA, 22 bp, Homo sapiens
ttttacaaatgaggagctggag

SEQ ID NO: 8080583 - DNA, 22 bp, Homo sapiens
ttttacaagctgagtcgttaaa

SEQ ID NO: 8080584 - DNA, 22 bp, Homo sapiens
ttttacaagctgagtcgttaaa

SEQ ID NO: 8080585 - DNA, 22 bp, Homo sapiens
ttttacaagctgagtcgttaaa

SEQ ID NO: 8080586 - DNA, 22 bp, Homo sapiens
ttttaattttgcaaatctggtg

SEQ ID NO: 8080587 - DNA, 22 bp, Homo sapiens
ttttaattttagcccttctggt

SEQ ID NO: 8080588 - DNA, 22 bp, Homo sapiens
ttttacaggtcataggtatagt

SEQ ID NO: 8080589 - DNA, 22 bp, Homo sapiens
ttttacagttccatgcaaagcg

SEQ ID NO: 8080590 - DNA, 22 bp, Homo sapiens
ttttcaagagagtgttctatgt

SEQ ID NO: 8080591 - DNA, 22 bp, Homo sapiens
ttttattgtctcccagttctgg

SEQ ID NO: 8080592 - DNA, 22 bp, Homo sapiens
ttttagaaatactgatttagtg

SEQ ID NO: 8080593 - DNA, 22 bp, Homo sapiens
ttttacttaattcttggtcatg

SEQ ID NO: 8080594 - DNA, 22 bp, Homo sapiens
ttttacattgggaaatgcctct

SEQ ID NO: 8080595 - DNA, 22 bp, Homo sapiens
ttttaccactgggtgacatgga

SEQ ID NO: 8080596 - DNA, 22 bp, Homo sapiens
ttttagaagtgcctatcctatg

SEQ ID NO: 8080597 - DNA, 22 bp, Homo sapiens
ttttccttagcttctctgcgag

SEQ ID NO: 8080598 - DNA, 19 bp, Homo sapiens
ttttccttctatatgtttc

SEQ ID NO: 8080599 - DNA, 22 bp, Homo sapiens
tttttgtgatatgacactgtat

SEQ ID NO: 8080600 - DNA, 22 bp, Homo sapiens
tttttgtgtgagcagggtgtta

SEQ ID NO: 8080601 - DNA, 22 bp, Homo sapiens
ttttttcagcctgtctgtgcca

SEQ ID NO: 8080602 - DNA, 22 bp, Homo sapiens
ttttttatatcaactgaagtct

SEQ ID NO: 8080603 - DNA, 22 bp, Homo sapiens
ttttgtcacctgatttgcccac

SEQ ID NO: 8080604 - DNA, 22 bp, Homo sapiens
tttttgtatagaaatgaactaa

SEQ ID NO: 8080605 - DNA, 22 bp, Homo sapiens
ttttgtgtccttcacatcatgt

SEQ ID NO: 8080606 - DNA, 22 bp, Homo sapiens
ttggctttacaagcagtggcac

SEQ ID NO: 8080607 - DNA, 22 bp, Homo sapiens
ttggctttgtgatggtagaact

SEQ ID NO: 8080608 - DNA, 22 bp, Homo sapiens
ttggcttttatgcagcttaggt

SEQ ID NO: 8080609 - DNA, 22 bp, Homo sapiens
ttggctttgtgagagggcttgg

SEQ ID NO: 8080610 - DNA, 22 bp, Homo sapiens
ttggctttggtctggatgccag

SEQ ID NO: 8080611 - DNA, 18 bp, Homo sapiens
ttggctttgagaactggt

SEQ ID NO: 8080612 - DNA, 22 bp, Homo sapiens
ttggctttcagaatccctatct

SEQ ID NO: 8080613 - DNA, 22 bp, Homo sapiens
ttggctttcaggctggaaatct

SEQ ID NO: 8080614 - DNA, 22 bp, Homo sapiens
ttggctttctctgtatctgaat

SEQ ID NO: 8080615 - DNA, 22 bp, Homo sapiens
ttggctttagacctgagactgt

SEQ ID NO: 8080616 - DNA, 22 bp, Homo sapiens
ttggctttagcccaaatgactg

SEQ ID NO: 8080617 - DNA, 22 bp, Homo sapiens
ttgtattagctgtaaattttct

SEQ ID NO: 8080618 - DNA, 22 bp, Homo sapiens
ttgtattaattgaaatgaatgc

SEQ ID NO: 8080619 - DNA, 22 bp, Homo sapiens
ttgtagattggagagtgtgtga

SEQ ID NO: 8080620 - DNA, 22 bp, Homo sapiens
ttgggggcagagggagcatctg

SEQ ID NO: 8080621 - DNA, 22 bp, Homo sapiens
ttgggggcatattgagtagtgg

SEQ ID NO: 8080622 - DNA, 22 bp, Homo sapiens
ttgtgcatgcatacgtatgtgt

SEQ ID NO: 8080623 - DNA, 22 bp, Homo sapiens
ttgtgcatattaggtacatgct

SEQ ID NO: 8080624 - DNA, 22 bp, Homo sapiens
ttgtgctctgtgttatttaagg

SEQ ID NO: 8080625 - DNA, 20 bp, Homo sapiens
ttgttcattgagctgttttc

SEQ ID NO: 8080626 - DNA, 23 bp, Homo sapiens
ttggaacacagtaaatgcacaat

SEQ ID NO: 8080627 - DNA, 22 bp, Homo sapiens
ttggaacagaaacagacaaata

SEQ ID NO: 8080628 - DNA, 22 bp, Homo sapiens
ttggaacagagccctaaggaca

SEQ ID NO: 8080629 - DNA, 22 bp, Homo sapiens
ttggaataaaaacaactcacag

SEQ ID NO: 8080630 - DNA, 22 bp, Homo sapiens
ttggcacaaatttctgaaataa

SEQ ID NO: 8080631 - DNA, 22 bp, Homo sapiens
ttgcttcattttgggactctag

SEQ ID NO: 8080632 - DNA, 22 bp, Homo sapiens
ttgcttcagtcagtgctgccca

SEQ ID NO: 8080633 - DNA, 22 bp, Homo sapiens
ttgcttcagtagctctttaaag

SEQ ID NO: 8080634 - DNA, 22 bp, Homo sapiens
ttgcctttcccatgtctaggag

SEQ ID NO: 8080635 - DNA, 22 bp, Homo sapiens
ttgcctttcccctctggaagca

SEQ ID NO: 8080636 - DNA, 17 bp, Homo sapiens
ttgcctttatggtcact

SEQ ID NO: 8080637 - DNA, 22 bp, Homo sapiens
ttgccttttgctctgggggcag

SEQ ID NO: 8080638 - DNA, 22 bp, Homo sapiens
ttgcctttgacggtgcagcagt

SEQ ID NO: 8080639 - DNA, 22 bp, Homo sapiens
ttgcctttaagtataactgctg

SEQ ID NO: 8080640 - DNA, 22 bp, Homo sapiens
ttgcctttaacccctgaaaggc

SEQ ID NO: 8080641 - DNA, 22 bp, Homo sapiens
ttgcctcattttctggtgaaat

SEQ ID NO: 8080642 - DNA, 22 bp, Homo sapiens
ttgcccagagtcacccagctca

SEQ ID NO: 8080643 - DNA, 22 bp, Homo sapiens
ttgcctattgttcttacatgtt

SEQ ID NO: 8080644 - DNA, 22 bp, Homo sapiens
ttgcatttttagatgcttctgt

SEQ ID NO: 8080645 - DNA, 22 bp, Homo sapiens
ttgcatttttacaagtagccag

SEQ ID NO: 8080646 - DNA, 22 bp, Homo sapiens
ttgcatttgagaaagttctcct

SEQ ID NO: 8080647 - DNA, 22 bp, Homo sapiens
ttgcatttcctgtactgtttga

SEQ ID NO: 8080648 - DNA, 22 bp, Homo sapiens
tttcataatatccagagatttt

SEQ ID NO: 8080649 - DNA, 22 bp, Homo sapiens
tttccaaataaggtcacattct

SEQ ID NO: 8080650 - DNA, 22 bp, Homo sapiens
tttctaaatggtggctgcattg

SEQ ID NO: 8080651 - DNA, 22 bp, Homo sapiens
tttcgaatgatgtttggaatat

SEQ ID NO: 8080652 - DNA, 22 bp, Homo sapiens
tttcggaaatgcagaaacttca

SEQ ID NO: 8080653 - DNA, 22 bp, Homo sapiens
tttctaaaatagattttatggt

SEQ ID NO: 8080654 - DNA, 22 bp, Homo sapiens
tttcagtttttgctcgatgtat

SEQ ID NO: 8080655 - DNA, 22 bp, Homo sapiens
tttcagttttataactttggcc

SEQ ID NO: 8080656 - DNA, 23 bp, Homo sapiens
tttcagtttggaccagccccgac

SEQ ID NO: 8080657 - DNA, 22 bp, Homo sapiens
tttcagtttgtcggccttggac

SEQ ID NO: 8080658 - DNA, 22 bp, Homo sapiens
tttcagtttgaaggaaaggcca

SEQ ID NO: 8080659 - DNA, 22 bp, Homo sapiens
tttcacattggcttctatttct

SEQ ID NO: 8080660 - DNA, 22 bp, Homo sapiens
tttcacatggactttttgttct

SEQ ID NO: 8080661 - DNA, 22 bp, Homo sapiens
tttcaaggctagttttaattag

SEQ ID NO: 8080662 - DNA, 22 bp, Homo sapiens
tttatgtcaaaactacagttgg

SEQ ID NO: 8080663 - DNA, 22 bp, Homo sapiens
tttattgccctgtagtacagga

SEQ ID NO: 8080664 - DNA, 22 bp, Homo sapiens
tttattgtgttgaaactgaatt

SEQ ID NO: 8080665 - DNA, 22 bp, Homo sapiens
tttagtgtggcactgatgttca

SEQ ID NO: 8080666 - DNA, 22 bp, Homo sapiens
tttagtgtggcactgatgttca

SEQ ID NO: 8080667 - DNA, 22 bp, Homo sapiens
tttagtgtagcctaagcagaat

SEQ ID NO: 8080668 - DNA, 22 bp, Homo sapiens
tttagtgtaattctgccttttg

SEQ ID NO: 8080669 - DNA, 22 bp, Homo sapiens
tttagtgcttaggaaatgggga

SEQ ID NO: 8080670 - DNA, 22 bp, Homo sapiens
tttagtgctttgctattcatgg

SEQ ID NO: 8080671 - DNA, 22 bp, Homo sapiens
tttagcattaagcttttcaaat

SEQ ID NO: 8080672 - DNA, 18 bp, Homo sapiens
tttaggaattccaagaga

SEQ ID NO: 8080673 - DNA, 22 bp, Homo sapiens
tttaggaagagttgagtaaatt

SEQ ID NO: 8080674 - DNA, 22 bp, Homo sapiens
ttgtttaaaagaaatcatagaa

SEQ ID NO: 8080675 - DNA, 22 bp, Homo sapiens
ttgtttaaaagaaatcatagaa

SEQ ID NO: 8080676 - DNA, 22 bp, Homo sapiens
ttgtttaaaagaaatcatagaa

SEQ ID NO: 8080677 - DNA, 22 bp, Homo sapiens
tttaacttagaagagatatcct

SEQ ID NO: 8080678 - DNA, 22 bp, Homo sapiens
tttaacttagaagagatatcct

SEQ ID NO: 8080679 - DNA, 22 bp, Homo sapiens
tttaaccagtttacaaagaatt

SEQ ID NO: 8080680 - DNA, 22 bp, Homo sapiens
tttaacaggtaaagtaaatgtg

SEQ ID NO: 8080681 - DNA, 22 bp, Homo sapiens
ttgtttaaaatgtagcaagaaa

SEQ ID NO: 8080682 - DNA, 22 bp, Homo sapiens
ttgtttaaaatgtagcaagaaa

SEQ ID NO: 8080683 - DNA, 22 bp, Homo sapiens
tttaaattatagttaatgtctg

SEQ ID NO: 8080684 - DNA, 22 bp, Homo sapiens
tttacacattattttcagtgtg

SEQ ID NO: 8080685 - DNA, 22 bp, Homo sapiens
tttaagagcctgtacaaatatt

SEQ ID NO: 8080686 - DNA, 22 bp, Homo sapiens
tttaagagctagtatgtcattt

SEQ ID NO: 8080687 - DNA, 22 bp, Homo sapiens
tttaagatcatttgtattatcc

SEQ ID NO: 8080688 - DNA, 22 bp, Homo sapiens
tttacacttgaggaaactgagg

SEQ ID NO: 8080689 - DNA, 22 bp, Homo sapiens
tttacagagaatgtacataaag

SEQ ID NO: 8080690 - DNA, 22 bp, Homo sapiens
tttacagctagacatacctgag

SEQ ID NO: 8080691 - DNA, 22 bp, Homo sapiens
ttatggaaaatacaattataag

SEQ ID NO: 8080692 - DNA, 22 bp, Homo sapiens
ttatggaaaactccagagagta

SEQ ID NO: 8080693 - DNA, 22 bp, Homo sapiens
ttatgcatgagataaaaattgg

SEQ ID NO: 8080694 - DNA, 22 bp, Homo sapiens
ttatggcaagggttttaatttg

SEQ ID NO: 8080695 - DNA, 22 bp, Homo sapiens
ttatggaatggagaaagtctgc

SEQ ID NO: 8080696 - DNA, 22 bp, Homo sapiens
ttatggaatttgcaaaaggtta

SEQ ID NO: 8080697 - DNA, 22 bp, Homo sapiens
ttatgtgtgtacatgcatatgt

SEQ ID NO: 8080698 - DNA, 22 bp, Homo sapiens
ttatgtgtacctcaatctgagg

SEQ ID NO: 8080699 - DNA, 22 bp, Homo sapiens
tcctctccagcaaactggctat

SEQ ID NO: 8080700 - DNA, 17 bp, Homo sapiens
ttagtgtatctgttttg

SEQ ID NO: 8080701 - DNA, 22 bp, Homo sapiens
ttagtgtaaattgtgcttgaga

SEQ ID NO: 8080702 - DNA, 22 bp, Homo sapiens
ttattttaccttcctctgagct

SEQ ID NO: 8080703 - DNA, 21 bp, Homo sapiens
ttcaaaatggtgtgtttgtct

SEQ ID NO: 8080704 - DNA, 22 bp, Homo sapiens
ttcaaaagcggtccaggaagat

SEQ ID NO: 8080705 - DNA, 22 bp, Homo sapiens
ttcaagaggcttaattctggat

SEQ ID NO: 8080706 - DNA, 22 bp, Homo sapiens
ttcaagaaggtacatttacatc

SEQ ID NO: 8080707 - DNA, 22 bp, Homo sapiens
ttcaaaattgttctaagctctg

SEQ ID NO: 8080708 - DNA, 22 bp, Homo sapiens
ttatttaaaagtggtaagattc

SEQ ID NO: 8080709 - DNA, 22 bp, Homo sapiens
ttatttaaaagtggtaagattc

SEQ ID NO: 8080710 - DNA, 22 bp, Homo sapiens
ttatttaatgtgatctgaagag

SEQ ID NO: 8080711 - DNA, 22 bp, Homo sapiens
ttatttaattttctcactcaga

SEQ ID NO: 8080712 - DNA, 22 bp, Homo sapiens
ttatttagtctagatgaatttt

SEQ ID NO: 8080713 - DNA, 22 bp, Homo sapiens
ttcatagacccagaactcatta

SEQ ID NO: 8080714 - DNA, 22 bp, Homo sapiens
ttcatagaaagtgcttagattg

SEQ ID NO: 8080715 - DNA, 22 bp, Homo sapiens
ttcactgtactgactgtcttat

SEQ ID NO: 8080716 - DNA, 22 bp, Homo sapiens
ttcagaagttttcaaaactaag

SEQ ID NO: 8080717 - DNA, 22 bp, Homo sapiens
ttcagaaggattttaacacatg

SEQ ID NO: 8080718 - DNA, 22 bp, Homo sapiens
ttccccaggctggagtgcagtg

SEQ ID NO: 8080719 - DNA, 22 bp, Homo sapiens
ttcccagtgattaaggcagtgg

SEQ ID NO: 8080720 - DNA, 21 bp, Homo sapiens
ttccagttttaattaaattgt

SEQ ID NO: 8080721 - DNA, 22 bp, Homo sapiens
ttctcttctgttcagtgcccaa

SEQ ID NO: 8080722 - DNA, 22 bp, Homo sapiens
ttctcttcccactttctgtatt

SEQ ID NO: 8080723 - DNA, 20 bp, Homo sapiens
ttctccagtgcggtagccat

SEQ ID NO: 8080724 - DNA, 22 bp, Homo sapiens
ttctgataacaaacaccaattt

SEQ ID NO: 8080725 - DNA, 22 bp, Homo sapiens
ttctgatacagtcccaacacaa

SEQ ID NO: 8080726 - DNA, 22 bp, Homo sapiens
ttctgataataccacatcgcag

SEQ ID NO: 8080727 - DNA, 22 bp, Homo sapiens
ttctgataccttgcaggatcct

SEQ ID NO: 8080728 - DNA, 22 bp, Homo sapiens
ttctctttgacattattcaggt

SEQ ID NO: 8080729 - DNA, 22 bp, Homo sapiens
ttctgcatttaaaatattacta

SEQ ID NO: 8080730 - DNA, 22 bp, Homo sapiens
ttctgccagggaattctgctta

SEQ ID NO: 8080731 - DNA, 22 bp, Homo sapiens
ttctgccacgagcagtttcttc

SEQ ID NO: 8080732 - DNA, 22 bp, Homo sapiens
ttctgccaaaggctttgttttg

SEQ ID NO: 8080733 - DNA, 22 bp, Homo sapiens
ttctgcccaccacactttatct

SEQ ID NO: 8080734 - DNA, 22 bp, Homo sapiens
ttctatattggaagtgagaaat

SEQ ID NO: 8080735 - DNA, 22 bp, Homo sapiens
ttctccaggcttgggccaggtc

SEQ ID NO: 8080736 - DNA, 21 bp, Homo sapiens
ttctccaggcaaccatttcag

SEQ ID NO: 8080737 - DNA, 22 bp, Homo sapiens
ttctccaggccgcgcagggggc

SEQ ID NO: 8080738 - DNA, 22 bp, Homo sapiens
ttctccagcctattggcctatc

SEQ ID NO: 8080739 - DNA, 22 bp, Homo sapiens
ttcgttttctaggaccaacaga

SEQ ID NO: 8080740 - DNA, 22 bp, Homo sapiens
ttctaaaataagtttatctggt

SEQ ID NO: 8080741 - DNA, 22 bp, Homo sapiens
ttcgagttggctttattaaact

SEQ ID NO: 8080742 - DNA, 22 bp, Homo sapiens
ttccctccatttcattttataa

SEQ ID NO: 8080743 - DNA, 22 bp, Homo sapiens
ttctttcttggggaacacactc

SEQ ID NO: 8080744 - DNA, 22 bp, Homo sapiens
ttctttgcccttaatgaaataa

SEQ ID NO: 8080745 - DNA, 22 bp, Homo sapiens
ttcttctgaaacataatcaata

SEQ ID NO: 8080746 - DNA, 22 bp, Homo sapiens
ttcttctgtgaggtgtgtgcct

SEQ ID NO: 8080747 - DNA, 22 bp, Homo sapiens
ttcttctgcctcccacctgata

SEQ ID NO: 8080748 - DNA, 22 bp, Homo sapiens
ttctttcttctcaggctgggta

SEQ ID NO: 8080749 - DNA, 22 bp, Homo sapiens
ttctttctctactagcagagct

SEQ ID NO: 8080750 - DNA, 22 bp, Homo sapiens
ttctttctcagtgggcagatac

SEQ ID NO: 8080751 - DNA, 22 bp, Homo sapiens
ttctttctcactctttaggaag

SEQ ID NO: 8080752 - DNA, 22 bp, Homo sapiens
ttcttcttctggctgcacctgg

SEQ ID NO: 8080753 - DNA, 21 bp, Homo sapiens
ttcttcttggactgttttggc

SEQ ID NO: 8080754 - DNA, 21 bp, Homo sapiens
ttcttcttggactgttttggc

SEQ ID NO: 8080755 - DNA, 22 bp, Homo sapiens
ttctttttatcttcccataaga

SEQ ID NO: 8080756 - DNA, 22 bp, Homo sapiens
ttctttttggatagctgatgaa

SEQ ID NO: 8080757 - DNA, 20 bp, Homo sapiens
ttgaaaatgcattgtgcagt

SEQ ID NO: 8080758 - DNA, 22 bp, Homo sapiens
ttgaaagatatgttaatctttc

SEQ ID NO: 8080759 - DNA, 22 bp, Homo sapiens
ttgaaagacattatttatatat

SEQ ID NO: 8080760 - DNA, 22 bp, Homo sapiens
aaatgcaggttcttgagccaag

SEQ ID NO: 8080761 - DNA, 22 bp, Homo sapiens
aaatgcatcagctcataagaga

SEQ ID NO: 8080762 - DNA, 22 bp, Homo sapiens
aaatgcatatcaaagacttgaa

SEQ ID NO: 8080763 - DNA, 22 bp, Homo sapiens
aaatgcatcagctcataagaga

SEQ ID NO: 8080764 - DNA, 22 bp, Homo sapiens
aaatgcatgagaaagtattctg

SEQ ID NO: 8080765 - DNA, 22 bp, Homo sapiens
aaatgcagctgggcatgagagg

SEQ ID NO: 8080766 - DNA, 22 bp, Homo sapiens
aaatgcacaggttttaaatcct

SEQ ID NO: 8080767 - DNA, 22 bp, Homo sapiens
aagcacagactccctctgagtg

SEQ ID NO: 8080768 - DNA, 22 bp, Homo sapiens
aagcacagactccctctgagtg

SEQ ID NO: 8080769 - DNA, 20 bp, Homo sapiens
aagcatggtcaaaacttatg

SEQ ID NO: 8080770 - DNA, 22 bp, Homo sapiens
aagcatgggaggcctggaggag

SEQ ID NO: 8080771 - DNA, 22 bp, Homo sapiens
aagcatggctgttctagctata

SEQ ID NO: 8080772 - DNA, 22 bp, Homo sapiens
aagcatgggaatcccacagggt

SEQ ID NO: 8080773 - DNA, 22 bp, Homo sapiens
aagcatggagcaatagaatgac

SEQ ID NO: 8080774 - DNA, 22 bp, Homo sapiens
aagcatggcctctccgctcccc

SEQ ID NO: 8080775 - DNA, 22 bp, Homo sapiens
aaagtgttttctgatgtgttct

SEQ ID NO: 8080776 - DNA, 22 bp, Homo sapiens
aaagtgttttccatgcaatgaa

SEQ ID NO: 8080777 - DNA, 22 bp, Homo sapiens
aaagtgtttacattgctataag

SEQ ID NO: 8080778 - DNA, 22 bp, Homo sapiens
aaagttttattcaagcattagt

SEQ ID NO: 8080779 - DNA, 22 bp, Homo sapiens
aaataacagtcagggacaacat

SEQ ID NO: 8080780 - DNA, 19 bp, Homo sapiens
aaagtgttttcttttctgt

SEQ ID NO: 8080781 - DNA, 22 bp, Homo sapiens
aaataagaaattcttctttgca

SEQ ID NO: 8080782 - DNA, 22 bp, Homo sapiens
aaataacttggtttcatcagag

SEQ ID NO: 8080783 - DNA, 22 bp, Homo sapiens
aaatagcttttcataattctca

SEQ ID NO: 8080784 - DNA, 22 bp, Homo sapiens
aaatagctacatgatctctagg

SEQ ID NO: 8080785 - DNA, 22 bp, Homo sapiens
aaatcagatcttacacaattgt

SEQ ID NO: 8080786 - DNA, 22 bp, Homo sapiens
aaatccatcaaatcttctagaa

SEQ ID NO: 8080787 - DNA, 22 bp, Homo sapiens
aaatagaattggaagcagagtt

SEQ ID NO: 8080788 - DNA, 22 bp, Homo sapiens
aaatagatttcctagcattgga

SEQ ID NO: 8080789 - DNA, 22 bp, Homo sapiens
aaagctttgctggaaggaagag

SEQ ID NO: 8080790 - DNA, 22 bp, Homo sapiens
aaagctgctgtgaatggtttgg

SEQ ID NO: 8080791 - DNA, 22 bp, Homo sapiens
aaagctgctatgaacattctat

SEQ ID NO: 8080792 - DNA, 22 bp, Homo sapiens
aaagctgctttaaacatctatg

SEQ ID NO: 8080793 - DNA, 22 bp, Homo sapiens
aaagctcttttccaagtattga

SEQ ID NO: 8080794 - DNA, 22 bp, Homo sapiens
aacagataatttctaagttact

SEQ ID NO: 8080795 - DNA, 22 bp, Homo sapiens
aacagatttaagaagccaaggt

SEQ ID NO: 8080796 - DNA, 19 bp, Homo sapiens
aacagcaacttcctagtca

SEQ ID NO: 8080797 - DNA, 19 bp, Homo sapiens
aacagcaacttcctagtca

SEQ ID NO: 8080798 - DNA, 22 bp, Homo sapiens
aacagcaagggcggggtcaaga

SEQ ID NO: 8080799 - DNA, 22 bp, Homo sapiens
aacagcaatagcactattcatt

SEQ ID NO: 8080800 - DNA, 22 bp, Homo sapiens
aaagatcaatagataaagctac

SEQ ID NO: 8080801 - DNA, 22 bp, Homo sapiens
aaagatcagaggatagctgagt

SEQ ID NO: 8080802 - DNA, 22 bp, Homo sapiens
aaattgtggcgtctgtaagagt

SEQ ID NO: 8080803 - DNA, 22 bp, Homo sapiens
aaattgtgagactgaaccaaat

SEQ ID NO: 8080804 - DNA, 22 bp, Homo sapiens
aaattgtgagctatagatctag

SEQ ID NO: 8080805 - DNA, 22 bp, Homo sapiens
aacaaaacatttgtcttgtttc

SEQ ID NO: 8080806 - DNA, 22 bp, Homo sapiens
aaagataatgtttccttattct

SEQ ID NO: 8080807 - DNA, 22 bp, Homo sapiens
aaagataatgtttccttattct

SEQ ID NO: 8080808 - DNA, 22 bp, Homo sapiens
aaagtatatttacttactgtga

SEQ ID NO: 8080809 - DNA, 22 bp, Homo sapiens
aactaacagtcattaaaagaac

SEQ ID NO: 8080810 - DNA, 22 bp, Homo sapiens
aaagtacaaatgttctagccat

SEQ ID NO: 8080811 - DNA, 22 bp, Homo sapiens
aaagcttttgttttcgtaactg

SEQ ID NO: 8080812 - DNA, 22 bp, Homo sapiens
aaagcttttcagtatgttcatg

SEQ ID NO: 8080813 - DNA, 22 bp, Homo sapiens
aaagctttgtaaataaacaggt

SEQ ID NO: 8080814 - DNA, 22 bp, Homo sapiens
aaaggtttgcatggaatttacc

SEQ ID NO: 8080815 - DNA, 22 bp, Homo sapiens
aaaagtatggtggtccttttta

SEQ ID NO: 8080816 - DNA, 22 bp, Homo sapiens
aaactctagctactaggataac

SEQ ID NO: 8080817 - DNA, 22 bp, Homo sapiens
aaaagtactattttaacaaagt

SEQ ID NO: 8080818 - DNA, 19 bp, Homo sapiens
aaactcatagactcatatt

SEQ ID NO: 8080819 - DNA, 22 bp, Homo sapiens
aaactcaagtttcttaatgtca

SEQ ID NO: 8080820 - DNA, 22 bp, Homo sapiens
aaactagatgattatgaagcat

SEQ ID NO: 8080821 - DNA, 22 bp, Homo sapiens
aaagacctgaaatataatctag

SEQ ID NO: 8080822 - DNA, 22 bp, Homo sapiens
aaaatcagtacactttattttg

SEQ ID NO: 8080823 - DNA, 22 bp, Homo sapiens
aaagactaaccagttgtcaaaa

SEQ ID NO: 8080824 - DNA, 22 bp, Homo sapiens
aaacaatgaaatatttttatgg

SEQ ID NO: 8080825 - DNA, 22 bp, Homo sapiens
aaaatctaagtagcgagtaagg

SEQ ID NO: 8080826 - DNA, 22 bp, Homo sapiens
aaaaatacttcacttctgggtg

SEQ ID NO: 8080827 - DNA, 22 bp, Homo sapiens
aaaaatagcttctcttgtccct

SEQ ID NO: 8080828 - DNA, 22 bp, Homo sapiens
aaaaatcacttttataggcagc

SEQ ID NO: 8080829 - DNA, 22 bp, Homo sapiens
aaacagaagggtaggtaaacat

SEQ ID NO: 8080830 - DNA, 22 bp, Homo sapiens
aaaaacacaactgtctttctct

SEQ ID NO: 8080831 - DNA, 22 bp, Homo sapiens
aaaaaattatcatagttcctga

SEQ ID NO: 8080832 - DNA, 22 bp, Homo sapiens
aaaaaattatcatagttcctga

SEQ ID NO: 8080833 - DNA, 22 bp, Homo sapiens
aaaaaagattgatggtggatgc

SEQ ID NO: 8080834 - DNA, 22 bp, Homo sapiens
aaaaacctttcattgcaaatgt

SEQ ID NO: 8080835 - DNA, 22 bp, Homo sapiens
aaaatagttaacgttcagagta

SEQ ID NO: 8080836 - DNA, 22 bp, Homo sapiens
aaaatagttaacgttcagagta

SEQ ID NO: 8080837 - DNA, 22 bp, Homo sapiens
aaaaacctttcccatactaaga

SEQ ID NO: 8080838 - DNA, 22 bp, Homo sapiens
aaaatctggtaatttgaatgtg

SEQ ID NO: 8080839 - DNA, 22 bp, Homo sapiens
aaaatcttgactgtttttagaa

SEQ ID NO: 8080840 - DNA, 22 bp, Homo sapiens
aaaatcttgtgacttaggaagg

SEQ ID NO: 8080841 - DNA, 22 bp, Homo sapiens
aaactcttttgcatattagagg

SEQ ID NO: 8080842 - DNA, 22 bp, Homo sapiens
aaactctttccacgattacttt

SEQ ID NO: 8080843 - DNA, 22 bp, Homo sapiens
aaactgataaaataagtacatt

SEQ ID NO: 8080844 - DNA, 21 bp, Homo sapiens
aaactgaggcttcaagcagtg

SEQ ID NO: 8080845 - DNA, 22 bp, Homo sapiens
aaagaactacctgtatgatatt

SEQ ID NO: 8080846 - DNA, 22 bp, Homo sapiens
aaagaatactccttttgccttg

SEQ ID NO: 8080847 - DNA, 22 bp, Homo sapiens
aaagaatagttaagtttagggc

SEQ ID NO: 8080848 - DNA, 22 bp, Homo sapiens
aaagaatagcctttgtccaaat

SEQ ID NO: 8080849 - DNA, 22 bp, Homo sapiens
aaagagcaccctcaatgtctga

SEQ ID NO: 8080850 - DNA, 22 bp, Homo sapiens
aaagagttccaagtcattttat

SEQ ID NO: 8080851 - DNA, 22 bp, Homo sapiens
aaattagaaatactttcaaagc

SEQ ID NO: 8080852 - DNA, 22 bp, Homo sapiens
aaattagaaatactttcaaagc

SEQ ID NO: 8080853 - DNA, 20 bp, Homo sapiens
aaattactgccacacatttc

SEQ ID NO: 8080854 - DNA, 22 bp, Homo sapiens
aaattaccattgtaaagtattt

SEQ ID NO: 8080855 - DNA, 22 bp, Homo sapiens
aaacctagaaggaagggtctct

SEQ ID NO: 8080856 - DNA, 22 bp, Homo sapiens
aaacctcttctcaagatttctg

SEQ ID NO: 8080857 - DNA, 22 bp, Homo sapiens
aaacctgtagcagtttgttaca

SEQ ID NO: 8080858 - DNA, 22 bp, Homo sapiens
aaagttcactatgtagcagcgt

SEQ ID NO: 8080859 - DNA, 22 bp, Homo sapiens
aaagttcagtgccttctataca

SEQ ID NO: 8080860 - DNA, 18 bp, Homo sapiens
aaagttcagggagagttg

SEQ ID NO: 8080861 - DNA, 22 bp, Homo sapiens
aaagttcactgaccagcactgg

SEQ ID NO: 8080862 - DNA, 22 bp, Homo sapiens
aaagttcactgaccagcactgg

SEQ ID NO: 8080863 - DNA, 22 bp, Homo sapiens
aaagttcagattagactcaaga

SEQ ID NO: 8080864 - DNA, 22 bp, Homo sapiens
aaactctatgaaccttctacca

SEQ ID NO: 8080865 - DNA, 22 bp, Homo sapiens
aaactctcttttcttcagtagg

SEQ ID NO: 8080866 - DNA, 22 bp, Homo sapiens
aaagttcatggtgttatagaaa

SEQ ID NO: 8080867 - DNA, 21 bp, Homo sapiens
aaagttcatgctttaatattc

SEQ ID NO: 8080868 - DNA, 22 bp, Homo sapiens
aaagttcattgatgactgaggt

SEQ ID NO: 8080869 - DNA, 20 bp, Homo sapiens
aaagttcatgtttgcacttt

SEQ ID NO: 8080870 - DNA, 22 bp, Homo sapiens
aaacagttctcatttgtttaga

SEQ ID NO: 8080871 - DNA, 22 bp, Homo sapiens
aaacagtttcattttcatgacc

SEQ ID NO: 8080872 - DNA, 22 bp, Homo sapiens
aaacagttgttatttttatatg

SEQ ID NO: 8080873 - DNA, 22 bp, Homo sapiens
aaacagttctccaggaagccag

SEQ ID NO: 8080874 - DNA, 22 bp, Homo sapiens
aaaggtagtacttctagaaggg

SEQ ID NO: 8080875 - DNA, 22 bp, Homo sapiens
aaacagtgatgttgagtgtaaa

SEQ ID NO: 8080876 - DNA, 22 bp, Homo sapiens
aaacaatttccacctctcctga

SEQ ID NO: 8080877 - DNA, 22 bp, Homo sapiens
aaattgcattcaggatgcagga

SEQ ID NO: 8080878 - DNA, 22 bp, Homo sapiens
aacaaaggccgttaataaccac

SEQ ID NO: 8080879 - DNA, 22 bp, Homo sapiens
aacaaagtagctgctgttctta

SEQ ID NO: 8080880 - DNA, 22 bp, Homo sapiens
aacaaagaagactggttatttt

SEQ ID NO: 8080881 - DNA, 22 bp, Homo sapiens
aacaaagatgggtgggaaagag

SEQ ID NO: 8080882 - DNA, 22 bp, Homo sapiens
aaattctttcatggctaataag

SEQ ID NO: 8080883 - DNA, 22 bp, Homo sapiens
aaattctttggcctactttgaa

SEQ ID NO: 8080884 - DNA, 22 bp, Homo sapiens
aaattgcaaaagtacttttagg

SEQ ID NO: 8080885 - DNA, 22 bp, Homo sapiens
aaattgaatttgggaaacattg

SEQ ID NO: 8080886 - DNA, 22 bp, Homo sapiens
aaattctcaagtgatcctgttg

SEQ ID NO: 8080887 - DNA, 22 bp, Homo sapiens
aaattctaaggtcacaatgttg

SEQ ID NO: 8080888 - DNA, 22 bp, Homo sapiens
aacaaagtgtacttccatactg

SEQ ID NO: 8080889 - DNA, 22 bp, Homo sapiens
aacactgaaacattgattgaca

SEQ ID NO: 8080890 - DNA, 22 bp, Homo sapiens
aacactaatgggagaacaaccc

SEQ ID NO: 8080891 - DNA, 22 bp, Homo sapiens
aacactgagaacaatacagagt

SEQ ID NO: 8080892 - DNA, 22 bp, Homo sapiens
aacactgagaacaatacagagt

SEQ ID NO: 8080893 - DNA, 22 bp, Homo sapiens
aacactgacgacgtgaactaaa

SEQ ID NO: 8080894 - DNA, 22 bp, Homo sapiens
aacactgaagtagtgaatactg

SEQ ID NO: 8080895 - DNA, 22 bp, Homo sapiens
aacactgaagaccaggtaattt

SEQ ID NO: 8080896 - DNA, 22 bp, Homo sapiens
aagtcatgtggaagaataacct

SEQ ID NO: 8080897 - DNA, 22 bp, Homo sapiens
aacagcagttacttttgcatca

SEQ ID NO: 8080898 - DNA, 18 bp, Homo sapiens
aacatgcattagaactgc

SEQ ID NO: 8080899 - DNA, 22 bp, Homo sapiens
aataacttgtatggttattcca

SEQ ID NO: 8080900 - DNA, 22 bp, Homo sapiens
aataacttgaagatctcttcca

SEQ ID NO: 8080901 - DNA, 22 bp, Homo sapiens
aataacttcatgtaacatttaa

SEQ ID NO: 8080902 - DNA, 22 bp, Homo sapiens
aataacttcatcttcaggatag

SEQ ID NO: 8080903 - DNA, 22 bp, Homo sapiens
aaccaatttaaatataaagact

SEQ ID NO: 8080904 - DNA, 22 bp, Homo sapiens
aaccaattaatagataggaaac

SEQ ID NO: 8080905 - DNA, 22 bp, Homo sapiens
aaccaattaatagataggaaac

SEQ ID NO: 8080906 - DNA, 22 bp, Homo sapiens
aaccaaggacagctagtgatgc

SEQ ID NO: 8080907 - DNA, 22 bp, Homo sapiens
aacttaaacccactcatgtaga

SEQ ID NO: 8080908 - DNA, 22 bp, Homo sapiens
aacttaaacaagctcccaagtt

SEQ ID NO: 8080909 - DNA, 22 bp, Homo sapiens
aacttaagtgtgaagagactct

SEQ ID NO: 8080910 - DNA, 22 bp, Homo sapiens
aacttaaacccactcatgtaga

SEQ ID NO: 8080911 - DNA, 22 bp, Homo sapiens
aacttaaacccactcatgtaga

SEQ ID NO: 8080912 - DNA, 22 bp, Homo sapiens
aactgttacatagttatagatc

SEQ ID NO: 8080913 - DNA, 19 bp, Homo sapiens
aactgtaaagatctgtagc

SEQ ID NO: 8080914 - DNA, 22 bp, Homo sapiens
aactgtgtgttttgctattagt

SEQ ID NO: 8080915 - DNA, 22 bp, Homo sapiens
aactgttgcttgtaatatgtgc

SEQ ID NO: 8080916 - DNA, 22 bp, Homo sapiens
aactgttggaggattattttgc

SEQ ID NO: 8080917 - DNA, 22 bp, Homo sapiens
aactgttgtcatatggtcttaa

SEQ ID NO: 8080918 - DNA, 22 bp, Homo sapiens
aatgatatagcagacatagcct

SEQ ID NO: 8080919 - DNA, 22 bp, Homo sapiens
aatgataccgccaatattacca

SEQ ID NO: 8080920 - DNA, 22 bp, Homo sapiens
aatgatacatatgtatcgttag

SEQ ID NO: 8080921 - DNA, 22 bp, Homo sapiens
aatgatacaaagggttttattt

SEQ ID NO: 8080922 - DNA, 22 bp, Homo sapiens
aatgatatgcaaattatcatca

SEQ ID NO: 8080923 - DNA, 20 bp, Homo sapiens
aatgatcagcatagcaagga

SEQ ID NO: 8080924 - DNA, 22 bp, Homo sapiens
aactacagctcttgtctttctg

SEQ ID NO: 8080925 - DNA, 22 bp, Homo sapiens
aagatttactttctttgtaata

SEQ ID NO: 8080926 - DNA, 22 bp, Homo sapiens
aagatttactagcataatagct

SEQ ID NO: 8080927 - DNA, 22 bp, Homo sapiens
acacaggaactcaagctcgctt

SEQ ID NO: 8080928 - DNA, 22 bp, Homo sapiens
acacaggaaatggtttagtttt

SEQ ID NO: 8080929 - DNA, 22 bp, Homo sapiens
acacagtaccccaaggctgggc

SEQ ID NO: 8080930 - DNA, 22 bp, Homo sapiens
aagaggccacagctgacagcac

SEQ ID NO: 8080931 - DNA, 22 bp, Homo sapiens
aagaggcctcacctcactgccc

SEQ ID NO: 8080932 - DNA, 22 bp, Homo sapiens
aagaggccccccagcaggtgaa

SEQ ID NO: 8080933 - DNA, 22 bp, Homo sapiens
aagatttaccactttattcaag

SEQ ID NO: 8080934 - DNA, 23 bp, Homo sapiens
acagacaacactgatgagagaaa

SEQ ID NO: 8080935 - DNA, 22 bp, Homo sapiens
aagcatttatagataagaattt

SEQ ID NO: 8080936 - DNA, 22 bp, Homo sapiens
aagcatcaacactatattgatg

SEQ ID NO: 8080937 - DNA, 23 bp, Homo sapiens
aagcatggttcacagttagtact

SEQ ID NO: 8080938 - DNA, 22 bp, Homo sapiens
aagcatgtgtataagctgggca

SEQ ID NO: 8080939 - DNA, 22 bp, Homo sapiens
aagcatttggttctgaagactc

SEQ ID NO: 8080940 - DNA, 22 bp, Homo sapiens
aagcatttcaggtagagatatt

SEQ ID NO: 8080941 - DNA, 22 bp, Homo sapiens
aagcatttctgtttatctatcg

SEQ ID NO: 8080942 - DNA, 22 bp, Homo sapiens
aagcatttcaatataatattca

SEQ ID NO: 8080943 - DNA, 22 bp, Homo sapiens
aacttcagttgagaaaggcatg

SEQ ID NO: 8080944 - DNA, 22 bp, Homo sapiens
aagaaagcattagacaggcatt

SEQ ID NO: 8080945 - DNA, 22 bp, Homo sapiens
aagaaatcagaaaagcattcgt

SEQ ID NO: 8080946 - DNA, 22 bp, Homo sapiens
aagaaatcagaaaagcattcgt

SEQ ID NO: 8080947 - DNA, 22 bp, Homo sapiens
aagaaatcatatcatttcttgg

SEQ ID NO: 8080948 - DNA, 22 bp, Homo sapiens
aatgttttgcattagttttcta

SEQ ID NO: 8080949 - DNA, 23 bp, Homo sapiens
aagaataaatgacattaaaggtg

SEQ ID NO: 8080950 - DNA, 22 bp, Homo sapiens
aagaataacacttaggttttgc

SEQ ID NO: 8080951 - DNA, 22 bp, Homo sapiens
aagaatacgtatcaacaatggt

SEQ ID NO: 8080952 - DNA, 22 bp, Homo sapiens
aagaatatagattttttgaagt

SEQ ID NO: 8080953 - DNA, 22 bp, Homo sapiens
aattggctatattatttagcct

SEQ ID NO: 8080954 - DNA, 22 bp, Homo sapiens
aattggctttgagaagtttgag

SEQ ID NO: 8080955 - DNA, 22 bp, Homo sapiens
aattgtgctgtgatcaattact

SEQ ID NO: 8080956 - DNA, 22 bp, Homo sapiens
aagacagccagctccatgggat

SEQ ID NO: 8080957 - DNA, 22 bp, Homo sapiens
aagacagcactggcattttcaa

SEQ ID NO: 8080958 - DNA, 20 bp, Homo sapiens
aagagctgactcacagtggt

SEQ ID NO: 8080959 - DNA, 23 bp, Homo sapiens
aagagcagggaatatttatttgc

SEQ ID NO: 8080960 - DNA, 23 bp, Homo sapiens
acaaggcaacatagatcagggca

SEQ ID NO: 8080961 - DNA, 22 bp, Homo sapiens
aagagctggatgaagaaatcaa

SEQ ID NO: 8080962 - DNA, 22 bp, Homo sapiens
aagagctggcccaatctgagca

SEQ ID NO: 8080963 - DNA, 22 bp, Homo sapiens
aagagctggctcttgcagcagc

SEQ ID NO: 8080964 - DNA, 22 bp, Homo sapiens
aagacatgcagtttgttccatt

SEQ ID NO: 8080965 - DNA, 20 bp, Homo sapiens
acaaagactggaaaagcaag

SEQ ID NO: 8080966 - DNA, 22 bp, Homo sapiens
acaaagattcatttgcattatt

SEQ ID NO: 8080967 - DNA, 22 bp, Homo sapiens
acaaagattcatttgcattatt

SEQ ID NO: 8080968 - DNA, 22 bp, Homo sapiens
acaaagatgtttaaagcattta

SEQ ID NO: 8080969 - DNA, 22 bp, Homo sapiens
acaaagatgtttaaagcattta

SEQ ID NO: 8080970 - DNA, 22 bp, Homo sapiens
acaaagataagtcagaaagtca

SEQ ID NO: 8080971 - DNA, 22 bp, Homo sapiens
acaaagataagtcagaaagtca

SEQ ID NO: 8080972 - DNA, 22 bp, Homo sapiens
acaaggacatgcaatttggatt

SEQ ID NO: 8080973 - DNA, 22 bp, Homo sapiens
agaagtatgtgagaaattatcc

SEQ ID NO: 8080974 - DNA, 22 bp, Homo sapiens
aatgtctgtgccttaaaacttc

SEQ ID NO: 8080975 - DNA, 22 bp, Homo sapiens
aatgtctatttgctacaaagcc

SEQ ID NO: 8080976 - DNA, 22 bp, Homo sapiens
aatgtctgcctgaactttatat

SEQ ID NO: 8080977 - DNA, 22 bp, Homo sapiens
aatgttccacagatatagcatg

SEQ ID NO: 8080978 - DNA, 22 bp, Homo sapiens
aattaccaggatttttcagtat

SEQ ID NO: 8080979 - DNA, 23 bp, Homo sapiens
aatttagtttgagacattagcct

SEQ ID NO: 8080980 - DNA, 21 bp, Homo sapiens
aatttagtcaacagactgtgg

SEQ ID NO: 8080981 - DNA, 22 bp, Homo sapiens
aatttagtgtaaagctactgga

SEQ ID NO: 8080982 - DNA, 20 bp, Homo sapiens
aatttactcacagaatgaat

SEQ ID NO: 8080983 - DNA, 22 bp, Homo sapiens
aattatattgaagttgaatgtc

SEQ ID NO: 8080984 - DNA, 22 bp, Homo sapiens
aattatgattggtctaaaccag

SEQ ID NO: 8080985 - DNA, 22 bp, Homo sapiens
aattatggtatgttcaacaact

SEQ ID NO: 8080986 - DNA, 22 bp, Homo sapiens
aattatattgtggtgtgaatgt

SEQ ID NO: 8080987 - DNA, 22 bp, Homo sapiens
acaaatgattttccaagccagt

SEQ ID NO: 8080988 - DNA, 19 bp, Homo sapiens
acaaatgatgttgcactga

SEQ ID NO: 8080989 - DNA, 22 bp, Homo sapiens
acaaactgggataggatcctgt

SEQ ID NO: 8080990 - DNA, 22 bp, Homo sapiens
acaaacttatgtttcatatgta

SEQ ID NO: 8080991 - DNA, 22 bp, Homo sapiens
acaaacttcccagacaagctcc

SEQ ID NO: 8080992 - DNA, 22 bp, Homo sapiens
acaaacagctaacatatgttaa

SEQ ID NO: 8080993 - DNA, 22 bp, Homo sapiens
acaaacagagttgaaaaatagg

SEQ ID NO: 8080994 - DNA, 22 bp, Homo sapiens
acaaacagagttgaaaaatagg

SEQ ID NO: 8080995 - DNA, 22 bp, Homo sapiens
aattttcacagtgctgtgagat

SEQ ID NO: 8080996 - DNA, 22 bp, Homo sapiens
aattttctggtgtgtaatgaag

SEQ ID NO: 8080997 - DNA, 20 bp, Homo sapiens
agaggccagttaggagtcta

SEQ ID NO: 8080998 - DNA, 22 bp, Homo sapiens
agaggccatgctagaggcctgg

SEQ ID NO: 8080999 - DNA, 22 bp, Homo sapiens
acaaaaagggagatgaggtaga

SEQ ID NO: 8081000 - DNA, 22 bp, Homo sapiens
acaaaaagggagatgaggtaga

SEQ ID NO: 8081001 - DNA, 21 bp, Homo sapiens
agaggccctcggactgggcgt

SEQ ID NO: 8081002 - DNA, 22 bp, Homo sapiens
acaatgtagaggctgaaagcaa

SEQ ID NO: 8081003 - DNA, 22 bp, Homo sapiens
acaatgtttttgttcaaagagt

SEQ ID NO: 8081004 - DNA, 22 bp, Homo sapiens
acaattcattaatgtgaggtag

SEQ ID NO: 8081005 - DNA, 22 bp, Homo sapiens
acaattcaagcaagagagacaa

SEQ ID NO: 8081006 - DNA, 22 bp, Homo sapiens
acaattcaagatgagattcagg

SEQ ID NO: 8081007 - DNA, 22 bp, Homo sapiens
acaattcaagatgagattcagg

SEQ ID NO: 8081008 - DNA, 22 bp, Homo sapiens
acaattcaagaagagagatgaa

SEQ ID NO: 8081009 - DNA, 22 bp, Homo sapiens
acaagtctttttcatgtcttct

SEQ ID NO: 8081010 - DNA, 22 bp, Homo sapiens
acaagtttatttgattagaaca

SEQ ID NO: 8081011 - DNA, 22 bp, Homo sapiens
agcaccccatagtcagtcacgt

SEQ ID NO: 8081012 - DNA, 22 bp, Homo sapiens
acacaggaactctgagaggtgg

SEQ ID NO: 8081013 - DNA, 22 bp, Homo sapiens
acacaggaagagagataataat

SEQ ID NO: 8081014 - DNA, 22 bp, Homo sapiens
acacaggaagcaatttcagagc

SEQ ID NO: 8081015 - DNA, 22 bp, Homo sapiens
acacaggaagagagataataat

SEQ ID NO: 8081016 - DNA, 22 bp, Homo sapiens
acacaggaagtcagcactgatg

SEQ ID NO: 8081017 - DNA, 22 bp, Homo sapiens
acacaggagaaaagatctccca

SEQ ID NO: 8081018 - DNA, 22 bp, Homo sapiens
acacaggacagggatgtgtttt

SEQ ID NO: 8081019 - DNA, 22 bp, Homo sapiens
acacaggacagggatgtgtttt

SEQ ID NO: 8081020 - DNA, 22 bp, Homo sapiens
acacaggacggccctgtggctt

SEQ ID NO: 8081021 - DNA, 21 bp, Homo sapiens
acacaggagtttcttctttct

SEQ ID NO: 8081022 - DNA, 22 bp, Homo sapiens
acacaggaggaggatggtggtc

SEQ ID NO: 8081023 - DNA, 22 bp, Homo sapiens
acacaggcaagagtgcaggtct

SEQ ID NO: 8081024 - DNA, 23 bp, Homo sapiens
acacaggatacatacggaagcaa

SEQ ID NO: 8081025 - DNA, 22 bp, Homo sapiens
acacaggagatatgtaatggct

SEQ ID NO: 8081026 - DNA, 22 bp, Homo sapiens
acacaggagagagttgggaagg

SEQ ID NO: 8081027 - DNA, 22 bp, Homo sapiens
acacaggcaatgtgagtgggag

SEQ ID NO: 8081028 - DNA, 21 bp, Homo sapiens
acacaggcagtgtcccgaggt

SEQ ID NO: 8081029 - DNA, 22 bp, Homo sapiens
acacatatatttgcatatacac

SEQ ID NO: 8081030 - DNA, 22 bp, Homo sapiens
acactgtaggagaaaggagttt

SEQ ID NO: 8081031 - DNA, 22 bp, Homo sapiens
acaccaaagtagaattaatgta

SEQ ID NO: 8081032 - DNA, 22 bp, Homo sapiens
acagaacaagacctgcttattg

SEQ ID NO: 8081033 - DNA, 22 bp, Homo sapiens
acagaacaacaaggtggaccag

SEQ ID NO: 8081034 - DNA, 22 bp, Homo sapiens
acagaaattagcagtgagttta

SEQ ID NO: 8081035 - DNA, 22 bp, Homo sapiens
acagaaattgctaatagctcat

SEQ ID NO: 8081036 - DNA, 22 bp, Homo sapiens
acagaaattctgggacagaaaa

SEQ ID NO: 8081037 - DNA, 22 bp, Homo sapiens
acagaaagataggcacaaggtc

SEQ ID NO: 8081038 - DNA, 22 bp, Homo sapiens
acagaaagataggcacaaggtc

SEQ ID NO: 8081039 - DNA, 22 bp, Homo sapiens
acagataatacattgtgctaca

SEQ ID NO: 8081040 - DNA, 22 bp, Homo sapiens
acagagcatttgggacagagag

SEQ ID NO: 8081041 - DNA, 22 bp, Homo sapiens
acagagcataatgtctagcaca

SEQ ID NO: 8081042 - DNA, 22 bp, Homo sapiens
acagagcatgctcagtgtgtga

SEQ ID NO: 8081043 - DNA, 22 bp, Homo sapiens
agccacagtctgatgcctgaga

SEQ ID NO: 8081044 - DNA, 22 bp, Homo sapiens
agccacaggtgttggccagtgt

SEQ ID NO: 8081045 - DNA, 22 bp, Homo sapiens
agctatgttctgtgtctgtgga

SEQ ID NO: 8081046 - DNA, 22 bp, Homo sapiens
agctatgttatcattggtcctt

SEQ ID NO: 8081047 - DNA, 20 bp, Homo sapiens
agctatgtgacctgatggaa

SEQ ID NO: 8081048 - DNA, 21 bp, Homo sapiens
acagcaagccttcacatgagt

SEQ ID NO: 8081049 - DNA, 22 bp, Homo sapiens
acagcaataggaaatacttgca

SEQ ID NO: 8081050 - DNA, 22 bp, Homo sapiens
acagcaatctgagagacatagt

SEQ ID NO: 8081051 - DNA, 22 bp, Homo sapiens
acagcaaaagacaagaacttaa

SEQ ID NO: 8081052 - DNA, 22 bp, Homo sapiens
acagcaaatggttttctgtctg

SEQ ID NO: 8081053 - DNA, 22 bp, Homo sapiens
acagcaaatggttttctgtctg

SEQ ID NO: 8081054 - DNA, 22 bp, Homo sapiens
acagcaaaggacgaacactctg

SEQ ID NO: 8081055 - DNA, 19 bp, Homo sapiens
agctcctgttcagcagctc

SEQ ID NO: 8081056 - DNA, 22 bp, Homo sapiens
aagggcccagccaagctatgct

SEQ ID NO: 8081057 - DNA, 22 bp, Homo sapiens
aaggctttgaaaaccaaaaggt

SEQ ID NO: 8081058 - DNA, 22 bp, Homo sapiens
aaggcttttgggaattttcaac

SEQ ID NO: 8081059 - DNA, 22 bp, Homo sapiens
aaggcttttgttcctatttagt

SEQ ID NO: 8081060 - DNA, 22 bp, Homo sapiens
aaggctttatgtgaccaaaaga

SEQ ID NO: 8081061 - DNA, 22 bp, Homo sapiens
aagtacagccttcattctcatg

SEQ ID NO: 8081062 - DNA, 22 bp, Homo sapiens
aagtacttgatagattaactgt

SEQ ID NO: 8081063 - DNA, 22 bp, Homo sapiens
aagtacgtgcctccacttgtgt

SEQ ID NO: 8081064 - DNA, 22 bp, Homo sapiens
accccagggctgccagcctcct

SEQ ID NO: 8081065 - DNA, 23 bp, Homo sapiens
accccaggcatcgcattcctctt

SEQ ID NO: 8081066 - DNA, 22 bp, Homo sapiens
accccaggcccagggaagaggc

SEQ ID NO: 8081067 - DNA, 22 bp, Homo sapiens
accccaggtctccaggctctgg

SEQ ID NO: 8081068 - DNA, 22 bp, Homo sapiens
aagtaacagcatcaagtctcaa

SEQ ID NO: 8081069 - DNA, 21 bp, Homo sapiens
accatcttccatgcattatat

SEQ ID NO: 8081070 - DNA, 22 bp, Homo sapiens
aaggtgactcacaaagccagtt

SEQ ID NO: 8081071 - DNA, 22 bp, Homo sapiens
acagtataactccatgccaccc

SEQ ID NO: 8081072 - DNA, 22 bp, Homo sapiens
aaggcagccgtgtgactgcatg

SEQ ID NO: 8081073 - DNA, 22 bp, Homo sapiens
aaggcagctcagctcatggcag

SEQ ID NO: 8081074 - DNA, 22 bp, Homo sapiens
acagttcctgactttaactcca

SEQ ID NO: 8081075 - DNA, 22 bp, Homo sapiens
aaggcagagatattcttgatct

SEQ ID NO: 8081076 - DNA, 22 bp, Homo sapiens
aaggcagggaaagtggattagg

SEQ ID NO: 8081077 - DNA, 22 bp, Homo sapiens
aaggcaggatgggaaaagattt

SEQ ID NO: 8081078 - DNA, 22 bp, Homo sapiens
aaggcagcttcaccacagcatt

SEQ ID NO: 8081079 - DNA, 22 bp, Homo sapiens
aagctttaaggaattttatgga

SEQ ID NO: 8081080 - DNA, 22 bp, Homo sapiens
aagcttgtcagtgcaattttac

SEQ ID NO: 8081081 - DNA, 22 bp, Homo sapiens
acagtacagctgaaactttagt

SEQ ID NO: 8081082 - DNA, 22 bp, Homo sapiens
agaaaacactgccccctctctc

SEQ ID NO: 8081083 - DNA, 22 bp, Homo sapiens
agaaaacattacataggtgtgt

SEQ ID NO: 8081084 - DNA, 22 bp, Homo sapiens
aatgaaactatatttagagagg

SEQ ID NO: 8081085 - DNA, 22 bp, Homo sapiens
aatgaacatataaagagatctt

SEQ ID NO: 8081086 - DNA, 22 bp, Homo sapiens
agaaatacaaagtactaagata

SEQ ID NO: 8081087 - DNA, 20 bp, Homo sapiens
agaaatacatgcatgcatga

SEQ ID NO: 8081088 - DNA, 22 bp, Homo sapiens
agaaatactaggaatattcata

SEQ ID NO: 8081089 - DNA, 18 bp, Homo sapiens
agaaataccagtattgga

SEQ ID NO: 8081090 - DNA, 22 bp, Homo sapiens
aatgagttctggttcattttat

SEQ ID NO: 8081091 - DNA, 22 bp, Homo sapiens
aatgagcaaatgaagacgctgt

SEQ ID NO: 8081092 - DNA, 22 bp, Homo sapiens
aatgactgtagtcatattaagg

SEQ ID NO: 8081093 - DNA, 20 bp, Homo sapiens
agaaatactttggtataatg

SEQ ID NO: 8081094 - DNA, 22 bp, Homo sapiens
agaaatactgcctaagactgta

SEQ ID NO: 8081095 - DNA, 22 bp, Homo sapiens
aatgactagtccacatttgtaa

SEQ ID NO: 8081096 - DNA, 22 bp, Homo sapiens
acttgttaactctcaaagaaca

SEQ ID NO: 8081097 - DNA, 22 bp, Homo sapiens
aatcaagaataagttgtaaagc

SEQ ID NO: 8081098 - DNA, 22 bp, Homo sapiens
acttgtaaacaaatctaatgta

SEQ ID NO: 8081099 - DNA, 21 bp, Homo sapiens
acttgtaacttgaaggggcat

SEQ ID NO: 8081100 - DNA, 22 bp, Homo sapiens
acttgtaattcctggcccaggt

SEQ ID NO: 8081101 - DNA, 22 bp, Homo sapiens
acttgtaagctctgtatttgag

SEQ ID NO: 8081102 - DNA, 22 bp, Homo sapiens
acttgtaagtaacaagtgagaa

SEQ ID NO: 8081103 - DNA, 22 bp, Homo sapiens
aatattttaggctttccaggct

SEQ ID NO: 8081104 - DNA, 22 bp, Homo sapiens
aatatttttgaggccctgttat

SEQ ID NO: 8081105 - DNA, 22 bp, Homo sapiens
aatatttttgaggccctgttat

SEQ ID NO: 8081106 - DNA, 22 bp, Homo sapiens
aatcaacattgttttaagtcaa

SEQ ID NO: 8081107 - DNA, 22 bp, Homo sapiens
actttaaaaagagccttctaac

SEQ ID NO: 8081108 - DNA, 22 bp, Homo sapiens
aatccatttactctttacaaga

SEQ ID NO: 8081109 - DNA, 21 bp, Homo sapiens
aatacagaaatgagtagttgc

SEQ ID NO: 8081110 - DNA, 22 bp, Homo sapiens
acttgaaacatctttaaatgta

SEQ ID NO: 8081111 - DNA, 19 bp, Homo sapiens
aatattttagcctcttcct

SEQ ID NO: 8081112 - DNA, 18 bp, Homo sapiens
aatatcaataagggggag

SEQ ID NO: 8081113 - DNA, 23 bp, Homo sapiens
aatatcaaggtgatgttcccaga

SEQ ID NO: 8081114 - DNA, 22 bp, Homo sapiens
aatatcaacagtgtccttctaa

SEQ ID NO: 8081115 - DNA, 22 bp, Homo sapiens
aatatatagaagtacccgttgt

SEQ ID NO: 8081116 - DNA, 22 bp, Homo sapiens
aagtcacagaacccattgtaac

SEQ ID NO: 8081117 - DNA, 22 bp, Homo sapiens
aagtcagacagctgagctgcct

SEQ ID NO: 8081118 - DNA, 22 bp, Homo sapiens
actaacatgttaatcaaaagaa

SEQ ID NO: 8081119 - DNA, 22 bp, Homo sapiens
aagttagtgcctccttaaattt

SEQ ID NO: 8081120 - DNA, 22 bp, Homo sapiens
aataacttaagaaatttcccca

SEQ ID NO: 8081121 - DNA, 22 bp, Homo sapiens
aagtttactgtccctggaaact

SEQ ID NO: 8081122 - DNA, 22 bp, Homo sapiens
aagtttagtattagggaaaagt

SEQ ID NO: 8081123 - DNA, 22 bp, Homo sapiens
aagttggtaggagacagaaggt

SEQ ID NO: 8081124 - DNA, 22 bp, Homo sapiens
aagttggtgtatgagacagaag

SEQ ID NO: 8081125 - DNA, 22 bp, Homo sapiens
aagttctatagtctttctacta

SEQ ID NO: 8081126 - DNA, 23 bp, Homo sapiens
aagttgtttttggccagggaaag

SEQ ID NO: 8081127 - DNA, 22 bp, Homo sapiens
aagtttacataagtgatgatga

SEQ ID NO: 8081128 - DNA, 22 bp, Homo sapiens
aataattttagctcagagttgt

SEQ ID NO: 8081129 - DNA, 22 bp, Homo sapiens
aataatgtgatagataagggaa

SEQ ID NO: 8081130 - DNA, 22 bp, Homo sapiens
aataatagttgcaaagtgttta

SEQ ID NO: 8081131 - DNA, 17 bp, Homo sapiens
agagttttaagaaattt

SEQ ID NO: 8081132 - DNA, 22 bp, Homo sapiens
agataaacccaacttaatgaag

SEQ ID NO: 8081133 - DNA, 22 bp, Homo sapiens
atttcacattaatttgatgctc

SEQ ID NO: 8081134 - DNA, 22 bp, Homo sapiens
agagttctgaaattatctttac

SEQ ID NO: 8081135 - DNA, 22 bp, Homo sapiens
agagttctgaattttattctct

SEQ ID NO: 8081136 - DNA, 22 bp, Homo sapiens
agagttgctccattagaactta

SEQ ID NO: 8081137 - DNA, 22 bp, Homo sapiens
attgcctttggaggaagaaagc

SEQ ID NO: 8081138 - DNA, 22 bp, Homo sapiens
attgccttgtcagatttctttt

SEQ ID NO: 8081139 - DNA, 22 bp, Homo sapiens
atttggcaaaaattagcagtag

SEQ ID NO: 8081140 - DNA, 18 bp, Homo sapiens
atttggcagatgatgaac

SEQ ID NO: 8081141 - DNA, 20 bp, Homo sapiens
atttggcatagtttaagcaa

SEQ ID NO: 8081142 - DNA, 22 bp, Homo sapiens
atttggcatagagtatcattct

SEQ ID NO: 8081143 - DNA, 22 bp, Homo sapiens
caaaagggagttctctggaagg

SEQ ID NO: 8081144 - DNA, 22 bp, Homo sapiens
caaaagtaattgcagtttttgc

SEQ ID NO: 8081145 - DNA, 22 bp, Homo sapiens
atttccttcagtgtttaatact

SEQ ID NO: 8081146 - DNA, 21 bp, Homo sapiens
agatagttgggcatgcagctg

SEQ ID NO: 8081147 - DNA, 22 bp, Homo sapiens
agatactgaaatccaatggcca

SEQ ID NO: 8081148 - DNA, 22 bp, Homo sapiens
agatactgattctcaatggctc

SEQ ID NO: 8081149 - DNA, 22 bp, Homo sapiens
atttccttcatcagcctatcct

SEQ ID NO: 8081150 - DNA, 17 bp, Homo sapiens
atttggaatttctcttc

SEQ ID NO: 8081151 - DNA, 22 bp, Homo sapiens
atttctctgcctcagcttctgc

SEQ ID NO: 8081152 - DNA, 22 bp, Homo sapiens
atgtttacaattcagtattaca

SEQ ID NO: 8081153 - DNA, 22 bp, Homo sapiens
agaggagaatccgtttccttgc

SEQ ID NO: 8081154 - DNA, 22 bp, Homo sapiens
attattattttagagagaggcc

SEQ ID NO: 8081155 - DNA, 22 bp, Homo sapiens
attattattgttgatgttaggg

SEQ ID NO: 8081156 - DNA, 21 bp, Homo sapiens
attattataaagaccacaggg

SEQ ID NO: 8081157 - DNA, 22 bp, Homo sapiens
attccagtgtgcatggtacaca

SEQ ID NO: 8081158 - DNA, 22 bp, Homo sapiens
attcatttaggtattcacttac

SEQ ID NO: 8081159 - DNA, 22 bp, Homo sapiens
agaggcagcagtcatactacag

SEQ ID NO: 8081160 - DNA, 22 bp, Homo sapiens
atgggggcctgaacaggcaaaa

SEQ ID NO: 8081161 - DNA, 22 bp, Homo sapiens
atgggggcggctgaagcccagg

SEQ ID NO: 8081162 - DNA, 22 bp, Homo sapiens
atgtcaaatcagttttatcaga

SEQ ID NO: 8081163 - DNA, 22 bp, Homo sapiens
atgtcaaatcagttttatcaga

SEQ ID NO: 8081164 - DNA, 22 bp, Homo sapiens
atgtatttgcttgttatggatt

SEQ ID NO: 8081165 - DNA, 22 bp, Homo sapiens
atgtgtaaattgttaggtttaa

SEQ ID NO: 8081166 - DNA, 21 bp, Homo sapiens
agagacagagaaagtaacatt

SEQ ID NO: 8081167 - DNA, 22 bp, Homo sapiens
atggcctggccagagctctgct

SEQ ID NO: 8081168 - DNA, 20 bp, Homo sapiens
atggcctgctagaagtctgt

SEQ ID NO: 8081169 - DNA, 22 bp, Homo sapiens
atggcctggggattcctgagca

SEQ ID NO: 8081170 - DNA, 22 bp, Homo sapiens
agagaagacttacagccacagt

SEQ ID NO: 8081171 - DNA, 22 bp, Homo sapiens
agaccaaagaaaacacatctgg

SEQ ID NO: 8081172 - DNA, 22 bp, Homo sapiens
agacattttgatacccctaccg

SEQ ID NO: 8081173 - DNA, 22 bp, Homo sapiens
atgaaatttgctgctaagttcc

SEQ ID NO: 8081174 - DNA, 22 bp, Homo sapiens
atgaaatttgaccaattattta

SEQ ID NO: 8081175 - DNA, 22 bp, Homo sapiens
atgaaagcaacttatttgagat

SEQ ID NO: 8081176 - DNA, 22 bp, Homo sapiens
agacaaaggattaatgatgatg

SEQ ID NO: 8081177 - DNA, 22 bp, Homo sapiens
agacaaaccttgttttatgatg

SEQ ID NO: 8081178 - DNA, 22 bp, Homo sapiens
atgaacaatctggcaagaactt

SEQ ID NO: 8081179 - DNA, 22 bp, Homo sapiens
agaagtttggtcctataaactc

SEQ ID NO: 8081180 - DNA, 22 bp, Homo sapiens
atgcacttaaataacataactt

SEQ ID NO: 8081181 - DNA, 22 bp, Homo sapiens
atgacaaaatgaatgcagctag

SEQ ID NO: 8081182 - DNA, 22 bp, Homo sapiens
agacagcatgatacatgatgct

SEQ ID NO: 8081183 - DNA, 22 bp, Homo sapiens
cagaatcagcccttgctattaa

SEQ ID NO: 8081184 - DNA, 22 bp, Homo sapiens
cagaatatgacaagattttcct

SEQ ID NO: 8081185 - DNA, 22 bp, Homo sapiens
agccactgtgagaggaccaggg

SEQ ID NO: 8081186 - DNA, 22 bp, Homo sapiens
agccagactttaaaatagatga

SEQ ID NO: 8081187 - DNA, 22 bp, Homo sapiens
cagacagtggacttgataaagg

SEQ ID NO: 8081188 - DNA, 22 bp, Homo sapiens
agccactggcctgggcagctct

SEQ ID NO: 8081189 - DNA, 22 bp, Homo sapiens
cagaaatatcagttgaaagtgc

SEQ ID NO: 8081190 - DNA, 22 bp, Homo sapiens
cagaaatatcagttgaaagtgc

SEQ ID NO: 8081191 - DNA, 22 bp, Homo sapiens
cagaaatattccaagtactgca

SEQ ID NO: 8081192 - DNA, 22 bp, Homo sapiens
agcatatacaaactcatataca

SEQ ID NO: 8081193 - DNA, 22 bp, Homo sapiens
agccacagtctgtagccagctt

SEQ ID NO: 8081194 - DNA, 22 bp, Homo sapiens
agccacaggaaacagagacagc

SEQ ID NO: 8081195 - DNA, 22 bp, Homo sapiens
cagacttttgacattaatacag

SEQ ID NO: 8081196 - DNA, 22 bp, Homo sapiens
cagagaaagaagcccattcatt

SEQ ID NO: 8081197 - DNA, 22 bp, Homo sapiens
agcctccctatgcaccttcagg

SEQ ID NO: 8081198 - DNA, 22 bp, Homo sapiens
agcctggcactgaggcagggcg

SEQ ID NO: 8081199 - DNA, 22 bp, Homo sapiens
cagcagctgactccaagagagc

SEQ ID NO: 8081200 - DNA, 23 bp, Homo sapiens
cagccctgaaatcgaggtgacac

SEQ ID NO: 8081201 - DNA, 22 bp, Homo sapiens
cagctaaggctccttctaggta

SEQ ID NO: 8081202 - DNA, 23 bp, Homo sapiens
agctcctgaggccagcctctcct

SEQ ID NO: 8081203 - DNA, 22 bp, Homo sapiens
agctcctgatacatgcaggaat

SEQ ID NO: 8081204 - DNA, 22 bp, Homo sapiens
caaaagttattgcggtttttgc

SEQ ID NO: 8081205 - DNA, 22 bp, Homo sapiens
caaaagttctcacccagacatg

SEQ ID NO: 8081206 - DNA, 20 bp, Homo sapiens
agcaaactcttcccatcttc

SEQ ID NO: 8081207 - DNA, 22 bp, Homo sapiens
agcaaactaattgcagttctgg

SEQ ID NO: 8081208 - DNA, 22 bp, Homo sapiens
agcaaacctgcagccttctgag

SEQ ID NO: 8081209 - DNA, 22 bp, Homo sapiens
caaatagacttcaatctcttga

SEQ ID NO: 8081210 - DNA, 22 bp, Homo sapiens
caaatagtgtcacattgtgagg

SEQ ID NO: 8081211 - DNA, 22 bp, Homo sapiens
caaatagtttttcatgtattat

SEQ ID NO: 8081212 - DNA, 22 bp, Homo sapiens
caaatatctttggcaaagagaa

SEQ ID NO: 8081213 - DNA, 22 bp, Homo sapiens
caatttttgtacttatagtact

SEQ ID NO: 8081214 - DNA, 22 bp, Homo sapiens
caagagcatttagttagctggt

SEQ ID NO: 8081215 - DNA, 22 bp, Homo sapiens
caagagcaggtgctgcttccat

SEQ ID NO: 8081216 - DNA, 22 bp, Homo sapiens
caagagcacgtgccctccataa

SEQ ID NO: 8081217 - DNA, 22 bp, Homo sapiens
cacagtttggttttgctgtaat

SEQ ID NO: 8081218 - DNA, 22 bp, Homo sapiens
cacagttcctgaatatatcaca

SEQ ID NO: 8081219 - DNA, 22 bp, Homo sapiens
cacagtttcaataattattctt

SEQ ID NO: 8081220 - DNA, 22 bp, Homo sapiens
cacagtttctataggtcagaat

SEQ ID NO: 8081221 - DNA, 22 bp, Homo sapiens
agcagctgatcaaagcacttat

SEQ ID NO: 8081222 - DNA, 22 bp, Homo sapiens
cacacaaatattctggaggcaa

SEQ ID NO: 8081223 - DNA, 22 bp, Homo sapiens
cacccagggctgtgcctgccca

SEQ ID NO: 8081224 - DNA, 22 bp, Homo sapiens
cacccaggctggagtgcagtgg

SEQ ID NO: 8081225 - DNA, 22 bp, Homo sapiens
cactgcacttcagcctgggtga

SEQ ID NO: 8081226 - DNA, 22 bp, Homo sapiens
agcatacaggtctgaaacagct

SEQ ID NO: 8081227 - DNA, 22 bp, Homo sapiens
agcagggggagttagactagat

SEQ ID NO: 8081228 - DNA, 22 bp, Homo sapiens
cacccaggctggagtgcagtga

SEQ ID NO: 8081229 - DNA, 22 bp, Homo sapiens
cacccaggctggagagcagtgg

SEQ ID NO: 8081230 - DNA, 22 bp, Homo sapiens
agcagggttccaggagttgcag

SEQ ID NO: 8081231 - DNA, 22 bp, Homo sapiens
agcagggttccttaaggccata

SEQ ID NO: 8081232 - DNA, 22 bp, Homo sapiens
agcagggtatgttagagctgta

SEQ ID NO: 8081233 - DNA, 22 bp, Homo sapiens
agcagggtttggggattggcac

SEQ ID NO: 8081234 - DNA, 22 bp, Homo sapiens
agcaggggtggaaggtagcttt

SEQ ID NO: 8081235 - DNA, 22 bp, Homo sapiens
atctaagagagagagcatgtct

SEQ ID NO: 8081236 - DNA, 22 bp, Homo sapiens
atctaaaatgtggttagttggt

SEQ ID NO: 8081237 - DNA, 22 bp, Homo sapiens
agaaagtttattcctatctagc

SEQ ID NO: 8081238 - DNA, 22 bp, Homo sapiens
agaaagtttgagaactgtagat

SEQ ID NO: 8081239 - DNA, 22 bp, Homo sapiens
agaaagtttatttcttgatgga

SEQ ID NO: 8081240 - DNA, 22 bp, Homo sapiens
agaaagtttggggctgggcacg

SEQ ID NO: 8081241 - DNA, 23 bp, Homo sapiens
agaaagtttgtgccttgtgacac

SEQ ID NO: 8081242 - DNA, 23 bp, Homo sapiens
agaaagtcatggccaggtttgat

SEQ ID NO: 8081243 - DNA, 22 bp, Homo sapiens
agaaagttctgtgagttgttca

SEQ ID NO: 8081244 - DNA, 22 bp, Homo sapiens
agaaagttgttggaggaaatga

SEQ ID NO: 8081245 - DNA, 22 bp, Homo sapiens
agaaagttgttttagccaaacc

SEQ ID NO: 8081246 - DNA, 22 bp, Homo sapiens
agaaagttatcacaaaattgag

SEQ ID NO: 8081247 - DNA, 22 bp, Homo sapiens
agaaagttatcacaaaattgag

SEQ ID NO: 8081248 - DNA, 22 bp, Homo sapiens
agaaagttcactggtatatttt

SEQ ID NO: 8081249 - DNA, 22 bp, Homo sapiens
agaaagttagcagactcttggc

SEQ ID NO: 8081250 - DNA, 22 bp, Homo sapiens
agaaagttaaacagtgataaga

SEQ ID NO: 8081251 - DNA, 22 bp, Homo sapiens
agaaaagtgctctagtgagagc

SEQ ID NO: 8081252 - DNA, 23 bp, Homo sapiens
agaaaagttcatacctttttaac

SEQ ID NO: 8081253 - DNA, 22 bp, Homo sapiens
atattctctgctgcttttgtgt

SEQ ID NO: 8081254 - DNA, 22 bp, Homo sapiens
atattacacacggtatcacggg

SEQ ID NO: 8081255 - DNA, 22 bp, Homo sapiens
atatttcacgtaggttgttttc

SEQ ID NO: 8081256 - DNA, 22 bp, Homo sapiens
atatggacttaaaatttgatgt

SEQ ID NO: 8081257 - DNA, 22 bp, Homo sapiens
actttctcccacccacccgtct

SEQ ID NO: 8081258 - DNA, 20 bp, Homo sapiens
actttctcggtttctcacct

SEQ ID NO: 8081259 - DNA, 22 bp, Homo sapiens
actttctatggcttattatgag

SEQ ID NO: 8081260 - DNA, 22 bp, Homo sapiens
actttctaggtgctattgtgat

SEQ ID NO: 8081261 - DNA, 22 bp, Homo sapiens
actttctaggtctcagtccttt

SEQ ID NO: 8081262 - DNA, 22 bp, Homo sapiens
actttctcaggaattcacagac

SEQ ID NO: 8081263 - DNA, 22 bp, Homo sapiens
actttctattcccacagagata

SEQ ID NO: 8081264 - DNA, 22 bp, Homo sapiens
actttctaaaattgctagcact

SEQ ID NO: 8081265 - DNA, 22 bp, Homo sapiens
actttccctctcagaactctta

SEQ ID NO: 8081266 - DNA, 22 bp, Homo sapiens
actttcccacttaatgtattta

SEQ ID NO: 8081267 - DNA, 23 bp, Homo sapiens
actttcccatagcatggcttcct

SEQ ID NO: 8081268 - DNA, 22 bp, Homo sapiens
actttcaagaacttctttaatg

SEQ ID NO: 8081269 - DNA, 22 bp, Homo sapiens
atactgaattaggtaaagcata

SEQ ID NO: 8081270 - DNA, 22 bp, Homo sapiens
atactgaaaaatgatttgctgt

SEQ ID NO: 8081271 - DNA, 22 bp, Homo sapiens
atactgaacatgtttgcagtca

SEQ ID NO: 8081272 - DNA, 22 bp, Homo sapiens
atactgaaagggtgttacctaa

SEQ ID NO: 8081273 - DNA, 22 bp, Homo sapiens
atactgattgatattcccatga

SEQ ID NO: 8081274 - DNA, 22 bp, Homo sapiens
acttctgtatgtcctgcattca

SEQ ID NO: 8081275 - DNA, 22 bp, Homo sapiens
acttctgtcctccaagccacgt

SEQ ID NO: 8081276 - DNA, 22 bp, Homo sapiens
acttctgtatgtcctgcattca

SEQ ID NO: 8081277 - DNA, 22 bp, Homo sapiens
acttctgtaaagggaagacagt

SEQ ID NO: 8081278 - DNA, 22 bp, Homo sapiens
atacattagtgaacaaaagaga

SEQ ID NO: 8081279 - DNA, 22 bp, Homo sapiens
atacattagaatctggtactca

SEQ ID NO: 8081280 - DNA, 22 bp, Homo sapiens
atacatgttgtaccatatgttt

SEQ ID NO: 8081281 - DNA, 22 bp, Homo sapiens
ataatgcatttagaataattca

SEQ ID NO: 8081282 - DNA, 21 bp, Homo sapiens
acttaaattccttgatattta

SEQ ID NO: 8081283 - DNA, 23 bp, Homo sapiens
acttaaatggttctttatctcag

SEQ ID NO: 8081284 - DNA, 22 bp, Homo sapiens
acttaaatagaactcctcaata

SEQ ID NO: 8081285 - DNA, 22 bp, Homo sapiens
acttacaatcaaccaccttgga

SEQ ID NO: 8081286 - DNA, 22 bp, Homo sapiens
acttaagatagagcaagtctga

SEQ ID NO: 8081287 - DNA, 22 bp, Homo sapiens
acttaagatagagcaagtctga

SEQ ID NO: 8081288 - DNA, 22 bp, Homo sapiens
atacacttgtacattttttaat

SEQ ID NO: 8081289 - DNA, 22 bp, Homo sapiens
atacagcagcccttgctttgca

SEQ ID NO: 8081290 - DNA, 22 bp, Homo sapiens
atacagcttacagttctaatgc

SEQ ID NO: 8081291 - DNA, 22 bp, Homo sapiens
atacagcttatgcatatatctc

SEQ ID NO: 8081292 - DNA, 22 bp, Homo sapiens
atacagctttctttcacatgag

SEQ ID NO: 8081293 - DNA, 22 bp, Homo sapiens
atacagctttctttcacatgag

SEQ ID NO: 8081294 - DNA, 22 bp, Homo sapiens
actgtatttggatataagatct

SEQ ID NO: 8081295 - DNA, 22 bp, Homo sapiens
actgtattttgggtgtattttc

SEQ ID NO: 8081296 - DNA, 22 bp, Homo sapiens
actgtcaaaagagattatatta

SEQ ID NO: 8081297 - DNA, 22 bp, Homo sapiens
actgtatacttctgtatacaat

SEQ ID NO: 8081298 - DNA, 22 bp, Homo sapiens
actgtatacttctgtatacaat

SEQ ID NO: 8081299 - DNA, 22 bp, Homo sapiens
actgtattcctactagaatcta

SEQ ID NO: 8081300 - DNA, 22 bp, Homo sapiens
actgtattggaaatatagcaaa

SEQ ID NO: 8081301 - DNA, 22 bp, Homo sapiens
actgtaacactcatactgaagt

SEQ ID NO: 8081302 - DNA, 22 bp, Homo sapiens
actgtaaattttggttgcaggt

SEQ ID NO: 8081303 - DNA, 22 bp, Homo sapiens
actgtaaattttggttgcaggt

SEQ ID NO: 8081304 - DNA, 22 bp, Homo sapiens
ataaaatttgctactgttaaat

SEQ ID NO: 8081305 - DNA, 22 bp, Homo sapiens
ataaacaagactggccaacttt

SEQ ID NO: 8081306 - DNA, 22 bp, Homo sapiens
ataaaatggtaaacgaagctga

SEQ ID NO: 8081307 - DNA, 22 bp, Homo sapiens
ataaacagctccatttagtgcc

SEQ ID NO: 8081308 - DNA, 22 bp, Homo sapiens
ataatgaatcagcatagggtga

SEQ ID NO: 8081309 - DNA, 22 bp, Homo sapiens
acctggctgagaacgtgcagct

SEQ ID NO: 8081310 - DNA, 20 bp, Homo sapiens
acctggctctcaggagcaac

SEQ ID NO: 8081311 - DNA, 22 bp, Homo sapiens
aggtcctgtgtccaggggcctg

SEQ ID NO: 8081312 - DNA, 22 bp, Homo sapiens
aggtcctgtttcttccctgggg

SEQ ID NO: 8081313 - DNA, 22 bp, Homo sapiens
actagaaattactcagaataaa

SEQ ID NO: 8081314 - DNA, 22 bp, Homo sapiens
agtaaacagaaagcaagatgat

SEQ ID NO: 8081315 - DNA, 22 bp, Homo sapiens
agtaaaattgtattggaaaaca

SEQ ID NO: 8081316 - DNA, 22 bp, Homo sapiens
agtattttcgccatcacaagaa

SEQ ID NO: 8081317 - DNA, 22 bp, Homo sapiens
agtattttcaaccatagcctgg

SEQ ID NO: 8081318 - DNA, 22 bp, Homo sapiens
agtatactagtgcagcatgtat

SEQ ID NO: 8081319 - DNA, 22 bp, Homo sapiens
agtgtttacattgaagcttgta

SEQ ID NO: 8081320 - DNA, 20 bp, Homo sapiens
agtgtttagaatactattat

SEQ ID NO: 8081321 - DNA, 22 bp, Homo sapiens
agtgtttagcatgaagttcatt

SEQ ID NO: 8081322 - DNA, 22 bp, Homo sapiens
agtgttgtaataaatatcatct

SEQ ID NO: 8081323 - DNA, 22 bp, Homo sapiens
agtgtttaagttacacacatat

SEQ ID NO: 8081324 - DNA, 22 bp, Homo sapiens
agtgtttaaactgaagtgatga

SEQ ID NO: 8081325 - DNA, 22 bp, Homo sapiens
agtgtttaatgccttttccagc

SEQ ID NO: 8081326 - DNA, 22 bp, Homo sapiens
actggaaattgagaggtcactg

SEQ ID NO: 8081327 - DNA, 22 bp, Homo sapiens
agtggcagggctggctgctgca

SEQ ID NO: 8081328 - DNA, 22 bp, Homo sapiens
agtggcagtggctgggcagagc

SEQ ID NO: 8081329 - DNA, 22 bp, Homo sapiens
agtgcaatgtgtacagaaaaat

SEQ ID NO: 8081330 - DNA, 22 bp, Homo sapiens
agtcttctttcatttactcagt

SEQ ID NO: 8081331 - DNA, 22 bp, Homo sapiens
agtcttcttgatcttttcagtg

SEQ ID NO: 8081332 - DNA, 22 bp, Homo sapiens
agtctttactaaacagaccacc

SEQ ID NO: 8081333 - DNA, 22 bp, Homo sapiens
agtctttacatgtgttatatat

SEQ ID NO: 8081334 - DNA, 22 bp, Homo sapiens
agtctttagggaggtcagagtt

SEQ ID NO: 8081335 - DNA, 22 bp, Homo sapiens
agggcagcaaagtttgacctca

SEQ ID NO: 8081336 - DNA, 22 bp, Homo sapiens
agggcagcaatgcagctgctgc

SEQ ID NO: 8081337 - DNA, 22 bp, Homo sapiens
agggcagcacaaggcatggact

SEQ ID NO: 8081338 - DNA, 22 bp, Homo sapiens
agggcagcaatttggttcctgg

SEQ ID NO: 8081339 - DNA, 22 bp, Homo sapiens
agggcagcagcccatggctctg

SEQ ID NO: 8081340 - DNA, 22 bp, Homo sapiens
agggcagcacagctgtgctcct

SEQ ID NO: 8081341 - DNA, 22 bp, Homo sapiens
agggcagcagcggcccaggcct

SEQ ID NO: 8081342 - DNA, 22 bp, Homo sapiens
agggctgcccagtgtgagagct

SEQ ID NO: 8081343 - DNA, 22 bp, Homo sapiens
agggctgcctgactccagagcc

SEQ ID NO: 8081344 - DNA, 22 bp, Homo sapiens
agggctgccccagtccagccgg

SEQ ID NO: 8081345 - DNA, 22 bp, Homo sapiens
agggctgcctgctctgcattga

SEQ ID NO: 8081346 - DNA, 22 bp, Homo sapiens
agggctgctatgttgattcaga

SEQ ID NO: 8081347 - DNA, 22 bp, Homo sapiens
agggctgctaccttaatcagtt

SEQ ID NO: 8081348 - DNA, 22 bp, Homo sapiens
agggctgctcctccttcaggcc

SEQ ID NO: 8081349 - DNA, 19 bp, Homo sapiens
agggctgctctggcctggg

SEQ ID NO: 8081350 - DNA, 22 bp, Homo sapiens
agggggctcagcaggctctgga

SEQ ID NO: 8081351 - DNA, 22 bp, Homo sapiens
agggggctcagcatggatggag

SEQ ID NO: 8081352 - DNA, 22 bp, Homo sapiens
agggggctcctccggtgcttcc

SEQ ID NO: 8081353 - DNA, 22 bp, Homo sapiens
agggggctcagtgactgaagtg

SEQ ID NO: 8081354 - DNA, 22 bp, Homo sapiens
accctccactttatctgtcttt

SEQ ID NO: 8081355 - DNA, 22 bp, Homo sapiens
acatttgacatttagtatcagc

SEQ ID NO: 8081356 - DNA, 22 bp, Homo sapiens
acatttcttttcatctctatat

SEQ ID NO: 8081357 - DNA, 22 bp, Homo sapiens
acatttctaatttaatgtaaca

SEQ ID NO: 8081358 - DNA, 22 bp, Homo sapiens
acatgtttggctctatgctata

SEQ ID NO: 8081359 - DNA, 22 bp, Homo sapiens
acatgtttacattaggtgatat

SEQ ID NO: 8081360 - DNA, 22 bp, Homo sapiens
acatgtttaagtttgttatatg

SEQ ID NO: 8081361 - DNA, 22 bp, Homo sapiens
acatgtttaagtttaatgaaaa

SEQ ID NO: 8081362 - DNA, 22 bp, Homo sapiens
acatattttgaaagctttctaa

SEQ ID NO: 8081363 - DNA, 22 bp, Homo sapiens
acatgcttttcccacaattata

SEQ ID NO: 8081364 - DNA, 22 bp, Homo sapiens
acatattaactgcactacacta

SEQ ID NO: 8081365 - DNA, 22 bp, Homo sapiens
acagtttagagcatgatgacca

SEQ ID NO: 8081366 - DNA, 22 bp, Homo sapiens
acagtttataaaaataatgagg

SEQ ID NO: 8081367 - DNA, 22 bp, Homo sapiens
acagtatttgcgatactgatga

SEQ ID NO: 8081368 - DNA, 22 bp, Homo sapiens
acagtccttgtttcggtcagat

SEQ ID NO: 8081369 - DNA, 22 bp, Homo sapiens
acagtccttgtgtggaacatta

SEQ ID NO: 8081370 - DNA, 22 bp, Homo sapiens
acagtctcttggaattttcaga

SEQ ID NO: 8081371 - DNA, 22 bp, Homo sapiens
acagtctacttgagcttgtata

SEQ ID NO: 8081372 - DNA, 22 bp, Homo sapiens
acagtaaatcaacagaatatct

SEQ ID NO: 8081373 - DNA, 22 bp, Homo sapiens
acagtaaatcaacagaatatct

SEQ ID NO: 8081374 - DNA, 22 bp, Homo sapiens
acagtaaatcaacagaatatct

SEQ ID NO: 8081375 - DNA, 22 bp, Homo sapiens
aggagcaaatgatgagacagca

SEQ ID NO: 8081376 - DNA, 22 bp, Homo sapiens
aggagcagaatttaatgtgcag

SEQ ID NO: 8081377 - DNA, 22 bp, Homo sapiens
acagtacagctaatgtcattag

SEQ ID NO: 8081378 - DNA, 22 bp, Homo sapiens
acagtatattttcttgattgtt

SEQ ID NO: 8081379 - DNA, 22 bp, Homo sapiens
acagtaaacaatgcagcaaatt

SEQ ID NO: 8081380 - DNA, 22 bp, Homo sapiens
acaggttttggactccagattt

SEQ ID NO: 8081381 - DNA, 22 bp, Homo sapiens
acagtaaaaagccttagaattt

SEQ ID NO: 8081382 - DNA, 22 bp, Homo sapiens
acagtaaacaatgcagcaaatt

SEQ ID NO: 8081383 - DNA, 22 bp, Homo sapiens
acaggcaggcttcggccagagc

SEQ ID NO: 8081384 - DNA, 22 bp, Homo sapiens
acaggctgttggggtccagggt

SEQ ID NO: 8081385 - DNA, 22 bp, Homo sapiens
acagggagatgggtgaaagcgg

SEQ ID NO: 8081386 - DNA, 22 bp, Homo sapiens
acagggagatatcttcaatatc

SEQ ID NO: 8081387 - DNA, 19 bp, Homo sapiens
acaggatatatcaggaaat

SEQ ID NO: 8081388 - DNA, 22 bp, Homo sapiens
agctctggggtggagcccagga

SEQ ID NO: 8081389 - DNA, 22 bp, Homo sapiens
agctgaagtgttggtggtttca

SEQ ID NO: 8081390 - DNA, 22 bp, Homo sapiens
cagtttatttccaagatgacaa

SEQ ID NO: 8081391 - DNA, 22 bp, Homo sapiens
cagttttaaattgttagataat

SEQ ID NO: 8081392 - DNA, 22 bp, Homo sapiens
cagttttaaattttgaatgtct

SEQ ID NO: 8081393 - DNA, 16 bp, Homo sapiens
cagttttaaggcccaa

SEQ ID NO: 8081394 - DNA, 22 bp, Homo sapiens
cagttttatacactgcagctcc

SEQ ID NO: 8081395 - DNA, 22 bp, Homo sapiens
cagttttaggacatgtggatgt

SEQ ID NO: 8081396 - DNA, 22 bp, Homo sapiens
cagttttagggcaatgtgaaga

SEQ ID NO: 8081397 - DNA, 22 bp, Homo sapiens
cagttttacccaagcttatttt

SEQ ID NO: 8081398 - DNA, 22 bp, Homo sapiens
cagttttagctagagcaaacca

SEQ ID NO: 8081399 - DNA, 22 bp, Homo sapiens
cagtggcctttcctgctgctca

SEQ ID NO: 8081400 - DNA, 22 bp, Homo sapiens
aggagggagcactatatgggga

SEQ ID NO: 8081401 - DNA, 22 bp, Homo sapiens
catattttagttgctgaacagc

SEQ ID NO: 8081402 - DNA, 22 bp, Homo sapiens
catatttatagatctggcattt

SEQ ID NO: 8081403 - DNA, 22 bp, Homo sapiens
catattgtctattgctgttttt

SEQ ID NO: 8081404 - DNA, 22 bp, Homo sapiens
catattagcctccactgggaca

SEQ ID NO: 8081405 - DNA, 22 bp, Homo sapiens
catattagacacttatgtccac

SEQ ID NO: 8081406 - DNA, 22 bp, Homo sapiens
catattctgttggtcacataga

SEQ ID NO: 8081407 - DNA, 22 bp, Homo sapiens
catataaatacaacatgtgtta

SEQ ID NO: 8081408 - DNA, 22 bp, Homo sapiens
catagattttaggttagatcga

SEQ ID NO: 8081409 - DNA, 22 bp, Homo sapiens
cagttttatgtcgaatgtatac

SEQ ID NO: 8081410 - DNA, 22 bp, Homo sapiens
cagttttatcatctgtgaaatg

SEQ ID NO: 8081411 - DNA, 22 bp, Homo sapiens
cagttttatgaatgcttattag

SEQ ID NO: 8081412 - DNA, 22 bp, Homo sapiens
caggtgggattttgctgcttga

SEQ ID NO: 8081413 - DNA, 22 bp, Homo sapiens
cagtggccgcggggctgtgggt

SEQ ID NO: 8081414 - DNA, 22 bp, Homo sapiens
cagtggcctgagccaggcttcc

SEQ ID NO: 8081415 - DNA, 22 bp, Homo sapiens
cagtggccttgatgcctcattc

SEQ ID NO: 8081416 - DNA, 22 bp, Homo sapiens
cagtggccaacttcctgcctct

SEQ ID NO: 8081417 - DNA, 22 bp, Homo sapiens
cagtgcctggccggcttccatt

SEQ ID NO: 8081418 - DNA, 22 bp, Homo sapiens
cagtgcctgtgggcttcttcca

SEQ ID NO: 8081419 - DNA, 22 bp, Homo sapiens
catgtatagttggaactacatc

SEQ ID NO: 8081420 - DNA, 22 bp, Homo sapiens
ccaagggctctgacttgcctgc

SEQ ID NO: 8081421 - DNA, 22 bp, Homo sapiens
ccaagattactttcttaattgc

SEQ ID NO: 8081422 - DNA, 22 bp, Homo sapiens
ccaagataagagacaagattta

SEQ ID NO: 8081423 - DNA, 22 bp, Homo sapiens
aggcagcagggccactggctga

SEQ ID NO: 8081424 - DNA, 23 bp, Homo sapiens
aggcagcaggttgtccagggtga

SEQ ID NO: 8081425 - DNA, 21 bp, Homo sapiens
aggcagcaggatccagggaca

SEQ ID NO: 8081426 - DNA, 19 bp, Homo sapiens
aggcagcaggccagggatg

SEQ ID NO: 8081427 - DNA, 22 bp, Homo sapiens
cattaaacaaccttgaatcaat

SEQ ID NO: 8081428 - DNA, 22 bp, Homo sapiens
caggctgctccagggtaggaaa

SEQ ID NO: 8081429 - DNA, 22 bp, Homo sapiens
caggctgcggccgtgtgagcat

SEQ ID NO: 8081430 - DNA, 22 bp, Homo sapiens
cagggatgggatggagtcagtt

SEQ ID NO: 8081431 - DNA, 19 bp, Homo sapiens
cagggatgggtagggactc

SEQ ID NO: 8081432 - DNA, 22 bp, Homo sapiens
cagggtgactgccctggccact

SEQ ID NO: 8081433 - DNA, 22 bp, Homo sapiens
cagggtgagcctctggagccct

SEQ ID NO: 8081434 - DNA, 22 bp, Homo sapiens
cagggtgacaagtggcaaggag

SEQ ID NO: 8081435 - DNA, 23 bp, Homo sapiens
cagggccaggcagcagctgtcac

SEQ ID NO: 8081436 - DNA, 22 bp, Homo sapiens
cagggatgtctctggaagggag

SEQ ID NO: 8081437 - DNA, 22 bp, Homo sapiens
cagggctcgctcttgcccttcg

SEQ ID NO: 8081438 - DNA, 22 bp, Homo sapiens
cagggctccccagagagcctct

SEQ ID NO: 8081439 - DNA, 22 bp, Homo sapiens
cagggctccctgcagcctctgt

SEQ ID NO: 8081440 - DNA, 19 bp, Homo sapiens
agctgctgattggtggagg

SEQ ID NO: 8081441 - DNA, 22 bp, Homo sapiens
agctgctgggaccccagatcca

SEQ ID NO: 8081442 - DNA, 18 bp, Homo sapiens
agctggccctggctgccg

SEQ ID NO: 8081443 - DNA, 22 bp, Homo sapiens
agctggcctcactgcagaatgc

SEQ ID NO: 8081444 - DNA, 20 bp, Homo sapiens
agctggcccccggtggcctg

SEQ ID NO: 8081445 - DNA, 22 bp, Homo sapiens
cagctctgtaaattccttcatc

SEQ ID NO: 8081446 - DNA, 22 bp, Homo sapiens
agctgcagcactccagtagccg

SEQ ID NO: 8081447 - DNA, 17 bp, Homo sapiens
agctgcagatgaagttg

SEQ ID NO: 8081448 - DNA, 22 bp, Homo sapiens
agctgcagattctatctagaag

SEQ ID NO: 8081449 - DNA, 18 bp, Homo sapiens
agctgcagaccaggaggt

SEQ ID NO: 8081450 - DNA, 19 bp, Homo sapiens
agctgcagaccagaagtgc

SEQ ID NO: 8081451 - DNA, 20 bp, Homo sapiens
agctgcagaacccactggac

SEQ ID NO: 8081452 - DNA, 22 bp, Homo sapiens
agctgcagaaaggacaactaat

SEQ ID NO: 8081453 - DNA, 22 bp, Homo sapiens
agctgcagatcaataggctcac

SEQ ID NO: 8081454 - DNA, 22 bp, Homo sapiens
agctgcagagaaaagaggctgg

SEQ ID NO: 8081455 - DNA, 22 bp, Homo sapiens
agggagaagagaacaaagccct

SEQ ID NO: 8081456 - DNA, 22 bp, Homo sapiens
agggagaaaattggatgcacaa

SEQ ID NO: 8081457 - DNA, 22 bp, Homo sapiens
agggagaacagttgcagcagac

SEQ ID NO: 8081458 - DNA, 22 bp, Homo sapiens
aggctggctgagctgcagcctg

SEQ ID NO: 8081459 - DNA, 22 bp, Homo sapiens
cccaggagttggaggctacggt

SEQ ID NO: 8081460 - DNA, 22 bp, Homo sapiens
cccagggcttttctcactagac

SEQ ID NO: 8081461 - DNA, 22 bp, Homo sapiens
cccagggctgtagaatgtccaa

SEQ ID NO: 8081462 - DNA, 22 bp, Homo sapiens
cccagggcttgagtcatccatg

SEQ ID NO: 8081463 - DNA, 22 bp, Homo sapiens
cccaggggaggtcctcagggaa

SEQ ID NO: 8081464 - DNA, 22 bp, Homo sapiens
cccagggctgcagatggaggct

SEQ ID NO: 8081465 - DNA, 22 bp, Homo sapiens
cccagggccctggacagctaca

SEQ ID NO: 8081466 - DNA, 22 bp, Homo sapiens
cccaggagttggaggctgcagt

SEQ ID NO: 8081467 - DNA, 22 bp, Homo sapiens
ccctttctccagaactgtctga

SEQ ID NO: 8081468 - DNA, 21 bp, Homo sapiens
ccctttctccatacttcatcc

SEQ ID NO: 8081469 - DNA, 22 bp, Homo sapiens
ccctttctgccttctaaaataa

SEQ ID NO: 8081470 - DNA, 22 bp, Homo sapiens
ccctttctgggacccctgtctc

SEQ ID NO: 8081471 - DNA, 22 bp, Homo sapiens
ccgcccacactaaatatgagcg

SEQ ID NO: 8081472 - DNA, 22 bp, Homo sapiens
ccgaggtcctggacttggccct

SEQ ID NO: 8081473 - DNA, 22 bp, Homo sapiens
agggccagagtacatcagggct

SEQ ID NO: 8081474 - DNA, 22 bp, Homo sapiens
cctccccatgacccggtgctgg

SEQ ID NO: 8081475 - DNA, 22 bp, Homo sapiens
aggggctgggacagagccaagc

SEQ ID NO: 8081476 - DNA, 22 bp, Homo sapiens
aggggctggcttatctgagagt

SEQ ID NO: 8081477 - DNA, 22 bp, Homo sapiens
aggggctggagttcgaggttac

SEQ ID NO: 8081478 - DNA, 22 bp, Homo sapiens
aggggctgctgggtccgcccct

SEQ ID NO: 8081479 - DNA, 22 bp, Homo sapiens
agggctgcaccggggcttcgcg

SEQ ID NO: 8081480 - DNA, 22 bp, Homo sapiens
agggctgcaggcaagatatggc

SEQ ID NO: 8081481 - DNA, 22 bp, Homo sapiens
agggctgcagtcctaaggtgct

SEQ ID NO: 8081482 - DNA, 22 bp, Homo sapiens
agggctgcaatgggagataact

SEQ ID NO: 8081483 - DNA, 22 bp, Homo sapiens
ccagggagcggggctgggtctc

SEQ ID NO: 8081484 - DNA, 18 bp, Homo sapiens
ccagggagcttattagga

SEQ ID NO: 8081485 - DNA, 22 bp, Homo sapiens
ccagggtgagaaaaggctggat

SEQ ID NO: 8081486 - DNA, 22 bp, Homo sapiens
ccagggtgaccagctggcctag

SEQ ID NO: 8081487 - DNA, 22 bp, Homo sapiens
ccagggtgagtgtcatgggtta

SEQ ID NO: 8081488 - DNA, 22 bp, Homo sapiens
ccatgggcgcacaggcctggag

SEQ ID NO: 8081489 - DNA, 22 bp, Homo sapiens
ccatgggctggctgccttatca

SEQ ID NO: 8081490 - DNA, 22 bp, Homo sapiens
ccagggtgctctgtggcgtcgc

SEQ ID NO: 8081491 - DNA, 22 bp, Homo sapiens
ccagggtggaggctggatggag

SEQ ID NO: 8081492 - DNA, 22 bp, Homo sapiens
ccagctttccagggttgactgg

SEQ ID NO: 8081493 - DNA, 22 bp, Homo sapiens
aggcccagctggacaaactgct

SEQ ID NO: 8081494 - DNA, 23 bp, Homo sapiens
ccagagattgttacacagtaggc

SEQ ID NO: 8081495 - DNA, 22 bp, Homo sapiens
aggcagggtcttgctatgttgc

SEQ ID NO: 8081496 - DNA, 22 bp, Homo sapiens
ccacagcttcgcagtctgctgc

SEQ ID NO: 8081497 - DNA, 22 bp, Homo sapiens
aggcagggtgatgataatgatt

SEQ ID NO: 8081498 - DNA, 22 bp, Homo sapiens
ccagagaggggaagggcttgcc

SEQ ID NO: 8081499 - DNA, 22 bp, Homo sapiens
ccagagagtatcatggagagta

SEQ ID NO: 8081500 - DNA, 22 bp, Homo sapiens
ccagagaaaggtttgattcatt

SEQ ID NO: 8081501 - DNA, 23 bp, Homo sapiens
ccacaggagggttcatttattca

SEQ ID NO: 8081502 - DNA, 22 bp, Homo sapiens
ccacaggacggaggtctggccg

SEQ ID NO: 8081503 - DNA, 22 bp, Homo sapiens
atagaattcgtgtttgtaattc

SEQ ID NO: 8081504 - DNA, 22 bp, Homo sapiens
atagaattctttgaaatttatg

SEQ ID NO: 8081505 - DNA, 22 bp, Homo sapiens
atagacaaacacgaagatgaca

SEQ ID NO: 8081506 - DNA, 22 bp, Homo sapiens
atagacacatgttattatactt

SEQ ID NO: 8081507 - DNA, 22 bp, Homo sapiens
atagaaaacagatgtccttaaa

SEQ ID NO: 8081508 - DNA, 22 bp, Homo sapiens
atacttttaattccttctgagt

SEQ ID NO: 8081509 - DNA, 22 bp, Homo sapiens
ataatgtacaactgcttttaat

SEQ ID NO: 8081510 - DNA, 20 bp, Homo sapiens
ataattacatagagattgcc

SEQ ID NO: 8081511 - DNA, 22 bp, Homo sapiens
ataattacattatactgttaga

SEQ ID NO: 8081512 - DNA, 22 bp, Homo sapiens
ataattatctcagacacttgtt

SEQ ID NO: 8081513 - DNA, 16 bp, Homo sapiens
ataattactgctactt

SEQ ID NO: 8081514 - DNA, 22 bp, Homo sapiens
ataatttaattttcacagtggt

SEQ ID NO: 8081515 - DNA, 22 bp, Homo sapiens
atacagaactctcagttgtata

SEQ ID NO: 8081516 - DNA, 22 bp, Homo sapiens
atacagaagaactatagccact

SEQ ID NO: 8081517 - DNA, 22 bp, Homo sapiens
atacagaagaactatagccact

SEQ ID NO: 8081518 - DNA, 22 bp, Homo sapiens
atacagaactctcagttgtata

SEQ ID NO: 8081519 - DNA, 22 bp, Homo sapiens
atacagaacaagcctcacctcc

SEQ ID NO: 8081520 - DNA, 22 bp, Homo sapiens
atacagaaaagtggatagccag

SEQ ID NO: 8081521 - DNA, 22 bp, Homo sapiens
atacagaaaatgatgcagagtt

SEQ ID NO: 8081522 - DNA, 22 bp, Homo sapiens
atacagaaaatgatgcagagtt

SEQ ID NO: 8081523 - DNA, 22 bp, Homo sapiens
atacatgaggctcatttatgtc

SEQ ID NO: 8081524 - DNA, 22 bp, Homo sapiens
atacatgactcacacattctgc

SEQ ID NO: 8081525 - DNA, 22 bp, Homo sapiens
atacatgacagcatagcatcct

SEQ ID NO: 8081526 - DNA, 22 bp, Homo sapiens
ctggaaatcactactagtcaat

SEQ ID NO: 8081527 - DNA, 21 bp, Homo sapiens
atacagaaggtggcaaagtac

SEQ ID NO: 8081528 - DNA, 21 bp, Homo sapiens
atacagaaggcagactctctc

SEQ ID NO: 8081529 - DNA, 21 bp, Homo sapiens
atacagaaggtggcaaagtac

SEQ ID NO: 8081530 - DNA, 22 bp, Homo sapiens
atacagaagaactatagccact

SEQ ID NO: 8081531 - DNA, 22 bp, Homo sapiens
atacagaagacccctccgtcat

SEQ ID NO: 8081532 - DNA, 22 bp, Homo sapiens
agttttgatactttctcttcat

SEQ ID NO: 8081533 - DNA, 22 bp, Homo sapiens
agttttctgacccctgctctat

SEQ ID NO: 8081534 - DNA, 22 bp, Homo sapiens
agttttcagaaattgcgaccca

SEQ ID NO: 8081535 - DNA, 20 bp, Homo sapiens
agttttcagcagaacaccca

SEQ ID NO: 8081536 - DNA, 22 bp, Homo sapiens
agttttcacactcaccaaaagg

SEQ ID NO: 8081537 - DNA, 22 bp, Homo sapiens
agttttcagggtttctgtcctc

SEQ ID NO: 8081538 - DNA, 22 bp, Homo sapiens
agttttgactaagatggcttgg

SEQ ID NO: 8081539 - DNA, 21 bp, Homo sapiens
agttttctgagttataaaata

SEQ ID NO: 8081540 - DNA, 23 bp, Homo sapiens
ataataattatggcagcaaagtg

SEQ ID NO: 8081541 - DNA, 22 bp, Homo sapiens
ataagtttgtctttgtaaagat

SEQ ID NO: 8081542 - DNA, 22 bp, Homo sapiens
ataagtgctgattagctcttca

SEQ ID NO: 8081543 - DNA, 22 bp, Homo sapiens
agtttcacatgcatggatgtgt

SEQ ID NO: 8081544 - DNA, 22 bp, Homo sapiens
agtttctattttcatgtctgtt

SEQ ID NO: 8081545 - DNA, 22 bp, Homo sapiens
agtttctttagatagaaagttc

SEQ ID NO: 8081546 - DNA, 22 bp, Homo sapiens
agttttattccaatgtgcagca

SEQ ID NO: 8081547 - DNA, 22 bp, Homo sapiens
agttttattaaatccacagaag

SEQ ID NO: 8081548 - DNA, 22 bp, Homo sapiens
agttttattgtcccagaggtga

SEQ ID NO: 8081549 - DNA, 22 bp, Homo sapiens
agttttatgttcacagaaggat

SEQ ID NO: 8081550 - DNA, 22 bp, Homo sapiens
ctgagtgatcagcttgggtccg

SEQ ID NO: 8081551 - DNA, 22 bp, Homo sapiens
ctgagtgaaagaagccagacat

SEQ ID NO: 8081552 - DNA, 22 bp, Homo sapiens
agtgttatttattgtttcataa

SEQ ID NO: 8081553 - DNA, 22 bp, Homo sapiens
agtttcacagaatatgaaggtt

SEQ ID NO: 8081554 - DNA, 22 bp, Homo sapiens
ctgtttattctcatctaaaatg

SEQ ID NO: 8081555 - DNA, 22 bp, Homo sapiens
ctgtttattctcatctaaaatg

SEQ ID NO: 8081556 - DNA, 22 bp, Homo sapiens
atcattaaatataagcttcaca

SEQ ID NO: 8081557 - DNA, 22 bp, Homo sapiens
ctgtgtgtgaacacagcccagc

SEQ ID NO: 8081558 - DNA, 17 bp, Homo sapiens
atctgcatttctaatga

SEQ ID NO: 8081559 - DNA, 22 bp, Homo sapiens
cttcagtttatcccatcatcca

SEQ ID NO: 8081560 - DNA, 22 bp, Homo sapiens
cttcagtttacaatgcattggc

SEQ ID NO: 8081561 - DNA, 22 bp, Homo sapiens
cttcagttatgtgccaaggaca

SEQ ID NO: 8081562 - DNA, 22 bp, Homo sapiens
cttcagttctaaagtagaatgt

SEQ ID NO: 8081563 - DNA, 22 bp, Homo sapiens
atctccagttagcagtactgat

SEQ ID NO: 8081564 - DNA, 22 bp, Homo sapiens
atctccaggttgtgcctgcgtc

SEQ ID NO: 8081565 - DNA, 22 bp, Homo sapiens
atccttgggaactaaatgtaag

SEQ ID NO: 8081566 - DNA, 22 bp, Homo sapiens
ctgtttcagaacttcttaaaaa

SEQ ID NO: 8081567 - DNA, 22 bp, Homo sapiens
ctgtttcaatttgaggatcagc

SEQ ID NO: 8081568 - DNA, 22 bp, Homo sapiens
atagtcataggcaaatagaaga

SEQ ID NO: 8081569 - DNA, 22 bp, Homo sapiens
atagtcaaccttgtaattagcc

SEQ ID NO: 8081570 - DNA, 22 bp, Homo sapiens
atagtatttccagaaatagtct

SEQ ID NO: 8081571 - DNA, 22 bp, Homo sapiens
atatcaaaataaacagcatgca

SEQ ID NO: 8081572 - DNA, 22 bp, Homo sapiens
atatcaaaataaacagcatgca

SEQ ID NO: 8081573 - DNA, 22 bp, Homo sapiens
atatcaaacgaagttattttaa

SEQ ID NO: 8081574 - DNA, 22 bp, Homo sapiens
atatcaaagctagtggaaattt

SEQ ID NO: 8081575 - DNA, 23 bp, Homo sapiens
atatcacacccagtacagtctcc

SEQ ID NO: 8081576 - DNA, 22 bp, Homo sapiens
atatcacagctctttcattgct

SEQ ID NO: 8081577 - DNA, 22 bp, Homo sapiens
atatcacagatgcagaaagaga

SEQ ID NO: 8081578 - DNA, 22 bp, Homo sapiens
atatcagacagaaagcattgac

SEQ ID NO: 8081579 - DNA, 22 bp, Homo sapiens
atatcagacagaaagcattgac

SEQ ID NO: 8081580 - DNA, 22 bp, Homo sapiens
ctgggcctgagctctgaagagt

SEQ ID NO: 8081581 - DNA, 22 bp, Homo sapiens
ctgggcctggcgttccaggctg

SEQ ID NO: 8081582 - DNA, 22 bp, Homo sapiens
ctgggcagtttacattcctacc

SEQ ID NO: 8081583 - DNA, 22 bp, Homo sapiens
atattttggcaaatgtctagat

SEQ ID NO: 8081584 - DNA, 22 bp, Homo sapiens
atattttgaagttaataatgtg

SEQ ID NO: 8081585 - DNA, 22 bp, Homo sapiens
atattttcactgaaccaaagta

SEQ ID NO: 8081586 - DNA, 22 bp, Homo sapiens
atatttgtttggcagagttcag

SEQ ID NO: 8081587 - DNA, 22 bp, Homo sapiens
ctcttaaaattacctttgcaaa

SEQ ID NO: 8081588 - DNA, 22 bp, Homo sapiens
ctcttaaagaatgttccagctg

SEQ ID NO: 8081589 - DNA, 22 bp, Homo sapiens
ctctgtttttcaatagttcttg

SEQ ID NO: 8081590 - DNA, 19 bp, Homo sapiens
ctcttaaattgtctcttgc

SEQ ID NO: 8081591 - DNA, 20 bp, Homo sapiens
ctcttaattgctcacattag

SEQ ID NO: 8081592 - DNA, 22 bp, Homo sapiens
ctcttaatgttttatagattga

SEQ ID NO: 8081593 - DNA, 22 bp, Homo sapiens
ctgagaaaggacctcaaacagg

SEQ ID NO: 8081594 - DNA, 22 bp, Homo sapiens
ctgaagctaggtcaaaaaaggg

SEQ ID NO: 8081595 - DNA, 22 bp, Homo sapiens
ctgaagcaggcctacttcattg

SEQ ID NO: 8081596 - DNA, 23 bp, Homo sapiens
ctgaagcaatatcccctcacttc

SEQ ID NO: 8081597 - DNA, 22 bp, Homo sapiens
agtggctggtagttactgagca

SEQ ID NO: 8081598 - DNA, 22 bp, Homo sapiens
agtgggcaggcagggtgcgcag

SEQ ID NO: 8081599 - DNA, 22 bp, Homo sapiens
agtgggcaaaacagctcagagc

SEQ ID NO: 8081600 - DNA, 22 bp, Homo sapiens
agtgggcagcccaggaggtctt

SEQ ID NO: 8081601 - DNA, 22 bp, Homo sapiens
agtgcaggccccaggccaggcc

SEQ ID NO: 8081602 - DNA, 17 bp, Homo sapiens
agtggcaggcagatggg

SEQ ID NO: 8081603 - DNA, 22 bp, Homo sapiens
agtggcaggaaagtggaagaga

SEQ ID NO: 8081604 - DNA, 22 bp, Homo sapiens
agtctgcaggctgtgatttttt

SEQ ID NO: 8081605 - DNA, 22 bp, Homo sapiens
agtctgcattttaacaagatcc

SEQ ID NO: 8081606 - DNA, 22 bp, Homo sapiens
agtctctttaatcacagtgtct

SEQ ID NO: 8081607 - DNA, 22 bp, Homo sapiens
agtctcttttgcgaagagtgtt

SEQ ID NO: 8081608 - DNA, 18 bp, Homo sapiens
agtcatttacttttgtga

SEQ ID NO: 8081609 - DNA, 22 bp, Homo sapiens
agtgcagcatgaagcacatgtg

SEQ ID NO: 8081610 - DNA, 22 bp, Homo sapiens
ctcccagggtctaggctgctgg

SEQ ID NO: 8081611 - DNA, 22 bp, Homo sapiens
ctcccaggttacatctgagcct

SEQ ID NO: 8081612 - DNA, 21 bp, Homo sapiens
ctcccagggtgactgttcaac

SEQ ID NO: 8081613 - DNA, 23 bp, Homo sapiens
ctcctcgtaactctgtggtgggt

SEQ ID NO: 8081614 - DNA, 22 bp, Homo sapiens
agtgatttgactcttttattgt

SEQ ID NO: 8081615 - DNA, 22 bp, Homo sapiens
agtgatttgcagtatttactaa

SEQ ID NO: 8081616 - DNA, 22 bp, Homo sapiens
agtgatttgaggattattgctc

SEQ ID NO: 8081617 - DNA, 22 bp, Homo sapiens
agtgcagcaacaaactgccctc

SEQ ID NO: 8081618 - DNA, 18 bp, Homo sapiens
cgtgagtggaggctgcgg

SEQ ID NO: 8081619 - DNA, 22 bp, Homo sapiens
agtcagtgtgattctcaggagg

SEQ ID NO: 8081620 - DNA, 22 bp, Homo sapiens
agtcagtgtcaacaggaagtag

SEQ ID NO: 8081621 - DNA, 22 bp, Homo sapiens
agtcagtgttctccggagaggc

SEQ ID NO: 8081622 - DNA, 22 bp, Homo sapiens
agtcagggcctggcctgctgaa

SEQ ID NO: 8081623 - DNA, 22 bp, Homo sapiens
agtcagtgttctgggttgtaat

SEQ ID NO: 8081624 - DNA, 22 bp, Homo sapiens
ctacagaaacctttttcataca

SEQ ID NO: 8081625 - DNA, 22 bp, Homo sapiens
agtaatttgttataaagcaata

SEQ ID NO: 8081626 - DNA, 22 bp, Homo sapiens
agtacaaactgtttcaaagtag

SEQ ID NO: 8081627 - DNA, 22 bp, Homo sapiens
aggtttactgagggtgctggtt

SEQ ID NO: 8081628 - DNA, 22 bp, Homo sapiens
aggggctgtggaaaccaactct

SEQ ID NO: 8081629 - DNA, 22 bp, Homo sapiens
cctggccttaagggcagggagc

SEQ ID NO: 8081630 - DNA, 22 bp, Homo sapiens
cctggcctttgaacgctagact

SEQ ID NO: 8081631 - DNA, 22 bp, Homo sapiens
cctggctcaggcacgcatggct

SEQ ID NO: 8081632 - DNA, 22 bp, Homo sapiens
cctggctcagaccccagttctg

SEQ ID NO: 8081633 - DNA, 22 bp, Homo sapiens
cctggctcattatgtgccccca

SEQ ID NO: 8081634 - DNA, 22 bp, Homo sapiens
cctggctcagtgttgaaggggt

SEQ ID NO: 8081635 - DNA, 22 bp, Homo sapiens
cctgggcaggtgtggcttcccc

SEQ ID NO: 8081636 - DNA, 22 bp, Homo sapiens
aggtcctgtccttggtctctga

SEQ ID NO: 8081637 - DNA, 22 bp, Homo sapiens
atgttattaaagtacagattct

SEQ ID NO: 8081638 - DNA, 22 bp, Homo sapiens
attaaattggacgctgggggaa

SEQ ID NO: 8081639 - DNA, 22 bp, Homo sapiens
attaacatgagttggagatagg

SEQ ID NO: 8081640 - DNA, 22 bp, Homo sapiens
attaacagaattttacatgctt

SEQ ID NO: 8081641 - DNA, 22 bp, Homo sapiens
attaaattttcactaggctccc

SEQ ID NO: 8081642 - DNA, 22 bp, Homo sapiens
attatggacatcaaataactct

SEQ ID NO: 8081643 - DNA, 22 bp, Homo sapiens
attatccaacacccagttacat

SEQ ID NO: 8081644 - DNA, 22 bp, Homo sapiens
gcacacaggcagtttccagcca

SEQ ID NO: 8081645 - DNA, 22 bp, Homo sapiens
attgcaaaggtcccattcaaga

SEQ ID NO: 8081646 - DNA, 22 bp, Homo sapiens
gcagtaagatgtaagtgctata

SEQ ID NO: 8081647 - DNA, 22 bp, Homo sapiens
attgcaaatgagtcttaatata

SEQ ID NO: 8081648 - DNA, 22 bp, Homo sapiens
gcatcatcacggtcaccgagcc

SEQ ID NO: 8081649 - DNA, 22 bp, Homo sapiens
attgcactccagcctgggtgac

SEQ ID NO: 8081650 - DNA, 22 bp, Homo sapiens
attgcactccagcctgggggac

SEQ ID NO: 8081651 - DNA, 22 bp, Homo sapiens
attctgccgctgccacttacta

SEQ ID NO: 8081652 - DNA, 20 bp, Homo sapiens
gcagggcatcttggccccca

SEQ ID NO: 8081653 - DNA, 22 bp, Homo sapiens
gcagggcatccctgagcgggtg

SEQ ID NO: 8081654 - DNA, 22 bp, Homo sapiens
gcagggcatagaggcacggagg

SEQ ID NO: 8081655 - DNA, 22 bp, Homo sapiens
gcagggcagtaagagctagagt

SEQ ID NO: 8081656 - DNA, 22 bp, Homo sapiens
gcagggcagtgtgtctgtgggg

SEQ ID NO: 8081657 - DNA, 22 bp, Homo sapiens
attcttttaagccccagggatt

SEQ ID NO: 8081658 - DNA, 22 bp, Homo sapiens
attcttttaaatggcagtagta

SEQ ID NO: 8081659 - DNA, 22 bp, Homo sapiens
attcttttgtcctagcttgata

SEQ ID NO: 8081660 - DNA, 22 bp, Homo sapiens
attcttttttaaggaatagaac

SEQ ID NO: 8081661 - DNA, 22 bp, Homo sapiens
attcttttcccaactgctttaa

SEQ ID NO: 8081662 - DNA, 22 bp, Homo sapiens
attccacaagaccataaattag

SEQ ID NO: 8081663 - DNA, 22 bp, Homo sapiens
attcacaaaatgatatagatac

SEQ ID NO: 8081664 - DNA, 20 bp, Homo sapiens
attcacaaagccagtgttgc

SEQ ID NO: 8081665 - DNA, 22 bp, Homo sapiens
attccaaactctttccctgtcg

SEQ ID NO: 8081666 - DNA, 22 bp, Homo sapiens
attcatttgctattgtgtatgg

SEQ ID NO: 8081667 - DNA, 21 bp, Homo sapiens
attcatgcagatgtgggtgaa

SEQ ID NO: 8081668 - DNA, 22 bp, Homo sapiens
atttatcaacatgtaccattgg

SEQ ID NO: 8081669 - DNA, 22 bp, Homo sapiens
atttatcatcagaccttttaaa

SEQ ID NO: 8081670 - DNA, 22 bp, Homo sapiens
atttagtttaggaaaagtaggt

SEQ ID NO: 8081671 - DNA, 22 bp, Homo sapiens
atttattacctcggagtttctg

SEQ ID NO: 8081672 - DNA, 22 bp, Homo sapiens
atttattatgggatttggcaca

SEQ ID NO: 8081673 - DNA, 22 bp, Homo sapiens
atttattatgggatttggcaca

SEQ ID NO: 8081674 - DNA, 22 bp, Homo sapiens
gccagctgcatctcctgggctg

SEQ ID NO: 8081675 - DNA, 22 bp, Homo sapiens
atttcttatgaatattgactgt

SEQ ID NO: 8081676 - DNA, 22 bp, Homo sapiens
atttctgtttgctactataagt

SEQ ID NO: 8081677 - DNA, 22 bp, Homo sapiens
atttcttacataacaaattgtt

SEQ ID NO: 8081678 - DNA, 22 bp, Homo sapiens
gccctgggctccctgctccaca

SEQ ID NO: 8081679 - DNA, 22 bp, Homo sapiens
gcccagtggcatcttcactgct

SEQ ID NO: 8081680 - DNA, 22 bp, Homo sapiens
gcccagtgggaagctaaggtgg

SEQ ID NO: 8081681 - DNA, 22 bp, Homo sapiens
gccatcttgagccaggaagtga

SEQ ID NO: 8081682 - DNA, 22 bp, Homo sapiens
gcccagggtctacaaaaatatt

SEQ ID NO: 8081683 - DNA, 19 bp, Homo sapiens
gcccaggggcccgatgctg

SEQ ID NO: 8081684 - DNA, 22 bp, Homo sapiens
atttcaacgttagatgtaatag

SEQ ID NO: 8081685 - DNA, 22 bp, Homo sapiens
gcccagtgccctagaatgcact

SEQ ID NO: 8081686 - DNA, 22 bp, Homo sapiens
gcccagtctcttctggccctgt

SEQ ID NO: 8081687 - DNA, 22 bp, Homo sapiens
gcccagggtgcttagaacccat

SEQ ID NO: 8081688 - DNA, 22 bp, Homo sapiens
gcccagggtgaagtgcagttgt

SEQ ID NO: 8081689 - DNA, 22 bp, Homo sapiens
atttggaattcgagtaattcca

SEQ ID NO: 8081690 - DNA, 22 bp, Homo sapiens
atttggaattctatttcagtag

SEQ ID NO: 8081691 - DNA, 22 bp, Homo sapiens
atttgtaaagtgcttaaaagta

SEQ ID NO: 8081692 - DNA, 22 bp, Homo sapiens
atttgtaagctagagccatgat

SEQ ID NO: 8081693 - DNA, 22 bp, Homo sapiens
atttgtaatttcttatctgtgt

SEQ ID NO: 8081694 - DNA, 22 bp, Homo sapiens
atttgtcaaaacacagagaaca

SEQ ID NO: 8081695 - DNA, 22 bp, Homo sapiens
atttgtcaacaggcatttaggt

SEQ ID NO: 8081696 - DNA, 22 bp, Homo sapiens
atttgtcagtggaagtgattca

SEQ ID NO: 8081697 - DNA, 22 bp, Homo sapiens
atttgtcactgagagagttaga

SEQ ID NO: 8081698 - DNA, 22 bp, Homo sapiens
atttgtcacacatagtttatcc

SEQ ID NO: 8081699 - DNA, 21 bp, Homo sapiens
attttcattaattcagtgtgg

SEQ ID NO: 8081700 - DNA, 22 bp, Homo sapiens
attttcatgactaccttaaata

SEQ ID NO: 8081701 - DNA, 22 bp, Homo sapiens
attttcatggcttctgctcagt

SEQ ID NO: 8081702 - DNA, 22 bp, Homo sapiens
attttcatcatgggtttaacat

SEQ ID NO: 8081703 - DNA, 22 bp, Homo sapiens
attttcagttgaaaaagttggt

SEQ ID NO: 8081704 - DNA, 22 bp, Homo sapiens
gccttccttacacctgctcagc

SEQ ID NO: 8081705 - DNA, 22 bp, Homo sapiens
attttgatgtatctttgtagct

SEQ ID NO: 8081706 - DNA, 22 bp, Homo sapiens
attttgactgcattacagaaca

SEQ ID NO: 8081707 - DNA, 22 bp, Homo sapiens
gctcagagaatttactgctgcc

SEQ ID NO: 8081708 - DNA, 21 bp, Homo sapiens
caaaagagactgattcttgga

SEQ ID NO: 8081709 - DNA, 22 bp, Homo sapiens
caaaagatacttgcatctaact

SEQ ID NO: 8081710 - DNA, 22 bp, Homo sapiens
gctcccagggacactggccact

SEQ ID NO: 8081711 - DNA, 22 bp, Homo sapiens
caaagaagagatttacagagct

SEQ ID NO: 8081712 - DNA, 22 bp, Homo sapiens
caaagaatcactcatctttagc

SEQ ID NO: 8081713 - DNA, 22 bp, Homo sapiens
caaagactgcataacacatgaa

SEQ ID NO: 8081714 - DNA, 22 bp, Homo sapiens
gaagagcatttgcccaggctgt

SEQ ID NO: 8081715 - DNA, 22 bp, Homo sapiens
gaagcctgtggataggggcatc

SEQ ID NO: 8081716 - DNA, 22 bp, Homo sapiens
gaagctaaaagagatgtggttt

SEQ ID NO: 8081717 - DNA, 22 bp, Homo sapiens
gaagcctgacactggccatcag

SEQ ID NO: 8081718 - DNA, 22 bp, Homo sapiens
gaaggatttgagattatcctag

SEQ ID NO: 8081719 - DNA, 22 bp, Homo sapiens
atgcataaagaaagctatctgg

SEQ ID NO: 8081720 - DNA, 22 bp, Homo sapiens
ctttatgttcagtacaatgctt

SEQ ID NO: 8081721 - DNA, 22 bp, Homo sapiens
atctttctccatatacatcttt

SEQ ID NO: 8081722 - DNA, 22 bp, Homo sapiens
atctttcttatttgaagaaaga

SEQ ID NO: 8081723 - DNA, 22 bp, Homo sapiens
atctttctctgcactatacaat

SEQ ID NO: 8081724 - DNA, 22 bp, Homo sapiens
atctttctatggtactttctcc

SEQ ID NO: 8081725 - DNA, 22 bp, Homo sapiens
ctttggaaaagcataccaagga

SEQ ID NO: 8081726 - DNA, 22 bp, Homo sapiens
ctttggaaaaatacctggcata

SEQ ID NO: 8081727 - DNA, 22 bp, Homo sapiens
ctttggaaaaagtgactggctc

SEQ ID NO: 8081728 - DNA, 22 bp, Homo sapiens
ctttggaaagtggttcaggtga

SEQ ID NO: 8081729 - DNA, 22 bp, Homo sapiens
ctttggaaagtaagcagctaga

SEQ ID NO: 8081730 - DNA, 22 bp, Homo sapiens
atgacacaagagcagaagccat

SEQ ID NO: 8081731 - DNA, 22 bp, Homo sapiens
atgagaaagttaatcatcatga

SEQ ID NO: 8081732 - DNA, 22 bp, Homo sapiens
ctttttcactgtgtcctcacac

SEQ ID NO: 8081733 - DNA, 19 bp, Homo sapiens
ctttttcaccttctagaag

SEQ ID NO: 8081734 - DNA, 22 bp, Homo sapiens
ctttttatagctatgtcctatg

SEQ ID NO: 8081735 - DNA, 22 bp, Homo sapiens
ctttttatctcttaatgatgtt

SEQ ID NO: 8081736 - DNA, 22 bp, Homo sapiens
atgacagatagtcttcatttgc

SEQ ID NO: 8081737 - DNA, 22 bp, Homo sapiens
ctttttatagctatgtcctatg

SEQ ID NO: 8081738 - DNA, 22 bp, Homo sapiens
ctttttataccgtgccagttga

SEQ ID NO: 8081739 - DNA, 22 bp, Homo sapiens
atgtcactccagggacacaggt

SEQ ID NO: 8081740 - DNA, 22 bp, Homo sapiens
atgtcactgtgaggcagctgtc

SEQ ID NO: 8081741 - DNA, 22 bp, Homo sapiens
atgtcacttttctccctgctgg

SEQ ID NO: 8081742 - DNA, 22 bp, Homo sapiens
atgtcacttttgagactaggtt

SEQ ID NO: 8081743 - DNA, 19 bp, Homo sapiens
atgtcactcatgttccctg

SEQ ID NO: 8081744 - DNA, 22 bp, Homo sapiens
atgtcacttttgagactaggtt

SEQ ID NO: 8081745 - DNA, 22 bp, Homo sapiens
atgtggcctagtatagaaatga

SEQ ID NO: 8081746 - DNA, 22 bp, Homo sapiens
atgttacagaaagcaaagatga

SEQ ID NO: 8081747 - DNA, 22 bp, Homo sapiens
atgggcagcagctgccattcat

SEQ ID NO: 8081748 - DNA, 22 bp, Homo sapiens
atgggcagagtggggacaggaa

SEQ ID NO: 8081749 - DNA, 22 bp, Homo sapiens
atgggcagcagctgtcattttc

SEQ ID NO: 8081750 - DNA, 22 bp, Homo sapiens
atgggcagctgcagcagtggtg

SEQ ID NO: 8081751 - DNA, 22 bp, Homo sapiens
atgggcaggcactggctctcag

SEQ ID NO: 8081752 - DNA, 22 bp, Homo sapiens
atgggcaggcaaggtggcgagt

SEQ ID NO: 8081753 - DNA, 22 bp, Homo sapiens
atgggcaggcctctcatttctg

SEQ ID NO: 8081754 - DNA, 23 bp, Homo sapiens
atgtatttaaatttcagtgatga

SEQ ID NO: 8081755 - DNA, 22 bp, Homo sapiens
atgtattatggttttccttaag

SEQ ID NO: 8081756 - DNA, 22 bp, Homo sapiens
gagctgcacatctgaggctaat

SEQ ID NO: 8081757 - DNA, 21 bp, Homo sapiens
atgggcagaggcagagaggct

SEQ ID NO: 8081758 - DNA, 22 bp, Homo sapiens
atgggcagagctggtgggaggc

SEQ ID NO: 8081759 - DNA, 22 bp, Homo sapiens
atgggcagacagggagctcacg

SEQ ID NO: 8081760 - DNA, 18 bp, Homo sapiens
gagaagtgcatacattat

SEQ ID NO: 8081761 - DNA, 22 bp, Homo sapiens
gagaacaggctctggagtcaga

SEQ ID NO: 8081762 - DNA, 22 bp, Homo sapiens
gagaagtttggagtgaaggttt

SEQ ID NO: 8081763 - DNA, 22 bp, Homo sapiens
gagaagttgtaggagaattttg

SEQ ID NO: 8081764 - DNA, 22 bp, Homo sapiens
gagaatctacaggaaaccgaag

SEQ ID NO: 8081765 - DNA, 22 bp, Homo sapiens
cagacaaagcggaaactgttta

SEQ ID NO: 8081766 - DNA, 22 bp, Homo sapiens
gggagctgccttagaccggagg

SEQ ID NO: 8081767 - DNA, 22 bp, Homo sapiens
cagacacacaagcaatctaagt

SEQ ID NO: 8081768 - DNA, 22 bp, Homo sapiens
gggagctgcacacgccccggaa

SEQ ID NO: 8081769 - DNA, 22 bp, Homo sapiens
gggcaggggtagcattccaagt

SEQ ID NO: 8081770 - DNA, 22 bp, Homo sapiens
gggcaggggtcagtggccccaa

SEQ ID NO: 8081771 - DNA, 22 bp, Homo sapiens
gggcaggtacaagatgcttctt

SEQ ID NO: 8081772 - DNA, 22 bp, Homo sapiens
ggtcctgggaagatgctcatga

SEQ ID NO: 8081773 - DNA, 22 bp, Homo sapiens
ggtcctgcgtctggctcgcccg

SEQ ID NO: 8081774 - DNA, 23 bp, Homo sapiens
ggtcctgcccccggtcgcccaaa

SEQ ID NO: 8081775 - DNA, 20 bp, Homo sapiens
ggtcctgccttcatcacttc

SEQ ID NO: 8081776 - DNA, 22 bp, Homo sapiens
ggtcctgcattgccagcaagct

SEQ ID NO: 8081777 - DNA, 22 bp, Homo sapiens
gggctgtcacgcccctgcacct

SEQ ID NO: 8081778 - DNA, 22 bp, Homo sapiens
gggctgtccgcacatctggaat

SEQ ID NO: 8081779 - DNA, 22 bp, Homo sapiens
cagagccagagacctgctgtgc

SEQ ID NO: 8081780 - DNA, 22 bp, Homo sapiens
ggggcagctaccggaagtaggg

SEQ ID NO: 8081781 - DNA, 22 bp, Homo sapiens
ggggcagcctccaggaaagctg

SEQ ID NO: 8081782 - DNA, 22 bp, Homo sapiens
gtgaattacatgtatttttaag

SEQ ID NO: 8081783 - DNA, 22 bp, Homo sapiens
gtgaatttagtttgtaagaagg

SEQ ID NO: 8081784 - DNA, 22 bp, Homo sapiens
gtgaattaggacaaaagggctt

SEQ ID NO: 8081785 - DNA, 22 bp, Homo sapiens
gtcacagcctcaatcccatctg

SEQ ID NO: 8081786 - DNA, 22 bp, Homo sapiens
gtccagccaccctggaggcacg

SEQ ID NO: 8081787 - DNA, 20 bp, Homo sapiens
cagattctccactaacatat

SEQ ID NO: 8081788 - DNA, 22 bp, Homo sapiens
cagattttgatgaatgtggaaa

SEQ ID NO: 8081789 - DNA, 22 bp, Homo sapiens
cagcaaaacagccgttgcctgg

SEQ ID NO: 8081790 - DNA, 22 bp, Homo sapiens
cagcaaaagccagcataagctc

SEQ ID NO: 8081791 - DNA, 22 bp, Homo sapiens
cagcaaaagccagcataagctc

SEQ ID NO: 8081792 - DNA, 20 bp, Homo sapiens
cagcaaaatgaaaatggatt

SEQ ID NO: 8081793 - DNA, 22 bp, Homo sapiens
cagcaaaatttgaggattgcct

SEQ ID NO: 8081794 - DNA, 19 bp, Homo sapiens
cagcaaacactgtaaatgg

SEQ ID NO: 8081795 - DNA, 22 bp, Homo sapiens
cagcaaagcaggctcctagaac

SEQ ID NO: 8081796 - DNA, 20 bp, Homo sapiens
gtacacttcatgtttcacct

SEQ ID NO: 8081797 - DNA, 22 bp, Homo sapiens
caaagtgagttataaacatctt

SEQ ID NO: 8081798 - DNA, 17 bp, Homo sapiens
gctctggcacaggattg

SEQ ID NO: 8081799 - DNA, 22 bp, Homo sapiens
caaagtatgaaccagtttctct

SEQ ID NO: 8081800 - DNA, 22 bp, Homo sapiens
caagaaattctgttcagatagc

SEQ ID NO: 8081801 - DNA, 22 bp, Homo sapiens
gctgccctgtctgcagcaggac

SEQ ID NO: 8081802 - DNA, 22 bp, Homo sapiens
caactttagcaatgttagtata

SEQ ID NO: 8081803 - DNA, 22 bp, Homo sapiens
caacacaggttctgcaaaggaa

SEQ ID NO: 8081804 - DNA, 22 bp, Homo sapiens
caacaatttcccagtttcccat

SEQ ID NO: 8081805 - DNA, 22 bp, Homo sapiens
caagaattgtacaaactgggtg

SEQ ID NO: 8081806 - DNA, 22 bp, Homo sapiens
caagaagtgtcagctttttaaa

SEQ ID NO: 8081807 - DNA, 18 bp, Homo sapiens
gctgcctgcattcctcac

SEQ ID NO: 8081808 - DNA, 22 bp, Homo sapiens
gctgctggccgcccagcttctc

SEQ ID NO: 8081809 - DNA, 22 bp, Homo sapiens
gctggctctttttgccgggctc

SEQ ID NO: 8081810 - DNA, 22 bp, Homo sapiens
caaggctggagtgtaatggcat

SEQ ID NO: 8081811 - DNA, 22 bp, Homo sapiens
caaggctgcactgttgccatag

SEQ ID NO: 8081812 - DNA, 22 bp, Homo sapiens
caatatcaggtccgcgtaagtc

SEQ ID NO: 8081813 - DNA, 22 bp, Homo sapiens
caatcagatatgtgacatattt

SEQ ID NO: 8081814 - DNA, 22 bp, Homo sapiens
caattcatgttaaacagaagca

SEQ ID NO: 8081815 - DNA, 22 bp, Homo sapiens
caattcattacattgcaaagac

SEQ ID NO: 8081816 - DNA, 22 bp, Homo sapiens
caattctttcagctgcatttgt

SEQ ID NO: 8081817 - DNA, 23 bp, Homo sapiens
caattgtataaagcaaatggttt

SEQ ID NO: 8081818 - DNA, 22 bp, Homo sapiens
caatttcaatacaaaatacatt

SEQ ID NO: 8081819 - DNA, 22 bp, Homo sapiens
caattgaacagatgagttaaat

SEQ ID NO: 8081820 - DNA, 22 bp, Homo sapiens
caatttcagtctcagagagttc

SEQ ID NO: 8081821 - DNA, 22 bp, Homo sapiens
caatttcatgccatgtattgct

SEQ ID NO: 8081822 - DNA, 22 bp, Homo sapiens
caatttccttcatagatgactg

SEQ ID NO: 8081823 - DNA, 22 bp, Homo sapiens
caatttcattaatagatataga

SEQ ID NO: 8081824 - DNA, 22 bp, Homo sapiens
cacaaatggttgtagacattaa

SEQ ID NO: 8081825 - DNA, 22 bp, Homo sapiens
cacaaatggccgtgttcaaaga

SEQ ID NO: 8081826 - DNA, 22 bp, Homo sapiens
ggaccacagcacttggcttgag

SEQ ID NO: 8081827 - DNA, 18 bp, Homo sapiens
ggaccacatcaacttgaa

SEQ ID NO: 8081828 - DNA, 22 bp, Homo sapiens
ggacattatagcttccagattg

SEQ ID NO: 8081829 - DNA, 22 bp, Homo sapiens
cacaaatgactgaaacgactgt

SEQ ID NO: 8081830 - DNA, 22 bp, Homo sapiens
cacaaatgactgaaacgactgt

SEQ ID NO: 8081831 - DNA, 22 bp, Homo sapiens
cacacagtaggcactcattaat

SEQ ID NO: 8081832 - DNA, 21 bp, Homo sapiens
cacacagtgatctatccacat

SEQ ID NO: 8081833 - DNA, 22 bp, Homo sapiens
cacatgttaatgaaaggttttt

SEQ ID NO: 8081834 - DNA, 22 bp, Homo sapiens
cacatgttaacttcctacagtg

SEQ ID NO: 8081835 - DNA, 17 bp, Homo sapiens
cacatgttcttagagcc

SEQ ID NO: 8081836 - DNA, 22 bp, Homo sapiens
cacattcaattacacagatagg

SEQ ID NO: 8081837 - DNA, 22 bp, Homo sapiens
cacatgtttggcatgtcaccaa

SEQ ID NO: 8081838 - DNA, 22 bp, Homo sapiens
cacattaaaatcctaacttcca

SEQ ID NO: 8081839 - DNA, 22 bp, Homo sapiens
cacattcagggcagaccactca

SEQ ID NO: 8081840 - DNA, 22 bp, Homo sapiens
ggcagatgctggcttctgctgt

SEQ ID NO: 8081841 - DNA, 22 bp, Homo sapiens
cacaggagttaacataattaag

SEQ ID NO: 8081842 - DNA, 22 bp, Homo sapiens
cacagtctcctctcttagcctg

SEQ ID NO: 8081843 - DNA, 22 bp, Homo sapiens
cactgtaatggaattttcttta

SEQ ID NO: 8081844 - DNA, 22 bp, Homo sapiens
cactgtaatagcattataagtg

SEQ ID NO: 8081845 - DNA, 22 bp, Homo sapiens
cactgtaagatgagctttttta

SEQ ID NO: 8081846 - DNA, 22 bp, Homo sapiens
cactgtaacctccacctcctgg

SEQ ID NO: 8081847 - DNA, 22 bp, Homo sapiens
cactgtaacctccacctcctgg

SEQ ID NO: 8081848 - DNA, 22 bp, Homo sapiens
cactgtaaagcgtcacagggac

SEQ ID NO: 8081849 - DNA, 22 bp, Homo sapiens
ggctctgcttcagaaggctcat

SEQ ID NO: 8081850 - DNA, 22 bp, Homo sapiens
cactgcactccagcctgggtga

SEQ ID NO: 8081851 - DNA, 22 bp, Homo sapiens
cactgcactccagcctgggtca

SEQ ID NO: 8081852 - DNA, 22 bp, Homo sapiens
cactgcactccagcctgggaga

SEQ ID NO: 8081853 - DNA, 20 bp, Homo sapiens
ggctctgcttgtgagcagcc

SEQ ID NO: 8081854 - DNA, 20 bp, Homo sapiens
ggctctggaatctggtgggc

SEQ ID NO: 8081855 - DNA, 22 bp, Homo sapiens
ggctctggaaagtgtccttgat

SEQ ID NO: 8081856 - DNA, 22 bp, Homo sapiens
cacttcaaggaatatctagaaa

SEQ ID NO: 8081857 - DNA, 22 bp, Homo sapiens
cacttcagctacaatcacatga

SEQ ID NO: 8081858 - DNA, 22 bp, Homo sapiens
cacttgtagaggcattattcca

SEQ ID NO: 8081859 - DNA, 22 bp, Homo sapiens
cactctgactggccctgcagga

SEQ ID NO: 8081860 - DNA, 22 bp, Homo sapiens
cactgcaacctccacctcctgg

SEQ ID NO: 8081861 - DNA, 21 bp, Homo sapiens
cactccacttagaacagggtt

SEQ ID NO: 8081862 - DNA, 22 bp, Homo sapiens
cactctaacctccatcttccat

SEQ ID NO: 8081863 - DNA, 22 bp, Homo sapiens
cactataatcctgttttagaac

SEQ ID NO: 8081864 - DNA, 22 bp, Homo sapiens
cactcacttatttctaacagaa

SEQ ID NO: 8081865 - DNA, 22 bp, Homo sapiens
cagggcaggaatttgacattgc

SEQ ID NO: 8081866 - DNA, 22 bp, Homo sapiens
tagctttaagatgagatgtgga

SEQ ID NO: 8081867 - DNA, 22 bp, Homo sapiens
cagggcagagggaaactccttt

SEQ ID NO: 8081868 - DNA, 22 bp, Homo sapiens
cagggcagccaggccccgtggg

SEQ ID NO: 8081869 - DNA, 22 bp, Homo sapiens
tatcataagttaattaaacagt

SEQ ID NO: 8081870 - DNA, 22 bp, Homo sapiens
tatcagtttattctataaatag

SEQ ID NO: 8081871 - DNA, 22 bp, Homo sapiens
tagtgaatgggggttatgagac

SEQ ID NO: 8081872 - DNA, 22 bp, Homo sapiens
tagggcagtttcatgttatctt

SEQ ID NO: 8081873 - DNA, 21 bp, Homo sapiens
tagggcaggcattggaagaga

SEQ ID NO: 8081874 - DNA, 22 bp, Homo sapiens
tagggcaggggaggaatctgaa

SEQ ID NO: 8081875 - DNA, 22 bp, Homo sapiens
caggggaagatgccaagggaga

SEQ ID NO: 8081876 - DNA, 22 bp, Homo sapiens
caggctggagtgcagtggcgcc

SEQ ID NO: 8081877 - DNA, 22 bp, Homo sapiens
tagaatatgattaattttctta

SEQ ID NO: 8081878 - DNA, 22 bp, Homo sapiens
tagaatatacactacagcttaa

SEQ ID NO: 8081879 - DNA, 22 bp, Homo sapiens
caggctggagtgcagtggcgct

SEQ ID NO: 8081880 - DNA, 22 bp, Homo sapiens
tactcagtttatgatttcaagt

SEQ ID NO: 8081881 - DNA, 22 bp, Homo sapiens
tactgtatgatttcatgtatat

SEQ ID NO: 8081882 - DNA, 22 bp, Homo sapiens
tactgtatgaattatgttattt

SEQ ID NO: 8081883 - DNA, 22 bp, Homo sapiens
cagggatggcgctggctgcccg

SEQ ID NO: 8081884 - DNA, 21 bp, Homo sapiens
cagggcacacagaggatggta

SEQ ID NO: 8081885 - DNA, 22 bp, Homo sapiens
cagggcaaggcagagcgtcccc

SEQ ID NO: 8081886 - DNA, 20 bp, Homo sapiens
cagggcacactgcagcctcg

SEQ ID NO: 8081887 - DNA, 22 bp, Homo sapiens
cagggcagaaggcactctactc

SEQ ID NO: 8081888 - DNA, 22 bp, Homo sapiens
cagggcagaacatatagatagt

SEQ ID NO: 8081889 - DNA, 22 bp, Homo sapiens
tagaccaagacaggaagtaaca

SEQ ID NO: 8081890 - DNA, 21 bp, Homo sapiens
cagtgggctgctgcgctccag

SEQ ID NO: 8081891 - DNA, 23 bp, Homo sapiens
cagtgggcttctaactgctcctg

SEQ ID NO: 8081892 - DNA, 22 bp, Homo sapiens
cagtgggctgtgatggattcac

SEQ ID NO: 8081893 - DNA, 22 bp, Homo sapiens
cagtggcaggggaagcaggtgt

SEQ ID NO: 8081894 - DNA, 23 bp, Homo sapiens
cagtgccatttgtcttgcctatg

SEQ ID NO: 8081895 - DNA, 22 bp, Homo sapiens
cagtgccacaggaatggccaat

SEQ ID NO: 8081896 - DNA, 22 bp, Homo sapiens
cagtgccacttaatgaggctgc

SEQ ID NO: 8081897 - DNA, 22 bp, Homo sapiens
cagtgccaaggctcttggtctg

SEQ ID NO: 8081898 - DNA, 22 bp, Homo sapiens
cagtgccaaggatggcctggga

SEQ ID NO: 8081899 - DNA, 21 bp, Homo sapiens
cagtgccagccacaggacgcc

SEQ ID NO: 8081900 - DNA, 22 bp, Homo sapiens
cagtgccaggagacaagatcag

SEQ ID NO: 8081901 - DNA, 22 bp, Homo sapiens
cagtgccagaggtactagtgga

SEQ ID NO: 8081902 - DNA, 22 bp, Homo sapiens
cagtgccatgtgagaaggggca

SEQ ID NO: 8081903 - DNA, 22 bp, Homo sapiens
cagtgccatgtctgagccccta

SEQ ID NO: 8081904 - DNA, 22 bp, Homo sapiens
cagtgccatattgaaagacatt

SEQ ID NO: 8081905 - DNA, 22 bp, Homo sapiens
cagtgccagggttgtgtaaatc

SEQ ID NO: 8081906 - DNA, 22 bp, Homo sapiens
cagtgccagtggatgaactgtt

SEQ ID NO: 8081907 - DNA, 22 bp, Homo sapiens
cagtgccatgatgcagagcaat

SEQ ID NO: 8081908 - DNA, 22 bp, Homo sapiens
cagtgccagctgcttggcctac

SEQ ID NO: 8081909 - DNA, 22 bp, Homo sapiens
tcagctttttacatgtgaaata

SEQ ID NO: 8081910 - DNA, 22 bp, Homo sapiens
tcagctttttacatgtgaaata

SEQ ID NO: 8081911 - DNA, 22 bp, Homo sapiens
tcagcttttgtcagaaattgta

SEQ ID NO: 8081912 - DNA, 22 bp, Homo sapiens
cataaagtagcagagcatgact

SEQ ID NO: 8081913 - DNA, 22 bp, Homo sapiens
cataaagtctcataattcactt

SEQ ID NO: 8081914 - DNA, 22 bp, Homo sapiens
cataaagtaggcaagcattcca

SEQ ID NO: 8081915 - DNA, 22 bp, Homo sapiens
cataaagttttataggctcaaa

SEQ ID NO: 8081916 - DNA, 19 bp, Homo sapiens
cataaatgtacaagataca

SEQ ID NO: 8081917 - DNA, 22 bp, Homo sapiens
tcagcttttaaaaacaagaagt

SEQ ID NO: 8081918 - DNA, 22 bp, Homo sapiens
tcagctttgggggtctcaggag

SEQ ID NO: 8081919 - DNA, 22 bp, Homo sapiens
tcagctttgccaccagctgtaa

SEQ ID NO: 8081920 - DNA, 22 bp, Homo sapiens
tcagctttgatctcaggcaatc

SEQ ID NO: 8081921 - DNA, 22 bp, Homo sapiens
tcagctttgcaagttagaaaat

SEQ ID NO: 8081922 - DNA, 22 bp, Homo sapiens
cagtttatagctctagcagctt

SEQ ID NO: 8081923 - DNA, 22 bp, Homo sapiens
cagtttatatataagcacattg

SEQ ID NO: 8081924 - DNA, 22 bp, Homo sapiens
cagttacatgctcatgtcatca

SEQ ID NO: 8081925 - DNA, 22 bp, Homo sapiens
cagttaaagtgcttatcacaga

SEQ ID NO: 8081926 - DNA, 22 bp, Homo sapiens
tcagcagatgatttccatacaa

SEQ ID NO: 8081927 - DNA, 19 bp, Homo sapiens
cagtttaactaattttatc

SEQ ID NO: 8081928 - DNA, 22 bp, Homo sapiens
cagtttaacctatccattatgt

SEQ ID NO: 8081929 - DNA, 22 bp, Homo sapiens
tcacaaatattttaacagtagg

SEQ ID NO: 8081930 - DNA, 22 bp, Homo sapiens
cagtgaagtttaaagtgtagat

SEQ ID NO: 8081931 - DNA, 22 bp, Homo sapiens
cagtgaagtgtggacgtcacca

SEQ ID NO: 8081932 - DNA, 22 bp, Homo sapiens
cagtgaagttctactgaatggt

SEQ ID NO: 8081933 - DNA, 22 bp, Homo sapiens
tcacagttactccttcagatga

SEQ ID NO: 8081934 - DNA, 23 bp, Homo sapiens
tcacagttacttttgcatcaacc

SEQ ID NO: 8081935 - DNA, 22 bp, Homo sapiens
tcacagttaattgttggaatgt

SEQ ID NO: 8081936 - DNA, 22 bp, Homo sapiens
tcacagttcaaaccccatatct

SEQ ID NO: 8081937 - DNA, 22 bp, Homo sapiens
tcacagttatagtctgtagaat

SEQ ID NO: 8081938 - DNA, 22 bp, Homo sapiens
cagtgccaaggagaaggacagc

SEQ ID NO: 8081939 - DNA, 22 bp, Homo sapiens
cagtgccaagccacagatcact

SEQ ID NO: 8081940 - DNA, 22 bp, Homo sapiens
cagtagttattagttgccactg

SEQ ID NO: 8081941 - DNA, 22 bp, Homo sapiens
tatttctttcaggtatgtgttg

SEQ ID NO: 8081942 - DNA, 22 bp, Homo sapiens
tatttcttttcgtgacttattg

SEQ ID NO: 8081943 - DNA, 22 bp, Homo sapiens
cagtatatgctctttcatcaaa

SEQ ID NO: 8081944 - DNA, 20 bp, Homo sapiens
cagtcccaatccagggccag

SEQ ID NO: 8081945 - DNA, 22 bp, Homo sapiens
cagggtgggcacccagcctcca

SEQ ID NO: 8081946 - DNA, 22 bp, Homo sapiens
cagggtggccctgtggtctcat

SEQ ID NO: 8081947 - DNA, 21 bp, Homo sapiens
tatttagttttacaaatgtgg

SEQ ID NO: 8081948 - DNA, 22 bp, Homo sapiens
tccacagggcctttctggtgtg

SEQ ID NO: 8081949 - DNA, 22 bp, Homo sapiens
tccacagtggtggaattgttca

SEQ ID NO: 8081950 - DNA, 22 bp, Homo sapiens
tcattctggatgactttctaga

SEQ ID NO: 8081951 - DNA, 22 bp, Homo sapiens
cataacagtggcttcagcaagt

SEQ ID NO: 8081952 - DNA, 22 bp, Homo sapiens
catgttaaaatatacattctga

SEQ ID NO: 8081953 - DNA, 22 bp, Homo sapiens
catgtgtgtgagggaaacatgt

SEQ ID NO: 8081954 - DNA, 22 bp, Homo sapiens
tccagctgacagttcaaaatga

SEQ ID NO: 8081955 - DNA, 22 bp, Homo sapiens
tcccagggtcctcttctggaat

SEQ ID NO: 8081956 - DNA, 22 bp, Homo sapiens
tccccaggaaattctgattctt

SEQ ID NO: 8081957 - DNA, 22 bp, Homo sapiens
tccccagattcatgtctgctgt

SEQ ID NO: 8081958 - DNA, 22 bp, Homo sapiens
tccccagagggctgtttaggcc

SEQ ID NO: 8081959 - DNA, 22 bp, Homo sapiens
cattcaaattaagattttgtta

SEQ ID NO: 8081960 - DNA, 22 bp, Homo sapiens
cattcaaatgtgccactgtcct

SEQ ID NO: 8081961 - DNA, 22 bp, Homo sapiens
catgttaagtgtttgataacca

SEQ ID NO: 8081962 - DNA, 22 bp, Homo sapiens
cattcaaaggcatgtcctattt

SEQ ID NO: 8081963 - DNA, 22 bp, Homo sapiens
tcccagcccagacttctccagt

SEQ ID NO: 8081964 - DNA, 22 bp, Homo sapiens
tcccagaggactgttggtgcta

SEQ ID NO: 8081965 - DNA, 22 bp, Homo sapiens
tcccagaggaaatggcagctga

SEQ ID NO: 8081966 - DNA, 22 bp, Homo sapiens
tcccagagcctctgccactctg

SEQ ID NO: 8081967 - DNA, 22 bp, Homo sapiens
tcccagagctctgacaccagct

SEQ ID NO: 8081968 - DNA, 22 bp, Homo sapiens
tcccagagctctggaggttgga

SEQ ID NO: 8081969 - DNA, 22 bp, Homo sapiens
tcccagagcccaagttggagag

SEQ ID NO: 8081970 - DNA, 22 bp, Homo sapiens
tctcctggccgggctgtcccct

SEQ ID NO: 8081971 - DNA, 22 bp, Homo sapiens
tctctgggagccaggatgacac

SEQ ID NO: 8081972 - DNA, 22 bp, Homo sapiens
ccagcagagtatcaatgtattt

SEQ ID NO: 8081973 - DNA, 22 bp, Homo sapiens
ccagccaccgcttgtttgcact

SEQ ID NO: 8081974 - DNA, 22 bp, Homo sapiens
ccagccacagcttccagctcct

SEQ ID NO: 8081975 - DNA, 22 bp, Homo sapiens
tctgatatcgcactaaactctg

SEQ ID NO: 8081976 - DNA, 22 bp, Homo sapiens
tctgaatatgtttatcatctct

SEQ ID NO: 8081977 - DNA, 22 bp, Homo sapiens
tctcttaaaagattttaatgac

SEQ ID NO: 8081978 - DNA, 22 bp, Homo sapiens
tcctgactccaggtcctgtgtg

SEQ ID NO: 8081979 - DNA, 21 bp, Homo sapiens
ccacattctcattctgactgc

SEQ ID NO: 8081980 - DNA, 22 bp, Homo sapiens
ccacattcactcatttcattgt

SEQ ID NO: 8081981 - DNA, 22 bp, Homo sapiens
ccacatgtgcactgctgtatgg

SEQ ID NO: 8081982 - DNA, 22 bp, Homo sapiens
ccacattcatcagttgttaatg

SEQ ID NO: 8081983 - DNA, 22 bp, Homo sapiens
ccacatgtgcactgctgtatgg

SEQ ID NO: 8081984 - DNA, 22 bp, Homo sapiens
ccacatttggagaagatacttt

SEQ ID NO: 8081985 - DNA, 22 bp, Homo sapiens
ccactttttagagaacaaaact

SEQ ID NO: 8081986 - DNA, 22 bp, Homo sapiens
ccactttttcagtgtgcatgca

SEQ ID NO: 8081987 - DNA, 22 bp, Homo sapiens
ccagaaaactctacatgcttgt

SEQ ID NO: 8081988 - DNA, 22 bp, Homo sapiens
tctcagtttctcattataaaag

SEQ ID NO: 8081989 - DNA, 22 bp, Homo sapiens
tctatattccagatacagatta

SEQ ID NO: 8081990 - DNA, 22 bp, Homo sapiens
tctcaaatttgttagataaaat

SEQ ID NO: 8081991 - DNA, 22 bp, Homo sapiens
ccagagaggccttggcaagaca

SEQ ID NO: 8081992 - DNA, 22 bp, Homo sapiens
tctccaggaaagacactggact

SEQ ID NO: 8081993 - DNA, 22 bp, Homo sapiens
tctccaggaagccctccctgac

SEQ ID NO: 8081994 - DNA, 21 bp, Homo sapiens
ccagagagagggaagtgggtt

SEQ ID NO: 8081995 - DNA, 22 bp, Homo sapiens
cccagagaagtgaagtgacttg

SEQ ID NO: 8081996 - DNA, 22 bp, Homo sapiens
cccagagggtggaggttgcagt

SEQ ID NO: 8081997 - DNA, 22 bp, Homo sapiens
cccagaggtgaaggaggtggga

SEQ ID NO: 8081998 - DNA, 22 bp, Homo sapiens
cccagaggtctgaaaaggttga

SEQ ID NO: 8081999 - DNA, 22 bp, Homo sapiens
ccagtgttattttagagtgtga

SEQ ID NO: 8082000 - DNA, 22 bp, Homo sapiens
ccagtgttcatcaagaaaatgt

SEQ ID NO: 8082001 - DNA, 22 bp, Homo sapiens
tgattatattctaacttcataa

SEQ ID NO: 8082002 - DNA, 22 bp, Homo sapiens
tgattatattaactatgttcct

SEQ ID NO: 8082003 - DNA, 22 bp, Homo sapiens
tgattagctgaagaatatgctg

SEQ ID NO: 8082004 - DNA, 17 bp, Homo sapiens
tgattcaactagaaact

SEQ ID NO: 8082005 - DNA, 17 bp, Homo sapiens
tgattcaactagaaact

SEQ ID NO: 8082006 - DNA, 22 bp, Homo sapiens
tgattacagtatttgagatcca

SEQ ID NO: 8082007 - DNA, 23 bp, Homo sapiens
tgattacaggaagttcaagtgtt

SEQ ID NO: 8082008 - DNA, 22 bp, Homo sapiens
tgattacagtctgacagatgtt

SEQ ID NO: 8082009 - DNA, 22 bp, Homo sapiens
tgattacattggtaatgtttat

SEQ ID NO: 8082010 - DNA, 21 bp, Homo sapiens
cccaggagaagaaaagatgca

SEQ ID NO: 8082011 - DNA, 19 bp, Homo sapiens
cccagccaggtcttgcatc

SEQ ID NO: 8082012 - DNA, 18 bp, Homo sapiens
cccagcccaccatttctc

SEQ ID NO: 8082013 - DNA, 22 bp, Homo sapiens
cccagcccccgagtgtctggaa

SEQ ID NO: 8082014 - DNA, 22 bp, Homo sapiens
cccagccaaggtgctggtgttg

SEQ ID NO: 8082015 - DNA, 22 bp, Homo sapiens
tgcagcatgcaggagaggctct

SEQ ID NO: 8082016 - DNA, 21 bp, Homo sapiens
tgcatatataagtgcatacac

SEQ ID NO: 8082017 - DNA, 19 bp, Homo sapiens
tgcatatatctatgaaaga

SEQ ID NO: 8082018 - DNA, 22 bp, Homo sapiens
cccaggaggaggaaaaagctcg

SEQ ID NO: 8082019 - DNA, 22 bp, Homo sapiens
cccaggaggcctgcctggccgg

SEQ ID NO: 8082020 - DNA, 22 bp, Homo sapiens
tgcccaggatctggcgatgctc

SEQ ID NO: 8082021 - DNA, 22 bp, Homo sapiens
cccaggaggttggggctacagt

SEQ ID NO: 8082022 - DNA, 19 bp, Homo sapiens
cccaggagtctggctggtt

SEQ ID NO: 8082023 - DNA, 22 bp, Homo sapiens
cccaggagtaagtgacattgtt

SEQ ID NO: 8082024 - DNA, 23 bp, Homo sapiens
ccagggcccctacaccactgtcc

SEQ ID NO: 8082025 - DNA, 21 bp, Homo sapiens
tgactttatttgacagcccag

SEQ ID NO: 8082026 - DNA, 22 bp, Homo sapiens
tgacaattgcagacacagaagt

SEQ ID NO: 8082027 - DNA, 22 bp, Homo sapiens
ccagggcatgggaagaactgaa

SEQ ID NO: 8082028 - DNA, 22 bp, Homo sapiens
ccagggcatgtaactaatggtg

SEQ ID NO: 8082029 - DNA, 22 bp, Homo sapiens
ccagggcatgtccaagacttag

SEQ ID NO: 8082030 - DNA, 22 bp, Homo sapiens
ccagggtggggtccaggaacca

SEQ ID NO: 8082031 - DNA, 22 bp, Homo sapiens
ccagggtgtgagaaggaagtag

SEQ ID NO: 8082032 - DNA, 22 bp, Homo sapiens
ccagggtgggaggctgaaggcg

SEQ ID NO: 8082033 - DNA, 22 bp, Homo sapiens
ccagggtggcgtagatgctggg

SEQ ID NO: 8082034 - DNA, 22 bp, Homo sapiens
ccagggtgtgggcgtcggcacg

SEQ ID NO: 8082035 - DNA, 22 bp, Homo sapiens
ccagggtttagcaagcctacaa

SEQ ID NO: 8082036 - DNA, 22 bp, Homo sapiens
ccagccgcggtgagggtggctg

SEQ ID NO: 8082037 - DNA, 22 bp, Homo sapiens
tctttaaagttggagcttgcaa

SEQ ID NO: 8082038 - DNA, 22 bp, Homo sapiens
tcttgggggactttggcatgga

SEQ ID NO: 8082039 - DNA, 22 bp, Homo sapiens
tgaagattgagaaattatccaa

SEQ ID NO: 8082040 - DNA, 22 bp, Homo sapiens
tgaagctttcctgtggtcagga

SEQ ID NO: 8082041 - DNA, 22 bp, Homo sapiens
tgaaagctgaggacaggagggt

SEQ ID NO: 8082042 - DNA, 22 bp, Homo sapiens
tgaaagcatatgctaaagacca

SEQ ID NO: 8082043 - DNA, 22 bp, Homo sapiens
cctcactgaagaggtgacattt

SEQ ID NO: 8082044 - DNA, 22 bp, Homo sapiens
cctcactgctatgtgtttgctc

SEQ ID NO: 8082045 - DNA, 22 bp, Homo sapiens
cctcactggccagccaggggtg

SEQ ID NO: 8082046 - DNA, 22 bp, Homo sapiens
cctcactgtcatcagtagttat

SEQ ID NO: 8082047 - DNA, 22 bp, Homo sapiens
cctcactgtcacttatagtggt

SEQ ID NO: 8082048 - DNA, 17 bp, Homo sapiens
cctcacagggaccagac

SEQ ID NO: 8082049 - DNA, 22 bp, Homo sapiens
cctcacagcttttcaaagtgga

SEQ ID NO: 8082050 - DNA, 22 bp, Homo sapiens
cctcacagcttgggcaaacggc

SEQ ID NO: 8082051 - DNA, 22 bp, Homo sapiens
cctcacagggccaggcccctca

SEQ ID NO: 8082052 - DNA, 20 bp, Homo sapiens
cctcacagggcagagagggg

SEQ ID NO: 8082053 - DNA, 22 bp, Homo sapiens
cctcacagtcagttcttagtct

SEQ ID NO: 8082054 - DNA, 22 bp, Homo sapiens
cctcacagtttggctaactgtg

SEQ ID NO: 8082055 - DNA, 22 bp, Homo sapiens
cctcacagtgttcgtgtcagat

SEQ ID NO: 8082056 - DNA, 22 bp, Homo sapiens
cctcacagagcccagatgtcta

SEQ ID NO: 8082057 - DNA, 22 bp, Homo sapiens
cctcacagaggggcagccatct

SEQ ID NO: 8082058 - DNA, 22 bp, Homo sapiens
cctcacagcaaggatttcagtg

SEQ ID NO: 8082059 - DNA, 22 bp, Homo sapiens
cctcacagcctcatgcccagcc

SEQ ID NO: 8082060 - DNA, 22 bp, Homo sapiens
cctcacagcccttggcccagga

SEQ ID NO: 8082061 - DNA, 22 bp, Homo sapiens
cctcacagccctcctctagcac

SEQ ID NO: 8082062 - DNA, 22 bp, Homo sapiens
ccctgtgccagagaggcaggag

SEQ ID NO: 8082063 - DNA, 22 bp, Homo sapiens
tgctttcattcacaaaatagca

SEQ ID NO: 8082064 - DNA, 22 bp, Homo sapiens
tgctttcacctgtttgcaccca

SEQ ID NO: 8082065 - DNA, 22 bp, Homo sapiens
tgctttcacaccatgcctataa

SEQ ID NO: 8082066 - DNA, 22 bp, Homo sapiens
tgctttcaatgaattgtatact

SEQ ID NO: 8082067 - DNA, 22 bp, Homo sapiens
ccctgcagccggccagctcatt

SEQ ID NO: 8082068 - DNA, 22 bp, Homo sapiens
tgggtcaggctgggagtcctga

SEQ ID NO: 8082069 - DNA, 22 bp, Homo sapiens
tgtaatttgcatggctgaatgc

SEQ ID NO: 8082070 - DNA, 22 bp, Homo sapiens
tgtaatattgtagtgacagtac

SEQ ID NO: 8082071 - DNA, 22 bp, Homo sapiens
tgtaaagacgcttatagcttgc

SEQ ID NO: 8082072 - DNA, 22 bp, Homo sapiens
tgtcaaatagtagaaagatggc

SEQ ID NO: 8082073 - DNA, 23 bp, Homo sapiens
tgtcaagtatagcaggccctccc

SEQ ID NO: 8082074 - DNA, 22 bp, Homo sapiens
tgggggtgtgccagggacctcc

SEQ ID NO: 8082075 - DNA, 22 bp, Homo sapiens
tgggagctcacaggcctggctc

SEQ ID NO: 8082076 - DNA, 22 bp, Homo sapiens
tggctctgaccaggtagaggag

SEQ ID NO: 8082077 - DNA, 22 bp, Homo sapiens
cctcttctgcttcaggagcact

SEQ ID NO: 8082078 - DNA, 22 bp, Homo sapiens
ccttaaattctccatttgaaag

SEQ ID NO: 8082079 - DNA, 23 bp, Homo sapiens
ccttaaatatctaccctgtggca

SEQ ID NO: 8082080 - DNA, 22 bp, Homo sapiens
ccttaaaagaactatctcttct

SEQ ID NO: 8082081 - DNA, 22 bp, Homo sapiens
ttaagcaacaagaatcccattg

SEQ ID NO: 8082082 - DNA, 22 bp, Homo sapiens
ttaagcaacacacattaattat

SEQ ID NO: 8082083 - DNA, 22 bp, Homo sapiens
ttaagcaacacacattaattat

SEQ ID NO: 8082084 - DNA, 22 bp, Homo sapiens
ttacaaagagtgttcttttcca

SEQ ID NO: 8082085 - DNA, 22 bp, Homo sapiens
ttacaaagagtgttcttttcca

SEQ ID NO: 8082086 - DNA, 22 bp, Homo sapiens
ttacaaagattatattcagtta

SEQ ID NO: 8082087 - DNA, 22 bp, Homo sapiens
ttacaaagcgttgagacaagta

SEQ ID NO: 8082088 - DNA, 22 bp, Homo sapiens
ttacagttgttctatcagcatg

SEQ ID NO: 8082089 - DNA, 22 bp, Homo sapiens
ttaaattattgagggattgtca

SEQ ID NO: 8082090 - DNA, 22 bp, Homo sapiens
ttaaattgtcatttgagcaatg

SEQ ID NO: 8082091 - DNA, 22 bp, Homo sapiens
ttaaatttctacgtgatccagg

SEQ ID NO: 8082092 - DNA, 22 bp, Homo sapiens
ttaaattcattccaacttttga

SEQ ID NO: 8082093 - DNA, 22 bp, Homo sapiens
ttaaattccagcctcataatag

SEQ ID NO: 8082094 - DNA, 22 bp, Homo sapiens
ttaagcaaatgtcagttgttag

SEQ ID NO: 8082095 - DNA, 21 bp, Homo sapiens
ttaagagcttagcagtaggcc

SEQ ID NO: 8082096 - DNA, 22 bp, Homo sapiens
ttaagagcaacatatggtgaca

SEQ ID NO: 8082097 - DNA, 22 bp, Homo sapiens
ttaagagccaacttatccatct

SEQ ID NO: 8082098 - DNA, 18 bp, Homo sapiens
ttaagagctgaaagggga

SEQ ID NO: 8082099 - DNA, 22 bp, Homo sapiens
ttaaattttagaaacagactct

SEQ ID NO: 8082100 - DNA, 21 bp, Homo sapiens
ttagcaaagcaaacacatgct

SEQ ID NO: 8082101 - DNA, 22 bp, Homo sapiens
ttagcaaaggcccctacaccca

SEQ ID NO: 8082102 - DNA, 22 bp, Homo sapiens
ttagcaaagtttgccatctagt

SEQ ID NO: 8082103 - DNA, 22 bp, Homo sapiens
ttagcaaatatcttgaaacagg

SEQ ID NO: 8082104 - DNA, 22 bp, Homo sapiens
ccttgcagctgattatttttca

SEQ ID NO: 8082105 - DNA, 22 bp, Homo sapiens
ttagttttctcatctatctcac

SEQ ID NO: 8082106 - DNA, 22 bp, Homo sapiens
ttataacactgccttgtcacca

SEQ ID NO: 8082107 - DNA, 22 bp, Homo sapiens
ttataacaacagtttactttaa

SEQ ID NO: 8082108 - DNA, 22 bp, Homo sapiens
ttataactttggatatgacaag

SEQ ID NO: 8082109 - DNA, 22 bp, Homo sapiens
ttataacattataaagtggaga

SEQ ID NO: 8082110 - DNA, 22 bp, Homo sapiens
ttataaaggtttgtgcatattt

SEQ ID NO: 8082111 - DNA, 22 bp, Homo sapiens
ttatcattgtcgcagtctaatt

SEQ ID NO: 8082112 - DNA, 22 bp, Homo sapiens
cgctgctctgcagactcccgga

SEQ ID NO: 8082113 - DNA, 22 bp, Homo sapiens
cgctgctcggaaggtgtcacgt

SEQ ID NO: 8082114 - DNA, 22 bp, Homo sapiens
cgctgctccgccttgtccatat

SEQ ID NO: 8082115 - DNA, 22 bp, Homo sapiens
cgctgccttcatcccacgccta

SEQ ID NO: 8082116 - DNA, 22 bp, Homo sapiens
ttatttcatgtaaaatttatgt

SEQ ID NO: 8082117 - DNA, 22 bp, Homo sapiens
ttatttcatataatgttatcaa

SEQ ID NO: 8082118 - DNA, 22 bp, Homo sapiens
ttattgcaactttagggataga

SEQ ID NO: 8082119 - DNA, 22 bp, Homo sapiens
ccttttctatgtaccagcagtg

SEQ ID NO: 8082120 - DNA, 22 bp, Homo sapiens
ccttttctacaagcaaatgtgc

SEQ ID NO: 8082121 - DNA, 22 bp, Homo sapiens
ccttttctacaagcaaatgtgc

SEQ ID NO: 8082122 - DNA, 22 bp, Homo sapiens
ccttttctaggatgctttatag

SEQ ID NO: 8082123 - DNA, 22 bp, Homo sapiens
ccttttctgaaccacttaaata

SEQ ID NO: 8082124 - DNA, 22 bp, Homo sapiens
ccttttctgtttcctgtcactg

SEQ ID NO: 8082125 - DNA, 22 bp, Homo sapiens
ccttttctgtttcctgtcactg

SEQ ID NO: 8082126 - DNA, 22 bp, Homo sapiens
ccttttctgtgtgggtaattta

SEQ ID NO: 8082127 - DNA, 22 bp, Homo sapiens
cctttttctgagttgtagcttc

SEQ ID NO: 8082128 - DNA, 22 bp, Homo sapiens
cggcagggttggttttctctga

SEQ ID NO: 8082129 - DNA, 22 bp, Homo sapiens
cggggctgaggcaacgcggaga

SEQ ID NO: 8082130 - DNA, 22 bp, Homo sapiens
cggggctgcgctcttcctgccg

SEQ ID NO: 8082131 - DNA, 22 bp, Homo sapiens
cggggctgctcgtcctcctgtg

SEQ ID NO: 8082132 - DNA, 22 bp, Homo sapiens
cggggctgacagcaggtgtgct

SEQ ID NO: 8082133 - DNA, 22 bp, Homo sapiens
cggggctggcacaggtgaccac

SEQ ID NO: 8082134 - DNA, 22 bp, Homo sapiens
cggcagcaaaggaagccaggtc

SEQ ID NO: 8082135 - DNA, 22 bp, Homo sapiens
cggcagcatcgaaactacattc

SEQ ID NO: 8082136 - DNA, 22 bp, Homo sapiens
cggcagggctccatgcatttct

SEQ ID NO: 8082137 - DNA, 22 bp, Homo sapiens
ttggaaaatgaggcacagagag

SEQ ID NO: 8082138 - DNA, 22 bp, Homo sapiens
ctccactcaccagatgccagga

SEQ ID NO: 8082139 - DNA, 22 bp, Homo sapiens
ctccagagggtcagactctgag

SEQ ID NO: 8082140 - DNA, 22 bp, Homo sapiens
ctccaggaccagggctcctgga

SEQ ID NO: 8082141 - DNA, 22 bp, Homo sapiens
ttgcagaacttaaagacagagt

SEQ ID NO: 8082142 - DNA, 22 bp, Homo sapiens
ttgcagaacttaaagacagagt

SEQ ID NO: 8082143 - DNA, 22 bp, Homo sapiens
ttgcagaaaacagttttcttgt

SEQ ID NO: 8082144 - DNA, 22 bp, Homo sapiens
ttgcactttgaaataacagtgg

SEQ ID NO: 8082145 - DNA, 22 bp, Homo sapiens
ttgcagtttctggatgccttct

SEQ ID NO: 8082146 - DNA, 22 bp, Homo sapiens
ttgcagtttgtggcaactttga

SEQ ID NO: 8082147 - DNA, 22 bp, Homo sapiens
ttgcataaatgcttaaaatttg

SEQ ID NO: 8082148 - DNA, 22 bp, Homo sapiens
ttgcatcagcaggcataattgg

SEQ ID NO: 8082149 - DNA, 22 bp, Homo sapiens
ctcagggcggcgggcagcccag

SEQ ID NO: 8082150 - DNA, 23 bp, Homo sapiens
ctcagggatagaaaggaagacag

SEQ ID NO: 8082151 - DNA, 21 bp, Homo sapiens
ctcagggcttggtgtcctcat

SEQ ID NO: 8082152 - DNA, 22 bp, Homo sapiens
ttctgcatgtgtttcaaatact

SEQ ID NO: 8082153 - DNA, 22 bp, Homo sapiens
ttctggaagagtaaaataagcc

SEQ ID NO: 8082154 - DNA, 22 bp, Homo sapiens
ttctggaagccccagagtcaga

SEQ ID NO: 8082155 - DNA, 22 bp, Homo sapiens
ttctggaagctggaaaaggcaa

SEQ ID NO: 8082156 - DNA, 22 bp, Homo sapiens
ttctatttcttaatcttggctg

SEQ ID NO: 8082157 - DNA, 22 bp, Homo sapiens
ttctattgcacacaaataatta

SEQ ID NO: 8082158 - DNA, 22 bp, Homo sapiens
ctaaaaatccacactaggtgaa

SEQ ID NO: 8082159 - DNA, 22 bp, Homo sapiens
ctagaaagatacttaaatcaag

SEQ ID NO: 8082160 - DNA, 22 bp, Homo sapiens
ctcactgactgcaagtcaagtt

SEQ ID NO: 8082161 - DNA, 22 bp, Homo sapiens
ctatacagcagcttactagtta

SEQ ID NO: 8082162 - DNA, 22 bp, Homo sapiens
ctatacagtaaccacagtgatt

SEQ ID NO: 8082163 - DNA, 22 bp, Homo sapiens
ctatacagtaaccacagtgatt

SEQ ID NO: 8082164 - DNA, 22 bp, Homo sapiens
ctcacaggttctgcagctcaca

SEQ ID NO: 8082165 - DNA, 22 bp, Homo sapiens
ctataattatgctcaaaatgta

SEQ ID NO: 8082166 - DNA, 22 bp, Homo sapiens
ctatacactttttgaaaataga

SEQ ID NO: 8082167 - DNA, 22 bp, Homo sapiens
ctatacagagcatccttaactt

SEQ ID NO: 8082168 - DNA, 22 bp, Homo sapiens
ctatacagcagcttactagtta

SEQ ID NO: 8082169 - DNA, 22 bp, Homo sapiens
ttctttctgtccataatgagac

SEQ ID NO: 8082170 - DNA, 22 bp, Homo sapiens
ttctttctggggtccttcggct

SEQ ID NO: 8082171 - DNA, 21 bp, Homo sapiens
ttctttctgaatctgaagtat

SEQ ID NO: 8082172 - DNA, 22 bp, Homo sapiens
ttctttctctccacaaggcttg

SEQ ID NO: 8082173 - DNA, 22 bp, Homo sapiens
ttctttctctgtaaaaggaaaa

SEQ ID NO: 8082174 - DNA, 22 bp, Homo sapiens
ctctgaatggacactccagtgt

SEQ ID NO: 8082175 - DNA, 22 bp, Homo sapiens
tttgaaactctgaacatgtttc

SEQ ID NO: 8082176 - DNA, 22 bp, Homo sapiens
tttgaaagacagaatatttttg

SEQ ID NO: 8082177 - DNA, 22 bp, Homo sapiens
tttgaaagagctgatacatgaa

SEQ ID NO: 8082178 - DNA, 19 bp, Homo sapiens
tttgaaagagttttattgg

SEQ ID NO: 8082179 - DNA, 22 bp, Homo sapiens
tttgcaaagtgactattatatg

SEQ ID NO: 8082180 - DNA, 22 bp, Homo sapiens
tttgcaaagaaattattgctgt

SEQ ID NO: 8082181 - DNA, 22 bp, Homo sapiens
tttgagaagatgtaatgttaag

SEQ ID NO: 8082182 - DNA, 22 bp, Homo sapiens
tttgcaaacacttaagaagaga

SEQ ID NO: 8082183 - DNA, 22 bp, Homo sapiens
tttgcaaacacttaagaagaga

SEQ ID NO: 8082184 - DNA, 22 bp, Homo sapiens
tttgagaaacagacgaaagaca

SEQ ID NO: 8082185 - DNA, 22 bp, Homo sapiens
tttgagaaaaccagaaagatct

SEQ ID NO: 8082186 - DNA, 22 bp, Homo sapiens
tttggaagtcctgaaatagagg

SEQ ID NO: 8082187 - DNA, 22 bp, Homo sapiens
tttgttcatgcctatattctca

SEQ ID NO: 8082188 - DNA, 22 bp, Homo sapiens
ttttgcctgcactgtatatata

SEQ ID NO: 8082189 - DNA, 22 bp, Homo sapiens
tttccaataaagtgtcattgtt

SEQ ID NO: 8082190 - DNA, 22 bp, Homo sapiens
tttccaagctgtcttggcccac

SEQ ID NO: 8082191 - DNA, 22 bp, Homo sapiens
tttctacaacacttctgaatct

SEQ ID NO: 8082192 - DNA, 22 bp, Homo sapiens
tttctacaacacttctgaatct

SEQ ID NO: 8082193 - DNA, 22 bp, Homo sapiens
tttctcaagttcagatatttga

SEQ ID NO: 8082194 - DNA, 22 bp, Homo sapiens
tttctacatgtcaatccaaacc

SEQ ID NO: 8082195 - DNA, 22 bp, Homo sapiens
tttctacagtactgatttcata

SEQ ID NO: 8082196 - DNA, 22 bp, Homo sapiens
ctctctgttcattgagtcaaaa

SEQ ID NO: 8082197 - DNA, 22 bp, Homo sapiens
ctctctgttatgctttcatgaa

SEQ ID NO: 8082198 - DNA, 18 bp, Homo sapiens
ctctctttccactctttg

SEQ ID NO: 8082199 - DNA, 22 bp, Homo sapiens
ctctctgtcttggcatttggtc

SEQ ID NO: 8082200 - DNA, 22 bp, Homo sapiens
tttatgcacacttagacatggc

SEQ ID NO: 8082201 - DNA, 23 bp, Homo sapiens
tttatgcagcatgtagaacatgg

SEQ ID NO: 8082202 - DNA, 22 bp, Homo sapiens
tttatgcagatttgtacagtga

SEQ ID NO: 8082203 - DNA, 22 bp, Homo sapiens
tttatgcagcctcagtatcaga

SEQ ID NO: 8082204 - DNA, 21 bp, Homo sapiens
tttatgcatgcctctctgtca

SEQ ID NO: 8082205 - DNA, 22 bp, Homo sapiens
tttatggcacacaaatatcaaa

SEQ ID NO: 8082206 - DNA, 19 bp, Homo sapiens
tttattcacctttaccttg

SEQ ID NO: 8082207 - DNA, 22 bp, Homo sapiens
tttcagaaattgttattattct

SEQ ID NO: 8082208 - DNA, 22 bp, Homo sapiens
tttcagaaattatattagatgc

SEQ ID NO: 8082209 - DNA, 22 bp, Homo sapiens
tttcagaatatcgattcagtga

SEQ ID NO: 8082210 - DNA, 22 bp, Homo sapiens
tttcagaatatcgattcagtga

SEQ ID NO: 8082211 - DNA, 22 bp, Homo sapiens
tttcagtttagactaaaggtag

SEQ ID NO: 8082212 - DNA, 22 bp, Homo sapiens
tttcagtttatgtcttgaatta

SEQ ID NO: 8082213 - DNA, 22 bp, Homo sapiens
tttcagtttcatggcacagcta

SEQ ID NO: 8082214 - DNA, 22 bp, Homo sapiens
tttcagtttccagctttgtcat

SEQ ID NO: 8082215 - DNA, 22 bp, Homo sapiens
ctgcaggacagggccggaggcc

SEQ ID NO: 8082216 - DNA, 22 bp, Homo sapiens
ctgccatgttacctgcacaggt

SEQ ID NO: 8082217 - DNA, 22 bp, Homo sapiens
ctgccccaccccaacctgaggt

SEQ ID NO: 8082218 - DNA, 22 bp, Homo sapiens
ctgccccaggacctcttctgga

SEQ ID NO: 8082219 - DNA, 22 bp, Homo sapiens
ctgccccatggtccctggtggg

SEQ ID NO: 8082220 - DNA, 22 bp, Homo sapiens
ctcttcttgaaagaggaattca

SEQ ID NO: 8082221 - DNA, 22 bp, Homo sapiens
ttttggaaccaacagtgcacct

SEQ ID NO: 8082222 - DNA, 22 bp, Homo sapiens
ttttggaacacagacattagaa

SEQ ID NO: 8082223 - DNA, 22 bp, Homo sapiens
ttttggaagccgcggctgggca

SEQ ID NO: 8082224 - DNA, 22 bp, Homo sapiens
ttttggaatcatttacagagca

SEQ ID NO: 8082225 - DNA, 22 bp, Homo sapiens
ttttggaatctgggaaaacagt

SEQ ID NO: 8082226 - DNA, 19 bp, Homo sapiens
ttttggaaatgtgaacagc

SEQ ID NO: 8082227 - DNA, 22 bp, Homo sapiens
ctgccttaaaagtacttttact

SEQ ID NO: 8082228 - DNA, 22 bp, Homo sapiens
ctgcctttgtgatcagttcttt

SEQ ID NO: 8082229 - DNA, 22 bp, Homo sapiens
ctgcctttgaaagttctgttga

SEQ ID NO: 8082230 - DNA, 22 bp, Homo sapiens
ctgctctgagaggctcttccta

SEQ ID NO: 8082231 - DNA, 22 bp, Homo sapiens
ctgctgagcatcagggctgccc

SEQ ID NO: 8082232 - DNA, 22 bp, Homo sapiens
ctgctgtcgccacggtcgccgc

SEQ ID NO: 8082233 - DNA, 22 bp, Homo sapiens
ctgctgtccaggagtgccctgt

SEQ ID NO: 8082234 - DNA, 22 bp, Homo sapiens
ctgtcccacaagcagtgtgcac

SEQ ID NO: 8082235 - DNA, 17 bp, Homo sapiens
ctgtggccacctggatg

SEQ ID NO: 8082236 - DNA, 22 bp, Homo sapiens
ctgtggggaaagggtcctgctc

SEQ ID NO: 8082237 - DNA, 22 bp, Homo sapiens
ctgtggtcaccaggctggggcc

SEQ ID NO: 8082238 - DNA, 22 bp, Homo sapiens
ctgtgtgtgtctgcagcatact

SEQ ID NO: 8082239 - DNA, 22 bp, Homo sapiens
ctgtgtttgctatgcaaagaca

SEQ ID NO: 8082240 - DNA, 22 bp, Homo sapiens
ctggtgcctcctccctgtgctt

SEQ ID NO: 8082241 - DNA, 22 bp, Homo sapiens
ctgggggccttacggaactcca

SEQ ID NO: 8082242 - DNA, 22 bp, Homo sapiens
ctgggggcagcaagaagccatg

SEQ ID NO: 8082243 - DNA, 22 bp, Homo sapiens
ctgggaggcggaggttgcagtg

SEQ ID NO: 8082244 - DNA, 22 bp, Homo sapiens
cttccctttagcatatagtagt

SEQ ID NO: 8082245 - DNA, 22 bp, Homo sapiens
cttccctttctggtgacttctc

SEQ ID NO: 8082246 - DNA, 22 bp, Homo sapiens
cttcccttctgcagatctttgg

SEQ ID NO: 8082247 - DNA, 22 bp, Homo sapiens
cttcccttggtgaacagagcat

SEQ ID NO: 8082248 - DNA, 22 bp, Homo sapiens
cttcccttctgtgcagggcaga

SEQ ID NO: 8082249 - DNA, 22 bp, Homo sapiens
cttcccttcctggggcaattta

SEQ ID NO: 8082250 - DNA, 22 bp, Homo sapiens
cttcccttcccctcacggagac

SEQ ID NO: 8082251 - DNA, 22 bp, Homo sapiens
cttcccagacggggtggcagcc

SEQ ID NO: 8082252 - DNA, 22 bp, Homo sapiens
cttccccaggacctctgctaaa

SEQ ID NO: 8082253 - DNA, 22 bp, Homo sapiens
cttcactggaatctgtaatagt

SEQ ID NO: 8082254 - DNA, 22 bp, Homo sapiens
cttcactgagtagtctagactc

SEQ ID NO: 8082255 - DNA, 23 bp, Homo sapiens
cttcacaggttcaggggattaag

SEQ ID NO: 8082256 - DNA, 22 bp, Homo sapiens
cttcaaatgtgattttaataac

SEQ ID NO: 8082257 - DNA, 16 bp, Homo sapiens
cttcacagaggagagt

SEQ ID NO: 8082258 - DNA, 22 bp, Homo sapiens
ctgttaaatgagaaagcagact

SEQ ID NO: 8082259 - DNA, 20 bp, Homo sapiens
ctgttaaaaggtatgaattc

SEQ ID NO: 8082260 - DNA, 22 bp, Homo sapiens
ctttctctgtggtgaggagggt

SEQ ID NO: 8082261 - DNA, 22 bp, Homo sapiens
ctttctctgtgtggtaaagggc

SEQ ID NO: 8082262 - DNA, 22 bp, Homo sapiens
ctttctcagtgttaattacttt

SEQ ID NO: 8082263 - DNA, 22 bp, Homo sapiens
ctttggaacaagaagaaatggc

SEQ ID NO: 8082264 - DNA, 22 bp, Homo sapiens
ctttggaacacatgggcatggt

SEQ ID NO: 8082265 - DNA, 22 bp, Homo sapiens
ctttggaacacccagctctgtg

SEQ ID NO: 8082266 - DNA, 22 bp, Homo sapiens
ctttgcataatgaatgatcata

SEQ ID NO: 8082267 - DNA, 22 bp, Homo sapiens
ctttctcttacccaaggatctg

SEQ ID NO: 8082268 - DNA, 22 bp, Homo sapiens
ctttccttaataagcaggtata

SEQ ID NO: 8082269 - DNA, 22 bp, Homo sapiens
ctttccttctcgtggttctcac

SEQ ID NO: 8082270 - DNA, 22 bp, Homo sapiens
ctttcctgagaaaggagaagga

SEQ ID NO: 8082271 - DNA, 22 bp, Homo sapiens
ctttcctggctggcagttgtgg

SEQ ID NO: 8082272 - DNA, 22 bp, Homo sapiens
cttggaggaggtggtgcttgat

SEQ ID NO: 8082273 - DNA, 22 bp, Homo sapiens
cttggaggatgtgcggctgccc

SEQ ID NO: 8082274 - DNA, 22 bp, Homo sapiens
cttgctgtcttgcatttagagc

SEQ ID NO: 8082275 - DNA, 22 bp, Homo sapiens
cttgctgttatccatattatct

SEQ ID NO: 8082276 - DNA, 22 bp, Homo sapiens
cttggaaaggttttacaaagcg

SEQ ID NO: 8082277 - DNA, 22 bp, Homo sapiens
gaaatatacattgcaggaagag

SEQ ID NO: 8082278 - DNA, 22 bp, Homo sapiens
gaaatacagaaagggctgaatg

SEQ ID NO: 8082279 - DNA, 22 bp, Homo sapiens
gaaagactaactagaaagtgca

SEQ ID NO: 8082280 - DNA, 22 bp, Homo sapiens
gaaagacatagttgcaagatgg

SEQ ID NO: 8082281 - DNA, 22 bp, Homo sapiens
gaacttataattattaagattg

SEQ ID NO: 8082282 - DNA, 22 bp, Homo sapiens
gaaattcaggacaaagactctt

SEQ ID NO: 8082283 - DNA, 22 bp, Homo sapiens
gaaattcactgtatttcttggg

SEQ ID NO: 8082284 - DNA, 22 bp, Homo sapiens
gaaattcaggacaaagactctt

SEQ ID NO: 8082285 - DNA, 22 bp, Homo sapiens
gaaattcaccttttacgtggcc

SEQ ID NO: 8082286 - DNA, 22 bp, Homo sapiens
gaaattcaaataagatatgtag

SEQ ID NO: 8082287 - DNA, 22 bp, Homo sapiens
gaaatgttggacacttgaaatt

SEQ ID NO: 8082288 - DNA, 22 bp, Homo sapiens
gaaattaaccacctttggcttt

SEQ ID NO: 8082289 - DNA, 22 bp, Homo sapiens
ctttggaatgcacagaggtgta

SEQ ID NO: 8082290 - DNA, 22 bp, Homo sapiens
ctttggaagtgatagatatgat

SEQ ID NO: 8082291 - DNA, 22 bp, Homo sapiens
ctttggaataaaattagttgtt

SEQ ID NO: 8082292 - DNA, 22 bp, Homo sapiens
ctttggaataatcaagctctga

SEQ ID NO: 8082293 - DNA, 22 bp, Homo sapiens
ctttggaagtgaccacaatcct

SEQ ID NO: 8082294 - DNA, 22 bp, Homo sapiens
ctttggaagtaaagtcagcagg

SEQ ID NO: 8082295 - DNA, 22 bp, Homo sapiens
ctttggaataatttcctggagt

SEQ ID NO: 8082296 - DNA, 22 bp, Homo sapiens
ctttggaatattttattgagaa

SEQ ID NO: 8082297 - DNA, 22 bp, Homo sapiens
ctttggaatcattgcttattca

SEQ ID NO: 8082298 - DNA, 22 bp, Homo sapiens
ctttggaaggaagacctttcag

SEQ ID NO: 8082299 - DNA, 22 bp, Homo sapiens
ctttggaaggtcgtccgtgtgg

SEQ ID NO: 8082300 - DNA, 22 bp, Homo sapiens
ctttggaaggcagagctctgtg

SEQ ID NO: 8082301 - DNA, 22 bp, Homo sapiens
ctttggaaggaacaggattctc

SEQ ID NO: 8082302 - DNA, 22 bp, Homo sapiens
ctttggaagccaggcagttcac

SEQ ID NO: 8082303 - DNA, 22 bp, Homo sapiens
ctttggaactgtaaggagatgg

SEQ ID NO: 8082304 - DNA, 22 bp, Homo sapiens
ctttggaacatactgctgagct

SEQ ID NO: 8082305 - DNA, 22 bp, Homo sapiens
ctttttctaatcataattgtct

SEQ ID NO: 8082306 - DNA, 22 bp, Homo sapiens
ctttttgcaagagtttctcatc

SEQ ID NO: 8082307 - DNA, 22 bp, Homo sapiens
ctttggcacagtgtttactagc

SEQ ID NO: 8082308 - DNA, 22 bp, Homo sapiens
cttttttaaggtagctcctcct

SEQ ID NO: 8082309 - DNA, 22 bp, Homo sapiens
gaaactgtatgtagtttttggg

SEQ ID NO: 8082310 - DNA, 22 bp, Homo sapiens
gaaactgtgaggatcttaactt

SEQ ID NO: 8082311 - DNA, 22 bp, Homo sapiens
gaaactgtgaggatcttaactt

SEQ ID NO: 8082312 - DNA, 22 bp, Homo sapiens
gaaactgtgatcgtgttctggg

SEQ ID NO: 8082313 - DNA, 22 bp, Homo sapiens
gaggcctggaccagccacagag

SEQ ID NO: 8082314 - DNA, 22 bp, Homo sapiens
gaggtgggagggcagtccctaa

SEQ ID NO: 8082315 - DNA, 22 bp, Homo sapiens
gagtaaaagttggattacaaag

SEQ ID NO: 8082316 - DNA, 22 bp, Homo sapiens
gagtaaaagatgaggcagtaga

SEQ ID NO: 8082317 - DNA, 22 bp, Homo sapiens
gaggctggggtctgcctttctg

SEQ ID NO: 8082318 - DNA, 22 bp, Homo sapiens
gaggcctggtgctgtgtccaca

SEQ ID NO: 8082319 - DNA, 22 bp, Homo sapiens
gagggctgataaatgcgcatgg

SEQ ID NO: 8082320 - DNA, 22 bp, Homo sapiens
gagcaaggagggtggggccttt

SEQ ID NO: 8082321 - DNA, 22 bp, Homo sapiens
gagcaaacatcagtgatgtctg

SEQ ID NO: 8082322 - DNA, 22 bp, Homo sapiens
gagcaaacaaaactgatgtgac

SEQ ID NO: 8082323 - DNA, 22 bp, Homo sapiens
gagcaaaataaattctgacaaa

SEQ ID NO: 8082324 - DNA, 22 bp, Homo sapiens
gagatttttcaacaagaatagg

SEQ ID NO: 8082325 - DNA, 15 bp, Homo sapiens
gagcaaacattaatc

SEQ ID NO: 8082326 - DNA, 23 bp, Homo sapiens
gagcaaacccgtctatgccctcc

SEQ ID NO: 8082327 - DNA, 22 bp, Homo sapiens
gagaacagtgtcatcctataat

SEQ ID NO: 8082328 - DNA, 22 bp, Homo sapiens
gagaacagtgttgtattttttc

SEQ ID NO: 8082329 - DNA, 22 bp, Homo sapiens
gagaagaacttgggcaaagtca

SEQ ID NO: 8082330 - DNA, 18 bp, Homo sapiens
gacaaaagtacagacaga

SEQ ID NO: 8082331 - DNA, 22 bp, Homo sapiens
gacaaaactgagatcacactgt

SEQ ID NO: 8082332 - DNA, 22 bp, Homo sapiens
gacaaaagtgttttgaacaagg

SEQ ID NO: 8082333 - DNA, 22 bp, Homo sapiens
gacaaaacacattagtttaaaa

SEQ ID NO: 8082334 - DNA, 22 bp, Homo sapiens
gaatttaaggaccaagcatttt

SEQ ID NO: 8082335 - DNA, 22 bp, Homo sapiens
gacaaagagaagtaacagtacc

SEQ ID NO: 8082336 - DNA, 22 bp, Homo sapiens
gaatggctatcggattattagg

SEQ ID NO: 8082337 - DNA, 22 bp, Homo sapiens
gaattaaaatagttttggtcga

SEQ ID NO: 8082338 - DNA, 22 bp, Homo sapiens
gaattacataataaaatgagag

SEQ ID NO: 8082339 - DNA, 21 bp, Homo sapiens
gttttaagggagaaaacctag

SEQ ID NO: 8082340 - DNA, 22 bp, Homo sapiens
taaaagagaatggataacagag

SEQ ID NO: 8082341 - DNA, 20 bp, Homo sapiens
taaagacataagctactatc

SEQ ID NO: 8082342 - DNA, 22 bp, Homo sapiens
taaaagctgagatatcctgtac

SEQ ID NO: 8082343 - DNA, 19 bp, Homo sapiens
taaagcacatagcaaaagt

SEQ ID NO: 8082344 - DNA, 20 bp, Homo sapiens
taaatgcatgaatgtaaggc

SEQ ID NO: 8082345 - DNA, 22 bp, Homo sapiens
taaatgcagcagtttctgttct

SEQ ID NO: 8082346 - DNA, 22 bp, Homo sapiens
taaagattgctcaaaactgtga

SEQ ID NO: 8082347 - DNA, 22 bp, Homo sapiens
taaagattgctcaaaactgtga

SEQ ID NO: 8082348 - DNA, 22 bp, Homo sapiens
taaagcaaggaatagagtagtc

SEQ ID NO: 8082349 - DNA, 23 bp, Homo sapiens
taaagcaaagtcaagtgcactcc

SEQ ID NO: 8082350 - DNA, 22 bp, Homo sapiens
taaagcaagacacacccatagc

SEQ ID NO: 8082351 - DNA, 22 bp, Homo sapiens
taaagcaatgaaagttttgcag

SEQ ID NO: 8082352 - DNA, 20 bp, Homo sapiens
taacagttgaagaacaagga

SEQ ID NO: 8082353 - DNA, 22 bp, Homo sapiens
taaatgtgtctttttaaggcct

SEQ ID NO: 8082354 - DNA, 22 bp, Homo sapiens
taaatgtttagtcttatttggg

SEQ ID NO: 8082355 - DNA, 22 bp, Homo sapiens
taacatgatttgctatttagat

SEQ ID NO: 8082356 - DNA, 22 bp, Homo sapiens
taagagcactgaagtcttctta

SEQ ID NO: 8082357 - DNA, 22 bp, Homo sapiens
taagagaactggatagatagga

SEQ ID NO: 8082358 - DNA, 22 bp, Homo sapiens
taagagcattgtaaaataatct

SEQ ID NO: 8082359 - DNA, 22 bp, Homo sapiens
taagagcctgtgctttgagttc

SEQ ID NO: 8082360 - DNA, 22 bp, Homo sapiens
taagagcagacacaacctgaga

SEQ ID NO: 8082361 - DNA, 18 bp, Homo sapiens
taagagcagactgtaggc

SEQ ID NO: 8082362 - DNA, 22 bp, Homo sapiens
taagagctccaatatttgtggc

SEQ ID NO: 8082363 - DNA, 21 bp, Homo sapiens
gttcttcctgactagagtagt

SEQ ID NO: 8082364 - DNA, 22 bp, Homo sapiens
gttctttaagtggagaaggaaa

SEQ ID NO: 8082365 - DNA, 19 bp, Homo sapiens
gttcttttcacctctgtgc

SEQ ID NO: 8082366 - DNA, 19 bp, Homo sapiens
gttcttttcacctctgtgc

SEQ ID NO: 8082367 - DNA, 22 bp, Homo sapiens
gtttattaactgtcaagtgatt

SEQ ID NO: 8082368 - DNA, 22 bp, Homo sapiens
gtttcaaagtcagaaaaggagg

SEQ ID NO: 8082369 - DNA, 22 bp, Homo sapiens
gtttcaaaggtgtcaggcagtt

SEQ ID NO: 8082370 - DNA, 22 bp, Homo sapiens
gtttattatacaacaaaagcta

SEQ ID NO: 8082371 - DNA, 22 bp, Homo sapiens
gtttgtttatacaaaagatcct

SEQ ID NO: 8082372 - DNA, 22 bp, Homo sapiens
gtttgttagaagagcagaatct

SEQ ID NO: 8082373 - DNA, 22 bp, Homo sapiens
gtttgtcaggaggttgaagtca

SEQ ID NO: 8082374 - DNA, 22 bp, Homo sapiens
gtttgtcatttgtacttctagc

SEQ ID NO: 8082375 - DNA, 22 bp, Homo sapiens
gtttcttttgtgatcaccaacc

SEQ ID NO: 8082376 - DNA, 22 bp, Homo sapiens
gtttcttagacatatgccatga

SEQ ID NO: 8082377 - DNA, 22 bp, Homo sapiens
gtttcacagatggtgttcatat

SEQ ID NO: 8082378 - DNA, 22 bp, Homo sapiens
gtttcaatttgaatgcgaggct

SEQ ID NO: 8082379 - DNA, 22 bp, Homo sapiens
gtttcaatttcactttccaggc

SEQ ID NO: 8082380 - DNA, 22 bp, Homo sapiens
gtttcaaataggtttcagcaaa

SEQ ID NO: 8082381 - DNA, 22 bp, Homo sapiens
gttataaatgactgcaaaagtt

SEQ ID NO: 8082382 - DNA, 21 bp, Homo sapiens
gttctggaggctgcaagtcca

SEQ ID NO: 8082383 - DNA, 22 bp, Homo sapiens
gttctggaggagagcctggtgt

SEQ ID NO: 8082384 - DNA, 22 bp, Homo sapiens
gtgtttatacagcaaagagcat

SEQ ID NO: 8082385 - DNA, 22 bp, Homo sapiens
gtgtttaataggtagctgaatc

SEQ ID NO: 8082386 - DNA, 22 bp, Homo sapiens
gttaaataacctcatgtccgtt

SEQ ID NO: 8082387 - DNA, 22 bp, Homo sapiens
gtgttcaaaatgtaggtagatt

SEQ ID NO: 8082388 - DNA, 22 bp, Homo sapiens
gtgttcatcccaatgctgatag

SEQ ID NO: 8082389 - DNA, 22 bp, Homo sapiens
tacacatacattgcttacaagg

SEQ ID NO: 8082390 - DNA, 22 bp, Homo sapiens
tacaaccatagacatatactag

SEQ ID NO: 8082391 - DNA, 22 bp, Homo sapiens
tacaaccatagacatatactag

SEQ ID NO: 8082392 - DNA, 22 bp, Homo sapiens
tacaacattgtgttgcttcata

SEQ ID NO: 8082393 - DNA, 22 bp, Homo sapiens
tacaagaaatttctgcatatat

SEQ ID NO: 8082394 - DNA, 22 bp, Homo sapiens
tacaagaaactacatgaatgca

SEQ ID NO: 8082395 - DNA, 22 bp, Homo sapiens
tacaacttccagctttcagccc

SEQ ID NO: 8082396 - DNA, 22 bp, Homo sapiens
tacaagaaggaaaactagcaat

SEQ ID NO: 8082397 - DNA, 22 bp, Homo sapiens
tacaagctcacaaatttttaag

SEQ ID NO: 8082398 - DNA, 22 bp, Homo sapiens
tacacaatgacttaagatgtca

SEQ ID NO: 8082399 - DNA, 22 bp, Homo sapiens
taatataccaaactgtaatttt

SEQ ID NO: 8082400 - DNA, 22 bp, Homo sapiens
taatatacttcccatagtttga

SEQ ID NO: 8082401 - DNA, 22 bp, Homo sapiens
taatagtttcataatgtgcttc

SEQ ID NO: 8082402 - DNA, 22 bp, Homo sapiens
taatatatacctttgttaggaa

SEQ ID NO: 8082403 - DNA, 22 bp, Homo sapiens
taattcttcaggccttttgtct

SEQ ID NO: 8082404 - DNA, 22 bp, Homo sapiens
taattattgtctgaagagttat

SEQ ID NO: 8082405 - DNA, 22 bp, Homo sapiens
taattattgtctgaagagttat

SEQ ID NO: 8082406 - DNA, 22 bp, Homo sapiens
taattcagtgttcacttggaca

SEQ ID NO: 8082407 - DNA, 22 bp, Homo sapiens
taatttagtccaatgtgaatat

SEQ ID NO: 8082408 - DNA, 22 bp, Homo sapiens
taatttacttgcaaataacaat

SEQ ID NO: 8082409 - DNA, 22 bp, Homo sapiens
taattgctcgagaaataacctc

SEQ ID NO: 8082410 - DNA, 22 bp, Homo sapiens
taatatatttctgctaagctca

SEQ ID NO: 8082411 - DNA, 22 bp, Homo sapiens
taatctagaacatatgagagca

SEQ ID NO: 8082412 - DNA, 22 bp, Homo sapiens
taatctagtcccacatggaatt

SEQ ID NO: 8082413 - DNA, 22 bp, Homo sapiens
taatctctttatgagaagaagg

SEQ ID NO: 8082414 - DNA, 22 bp, Homo sapiens
tacagtgtatgtatttgtaggt

SEQ ID NO: 8082415 - DNA, 20 bp, Homo sapiens
tacagacatgacaataatgg

SEQ ID NO: 8082416 - DNA, 22 bp, Homo sapiens
tacagacagtttttcagatatt

SEQ ID NO: 8082417 - DNA, 22 bp, Homo sapiens
tacagtatttgaagaatatgag

SEQ ID NO: 8082418 - DNA, 22 bp, Homo sapiens
tacatgaagaaaattaagcagt

SEQ ID NO: 8082419 - DNA, 22 bp, Homo sapiens
tacatgcaatgaggattctagt

SEQ ID NO: 8082420 - DNA, 22 bp, Homo sapiens
tacatgaatgtttcaatattgt

SEQ ID NO: 8082421 - DNA, 22 bp, Homo sapiens
tacatgcattggatggcaatag

SEQ ID NO: 8082422 - DNA, 22 bp, Homo sapiens
tacttaaataattgctgctatt

SEQ ID NO: 8082423 - DNA, 22 bp, Homo sapiens
tacttaaataattgctgctatt

SEQ ID NO: 8082424 - DNA, 22 bp, Homo sapiens
tacttaaaactgatagaatctc

SEQ ID NO: 8082425 - DNA, 22 bp, Homo sapiens
tacttaaaaattatcaaagtgg

SEQ ID NO: 8082426 - DNA, 22 bp, Homo sapiens
tacttaaaactgatagaatctc

SEQ ID NO: 8082427 - DNA, 22 bp, Homo sapiens
tactgaaactcttgtaaatatc

SEQ ID NO: 8082428 - DNA, 22 bp, Homo sapiens
tactgtgtgattccatttacgt

SEQ ID NO: 8082429 - DNA, 22 bp, Homo sapiens
tactgaaagaatacataatttc

SEQ ID NO: 8082430 - DNA, 22 bp, Homo sapiens
taccacaggccaaatttgaggt

SEQ ID NO: 8082431 - DNA, 22 bp, Homo sapiens
taccacagcaaatgaggccaac

SEQ ID NO: 8082432 - DNA, 22 bp, Homo sapiens
taccacagacagatttcagtaa

SEQ ID NO: 8082433 - DNA, 22 bp, Homo sapiens
tactataaagtcttaatgagtc

SEQ ID NO: 8082434 - DNA, 23 bp, Homo sapiens
tactataacgctgtgtcagctcc

SEQ ID NO: 8082435 - DNA, 23 bp, Homo sapiens
tactataacgctgtgtcagctcc

SEQ ID NO: 8082436 - DNA, 22 bp, Homo sapiens
tactagaatgccactgttagtg

SEQ ID NO: 8082437 - DNA, 22 bp, Homo sapiens
tactacatacagaatttagaga

SEQ ID NO: 8082438 - DNA, 22 bp, Homo sapiens
tagtttttaagtgtacaatttc

SEQ ID NO: 8082439 - DNA, 22 bp, Homo sapiens
tagttttttcaacaaatggtgc

SEQ ID NO: 8082440 - DNA, 22 bp, Homo sapiens
tagtttttactgcgagttataa

SEQ ID NO: 8082441 - DNA, 22 bp, Homo sapiens
tagtttttaagtgtacaatttc

SEQ ID NO: 8082442 - DNA, 22 bp, Homo sapiens
tagttttatgaattggtataat

SEQ ID NO: 8082443 - DNA, 22 bp, Homo sapiens
tagttttataatgttaacatct

SEQ ID NO: 8082444 - DNA, 22 bp, Homo sapiens
tagttctgtgtagctcaagagt

SEQ ID NO: 8082445 - DNA, 22 bp, Homo sapiens
tagtgccattgccaggaagggc

SEQ ID NO: 8082446 - DNA, 22 bp, Homo sapiens
tagtgccatgcgaggggtggga

SEQ ID NO: 8082447 - DNA, 22 bp, Homo sapiens
tagtgccattcaagaggtagtt

SEQ ID NO: 8082448 - DNA, 22 bp, Homo sapiens
tagtgccaccttccaagtatca

SEQ ID NO: 8082449 - DNA, 20 bp, Homo sapiens
tagtgccagtgtgcatgcta

SEQ ID NO: 8082450 - DNA, 20 bp, Homo sapiens
tagtgccagtgtgcatgcta

SEQ ID NO: 8082451 - DNA, 22 bp, Homo sapiens
tagtgccatagataggaccatt

SEQ ID NO: 8082452 - DNA, 22 bp, Homo sapiens
tagtgccatatgtgactagaac

SEQ ID NO: 8082453 - DNA, 22 bp, Homo sapiens
tagtgccatcttgagctgcttt

SEQ ID NO: 8082454 - DNA, 22 bp, Homo sapiens
tagtgccaaagcctggtgtcat

SEQ ID NO: 8082455 - DNA, 22 bp, Homo sapiens
tagtgccaagctaatgccagaa

SEQ ID NO: 8082456 - DNA, 22 bp, Homo sapiens
tagtgccaagctaatgccagaa

SEQ ID NO: 8082457 - DNA, 22 bp, Homo sapiens
tagtgccaccactgtctttggc

SEQ ID NO: 8082458 - DNA, 22 bp, Homo sapiens
tagtgccaccactgtctttggc

SEQ ID NO: 8082459 - DNA, 22 bp, Homo sapiens
tagtgccaaggttcgaagtaca

SEQ ID NO: 8082460 - DNA, 22 bp, Homo sapiens
tagtgccaaggttcgaagtaca

SEQ ID NO: 8082461 - DNA, 22 bp, Homo sapiens
tagtctctgtggtcctgaggaa

SEQ ID NO: 8082462 - DNA, 22 bp, Homo sapiens
tagtctcttatcaggcacacac

SEQ ID NO: 8082463 - DNA, 22 bp, Homo sapiens
tagtctctgttgctgctttcat

SEQ ID NO: 8082464 - DNA, 22 bp, Homo sapiens
tagtctctgttcccacaatgcc

SEQ ID NO: 8082465 - DNA, 22 bp, Homo sapiens
tagtctctatgagtgaatcaca

SEQ ID NO: 8082466 - DNA, 19 bp, Homo sapiens
tagtctctgatgaggcttt

SEQ ID NO: 8082467 - DNA, 22 bp, Homo sapiens
tagtctctgctttgcccttggc

SEQ ID NO: 8082468 - DNA, 22 bp, Homo sapiens
tagtctctggagactctagggg

SEQ ID NO: 8082469 - DNA, 22 bp, Homo sapiens
tagggcagagtccaggatgggc

SEQ ID NO: 8082470 - DNA, 22 bp, Homo sapiens
tagggcagattcggtggagttt

SEQ ID NO: 8082471 - DNA, 22 bp, Homo sapiens
tagggcagccacccaggctgct

SEQ ID NO: 8082472 - DNA, 23 bp, Homo sapiens
tagggcagctgggagggacatgc

SEQ ID NO: 8082473 - DNA, 22 bp, Homo sapiens
tagggcagccttatagctccca

SEQ ID NO: 8082474 - DNA, 22 bp, Homo sapiens
tagggcagctgcatcaggcact

SEQ ID NO: 8082475 - DNA, 22 bp, Homo sapiens
taggcaggctgaatgtagattt

SEQ ID NO: 8082476 - DNA, 23 bp, Homo sapiens
taggcaggactcagatatgacag

SEQ ID NO: 8082477 - DNA, 22 bp, Homo sapiens
tagcaactgctctattctagga

SEQ ID NO: 8082478 - DNA, 22 bp, Homo sapiens
tagcaactgcctttactatatt

SEQ ID NO: 8082479 - DNA, 22 bp, Homo sapiens
tagcaaatgggcttgttttcca

SEQ ID NO: 8082480 - DNA, 22 bp, Homo sapiens
tagcaaaatgtggatgtagttg

SEQ ID NO: 8082481 - DNA, 22 bp, Homo sapiens
tagcaaactaatacaggctcaa

SEQ ID NO: 8082482 - DNA, 22 bp, Homo sapiens
tagcaaactcatacatgtgggt

SEQ ID NO: 8082483 - DNA, 22 bp, Homo sapiens
tagcaaactaccacaaactggg

SEQ ID NO: 8082484 - DNA, 22 bp, Homo sapiens
tagaaatgggttacatttagag

SEQ ID NO: 8082485 - DNA, 22 bp, Homo sapiens
tagaacttagcactagacttgt

SEQ ID NO: 8082486 - DNA, 22 bp, Homo sapiens
tagaactggaattttgtggttt

SEQ ID NO: 8082487 - DNA, 22 bp, Homo sapiens
tagaacttattagaaaggctca

SEQ ID NO: 8082488 - DNA, 22 bp, Homo sapiens
tagaacttgatagacagtacaa

SEQ ID NO: 8082489 - DNA, 22 bp, Homo sapiens
tagaacttgaatgtgaaatcag

SEQ ID NO: 8082490 - DNA, 22 bp, Homo sapiens
tagaactgctctcatacttgct

SEQ ID NO: 8082491 - DNA, 22 bp, Homo sapiens
tagactatagctcacagtgctt

SEQ ID NO: 8082492 - DNA, 22 bp, Homo sapiens
tagagaacaagtatggcacgga

SEQ ID NO: 8082493 - DNA, 22 bp, Homo sapiens
tagatacatacattttaaaatg

SEQ ID NO: 8082494 - DNA, 22 bp, Homo sapiens
tagatataaggtccttagaaca

SEQ ID NO: 8082495 - DNA, 22 bp, Homo sapiens
tagatatgacagcagaacaagc

SEQ ID NO: 8082496 - DNA, 22 bp, Homo sapiens
tagatatggccgtctgttttaa

SEQ ID NO: 8082497 - DNA, 22 bp, Homo sapiens
tagatatgatgagtcacttgag

SEQ ID NO: 8082498 - DNA, 22 bp, Homo sapiens
tagatatgtagtttttacagta

SEQ ID NO: 8082499 - DNA, 22 bp, Homo sapiens
tagatcataaatactatggtgc

SEQ ID NO: 8082500 - DNA, 22 bp, Homo sapiens
tagatatgtgtttattatgctg

SEQ ID NO: 8082501 - DNA, 22 bp, Homo sapiens
tagatatgtatacttgtttgag

SEQ ID NO: 8082502 - DNA, 22 bp, Homo sapiens
tagatcagagttcaggaagttt

SEQ ID NO: 8082503 - DNA, 22 bp, Homo sapiens
tatttaaaatagtgctccagca

SEQ ID NO: 8082504 - DNA, 22 bp, Homo sapiens
tattacaaattataatgggaga

SEQ ID NO: 8082505 - DNA, 22 bp, Homo sapiens
tattacaagaaagggcatgaat

SEQ ID NO: 8082506 - DNA, 22 bp, Homo sapiens
tattacaatttacattgcactt

SEQ ID NO: 8082507 - DNA, 23 bp, Homo sapiens
tattacaattggtcttattaaga

SEQ ID NO: 8082508 - DNA, 23 bp, Homo sapiens
tattacaattggtcttattaaga

SEQ ID NO: 8082509 - DNA, 22 bp, Homo sapiens
tatttaattagtgattgtagag

SEQ ID NO: 8082510 - DNA, 22 bp, Homo sapiens
tattttgaaagtctgttttgaa

SEQ ID NO: 8082511 - DNA, 19 bp, Homo sapiens
tcaaagcaagcatgttctg

SEQ ID NO: 8082512 - DNA, 22 bp, Homo sapiens
tcaaagatgggttttgtttgat

SEQ ID NO: 8082513 - DNA, 20 bp, Homo sapiens
tcaaagcaaagggagatgat

SEQ ID NO: 8082514 - DNA, 20 bp, Homo sapiens
tcaaagcaaagggagatgat

SEQ ID NO: 8082515 - DNA, 22 bp, Homo sapiens
tcaaagatgataggaaatcata

SEQ ID NO: 8082516 - DNA, 22 bp, Homo sapiens
tcaaagatgatgctgaagttat

SEQ ID NO: 8082517 - DNA, 22 bp, Homo sapiens
tcaaagagctctatcttcaaaa

SEQ ID NO: 8082518 - DNA, 22 bp, Homo sapiens
tcaaagaacatcatctgaaatg

SEQ ID NO: 8082519 - DNA, 22 bp, Homo sapiens
tatttttgcctctcagataaaa

SEQ ID NO: 8082520 - DNA, 22 bp, Homo sapiens
tcaaaaataagatattctggac

SEQ ID NO: 8082521 - DNA, 22 bp, Homo sapiens
tcaaaaatggtctttgagctgc

SEQ ID NO: 8082522 - DNA, 22 bp, Homo sapiens
tattttgagcccctgacatcta

SEQ ID NO: 8082523 - DNA, 22 bp, Homo sapiens
tcaaatattggctatttcacat

SEQ ID NO: 8082524 - DNA, 22 bp, Homo sapiens
tcaaataccagcaatttcatgt

SEQ ID NO: 8082525 - DNA, 22 bp, Homo sapiens
tcaaatatgtgatagaagctaa

SEQ ID NO: 8082526 - DNA, 22 bp, Homo sapiens
tcaaatatgtgatagaagctaa

SEQ ID NO: 8082527 - DNA, 22 bp, Homo sapiens
tcaaagtaagattgttgaagct

SEQ ID NO: 8082528 - DNA, 19 bp, Homo sapiens
tcaaagtctgagtcacttt

SEQ ID NO: 8082529 - DNA, 22 bp, Homo sapiens
tcaaagtcatggctagtaatga

SEQ ID NO: 8082530 - DNA, 22 bp, Homo sapiens
tcaaataatgccattcatcatc

SEQ ID NO: 8082531 - DNA, 18 bp, Homo sapiens
tataaacacacttaggtt

SEQ ID NO: 8082532 - DNA, 22 bp, Homo sapiens
tataaactcctcttgcattcct

SEQ ID NO: 8082533 - DNA, 22 bp, Homo sapiens
tataaagctgactcatgaaact

SEQ ID NO: 8082534 - DNA, 22 bp, Homo sapiens
tatcacaggtgtgatttacatt

SEQ ID NO: 8082535 - DNA, 22 bp, Homo sapiens
tataaagaagtgtaaacaggaa

SEQ ID NO: 8082536 - DNA, 22 bp, Homo sapiens
tataaagaaggcacagcaagac

SEQ ID NO: 8082537 - DNA, 22 bp, Homo sapiens
tatcagaaggcacatggagtct

SEQ ID NO: 8082538 - DNA, 22 bp, Homo sapiens
tatcagaaatgccttaaattgg

SEQ ID NO: 8082539 - DNA, 22 bp, Homo sapiens
tatcacaggtgtgatttacatt

SEQ ID NO: 8082540 - DNA, 22 bp, Homo sapiens
tatgaattctgttcattgatga

SEQ ID NO: 8082541 - DNA, 23 bp, Homo sapiens
tatctttttcaatgttggaaata

SEQ ID NO: 8082542 - DNA, 22 bp, Homo sapiens
tatgaaacattcatacaaataa

SEQ ID NO: 8082543 - DNA, 22 bp, Homo sapiens
tatccaaagtggcatattatag

SEQ ID NO: 8082544 - DNA, 22 bp, Homo sapiens
tatgtttcttccttttcataca

SEQ ID NO: 8082545 - DNA, 22 bp, Homo sapiens
tattaacacgtataaagtgttt

SEQ ID NO: 8082546 - DNA, 22 bp, Homo sapiens
tattaagatacgtagttgtaaa

SEQ ID NO: 8082547 - DNA, 22 bp, Homo sapiens
tattaataagtgactactagct

SEQ ID NO: 8082548 - DNA, 22 bp, Homo sapiens
tatgtagatttctctgtttttc

SEQ ID NO: 8082549 - DNA, 22 bp, Homo sapiens
tatgtagatgtcatataaattg

SEQ ID NO: 8082550 - DNA, 22 bp, Homo sapiens
tatgtagagataaaatccaaat

SEQ ID NO: 8082551 - DNA, 22 bp, Homo sapiens
tatggaacgctagaggaagaaa

SEQ ID NO: 8082552 - DNA, 22 bp, Homo sapiens
tatggcttgagtttcagactat

SEQ ID NO: 8082553 - DNA, 22 bp, Homo sapiens
tatggcttgacttgcaccggca

SEQ ID NO: 8082554 - DNA, 20 bp, Homo sapiens
tatggcttggcaaagcttca

SEQ ID NO: 8082555 - DNA, 20 bp, Homo sapiens
tatggcttgcagccaccctt

SEQ ID NO: 8082556 - DNA, 22 bp, Homo sapiens
tatggcttctgggccaaattta

SEQ ID NO: 8082557 - DNA, 22 bp, Homo sapiens
tatggcttcttttgcaactact

SEQ ID NO: 8082558 - DNA, 22 bp, Homo sapiens
tatggcttcttgtgttactgtg

SEQ ID NO: 8082559 - DNA, 22 bp, Homo sapiens
tatgtagacaggctgcttttcc

SEQ ID NO: 8082560 - DNA, 22 bp, Homo sapiens
tatggctttttattcatcttac

SEQ ID NO: 8082561 - DNA, 22 bp, Homo sapiens
tatggcttttcttcctccccca

SEQ ID NO: 8082562 - DNA, 22 bp, Homo sapiens
tatggcttttcattcctatgtg

SEQ ID NO: 8082563 - DNA, 22 bp, Homo sapiens
tatggcttttctttcctagtgt

SEQ ID NO: 8082564 - DNA, 22 bp, Homo sapiens
tatggcttttggcttctctctg

SEQ ID NO: 8082565 - DNA, 22 bp, Homo sapiens
tatggctttaaattgaaggagt

SEQ ID NO: 8082566 - DNA, 22 bp, Homo sapiens
tatggctttaaacttttcattt

SEQ ID NO: 8082567 - DNA, 22 bp, Homo sapiens
tatggcttgtccctggtcagtc

SEQ ID NO: 8082568 - DNA, 22 bp, Homo sapiens
tatggcttgtctttataccagg

SEQ ID NO: 8082569 - DNA, 22 bp, Homo sapiens
tatggcttgtggagagttgtag

SEQ ID NO: 8082570 - DNA, 22 bp, Homo sapiens
tatggctttaaacaacttaggt

SEQ ID NO: 8082571 - DNA, 22 bp, Homo sapiens
tatggctttctccatagggcag

SEQ ID NO: 8082572 - DNA, 22 bp, Homo sapiens
tatggctttgaaagggcttttc

SEQ ID NO: 8082573 - DNA, 21 bp, Homo sapiens
tatggctttactaagctgcac

SEQ ID NO: 8082574 - DNA, 22 bp, Homo sapiens
tatggctttcaaaggaactcgg

SEQ ID NO: 8082575 - DNA, 22 bp, Homo sapiens
tatggcttttaaggagatctga

SEQ ID NO: 8082576 - DNA, 22 bp, Homo sapiens
tatggctttgggccaaatctac

SEQ ID NO: 8082577 - DNA, 22 bp, Homo sapiens
tatggcttttaactgtcgtatg

SEQ ID NO: 8082578 - DNA, 22 bp, Homo sapiens
tcagtgttgtgcacatacaaaa

SEQ ID NO: 8082579 - DNA, 22 bp, Homo sapiens
tcagtgttgtgcacatacaaaa

SEQ ID NO: 8082580 - DNA, 22 bp, Homo sapiens
tcagtgttggtcaagaatcagt

SEQ ID NO: 8082581 - DNA, 22 bp, Homo sapiens
tcagtgtttaccgtatgttgtt

SEQ ID NO: 8082582 - DNA, 22 bp, Homo sapiens
tcagtgtttcagtttggaaatg

SEQ ID NO: 8082583 - DNA, 22 bp, Homo sapiens
tcagtgtttcagtttggaaatg

SEQ ID NO: 8082584 - DNA, 22 bp, Homo sapiens
tcagtgtttacatgcatccttg

SEQ ID NO: 8082585 - DNA, 22 bp, Homo sapiens
tcagtgttggtcaagaatcagt

SEQ ID NO: 8082586 - DNA, 22 bp, Homo sapiens
tcagtgttcttatttaattagg

SEQ ID NO: 8082587 - DNA, 22 bp, Homo sapiens
tcagtgttgaattttttgcaaa

SEQ ID NO: 8082588 - DNA, 22 bp, Homo sapiens
tcagtgttcttatttaattagg

SEQ ID NO: 8082589 - DNA, 22 bp, Homo sapiens
tcagtgttggcattcagaaatg

SEQ ID NO: 8082590 - DNA, 22 bp, Homo sapiens
tcagtgttggcattcagaaatg

SEQ ID NO: 8082591 - DNA, 22 bp, Homo sapiens
tcagtgtttttaaagcaatata

SEQ ID NO: 8082592 - DNA, 22 bp, Homo sapiens
tcagtgtttttaaagcaatata

SEQ ID NO: 8082593 - DNA, 22 bp, Homo sapiens
tcagtgttttaactgtctttta

SEQ ID NO: 8082594 - DNA, 22 bp, Homo sapiens
tcagtgttttccagggtctact

SEQ ID NO: 8082595 - DNA, 22 bp, Homo sapiens
tcagtgtttggtttcagaattg

SEQ ID NO: 8082596 - DNA, 22 bp, Homo sapiens
tcagtgtttgtggcaaatgtta

SEQ ID NO: 8082597 - DNA, 22 bp, Homo sapiens
tcagtgtttcctgtggtacagc

SEQ ID NO: 8082598 - DNA, 22 bp, Homo sapiens
tcagtgtttcctagagcatata

SEQ ID NO: 8082599 - DNA, 23 bp, Homo sapiens
tcatcttcctcatttctccaggg

SEQ ID NO: 8082600 - DNA, 22 bp, Homo sapiens
tcatcttctattaatagggaga

SEQ ID NO: 8082601 - DNA, 22 bp, Homo sapiens
tcataaattgattatgtgcttt

SEQ ID NO: 8082602 - DNA, 22 bp, Homo sapiens
tcatacatcttgtatatctatc

SEQ ID NO: 8082603 - DNA, 22 bp, Homo sapiens
tcagggcaggacagtgtaggcc

SEQ ID NO: 8082604 - DNA, 22 bp, Homo sapiens
tcagggcaggcgagcagctgct

SEQ ID NO: 8082605 - DNA, 22 bp, Homo sapiens
tcagggcaggttaacttgggtg

SEQ ID NO: 8082606 - DNA, 21 bp, Homo sapiens
tcagggcagtgggaggttcct

SEQ ID NO: 8082607 - DNA, 19 bp, Homo sapiens
tcagggcagtccggtcccc

SEQ ID NO: 8082608 - DNA, 22 bp, Homo sapiens
tcagggcatccattgcctgttg

SEQ ID NO: 8082609 - DNA, 22 bp, Homo sapiens
tcagggcatcatcatgaatata

SEQ ID NO: 8082610 - DNA, 22 bp, Homo sapiens
tcagggcatactcttcaaggtc

SEQ ID NO: 8082611 - DNA, 22 bp, Homo sapiens
tcagggcatctcttaagtggtg

SEQ ID NO: 8082612 - DNA, 22 bp, Homo sapiens
tcagtatagctaaaagtttgtc

SEQ ID NO: 8082613 - DNA, 19 bp, Homo sapiens
tcagtatataattacacca

SEQ ID NO: 8082614 - DNA, 22 bp, Homo sapiens
tccaagttgatgtttcttaaat

SEQ ID NO: 8082615 - DNA, 22 bp, Homo sapiens
tccaatctagtatgataaatga

SEQ ID NO: 8082616 - DNA, 22 bp, Homo sapiens
tcatttttctcttacacgtaga

SEQ ID NO: 8082617 - DNA, 22 bp, Homo sapiens
tcatttttctcttacacgtaga

SEQ ID NO: 8082618 - DNA, 22 bp, Homo sapiens
tccaaaaaacgtttgaatagtt

SEQ ID NO: 8082619 - DNA, 22 bp, Homo sapiens
tccaaaaaacgtttgaatagtt

SEQ ID NO: 8082620 - DNA, 21 bp, Homo sapiens
tcatttttattgctaccttgc

SEQ ID NO: 8082621 - DNA, 22 bp, Homo sapiens
tcatttcagatgcatttagaat

SEQ ID NO: 8082622 - DNA, 22 bp, Homo sapiens
tcatttcagccatttttaaatg

SEQ ID NO: 8082623 - DNA, 21 bp, Homo sapiens
tcatttctctatgtatttcac

SEQ ID NO: 8082624 - DNA, 22 bp, Homo sapiens
tcatttctctgagtctgataat

SEQ ID NO: 8082625 - DNA, 22 bp, Homo sapiens
tcatttctctgagtctgataat

SEQ ID NO: 8082626 - DNA, 22 bp, Homo sapiens
tcatttaataatttttgagtag

SEQ ID NO: 8082627 - DNA, 22 bp, Homo sapiens
tcatttaatagcttttgtcttt

SEQ ID NO: 8082628 - DNA, 22 bp, Homo sapiens
tcatttaattggttttgctcgt

SEQ ID NO: 8082629 - DNA, 22 bp, Homo sapiens
tcatttaaaatgtaccaggatt

SEQ ID NO: 8082630 - DNA, 22 bp, Homo sapiens
tcacagtgagccatgtcagaga

SEQ ID NO: 8082631 - DNA, 23 bp, Homo sapiens
tcacataatccttcatccacagg

SEQ ID NO: 8082632 - DNA, 22 bp, Homo sapiens
tcacagttttagctgttaaata

SEQ ID NO: 8082633 - DNA, 22 bp, Homo sapiens
tcacagtttcttttctgataaa

SEQ ID NO: 8082634 - DNA, 22 bp, Homo sapiens
tcaacaattttgagatgagaca

SEQ ID NO: 8082635 - DNA, 22 bp, Homo sapiens
tcaacagacatttttaagcact

SEQ ID NO: 8082636 - DNA, 22 bp, Homo sapiens
tcacagtcggtgacttcttgct

SEQ ID NO: 8082637 - DNA, 22 bp, Homo sapiens
tcaagaactgtgaagagtctga

SEQ ID NO: 8082638 - DNA, 22 bp, Homo sapiens
tcaagaactggaaattgatatg

SEQ ID NO: 8082639 - DNA, 22 bp, Homo sapiens
tcagaaaggccacatggtgcag

SEQ ID NO: 8082640 - DNA, 22 bp, Homo sapiens
tcagaaaggagttagaggtctc

SEQ ID NO: 8082641 - DNA, 22 bp, Homo sapiens
tcagaaaggttctatgttttac

SEQ ID NO: 8082642 - DNA, 22 bp, Homo sapiens
tcagaaagacgaaacagatggg

SEQ ID NO: 8082643 - DNA, 22 bp, Homo sapiens
tcagaaagctatatggtgtgtc

SEQ ID NO: 8082644 - DNA, 22 bp, Homo sapiens
tcagaaagcttttacttaaaca

SEQ ID NO: 8082645 - DNA, 22 bp, Homo sapiens
tcagaaagctgattcttgatac

SEQ ID NO: 8082646 - DNA, 22 bp, Homo sapiens
tcagaaagcttagtgtcttgca

SEQ ID NO: 8082647 - DNA, 22 bp, Homo sapiens
tcagaaagaacacaggcagtag

SEQ ID NO: 8082648 - DNA, 22 bp, Homo sapiens
tcagacagaaagatgagtatgg

SEQ ID NO: 8082649 - DNA, 22 bp, Homo sapiens
tcagatttcctgttgaagaagt

SEQ ID NO: 8082650 - DNA, 22 bp, Homo sapiens
tcagatttctagcgtttggcca

SEQ ID NO: 8082651 - DNA, 22 bp, Homo sapiens
tcagattttgcacgaggttttg

SEQ ID NO: 8082652 - DNA, 22 bp, Homo sapiens
tcagcaaaggaccagcacaggc

SEQ ID NO: 8082653 - DNA, 22 bp, Homo sapiens
tcagcaaacattgattggactt

SEQ ID NO: 8082654 - DNA, 22 bp, Homo sapiens
tcagcaaaggcaattcattatt

SEQ ID NO: 8082655 - DNA, 22 bp, Homo sapiens
tcagcaaatacttattgagcgc

SEQ ID NO: 8082656 - DNA, 22 bp, Homo sapiens
tcctcagtaaggcatggctttg

SEQ ID NO: 8082657 - DNA, 22 bp, Homo sapiens
tcctgatggcctctggctccag

SEQ ID NO: 8082658 - DNA, 22 bp, Homo sapiens
tcctgcagccttgggctggagc

SEQ ID NO: 8082659 - DNA, 22 bp, Homo sapiens
tcctgcagctgaagctcatgtg

SEQ ID NO: 8082660 - DNA, 19 bp, Homo sapiens
tcctgcaggtggcttgcag

SEQ ID NO: 8082661 - DNA, 21 bp, Homo sapiens
tcctgcagaatgccttcctac

SEQ ID NO: 8082662 - DNA, 22 bp, Homo sapiens
tcctgatggttctctggttctt

SEQ ID NO: 8082663 - DNA, 22 bp, Homo sapiens
tcctgcagagccgccctcaggt

SEQ ID NO: 8082664 - DNA, 22 bp, Homo sapiens
tcctgcagatcaaagcctttga

SEQ ID NO: 8082665 - DNA, 22 bp, Homo sapiens
tcccagggactggatgatgcag

SEQ ID NO: 8082666 - DNA, 22 bp, Homo sapiens
tcccagggacccagcctgatac

SEQ ID NO: 8082667 - DNA, 22 bp, Homo sapiens
tcccagggactctctgccttcc

SEQ ID NO: 8082668 - DNA, 23 bp, Homo sapiens
tcccagggaaggtgagcgaggct

SEQ ID NO: 8082669 - DNA, 22 bp, Homo sapiens
tcccagggacaccaagctgttt

SEQ ID NO: 8082670 - DNA, 20 bp, Homo sapiens
tcccaggctgggctccagct

SEQ ID NO: 8082671 - DNA, 22 bp, Homo sapiens
tcccaggctggggccaggtgac

SEQ ID NO: 8082672 - DNA, 22 bp, Homo sapiens
tcccaggctaggcctctgcgtt

SEQ ID NO: 8082673 - DNA, 22 bp, Homo sapiens
tcccaggctaccagtgaggtca

SEQ ID NO: 8082674 - DNA, 22 bp, Homo sapiens
tccctgaaccactagtgatgag

SEQ ID NO: 8082675 - DNA, 22 bp, Homo sapiens
tccctggctgtgttcaggtgcg

SEQ ID NO: 8082676 - DNA, 22 bp, Homo sapiens
tccctggccattcctctaggcc

SEQ ID NO: 8082677 - DNA, 19 bp, Homo sapiens
tccctggcgcctctcgggc

SEQ ID NO: 8082678 - DNA, 22 bp, Homo sapiens
tccctggcctggaaggatatca

SEQ ID NO: 8082679 - DNA, 22 bp, Homo sapiens
tccctggcagctaagggtggtc

SEQ ID NO: 8082680 - DNA, 22 bp, Homo sapiens
tccctggctggtgtagagggat

SEQ ID NO: 8082681 - DNA, 22 bp, Homo sapiens
tcctagggttggagacagtgac

SEQ ID NO: 8082682 - DNA, 22 bp, Homo sapiens
tccctgggactcagacatggaa

SEQ ID NO: 8082683 - DNA, 22 bp, Homo sapiens
tcccaggcaggtgacaggggga

SEQ ID NO: 8082684 - DNA, 22 bp, Homo sapiens
tcccaggccacacttggggaac

SEQ ID NO: 8082685 - DNA, 22 bp, Homo sapiens
tcccagcctttctttctccagc

SEQ ID NO: 8082686 - DNA, 16 bp, Homo sapiens
tcccaggccaggtgga

SEQ ID NO: 8082687 - DNA, 22 bp, Homo sapiens
tcccaggcgcctggtggggagc

SEQ ID NO: 8082688 - DNA, 22 bp, Homo sapiens
tcccagagtattagcaattgct

SEQ ID NO: 8082689 - DNA, 22 bp, Homo sapiens
tcccagaggttgagtcacttat

SEQ ID NO: 8082690 - DNA, 22 bp, Homo sapiens
tcccagaggtctctgctggttc

SEQ ID NO: 8082691 - DNA, 22 bp, Homo sapiens
tcccagaggctccagtctctat

SEQ ID NO: 8082692 - DNA, 22 bp, Homo sapiens
tcccagaggcagttggtaactt

SEQ ID NO: 8082693 - DNA, 22 bp, Homo sapiens
tcccagagccaagctatggatg

SEQ ID NO: 8082694 - DNA, 22 bp, Homo sapiens
tcccagagaagagctggatgga

SEQ ID NO: 8082695 - DNA, 22 bp, Homo sapiens
tcccagagatttcctctccttc

SEQ ID NO: 8082696 - DNA, 22 bp, Homo sapiens
tcccagagacatcatttctccg

SEQ ID NO: 8082697 - DNA, 22 bp, Homo sapiens
tcccagagacagagcctcctcc

SEQ ID NO: 8082698 - DNA, 22 bp, Homo sapiens
tcccagagcagatgtgctaaag

SEQ ID NO: 8082699 - DNA, 22 bp, Homo sapiens
tcccagagcagtactccaggag

SEQ ID NO: 8082700 - DNA, 22 bp, Homo sapiens
tccattatacttctgattcaaa

SEQ ID NO: 8082701 - DNA, 22 bp, Homo sapiens
tccattcattcaggtatttagt

SEQ ID NO: 8082702 - DNA, 22 bp, Homo sapiens
tccattctacaaggtagcaggg

SEQ ID NO: 8082703 - DNA, 22 bp, Homo sapiens
tccattctatgcttacatttat

SEQ ID NO: 8082704 - DNA, 22 bp, Homo sapiens
tccaggcctttgcacatgttgt

SEQ ID NO: 8082705 - DNA, 22 bp, Homo sapiens
tccagggctgggttggctcagc

SEQ ID NO: 8082706 - DNA, 22 bp, Homo sapiens
tccagggctgttactttacata

SEQ ID NO: 8082707 - DNA, 22 bp, Homo sapiens
gcagcacacggtggtgccctgg

SEQ ID NO: 8082708 - DNA, 22 bp, Homo sapiens
gcagggcatgggccctgtctgc

SEQ ID NO: 8082709 - DNA, 22 bp, Homo sapiens
gcagggcaggatttgaacccag

SEQ ID NO: 8082710 - DNA, 22 bp, Homo sapiens
gcagggcagggcaagaactggg

SEQ ID NO: 8082711 - DNA, 22 bp, Homo sapiens
gcagggttctcagcagtgatgg

SEQ ID NO: 8082712 - DNA, 19 bp, Homo sapiens
gcagggtgttgactgtccc

SEQ ID NO: 8082713 - DNA, 22 bp, Homo sapiens
gcagggttggtgtcctctgcgg

SEQ ID NO: 8082714 - DNA, 22 bp, Homo sapiens
gcagggttcctctctagcattt

SEQ ID NO: 8082715 - DNA, 22 bp, Homo sapiens
gcagggtttagcacctgtagct

SEQ ID NO: 8082716 - DNA, 22 bp, Homo sapiens
gcagggcagcttagtccctgtc

SEQ ID NO: 8082717 - DNA, 22 bp, Homo sapiens
gcagggcagctgaagctaggtg

SEQ ID NO: 8082718 - DNA, 22 bp, Homo sapiens
gcagggcagctcactgtggttc

SEQ ID NO: 8082719 - DNA, 22 bp, Homo sapiens
gcaggccagctgtgcagatggg

SEQ ID NO: 8082720 - DNA, 18 bp, Homo sapiens
gcacatgtgtaaggcgac

SEQ ID NO: 8082721 - DNA, 22 bp, Homo sapiens
gcaatacagaagagtggcaagg

SEQ ID NO: 8082722 - DNA, 22 bp, Homo sapiens
gcacccagaggtcagcagtgct

SEQ ID NO: 8082723 - DNA, 22 bp, Homo sapiens
gcagacagccagactgcactgg

SEQ ID NO: 8082724 - DNA, 22 bp, Homo sapiens
gcccggccaggaacagagtata

SEQ ID NO: 8082725 - DNA, 22 bp, Homo sapiens
gcccaaggtcccatggcagcac

SEQ ID NO: 8082726 - DNA, 22 bp, Homo sapiens
gcccacaggggacctggtggct

SEQ ID NO: 8082727 - DNA, 22 bp, Homo sapiens
gccccaggttgcctgtcccagg

SEQ ID NO: 8082728 - DNA, 22 bp, Homo sapiens
gccctgctctggtctctgcccg

SEQ ID NO: 8082729 - DNA, 22 bp, Homo sapiens
gccaggctaagaaaggtgtgat

SEQ ID NO: 8082730 - DNA, 22 bp, Homo sapiens
gccacttgtgtaagcgcctgtc

SEQ ID NO: 8082731 - DNA, 22 bp, Homo sapiens
gcatttaaatttgaacttcaga

SEQ ID NO: 8082732 - DNA, 22 bp, Homo sapiens
gcatttatttctttactgcatc

SEQ ID NO: 8082733 - DNA, 22 bp, Homo sapiens
gcaggtggaagcagcagactca

SEQ ID NO: 8082734 - DNA, 22 bp, Homo sapiens
gcagttaaaaataaaccttcat

SEQ ID NO: 8082735 - DNA, 18 bp, Homo sapiens
gcattctgttaatgtgga

SEQ ID NO: 8082736 - DNA, 21 bp, Homo sapiens
gcagtttatgtaatatgcact

SEQ ID NO: 8082737 - DNA, 22 bp, Homo sapiens
gcagttttagagctttaagatg

SEQ ID NO: 8082738 - DNA, 22 bp, Homo sapiens
gcagttttagtggatctggggc

SEQ ID NO: 8082739 - DNA, 22 bp, Homo sapiens
gcagttttattatgatggaaat

SEQ ID NO: 8082740 - DNA, 22 bp, Homo sapiens
gctgtcaggaacatgccttggt

SEQ ID NO: 8082741 - DNA, 23 bp, Homo sapiens
gctgtcagttgtttttgtctcta

SEQ ID NO: 8082742 - DNA, 22 bp, Homo sapiens
gctgtcagtgaggtgagacatg

SEQ ID NO: 8082743 - DNA, 22 bp, Homo sapiens
gctgtccaggttgtggagcaac

SEQ ID NO: 8082744 - DNA, 22 bp, Homo sapiens
gctgtcagttttacccacagac

SEQ ID NO: 8082745 - DNA, 22 bp, Homo sapiens
gctgtcctcttggactcagggc

SEQ ID NO: 8082746 - DNA, 22 bp, Homo sapiens
gctgtcctctgatctctggagg

SEQ ID NO: 8082747 - DNA, 22 bp, Homo sapiens
gctgtctcatacaaggccctgc

SEQ ID NO: 8082748 - DNA, 23 bp, Homo sapiens
gcttttaaacctgtgactgccgc

SEQ ID NO: 8082749 - DNA, 22 bp, Homo sapiens
gcttttaattagttgcttccat

SEQ ID NO: 8082750 - DNA, 18 bp, Homo sapiens
gctttttagtgcatcttc

SEQ ID NO: 8082751 - DNA, 22 bp, Homo sapiens
gcttaaatcccaatgctagacc

SEQ ID NO: 8082752 - DNA, 22 bp, Homo sapiens
gcttaaattgtttgtggatagt

SEQ ID NO: 8082753 - DNA, 22 bp, Homo sapiens
gctttaaatggcttgcccaagt

SEQ ID NO: 8082754 - DNA, 22 bp, Homo sapiens
gctgtttaattcaccattcaac

SEQ ID NO: 8082755 - DNA, 22 bp, Homo sapiens
gctgtttcctacatggtgttat

SEQ ID NO: 8082756 - DNA, 22 bp, Homo sapiens
ggagaacaaatatctggcttct

SEQ ID NO: 8082757 - DNA, 23 bp, Homo sapiens
ggacagggccctgccctatggcc

SEQ ID NO: 8082758 - DNA, 22 bp, Homo sapiens
ggactgggaatcagggagatgc

SEQ ID NO: 8082759 - DNA, 22 bp, Homo sapiens
gctcccagcattgctgctgaat

SEQ ID NO: 8082760 - DNA, 22 bp, Homo sapiens
gctcccaggatgaggagccagg

SEQ ID NO: 8082761 - DNA, 22 bp, Homo sapiens
gctctgggtagccactgcctgg

SEQ ID NO: 8082762 - DNA, 22 bp, Homo sapiens
gctcccagcaattgaggcagcc

SEQ ID NO: 8082763 - DNA, 22 bp, Homo sapiens
gctcagggccatggaccagcag

SEQ ID NO: 8082764 - DNA, 22 bp, Homo sapiens
gctatacaagtgtagaatagag

SEQ ID NO: 8082765 - DNA, 22 bp, Homo sapiens
gctatacacatttcttggtagt

SEQ ID NO: 8082766 - DNA, 22 bp, Homo sapiens
gctagtgcagggaaatctttgg

SEQ ID NO: 8082767 - DNA, 22 bp, Homo sapiens
gctcagggagagagggcagccg

SEQ ID NO: 8082768 - DNA, 21 bp, Homo sapiens
gctatacagaatggccagagg

SEQ ID NO: 8082769 - DNA, 22 bp, Homo sapiens
gctcagggaatgagaagatgtt

SEQ ID NO: 8082770 - DNA, 22 bp, Homo sapiens
gctggcaggtaaagccccgggg

SEQ ID NO: 8082771 - DNA, 22 bp, Homo sapiens
gctgctgtccttcaagtctgcg

SEQ ID NO: 8082772 - DNA, 22 bp, Homo sapiens
gctgctggtcctcagagctcat

SEQ ID NO: 8082773 - DNA, 22 bp, Homo sapiens
gctgcctctcctgagttgacag

SEQ ID NO: 8082774 - DNA, 21 bp, Homo sapiens
gctgcagggcccagggcaccc

SEQ ID NO: 8082775 - DNA, 22 bp, Homo sapiens
gctgcagggagctggaaggctc

SEQ ID NO: 8082776 - DNA, 22 bp, Homo sapiens
gctgcaggggggtctggacttg

SEQ ID NO: 8082777 - DNA, 22 bp, Homo sapiens
gctgcaggctctgcaggaattg

SEQ ID NO: 8082778 - DNA, 22 bp, Homo sapiens
gctgcaggcggccgtggtggcg

SEQ ID NO: 8082779 - DNA, 22 bp, Homo sapiens
gctgcaggctgtggcaggggag

SEQ ID NO: 8082780 - DNA, 22 bp, Homo sapiens
gctgcagggaatgtatggattt

SEQ ID NO: 8082781 - DNA, 22 bp, Homo sapiens
gctgcaggcagaatctcccaat

SEQ ID NO: 8082782 - DNA, 22 bp, Homo sapiens
gctgcaggcattttcctgggca

SEQ ID NO: 8082783 - DNA, 18 bp, Homo sapiens
gctgcaggccctccgagg

SEQ ID NO: 8082784 - DNA, 22 bp, Homo sapiens
gctgcaggcgcctgcggtctct

SEQ ID NO: 8082785 - DNA, 19 bp, Homo sapiens
ggttatttgagggttaaga

SEQ ID NO: 8082786 - DNA, 22 bp, Homo sapiens
ggtgaatttgcctcccgactga

SEQ ID NO: 8082787 - DNA, 21 bp, Homo sapiens
ggtgaatttctaggaagtggc

SEQ ID NO: 8082788 - DNA, 22 bp, Homo sapiens
ggtgagctggtctggggctgct

SEQ ID NO: 8082789 - DNA, 18 bp, Homo sapiens
ggtgagggagctggaagc

SEQ ID NO: 8082790 - DNA, 22 bp, Homo sapiens
ggggtgctagagtggggccact

SEQ ID NO: 8082791 - DNA, 22 bp, Homo sapiens
ggggtgctgaagatgtcatggt

SEQ ID NO: 8082792 - DNA, 22 bp, Homo sapiens
gggctggtgaggctgccctgca

SEQ ID NO: 8082793 - DNA, 22 bp, Homo sapiens
gggcttctctttagtgagctga

SEQ ID NO: 8082794 - DNA, 22 bp, Homo sapiens
ggggcagggaggttatcgccga

SEQ ID NO: 8082795 - DNA, 20 bp, Homo sapiens
ggggcaggtttttatggcta

SEQ ID NO: 8082796 - DNA, 22 bp, Homo sapiens
gggcttctgtacctacctggaa

SEQ ID NO: 8082797 - DNA, 22 bp, Homo sapiens
gtctaattcctgctcttactca

SEQ ID NO: 8082798 - DNA, 22 bp, Homo sapiens
gtctatatattgcttgaataat

SEQ ID NO: 8082799 - DNA, 22 bp, Homo sapiens
gtctccagaggttacatcctgt

SEQ ID NO: 8082800 - DNA, 22 bp, Homo sapiens
gtctatttgggatcatgatatg

SEQ ID NO: 8082801 - DNA, 22 bp, Homo sapiens
gtcttggatatgtttgccttca

SEQ ID NO: 8082802 - DNA, 19 bp, Homo sapiens
gtcttggctctcaaccatc

SEQ ID NO: 8082803 - DNA, 22 bp, Homo sapiens
gtctccagttacagcagccagg

SEQ ID NO: 8082804 - DNA, 22 bp, Homo sapiens
gtctccagggctgctggcgcct

SEQ ID NO: 8082805 - DNA, 22 bp, Homo sapiens
gtctttttctacgatagcgcct

SEQ ID NO: 8082806 - DNA, 22 bp, Homo sapiens
gtctttttgtctggcagaggtc

SEQ ID NO: 8082807 - DNA, 22 bp, Homo sapiens
gtctttttattatagagtggag

SEQ ID NO: 8082808 - DNA, 22 bp, Homo sapiens
gtctttttctacgatagcgcct

SEQ ID NO: 8082809 - DNA, 22 bp, Homo sapiens
gtcttttttacaccttacatca

SEQ ID NO: 8082810 - DNA, 22 bp, Homo sapiens
gtcttttttacaccttacatca

SEQ ID NO: 8082811 - DNA, 22 bp, Homo sapiens
gtctttatttgagattgtcatt

SEQ ID NO: 8082812 - DNA, 22 bp, Homo sapiens
gtctttcactgcggtttacatg

SEQ ID NO: 8082813 - DNA, 21 bp, Homo sapiens
gtctttctacctctatgtggc

SEQ ID NO: 8082814 - DNA, 22 bp, Homo sapiens
gtctttctatgatgaactgttg

SEQ ID NO: 8082815 - DNA, 22 bp, Homo sapiens
gtctttcatggatattcagttt

SEQ ID NO: 8082816 - DNA, 22 bp, Homo sapiens
gtcttttgctagccagagagct

SEQ ID NO: 8082817 - DNA, 21 bp, Homo sapiens
gtctttttaattgcgatttcc

SEQ ID NO: 8082818 - DNA, 22 bp, Homo sapiens
gtgagcatgtagtaatctggag

SEQ ID NO: 8082819 - DNA, 22 bp, Homo sapiens
gtgagcatatatgtaatcgttt

SEQ ID NO: 8082820 - DNA, 22 bp, Homo sapiens
gtgcagggagcccagaaggtcc

SEQ ID NO: 8082821 - DNA, 22 bp, Homo sapiens
gtgcaggggcctccccttgctg

SEQ ID NO: 8082822 - DNA, 22 bp, Homo sapiens
gtgcagggtagcgacggcagga

SEQ ID NO: 8082823 - DNA, 17 bp, Homo sapiens
gtgcagggatgaaggat

SEQ ID NO: 8082824 - DNA, 22 bp, Homo sapiens
gtgcagggcagccgaatgggct

SEQ ID NO: 8082825 - DNA, 22 bp, Homo sapiens
gtgcaggggatcaggttgcagc

SEQ ID NO: 8082826 - DNA, 22 bp, Homo sapiens
gtgcagggctggcaccggaggc

SEQ ID NO: 8082827 - DNA, 22 bp, Homo sapiens
gtgcagggcaggtgtccttcca

SEQ ID NO: 8082828 - DNA, 22 bp, Homo sapiens
gtgcagggccctcctaacatct

SEQ ID NO: 8082829 - DNA, 22 bp, Homo sapiens
gtgctgctgccagcaggatcct

SEQ ID NO: 8082830 - DNA, 22 bp, Homo sapiens
gtgctgcttgggggcagagcag

SEQ ID NO: 8082831 - DNA, 22 bp, Homo sapiens
gtgctgctcaagggacaggaca

SEQ ID NO: 8082832 - DNA, 22 bp, Homo sapiens
gtcctctggcctttcccaggac

SEQ ID NO: 8082833 - DNA, 22 bp, Homo sapiens
gtcctggcacctcactggctac

SEQ ID NO: 8082834 - DNA, 22 bp, Homo sapiens
gtcctggcccactggcaggctg

SEQ ID NO: 8082835 - DNA, 22 bp, Homo sapiens
gtatttttagtagagtcggggt

SEQ ID NO: 8082836 - DNA, 22 bp, Homo sapiens
gtatttttcagttaggagctta

SEQ ID NO: 8082837 - DNA, 22 bp, Homo sapiens
gtatttttcattccaagtgaga

SEQ ID NO: 8082838 - DNA, 22 bp, Homo sapiens
gtatttttcattccaagtgaga

SEQ ID NO: 8082839 - DNA, 22 bp, Homo sapiens
gtagtttaattcctggcctttc

SEQ ID NO: 8082840 - DNA, 22 bp, Homo sapiens
gtataactgctaccacctgatg

SEQ ID NO: 8082841 - DNA, 22 bp, Homo sapiens
gtatacaatacacaatgctctg

SEQ ID NO: 8082842 - DNA, 22 bp, Homo sapiens
gtatttttaggtaaggaaagta

SEQ ID NO: 8082843 - DNA, 22 bp, Homo sapiens
gtaggcagataggagtgcagcc

SEQ ID NO: 8082844 - DNA, 22 bp, Homo sapiens
gtacaaaagttattgcggtttt

SEQ ID NO: 8082845 - DNA, 22 bp, Homo sapiens
gggcaggtgtgcagagctgttg

SEQ ID NO: 8082846 - DNA, 17 bp, Homo sapiens
gggcagggactcctggg

SEQ ID NO: 8082847 - DNA, 22 bp, Homo sapiens
gggcaggtctgggtcagcctga

SEQ ID NO: 8082848 - DNA, 22 bp, Homo sapiens
gggagctgaaggagccggcggg

SEQ ID NO: 8082849 - DNA, 22 bp, Homo sapiens
gggagctgaatggcaatggaga

SEQ ID NO: 8082850 - DNA, 22 bp, Homo sapiens
gggaaggccggtccagtcaggt

SEQ ID NO: 8082851 - DNA, 22 bp, Homo sapiens
gggaaggcagtgtctggttgaa

SEQ ID NO: 8082852 - DNA, 22 bp, Homo sapiens
ggctgtgcttggtgtccttgga

SEQ ID NO: 8082853 - DNA, 22 bp, Homo sapiens
ggctgcaggttggttggcagct

SEQ ID NO: 8082854 - DNA, 22 bp, Homo sapiens
ggctctgcggcgtgtgcgcagg

SEQ ID NO: 8082855 - DNA, 22 bp, Homo sapiens
ggctgcaggcagggtatccact

SEQ ID NO: 8082856 - DNA, 22 bp, Homo sapiens
ggctctgcagcttgctaactgt

SEQ ID NO: 8082857 - DNA, 22 bp, Homo sapiens
ggctctgcagagggcccagctt

SEQ ID NO: 8082858 - DNA, 22 bp, Homo sapiens
ggctctgcatgtgagtgggtgg

SEQ ID NO: 8082859 - DNA, 22 bp, Homo sapiens
ggctctgcccaggtggacagca

SEQ ID NO: 8082860 - DNA, 22 bp, Homo sapiens
ggctctgcctgcctgagtgtcc

SEQ ID NO: 8082861 - DNA, 22 bp, Homo sapiens
ggctctgcctgcccagcagcac

SEQ ID NO: 8082862 - DNA, 22 bp, Homo sapiens
ggctagggacacagctctgctc

SEQ ID NO: 8082863 - DNA, 23 bp, Homo sapiens
ggctcacacggagtgcctccacc

SEQ ID NO: 8082864 - DNA, 22 bp, Homo sapiens
ggccagcatatagagtgaagta

SEQ ID NO: 8082865 - DNA, 21 bp, Homo sapiens
ggccacagttagggctcagga

SEQ ID NO: 8082866 - DNA, 20 bp, Homo sapiens
ggccacagggtgctggtgga

SEQ ID NO: 8082867 - DNA, 22 bp, Homo sapiens
ggccacagagggcgggatgctg

SEQ ID NO: 8082868 - DNA, 17 bp, Homo sapiens
ggccacagagcttgggg

SEQ ID NO: 8082869 - DNA, 22 bp, Homo sapiens
ggcagtgggaaataagtgagaa

SEQ ID NO: 8082870 - DNA, 22 bp, Homo sapiens
ggcagggaaacagctgatccca

SEQ ID NO: 8082871 - DNA, 22 bp, Homo sapiens
ggcagggactatgtttcatgga

SEQ ID NO: 8082872 - DNA, 22 bp, Homo sapiens
ggcagggaagctggcatcacgg

SEQ ID NO: 8082873 - DNA, 22 bp, Homo sapiens
ggcagggagagcatgctgataa

SEQ ID NO: 8082874 - DNA, 22 bp, Homo sapiens
ggcagggccctgattcctgggg

SEQ ID NO: 8082875 - DNA, 22 bp, Homo sapiens
ggcagtgcctgatgctgcagga

SEQ ID NO: 8082876 - DNA, 22 bp, Homo sapiens
ggcagtggaggaccctgtgtct

SEQ ID NO: 8082877 - DNA, 22 bp, Homo sapiens
ggcagtggcagagcttggtcta

SEQ ID NO: 8082878 - DNA, 17 bp, Homo sapiens
ggcagtggaggaagaga

SEQ ID NO: 8082879 - DNA, 22 bp, Homo sapiens
ggcagccatgtcccagggcttc

SEQ ID NO: 8082880 - DNA, 18 bp, Homo sapiens
ggcagcctggacatgctc

SEQ ID NO: 8082881 - DNA, 20 bp, Homo sapiens
ggcagcaaccatatgctaca

SEQ ID NO: 8082882 - DNA, 22 bp, Homo sapiens
ggcagcaacgaggcttgatacc

SEQ ID NO: 8082883 - DNA, 22 bp, Homo sapiens
ggcagcaagagaggttcagctt

SEQ ID NO: 8082884 - DNA, 18 bp, Homo sapiens
ggcagcaagaagggaggg

SEQ ID NO: 8082885 - DNA, 22 bp, Homo sapiens
ggcagcaagcagaagttctatg

SEQ ID NO: 8082886 - DNA, 22 bp, Homo sapiens
ggcagcaaatattgtcagctgt

SEQ ID NO: 8082887 - DNA, 22 bp, Homo sapiens
ggcagcaacaggtgtgttgtga

SEQ ID NO: 8082888 - DNA, 22 bp, Homo sapiens
ggcagcaacacgagtgagctaa

SEQ ID NO: 8082889 - DNA, 22 bp, Homo sapiens
ggcagcaaaaagcctggttgaa

SEQ ID NO: 8082890 - DNA, 22 bp, Homo sapiens
ggcagcaaactggcttcaggct

SEQ ID NO: 8082891 - DNA, 22 bp, Homo sapiens
ggcagcaagtggtgggagactt

SEQ ID NO: 8082892 - DNA, 22 bp, Homo sapiens
ggcagatggggtgacaagagag

SEQ ID NO: 8082893 - DNA, 22 bp, Homo sapiens
tttgttcaacatcacttccacc

SEQ ID NO: 8082894 - DNA, 22 bp, Homo sapiens
tttgttaattcttatgttagag

SEQ ID NO: 8082895 - DNA, 22 bp, Homo sapiens
tttgttaaggagtattgcttct

SEQ ID NO: 8082896 - DNA, 22 bp, Homo sapiens
tttgtgttggaagaaatgctac

SEQ ID NO: 8082897 - DNA, 22 bp, Homo sapiens
tttgtgttttcccatactattg

SEQ ID NO: 8082898 - DNA, 22 bp, Homo sapiens
tttgttaaatatttattgagtg

SEQ ID NO: 8082899 - DNA, 22 bp, Homo sapiens
tttgttaaaatgcagattctgt

SEQ ID NO: 8082900 - DNA, 22 bp, Homo sapiens
tttgttaaaatgcagattctgt

SEQ ID NO: 8082901 - DNA, 22 bp, Homo sapiens
tttgtaaaaggaggaagcatgg

SEQ ID NO: 8082902 - DNA, 22 bp, Homo sapiens
tttgtaaagtctgttctgagtt

SEQ ID NO: 8082903 - DNA, 22 bp, Homo sapiens
tttgtaaatagcagtactcatg

SEQ ID NO: 8082904 - DNA, 22 bp, Homo sapiens
ttttaatgtgctctgcaatgat

SEQ ID NO: 8082905 - DNA, 22 bp, Homo sapiens
ttttaattcaaagtgaatagtg

SEQ ID NO: 8082906 - DNA, 22 bp, Homo sapiens
ttttaattgcaattatggtccc

SEQ ID NO: 8082907 - DNA, 22 bp, Homo sapiens
ttttaatactgctattgtagga

SEQ ID NO: 8082908 - DNA, 22 bp, Homo sapiens
ttttaatgggcgactattatgg

SEQ ID NO: 8082909 - DNA, 18 bp, Homo sapiens
ttttaatttcaggggtgg

SEQ ID NO: 8082910 - DNA, 23 bp, Homo sapiens
ttttaatttggacataagaagat

SEQ ID NO: 8082911 - DNA, 22 bp, Homo sapiens
ttttatgcaagttatgattaaa

SEQ ID NO: 8082912 - DNA, 21 bp, Homo sapiens
ttttatgcataggaaatatat

SEQ ID NO: 8082913 - DNA, 22 bp, Homo sapiens
ttttatgtaatccttactgtcg

SEQ ID NO: 8082914 - DNA, 22 bp, Homo sapiens
ttttatgtaataaactgtacac

SEQ ID NO: 8082915 - DNA, 22 bp, Homo sapiens
ttttatgtcataaggacactca

SEQ ID NO: 8082916 - DNA, 22 bp, Homo sapiens
ttttatgtgctggactggcagt

SEQ ID NO: 8082917 - DNA, 20 bp, Homo sapiens
ttttatgtcaccttcctgtc

SEQ ID NO: 8082918 - DNA, 22 bp, Homo sapiens
ttttaaaggatactcttgtcta

SEQ ID NO: 8082919 - DNA, 22 bp, Homo sapiens
ttttaaaggatagctctggttg

SEQ ID NO: 8082920 - DNA, 22 bp, Homo sapiens
ttttaaagagatgctgtgcata

SEQ ID NO: 8082921 - DNA, 22 bp, Homo sapiens
ttttaaactgcagaatttagaa

SEQ ID NO: 8082922 - DNA, 22 bp, Homo sapiens
ttttaaactgcagaatttagaa

SEQ ID NO: 8082923 - DNA, 22 bp, Homo sapiens
tttgttcaatatgtgtttgtcc

SEQ ID NO: 8082924 - DNA, 22 bp, Homo sapiens
ttttaaaggctgtatgaccaag

SEQ ID NO: 8082925 - DNA, 22 bp, Homo sapiens
ttttaacttaaaatacatagat

SEQ ID NO: 8082926 - DNA, 22 bp, Homo sapiens
ttttaacactcagcactatctc

SEQ ID NO: 8082927 - DNA, 22 bp, Homo sapiens
ttttctcagctgcactgtatta

SEQ ID NO: 8082928 - DNA, 22 bp, Homo sapiens
ttttctgaagtttaagacattt

SEQ ID NO: 8082929 - DNA, 22 bp, Homo sapiens
ttttcttactgtctgtgatcct

SEQ ID NO: 8082930 - DNA, 22 bp, Homo sapiens
ttttcttatagagcttaaagtt

SEQ ID NO: 8082931 - DNA, 22 bp, Homo sapiens
ttttcttatgtgcagctatatg

SEQ ID NO: 8082932 - DNA, 22 bp, Homo sapiens
ttttcttatggtgaagcacaaa

SEQ ID NO: 8082933 - DNA, 22 bp, Homo sapiens
ttttcattgagcacctgagtaa

SEQ ID NO: 8082934 - DNA, 22 bp, Homo sapiens
ttttcatgttccttgttaagtg

SEQ ID NO: 8082935 - DNA, 22 bp, Homo sapiens
ttttcacacaaggtgataagtt

SEQ ID NO: 8082936 - DNA, 19 bp, Homo sapiens
ttttcacatactggatcct

SEQ ID NO: 8082937 - DNA, 22 bp, Homo sapiens
ttttcatgtgatgtgacatttc

SEQ ID NO: 8082938 - DNA, 22 bp, Homo sapiens
ttttcatgtcatgtccttgagg

SEQ ID NO: 8082939 - DNA, 22 bp, Homo sapiens
ttttcatggccaccgcaagtga

SEQ ID NO: 8082940 - DNA, 22 bp, Homo sapiens
ttttcatgaggaaatactgccc

SEQ ID NO: 8082941 - DNA, 22 bp, Homo sapiens
ttttatgtgtgaaatgctgtct

SEQ ID NO: 8082942 - DNA, 22 bp, Homo sapiens
ttttatgtgtgaaatgctgtct

SEQ ID NO: 8082943 - DNA, 22 bp, Homo sapiens
ttttatgttcctctttatgcga

SEQ ID NO: 8082944 - DNA, 22 bp, Homo sapiens
ttttatgttcctgaagctatct

SEQ ID NO: 8082945 - DNA, 21 bp, Homo sapiens
tttgaaagccctatgttttca

SEQ ID NO: 8082946 - DNA, 21 bp, Homo sapiens
tttgaaagccctatgttttca

SEQ ID NO: 8082947 - DNA, 21 bp, Homo sapiens
tttgaaagctacatctatagc

SEQ ID NO: 8082948 - DNA, 22 bp, Homo sapiens
tttctttgttgttatcacatca

SEQ ID NO: 8082949 - DNA, 22 bp, Homo sapiens
tttctttgttgttatcacatca

SEQ ID NO: 8082950 - DNA, 22 bp, Homo sapiens
tttctttgtagtagcataatca

SEQ ID NO: 8082951 - DNA, 22 bp, Homo sapiens
tttcttttgctgagaggggcac

SEQ ID NO: 8082952 - DNA, 19 bp, Homo sapiens
tttcttttcccctcagcac

SEQ ID NO: 8082953 - DNA, 22 bp, Homo sapiens
tttcttttccaatatccctact

SEQ ID NO: 8082954 - DNA, 22 bp, Homo sapiens
tttccctctcatctctattatt

SEQ ID NO: 8082955 - DNA, 22 bp, Homo sapiens
tttggaaagacacacagtttta

SEQ ID NO: 8082956 - DNA, 22 bp, Homo sapiens
tttggaaagtgtgatttcaagg

SEQ ID NO: 8082957 - DNA, 22 bp, Homo sapiens
tttggaaacatctcagaaaata

SEQ ID NO: 8082958 - DNA, 22 bp, Homo sapiens
tttggtcagataagtcaatgta

SEQ ID NO: 8082959 - DNA, 22 bp, Homo sapiens
tttggtcatgtcgtcatttggg

SEQ ID NO: 8082960 - DNA, 22 bp, Homo sapiens
tttgtaaaagcccaagctgtag

SEQ ID NO: 8082961 - DNA, 22 bp, Homo sapiens
tttggtgtctgaaaataacagt

SEQ ID NO: 8082962 - DNA, 22 bp, Homo sapiens
tttgataattaaaaattgtagt

SEQ ID NO: 8082963 - DNA, 22 bp, Homo sapiens
tttgataatacacaagagaaag

SEQ ID NO: 8082964 - DNA, 22 bp, Homo sapiens
tttttcatctgattgataactc

SEQ ID NO: 8082965 - DNA, 22 bp, Homo sapiens
tttttcatattcccctctctgg

SEQ ID NO: 8082966 - DNA, 22 bp, Homo sapiens
tttttcagccatgaattacact

SEQ ID NO: 8082967 - DNA, 22 bp, Homo sapiens
tttttcagccatgaattacact

SEQ ID NO: 8082968 - DNA, 22 bp, Homo sapiens
tttttatactttgctcaagatt

SEQ ID NO: 8082969 - DNA, 22 bp, Homo sapiens
tttttataggtcagggcaagtc

SEQ ID NO: 8082970 - DNA, 22 bp, Homo sapiens
tttttatgcctacgctgaaaag

SEQ ID NO: 8082971 - DNA, 22 bp, Homo sapiens
tttttcaagacaacctgcatgt

SEQ ID NO: 8082972 - DNA, 22 bp, Homo sapiens
tttttacacttagcattgagcg

SEQ ID NO: 8082973 - DNA, 23 bp, Homo sapiens
tttttagttacacctctgccacc

SEQ ID NO: 8082974 - DNA, 22 bp, Homo sapiens
tttttataactcttttgtgaca

SEQ ID NO: 8082975 - DNA, 22 bp, Homo sapiens
tttttagagtgttaccagtata

SEQ ID NO: 8082976 - DNA, 22 bp, Homo sapiens
tttttagaattggctgagaatt

SEQ ID NO: 8082977 - DNA, 22 bp, Homo sapiens
ttatatgagtatcatatcactt

SEQ ID NO: 8082978 - DNA, 20 bp, Homo sapiens
ttatatcataatgtgccaat

SEQ ID NO: 8082979 - DNA, 22 bp, Homo sapiens
ttatatcagaaggtgagattga

SEQ ID NO: 8082980 - DNA, 22 bp, Homo sapiens
ttattaatcttatctttggaaa

SEQ ID NO: 8082981 - DNA, 22 bp, Homo sapiens
ttattatagattatgcaagatt

SEQ ID NO: 8082982 - DNA, 22 bp, Homo sapiens
ttattatagattatgcaagatt

SEQ ID NO: 8082983 - DNA, 22 bp, Homo sapiens
ttattagagtgctttgagaaag

SEQ ID NO: 8082984 - DNA, 22 bp, Homo sapiens
ttattacactgaaagaattgcg

SEQ ID NO: 8082985 - DNA, 22 bp, Homo sapiens
ttattagatctgttagggatcc

SEQ ID NO: 8082986 - DNA, 22 bp, Homo sapiens
ttattataatgagggataaaaa

SEQ ID NO: 8082987 - DNA, 22 bp, Homo sapiens
ttattataatgagggataaaaa

SEQ ID NO: 8082988 - DNA, 22 bp, Homo sapiens
ttcaaacagtgtagaatatatg

SEQ ID NO: 8082989 - DNA, 22 bp, Homo sapiens
ttcaaacagtgtagaatatatg

SEQ ID NO: 8082990 - DNA, 22 bp, Homo sapiens
ttcaaactagttaaaagtcaga

SEQ ID NO: 8082991 - DNA, 22 bp, Homo sapiens
ttattgactcccagcttttcca

SEQ ID NO: 8082992 - DNA, 22 bp, Homo sapiens
ttatagaaggagcattcactta

SEQ ID NO: 8082993 - DNA, 22 bp, Homo sapiens
ttatagcagcatgatttataat

SEQ ID NO: 8082994 - DNA, 22 bp, Homo sapiens
ttatagcagcatgatttatagt

SEQ ID NO: 8082995 - DNA, 22 bp, Homo sapiens
ttatagatctaaatgtgaaggg

SEQ ID NO: 8082996 - DNA, 22 bp, Homo sapiens
ttatacctgaagcaggtgatgt

SEQ ID NO: 8082997 - DNA, 22 bp, Homo sapiens
ttccaggggcagcagtgatggt

SEQ ID NO: 8082998 - DNA, 22 bp, Homo sapiens
ttccagggctaggtaatgggta

SEQ ID NO: 8082999 - DNA, 22 bp, Homo sapiens
ttccagggaagagcaaggcagt

SEQ ID NO: 8083000 - DNA, 22 bp, Homo sapiens
ttccagggcagcaagtgaatgg

SEQ ID NO: 8083001 - DNA, 22 bp, Homo sapiens
ttcatttttaccgcgtgtcaaa

SEQ ID NO: 8083002 - DNA, 22 bp, Homo sapiens
ttcattttctttcacgctgctg

SEQ ID NO: 8083003 - DNA, 21 bp, Homo sapiens
ttcataaaccattctcatgca

SEQ ID NO: 8083004 - DNA, 19 bp, Homo sapiens
ttcataacttttatatcct

SEQ ID NO: 8083005 - DNA, 22 bp, Homo sapiens
ttcagttttgcttttaatcatg

SEQ ID NO: 8083006 - DNA, 22 bp, Homo sapiens
ttcagttttattgtactgctat

SEQ ID NO: 8083007 - DNA, 22 bp, Homo sapiens
ttcagttttctttagaatgtag

SEQ ID NO: 8083008 - DNA, 22 bp, Homo sapiens
ttcagttttccctcctgcaggt

SEQ ID NO: 8083009 - DNA, 22 bp, Homo sapiens
ttcagtttgtttgactgttaga

SEQ ID NO: 8083010 - DNA, 22 bp, Homo sapiens
ttcagtttgctacaagcaacat

SEQ ID NO: 8083011 - DNA, 22 bp, Homo sapiens
ttcagtttcaaatcctgtgaag

SEQ ID NO: 8083012 - DNA, 22 bp, Homo sapiens
ttcagtttcaaatcctggatgc

SEQ ID NO: 8083013 - DNA, 22 bp, Homo sapiens
ttcataatcaccaaaaactgga

SEQ ID NO: 8083014 - DNA, 22 bp, Homo sapiens
ttcatacaatgggatattatga

SEQ ID NO: 8083015 - DNA, 22 bp, Homo sapiens
ttcatttaatttgtgtattaac

SEQ ID NO: 8083016 - DNA, 23 bp, Homo sapiens
ttcatttaggagttcataagagc

SEQ ID NO: 8083017 - DNA, 22 bp, Homo sapiens
ttcatttaatttgtgtattaac

SEQ ID NO: 8083018 - DNA, 22 bp, Homo sapiens
ttcagtgtgaagcttctgaaag

SEQ ID NO: 8083019 - DNA, 22 bp, Homo sapiens
ttcagcaagaccaccatgtacc

SEQ ID NO: 8083020 - DNA, 22 bp, Homo sapiens
ttcagcaacctataaatcccag

SEQ ID NO: 8083021 - DNA, 22 bp, Homo sapiens
ttcacagggccactggcaggag

SEQ ID NO: 8083022 - DNA, 23 bp, Homo sapiens
ttcaaagatcttctgaaatctgt

SEQ ID NO: 8083023 - DNA, 22 bp, Homo sapiens
ttcaaagatggagggatagatt

SEQ ID NO: 8083024 - DNA, 20 bp, Homo sapiens
ttcaaagaccctcaggtcca

SEQ ID NO: 8083025 - DNA, 21 bp, Homo sapiens
ttcaaagacttgatgctgacc

SEQ ID NO: 8083026 - DNA, 22 bp, Homo sapiens
ttcaaagagaaattgtattttc

SEQ ID NO: 8083027 - DNA, 22 bp, Homo sapiens
ttcaaagagaaattgtattttc

SEQ ID NO: 8083028 - DNA, 22 bp, Homo sapiens
ttcaaagataatgtagcatttt

SEQ ID NO: 8083029 - DNA, 22 bp, Homo sapiens
ttcaaagataatgtagcatttt

SEQ ID NO: 8083030 - DNA, 22 bp, Homo sapiens
ttcaaagagttgggtgtctggg

SEQ ID NO: 8083031 - DNA, 22 bp, Homo sapiens
ttcacagatgagaaaattgagg

SEQ ID NO: 8083032 - DNA, 20 bp, Homo sapiens
ttcttttgataagcttgaca

SEQ ID NO: 8083033 - DNA, 22 bp, Homo sapiens
ttctttttaaagtgtgtatgca

SEQ ID NO: 8083034 - DNA, 22 bp, Homo sapiens
ttgaagaaattattttatatag

SEQ ID NO: 8083035 - DNA, 22 bp, Homo sapiens
ttgaagaaagtcatatataatg

SEQ ID NO: 8083036 - DNA, 22 bp, Homo sapiens
ttcttttaatgtctggctttca

SEQ ID NO: 8083037 - DNA, 22 bp, Homo sapiens
ttcttttaattgtgggggagtg

SEQ ID NO: 8083038 - DNA, 22 bp, Homo sapiens
ttctgtgactcctcagagattt

SEQ ID NO: 8083039 - DNA, 22 bp, Homo sapiens
ttctgtgaaactaaagagagga

SEQ ID NO: 8083040 - DNA, 19 bp, Homo sapiens
ttctgtaaggacattaatc

SEQ ID NO: 8083041 - DNA, 19 bp, Homo sapiens
ttctgtaagggagagaggg

SEQ ID NO: 8083042 - DNA, 22 bp, Homo sapiens
ttctgtaagggatttattctga

SEQ ID NO: 8083043 - DNA, 22 bp, Homo sapiens
ttctgtaattctgttagtttca

SEQ ID NO: 8083044 - DNA, 22 bp, Homo sapiens
ttctgtcttctcggttgtttac

SEQ ID NO: 8083045 - DNA, 22 bp, Homo sapiens
ttcttacattactttacatgtg

SEQ ID NO: 8083046 - DNA, 22 bp, Homo sapiens
ttcttatagaagcaaccattgt

SEQ ID NO: 8083047 - DNA, 22 bp, Homo sapiens
ttctgtaagctaccaagtttgt

SEQ ID NO: 8083048 - DNA, 22 bp, Homo sapiens
ttctggaatcctcaaaacatga

SEQ ID NO: 8083049 - DNA, 22 bp, Homo sapiens
ttctggaatgcctgttctaatt

SEQ ID NO: 8083050 - DNA, 22 bp, Homo sapiens
ttctggaagttggaaatagcag

SEQ ID NO: 8083051 - DNA, 22 bp, Homo sapiens
ttccagtttgcagttgacacta

SEQ ID NO: 8083052 - DNA, 22 bp, Homo sapiens
ttccttggagttaagaccctgg

SEQ ID NO: 8083053 - DNA, 22 bp, Homo sapiens
ttccttggatacaagtaacttt

SEQ ID NO: 8083054 - DNA, 22 bp, Homo sapiens
ttccttggccccatgcccaggg

SEQ ID NO: 8083055 - DNA, 22 bp, Homo sapiens
ttccttggccacactggtgctt

SEQ ID NO: 8083056 - DNA, 20 bp, Homo sapiens
ttccttggattgtgtcttga

SEQ ID NO: 8083057 - DNA, 22 bp, Homo sapiens
ttccttggaaagagacgtcgct

SEQ ID NO: 8083058 - DNA, 22 bp, Homo sapiens
ttccttggagcgctaaagctct

SEQ ID NO: 8083059 - DNA, 22 bp, Homo sapiens
ttccttggagtcaaacagggag

SEQ ID NO: 8083060 - DNA, 22 bp, Homo sapiens
ttccttggaagggtaattgcaa

SEQ ID NO: 8083061 - DNA, 22 bp, Homo sapiens
ttccttggaaattctgacttca

SEQ ID NO: 8083062 - DNA, 22 bp, Homo sapiens
ttctctaagccttagtttcttc

SEQ ID NO: 8083063 - DNA, 22 bp, Homo sapiens
ttctctgagtacgtttcagtgt

SEQ ID NO: 8083064 - DNA, 22 bp, Homo sapiens
ttctccagaccctcctgcagac

SEQ ID NO: 8083065 - DNA, 22 bp, Homo sapiens
ttctccagaccactgcctctgt

SEQ ID NO: 8083066 - DNA, 22 bp, Homo sapiens
ttctccagagggctctgcagga

SEQ ID NO: 8083067 - DNA, 22 bp, Homo sapiens
ttctccagaggtggctagagtt

SEQ ID NO: 8083068 - DNA, 22 bp, Homo sapiens
ttccttggtgtaactgctccta

SEQ ID NO: 8083069 - DNA, 22 bp, Homo sapiens
ttccttggtacagagtagcttt

SEQ ID NO: 8083070 - DNA, 22 bp, Homo sapiens
ttccttggtgcgcctgctgcag

SEQ ID NO: 8083071 - DNA, 22 bp, Homo sapiens
ttccttggtgcccgatgtattt

SEQ ID NO: 8083072 - DNA, 22 bp, Homo sapiens
ttccttggtagggacaactctg

SEQ ID NO: 8083073 - DNA, 22 bp, Homo sapiens
ttccttggtagagagaatattt

SEQ ID NO: 8083074 - DNA, 22 bp, Homo sapiens
ttccttgggtgcctacttagag

SEQ ID NO: 8083075 - DNA, 22 bp, Homo sapiens
ttccttgggaaatgctcgttta

SEQ ID NO: 8083076 - DNA, 22 bp, Homo sapiens
ttccttgggagaaaaaatatat

SEQ ID NO: 8083077 - DNA, 18 bp, Homo sapiens
ttccttggtaacatatgc

SEQ ID NO: 8083078 - DNA, 17 bp, Homo sapiens
ttccttgggtgctgggt

SEQ ID NO: 8083079 - DNA, 22 bp, Homo sapiens
ttccttgggttctgatgtgttt

SEQ ID NO: 8083080 - DNA, 22 bp, Homo sapiens
ttgggcagtctggctgcagagt

SEQ ID NO: 8083081 - DNA, 22 bp, Homo sapiens
ttgggcagggaaaggacaggca

SEQ ID NO: 8083082 - DNA, 22 bp, Homo sapiens
ttgggcaggtgtggctctcctt

SEQ ID NO: 8083083 - DNA, 22 bp, Homo sapiens
ttgggcagtagcctcttggtgt

SEQ ID NO: 8083084 - DNA, 22 bp, Homo sapiens
ttgggcaggtgaagagagggct

SEQ ID NO: 8083085 - DNA, 22 bp, Homo sapiens
ttgtggctcgtgagatgttagg

SEQ ID NO: 8083086 - DNA, 22 bp, Homo sapiens
ttgtgtattttttgatactaac

SEQ ID NO: 8083087 - DNA, 23 bp, Homo sapiens
ttgtccagctggtttgggccaca

SEQ ID NO: 8083088 - DNA, 22 bp, Homo sapiens
ttgtccagtttctagaggcctc

SEQ ID NO: 8083089 - DNA, 22 bp, Homo sapiens
ttgtccagcagctcagtctacg

SEQ ID NO: 8083090 - DNA, 22 bp, Homo sapiens
ttgtccagaaaaaagccaaggg

SEQ ID NO: 8083091 - DNA, 22 bp, Homo sapiens
ttgtccagagccaggctgtcgg

SEQ ID NO: 8083092 - DNA, 19 bp, Homo sapiens
ttgtccagaaaggcattgc

SEQ ID NO: 8083093 - DNA, 22 bp, Homo sapiens
ttgtcatggatggaagggatat

SEQ ID NO: 8083094 - DNA, 22 bp, Homo sapiens
ttgtcatgatccttctgttagg

SEQ ID NO: 8083095 - DNA, 22 bp, Homo sapiens
ttgtcatgagtcacaaaaataa

SEQ ID NO: 8083096 - DNA, 22 bp, Homo sapiens
ttgtacaagtattatgtgaaca

SEQ ID NO: 8083097 - DNA, 22 bp, Homo sapiens
ttgtaatggagcaaacaggttg

SEQ ID NO: 8083098 - DNA, 22 bp, Homo sapiens
ttgggcagtgattagttcatga

SEQ ID NO: 8083099 - DNA, 22 bp, Homo sapiens
ttgtaacagtagctgtcagctc

SEQ ID NO: 8083100 - DNA, 22 bp, Homo sapiens
ttgtaacttaagttttgcatat

SEQ ID NO: 8083101 - DNA, 22 bp, Homo sapiens
ttgtaacatcaccatcaaaatc

SEQ ID NO: 8083102 - DNA, 22 bp, Homo sapiens
ttgtaacacttttctattaata

SEQ ID NO: 8083103 - DNA, 22 bp, Homo sapiens
ttgtaacagctgtttatatagt

SEQ ID NO: 8083104 - DNA, 22 bp, Homo sapiens
ttgtaacaatctgtcataaatg

SEQ ID NO: 8083105 - DNA, 22 bp, Homo sapiens
ttgtaacaaagacactccaaaa

SEQ ID NO: 8083106 - DNA, 22 bp, Homo sapiens
ttgtaacaaagacactccaaaa

SEQ ID NO: 8083107 - DNA, 22 bp, Homo sapiens
ttggacactgagactagcaagc

SEQ ID NO: 8083108 - DNA, 21 bp, Homo sapiens
ttggacactccctgtgctgtg

SEQ ID NO: 8083109 - DNA, 22 bp, Homo sapiens
ttggaacacaatgtttctttca

SEQ ID NO: 8083110 - DNA, 22 bp, Homo sapiens
ttggaacaatcacatccttgct

SEQ ID NO: 8083111 - DNA, 23 bp, Homo sapiens
ttggaaatggggagaacagattc

SEQ ID NO: 8083112 - DNA, 22 bp, Homo sapiens
ttggaaatacagcagttacttt

SEQ ID NO: 8083113 - DNA, 22 bp, Homo sapiens
ttgcttcagagacagggctcac

SEQ ID NO: 8083114 - DNA, 22 bp, Homo sapiens
ttggaaaatgaggcacagagag

SEQ ID NO: 8083115 - DNA, 22 bp, Homo sapiens
ttgcatgtgtataaaagttgga

SEQ ID NO: 8083116 - DNA, 21 bp, Homo sapiens
ttgctgttttcccaatgcagt

SEQ ID NO: 8083117 - DNA, 22 bp, Homo sapiens
ttgcttaattctgaaaatatag

SEQ ID NO: 8083118 - DNA, 22 bp, Homo sapiens
ttgacaaatacccattagacca

SEQ ID NO: 8083119 - DNA, 22 bp, Homo sapiens
ttgacaaaacaacacagatttc

SEQ ID NO: 8083120 - DNA, 22 bp, Homo sapiens
ttgcagaattaagcagagagcc

SEQ ID NO: 8083121 - DNA, 22 bp, Homo sapiens
ttgcagaatctcaggaaggaga

SEQ ID NO: 8083122 - DNA, 23 bp, Homo sapiens
ttgcagaagcagacgaccataat

SEQ ID NO: 8083123 - DNA, 22 bp, Homo sapiens
ttgcaattgctatggagagcgt

SEQ ID NO: 8083124 - DNA, 22 bp, Homo sapiens
ttgacagaatgttacatataga

SEQ ID NO: 8083125 - DNA, 22 bp, Homo sapiens
ttgcagttgctgtatttaagga

SEQ ID NO: 8083126 - DNA, 22 bp, Homo sapiens
ttgcagggttgaccaataggct

SEQ ID NO: 8083127 - DNA, 22 bp, Homo sapiens
ttgcagggttgacactgcctgc

SEQ ID NO: 8083128 - DNA, 18 bp, Homo sapiens
ttgcaggtacctctatct

SEQ ID NO: 8083129 - DNA, 22 bp, Homo sapiens
ttgcaggggagaggaacaaaca

SEQ ID NO: 8083130 - DNA, 22 bp, Homo sapiens
ttgcagggtcctgtggctctcc

SEQ ID NO: 8083131 - DNA, 22 bp, Homo sapiens
ttgcagggttaaagtaaggtag

SEQ ID NO: 8083132 - DNA, 22 bp, Homo sapiens
ttgcagggtcccagaggcctgg

SEQ ID NO: 8083133 - DNA, 22 bp, Homo sapiens
ttgcagggtacattcttagaat

SEQ ID NO: 8083134 - DNA, 22 bp, Homo sapiens
ttgcaggggaaggagcagagct

SEQ ID NO: 8083135 - DNA, 22 bp, Homo sapiens
ttgcagggcttggggattacag

SEQ ID NO: 8083136 - DNA, 22 bp, Homo sapiens
ttgcagggctggaacatggaat

SEQ ID NO: 8083137 - DNA, 22 bp, Homo sapiens
ttgcagggcatctatgtctggt

SEQ ID NO: 8083138 - DNA, 22 bp, Homo sapiens
ttgcagggccttggcttcttcc

SEQ ID NO: 8083139 - DNA, 22 bp, Homo sapiens
ttgcagggaaatagaaataaac

SEQ ID NO: 8083140 - DNA, 22 bp, Homo sapiens
ttgcagggcatcgcgtacttct

SEQ ID NO: 8083141 - DNA, 22 bp, Homo sapiens
ttgcagggcaggaccatggaca

SEQ ID NO: 8083142 - DNA, 22 bp, Homo sapiens
ttgcagggaaacagtttaggaa

SEQ ID NO: 8083143 - DNA, 22 bp, Homo sapiens
ttgcagggacctgcagaaagct

SEQ ID NO: 8083144 - DNA, 22 bp, Homo sapiens
ttgcagggaaatcagtgaggat

SEQ ID NO: 8083145 - DNA, 22 bp, Homo sapiens
ttgcagggataaaacaagtgaa

SEQ ID NO: 8083146 - DNA, 23 bp, Homo sapiens
ttgcagggatggagttcaaaatg

SEQ ID NO: 8083147 - DNA, 22 bp, Homo sapiens
ttgcagggcaaatggtcagata

SEQ ID NO: 8083148 - DNA, 22 bp, Homo sapiens
ttgcagggattaccttattttt

SEQ ID NO: 8083149 - DNA, 22 bp, Homo sapiens
tttagcaatatcataaggaaga

SEQ ID NO: 8083150 - DNA, 22 bp, Homo sapiens
tttagcaataaagggatattaa

SEQ ID NO: 8083151 - DNA, 22 bp, Homo sapiens
tttagcaagttctctgagagaa

SEQ ID NO: 8083152 - DNA, 22 bp, Homo sapiens
tttagcaatttctaaaagtgtt

SEQ ID NO: 8083153 - DNA, 22 bp, Homo sapiens
tttagcaattagaatccagcat

SEQ ID NO: 8083154 - DNA, 22 bp, Homo sapiens
tttagcaattattaagggttga

SEQ ID NO: 8083155 - DNA, 22 bp, Homo sapiens
tttatccatcatctgctgaagg

SEQ ID NO: 8083156 - DNA, 22 bp, Homo sapiens
tttatccattggttagaaaatc

SEQ ID NO: 8083157 - DNA, 22 bp, Homo sapiens
tttattcaagatgaggttcatg

SEQ ID NO: 8083158 - DNA, 22 bp, Homo sapiens
tttatcatcttgtttttaaagc

SEQ ID NO: 8083159 - DNA, 22 bp, Homo sapiens
tttacagtctgtctagcaatgt

SEQ ID NO: 8083160 - DNA, 22 bp, Homo sapiens
tttaccaaatagattatgtcag

SEQ ID NO: 8083161 - DNA, 22 bp, Homo sapiens
tttaccaagagttgtcactgtt

SEQ ID NO: 8083162 - DNA, 22 bp, Homo sapiens
tttagcaaaaaagctctgcgta

SEQ ID NO: 8083163 - DNA, 22 bp, Homo sapiens
tttagagtccaagttcttcact

SEQ ID NO: 8083164 - DNA, 22 bp, Homo sapiens
tttagagtccttgctcttattc

SEQ ID NO: 8083165 - DNA, 22 bp, Homo sapiens
tttagcaaggtaggtccatgga

SEQ ID NO: 8083166 - DNA, 22 bp, Homo sapiens
tttagcaagtatttactgacta

SEQ ID NO: 8083167 - DNA, 22 bp, Homo sapiens
tttagcaaggagaaataatcct

SEQ ID NO: 8083168 - DNA, 22 bp, Homo sapiens
tttagcaagattgagccgtctt

SEQ ID NO: 8083169 - DNA, 22 bp, Homo sapiens
tttagcaagatgccctggcttt

SEQ ID NO: 8083170 - DNA, 21 bp, Homo sapiens
tttagcaagagtatagtgcat

SEQ ID NO: 8083171 - DNA, 22 bp, Homo sapiens
tttagcaacgaagcactcgaca

SEQ ID NO: 8083172 - DNA, 22 bp, Homo sapiens
tttagcaaaggtagggttcaga

SEQ ID NO: 8083173 - DNA, 22 bp, Homo sapiens
tttagcaaactttggagtttgt

SEQ ID NO: 8083174 - DNA, 20 bp, Homo sapiens
tttagcaaaagggactgctc

SEQ ID NO: 8083175 - DNA, 22 bp, Homo sapiens
tttagcaaaacattatgtctgt

SEQ ID NO: 8083176 - DNA, 22 bp, Homo sapiens
tttagcaaaggtgtcttgggca

SEQ ID NO: 8083177 - DNA, 22 bp, Homo sapiens
tttagcaaatatttctgttgat

SEQ ID NO: 8083178 - DNA, 22 bp, Homo sapiens
tttagcaaattagcacctctaa

SEQ ID NO: 8083179 - DNA, 22 bp, Homo sapiens
tttagcaaattactcacagggt

SEQ ID NO: 8083180 - DNA, 22 bp, Homo sapiens
tttagagtcattttatattgac

SEQ ID NO: 8083181 - DNA, 22 bp, Homo sapiens
tttaatgcccaaggctttgatg

SEQ ID NO: 8083182 - DNA, 22 bp, Homo sapiens
tttaatgtgacatcttttagag

SEQ ID NO: 8083183 - DNA, 22 bp, Homo sapiens
tttacagtctctatagtcaaaa

SEQ ID NO: 8083184 - DNA, 22 bp, Homo sapiens
tttacagtctatgttgaattaa

SEQ ID NO: 8083185 - DNA, 22 bp, Homo sapiens
tttaagcagagaaatgatgtat

SEQ ID NO: 8083186 - DNA, 22 bp, Homo sapiens
tttaagcacagggataaagtta

SEQ ID NO: 8083187 - DNA, 22 bp, Homo sapiens
tttaagcacagggataaagtta

SEQ ID NO: 8083188 - DNA, 22 bp, Homo sapiens
tttaagctaatgtcataattag

SEQ ID NO: 8083189 - DNA, 22 bp, Homo sapiens
tttaagctgtggcattaattct

SEQ ID NO: 8083190 - DNA, 22 bp, Homo sapiens
tttaagattcagtaaggcaaac

SEQ ID NO: 8083191 - DNA, 19 bp, Homo sapiens
tttaagcaatagtatcttg

SEQ ID NO: 8083192 - DNA, 22 bp, Homo sapiens
tttaagcaagttgacatagcat

SEQ ID NO: 8083193 - DNA, 22 bp, Homo sapiens
tttaagcaagttgacatagcat

SEQ ID NO: 8083194 - DNA, 22 bp, Homo sapiens
tttaagcacagggataaagtta

SEQ ID NO: 8083195 - DNA, 22 bp, Homo sapiens
tttaaggcagtgaaactattct

SEQ ID NO: 8083196 - DNA, 22 bp, Homo sapiens
tttaaggcaatatagaattcat

SEQ ID NO: 8083197 - DNA, 22 bp, Homo sapiens
tttaatgaataattcaaatctg

SEQ ID NO: 8083198 - DNA, 22 bp, Homo sapiens
tttaaagaaattcctcatcttt

SEQ ID NO: 8083199 - DNA, 22 bp, Homo sapiens
tttaaagaaattcctcatcttt

SEQ ID NO: 8083200 - DNA, 17 bp, Homo sapiens
tttaaactactacaagg

SEQ ID NO: 8083201 - DNA, 17 bp, Homo sapiens
tttaaactactacaagg

SEQ ID NO: 8083202 - DNA, 22 bp, Homo sapiens
tttaaactgttgattttatgaa

SEQ ID NO: 8083203 - DNA, 22 bp, Homo sapiens
tttaaactaacagtacacgttg

SEQ ID NO: 8083204 - DNA, 22 bp, Homo sapiens
tttaaactaacagtacacgttg

SEQ ID NO: 8083205 - DNA, 22 bp, Homo sapiens
tttaaagtgctgctcctatcct

SEQ ID NO: 8083206 - DNA, 22 bp, Homo sapiens
tttaaataggactcctgggggt

SEQ ID NO: 8083207 - DNA, 22 bp, Homo sapiens
tttaaatgcagacgttgattca

SEQ ID NO: 8083208 - DNA, 22 bp, Homo sapiens
tttaaatgtttatagagagtac

SEQ ID NO: 8083209 - DNA, 22 bp, Homo sapiens
tttaaatggcattttcccagat

SEQ ID NO: 8083210 - DNA, 22 bp, Homo sapiens
tttattctataggcattaagca

SEQ ID NO: 8083211 - DNA, 20 bp, Homo sapiens
tttattcacagagaagagtt

SEQ ID NO: 8083212 - DNA, 22 bp, Homo sapiens
tttattgaacacttgcactggc

SEQ ID NO: 8083213 - DNA, 20 bp, Homo sapiens
tttcaacaatttcccttcca

SEQ ID NO: 8083214 - DNA, 22 bp, Homo sapiens
tttcaaagtaaggattttcatc

SEQ ID NO: 8083215 - DNA, 22 bp, Homo sapiens
tttcaaagtaaggattttcatc

SEQ ID NO: 8083216 - DNA, 22 bp, Homo sapiens
tttattgcatacacaaatgtca

SEQ ID NO: 8083217 - DNA, 22 bp, Homo sapiens
tttcacaatgcaatcctacttc

SEQ ID NO: 8083218 - DNA, 23 bp, Homo sapiens
tttcacaatgagcattacagaat

SEQ ID NO: 8083219 - DNA, 22 bp, Homo sapiens
tttcacagagaaatataacagg

SEQ ID NO: 8083220 - DNA, 22 bp, Homo sapiens
tttcaagaagcaaattaaagtc

SEQ ID NO: 8083221 - DNA, 23 bp, Homo sapiens
tttcaactcctgccattatttct

SEQ ID NO: 8083222 - DNA, 22 bp, Homo sapiens
tttcatgatccatttacaaaat

SEQ ID NO: 8083223 - DNA, 22 bp, Homo sapiens
tttcatgaggtctttcagcaag

SEQ ID NO: 8083224 - DNA, 22 bp, Homo sapiens
tttcatgtacttttttgataga

SEQ ID NO: 8083225 - DNA, 22 bp, Homo sapiens
tttcatgtctgaattctttagt

SEQ ID NO: 8083226 - DNA, 22 bp, Homo sapiens
tttcagaaagctgaacatatga

SEQ ID NO: 8083227 - DNA, 22 bp, Homo sapiens
tttcagaaaacttatcatcagt

SEQ ID NO: 8083228 - DNA, 22 bp, Homo sapiens
tttcagactgctgtgtgaaact

SEQ ID NO: 8083229 - DNA, 21 bp, Homo sapiens
tttcagacctatctttgaagg

SEQ ID NO: 8083230 - DNA, 22 bp, Homo sapiens
tttcactggaattttaacattt

SEQ ID NO: 8083231 - DNA, 22 bp, Homo sapiens
tttcacctcagtctttttatat

SEQ ID NO: 8083232 - DNA, 22 bp, Homo sapiens
tttcacctcagtctttttatat

SEQ ID NO: 8083233 - DNA, 18 bp, Homo sapiens
tttcacagattcatgact

SEQ ID NO: 8083234 - DNA, 22 bp, Homo sapiens
tttcacagcaacactgtctgca

SEQ ID NO: 8083235 - DNA, 22 bp, Homo sapiens
tttcacagcatataggtgtact

SEQ ID NO: 8083236 - DNA, 22 bp, Homo sapiens
tttcacagcgtctttctcttgc

SEQ ID NO: 8083237 - DNA, 21 bp, Homo sapiens
acaaaagaagctgccttttaa

SEQ ID NO: 8083238 - DNA, 21 bp, Homo sapiens
acaaaagaagctgccttttaa

SEQ ID NO: 8083239 - DNA, 22 bp, Homo sapiens
acaaaagaataagatgagtcat

SEQ ID NO: 8083240 - DNA, 22 bp, Homo sapiens
aagaatatctgttttatttagg

SEQ ID NO: 8083241 - DNA, 23 bp, Homo sapiens
aagaatcagtaagtaaggagacc

SEQ ID NO: 8083242 - DNA, 22 bp, Homo sapiens
aagaatcatcctgcaagagtct

SEQ ID NO: 8083243 - DNA, 22 bp, Homo sapiens
acaaatgaacatataagcttga

SEQ ID NO: 8083244 - DNA, 22 bp, Homo sapiens
acaaatgaacatataagcttga

SEQ ID NO: 8083245 - DNA, 22 bp, Homo sapiens
acaaatgaatcatacataatgt

SEQ ID NO: 8083246 - DNA, 22 bp, Homo sapiens
acaaatgaacctgaaatctcag

SEQ ID NO: 8083247 - DNA, 22 bp, Homo sapiens
acaaatatttactgaatccact

SEQ ID NO: 8083248 - DNA, 22 bp, Homo sapiens
aagaacattgactaagaggggc

SEQ ID NO: 8083249 - DNA, 22 bp, Homo sapiens
aagaacagtgtcctgggactcg

SEQ ID NO: 8083250 - DNA, 21 bp, Homo sapiens
aagaactattgaggtacacag

SEQ ID NO: 8083251 - DNA, 22 bp, Homo sapiens
aagaagcactttcctacatgtt

SEQ ID NO: 8083252 - DNA, 21 bp, Homo sapiens
aagaagcaatttattggaagg

SEQ ID NO: 8083253 - DNA, 22 bp, Homo sapiens
acaaaaattagctgggcatggt

SEQ ID NO: 8083254 - DNA, 22 bp, Homo sapiens
aagataatattcattaactaga

SEQ ID NO: 8083255 - DNA, 22 bp, Homo sapiens
aagataatattcattaactaga

SEQ ID NO: 8083256 - DNA, 22 bp, Homo sapiens
acacagctttcagtcattatct

SEQ ID NO: 8083257 - DNA, 22 bp, Homo sapiens
acacagagcaaatcatgacaga

SEQ ID NO: 8083258 - DNA, 20 bp, Homo sapiens
acacagactcagcttggatg

SEQ ID NO: 8083259 - DNA, 17 bp, Homo sapiens
acacagacaggcagaca

SEQ ID NO: 8083260 - DNA, 17 bp, Homo sapiens
acacagagattaacaca

SEQ ID NO: 8083261 - DNA, 22 bp, Homo sapiens
acaatgttctacatatacataa

SEQ ID NO: 8083262 - DNA, 22 bp, Homo sapiens
acaatatagtccatgagcatgc

SEQ ID NO: 8083263 - DNA, 22 bp, Homo sapiens
acaatattgtacccagaagttt

SEQ ID NO: 8083264 - DNA, 22 bp, Homo sapiens
acaacaaaatcactagtcttcc

SEQ ID NO: 8083265 - DNA, 22 bp, Homo sapiens
aagcagtgataagagctaccat

SEQ ID NO: 8083266 - DNA, 22 bp, Homo sapiens
aagcagtgatgcatacagctgt

SEQ ID NO: 8083267 - DNA, 22 bp, Homo sapiens
aagcaggctagattgaagggct

SEQ ID NO: 8083268 - DNA, 23 bp, Homo sapiens
acagaaagttctgctggacagag

SEQ ID NO: 8083269 - DNA, 18 bp, Homo sapiens
acagaaatagctgtgcct

SEQ ID NO: 8083270 - DNA, 22 bp, Homo sapiens
acagaaatatagaaggtaggaa

SEQ ID NO: 8083271 - DNA, 23 bp, Homo sapiens
acagaaatcatttgtaaggtacc

SEQ ID NO: 8083272 - DNA, 23 bp, Homo sapiens
acagaaatcatttgtaaggtacc

SEQ ID NO: 8083273 - DNA, 22 bp, Homo sapiens
acagaaatgatgtttggcaata

SEQ ID NO: 8083274 - DNA, 22 bp, Homo sapiens
acagaaatgatgtttggcaata

SEQ ID NO: 8083275 - DNA, 22 bp, Homo sapiens
acagagatgtcagattggcagc

SEQ ID NO: 8083276 - DNA, 22 bp, Homo sapiens
aagatacacgttgtattgaata

SEQ ID NO: 8083277 - DNA, 22 bp, Homo sapiens
acagaaagatgatttgaaatgg

SEQ ID NO: 8083278 - DNA, 20 bp, Homo sapiens
acagaaagctgccttgtccc

SEQ ID NO: 8083279 - DNA, 23 bp, Homo sapiens
acagaaagttctgctggacagag

SEQ ID NO: 8083280 - DNA, 22 bp, Homo sapiens
aacttgtaaaatagagtgtaca

SEQ ID NO: 8083281 - DNA, 22 bp, Homo sapiens
aatgtaaagttgggcacaaatg

SEQ ID NO: 8083282 - DNA, 22 bp, Homo sapiens
aatgtaaacagcaagagaaggg

SEQ ID NO: 8083283 - DNA, 22 bp, Homo sapiens
aacttgtatatgttattcagag

SEQ ID NO: 8083284 - DNA, 22 bp, Homo sapiens
aacttgtaatgaaaggcaatag

SEQ ID NO: 8083285 - DNA, 21 bp, Homo sapiens
aacttgtatttctccttattc

SEQ ID NO: 8083286 - DNA, 22 bp, Homo sapiens
aacttgtattgaaaatgggtaa

SEQ ID NO: 8083287 - DNA, 22 bp, Homo sapiens
aactttaaggctataaattatg

SEQ ID NO: 8083288 - DNA, 22 bp, Homo sapiens
aatgcactgtcagtattgttga

SEQ ID NO: 8083289 - DNA, 22 bp, Homo sapiens
aatgaaactgtatatagactgt

SEQ ID NO: 8083290 - DNA, 22 bp, Homo sapiens
aatctcttgtatttcctttgac

SEQ ID NO: 8083291 - DNA, 22 bp, Homo sapiens
aatacagaggggtcacaattca

SEQ ID NO: 8083292 - DNA, 22 bp, Homo sapiens
aatacagatggcatgtgaagat

SEQ ID NO: 8083293 - DNA, 22 bp, Homo sapiens
aatacagatattcagtggtact

SEQ ID NO: 8083294 - DNA, 22 bp, Homo sapiens
aataatatttgaagcttcaaag

SEQ ID NO: 8083295 - DNA, 21 bp, Homo sapiens
aacagttctctttgaaggtgt

SEQ ID NO: 8083296 - DNA, 22 bp, Homo sapiens
aacagtttatcaagtttttaca

SEQ ID NO: 8083297 - DNA, 22 bp, Homo sapiens
aacagtttatgagatatgctat

SEQ ID NO: 8083298 - DNA, 22 bp, Homo sapiens
aagttacagttattatttaaaa

SEQ ID NO: 8083299 - DNA, 22 bp, Homo sapiens
aatatccacttcaatacaggca

SEQ ID NO: 8083300 - DNA, 21 bp, Homo sapiens
aatatccaaatgattagatct

SEQ ID NO: 8083301 - DNA, 22 bp, Homo sapiens
aatatccattgggagcaaatgg

SEQ ID NO: 8083302 - DNA, 22 bp, Homo sapiens
aatatctgtggccatacaattt

SEQ ID NO: 8083303 - DNA, 22 bp, Homo sapiens
aagtcttttgctaagagtaatg

SEQ ID NO: 8083304 - DNA, 22 bp, Homo sapiens
aagtctttcataagtctcttat

SEQ ID NO: 8083305 - DNA, 22 bp, Homo sapiens
aagtctttttgaatctataact

SEQ ID NO: 8083306 - DNA, 22 bp, Homo sapiens
aagtgccagtttctggcttcct

SEQ ID NO: 8083307 - DNA, 22 bp, Homo sapiens
aagtgccatcatagcatggctg

SEQ ID NO: 8083308 - DNA, 21 bp, Homo sapiens
aagtgccacccacagatgcat

SEQ ID NO: 8083309 - DNA, 22 bp, Homo sapiens
aagtgccagggacacttcttgt

SEQ ID NO: 8083310 - DNA, 22 bp, Homo sapiens
aacagtgtgttttgttattaag

SEQ ID NO: 8083311 - DNA, 22 bp, Homo sapiens
aacagtgtgttttgttattaag

SEQ ID NO: 8083312 - DNA, 22 bp, Homo sapiens
aacagtgtcaggattacagata

SEQ ID NO: 8083313 - DNA, 22 bp, Homo sapiens
aacagtgttttgctctttgccc

SEQ ID NO: 8083314 - DNA, 22 bp, Homo sapiens
aacagtgtttttcttcagcact

SEQ ID NO: 8083315 - DNA, 22 bp, Homo sapiens
aagtctgatcatttcttctata

SEQ ID NO: 8083316 - DNA, 22 bp, Homo sapiens
aagtacaacgcatacagagaaa

SEQ ID NO: 8083317 - DNA, 22 bp, Homo sapiens
aagtaacatgggaacatctgaa

SEQ ID NO: 8083318 - DNA, 22 bp, Homo sapiens
aagtaacatctgaacatgatgt

SEQ ID NO: 8083319 - DNA, 23 bp, Homo sapiens
aagtaacagggataatagcagtt

SEQ ID NO: 8083320 - DNA, 22 bp, Homo sapiens
aagggcagggagtttgtgtcta

SEQ ID NO: 8083321 - DNA, 22 bp, Homo sapiens
aagggcaggaaaagatggatgt

SEQ ID NO: 8083322 - DNA, 22 bp, Homo sapiens
aagggcaggagaagacggatat

SEQ ID NO: 8083323 - DNA, 22 bp, Homo sapiens
aagggcaggcagagatcatata

SEQ ID NO: 8083324 - DNA, 22 bp, Homo sapiens
aaggagaagggtaatcaacaca

SEQ ID NO: 8083325 - DNA, 22 bp, Homo sapiens
aaaatgtaaagcttgagtgtag

SEQ ID NO: 8083326 - DNA, 22 bp, Homo sapiens
aaagcaggcagcaggctggatt

SEQ ID NO: 8083327 - DNA, 22 bp, Homo sapiens
aaaagctagtcaatgatgtatt

SEQ ID NO: 8083328 - DNA, 22 bp, Homo sapiens
aaaagttcattagtgagcttct

SEQ ID NO: 8083329 - DNA, 22 bp, Homo sapiens
aaaagttccctggttagaaaag

SEQ ID NO: 8083330 - DNA, 22 bp, Homo sapiens
aaaagttccctggttagaaaag

SEQ ID NO: 8083331 - DNA, 22 bp, Homo sapiens
aaaagtttaagactcattctag

SEQ ID NO: 8083332 - DNA, 22 bp, Homo sapiens
aaaagtttaagactcattctag

SEQ ID NO: 8083333 - DNA, 22 bp, Homo sapiens
aaaatactactgtcttcttccc

SEQ ID NO: 8083334 - DNA, 22 bp, Homo sapiens
aaaagtttgtgcaaacactcag

SEQ ID NO: 8083335 - DNA, 22 bp, Homo sapiens
aaaaccaagttttccttagtct

SEQ ID NO: 8083336 - DNA, 22 bp, Homo sapiens
aaaaatctatgactgcttctcc

SEQ ID NO: 8083337 - DNA, 22 bp, Homo sapiens
aaaagattgttagggagaatgt

SEQ ID NO: 8083338 - DNA, 22 bp, Homo sapiens
aaaagcaggtactcagcttggg

SEQ ID NO: 8083339 - DNA, 22 bp, Homo sapiens
aaaagcagtttatagtcagttg

SEQ ID NO: 8083340 - DNA, 22 bp, Homo sapiens
aaaagcagatctccaaagtcta

SEQ ID NO: 8083341 - DNA, 22 bp, Homo sapiens
aaaagcactacaatttcgcttc

SEQ ID NO: 8083342 - DNA, 22 bp, Homo sapiens
aaaacagacagccagtgtagag

SEQ ID NO: 8083343 - DNA, 22 bp, Homo sapiens
aaacttcaaggatttgcaaatc

SEQ ID NO: 8083344 - DNA, 22 bp, Homo sapiens
aaagacatatttctaagtttat

SEQ ID NO: 8083345 - DNA, 21 bp, Homo sapiens
aaatacagatgcaaatctgtt

SEQ ID NO: 8083346 - DNA, 22 bp, Homo sapiens
aaatacagatagatttaaccca

SEQ ID NO: 8083347 - DNA, 22 bp, Homo sapiens
aaatacagagttatggacctca

SEQ ID NO: 8083348 - DNA, 21 bp, Homo sapiens
aaatacagaaacttgttttca

SEQ ID NO: 8083349 - DNA, 22 bp, Homo sapiens
aaatacagagttgcttaaaagc

SEQ ID NO: 8083350 - DNA, 22 bp, Homo sapiens
aaatacaatttcaggctgtaat

SEQ ID NO: 8083351 - DNA, 22 bp, Homo sapiens
aaatacaatttcaggctgtaat

SEQ ID NO: 8083352 - DNA, 22 bp, Homo sapiens
aaataaactgaagcacagagag

SEQ ID NO: 8083353 - DNA, 22 bp, Homo sapiens
aaataaaggtccactttagggc

SEQ ID NO: 8083354 - DNA, 23 bp, Homo sapiens
aaactgttgcttcaatgtatcct

SEQ ID NO: 8083355 - DNA, 22 bp, Homo sapiens
aaactgtttccctccataacct

SEQ ID NO: 8083356 - DNA, 22 bp, Homo sapiens
aaactgttgtggtttatcatta

SEQ ID NO: 8083357 - DNA, 22 bp, Homo sapiens
aaatgacactaggctttttgca

SEQ ID NO: 8083358 - DNA, 22 bp, Homo sapiens
aaagtacagccacatccaagta

SEQ ID NO: 8083359 - DNA, 22 bp, Homo sapiens
aaagtacatgcaattcttctga

SEQ ID NO: 8083360 - DNA, 22 bp, Homo sapiens
aaagtacatgtttggccatttg

SEQ ID NO: 8083361 - DNA, 22 bp, Homo sapiens
aaagtcacttccttctgtcagc

SEQ ID NO: 8083362 - DNA, 22 bp, Homo sapiens
aaagtcatctgtcctaggctct

SEQ ID NO: 8083363 - DNA, 22 bp, Homo sapiens
aaagtcatgtaatgatatgatt

SEQ ID NO: 8083364 - DNA, 22 bp, Homo sapiens
aaagttccttttatagacatga

SEQ ID NO: 8083365 - DNA, 22 bp, Homo sapiens
aaagttctaaaactctttgtga

SEQ ID NO: 8083366 - DNA, 22 bp, Homo sapiens
aaagtcattggaatattaatga

SEQ ID NO: 8083367 - DNA, 22 bp, Homo sapiens
aaagtcattgctgttatcaatg

SEQ ID NO: 8083368 - DNA, 22 bp, Homo sapiens
aaagttttattcaagcattagt

SEQ ID NO: 8083369 - DNA, 22 bp, Homo sapiens
aaagttttctgccttcattaga

SEQ ID NO: 8083370 - DNA, 22 bp, Homo sapiens
aaagttttgttgattgtggaat

SEQ ID NO: 8083371 - DNA, 22 bp, Homo sapiens
aaagtttttaagcaagaccctt

SEQ ID NO: 8083372 - DNA, 22 bp, Homo sapiens
aaagctatgaggcatgcatttc

SEQ ID NO: 8083373 - DNA, 22 bp, Homo sapiens
aaagctattcaacacgaacatg

SEQ ID NO: 8083374 - DNA, 22 bp, Homo sapiens
aaagctatttattacagagaat

SEQ ID NO: 8083375 - DNA, 22 bp, Homo sapiens
aaagctatttgtgagttataga

SEQ ID NO: 8083376 - DNA, 22 bp, Homo sapiens
aaagctatttgttatgagagaa

SEQ ID NO: 8083377 - DNA, 22 bp, Homo sapiens
aaagctatagggtcaagcattt

SEQ ID NO: 8083378 - DNA, 22 bp, Homo sapiens
aaagctcagtcagtggtgtatg

SEQ ID NO: 8083379 - DNA, 22 bp, Homo sapiens
aaagctcttaatgagattatcc

SEQ ID NO: 8083380 - DNA, 22 bp, Homo sapiens
aaaggactagtctttctaccat

SEQ ID NO: 8083381 - DNA, 22 bp, Homo sapiens
aaagggaggggcgataagccgg

SEQ ID NO: 8083382 - DNA, 22 bp, Homo sapiens
aacatgattggaaaatgctgtc

SEQ ID NO: 8083383 - DNA, 22 bp, Homo sapiens
aacatgatttagtataatgcag

SEQ ID NO: 8083384 - DNA, 22 bp, Homo sapiens
aaagttctatgtaatgtttttt

SEQ ID NO: 8083385 - DNA, 19 bp, Homo sapiens
aaagttctgactgtagagc

SEQ ID NO: 8083386 - DNA, 22 bp, Homo sapiens
aaagttctgggggtgtttctgg

SEQ ID NO: 8083387 - DNA, 22 bp, Homo sapiens
aaagttctttctcttatttggt

SEQ ID NO: 8083388 - DNA, 22 bp, Homo sapiens
aaagttctggcattttctgtct

SEQ ID NO: 8083389 - DNA, 22 bp, Homo sapiens
aaagttctgggggagaagaacg

SEQ ID NO: 8083390 - DNA, 22 bp, Homo sapiens
aaagcattgtttcaagattaac

SEQ ID NO: 8083391 - DNA, 22 bp, Homo sapiens
aaagcatttcatgtctagaaag

SEQ ID NO: 8083392 - DNA, 22 bp, Homo sapiens
aaagcatgactcaagaattact

SEQ ID NO: 8083393 - DNA, 21 bp, Homo sapiens
aaagcagttcttcctgcctct

SEQ ID NO: 8083394 - DNA, 22 bp, Homo sapiens
aaagcatattaggactgaatta

SEQ ID NO: 8083395 - DNA, 22 bp, Homo sapiens
aaaggcacacactccttgttat

SEQ ID NO: 8083396 - DNA, 22 bp, Homo sapiens
aaattgctgaccaagtatattc

SEQ ID NO: 8083397 - DNA, 22 bp, Homo sapiens
aaattccattttgtgactattc

SEQ ID NO: 8083398 - DNA, 22 bp, Homo sapiens
aaattccattatgataatttcg

SEQ ID NO: 8083399 - DNA, 22 bp, Homo sapiens
aaattccattaggaaacttcca

SEQ ID NO: 8083400 - DNA, 22 bp, Homo sapiens
aaattccagcaacaccttttta

SEQ ID NO: 8083401 - DNA, 22 bp, Homo sapiens
aaattccagttcttttacctgc

SEQ ID NO: 8083402 - DNA, 22 bp, Homo sapiens
aaattccagaaactcagtatat

SEQ ID NO: 8083403 - DNA, 22 bp, Homo sapiens
aaattcagttttaataatcact

SEQ ID NO: 8083404 - DNA, 22 bp, Homo sapiens
aaattccaccagaatcagtaat

SEQ ID NO: 8083405 - DNA, 23 bp, Homo sapiens
aaattcagtccttcaactctgag

SEQ ID NO: 8083406 - DNA, 22 bp, Homo sapiens
aaattcagcagtgaaatgcccc

SEQ ID NO: 8083407 - DNA, 22 bp, Homo sapiens
aaattagatatgtgtgagactc

SEQ ID NO: 8083408 - DNA, 22 bp, Homo sapiens
aaagcagtagttttcaaatagt

SEQ ID NO: 8083409 - DNA, 22 bp, Homo sapiens
aaagcagtctcagacttaagca

SEQ ID NO: 8083410 - DNA, 22 bp, Homo sapiens
aaagcagtatgaaaggcaataa

SEQ ID NO: 8083411 - DNA, 22 bp, Homo sapiens
aaatgcacaaagattttgcact

SEQ ID NO: 8083412 - DNA, 22 bp, Homo sapiens
aaatatttgtctgaggcggttg

SEQ ID NO: 8083413 - DNA, 22 bp, Homo sapiens
aaatcaaggagggattatattt

SEQ ID NO: 8083414 - DNA, 22 bp, Homo sapiens
aaatcaaggagggattatattt

SEQ ID NO: 8083415 - DNA, 22 bp, Homo sapiens
aaatcagaaaatatggagagga

SEQ ID NO: 8083416 - DNA, 22 bp, Homo sapiens
aaatgatagtatggaactagga

SEQ ID NO: 8083417 - DNA, 22 bp, Homo sapiens
aaatgagtttgcctctagatag

SEQ ID NO: 8083418 - DNA, 19 bp, Homo sapiens
aaatcagaatctgcatttt

SEQ ID NO: 8083419 - DNA, 22 bp, Homo sapiens
aaatcagacttgaattttcatc

SEQ ID NO: 8083420 - DNA, 22 bp, Homo sapiens
aaatcagacacagtgaaagtta

SEQ ID NO: 8083421 - DNA, 22 bp, Homo sapiens
aaatcagagaatatatttagaa

SEQ ID NO: 8083422 - DNA, 22 bp, Homo sapiens
aaatcagaggtcagctgtacca

SEQ ID NO: 8083423 - DNA, 22 bp, Homo sapiens
aaatcagaggtcagctgtacca

SEQ ID NO: 8083424 - DNA, 22 bp, Homo sapiens
aaatcagagtagaattgagcca

SEQ ID NO: 8083425 - DNA, 22 bp, Homo sapiens
aaatcagagtctgattttaagg

SEQ ID NO: 8083426 - DNA, 22 bp, Homo sapiens
aaatcagagtctgattttaagg

SEQ ID NO: 8083427 - DNA, 22 bp, Homo sapiens
aaatatagcaattatgcctact

SEQ ID NO: 8083428 - DNA, 22 bp, Homo sapiens
aaatataatttctgcctcaata

SEQ ID NO: 8083429 - DNA, 22 bp, Homo sapiens
aaatatgagagtaggagtttgg

SEQ ID NO: 8083430 - DNA, 22 bp, Homo sapiens
aagagttttagacaaactgatt

SEQ ID NO: 8083431 - DNA, 22 bp, Homo sapiens
aagagttttctataatcttggc

SEQ ID NO: 8083432 - DNA, 22 bp, Homo sapiens
aagagtttctttattaaccttt

SEQ ID NO: 8083433 - DNA, 19 bp, Homo sapiens
aaatatcagagagatgata

SEQ ID NO: 8083434 - DNA, 22 bp, Homo sapiens
aaatatagtaaatgcatagttc

SEQ ID NO: 8083435 - DNA, 22 bp, Homo sapiens
aaatatagtgacacttatagtc

SEQ ID NO: 8083436 - DNA, 22 bp, Homo sapiens
aaatacaggagtttggacttct

SEQ ID NO: 8083437 - DNA, 22 bp, Homo sapiens
aaatacagtggcagcagataat

SEQ ID NO: 8083438 - DNA, 22 bp, Homo sapiens
aaatacagtgtgtgttctttga

SEQ ID NO: 8083439 - DNA, 22 bp, Homo sapiens
aaatacagattctgactcagag

SEQ ID NO: 8083440 - DNA, 22 bp, Homo sapiens
aaatacagattcttgtgtctat

SEQ ID NO: 8083441 - DNA, 19 bp, Homo sapiens
aaatacagcagctgtttcc

SEQ ID NO: 8083442 - DNA, 22 bp, Homo sapiens
aaatacagcagactcctgttgt

SEQ ID NO: 8083443 - DNA, 22 bp, Homo sapiens
aagaagcatggctgtagattcc

SEQ ID NO: 8083444 - DNA, 22 bp, Homo sapiens
aagaagcaggtcacagacaggg

SEQ ID NO: 8083445 - DNA, 22 bp, Homo sapiens
aaagttgcaggtggtgagaggt

SEQ ID NO: 8083446 - DNA, 22 bp, Homo sapiens
aaagttctttgcatctttgctc

SEQ ID NO: 8083447 - DNA, 22 bp, Homo sapiens
aaagttctttttctataaatcc

SEQ ID NO: 8083448 - DNA, 22 bp, Homo sapiens
acagaagtccccatgaagaagc

SEQ ID NO: 8083449 - DNA, 23 bp, Homo sapiens
acagaataccattgactaggtgt

SEQ ID NO: 8083450 - DNA, 22 bp, Homo sapiens
acagaatactacagactggtta

SEQ ID NO: 8083451 - DNA, 22 bp, Homo sapiens
acagaagtgtctttttcattca

SEQ ID NO: 8083452 - DNA, 22 bp, Homo sapiens
acagaatattgtaagtgccact

SEQ ID NO: 8083453 - DNA, 20 bp, Homo sapiens
acagaatatgctggttgtgg

SEQ ID NO: 8083454 - DNA, 22 bp, Homo sapiens
acagataattagcataaatgct

SEQ ID NO: 8083455 - DNA, 22 bp, Homo sapiens
agctaaatcacttattctttca

SEQ ID NO: 8083456 - DNA, 22 bp, Homo sapiens
agctaaactaggtaaacagcag

SEQ ID NO: 8083457 - DNA, 22 bp, Homo sapiens
acagcagaccactactagtagg

SEQ ID NO: 8083458 - DNA, 22 bp, Homo sapiens
acagatatttaagagcttttgt

SEQ ID NO: 8083459 - DNA, 21 bp, Homo sapiens
acagatatttcattgaacatt

SEQ ID NO: 8083460 - DNA, 22 bp, Homo sapiens
acagatagtatgtaaattaagc

SEQ ID NO: 8083461 - DNA, 22 bp, Homo sapiens
acagatatatgattgtgtaaat

SEQ ID NO: 8083462 - DNA, 22 bp, Homo sapiens
acagatatgcaaagcaaatgga

SEQ ID NO: 8083463 - DNA, 22 bp, Homo sapiens
acagatattatggtttctcctt

SEQ ID NO: 8083464 - DNA, 22 bp, Homo sapiens
acagatactcagctctatgctt

SEQ ID NO: 8083465 - DNA, 22 bp, Homo sapiens
acagatacaaatatacaaatac

SEQ ID NO: 8083466 - DNA, 22 bp, Homo sapiens
acacatctatctctacacaagg

SEQ ID NO: 8083467 - DNA, 22 bp, Homo sapiens
acacagtttttcagacagagat

SEQ ID NO: 8083468 - DNA, 22 bp, Homo sapiens
acacagtttatggtattctgtt

SEQ ID NO: 8083469 - DNA, 22 bp, Homo sapiens
acacagtttaaacgattagtac

SEQ ID NO: 8083470 - DNA, 22 bp, Homo sapiens
acacagttcgtgcttttctatt

SEQ ID NO: 8083471 - DNA, 22 bp, Homo sapiens
acacagttctcttcttgtaact

SEQ ID NO: 8083472 - DNA, 22 bp, Homo sapiens
acacagttcgttgttttctact

SEQ ID NO: 8083473 - DNA, 22 bp, Homo sapiens
acacagttctttcactgttggt

SEQ ID NO: 8083474 - DNA, 22 bp, Homo sapiens
acacagttcttagcaggtgtct

SEQ ID NO: 8083475 - DNA, 22 bp, Homo sapiens
acacaagggcctatagtgtatt

SEQ ID NO: 8083476 - DNA, 22 bp, Homo sapiens
acacaagattgtgtattgaatt

SEQ ID NO: 8083477 - DNA, 22 bp, Homo sapiens
acacaagaataatgatgaaggt

SEQ ID NO: 8083478 - DNA, 22 bp, Homo sapiens
acacaatacagggctcaaaata

SEQ ID NO: 8083479 - DNA, 23 bp, Homo sapiens
acacaatagagtactattcagcc

SEQ ID NO: 8083480 - DNA, 22 bp, Homo sapiens
acacaagtgaatattttaagga

SEQ ID NO: 8083481 - DNA, 22 bp, Homo sapiens
acacaatgtgcaggacacctgt

SEQ ID NO: 8083482 - DNA, 22 bp, Homo sapiens
acacaatgattcacaagcagca

SEQ ID NO: 8083483 - DNA, 22 bp, Homo sapiens
acacacaactcattgtgtaata

SEQ ID NO: 8083484 - DNA, 22 bp, Homo sapiens
acacacaactcattgtgtaata

SEQ ID NO: 8083485 - DNA, 22 bp, Homo sapiens
acacagtatgcatctagaaatt

SEQ ID NO: 8083486 - DNA, 22 bp, Homo sapiens
acacagttcaggatcaaatagc

SEQ ID NO: 8083487 - DNA, 22 bp, Homo sapiens
agcatttacctcaatgcatctg

SEQ ID NO: 8083488 - DNA, 22 bp, Homo sapiens
agcatttaattacagtttaatt

SEQ ID NO: 8083489 - DNA, 22 bp, Homo sapiens
acacccagcttttgaatgccct

SEQ ID NO: 8083490 - DNA, 22 bp, Homo sapiens
agccaatagcattatacagtga

SEQ ID NO: 8083491 - DNA, 22 bp, Homo sapiens
agccaaggtcgccccagggcaa

SEQ ID NO: 8083492 - DNA, 20 bp, Homo sapiens
agccaatacagcaaaatttg

SEQ ID NO: 8083493 - DNA, 22 bp, Homo sapiens
agccaatacactgaagatctaa

SEQ ID NO: 8083494 - DNA, 22 bp, Homo sapiens
agccagagggaatctttgggga

SEQ ID NO: 8083495 - DNA, 22 bp, Homo sapiens
acacttaacttctgagaataaa

SEQ ID NO: 8083496 - DNA, 22 bp, Homo sapiens
acacttaagcatgaagtataaa

SEQ ID NO: 8083497 - DNA, 22 bp, Homo sapiens
agagtgtaccaaatatcctaca

SEQ ID NO: 8083498 - DNA, 18 bp, Homo sapiens
aatttctttgacaactta

SEQ ID NO: 8083499 - DNA, 22 bp, Homo sapiens
aatttggcagtgtcttgaagta

SEQ ID NO: 8083500 - DNA, 22 bp, Homo sapiens
aatttcttcagctctaaaatgg

SEQ ID NO: 8083501 - DNA, 22 bp, Homo sapiens
acaaagtgctgacattacaggc

SEQ ID NO: 8083502 - DNA, 22 bp, Homo sapiens
acaaagtcttttacaacagtca

SEQ ID NO: 8083503 - DNA, 22 bp, Homo sapiens
acaaagtatttttaggtttgta

SEQ ID NO: 8083504 - DNA, 22 bp, Homo sapiens
acaaagttattctttcagagga

SEQ ID NO: 8083505 - DNA, 22 bp, Homo sapiens
acaacagtagcctttacaaggc

SEQ ID NO: 8083506 - DNA, 22 bp, Homo sapiens
agatgccagcttacactgggaa

SEQ ID NO: 8083507 - DNA, 19 bp, Homo sapiens
acaatagaaaagtcttttg

SEQ ID NO: 8083508 - DNA, 22 bp, Homo sapiens
acaatagaaataattaagcaca

SEQ ID NO: 8083509 - DNA, 22 bp, Homo sapiens
acaagtttcattgtttagaacc

SEQ ID NO: 8083510 - DNA, 22 bp, Homo sapiens
agcaaagtccagtctgtgtaca

SEQ ID NO: 8083511 - DNA, 22 bp, Homo sapiens
agcaaagcttccataaagcagc

SEQ ID NO: 8083512 - DNA, 22 bp, Homo sapiens
agcaaagctgctcccttttgtc

SEQ ID NO: 8083513 - DNA, 22 bp, Homo sapiens
agcaaataaagacaattatgtc

SEQ ID NO: 8083514 - DNA, 23 bp, Homo sapiens
agcaaataatctgcttgcttttt

SEQ ID NO: 8083515 - DNA, 22 bp, Homo sapiens
acaacagtttaggtatttgtag

SEQ ID NO: 8083516 - DNA, 22 bp, Homo sapiens
agcacaaaagcagccacagatg

SEQ ID NO: 8083517 - DNA, 22 bp, Homo sapiens
agagctgcgtctattcacaatc

SEQ ID NO: 8083518 - DNA, 22 bp, Homo sapiens
agagctgctcagatgtcactgc

SEQ ID NO: 8083519 - DNA, 22 bp, Homo sapiens
aattccaaatgttttcaatcca

SEQ ID NO: 8083520 - DNA, 23 bp, Homo sapiens
aattacaaccaagaactggaagg

SEQ ID NO: 8083521 - DNA, 21 bp, Homo sapiens
aattacagatggaattacaga

SEQ ID NO: 8083522 - DNA, 22 bp, Homo sapiens
aattacacagggatcacttttt

SEQ ID NO: 8083523 - DNA, 21 bp, Homo sapiens
aattacagatggaattacaga

SEQ ID NO: 8083524 - DNA, 22 bp, Homo sapiens
aattaactaatttggtacaaga

SEQ ID NO: 8083525 - DNA, 22 bp, Homo sapiens
aattaatggaaagtaaggaagg

SEQ ID NO: 8083526 - DNA, 22 bp, Homo sapiens
aattaattcagtttttaaggga

SEQ ID NO: 8083527 - DNA, 22 bp, Homo sapiens
aattaattcagtttttaaggga

SEQ ID NO: 8083528 - DNA, 22 bp, Homo sapiens
aatttcacagtgaactttgagg

SEQ ID NO: 8083529 - DNA, 22 bp, Homo sapiens
aatttcctgggataaaaagcca

SEQ ID NO: 8083530 - DNA, 22 bp, Homo sapiens
aatttcaattacttttgcacca

SEQ ID NO: 8083531 - DNA, 22 bp, Homo sapiens
aattccacaaaaggttctcttc

SEQ ID NO: 8083532 - DNA, 22 bp, Homo sapiens
agacatggagaaggagccagtg

SEQ ID NO: 8083533 - DNA, 22 bp, Homo sapiens
aatgctattcattaagcctact

SEQ ID NO: 8083534 - DNA, 22 bp, Homo sapiens
acatctaagccaattttgattt

SEQ ID NO: 8083535 - DNA, 22 bp, Homo sapiens
acatccttgattatgtaaggat

SEQ ID NO: 8083536 - DNA, 22 bp, Homo sapiens
acatccttatataggccaatga

SEQ ID NO: 8083537 - DNA, 22 bp, Homo sapiens
acatgacagtgactttataaga

SEQ ID NO: 8083538 - DNA, 22 bp, Homo sapiens
aaggcaaatgtgttcttttagt

SEQ ID NO: 8083539 - DNA, 22 bp, Homo sapiens
aagctgtgaaatctctagtgca

SEQ ID NO: 8083540 - DNA, 22 bp, Homo sapiens
aagtccttgtatacagaatcaa

SEQ ID NO: 8083541 - DNA, 22 bp, Homo sapiens
aagtcctttaatatcacatagt

SEQ ID NO: 8083542 - DNA, 22 bp, Homo sapiens
aagtcctgaataggggccctgg

SEQ ID NO: 8083543 - DNA, 22 bp, Homo sapiens
aagtcctgtgctagagacacct

SEQ ID NO: 8083544 - DNA, 22 bp, Homo sapiens
aagtatactgaaggtatccagg

SEQ ID NO: 8083545 - DNA, 22 bp, Homo sapiens
acctatcagccctgtggtttag

SEQ ID NO: 8083546 - DNA, 22 bp, Homo sapiens
acccagggtagaacctcagagc

SEQ ID NO: 8083547 - DNA, 19 bp, Homo sapiens
acccaggggtttatgtgtg

SEQ ID NO: 8083548 - DNA, 22 bp, Homo sapiens
acccaggggcgaagctggccac

SEQ ID NO: 8083549 - DNA, 22 bp, Homo sapiens
acccagggcagccagcggggag

SEQ ID NO: 8083550 - DNA, 22 bp, Homo sapiens
acccagggagtgctcctgttct

SEQ ID NO: 8083551 - DNA, 22 bp, Homo sapiens
acccagggccacagcccgcagt

SEQ ID NO: 8083552 - DNA, 22 bp, Homo sapiens
acccaggggcagccttgctgtg

SEQ ID NO: 8083553 - DNA, 21 bp, Homo sapiens
acccaggggaagcagaaactg

SEQ ID NO: 8083554 - DNA, 22 bp, Homo sapiens
acccagggcttaaggcggtgca

SEQ ID NO: 8083555 - DNA, 22 bp, Homo sapiens
acccagggctcaagcgtaggca

SEQ ID NO: 8083556 - DNA, 22 bp, Homo sapiens
acatttcagtaagtgttaattt

SEQ ID NO: 8083557 - DNA, 22 bp, Homo sapiens
acatttcagtgagctattgaag

SEQ ID NO: 8083558 - DNA, 22 bp, Homo sapiens
acatgcatgtgaatatggacac

SEQ ID NO: 8083559 - DNA, 22 bp, Homo sapiens
aagggcagaaagggacgctttg

SEQ ID NO: 8083560 - DNA, 22 bp, Homo sapiens
aagggcagagggaatcccacat

SEQ ID NO: 8083561 - DNA, 20 bp, Homo sapiens
aagggcagagggaacagact

SEQ ID NO: 8083562 - DNA, 22 bp, Homo sapiens
aagggcagaatagagaagatgg

SEQ ID NO: 8083563 - DNA, 20 bp, Homo sapiens
agaactgttgtttgggtcct

SEQ ID NO: 8083564 - DNA, 22 bp, Homo sapiens
agaacacactgggggaaacaag

SEQ ID NO: 8083565 - DNA, 22 bp, Homo sapiens
aatgcattgattgctggaaata

SEQ ID NO: 8083566 - DNA, 21 bp, Homo sapiens
aatgcattaacataaagctga

SEQ ID NO: 8083567 - DNA, 23 bp, Homo sapiens
aatagctggtaatgatagcacaa

SEQ ID NO: 8083568 - DNA, 22 bp, Homo sapiens
aatagtaaaagatacagctaat

SEQ ID NO: 8083569 - DNA, 22 bp, Homo sapiens
acttttaaggggccttgattta

SEQ ID NO: 8083570 - DNA, 22 bp, Homo sapiens
aatcaatgttagtcatgaattt

SEQ ID NO: 8083571 - DNA, 22 bp, Homo sapiens
acttttaaatgagtttcagttg

SEQ ID NO: 8083572 - DNA, 22 bp, Homo sapiens
acttttaaatgagtttcagttg

SEQ ID NO: 8083573 - DNA, 22 bp, Homo sapiens
acttttaaatgagtttcagttg

SEQ ID NO: 8083574 - DNA, 22 bp, Homo sapiens
aatcgcttggtaattttaaaag

SEQ ID NO: 8083575 - DNA, 22 bp, Homo sapiens
aatctagattcggatcaaaggg

SEQ ID NO: 8083576 - DNA, 22 bp, Homo sapiens
aatctagagttcccagcataaa

SEQ ID NO: 8083577 - DNA, 22 bp, Homo sapiens
aatctacatagagatcaaatga

SEQ ID NO: 8083578 - DNA, 22 bp, Homo sapiens
agaaactgacaggaaatgaatt

SEQ ID NO: 8083579 - DNA, 20 bp, Homo sapiens
aatcacagttaactctttct

SEQ ID NO: 8083580 - DNA, 22 bp, Homo sapiens
aatcacagtgggtactagattg

SEQ ID NO: 8083581 - DNA, 22 bp, Homo sapiens
aatcacaattacttttgcacca

SEQ ID NO: 8083582 - DNA, 22 bp, Homo sapiens
aatagcatagagttaaaatgca

SEQ ID NO: 8083583 - DNA, 22 bp, Homo sapiens
aatagcagttaaaaatcagccc

SEQ ID NO: 8083584 - DNA, 22 bp, Homo sapiens
aatagcaaagttatcaaattaa

SEQ ID NO: 8083585 - DNA, 22 bp, Homo sapiens
aatagcaaagttatcaaattaa

SEQ ID NO: 8083586 - DNA, 22 bp, Homo sapiens
aatagcaaatgctcatttgaaa

SEQ ID NO: 8083587 - DNA, 22 bp, Homo sapiens
actgtacacattcgtcaagact

SEQ ID NO: 8083588 - DNA, 22 bp, Homo sapiens
actgtaatggtggatccatgtc

SEQ ID NO: 8083589 - DNA, 22 bp, Homo sapiens
aataatacatgagattaatgtt

SEQ ID NO: 8083590 - DNA, 22 bp, Homo sapiens
aataatacatgagattaatgtt

SEQ ID NO: 8083591 - DNA, 22 bp, Homo sapiens
aagtttttgattctaagagaga

SEQ ID NO: 8083592 - DNA, 22 bp, Homo sapiens
aagtttttgattctaagagaga

SEQ ID NO: 8083593 - DNA, 22 bp, Homo sapiens
aagtttttcacattgctgttgt

SEQ ID NO: 8083594 - DNA, 20 bp, Homo sapiens
aagttttctccaaatacagt

SEQ ID NO: 8083595 - DNA, 22 bp, Homo sapiens
aagtttttggtagagaaaagta

SEQ ID NO: 8083596 - DNA, 22 bp, Homo sapiens
aagtttttggtagagaaaagta

SEQ ID NO: 8083597 - DNA, 22 bp, Homo sapiens
aagtgtttaacggtgattgagc

SEQ ID NO: 8083598 - DNA, 22 bp, Homo sapiens
aagtgtttaatggttttgatga

SEQ ID NO: 8083599 - DNA, 22 bp, Homo sapiens
aagtgtttaaattatttgcagg

SEQ ID NO: 8083600 - DNA, 22 bp, Homo sapiens
aagtgtttcaataatttggacc

SEQ ID NO: 8083601 - DNA, 22 bp, Homo sapiens
aagtgtttatggttattgttaa

SEQ ID NO: 8083602 - DNA, 22 bp, Homo sapiens
aagtgtttaggtttgcagtcga

SEQ ID NO: 8083603 - DNA, 22 bp, Homo sapiens
aagtgtttacttaaagtcatgg

SEQ ID NO: 8083604 - DNA, 22 bp, Homo sapiens
aagtgtttggggatcattttaa

SEQ ID NO: 8083605 - DNA, 22 bp, Homo sapiens
aagtgtttcttggaatgttgcg

SEQ ID NO: 8083606 - DNA, 22 bp, Homo sapiens
aagtgtttccgggagacttggt

SEQ ID NO: 8083607 - DNA, 22 bp, Homo sapiens
actgaaaatgaattagaaacag

SEQ ID NO: 8083608 - DNA, 22 bp, Homo sapiens
actgaaaaagacatcttggtaa

SEQ ID NO: 8083609 - DNA, 22 bp, Homo sapiens
actgaaaaagtatgattcactg

SEQ ID NO: 8083610 - DNA, 22 bp, Homo sapiens
aagttcaatcagatgaaaaagc

SEQ ID NO: 8083611 - DNA, 22 bp, Homo sapiens
aagttcagcctggttttaatgc

SEQ ID NO: 8083612 - DNA, 22 bp, Homo sapiens
aagttcacagaagattccaatt

SEQ ID NO: 8083613 - DNA, 22 bp, Homo sapiens
aagttcctcaaataaaacatga

SEQ ID NO: 8083614 - DNA, 22 bp, Homo sapiens
actgcaggtggatggcacttta

SEQ ID NO: 8083615 - DNA, 22 bp, Homo sapiens
actgcagggcatcctggccaag

SEQ ID NO: 8083616 - DNA, 22 bp, Homo sapiens
actgcaggccttggtgccagca

SEQ ID NO: 8083617 - DNA, 22 bp, Homo sapiens
actgcatgctttacatgacatg

SEQ ID NO: 8083618 - DNA, 22 bp, Homo sapiens
aagttttattggctatagcact

SEQ ID NO: 8083619 - DNA, 22 bp, Homo sapiens
agagagaacaccctcggcatgg

SEQ ID NO: 8083620 - DNA, 22 bp, Homo sapiens
agagactggcttctaaaatggc

SEQ ID NO: 8083621 - DNA, 22 bp, Homo sapiens
agagaacagtgttttgaaggag

SEQ ID NO: 8083622 - DNA, 22 bp, Homo sapiens
agagaacagcctcctagagaaa

SEQ ID NO: 8083623 - DNA, 22 bp, Homo sapiens
agagaacatgacgtaatagtgg

SEQ ID NO: 8083624 - DNA, 22 bp, Homo sapiens
agagaacatattttgtatgatt

SEQ ID NO: 8083625 - DNA, 22 bp, Homo sapiens
agagaacattagcaaaaacagc

SEQ ID NO: 8083626 - DNA, 22 bp, Homo sapiens
atggacaatgtgaaactacaag

SEQ ID NO: 8083627 - DNA, 22 bp, Homo sapiens
atggacacatgagttacgattg

SEQ ID NO: 8083628 - DNA, 22 bp, Homo sapiens
atgggcagttaggaggccagga

SEQ ID NO: 8083629 - DNA, 22 bp, Homo sapiens
atgggcagtgtattggaaggaa

SEQ ID NO: 8083630 - DNA, 16 bp, Homo sapiens
atgggcagtgaggaag

SEQ ID NO: 8083631 - DNA, 22 bp, Homo sapiens
atgggcagtaacagtggcagtc

SEQ ID NO: 8083632 - DNA, 22 bp, Homo sapiens
agagccaggatgtcttctgggg

SEQ ID NO: 8083633 - DNA, 22 bp, Homo sapiens
agagccaggatctgttttgggg

SEQ ID NO: 8083634 - DNA, 22 bp, Homo sapiens
atcttagagagtcgtgttttgt

SEQ ID NO: 8083635 - DNA, 22 bp, Homo sapiens
atgcaaatgtcaccacttctaa

SEQ ID NO: 8083636 - DNA, 22 bp, Homo sapiens
atgcaaatgtttaagttactat

SEQ ID NO: 8083637 - DNA, 22 bp, Homo sapiens
atgattttctgataaagaactg

SEQ ID NO: 8083638 - DNA, 22 bp, Homo sapiens
atgattttctgataaagaactg

SEQ ID NO: 8083639 - DNA, 22 bp, Homo sapiens
atgatatatgtgttgagcttgc

SEQ ID NO: 8083640 - DNA, 22 bp, Homo sapiens
atgacttctgctttacagagtt

SEQ ID NO: 8083641 - DNA, 22 bp, Homo sapiens
atgactttgttgttttccagcg

SEQ ID NO: 8083642 - DNA, 22 bp, Homo sapiens
atgctgataggagttaatggtg

SEQ ID NO: 8083643 - DNA, 22 bp, Homo sapiens
agagaacacgtgcatctgcaat

SEQ ID NO: 8083644 - DNA, 22 bp, Homo sapiens
agagaacagacagatgcaatga

SEQ ID NO: 8083645 - DNA, 22 bp, Homo sapiens
agagaacagcattgcagctttg

SEQ ID NO: 8083646 - DNA, 22 bp, Homo sapiens
agagaaaagagttcaggctttg

SEQ ID NO: 8083647 - DNA, 22 bp, Homo sapiens
agagaacaaattaaaggtggtt

SEQ ID NO: 8083648 - DNA, 22 bp, Homo sapiens
atgcaaattgccataaagtggg

SEQ ID NO: 8083649 - DNA, 22 bp, Homo sapiens
atttctttctggccacggtttt

SEQ ID NO: 8083650 - DNA, 22 bp, Homo sapiens
agatttaaatttgctacaattc

SEQ ID NO: 8083651 - DNA, 22 bp, Homo sapiens
agatttaaatttgctacaattc

SEQ ID NO: 8083652 - DNA, 22 bp, Homo sapiens
agatttacaaaggatttgcttt

SEQ ID NO: 8083653 - DNA, 22 bp, Homo sapiens
caaacattttaaataagggata

SEQ ID NO: 8083654 - DNA, 22 bp, Homo sapiens
caaacattgctaccagaggttt

SEQ ID NO: 8083655 - DNA, 22 bp, Homo sapiens
caaacatttaggaggagggagg

SEQ ID NO: 8083656 - DNA, 22 bp, Homo sapiens
agcaatatttaaaggtttgcaa

SEQ ID NO: 8083657 - DNA, 22 bp, Homo sapiens
caaagttttagtaaacatatat

SEQ ID NO: 8083658 - DNA, 22 bp, Homo sapiens
agcaataacagaaaactttcct

SEQ ID NO: 8083659 - DNA, 23 bp, Homo sapiens
attttttgtctttgtaactagat

SEQ ID NO: 8083660 - DNA, 22 bp, Homo sapiens
agcaagatgaaggattcaagac

SEQ ID NO: 8083661 - DNA, 22 bp, Homo sapiens
attttttatataccaaggtggg

SEQ ID NO: 8083662 - DNA, 22 bp, Homo sapiens
attttttagccaagactctgca

SEQ ID NO: 8083663 - DNA, 22 bp, Homo sapiens
attttgtgaaccctcaagcaat

SEQ ID NO: 8083664 - DNA, 22 bp, Homo sapiens
attttgtgggttctgctgatgt

SEQ ID NO: 8083665 - DNA, 22 bp, Homo sapiens
attgttaataactattacattg

SEQ ID NO: 8083666 - DNA, 22 bp, Homo sapiens
agatacaaggcagagatgtgca

SEQ ID NO: 8083667 - DNA, 22 bp, Homo sapiens
attgttaaactgaagcattact

SEQ ID NO: 8083668 - DNA, 22 bp, Homo sapiens
attgttaaactgaagcattact

SEQ ID NO: 8083669 - DNA, 22 bp, Homo sapiens
attgagcacaaacgttactaga

SEQ ID NO: 8083670 - DNA, 22 bp, Homo sapiens
attgagcaggcaaagtatcata

SEQ ID NO: 8083671 - DNA, 22 bp, Homo sapiens
attctaagtcttgttcacattc

SEQ ID NO: 8083672 - DNA, 22 bp, Homo sapiens
attcaaagaacctttagcattg

SEQ ID NO: 8083673 - DNA, 22 bp, Homo sapiens
attcaaagagctgccagaactg

SEQ ID NO: 8083674 - DNA, 22 bp, Homo sapiens
attcaaaagaccatgcagactc

SEQ ID NO: 8083675 - DNA, 20 bp, Homo sapiens
attctacaagaataagcatg

SEQ ID NO: 8083676 - DNA, 22 bp, Homo sapiens
attaataaaataccactttgtt

SEQ ID NO: 8083677 - DNA, 22 bp, Homo sapiens
agaggaaacataggtttttaaa

SEQ ID NO: 8083678 - DNA, 22 bp, Homo sapiens
attatttgtgtccacagaatac

SEQ ID NO: 8083679 - DNA, 22 bp, Homo sapiens
agaggcctccctcccagctggt

SEQ ID NO: 8083680 - DNA, 22 bp, Homo sapiens
agaggccggccgagcccatggg

SEQ ID NO: 8083681 - DNA, 22 bp, Homo sapiens
caatgatatctaggaatgggac

SEQ ID NO: 8083682 - DNA, 22 bp, Homo sapiens
caatgatagattttacaaatta

SEQ ID NO: 8083683 - DNA, 22 bp, Homo sapiens
caattatatttagaatgataca

SEQ ID NO: 8083684 - DNA, 22 bp, Homo sapiens
caattaaagaagacctgcctca

SEQ ID NO: 8083685 - DNA, 22 bp, Homo sapiens
caaggcattaccatggctagag

SEQ ID NO: 8083686 - DNA, 22 bp, Homo sapiens
agcagacaggctgccacagtgc

SEQ ID NO: 8083687 - DNA, 22 bp, Homo sapiens
agcaattatggagttgttgacg

SEQ ID NO: 8083688 - DNA, 22 bp, Homo sapiens
caagcagagaggttagaacaca

SEQ ID NO: 8083689 - DNA, 22 bp, Homo sapiens
cacagaaaggctcaaatcccaa

SEQ ID NO: 8083690 - DNA, 22 bp, Homo sapiens
cacagaaatattgtgtcccttg

SEQ ID NO: 8083691 - DNA, 22 bp, Homo sapiens
cacagaaattattaggatgctt

SEQ ID NO: 8083692 - DNA, 22 bp, Homo sapiens
cacagaaaaaggcttgaaaatc

SEQ ID NO: 8083693 - DNA, 22 bp, Homo sapiens
cacacatgaatccctagtacct

SEQ ID NO: 8083694 - DNA, 22 bp, Homo sapiens
caatttttaaactatgaagttg

SEQ ID NO: 8083695 - DNA, 19 bp, Homo sapiens
caatttggcagattctccc

SEQ ID NO: 8083696 - DNA, 22 bp, Homo sapiens
caattcaatggcaaagtattgt

SEQ ID NO: 8083697 - DNA, 22 bp, Homo sapiens
caattcaaatgcatagttcaca

SEQ ID NO: 8083698 - DNA, 22 bp, Homo sapiens
caattcaacctaagtgcatcca

SEQ ID NO: 8083699 - DNA, 22 bp, Homo sapiens
caattcaacttgcctttgtagc

SEQ ID NO: 8083700 - DNA, 22 bp, Homo sapiens
caattcaagttgagtacagctt

SEQ ID NO: 8083701 - DNA, 18 bp, Homo sapiens
caattcaagagcctacag

SEQ ID NO: 8083702 - DNA, 22 bp, Homo sapiens
cacaggctgcccgcagctggga

SEQ ID NO: 8083703 - DNA, 22 bp, Homo sapiens
cacaggctctccagggcctgga

SEQ ID NO: 8083704 - DNA, 22 bp, Homo sapiens
cacatgaacatgctggaaaagc

SEQ ID NO: 8083705 - DNA, 20 bp, Homo sapiens
cacaggctatatgagagcca

SEQ ID NO: 8083706 - DNA, 18 bp, Homo sapiens
cacaggctcccagtgagg

SEQ ID NO: 8083707 - DNA, 22 bp, Homo sapiens
cacgttttatgacagaagaagc

SEQ ID NO: 8083708 - DNA, 22 bp, Homo sapiens
cactaaatgtttcaatgtggga

SEQ ID NO: 8083709 - DNA, 22 bp, Homo sapiens
cactgaaatcgaaaaatgtagg

SEQ ID NO: 8083710 - DNA, 22 bp, Homo sapiens
cactaattccatctccttttcc

SEQ ID NO: 8083711 - DNA, 22 bp, Homo sapiens
cactacaggggtccacagctga

SEQ ID NO: 8083712 - DNA, 22 bp, Homo sapiens
cactaagatttaaagtattagt

SEQ ID NO: 8083713 - DNA, 19 bp, Homo sapiens
cactaagatgagatatagc

SEQ ID NO: 8083714 - DNA, 22 bp, Homo sapiens
agcatttatgactaatgtaaaa

SEQ ID NO: 8083715 - DNA, 22 bp, Homo sapiens
agcatttatttcttagaaattg

SEQ ID NO: 8083716 - DNA, 22 bp, Homo sapiens
agcatttatagcccctatcatc

SEQ ID NO: 8083717 - DNA, 22 bp, Homo sapiens
agcatttagttagtaaatgttt

SEQ ID NO: 8083718 - DNA, 22 bp, Homo sapiens
agcatttaggagaatttgagaa

SEQ ID NO: 8083719 - DNA, 22 bp, Homo sapiens
cactgcactccatcctgggaaa

SEQ ID NO: 8083720 - DNA, 22 bp, Homo sapiens
cactgcaacctccacctcctgg

SEQ ID NO: 8083721 - DNA, 22 bp, Homo sapiens
cactgcaacctccacctcctgg

SEQ ID NO: 8083722 - DNA, 22 bp, Homo sapiens
cactgcactccagcccgggcaa

SEQ ID NO: 8083723 - DNA, 22 bp, Homo sapiens
cagaaacttctggtgtcaaata

SEQ ID NO: 8083724 - DNA, 22 bp, Homo sapiens
cagaaacttctggtgtcaaata

SEQ ID NO: 8083725 - DNA, 22 bp, Homo sapiens
cagaaactgtttgttaatattt

SEQ ID NO: 8083726 - DNA, 22 bp, Homo sapiens
cagaaactagatttagacacaa

SEQ ID NO: 8083727 - DNA, 22 bp, Homo sapiens
cagaaactgcttgtggtcatct

SEQ ID NO: 8083728 - DNA, 22 bp, Homo sapiens
cactgggcacttgggttgcttc

SEQ ID NO: 8083729 - DNA, 22 bp, Homo sapiens
cagagtggcgaccccctcagct

SEQ ID NO: 8083730 - DNA, 22 bp, Homo sapiens
cagatattaggagctcaataat

SEQ ID NO: 8083731 - DNA, 22 bp, Homo sapiens
cagatcataacagatacataga

SEQ ID NO: 8083732 - DNA, 22 bp, Homo sapiens
cagatgaactaggctgcacttg

SEQ ID NO: 8083733 - DNA, 22 bp, Homo sapiens
cagagccatccaggtgcctgtt

SEQ ID NO: 8083734 - DNA, 22 bp, Homo sapiens
cagagccatcccagcctgtggt

SEQ ID NO: 8083735 - DNA, 22 bp, Homo sapiens
agccagggacgctgcaggctac

SEQ ID NO: 8083736 - DNA, 22 bp, Homo sapiens
agccaggggagtcagctgctgg

SEQ ID NO: 8083737 - DNA, 22 bp, Homo sapiens
cagccctggtgaggttggctat

SEQ ID NO: 8083738 - DNA, 22 bp, Homo sapiens
cagcatgtaagccactgccctg

SEQ ID NO: 8083739 - DNA, 22 bp, Homo sapiens
agccttttggagttattctggg

SEQ ID NO: 8083740 - DNA, 22 bp, Homo sapiens
cagcatgtggattcctcccact

SEQ ID NO: 8083741 - DNA, 22 bp, Homo sapiens
cagcatgtatctttcaggtgtg

SEQ ID NO: 8083742 - DNA, 19 bp, Homo sapiens
agttatttctaaatttacc

SEQ ID NO: 8083743 - DNA, 22 bp, Homo sapiens
agttcaattgttttgtaaaagt

SEQ ID NO: 8083744 - DNA, 22 bp, Homo sapiens
agtgcaatagcaaagaacaaca

SEQ ID NO: 8083745 - DNA, 22 bp, Homo sapiens
agtgctgtctccttcccccggg

SEQ ID NO: 8083746 - DNA, 22 bp, Homo sapiens
agtgattttgtagctatgagat

SEQ ID NO: 8083747 - DNA, 20 bp, Homo sapiens
agtgatttgttagtacattg

SEQ ID NO: 8083748 - DNA, 20 bp, Homo sapiens
agtgatttgttagtacattg

SEQ ID NO: 8083749 - DNA, 22 bp, Homo sapiens
agtgattttatcaatttactca

SEQ ID NO: 8083750 - DNA, 22 bp, Homo sapiens
agtccttgaatgttttgaaatc

SEQ ID NO: 8083751 - DNA, 18 bp, Homo sapiens
agtgaattaaggcaggaa

SEQ ID NO: 8083752 - DNA, 22 bp, Homo sapiens
agtcctttgggaaaaatgacta

SEQ ID NO: 8083753 - DNA, 22 bp, Homo sapiens
agtgaattctaaatgctaaaga

SEQ ID NO: 8083754 - DNA, 22 bp, Homo sapiens
agtgaattagcctatttgtaaa

SEQ ID NO: 8083755 - DNA, 23 bp, Homo sapiens
agtgaattcagtttaaaacagag

SEQ ID NO: 8083756 - DNA, 22 bp, Homo sapiens
agtggcagagaccccagccagc

SEQ ID NO: 8083757 - DNA, 22 bp, Homo sapiens
aggtgcagtggctcatgcctgt

SEQ ID NO: 8083758 - DNA, 22 bp, Homo sapiens
actcacagggcctcagttttcc

SEQ ID NO: 8083759 - DNA, 22 bp, Homo sapiens
actcacagtccctgtaggagtg

SEQ ID NO: 8083760 - DNA, 22 bp, Homo sapiens
actcacagtgaagccagaatca

SEQ ID NO: 8083761 - DNA, 22 bp, Homo sapiens
agtaacatgagtttttctaatg

SEQ ID NO: 8083762 - DNA, 17 bp, Homo sapiens
agtaagtgtgtcacttc

SEQ ID NO: 8083763 - DNA, 22 bp, Homo sapiens
agtaagtgcagaaaagatgtgg

SEQ ID NO: 8083764 - DNA, 22 bp, Homo sapiens
agtaagtgagtcactgtgctgg

SEQ ID NO: 8083765 - DNA, 22 bp, Homo sapiens
agtcaggggatctagacttgaa

SEQ ID NO: 8083766 - DNA, 22 bp, Homo sapiens
agtcagtgggagaagtgtgaag

SEQ ID NO: 8083767 - DNA, 22 bp, Homo sapiens
agtcagtgggcttggcacagaa

SEQ ID NO: 8083768 - DNA, 22 bp, Homo sapiens
agtcagtggtatttaggggaat

SEQ ID NO: 8083769 - DNA, 23 bp, Homo sapiens
agtcagtgtaagtttggaatgca

SEQ ID NO: 8083770 - DNA, 22 bp, Homo sapiens
agtcagtggctccgagcctggt

SEQ ID NO: 8083771 - DNA, 22 bp, Homo sapiens
agtcagtggatttaccatgcgt

SEQ ID NO: 8083772 - DNA, 22 bp, Homo sapiens
agtcagtgaatctgaaggctaa

SEQ ID NO: 8083773 - DNA, 22 bp, Homo sapiens
agtcagtgaaggcattgctcaa

SEQ ID NO: 8083774 - DNA, 22 bp, Homo sapiens
agtcagtgaatggtgtatgcta

SEQ ID NO: 8083775 - DNA, 23 bp, Homo sapiens
agtcagtgcgggatggtcagggg

SEQ ID NO: 8083776 - DNA, 22 bp, Homo sapiens
agtcagtgacttttgctgagag

SEQ ID NO: 8083777 - DNA, 22 bp, Homo sapiens
agtcagtgaaaactagaatgtt

SEQ ID NO: 8083778 - DNA, 22 bp, Homo sapiens
agtcagtgtagaaagcccaggc

SEQ ID NO: 8083779 - DNA, 22 bp, Homo sapiens
agtccttcacgtcctgcttatt

SEQ ID NO: 8083780 - DNA, 22 bp, Homo sapiens
atacacagctacattgaacaat

SEQ ID NO: 8083781 - DNA, 20 bp, Homo sapiens
atacacattcatagaaaaat

SEQ ID NO: 8083782 - DNA, 22 bp, Homo sapiens
atacacagccattatgaattag

SEQ ID NO: 8083783 - DNA, 22 bp, Homo sapiens
ataacagagagctactgaactg

SEQ ID NO: 8083784 - DNA, 22 bp, Homo sapiens
ataagctgtactctataaatgt

SEQ ID NO: 8083785 - DNA, 22 bp, Homo sapiens
agttctttgcatagatttggct

SEQ ID NO: 8083786 - DNA, 22 bp, Homo sapiens
agttctttgtcatctctggagt

SEQ ID NO: 8083787 - DNA, 22 bp, Homo sapiens
agttgactctcaagatcctgtt

SEQ ID NO: 8083788 - DNA, 22 bp, Homo sapiens
agttcactctttatgagaaagt

SEQ ID NO: 8083789 - DNA, 22 bp, Homo sapiens
agttcactgcttaagcctttga

SEQ ID NO: 8083790 - DNA, 22 bp, Homo sapiens
agttcactccagatgttctgac

SEQ ID NO: 8083791 - DNA, 22 bp, Homo sapiens
ataaattttcttgctgtactta

SEQ ID NO: 8083792 - DNA, 22 bp, Homo sapiens
ataaattttcttgctgtactta

SEQ ID NO: 8083793 - DNA, 22 bp, Homo sapiens
ataaatttataattgtttcctg

SEQ ID NO: 8083794 - DNA, 22 bp, Homo sapiens
ataacagacttagagttacaag

SEQ ID NO: 8083795 - DNA, 22 bp, Homo sapiens
ataacagacttagagttacaag

SEQ ID NO: 8083796 - DNA, 21 bp, Homo sapiens
ataaattctgagaggctctgc

SEQ ID NO: 8083797 - DNA, 22 bp, Homo sapiens
ataaattctctgatgtatagta

SEQ ID NO: 8083798 - DNA, 23 bp, Homo sapiens
agaaaagcttggacacatggcct

SEQ ID NO: 8083799 - DNA, 22 bp, Homo sapiens
atagctttacagaagagtttag

SEQ ID NO: 8083800 - DNA, 22 bp, Homo sapiens
atagctttgagggctccttagg

SEQ ID NO: 8083801 - DNA, 22 bp, Homo sapiens
ataggaaatcgctattaaccta

SEQ ID NO: 8083802 - DNA, 22 bp, Homo sapiens
atagtgttacccttcttaaagt

SEQ ID NO: 8083803 - DNA, 22 bp, Homo sapiens
atagaataaggcacagattctt

SEQ ID NO: 8083804 - DNA, 22 bp, Homo sapiens
atagatgtacgtatgtaaatca

SEQ ID NO: 8083805 - DNA, 22 bp, Homo sapiens
actttagaaaaggaacagagga

SEQ ID NO: 8083806 - DNA, 22 bp, Homo sapiens
atagaactcgggctttggaatc

SEQ ID NO: 8083807 - DNA, 22 bp, Homo sapiens
atagaagcaagaacagaatgga

SEQ ID NO: 8083808 - DNA, 22 bp, Homo sapiens
atagaaatgtattttggactag

SEQ ID NO: 8083809 - DNA, 22 bp, Homo sapiens
atacactgatctttttatgggg

SEQ ID NO: 8083810 - DNA, 22 bp, Homo sapiens
atacactgctgccacacagctg

SEQ ID NO: 8083811 - DNA, 22 bp, Homo sapiens
atatagaatacacagggaaagt

SEQ ID NO: 8083812 - DNA, 22 bp, Homo sapiens
atatagatcaaatgatgctaat

SEQ ID NO: 8083813 - DNA, 22 bp, Homo sapiens
atatagattccatggttccttt

SEQ ID NO: 8083814 - DNA, 22 bp, Homo sapiens
atatagcacttgttttgcatgt

SEQ ID NO: 8083815 - DNA, 22 bp, Homo sapiens
atattacacacggtatcacggg

SEQ ID NO: 8083816 - DNA, 22 bp, Homo sapiens
agaaagttttgtgctatatatg

SEQ ID NO: 8083817 - DNA, 22 bp, Homo sapiens
agaaagtttgtttttatccata

SEQ ID NO: 8083818 - DNA, 20 bp, Homo sapiens
agaaatcagcatgtcctctg

SEQ ID NO: 8083819 - DNA, 20 bp, Homo sapiens
agaaatattgagttcagagg

SEQ ID NO: 8083820 - DNA, 22 bp, Homo sapiens
atcaattttgaggatacaagaa

SEQ ID NO: 8083821 - DNA, 22 bp, Homo sapiens
atcaattttgaggatacaagaa

SEQ ID NO: 8083822 - DNA, 22 bp, Homo sapiens
agaaatgctcaggtcaacttaa

SEQ ID NO: 8083823 - DNA, 22 bp, Homo sapiens
agaaatgcctacgagataggga

SEQ ID NO: 8083824 - DNA, 22 bp, Homo sapiens
atcaatatcagatcagacagga

SEQ ID NO: 8083825 - DNA, 22 bp, Homo sapiens
agaagccattccctgtaggctc

SEQ ID NO: 8083826 - DNA, 22 bp, Homo sapiens
agaagctggaggaagactaagc

SEQ ID NO: 8083827 - DNA, 22 bp, Homo sapiens
agaagccaccagctgaggaaga

SEQ ID NO: 8083828 - DNA, 22 bp, Homo sapiens
agaagccatagtatctcagggt

SEQ ID NO: 8083829 - DNA, 22 bp, Homo sapiens
agaagccaaatgccagtgacct

SEQ ID NO: 8083830 - DNA, 20 bp, Homo sapiens
agaagcattcaaagaaaact

SEQ ID NO: 8083831 - DNA, 22 bp, Homo sapiens
agaagcaggcagatttcagctc

SEQ ID NO: 8083832 - DNA, 22 bp, Homo sapiens
aggcagtggtgtttgctggtgg

SEQ ID NO: 8083833 - DNA, 22 bp, Homo sapiens
acatcttcactggtttctggaa

SEQ ID NO: 8083834 - DNA, 22 bp, Homo sapiens
acatcttcaaagtgctttgcaa

SEQ ID NO: 8083835 - DNA, 22 bp, Homo sapiens
aggcagtgtattgctagcggct

SEQ ID NO: 8083836 - DNA, 22 bp, Homo sapiens
aggcagatatttcagttcacat

SEQ ID NO: 8083837 - DNA, 22 bp, Homo sapiens
aggcagatcagtacagggttaa

SEQ ID NO: 8083838 - DNA, 22 bp, Homo sapiens
aggcagatgggcgtctataaat

SEQ ID NO: 8083839 - DNA, 22 bp, Homo sapiens
aggcagatgggagctggaagtt

SEQ ID NO: 8083840 - DNA, 22 bp, Homo sapiens
aggcagatgtgtcttctaaaat

SEQ ID NO: 8083841 - DNA, 22 bp, Homo sapiens
aggcagatgtgattaatttcct

SEQ ID NO: 8083842 - DNA, 22 bp, Homo sapiens
aggcagattaggattaggaaat

SEQ ID NO: 8083843 - DNA, 22 bp, Homo sapiens
aggcaggggagctggaagggta

SEQ ID NO: 8083844 - DNA, 22 bp, Homo sapiens
aggcagcaatgaatgaaatgga

SEQ ID NO: 8083845 - DNA, 22 bp, Homo sapiens
aggcagcaaatgtctggaacag

SEQ ID NO: 8083846 - DNA, 22 bp, Homo sapiens
aggcagcaagattatttaatcc

SEQ ID NO: 8083847 - DNA, 22 bp, Homo sapiens
aggcagcaaagaaatgatgctg

SEQ ID NO: 8083848 - DNA, 22 bp, Homo sapiens
aggcagattttctttactcagt

SEQ ID NO: 8083849 - DNA, 22 bp, Homo sapiens
acagtgttcctttgttgtgact

SEQ ID NO: 8083850 - DNA, 22 bp, Homo sapiens
aggaggccctagagctctagag

SEQ ID NO: 8083851 - DNA, 22 bp, Homo sapiens
acagtgaaaagaatattagaat

SEQ ID NO: 8083852 - DNA, 22 bp, Homo sapiens
acagtgaaaattctattgattt

SEQ ID NO: 8083853 - DNA, 22 bp, Homo sapiens
acagtgaataagacatgtgctt

SEQ ID NO: 8083854 - DNA, 22 bp, Homo sapiens
acagtgaatccaaattcctacc

SEQ ID NO: 8083855 - DNA, 22 bp, Homo sapiens
acagtgaatgcccaagaaaagt

SEQ ID NO: 8083856 - DNA, 22 bp, Homo sapiens
aggactggccctgaggggaggc

SEQ ID NO: 8083857 - DNA, 22 bp, Homo sapiens
acagggcagtgtcttgaaaaat

SEQ ID NO: 8083858 - DNA, 22 bp, Homo sapiens
acagggcaggtggctactggtc

SEQ ID NO: 8083859 - DNA, 22 bp, Homo sapiens
acagggcatgtgcaagagacat

SEQ ID NO: 8083860 - DNA, 21 bp, Homo sapiens
acagggcatgcagctggctgt

SEQ ID NO: 8083861 - DNA, 22 bp, Homo sapiens
acagggcatttcctctatgtgt

SEQ ID NO: 8083862 - DNA, 23 bp, Homo sapiens
acagggcattgctggcctcgagg

SEQ ID NO: 8083863 - DNA, 22 bp, Homo sapiens
acaggacatgtaccaggtggtc

SEQ ID NO: 8083864 - DNA, 22 bp, Homo sapiens
acaggacaggctgggctagact

SEQ ID NO: 8083865 - DNA, 22 bp, Homo sapiens
acaggacaaaaatctggatggc

SEQ ID NO: 8083866 - DNA, 22 bp, Homo sapiens
acagcatccctgaagataacca

SEQ ID NO: 8083867 - DNA, 22 bp, Homo sapiens
acagcatccttctaaagtagct

SEQ ID NO: 8083868 - DNA, 22 bp, Homo sapiens
acagcagtttagaggacagcca

SEQ ID NO: 8083869 - DNA, 22 bp, Homo sapiens
acagcattccctttggctgctt

SEQ ID NO: 8083870 - DNA, 22 bp, Homo sapiens
aggctgctggcaggcgtggacg

SEQ ID NO: 8083871 - DNA, 22 bp, Homo sapiens
aggctgctgctctacagttgct

SEQ ID NO: 8083872 - DNA, 17 bp, Homo sapiens
aggctgctgggccaggg

SEQ ID NO: 8083873 - DNA, 22 bp, Homo sapiens
aggctgctgccttggagagtgt

SEQ ID NO: 8083874 - DNA, 23 bp, Homo sapiens
aggctggcttcaggagcctctcc

SEQ ID NO: 8083875 - DNA, 22 bp, Homo sapiens
aggctggcttggctctcctgtg

SEQ ID NO: 8083876 - DNA, 22 bp, Homo sapiens
aggctggccagtgctgcagtgg

SEQ ID NO: 8083877 - DNA, 22 bp, Homo sapiens
acatttctccctgcatgcctgc

SEQ ID NO: 8083878 - DNA, 22 bp, Homo sapiens
accagaaaggaataatagaatt

SEQ ID NO: 8083879 - DNA, 22 bp, Homo sapiens
accagaaaggaataatagaatt

SEQ ID NO: 8083880 - DNA, 22 bp, Homo sapiens
aggctggctttggtagcatggt

SEQ ID NO: 8083881 - DNA, 20 bp, Homo sapiens
acatgtactaatgaatacag

SEQ ID NO: 8083882 - DNA, 22 bp, Homo sapiens
acatgtacatacacatatgtaa

SEQ ID NO: 8083883 - DNA, 22 bp, Homo sapiens
acatgtaaaagataaattaaca

SEQ ID NO: 8083884 - DNA, 22 bp, Homo sapiens
acatgtaagactagcttaaagt

SEQ ID NO: 8083885 - DNA, 22 bp, Homo sapiens
acatgtaaacatttacagtatt

SEQ ID NO: 8083886 - DNA, 22 bp, Homo sapiens
acattaaatttcatagtgatta

SEQ ID NO: 8083887 - DNA, 22 bp, Homo sapiens
acatgttttgtgccttgactag

SEQ ID NO: 8083888 - DNA, 21 bp, Homo sapiens
agggcacccccgctgcctacc

SEQ ID NO: 8083889 - DNA, 20 bp, Homo sapiens
agggaggtgctgggcctgag

SEQ ID NO: 8083890 - DNA, 22 bp, Homo sapiens
accagagactctttctagtcct

SEQ ID NO: 8083891 - DNA, 20 bp, Homo sapiens
accagagatagcaatagtgc

SEQ ID NO: 8083892 - DNA, 22 bp, Homo sapiens
aggggagctaacaccagagccc

SEQ ID NO: 8083893 - DNA, 22 bp, Homo sapiens
aggggagcttgaggcatggcct

SEQ ID NO: 8083894 - DNA, 22 bp, Homo sapiens
cataacatctgtgaagcaggaa

SEQ ID NO: 8083895 - DNA, 22 bp, Homo sapiens
cagttttattggttgaaatctg

SEQ ID NO: 8083896 - DNA, 23 bp, Homo sapiens
aggaggcctgaaactgaggctga

SEQ ID NO: 8083897 - DNA, 22 bp, Homo sapiens
catacaaatgtgtccaggctct

SEQ ID NO: 8083898 - DNA, 19 bp, Homo sapiens
catctcccacagccacaca

SEQ ID NO: 8083899 - DNA, 22 bp, Homo sapiens
catcttaatttctaacaggcac

SEQ ID NO: 8083900 - DNA, 22 bp, Homo sapiens
catgagcataaatcagtcacga

SEQ ID NO: 8083901 - DNA, 22 bp, Homo sapiens
catcttctgggacttctcagtt

SEQ ID NO: 8083902 - DNA, 22 bp, Homo sapiens
cattgctgtgggcatttgctgc

SEQ ID NO: 8083903 - DNA, 19 bp, Homo sapiens
cattcctttgtctgccaaa

SEQ ID NO: 8083904 - DNA, 22 bp, Homo sapiens
catttcaattatttgctcttct

SEQ ID NO: 8083905 - DNA, 22 bp, Homo sapiens
catttcaagcattgacttctat

SEQ ID NO: 8083906 - DNA, 22 bp, Homo sapiens
catttactgtaaaagattctct

SEQ ID NO: 8083907 - DNA, 22 bp, Homo sapiens
cattgtaagaggctttgcagca

SEQ ID NO: 8083908 - DNA, 22 bp, Homo sapiens
catttgaaacctggaatctacc

SEQ ID NO: 8083909 - DNA, 22 bp, Homo sapiens
catttctgtgacacttccatct

SEQ ID NO: 8083910 - DNA, 22 bp, Homo sapiens
catttctgtcacgttcttttat

SEQ ID NO: 8083911 - DNA, 23 bp, Homo sapiens
ccacaggcacagaggcttgcatc

SEQ ID NO: 8083912 - DNA, 22 bp, Homo sapiens
aggcaggagtgaccctgacagg

SEQ ID NO: 8083913 - DNA, 19 bp, Homo sapiens
ccacagagcatgctgaggc

SEQ ID NO: 8083914 - DNA, 22 bp, Homo sapiens
ccacagtggttgtggcatgtgg

SEQ ID NO: 8083915 - DNA, 22 bp, Homo sapiens
ccacagttattcatttgtgaca

SEQ ID NO: 8083916 - DNA, 22 bp, Homo sapiens
ccacagtttgccagccaggaat

SEQ ID NO: 8083917 - DNA, 22 bp, Homo sapiens
ccacgagggaaccaggtggggt

SEQ ID NO: 8083918 - DNA, 21 bp, Homo sapiens
caggctctgctgggtgctggg

SEQ ID NO: 8083919 - DNA, 22 bp, Homo sapiens
agctgtcctgtgggagggagtg

SEQ ID NO: 8083920 - DNA, 22 bp, Homo sapiens
caggcagagtgaggtggtctaa

SEQ ID NO: 8083921 - DNA, 22 bp, Homo sapiens
caggagcagagggtggtcagca

SEQ ID NO: 8083922 - DNA, 22 bp, Homo sapiens
caggcacaattatttccctttc

SEQ ID NO: 8083923 - DNA, 22 bp, Homo sapiens
caggcacacagggaatttggct

SEQ ID NO: 8083924 - DNA, 22 bp, Homo sapiens
caggagaaacataattttctgg

SEQ ID NO: 8083925 - DNA, 22 bp, Homo sapiens
cagggcagggagcttagaatga

SEQ ID NO: 8083926 - DNA, 22 bp, Homo sapiens
cagggcagggatgttgcggcag

SEQ ID NO: 8083927 - DNA, 22 bp, Homo sapiens
cagggcaggatgctgtgattat

SEQ ID NO: 8083928 - DNA, 22 bp, Homo sapiens
cagggcttactggaggctgctt

SEQ ID NO: 8083929 - DNA, 22 bp, Homo sapiens
cagggcttcgctcctggtgcac

SEQ ID NO: 8083930 - DNA, 22 bp, Homo sapiens
cagggcttcgtgtctcagtgct

SEQ ID NO: 8083931 - DNA, 23 bp, Homo sapiens
aggaagttaaggcagacagacag

SEQ ID NO: 8083932 - DNA, 22 bp, Homo sapiens
cagtaaaagatggaaatagaat

SEQ ID NO: 8083933 - DNA, 22 bp, Homo sapiens
cagtaaattatctcatctctgt

SEQ ID NO: 8083934 - DNA, 22 bp, Homo sapiens
cagtaaatgagaagctagtaat

SEQ ID NO: 8083935 - DNA, 22 bp, Homo sapiens
cagtaactgatgtgatcaaacg

SEQ ID NO: 8083936 - DNA, 22 bp, Homo sapiens
cagtatttcctcttcttaactt

SEQ ID NO: 8083937 - DNA, 22 bp, Homo sapiens
cagtatttcattcagaattgtt

SEQ ID NO: 8083938 - DNA, 22 bp, Homo sapiens
aggcttttgtggtgtggaatgg

SEQ ID NO: 8083939 - DNA, 22 bp, Homo sapiens
aggcttttagaatcttatttct

SEQ ID NO: 8083940 - DNA, 22 bp, Homo sapiens
aggcttttctccagaatgtact

SEQ ID NO: 8083941 - DNA, 22 bp, Homo sapiens
aggcttttatacattgctgacc

SEQ ID NO: 8083942 - DNA, 22 bp, Homo sapiens
aggcttggctctcctatgagaa

SEQ ID NO: 8083943 - DNA, 22 bp, Homo sapiens
agggaccacatcccctctgtgg

SEQ ID NO: 8083944 - DNA, 22 bp, Homo sapiens
cccaggccagaacttggttgct

SEQ ID NO: 8083945 - DNA, 22 bp, Homo sapiens
agggcagcttccatagtctggc

SEQ ID NO: 8083946 - DNA, 22 bp, Homo sapiens
agggccacctctctgggttccc

SEQ ID NO: 8083947 - DNA, 22 bp, Homo sapiens
ccctgaggccctcctggggtct

SEQ ID NO: 8083948 - DNA, 22 bp, Homo sapiens
cccctgccatagtcaaatctaa

SEQ ID NO: 8083949 - DNA, 23 bp, Homo sapiens
cccaggtgtggaggcggtggcag

SEQ ID NO: 8083950 - DNA, 19 bp, Homo sapiens
cccaggtgtttgaggctgc

SEQ ID NO: 8083951 - DNA, 22 bp, Homo sapiens
cccaggtgctgcgtgaagcctc

SEQ ID NO: 8083952 - DNA, 22 bp, Homo sapiens
cccaggtgggttggcctctgtc

SEQ ID NO: 8083953 - DNA, 22 bp, Homo sapiens
aggggctgactggaaagtgcca

SEQ ID NO: 8083954 - DNA, 22 bp, Homo sapiens
aggggctgcctggcttggcact

SEQ ID NO: 8083955 - DNA, 20 bp, Homo sapiens
cctctgtttacaacacaccc

SEQ ID NO: 8083956 - DNA, 22 bp, Homo sapiens
cctctgttgaaaattacaaaca

SEQ ID NO: 8083957 - DNA, 22 bp, Homo sapiens
agggggctccttggtgtgcaga

SEQ ID NO: 8083958 - DNA, 22 bp, Homo sapiens
agggggctgccaaggaatgtaa

SEQ ID NO: 8083959 - DNA, 22 bp, Homo sapiens
agggggctggagacacctcctc

SEQ ID NO: 8083960 - DNA, 22 bp, Homo sapiens
cctacagttatattcttgattg

SEQ ID NO: 8083961 - DNA, 22 bp, Homo sapiens
ccctggccagctcatgtctgag

SEQ ID NO: 8083962 - DNA, 22 bp, Homo sapiens
cccagaggtgcttcagaggtgc

SEQ ID NO: 8083963 - DNA, 20 bp, Homo sapiens
cccagaggttgcggcaggag

SEQ ID NO: 8083964 - DNA, 22 bp, Homo sapiens
cccagaggttccttagggacca

SEQ ID NO: 8083965 - DNA, 22 bp, Homo sapiens
cccagaggtgacatcccattct

SEQ ID NO: 8083966 - DNA, 22 bp, Homo sapiens
ccagtgggtaggccatggtgag

SEQ ID NO: 8083967 - DNA, 22 bp, Homo sapiens
aggctgcagaggtgctgccaga

SEQ ID NO: 8083968 - DNA, 22 bp, Homo sapiens
aggctgcaggtctgggtcatgt

SEQ ID NO: 8083969 - DNA, 22 bp, Homo sapiens
ccagggcagccaacccagatgc

SEQ ID NO: 8083970 - DNA, 22 bp, Homo sapiens
ccagggcagcgcccctccacgc

SEQ ID NO: 8083971 - DNA, 22 bp, Homo sapiens
ccagggcagcagaattggggca

SEQ ID NO: 8083972 - DNA, 22 bp, Homo sapiens
ccagggcagaaaaagagggaat

SEQ ID NO: 8083973 - DNA, 22 bp, Homo sapiens
ccagggcacttaggcccagccc

SEQ ID NO: 8083974 - DNA, 22 bp, Homo sapiens
ccagaggctggcaagggctcct

SEQ ID NO: 8083975 - DNA, 19 bp, Homo sapiens
ccagaggtttgctgggcct

SEQ ID NO: 8083976 - DNA, 21 bp, Homo sapiens
ccagaggttctgggcctccct

SEQ ID NO: 8083977 - DNA, 22 bp, Homo sapiens
ccagaggttacaccctcagccc

SEQ ID NO: 8083978 - DNA, 18 bp, Homo sapiens
ccagaggcccgggcaggc

SEQ ID NO: 8083979 - DNA, 22 bp, Homo sapiens
ccagaggcagacttacactcca

SEQ ID NO: 8083980 - DNA, 22 bp, Homo sapiens
aggcctgggtctcgtgcctacc

SEQ ID NO: 8083981 - DNA, 22 bp, Homo sapiens
aggcctgggcaagaaggggcgt

SEQ ID NO: 8083982 - DNA, 22 bp, Homo sapiens
ccaggaggtctgagtgtggaca

SEQ ID NO: 8083983 - DNA, 22 bp, Homo sapiens
ccaggaggtggcaggacttgcc

SEQ ID NO: 8083984 - DNA, 22 bp, Homo sapiens
atacaacagaaaatgattattc

SEQ ID NO: 8083985 - DNA, 22 bp, Homo sapiens
ataactttcttcacccttgctg

SEQ ID NO: 8083986 - DNA, 22 bp, Homo sapiens
atacaaagctaaatatggtttc

SEQ ID NO: 8083987 - DNA, 22 bp, Homo sapiens
ataagagctatggtgggagttg

SEQ ID NO: 8083988 - DNA, 22 bp, Homo sapiens
ataagagctagtcttttccttg

SEQ ID NO: 8083989 - DNA, 22 bp, Homo sapiens
ataagagctacagccagttctg

SEQ ID NO: 8083990 - DNA, 22 bp, Homo sapiens
ataacagatgcttcagcataaa

SEQ ID NO: 8083991 - DNA, 22 bp, Homo sapiens
ataacagctcttaaacaccata

SEQ ID NO: 8083992 - DNA, 20 bp, Homo sapiens
ctgcagggttagaggctcca

SEQ ID NO: 8083993 - DNA, 22 bp, Homo sapiens
ctgcagggtgacgttgcccacc

SEQ ID NO: 8083994 - DNA, 20 bp, Homo sapiens
ctgcagggtgagtgggcgat

SEQ ID NO: 8083995 - DNA, 22 bp, Homo sapiens
ctgcaggggtgtcctgtattgg

SEQ ID NO: 8083996 - DNA, 22 bp, Homo sapiens
ctgcagggtttttcaaggacaa

SEQ ID NO: 8083997 - DNA, 22 bp, Homo sapiens
ctgcagggttttaacaatggac

SEQ ID NO: 8083998 - DNA, 22 bp, Homo sapiens
ctgcagggtttcgccagttgtg

SEQ ID NO: 8083999 - DNA, 22 bp, Homo sapiens
ctgcagggttcggagagttccc

SEQ ID NO: 8084000 - DNA, 22 bp, Homo sapiens
agttatcaggtgttttcatgga

SEQ ID NO: 8084001 - DNA, 22 bp, Homo sapiens
agttatcatcccttacactttg

SEQ ID NO: 8084002 - DNA, 22 bp, Homo sapiens
agttattactctttaacatatt

SEQ ID NO: 8084003 - DNA, 22 bp, Homo sapiens
agttattaagtcctgttttgag

SEQ ID NO: 8084004 - DNA, 22 bp, Homo sapiens
agttatttactcctttgtctct

SEQ ID NO: 8084005 - DNA, 22 bp, Homo sapiens
ctgcaaggctgaattcagctga

SEQ ID NO: 8084006 - DNA, 22 bp, Homo sapiens
agttatttcagtaacataatag

SEQ ID NO: 8084007 - DNA, 22 bp, Homo sapiens
atacagtataactaataaaccc

SEQ ID NO: 8084008 - DNA, 22 bp, Homo sapiens
atacagtattacctgttcagga

SEQ ID NO: 8084009 - DNA, 21 bp, Homo sapiens
atacattctattaagcattta

SEQ ID NO: 8084010 - DNA, 22 bp, Homo sapiens
atacatagttctgtgaaaagta

SEQ ID NO: 8084011 - DNA, 22 bp, Homo sapiens
ataccttttactcattatccat

SEQ ID NO: 8084012 - DNA, 22 bp, Homo sapiens
ctggagaagtactgagacattt

SEQ ID NO: 8084013 - DNA, 22 bp, Homo sapiens
ctggagaagccaaactagtcac

SEQ ID NO: 8084014 - DNA, 22 bp, Homo sapiens
ctggagaattctatgaaatatt

SEQ ID NO: 8084015 - DNA, 22 bp, Homo sapiens
atagcaattaagctccagaatt

SEQ ID NO: 8084016 - DNA, 22 bp, Homo sapiens
atagcaatggcaacaactaagc

SEQ ID NO: 8084017 - DNA, 22 bp, Homo sapiens
ctggctccatcactgggtgatg

SEQ ID NO: 8084018 - DNA, 22 bp, Homo sapiens
ctggctccatccttgagctctg

SEQ ID NO: 8084019 - DNA, 22 bp, Homo sapiens
ctggctccctcgctgaggtgct

SEQ ID NO: 8084020 - DNA, 22 bp, Homo sapiens
atagcaaatattttaatgagca

SEQ ID NO: 8084021 - DNA, 22 bp, Homo sapiens
atactacatactatgtaaacat

SEQ ID NO: 8084022 - DNA, 22 bp, Homo sapiens
atactacatactatgtaaacat

SEQ ID NO: 8084023 - DNA, 22 bp, Homo sapiens
atactacacattgactatattt

SEQ ID NO: 8084024 - DNA, 22 bp, Homo sapiens
atactacaatcataattgtaca

SEQ ID NO: 8084025 - DNA, 22 bp, Homo sapiens
atactacaaggtatgtgctaaa

SEQ ID NO: 8084026 - DNA, 22 bp, Homo sapiens
atagcaaaaatgaacaaagctt

SEQ ID NO: 8084027 - DNA, 22 bp, Homo sapiens
atagatgttttagtaatactgt

SEQ ID NO: 8084028 - DNA, 22 bp, Homo sapiens
atagattagccctatagtttta

SEQ ID NO: 8084029 - DNA, 22 bp, Homo sapiens
atagcaaagatcacttccttga

SEQ ID NO: 8084030 - DNA, 22 bp, Homo sapiens
atagcaaactggcagcttgtgg

SEQ ID NO: 8084031 - DNA, 22 bp, Homo sapiens
atagcaaaaggcaccagagtga

SEQ ID NO: 8084032 - DNA, 22 bp, Homo sapiens
atagcaaagatgtcaattcccc

SEQ ID NO: 8084033 - DNA, 22 bp, Homo sapiens
atagcaaaggacaatagtcagt

SEQ ID NO: 8084034 - DNA, 20 bp, Homo sapiens
atcagacttttaggaacata

SEQ ID NO: 8084035 - DNA, 22 bp, Homo sapiens
ctgtggccttggaccagcatct

SEQ ID NO: 8084036 - DNA, 22 bp, Homo sapiens
cttagatgaagtcacagaaccc

SEQ ID NO: 8084037 - DNA, 22 bp, Homo sapiens
atctgattcattgaaatgggtg

SEQ ID NO: 8084038 - DNA, 19 bp, Homo sapiens
atctgagattataaacaga

SEQ ID NO: 8084039 - DNA, 22 bp, Homo sapiens
cttcttatctgaaagtaatatt

SEQ ID NO: 8084040 - DNA, 22 bp, Homo sapiens
atctgcatgggtaataacacag

SEQ ID NO: 8084041 - DNA, 22 bp, Homo sapiens
cttcttggaagtcgtccttcca

SEQ ID NO: 8084042 - DNA, 22 bp, Homo sapiens
atctgaaaagctttaatgagct

SEQ ID NO: 8084043 - DNA, 22 bp, Homo sapiens
atctgaaactctgacattgtct

SEQ ID NO: 8084044 - DNA, 22 bp, Homo sapiens
atcagaaaatacccagtgttta

SEQ ID NO: 8084045 - DNA, 22 bp, Homo sapiens
atcagaaagttcatcatgtttg

SEQ ID NO: 8084046 - DNA, 22 bp, Homo sapiens
atcactttggtaccaattcagc

SEQ ID NO: 8084047 - DNA, 22 bp, Homo sapiens
atcaacatgaatttctctgaag

SEQ ID NO: 8084048 - DNA, 22 bp, Homo sapiens
atcaaatcattgcattaatgtt

SEQ ID NO: 8084049 - DNA, 22 bp, Homo sapiens
atcaaattatgtgctacaagaa

SEQ ID NO: 8084050 - DNA, 23 bp, Homo sapiens
atcaaaggatgtagagaagaagc

SEQ ID NO: 8084051 - DNA, 23 bp, Homo sapiens
atcaaactggtgagaatgtcagt

SEQ ID NO: 8084052 - DNA, 22 bp, Homo sapiens
atattcttgtgattataaagta

SEQ ID NO: 8084053 - DNA, 22 bp, Homo sapiens
ctggcttctgggccagggcaga

SEQ ID NO: 8084054 - DNA, 22 bp, Homo sapiens
ctggctgtttcaggcagtgtcc

SEQ ID NO: 8084055 - DNA, 22 bp, Homo sapiens
ctggctgggaagtagagtaggt

SEQ ID NO: 8084056 - DNA, 22 bp, Homo sapiens
atattatagacagagtcttctg

SEQ ID NO: 8084057 - DNA, 22 bp, Homo sapiens
atattatagacagagtcttctg

SEQ ID NO: 8084058 - DNA, 22 bp, Homo sapiens
atattatagacagagtcttctg

SEQ ID NO: 8084059 - DNA, 22 bp, Homo sapiens
atattaaaactatggttttcag

SEQ ID NO: 8084060 - DNA, 22 bp, Homo sapiens
atatgccagctccaagtaagag

SEQ ID NO: 8084061 - DNA, 22 bp, Homo sapiens
atattataagttatttcaagtt

SEQ ID NO: 8084062 - DNA, 22 bp, Homo sapiens
atattataagttatttcaagtt

SEQ ID NO: 8084063 - DNA, 22 bp, Homo sapiens
atattataagttatttcaagtt

SEQ ID NO: 8084064 - DNA, 22 bp, Homo sapiens
agtacacaagacacatttaaaa

SEQ ID NO: 8084065 - DNA, 22 bp, Homo sapiens
cgggctgctctggaccgacagc

SEQ ID NO: 8084066 - DNA, 22 bp, Homo sapiens
cgggcagcggcgtggccatggt

SEQ ID NO: 8084067 - DNA, 22 bp, Homo sapiens
ctacattttgtgattatgaaat

SEQ ID NO: 8084068 - DNA, 22 bp, Homo sapiens
agtatttagctgactcgctaca

SEQ ID NO: 8084069 - DNA, 21 bp, Homo sapiens
ctacagaatcgagcattctgg

SEQ ID NO: 8084070 - DNA, 22 bp, Homo sapiens
agtatttagagacacaagatgg

SEQ ID NO: 8084071 - DNA, 22 bp, Homo sapiens
ctagggtgtgcagattttgcct

SEQ ID NO: 8084072 - DNA, 22 bp, Homo sapiens
ctagaagcaactagatctgttt

SEQ ID NO: 8084073 - DNA, 22 bp, Homo sapiens
ctagaatactcgtattattccc

SEQ ID NO: 8084074 - DNA, 22 bp, Homo sapiens
ctagaatatcatatgaagagac

SEQ ID NO: 8084075 - DNA, 22 bp, Homo sapiens
cctggctctggttccctcagct

SEQ ID NO: 8084076 - DNA, 22 bp, Homo sapiens
cctggctctgggatcttcgctt

SEQ ID NO: 8084077 - DNA, 22 bp, Homo sapiens
cctggctctgcgtgcagctccg

SEQ ID NO: 8084078 - DNA, 22 bp, Homo sapiens
aggtcctgagggttcgtctgca

SEQ ID NO: 8084079 - DNA, 22 bp, Homo sapiens
cctggctctgccacttactgcc

SEQ ID NO: 8084080 - DNA, 22 bp, Homo sapiens
cctggctctgaggtatgcctgg

SEQ ID NO: 8084081 - DNA, 22 bp, Homo sapiens
cctggctctgcagccactccag

SEQ ID NO: 8084082 - DNA, 22 bp, Homo sapiens
ctcctgcctgtgggactgagga

SEQ ID NO: 8084083 - DNA, 18 bp, Homo sapiens
ctccagggaactcagtca

SEQ ID NO: 8084084 - DNA, 20 bp, Homo sapiens
ctccagggaacagactggag

SEQ ID NO: 8084085 - DNA, 22 bp, Homo sapiens
agtggcagatctctggtctgga

SEQ ID NO: 8084086 - DNA, 22 bp, Homo sapiens
ctcctggctttcccagaccagg

SEQ ID NO: 8084087 - DNA, 22 bp, Homo sapiens
agtcctctgctgtgcgtctttg

SEQ ID NO: 8084088 - DNA, 22 bp, Homo sapiens
agtcctctggagtatgccttat

SEQ ID NO: 8084089 - DNA, 22 bp, Homo sapiens
agtcttatgtgatttatctttc

SEQ ID NO: 8084090 - DNA, 22 bp, Homo sapiens
agtcttatggccatctctgatt

SEQ ID NO: 8084091 - DNA, 22 bp, Homo sapiens
agtcttatatcactatgctctg

SEQ ID NO: 8084092 - DNA, 22 bp, Homo sapiens
ctctgcattttaacagatgatt

SEQ ID NO: 8084093 - DNA, 23 bp, Homo sapiens
ctgaaataccagaaaatcagtgt

SEQ ID NO: 8084094 - DNA, 22 bp, Homo sapiens
ctgaaataaagttgctaaaatt

SEQ ID NO: 8084095 - DNA, 22 bp, Homo sapiens
ctgaaatagtttcatagaactt

SEQ ID NO: 8084096 - DNA, 22 bp, Homo sapiens
agttagaaagtaaatcatttga

SEQ ID NO: 8084097 - DNA, 22 bp, Homo sapiens
agttagaatagtcagattgtag

SEQ ID NO: 8084098 - DNA, 22 bp, Homo sapiens
agttaactctgaaaagacattt

SEQ ID NO: 8084099 - DNA, 18 bp, Homo sapiens
ctgaattatctcatcatt

SEQ ID NO: 8084100 - DNA, 22 bp, Homo sapiens
agtgtctgcttatcagttcttg

SEQ ID NO: 8084101 - DNA, 22 bp, Homo sapiens
cagcaaggactgggcatgtgaa

SEQ ID NO: 8084102 - DNA, 22 bp, Homo sapiens
ggtctgccctgggtggaggcgc

SEQ ID NO: 8084103 - DNA, 22 bp, Homo sapiens
cagcaaaggtagaagcacagga

SEQ ID NO: 8084104 - DNA, 18 bp, Homo sapiens
ggtcctgggcctggctca

SEQ ID NO: 8084105 - DNA, 22 bp, Homo sapiens
ggtcatgagggagcagtgcagg

SEQ ID NO: 8084106 - DNA, 22 bp, Homo sapiens
ggtcagtgtttcatctgtgaaa

SEQ ID NO: 8084107 - DNA, 22 bp, Homo sapiens
ggtcagtgtatgtattgataag

SEQ ID NO: 8084108 - DNA, 22 bp, Homo sapiens
ggtcagtgtacacatgtgcagg

SEQ ID NO: 8084109 - DNA, 21 bp, Homo sapiens
ggtcagtggctttcttgcacc

SEQ ID NO: 8084110 - DNA, 22 bp, Homo sapiens
ggtcagtggccaggaagcagtc

SEQ ID NO: 8084111 - DNA, 22 bp, Homo sapiens
ggtcagtggcagggggtacttc

SEQ ID NO: 8084112 - DNA, 22 bp, Homo sapiens
ggtcagtggagccggaaagacc

SEQ ID NO: 8084113 - DNA, 22 bp, Homo sapiens
ggtcagtgctgccagagtgacc

SEQ ID NO: 8084114 - DNA, 22 bp, Homo sapiens
ggtcagtggacaaaggagtttc

SEQ ID NO: 8084115 - DNA, 22 bp, Homo sapiens
ggtcagtgacttttttctgtgg

SEQ ID NO: 8084116 - DNA, 22 bp, Homo sapiens
ggtcagtgaatgtttgagcaga

SEQ ID NO: 8084117 - DNA, 22 bp, Homo sapiens
ggtcagtgagcaaacaaccacg

SEQ ID NO: 8084118 - DNA, 22 bp, Homo sapiens
ggtcagtgagacaatttaagcc

SEQ ID NO: 8084119 - DNA, 22 bp, Homo sapiens
ggtcagtgcctatcatgtgggc

SEQ ID NO: 8084120 - DNA, 23 bp, Homo sapiens
ggtcagtgagttcgtttctctgg

SEQ ID NO: 8084121 - DNA, 22 bp, Homo sapiens
ggtcagtgcgatttcccactcc

SEQ ID NO: 8084122 - DNA, 22 bp, Homo sapiens
ggtcagtgcgtgcccgcgcgtg

SEQ ID NO: 8084123 - DNA, 22 bp, Homo sapiens
cagagggctcttggctgcctgc

SEQ ID NO: 8084124 - DNA, 22 bp, Homo sapiens
gggcagtgtcgaggtctggtcc

SEQ ID NO: 8084125 - DNA, 22 bp, Homo sapiens
gggcagtgtggtcgtgcctttg

SEQ ID NO: 8084126 - DNA, 22 bp, Homo sapiens
gggctgacgaaggccatgtgtg

SEQ ID NO: 8084127 - DNA, 22 bp, Homo sapiens
gggctgacatatttggtgctct

SEQ ID NO: 8084128 - DNA, 22 bp, Homo sapiens
gggcagtgggtggctgcagcct

SEQ ID NO: 8084129 - DNA, 22 bp, Homo sapiens
gggcagtgggaccaggcaccag

SEQ ID NO: 8084130 - DNA, 22 bp, Homo sapiens
gggcagtggtccaggctacagc

SEQ ID NO: 8084131 - DNA, 22 bp, Homo sapiens
gggcagtggttacacagctgag

SEQ ID NO: 8084132 - DNA, 22 bp, Homo sapiens
gggcagcatcaggaggggcttt

SEQ ID NO: 8084133 - DNA, 22 bp, Homo sapiens
gggcagcatgaggaccctcatc

SEQ ID NO: 8084134 - DNA, 22 bp, Homo sapiens
gggcagcataacaatcactgaa

SEQ ID NO: 8084135 - DNA, 22 bp, Homo sapiens
gggcagcaggctccacgttcct

SEQ ID NO: 8084136 - DNA, 22 bp, Homo sapiens
gggcagcagttgccctaatcaa

SEQ ID NO: 8084137 - DNA, 21 bp, Homo sapiens
gggcagcagcagcaacaaggg

SEQ ID NO: 8084138 - DNA, 22 bp, Homo sapiens
gggcagcagaggatcccttaat

SEQ ID NO: 8084139 - DNA, 22 bp, Homo sapiens
gggcagcagcaggaggtctctg

SEQ ID NO: 8084140 - DNA, 22 bp, Homo sapiens
gggcagcagccactcatttagc

SEQ ID NO: 8084141 - DNA, 22 bp, Homo sapiens
gggcagcatttgaaaaacagat

SEQ ID NO: 8084142 - DNA, 22 bp, Homo sapiens
gggcagcatgtcactagcatgg

SEQ ID NO: 8084143 - DNA, 22 bp, Homo sapiens
gggcagcattctgtgggcaggt

SEQ ID NO: 8084144 - DNA, 22 bp, Homo sapiens
gggcagcagagccctgccgagt

SEQ ID NO: 8084145 - DNA, 22 bp, Homo sapiens
cagactgggagtcaggaagaag

SEQ ID NO: 8084146 - DNA, 17 bp, Homo sapiens
ggcttcagggagctggg

SEQ ID NO: 8084147 - DNA, 22 bp, Homo sapiens
gtcccaggcttatgtggagctt

SEQ ID NO: 8084148 - DNA, 22 bp, Homo sapiens
gtcccaggctccatggcagcca

SEQ ID NO: 8084149 - DNA, 22 bp, Homo sapiens
gtctcttgtggatgttgggaag

SEQ ID NO: 8084150 - DNA, 22 bp, Homo sapiens
cagcaggctgcgattgctcatt

SEQ ID NO: 8084151 - DNA, 22 bp, Homo sapiens
cagcaggctctgagtggctgcc

SEQ ID NO: 8084152 - DNA, 22 bp, Homo sapiens
gtcccagaggctttggccacag

SEQ ID NO: 8084153 - DNA, 22 bp, Homo sapiens
gtcccaggcaggccactggcag

SEQ ID NO: 8084154 - DNA, 22 bp, Homo sapiens
gtcccaggagttgctgggcctt

SEQ ID NO: 8084155 - DNA, 22 bp, Homo sapiens
gtcatggtgctcatcattggtg

SEQ ID NO: 8084156 - DNA, 23 bp, Homo sapiens
gtcatctctcctgggccagcgcc

SEQ ID NO: 8084157 - DNA, 22 bp, Homo sapiens
gtgccccagacacgcatgtggg

SEQ ID NO: 8084158 - DNA, 22 bp, Homo sapiens
cagccctggcccaggtgcctta

SEQ ID NO: 8084159 - DNA, 22 bp, Homo sapiens
cagcctgtctgggcagagtgga

SEQ ID NO: 8084160 - DNA, 22 bp, Homo sapiens
cagctatagatggactgaagag

SEQ ID NO: 8084161 - DNA, 22 bp, Homo sapiens
ggccgtcagccccgatttgcca

SEQ ID NO: 8084162 - DNA, 22 bp, Homo sapiens
ggccactccgctgctactggaa

SEQ ID NO: 8084163 - DNA, 22 bp, Homo sapiens
ggccactcggccacccctgccg

SEQ ID NO: 8084164 - DNA, 22 bp, Homo sapiens
ggcattctaggccaaaatcagg

SEQ ID NO: 8084165 - DNA, 22 bp, Homo sapiens
ggcattatctgagcacgtaata

SEQ ID NO: 8084166 - DNA, 22 bp, Homo sapiens
ggcatttacataatcttattta

SEQ ID NO: 8084167 - DNA, 22 bp, Homo sapiens
ggcagggagtggagactcccta

SEQ ID NO: 8084168 - DNA, 22 bp, Homo sapiens
ggcagggcaggaaagtcaggaa

SEQ ID NO: 8084169 - DNA, 22 bp, Homo sapiens
ggcaggtgccagttggcttggg

SEQ ID NO: 8084170 - DNA, 20 bp, Homo sapiens
ggcaggcaggaggtttccag

SEQ ID NO: 8084171 - DNA, 22 bp, Homo sapiens
cacatttctaggaaattaaatg

SEQ ID NO: 8084172 - DNA, 22 bp, Homo sapiens
cacatttccttggcctttaatt

SEQ ID NO: 8084173 - DNA, 22 bp, Homo sapiens
cacatttagaggttagcatggt

SEQ ID NO: 8084174 - DNA, 22 bp, Homo sapiens
cacaggcttttttggctgatgt

SEQ ID NO: 8084175 - DNA, 22 bp, Homo sapiens
cacataagaaatgaatatgaga

SEQ ID NO: 8084176 - DNA, 19 bp, Homo sapiens
ggctcagggcgctgccgcc

SEQ ID NO: 8084177 - DNA, 22 bp, Homo sapiens
ggcctgggctccgggagttact

SEQ ID NO: 8084178 - DNA, 22 bp, Homo sapiens
cactttaactcacatttcagct

SEQ ID NO: 8084179 - DNA, 22 bp, Homo sapiens
cacttttaacaggagaattccc

SEQ ID NO: 8084180 - DNA, 22 bp, Homo sapiens
ggctgccccagtgctcatggct

SEQ ID NO: 8084181 - DNA, 22 bp, Homo sapiens
ggctgccccatgggctgggctg

SEQ ID NO: 8084182 - DNA, 22 bp, Homo sapiens
cagaaagccaactccaactgtc

SEQ ID NO: 8084183 - DNA, 22 bp, Homo sapiens
cagaaagccgacttacaatgga

SEQ ID NO: 8084184 - DNA, 22 bp, Homo sapiens
cagaaagccgacttacaatgga

SEQ ID NO: 8084185 - DNA, 22 bp, Homo sapiens
cagaaagcttggtacaatatgc

SEQ ID NO: 8084186 - DNA, 22 bp, Homo sapiens
cagaaagcttaggcaagttgga

SEQ ID NO: 8084187 - DNA, 22 bp, Homo sapiens
cagaaaggtatgtgtgcctttg

SEQ ID NO: 8084188 - DNA, 22 bp, Homo sapiens
cagaaagtgatttgctattcca

SEQ ID NO: 8084189 - DNA, 18 bp, Homo sapiens
cagaaagttatttactct

SEQ ID NO: 8084190 - DNA, 23 bp, Homo sapiens
cagaaagtttgagaagatacatc

SEQ ID NO: 8084191 - DNA, 23 bp, Homo sapiens
cagaaataaactggtttgtagat

SEQ ID NO: 8084192 - DNA, 22 bp, Homo sapiens
ggctgtcagggtgagctggctt

SEQ ID NO: 8084193 - DNA, 22 bp, Homo sapiens
gctttcttatttagaagatttg

SEQ ID NO: 8084194 - DNA, 22 bp, Homo sapiens
caagttttctgggttcagagca

SEQ ID NO: 8084195 - DNA, 22 bp, Homo sapiens
caagtttacaatgtgtatgtgt

SEQ ID NO: 8084196 - DNA, 22 bp, Homo sapiens
caagttttagaaatatctggat

SEQ ID NO: 8084197 - DNA, 22 bp, Homo sapiens
caagttttgattttgcagtaaa

SEQ ID NO: 8084198 - DNA, 22 bp, Homo sapiens
caagttttgcatagttctgtat

SEQ ID NO: 8084199 - DNA, 22 bp, Homo sapiens
caataaagaagatttttgcaat

SEQ ID NO: 8084200 - DNA, 22 bp, Homo sapiens
caagtttaaggcactgataagt

SEQ ID NO: 8084201 - DNA, 22 bp, Homo sapiens
gctgttcacattttgggccaaa

SEQ ID NO: 8084202 - DNA, 22 bp, Homo sapiens
caagtcaatgattataagagtc

SEQ ID NO: 8084203 - DNA, 22 bp, Homo sapiens
caagtacaaaatgatatttagt

SEQ ID NO: 8084204 - DNA, 18 bp, Homo sapiens
caagtatagaattaggtt

SEQ ID NO: 8084205 - DNA, 22 bp, Homo sapiens
caaatgtaaattcttttgaagc

SEQ ID NO: 8084206 - DNA, 22 bp, Homo sapiens
caagcatttattataattatca

SEQ ID NO: 8084207 - DNA, 22 bp, Homo sapiens
caagccagtgatgtttgctgcc

SEQ ID NO: 8084208 - DNA, 22 bp, Homo sapiens
cacagatgaagtaaacaactct

SEQ ID NO: 8084209 - DNA, 22 bp, Homo sapiens
cacagagttgaatattgacatt

SEQ ID NO: 8084210 - DNA, 22 bp, Homo sapiens
cacaggctgggaagcctaggcc

SEQ ID NO: 8084211 - DNA, 22 bp, Homo sapiens
ggaggccaaagtgtgggcggct

SEQ ID NO: 8084212 - DNA, 22 bp, Homo sapiens
cacagctttgctttccttaata

SEQ ID NO: 8084213 - DNA, 22 bp, Homo sapiens
cacaggaatctgcattttgacc

SEQ ID NO: 8084214 - DNA, 22 bp, Homo sapiens
cacaggaatataagtttgagtt

SEQ ID NO: 8084215 - DNA, 22 bp, Homo sapiens
cacagaagtgtgtataactctt

SEQ ID NO: 8084216 - DNA, 22 bp, Homo sapiens
cacagaataattcacatggctc

SEQ ID NO: 8084217 - DNA, 22 bp, Homo sapiens
cacacagacagctctctgaaga

SEQ ID NO: 8084218 - DNA, 22 bp, Homo sapiens
ggactgggagaatggaggcaag

SEQ ID NO: 8084219 - DNA, 22 bp, Homo sapiens
ggactgggcatgggtgctctgc

SEQ ID NO: 8084220 - DNA, 22 bp, Homo sapiens
ggactggggccaacacctccct

SEQ ID NO: 8084221 - DNA, 17 bp, Homo sapiens
ggactgggcggggcagg

SEQ ID NO: 8084222 - DNA, 22 bp, Homo sapiens
cacagaggcaaccttctggggt

SEQ ID NO: 8084223 - DNA, 22 bp, Homo sapiens
cacagaggatttttagggcagt

SEQ ID NO: 8084224 - DNA, 22 bp, Homo sapiens
gaaagtatttacattaacatct

SEQ ID NO: 8084225 - DNA, 22 bp, Homo sapiens
gaaagtattagcctagaagtca

SEQ ID NO: 8084226 - DNA, 22 bp, Homo sapiens
gaaagtattagcctagaagtca

SEQ ID NO: 8084227 - DNA, 20 bp, Homo sapiens
gaaatacttacccaactgtt

SEQ ID NO: 8084228 - DNA, 22 bp, Homo sapiens
gaaatacaggaatgccacacag

SEQ ID NO: 8084229 - DNA, 22 bp, Homo sapiens
gaaatacagttgggaggaggta

SEQ ID NO: 8084230 - DNA, 19 bp, Homo sapiens
atgatacaggtgaaaattg

SEQ ID NO: 8084231 - DNA, 22 bp, Homo sapiens
atgatcaagaattttgtattcc

SEQ ID NO: 8084232 - DNA, 22 bp, Homo sapiens
atgatattattctagcccagag

SEQ ID NO: 8084233 - DNA, 22 bp, Homo sapiens
gaaacattgtgttctacagatt

SEQ ID NO: 8084234 - DNA, 22 bp, Homo sapiens
ctttctttcgaagacgtgatta

SEQ ID NO: 8084235 - DNA, 22 bp, Homo sapiens
ctttcttctccctcaatattac

SEQ ID NO: 8084236 - DNA, 22 bp, Homo sapiens
gaaacatagttgagacactgct

SEQ ID NO: 8084237 - DNA, 20 bp, Homo sapiens
atgaaattcctgttttctga

SEQ ID NO: 8084238 - DNA, 22 bp, Homo sapiens
atgaaaatgtacatgtgtataa

SEQ ID NO: 8084239 - DNA, 22 bp, Homo sapiens
ctttctgaaagacattttaact

SEQ ID NO: 8084240 - DNA, 22 bp, Homo sapiens
ctttcttaatttttaaggacac

SEQ ID NO: 8084241 - DNA, 22 bp, Homo sapiens
ctttcttatacctgtcagggcc

SEQ ID NO: 8084242 - DNA, 19 bp, Homo sapiens
ctttccaggagatgctgag

SEQ ID NO: 8084243 - DNA, 22 bp, Homo sapiens
cttctttaatgtatacaaaaga

SEQ ID NO: 8084244 - DNA, 22 bp, Homo sapiens
gaatacaaataataccaaggtg

SEQ ID NO: 8084245 - DNA, 22 bp, Homo sapiens
gaatacaaagcagaactcatac

SEQ ID NO: 8084246 - DNA, 22 bp, Homo sapiens
gaataacattttttcctttaca

SEQ ID NO: 8084247 - DNA, 22 bp, Homo sapiens
gacaataaagtgatacatggga

SEQ ID NO: 8084248 - DNA, 22 bp, Homo sapiens
gaatatttttaaagggactaat

SEQ ID NO: 8084249 - DNA, 22 bp, Homo sapiens
atgcacagaacaattttaagag

SEQ ID NO: 8084250 - DNA, 22 bp, Homo sapiens
gaccacagaagccttgataggg

SEQ ID NO: 8084251 - DNA, 22 bp, Homo sapiens
gacaattaggttaagagcaaga

SEQ ID NO: 8084252 - DNA, 22 bp, Homo sapiens
gacacaaagtttgtcagaaatt

SEQ ID NO: 8084253 - DNA, 21 bp, Homo sapiens
gacacaaagggtagtaatggt

SEQ ID NO: 8084254 - DNA, 22 bp, Homo sapiens
gacaccagtaaatattcaaaag

SEQ ID NO: 8084255 - DNA, 22 bp, Homo sapiens
gactacagatagccaattaagt

SEQ ID NO: 8084256 - DNA, 22 bp, Homo sapiens
gactgggccaaggtcagcagct

SEQ ID NO: 8084257 - DNA, 22 bp, Homo sapiens
atgtccttttatttaaagcagg

SEQ ID NO: 8084258 - DNA, 22 bp, Homo sapiens
atgtctcagagtggtcactggg

SEQ ID NO: 8084259 - DNA, 22 bp, Homo sapiens
atgtccttcggacaaaattctt

SEQ ID NO: 8084260 - DNA, 22 bp, Homo sapiens
atgtccttgtgagtaaatgatg

SEQ ID NO: 8084261 - DNA, 22 bp, Homo sapiens
gagggctgaagattgtggcccc

SEQ ID NO: 8084262 - DNA, 22 bp, Homo sapiens
atgtgactccaggcagttttgt

SEQ ID NO: 8084263 - DNA, 22 bp, Homo sapiens
atgtttaaagggttgagaaata

SEQ ID NO: 8084264 - DNA, 22 bp, Homo sapiens
atgtttaaagggttgagaaata

SEQ ID NO: 8084265 - DNA, 22 bp, Homo sapiens
atgtttaaggaactggtttgct

SEQ ID NO: 8084266 - DNA, 22 bp, Homo sapiens
atgtttaagaaagtcttccata

SEQ ID NO: 8084267 - DNA, 21 bp, Homo sapiens
atgttggaatccaaaaacatt

SEQ ID NO: 8084268 - DNA, 22 bp, Homo sapiens
gatacaaaatataaatggagag

SEQ ID NO: 8084269 - DNA, 22 bp, Homo sapiens
gatacaaaatataaatggagag

SEQ ID NO: 8084270 - DNA, 22 bp, Homo sapiens
atgttattttggaaaatacaaa

SEQ ID NO: 8084271 - DNA, 22 bp, Homo sapiens
atggtgaagcttcatgggtgtt

SEQ ID NO: 8084272 - DNA, 22 bp, Homo sapiens
atgggcagggcagtgtataaga

SEQ ID NO: 8084273 - DNA, 18 bp, Homo sapiens
atgggcaggtaagatcca

SEQ ID NO: 8084274 - DNA, 22 bp, Homo sapiens
atggctttccggactttggcca

SEQ ID NO: 8084275 - DNA, 22 bp, Homo sapiens
atggctttcctgggacatgggc

SEQ ID NO: 8084276 - DNA, 22 bp, Homo sapiens
atggctttcagatttctatgtt

SEQ ID NO: 8084277 - DNA, 22 bp, Homo sapiens
atggctttcagatggtgaaaga

SEQ ID NO: 8084278 - DNA, 22 bp, Homo sapiens
atggctttgctcaagtttagcc

SEQ ID NO: 8084279 - DNA, 22 bp, Homo sapiens
atggctttggtgtgaccctggg

SEQ ID NO: 8084280 - DNA, 17 bp, Homo sapiens
atggctttgtcacacag

SEQ ID NO: 8084281 - DNA, 22 bp, Homo sapiens
atggctttgactgtaagtggta

SEQ ID NO: 8084282 - DNA, 22 bp, Homo sapiens
atggctttgaagttcagctttt

SEQ ID NO: 8084283 - DNA, 22 bp, Homo sapiens
atggctttctctaatgtggtat

SEQ ID NO: 8084284 - DNA, 22 bp, Homo sapiens
atggctttctgtgtttccgtag

SEQ ID NO: 8084285 - DNA, 22 bp, Homo sapiens
atggctttgaagtaatgtaatt

SEQ ID NO: 8084286 - DNA, 22 bp, Homo sapiens
atggctttgtgttcagagctga

SEQ ID NO: 8084287 - DNA, 22 bp, Homo sapiens
atggcttttaactttgatggca

SEQ ID NO: 8084288 - DNA, 22 bp, Homo sapiens
atggctttgttccaataaaact

SEQ ID NO: 8084289 - DNA, 22 bp, Homo sapiens
atggcttttcacagagggttct

SEQ ID NO: 8084290 - DNA, 22 bp, Homo sapiens
atggctttttagactttggtac

SEQ ID NO: 8084291 - DNA, 22 bp, Homo sapiens
atggcttttgatgctaagccaa

SEQ ID NO: 8084292 - DNA, 22 bp, Homo sapiens
atggcttttgatcaaaagaaat

SEQ ID NO: 8084293 - DNA, 21 bp, Homo sapiens
atggcttttttaaagcttgtg

SEQ ID NO: 8084294 - DNA, 22 bp, Homo sapiens
atggcttttttcttgggcactc

SEQ ID NO: 8084295 - DNA, 22 bp, Homo sapiens
atggcattcacatttccagaga

SEQ ID NO: 8084296 - DNA, 22 bp, Homo sapiens
atggcattaggaccatgagcct

SEQ ID NO: 8084297 - DNA, 22 bp, Homo sapiens
atggcatttatgttgacaatgg

SEQ ID NO: 8084298 - DNA, 22 bp, Homo sapiens
atggcattgctgtgctccactg

SEQ ID NO: 8084299 - DNA, 22 bp, Homo sapiens
atggcatttgaccgctttgtgg

SEQ ID NO: 8084300 - DNA, 22 bp, Homo sapiens
atggcatttttagacagtcctt

SEQ ID NO: 8084301 - DNA, 22 bp, Homo sapiens
atggccaagaatatttctcaac

SEQ ID NO: 8084302 - DNA, 22 bp, Homo sapiens
atggccaccatctctaaaacac

SEQ ID NO: 8084303 - DNA, 22 bp, Homo sapiens
gagagcagactctcaaagctgg

SEQ ID NO: 8084304 - DNA, 22 bp, Homo sapiens
gccacaggtgggctctgggaaa

SEQ ID NO: 8084305 - DNA, 22 bp, Homo sapiens
gccacaggtactatgggagaga

SEQ ID NO: 8084306 - DNA, 22 bp, Homo sapiens
gccacaggtcggctagagggtc

SEQ ID NO: 8084307 - DNA, 22 bp, Homo sapiens
atttccatacacccatttctga

SEQ ID NO: 8084308 - DNA, 22 bp, Homo sapiens
atttccatgaaggcagatttta

SEQ ID NO: 8084309 - DNA, 22 bp, Homo sapiens
atttccatgaagtttagttata

SEQ ID NO: 8084310 - DNA, 22 bp, Homo sapiens
atttccatgtccaaaaattagt

SEQ ID NO: 8084311 - DNA, 22 bp, Homo sapiens
atttccatgtcggtattttata

SEQ ID NO: 8084312 - DNA, 22 bp, Homo sapiens
atttccattatcatgacaaatt

SEQ ID NO: 8084313 - DNA, 22 bp, Homo sapiens
atttctgtagtccacattcttt

SEQ ID NO: 8084314 - DNA, 22 bp, Homo sapiens
atttctgataaacgtaagctgc

SEQ ID NO: 8084315 - DNA, 22 bp, Homo sapiens
atttctgttgcttataaattac

SEQ ID NO: 8084316 - DNA, 22 bp, Homo sapiens
atttctgtggcttcattctcct

SEQ ID NO: 8084317 - DNA, 22 bp, Homo sapiens
atttctgtatcctgctgtcaga

SEQ ID NO: 8084318 - DNA, 22 bp, Homo sapiens
atttgccttttaaactcacaat

SEQ ID NO: 8084319 - DNA, 22 bp, Homo sapiens
atttgctagcaagtattctgaa

SEQ ID NO: 8084320 - DNA, 22 bp, Homo sapiens
atttggaaaagtttcttcaact

SEQ ID NO: 8084321 - DNA, 22 bp, Homo sapiens
atttggaaaagcggtaacttgc

SEQ ID NO: 8084322 - DNA, 22 bp, Homo sapiens
atttggaaatacgcgcttttgg

SEQ ID NO: 8084323 - DNA, 22 bp, Homo sapiens
atttggaaatgcatctcttgag

SEQ ID NO: 8084324 - DNA, 22 bp, Homo sapiens
atttggaaacatgctgaccatg

SEQ ID NO: 8084325 - DNA, 19 bp, Homo sapiens
atttggaaataaggtcttc

SEQ ID NO: 8084326 - DNA, 22 bp, Homo sapiens
atttggaaacaaatggtttcgc

SEQ ID NO: 8084327 - DNA, 22 bp, Homo sapiens
atttggaaaatctggttataga

SEQ ID NO: 8084328 - DNA, 22 bp, Homo sapiens
atttggaaacaattatattctt

SEQ ID NO: 8084329 - DNA, 22 bp, Homo sapiens
gcccccagacctcagtgggctg

SEQ ID NO: 8084330 - DNA, 18 bp, Homo sapiens
gcccccagatgctactga

SEQ ID NO: 8084331 - DNA, 22 bp, Homo sapiens
gcccccaggtgacttatccaca

SEQ ID NO: 8084332 - DNA, 22 bp, Homo sapiens
gcccccaggctctggagaacct

SEQ ID NO: 8084333 - DNA, 22 bp, Homo sapiens
gcccccaggcactacatgtgaa

SEQ ID NO: 8084334 - DNA, 22 bp, Homo sapiens
atttggaaatgtaagaatgcaa

SEQ ID NO: 8084335 - DNA, 22 bp, Homo sapiens
atttggaacaaatattagtaaa

SEQ ID NO: 8084336 - DNA, 22 bp, Homo sapiens
atttggaactgggcatgcaaac

SEQ ID NO: 8084337 - DNA, 22 bp, Homo sapiens
atttggaacttataataagttt

SEQ ID NO: 8084338 - DNA, 22 bp, Homo sapiens
atttggaagaaatctgtcacag

SEQ ID NO: 8084339 - DNA, 22 bp, Homo sapiens
atttggaatagctgtagaaata

SEQ ID NO: 8084340 - DNA, 22 bp, Homo sapiens
atttggaagtttttgtgggaat

SEQ ID NO: 8084341 - DNA, 22 bp, Homo sapiens
atttggaagtttggagtgaagg

SEQ ID NO: 8084342 - DNA, 22 bp, Homo sapiens
atttggaaggcgtttctctgta

SEQ ID NO: 8084343 - DNA, 22 bp, Homo sapiens
atttggaaggtttacaaagaga

SEQ ID NO: 8084344 - DNA, 22 bp, Homo sapiens
atttggaagcatttccaaagca

SEQ ID NO: 8084345 - DNA, 22 bp, Homo sapiens
atttggaagcttgaagattatt

SEQ ID NO: 8084346 - DNA, 22 bp, Homo sapiens
atttggaaggagctgcacagca

SEQ ID NO: 8084347 - DNA, 22 bp, Homo sapiens
atttggaatgctagtgaatgta

SEQ ID NO: 8084348 - DNA, 22 bp, Homo sapiens
atttggaatgggagcctggcat

SEQ ID NO: 8084349 - DNA, 22 bp, Homo sapiens
atttggaatggtctggcatttg

SEQ ID NO: 8084350 - DNA, 22 bp, Homo sapiens
atttggaatgtgtttgatcacc

SEQ ID NO: 8084351 - DNA, 22 bp, Homo sapiens
atttggaatggtctggcatttg

SEQ ID NO: 8084352 - DNA, 22 bp, Homo sapiens
atttttcagcttcattgaggca

SEQ ID NO: 8084353 - DNA, 22 bp, Homo sapiens
caaacattcagatgcaatggta

SEQ ID NO: 8084354 - DNA, 22 bp, Homo sapiens
caaacattcaagtacaagtctt

SEQ ID NO: 8084355 - DNA, 22 bp, Homo sapiens
caaagcaggaagaatattgaaa

SEQ ID NO: 8084356 - DNA, 22 bp, Homo sapiens
caaaatgatgtgattttattgt

SEQ ID NO: 8084357 - DNA, 22 bp, Homo sapiens
caaacaatttgcatttccttag

SEQ ID NO: 8084358 - DNA, 22 bp, Homo sapiens
caaatactgggtaagttaattt

SEQ ID NO: 8084359 - DNA, 22 bp, Homo sapiens
caaatagaactcacagacaaga

SEQ ID NO: 8084360 - DNA, 22 bp, Homo sapiens
caaatgcatgagaaataagagg

SEQ ID NO: 8084361 - DNA, 22 bp, Homo sapiens
caaatgatacctattactaggc

SEQ ID NO: 8084362 - DNA, 22 bp, Homo sapiens
gctgactgagctggcttttcgt

SEQ ID NO: 8084363 - DNA, 22 bp, Homo sapiens
gctgacagcaaggggctgccct

SEQ ID NO: 8084364 - DNA, 22 bp, Homo sapiens
gctgacagttgtacctgcccct

SEQ ID NO: 8084365 - DNA, 22 bp, Homo sapiens
caaatagactctagaatttatt

SEQ ID NO: 8084366 - DNA, 21 bp, Homo sapiens
gctcttggaaggggctcagct

SEQ ID NO: 8084367 - DNA, 21 bp, Homo sapiens
attcagaaagggaataaactc

SEQ ID NO: 8084368 - DNA, 22 bp, Homo sapiens
attcactgtcagcttgcatggg

SEQ ID NO: 8084369 - DNA, 22 bp, Homo sapiens
attcaaggtatttaaaacataa

SEQ ID NO: 8084370 - DNA, 22 bp, Homo sapiens
attcaagattaattctatgtca

SEQ ID NO: 8084371 - DNA, 22 bp, Homo sapiens
attcaagaggaacaatgaagat

SEQ ID NO: 8084372 - DNA, 22 bp, Homo sapiens
attcacaatgatacataagcga

SEQ ID NO: 8084373 - DNA, 22 bp, Homo sapiens
attcagttccttgtgattgtag

SEQ ID NO: 8084374 - DNA, 22 bp, Homo sapiens
attcagttctgctggttctgct

SEQ ID NO: 8084375 - DNA, 22 bp, Homo sapiens
attcagttctaaggtcagtgcc

SEQ ID NO: 8084376 - DNA, 22 bp, Homo sapiens
attcagttctggctgccttcct

SEQ ID NO: 8084377 - DNA, 22 bp, Homo sapiens
attcagtttcaatcattgtagt

SEQ ID NO: 8084378 - DNA, 23 bp, Homo sapiens
attcagttgtgagagaagacaca

SEQ ID NO: 8084379 - DNA, 22 bp, Homo sapiens
attcagttgtctactactgcct

SEQ ID NO: 8084380 - DNA, 22 bp, Homo sapiens
attcagttgtaatctttgttag

SEQ ID NO: 8084381 - DNA, 22 bp, Homo sapiens
attcagtttcatggcacagcta

SEQ ID NO: 8084382 - DNA, 21 bp, Homo sapiens
attcagtttgacatctagcag

SEQ ID NO: 8084383 - DNA, 22 bp, Homo sapiens
attcagtttttattggaccagc

SEQ ID NO: 8084384 - DNA, 22 bp, Homo sapiens
attcataacggcaaatgtcacc

SEQ ID NO: 8084385 - DNA, 22 bp, Homo sapiens
attcagtttttgaagggaaatt

SEQ ID NO: 8084386 - DNA, 22 bp, Homo sapiens
attcatatcatagagttattga

SEQ ID NO: 8084387 - DNA, 22 bp, Homo sapiens
attcataagtaaatgattacct

SEQ ID NO: 8084388 - DNA, 22 bp, Homo sapiens
attacagttaatttaccttctt

SEQ ID NO: 8084389 - DNA, 22 bp, Homo sapiens
gatattcaagtggaattattct

SEQ ID NO: 8084390 - DNA, 22 bp, Homo sapiens
attacaatcgagagaaacaaat

SEQ ID NO: 8084391 - DNA, 22 bp, Homo sapiens
attagatacacagatttccact

SEQ ID NO: 8084392 - DNA, 22 bp, Homo sapiens
attagcttatcacacaagctgc

SEQ ID NO: 8084393 - DNA, 22 bp, Homo sapiens
attcaaagtactagctattttt

SEQ ID NO: 8084394 - DNA, 22 bp, Homo sapiens
attcaaagtaataaccagaact

SEQ ID NO: 8084395 - DNA, 22 bp, Homo sapiens
attcaagagcccatgtttcctg

SEQ ID NO: 8084396 - DNA, 22 bp, Homo sapiens
gcagggctgggacttactggta

SEQ ID NO: 8084397 - DNA, 22 bp, Homo sapiens
gcagggctgagtcatgtgtgcc

SEQ ID NO: 8084398 - DNA, 22 bp, Homo sapiens
gcagggctgatggcttccctca

SEQ ID NO: 8084399 - DNA, 22 bp, Homo sapiens
attgcaaaattgtcctgtggaa

SEQ ID NO: 8084400 - DNA, 22 bp, Homo sapiens
attgcaaagaaatacatgctta

SEQ ID NO: 8084401 - DNA, 22 bp, Homo sapiens
attgataaattgcaatggggct

SEQ ID NO: 8084402 - DNA, 22 bp, Homo sapiens
attgactagagtcacagttgca

SEQ ID NO: 8084403 - DNA, 23 bp, Homo sapiens
attgactctaagagattcttgaa

SEQ ID NO: 8084404 - DNA, 22 bp, Homo sapiens
attctttcaaggaatagttatt

SEQ ID NO: 8084405 - DNA, 22 bp, Homo sapiens
attccttgggaattattgaatg

SEQ ID NO: 8084406 - DNA, 22 bp, Homo sapiens
attccttgggctgccttattat

SEQ ID NO: 8084407 - DNA, 22 bp, Homo sapiens
attcttgcttcacactcctctg

SEQ ID NO: 8084408 - DNA, 22 bp, Homo sapiens
attccttgctctcatcaacctt

SEQ ID NO: 8084409 - DNA, 22 bp, Homo sapiens
attccttgcacatcagatagtt

SEQ ID NO: 8084410 - DNA, 22 bp, Homo sapiens
gcattctctctctaaatgttgt

SEQ ID NO: 8084411 - DNA, 22 bp, Homo sapiens
gccaaagtacctagccctctgc

SEQ ID NO: 8084412 - DNA, 22 bp, Homo sapiens
gccacagggcgagcggaggcca

SEQ ID NO: 8084413 - DNA, 22 bp, Homo sapiens
gccacagggattgttttgtgag

SEQ ID NO: 8084414 - DNA, 22 bp, Homo sapiens
attgtcattccagtcattgtta

SEQ ID NO: 8084415 - DNA, 22 bp, Homo sapiens
attgtcattggcttctatgtct

SEQ ID NO: 8084416 - DNA, 22 bp, Homo sapiens
gcagtgcttgaagaggtggcca

SEQ ID NO: 8084417 - DNA, 22 bp, Homo sapiens
gcatacagagaggatgtggcat

SEQ ID NO: 8084418 - DNA, 22 bp, Homo sapiens
tgggctgctgcggtgctcttgg

SEQ ID NO: 8084419 - DNA, 22 bp, Homo sapiens
tgggctgctgagaatgagagag

SEQ ID NO: 8084420 - DNA, 22 bp, Homo sapiens
tgggctgctgtctgcacatgct

SEQ ID NO: 8084421 - DNA, 22 bp, Homo sapiens
tgggctgcggataggcctcgga

SEQ ID NO: 8084422 - DNA, 22 bp, Homo sapiens
tgggctgcttctcaaatgtctc

SEQ ID NO: 8084423 - DNA, 22 bp, Homo sapiens
tgggctgcttcctcagctgaga

SEQ ID NO: 8084424 - DNA, 22 bp, Homo sapiens
tgggctgctgttacaggggctg

SEQ ID NO: 8084425 - DNA, 22 bp, Homo sapiens
tgggctgcttctattggtggtc

SEQ ID NO: 8084426 - DNA, 22 bp, Homo sapiens
cctcttctaccatttacatttt

SEQ ID NO: 8084427 - DNA, 22 bp, Homo sapiens
cctcttctaggtttcagcctgc

SEQ ID NO: 8084428 - DNA, 18 bp, Homo sapiens
tgggagtgggagtggata

SEQ ID NO: 8084429 - DNA, 22 bp, Homo sapiens
tgggaagctgcattttaacaag

SEQ ID NO: 8084430 - DNA, 22 bp, Homo sapiens
tggcccagatctctgaccttga

SEQ ID NO: 8084431 - DNA, 22 bp, Homo sapiens
tggcccagcactccaagtaggg

SEQ ID NO: 8084432 - DNA, 22 bp, Homo sapiens
cctcagtttatcctctgtaaca

SEQ ID NO: 8084433 - DNA, 22 bp, Homo sapiens
tggcctggctgccctgtctgga

SEQ ID NO: 8084434 - DNA, 22 bp, Homo sapiens
tggcctggggacctgtgagacc

SEQ ID NO: 8084435 - DNA, 22 bp, Homo sapiens
tggcctgggcctgccggtgcaa

SEQ ID NO: 8084436 - DNA, 22 bp, Homo sapiens
tggcctgggccggcagatatac

SEQ ID NO: 8084437 - DNA, 22 bp, Homo sapiens
tggctctgagacacaggctctc

SEQ ID NO: 8084438 - DNA, 21 bp, Homo sapiens
cccttcttgggtcaaagtata

SEQ ID NO: 8084439 - DNA, 22 bp, Homo sapiens
ccctgcagccttgcatgccttc

SEQ ID NO: 8084440 - DNA, 22 bp, Homo sapiens
ccctgcaggggacctgcagcct

SEQ ID NO: 8084441 - DNA, 22 bp, Homo sapiens
tggcagggtggcaacttttggt

SEQ ID NO: 8084442 - DNA, 22 bp, Homo sapiens
tggcagggtgggcttcagcccc

SEQ ID NO: 8084443 - DNA, 22 bp, Homo sapiens
tggcagggttggccaccttacc

SEQ ID NO: 8084444 - DNA, 22 bp, Homo sapiens
cccagggtagctgagctggcag

SEQ ID NO: 8084445 - DNA, 22 bp, Homo sapiens
cccagggtgcggccctggctgg

SEQ ID NO: 8084446 - DNA, 22 bp, Homo sapiens
cccagggtaatcatgtgaagcc

SEQ ID NO: 8084447 - DNA, 22 bp, Homo sapiens
cccaggggttctgagcagcagc

SEQ ID NO: 8084448 - DNA, 22 bp, Homo sapiens
cccaggggttcaaggctgcagt

SEQ ID NO: 8084449 - DNA, 22 bp, Homo sapiens
cccagggaatgactctggcctt

SEQ ID NO: 8084450 - DNA, 22 bp, Homo sapiens
cccagggacagctaggtggggc

SEQ ID NO: 8084451 - DNA, 22 bp, Homo sapiens
tgccatattgatgtgctgtacc

SEQ ID NO: 8084452 - DNA, 22 bp, Homo sapiens
tgccatattattgagcatatta

SEQ ID NO: 8084453 - DNA, 22 bp, Homo sapiens
tgccagtgaaacatggaagaat

SEQ ID NO: 8084454 - DNA, 22 bp, Homo sapiens
tgccagtgagccctgggatgtg

SEQ ID NO: 8084455 - DNA, 22 bp, Homo sapiens
cccaggagagggaaccaaatgt

SEQ ID NO: 8084456 - DNA, 22 bp, Homo sapiens
cccaggagagaggccagttggc

SEQ ID NO: 8084457 - DNA, 22 bp, Homo sapiens
cccaggagacctagatctgttt

SEQ ID NO: 8084458 - DNA, 22 bp, Homo sapiens
tgccacagaggtgaagcccact

SEQ ID NO: 8084459 - DNA, 22 bp, Homo sapiens
tgccaggagagtgcatgcaggg

SEQ ID NO: 8084460 - DNA, 23 bp, Homo sapiens
cccattttcatgttaactcctgg

SEQ ID NO: 8084461 - DNA, 22 bp, Homo sapiens
cccattctaagctttgctcttc

SEQ ID NO: 8084462 - DNA, 22 bp, Homo sapiens
cccattctaggctttgctcttc

SEQ ID NO: 8084463 - DNA, 22 bp, Homo sapiens
cccatttttgtgtgagtaatga

SEQ ID NO: 8084464 - DNA, 22 bp, Homo sapiens
cccaggtcccgccccagctcta

SEQ ID NO: 8084465 - DNA, 22 bp, Homo sapiens
cccaggtccccacctgtctgct

SEQ ID NO: 8084466 - DNA, 22 bp, Homo sapiens
cccaggtcccggggccagctgc

SEQ ID NO: 8084467 - DNA, 22 bp, Homo sapiens
cccaggtctccctgcagccctg

SEQ ID NO: 8084468 - DNA, 22 bp, Homo sapiens
cccgagggtagatggcattgaa

SEQ ID NO: 8084469 - DNA, 19 bp, Homo sapiens
ccaggactttgcagacact

SEQ ID NO: 8084470 - DNA, 22 bp, Homo sapiens
tctgggagccatgccttggagt

SEQ ID NO: 8084471 - DNA, 22 bp, Homo sapiens
tctgggagcacacgcagtgatc

SEQ ID NO: 8084472 - DNA, 22 bp, Homo sapiens
tctggctcacttcaggcttcac

SEQ ID NO: 8084473 - DNA, 22 bp, Homo sapiens
tctggcctactggagtccatga

SEQ ID NO: 8084474 - DNA, 22 bp, Homo sapiens
ccagctctgcagggcctggggt

SEQ ID NO: 8084475 - DNA, 22 bp, Homo sapiens
tctgctttgaccttcttgatgc

SEQ ID NO: 8084476 - DNA, 22 bp, Homo sapiens
tctggaaaagcgataaaccatt

SEQ ID NO: 8084477 - DNA, 22 bp, Homo sapiens
ccagagagaaaatggagggcca

SEQ ID NO: 8084478 - DNA, 22 bp, Homo sapiens
tctttcttcagccctgtaagat

SEQ ID NO: 8084479 - DNA, 22 bp, Homo sapiens
tctttcttcctggagcccaaca

SEQ ID NO: 8084480 - DNA, 22 bp, Homo sapiens
tctttcttggtataaagcaggg

SEQ ID NO: 8084481 - DNA, 22 bp, Homo sapiens
tctttcttggtattctgagcta

SEQ ID NO: 8084482 - DNA, 22 bp, Homo sapiens
tctttctttatcacctgatatg

SEQ ID NO: 8084483 - DNA, 22 bp, Homo sapiens
tctttcttgtgggtgccctttt

SEQ ID NO: 8084484 - DNA, 22 bp, Homo sapiens
ccaggcctggacgggtggcctg

SEQ ID NO: 8084485 - DNA, 22 bp, Homo sapiens
ccaggatggggagcagatagaa

SEQ ID NO: 8084486 - DNA, 23 bp, Homo sapiens
tgcaaataacaaggagtttaagg

SEQ ID NO: 8084487 - DNA, 22 bp, Homo sapiens
tgcaaatagcctatatttatag

SEQ ID NO: 8084488 - DNA, 22 bp, Homo sapiens
tgcacacatgtttacaagcatc

SEQ ID NO: 8084489 - DNA, 22 bp, Homo sapiens
ccattctgaacaattcttgtct

SEQ ID NO: 8084490 - DNA, 22 bp, Homo sapiens
ccattctgccatgcttcatcta

SEQ ID NO: 8084491 - DNA, 22 bp, Homo sapiens
ccattctgacacctaattctgt

SEQ ID NO: 8084492 - DNA, 22 bp, Homo sapiens
ccattctgacttcattgcctca

SEQ ID NO: 8084493 - DNA, 22 bp, Homo sapiens
ccattctgagtcttatgtcttt

SEQ ID NO: 8084494 - DNA, 19 bp, Homo sapiens
ccattctgtctctgccaca

SEQ ID NO: 8084495 - DNA, 22 bp, Homo sapiens
ccattctgtgtctctccacagc

SEQ ID NO: 8084496 - DNA, 22 bp, Homo sapiens
tgattcaagctactgttactgg

SEQ ID NO: 8084497 - DNA, 22 bp, Homo sapiens
tgattttattgaaacttcactt

SEQ ID NO: 8084498 - DNA, 22 bp, Homo sapiens
ccagtgttccctcgggttcatg

SEQ ID NO: 8084499 - DNA, 22 bp, Homo sapiens
ccagtgttggaggatggcttgc

SEQ ID NO: 8084500 - DNA, 22 bp, Homo sapiens
ccagtgtttacagttgaacaaa

SEQ ID NO: 8084501 - DNA, 22 bp, Homo sapiens
ccagtgtttaggaataaaatgt

SEQ ID NO: 8084502 - DNA, 22 bp, Homo sapiens
ccatgcatgcctgaaattgctg

SEQ ID NO: 8084503 - DNA, 22 bp, Homo sapiens
ccagtgtttccccagaagagag

SEQ ID NO: 8084504 - DNA, 22 bp, Homo sapiens
tgagacgaagtcttgctctgtt

SEQ ID NO: 8084505 - DNA, 22 bp, Homo sapiens
ccaggggctctcagggtgtgtg

SEQ ID NO: 8084506 - DNA, 22 bp, Homo sapiens
ccagggtaccccaagggcaggt

SEQ ID NO: 8084507 - DNA, 22 bp, Homo sapiens
ccaggggctggtgctgagctgg

SEQ ID NO: 8084508 - DNA, 22 bp, Homo sapiens
ccagggcttcccacgtgccctg

SEQ ID NO: 8084509 - DNA, 22 bp, Homo sapiens
tattttaaagtgaagggtcttg

SEQ ID NO: 8084510 - DNA, 22 bp, Homo sapiens
tattttacagactactttagat

SEQ ID NO: 8084511 - DNA, 22 bp, Homo sapiens
tattttaaagactgccagccta

SEQ ID NO: 8084512 - DNA, 22 bp, Homo sapiens
cagtcacttacaaaaatataat

SEQ ID NO: 8084513 - DNA, 22 bp, Homo sapiens
tcaacaaatacttaaagcagag

SEQ ID NO: 8084514 - DNA, 22 bp, Homo sapiens
tcaaaacactattacctttaat

SEQ ID NO: 8084515 - DNA, 22 bp, Homo sapiens
tcaaaaattttctgaggatgag

SEQ ID NO: 8084516 - DNA, 22 bp, Homo sapiens
tattttcaccatgtatccctgt

SEQ ID NO: 8084517 - DNA, 22 bp, Homo sapiens
tattttacatgacaggtgttta

SEQ ID NO: 8084518 - DNA, 22 bp, Homo sapiens
caggtcagctggtgccccaggt

SEQ ID NO: 8084519 - DNA, 22 bp, Homo sapiens
tattatcattaactgttgaatt

SEQ ID NO: 8084520 - DNA, 22 bp, Homo sapiens
tattatcatgttaattagtggg

SEQ ID NO: 8084521 - DNA, 22 bp, Homo sapiens
tattataatttagggcttggat

SEQ ID NO: 8084522 - DNA, 22 bp, Homo sapiens
tattatgcataggcaataatgg

SEQ ID NO: 8084523 - DNA, 22 bp, Homo sapiens
tattattaaatggcagaatttt

SEQ ID NO: 8084524 - DNA, 18 bp, Homo sapiens
caggtgggtctcctgccc

SEQ ID NO: 8084525 - DNA, 22 bp, Homo sapiens
cagggagatcttggctcctggt

SEQ ID NO: 8084526 - DNA, 22 bp, Homo sapiens
cagggagcagcgctggggcctc

SEQ ID NO: 8084527 - DNA, 22 bp, Homo sapiens
cagggccaggctgatggcctgg

SEQ ID NO: 8084528 - DNA, 22 bp, Homo sapiens
cagggccatgaggcacagggtc

SEQ ID NO: 8084529 - DNA, 22 bp, Homo sapiens
cagggccattggcgtggctgtc

SEQ ID NO: 8084530 - DNA, 22 bp, Homo sapiens
cagggccatatcttgtgcacca

SEQ ID NO: 8084531 - DNA, 22 bp, Homo sapiens
cagggcccaggccactgggttg

SEQ ID NO: 8084532 - DNA, 22 bp, Homo sapiens
cagggcccagtccctgctgtca

SEQ ID NO: 8084533 - DNA, 22 bp, Homo sapiens
cagggcccatggctcaggtagg

SEQ ID NO: 8084534 - DNA, 22 bp, Homo sapiens
cagggccccagggatgtctgct

SEQ ID NO: 8084535 - DNA, 22 bp, Homo sapiens
cagggccctaagatacacatca

SEQ ID NO: 8084536 - DNA, 18 bp, Homo sapiens
cagggccccagaattatc

SEQ ID NO: 8084537 - DNA, 23 bp, Homo sapiens
cagggccctgctcaatttctcca

SEQ ID NO: 8084538 - DNA, 22 bp, Homo sapiens
cagggccctgctcaatttctcc

SEQ ID NO: 8084539 - DNA, 22 bp, Homo sapiens
taggcaggtgtgcactgcccac

SEQ ID NO: 8084540 - DNA, 22 bp, Homo sapiens
tagctttaaaaatcatcaaagc

SEQ ID NO: 8084541 - DNA, 22 bp, Homo sapiens
tagcttctaatacttaccaatt

SEQ ID NO: 8084542 - DNA, 22 bp, Homo sapiens
caggggtgtttttggccaggag

SEQ ID NO: 8084543 - DNA, 22 bp, Homo sapiens
cagggtcaggctgctagaagct

SEQ ID NO: 8084544 - DNA, 22 bp, Homo sapiens
cagggctgtggaaaactggtgc

SEQ ID NO: 8084545 - DNA, 20 bp, Homo sapiens
cagggctctgggcctggcct

SEQ ID NO: 8084546 - DNA, 22 bp, Homo sapiens
cagggacaatggcagagcctga

SEQ ID NO: 8084547 - DNA, 22 bp, Homo sapiens
cagggacaaagtgagaaaggaa

SEQ ID NO: 8084548 - DNA, 22 bp, Homo sapiens
caggcttgtgtctcagctgcag

SEQ ID NO: 8084549 - DNA, 22 bp, Homo sapiens
caggcttggagggcagtggcat

SEQ ID NO: 8084550 - DNA, 22 bp, Homo sapiens
caggctgcagtgcagtggctat

SEQ ID NO: 8084551 - DNA, 22 bp, Homo sapiens
caggctgcatggaggggtacag

SEQ ID NO: 8084552 - DNA, 22 bp, Homo sapiens
caggctgccaaggctggggagg

SEQ ID NO: 8084553 - DNA, 22 bp, Homo sapiens
caggctgccgtgaagcaggcct

SEQ ID NO: 8084554 - DNA, 22 bp, Homo sapiens
caggcctttgcacgtgcagttg

SEQ ID NO: 8084555 - DNA, 22 bp, Homo sapiens
tactttaatatatgtgaagttc

SEQ ID NO: 8084556 - DNA, 22 bp, Homo sapiens
tactttaaagaggtgtaatgag

SEQ ID NO: 8084557 - DNA, 22 bp, Homo sapiens
caggcctgaccctgagcttcac

SEQ ID NO: 8084558 - DNA, 22 bp, Homo sapiens
tacatgttcaaatttgtctttc

SEQ ID NO: 8084559 - DNA, 22 bp, Homo sapiens
taatcacatcagggtaaatggg

SEQ ID NO: 8084560 - DNA, 22 bp, Homo sapiens
taatatggatctttccaatgtt

SEQ ID NO: 8084561 - DNA, 22 bp, Homo sapiens
taatatggacggctccaaggga

SEQ ID NO: 8084562 - DNA, 22 bp, Homo sapiens
taatatgggcagtctgaatata

SEQ ID NO: 8084563 - DNA, 22 bp, Homo sapiens
taatatttctaccctgctgcct

SEQ ID NO: 8084564 - DNA, 22 bp, Homo sapiens
taatacagacaacttgccaaat

SEQ ID NO: 8084565 - DNA, 22 bp, Homo sapiens
taatcacagaaacagactgttt

SEQ ID NO: 8084566 - DNA, 22 bp, Homo sapiens
taatcacaattcagatgtctta

SEQ ID NO: 8084567 - DNA, 22 bp, Homo sapiens
tacaaaaaattgatactgacga

SEQ ID NO: 8084568 - DNA, 22 bp, Homo sapiens
tacaaaaaattgatactgacga

SEQ ID NO: 8084569 - DNA, 22 bp, Homo sapiens
tacaaaagtaattacggttttt

SEQ ID NO: 8084570 - DNA, 22 bp, Homo sapiens
tacaaaaggaagagggatctta

SEQ ID NO: 8084571 - DNA, 22 bp, Homo sapiens
tacaaaacagtgctctggtcct

SEQ ID NO: 8084572 - DNA, 22 bp, Homo sapiens
caggcagagttagagcaactgg

SEQ ID NO: 8084573 - DNA, 22 bp, Homo sapiens
caggcagagttagtgatttagg

SEQ ID NO: 8084574 - DNA, 21 bp, Homo sapiens
taataattccactacagagta

SEQ ID NO: 8084575 - DNA, 22 bp, Homo sapiens
taataattttaaagaaggctag

SEQ ID NO: 8084576 - DNA, 22 bp, Homo sapiens
taataattggcaatgttgagca

SEQ ID NO: 8084577 - DNA, 22 bp, Homo sapiens
taataattggcaatgttgagca

SEQ ID NO: 8084578 - DNA, 22 bp, Homo sapiens
gtgcttaagcttctgctttatg

SEQ ID NO: 8084579 - DNA, 19 bp, Homo sapiens
gtgcttaacattttattgt

SEQ ID NO: 8084580 - DNA, 22 bp, Homo sapiens
gtgcttaaggcagtctgtcaaa

SEQ ID NO: 8084581 - DNA, 22 bp, Homo sapiens
gtgcttaatacatgtcaataac

SEQ ID NO: 8084582 - DNA, 22 bp, Homo sapiens
cagctattttgcctatcatggt

SEQ ID NO: 8084583 - DNA, 22 bp, Homo sapiens
taagtcgtggatgattcttcgg

SEQ ID NO: 8084584 - DNA, 19 bp, Homo sapiens
taagtatgtactatcttgc

SEQ ID NO: 8084585 - DNA, 22 bp, Homo sapiens
catggcagagcctgcaggtggg

SEQ ID NO: 8084586 - DNA, 20 bp, Homo sapiens
tccagctgggaacagctgat

SEQ ID NO: 8084587 - DNA, 23 bp, Homo sapiens
tccaggagaattccagggcccgg

SEQ ID NO: 8084588 - DNA, 22 bp, Homo sapiens
catgaccaaaatcattacactg

SEQ ID NO: 8084589 - DNA, 22 bp, Homo sapiens
catgcatatgtcaaaaaagcta

SEQ ID NO: 8084590 - DNA, 22 bp, Homo sapiens
catctgctctgtctgccatgtt

SEQ ID NO: 8084591 - DNA, 22 bp, Homo sapiens
catcttaaattaaagcttaagg

SEQ ID NO: 8084592 - DNA, 22 bp, Homo sapiens
catcttaaaatgtgtcataact

SEQ ID NO: 8084593 - DNA, 22 bp, Homo sapiens
catgaagcatgttttgtcatga

SEQ ID NO: 8084594 - DNA, 22 bp, Homo sapiens
tcagggagggacctgaggctgg

SEQ ID NO: 8084595 - DNA, 22 bp, Homo sapiens
tcagggagatttggggactcaa

SEQ ID NO: 8084596 - DNA, 22 bp, Homo sapiens
tcagggagagtgacccatccac

SEQ ID NO: 8084597 - DNA, 22 bp, Homo sapiens
tcagggagcctggacttcaagg

SEQ ID NO: 8084598 - DNA, 22 bp, Homo sapiens
tcagggaggtgtctgccagaga

SEQ ID NO: 8084599 - DNA, 22 bp, Homo sapiens
tcagggagtagtttgtgctatg

SEQ ID NO: 8084600 - DNA, 19 bp, Homo sapiens
tcagggagtttacagcatg

SEQ ID NO: 8084601 - DNA, 22 bp, Homo sapiens
tcagggagtgttggcaggatca

SEQ ID NO: 8084602 - DNA, 22 bp, Homo sapiens
tcagtgccagtttgctccttct

SEQ ID NO: 8084603 - DNA, 22 bp, Homo sapiens
tcagtgccaattctgccatggg

SEQ ID NO: 8084604 - DNA, 23 bp, Homo sapiens
tcagtcccaacagcttctcctgg

SEQ ID NO: 8084605 - DNA, 22 bp, Homo sapiens
cataattactgatatgctgatt

SEQ ID NO: 8084606 - DNA, 22 bp, Homo sapiens
cataatttcccaagagattgaa

SEQ ID NO: 8084607 - DNA, 22 bp, Homo sapiens
cataattttccatggtttgcta

SEQ ID NO: 8084608 - DNA, 22 bp, Homo sapiens
catagaaactgagacaaggatt

SEQ ID NO: 8084609 - DNA, 22 bp, Homo sapiens
tcagggagaggtgagagcctgt

SEQ ID NO: 8084610 - DNA, 17 bp, Homo sapiens
cataaaacagttctatt

SEQ ID NO: 8084611 - DNA, 22 bp, Homo sapiens
cagtttttgccattaagagtaa

SEQ ID NO: 8084612 - DNA, 22 bp, Homo sapiens
cagtttttcaaaattacatgat

SEQ ID NO: 8084613 - DNA, 18 bp, Homo sapiens
cagtttttatatctggca

SEQ ID NO: 8084614 - DNA, 22 bp, Homo sapiens
cagttttctatggtagaagcat

SEQ ID NO: 8084615 - DNA, 22 bp, Homo sapiens
cagtttttagattagttggtgg

SEQ ID NO: 8084616 - DNA, 22 bp, Homo sapiens
cagttctggagtttcattcttt

SEQ ID NO: 8084617 - DNA, 22 bp, Homo sapiens
tcaatatttttatgagcataga

SEQ ID NO: 8084618 - DNA, 22 bp, Homo sapiens
cagttgtaggcatgtgcatgga

SEQ ID NO: 8084619 - DNA, 22 bp, Homo sapiens
cagttgtaatgctttcctctga

SEQ ID NO: 8084620 - DNA, 22 bp, Homo sapiens
cagttgttcccagcaatgaaag

SEQ ID NO: 8084621 - DNA, 22 bp, Homo sapiens
ccaagaggttgtgaggcaggca

SEQ ID NO: 8084622 - DNA, 22 bp, Homo sapiens
ccaaggcaacgttggtgtcagg

SEQ ID NO: 8084623 - DNA, 22 bp, Homo sapiens
ccaaggcaatgtgcagctggtg

SEQ ID NO: 8084624 - DNA, 22 bp, Homo sapiens
ccaaggcagaagatggctcttg

SEQ ID NO: 8084625 - DNA, 22 bp, Homo sapiens
tccttaaagtgcacctcctcat

SEQ ID NO: 8084626 - DNA, 22 bp, Homo sapiens
tccttaaatatttactgttaac

SEQ ID NO: 8084627 - DNA, 22 bp, Homo sapiens
tccttaaacaacacactttgta

SEQ ID NO: 8084628 - DNA, 22 bp, Homo sapiens
tccttggggacgctgacatcgt

SEQ ID NO: 8084629 - DNA, 23 bp, Homo sapiens
tcctttaagatatcttattcctt

SEQ ID NO: 8084630 - DNA, 22 bp, Homo sapiens
ccagagaattttagacaaaaat

SEQ ID NO: 8084631 - DNA, 22 bp, Homo sapiens
ccagagaaggtggagcttgtgt

SEQ ID NO: 8084632 - DNA, 22 bp, Homo sapiens
ccagagaagtcttgcctggatt

SEQ ID NO: 8084633 - DNA, 22 bp, Homo sapiens
ccagagaaagtgaagcaaatgt

SEQ ID NO: 8084634 - DNA, 22 bp, Homo sapiens
ccagagaaccttgagctgtgag

SEQ ID NO: 8084635 - DNA, 22 bp, Homo sapiens
tctaagctagtggctcatgtga

SEQ ID NO: 8084636 - DNA, 22 bp, Homo sapiens
catgggcaccttaaaatgaggc

SEQ ID NO: 8084637 - DNA, 22 bp, Homo sapiens
tccattttagaagaaaatccac

SEQ ID NO: 8084638 - DNA, 22 bp, Homo sapiens
tccattttgtaggtatgctaca

SEQ ID NO: 8084639 - DNA, 22 bp, Homo sapiens
tccattttcatctcatgtataa

SEQ ID NO: 8084640 - DNA, 22 bp, Homo sapiens
tccattttagagatgaagaaac

SEQ ID NO: 8084641 - DNA, 22 bp, Homo sapiens
tccaggagaggtgtggggactg

SEQ ID NO: 8084642 - DNA, 22 bp, Homo sapiens
tccaggagaccagatgtaggcc

SEQ ID NO: 8084643 - DNA, 22 bp, Homo sapiens
tccaggagacacccttgtgtgt

SEQ ID NO: 8084644 - DNA, 22 bp, Homo sapiens
tccaggagcatccaggtgaagc

SEQ ID NO: 8084645 - DNA, 22 bp, Homo sapiens
cattctctgatcttcacatacc

SEQ ID NO: 8084646 - DNA, 22 bp, Homo sapiens
cattctctctacttgttttcaa

SEQ ID NO: 8084647 - DNA, 17 bp, Homo sapiens
cattctgtaatctttct

SEQ ID NO: 8084648 - DNA, 22 bp, Homo sapiens
cattacagaatatgtaatgatc

SEQ ID NO: 8084649 - DNA, 22 bp, Homo sapiens
cattctctacactcctgccctg

SEQ ID NO: 8084650 - DNA, 22 bp, Homo sapiens
catttaaaggttgtgggtaaaa

SEQ ID NO: 8084651 - DNA, 22 bp, Homo sapiens
tccctctccctattgcctggag

SEQ ID NO: 8084652 - DNA, 18 bp, Homo sapiens
tttccttgtatgaacata

SEQ ID NO: 8084653 - DNA, 22 bp, Homo sapiens
ctctccaggagctcagagtcta

SEQ ID NO: 8084654 - DNA, 22 bp, Homo sapiens
tttcacaaagcatagcacttta

SEQ ID NO: 8084655 - DNA, 22 bp, Homo sapiens
tttcacaacacaatctcgttaa

SEQ ID NO: 8084656 - DNA, 22 bp, Homo sapiens
tttcaattgactttggaagaaa

SEQ ID NO: 8084657 - DNA, 22 bp, Homo sapiens
tttcaatttccaggctagaatt

SEQ ID NO: 8084658 - DNA, 22 bp, Homo sapiens
tttcaatgtatgtctttctgag

SEQ ID NO: 8084659 - DNA, 21 bp, Homo sapiens
tttcaatgtgttctttgtagt

SEQ ID NO: 8084660 - DNA, 23 bp, Homo sapiens
tttcaaattactctgcagatgac

SEQ ID NO: 8084661 - DNA, 22 bp, Homo sapiens
tttcctaaggctcattttaaaa

SEQ ID NO: 8084662 - DNA, 22 bp, Homo sapiens
tttcacagttagcatgaggact

SEQ ID NO: 8084663 - DNA, 22 bp, Homo sapiens
tttcacagtgctctgtaagtat

SEQ ID NO: 8084664 - DNA, 20 bp, Homo sapiens
tttcacagtccctgtttcct

SEQ ID NO: 8084665 - DNA, 22 bp, Homo sapiens
tttattgttgttagtcataagt

SEQ ID NO: 8084666 - DNA, 22 bp, Homo sapiens
ctcctggccacgttcttgctgg

SEQ ID NO: 8084667 - DNA, 22 bp, Homo sapiens
ctcctggccctgagctcccagg

SEQ ID NO: 8084668 - DNA, 22 bp, Homo sapiens
ctcctggcactgtcttgaccca

SEQ ID NO: 8084669 - DNA, 22 bp, Homo sapiens
tttaatcaggcaaagcataata

SEQ ID NO: 8084670 - DNA, 22 bp, Homo sapiens
tttagtcatttggatttgatct

SEQ ID NO: 8084671 - DNA, 22 bp, Homo sapiens
tttagtgataagaattatgaaa

SEQ ID NO: 8084672 - DNA, 23 bp, Homo sapiens
tttagtgatctcgtgtttttagc

SEQ ID NO: 8084673 - DNA, 22 bp, Homo sapiens
tttagtgcctggtttccttctt

SEQ ID NO: 8084674 - DNA, 22 bp, Homo sapiens
tttagtgcagttcccttttggc

SEQ ID NO: 8084675 - DNA, 22 bp, Homo sapiens
tttagtgcatcagacaccctct

SEQ ID NO: 8084676 - DNA, 22 bp, Homo sapiens
tttagtgcctgggccagttcca

SEQ ID NO: 8084677 - DNA, 22 bp, Homo sapiens
tttagtaagttcactgcaaagc

SEQ ID NO: 8084678 - DNA, 22 bp, Homo sapiens
tttagtactgtttaaaaatgga

SEQ ID NO: 8084679 - DNA, 22 bp, Homo sapiens
tttaatatctcacacttccatg

SEQ ID NO: 8084680 - DNA, 22 bp, Homo sapiens
tttaatatttctttcctgaagc

SEQ ID NO: 8084681 - DNA, 22 bp, Homo sapiens
tttaatatctcacacttccatg

SEQ ID NO: 8084682 - DNA, 22 bp, Homo sapiens
ctcccaggcagggctgcccact

SEQ ID NO: 8084683 - DNA, 22 bp, Homo sapiens
tttaacagatgtgaaattttca

SEQ ID NO: 8084684 - DNA, 22 bp, Homo sapiens
tttaagttccttttcaacaact

SEQ ID NO: 8084685 - DNA, 22 bp, Homo sapiens
tttaatacagaacttgtcaggg

SEQ ID NO: 8084686 - DNA, 22 bp, Homo sapiens
ctcccagccttcgccagtctga

SEQ ID NO: 8084687 - DNA, 22 bp, Homo sapiens
ctcccaggactcagaggagaag

SEQ ID NO: 8084688 - DNA, 22 bp, Homo sapiens
ttgtgaaacattcatggatttg

SEQ ID NO: 8084689 - DNA, 22 bp, Homo sapiens
ttgtgaaaagccgcaagtatag

SEQ ID NO: 8084690 - DNA, 22 bp, Homo sapiens
ttgtgaaaagccgcaagtatag

SEQ ID NO: 8084691 - DNA, 22 bp, Homo sapiens
ttgtgtaacttgagcaaacaca

SEQ ID NO: 8084692 - DNA, 22 bp, Homo sapiens
ctcatttatgtaatgattaagg

SEQ ID NO: 8084693 - DNA, 22 bp, Homo sapiens
ctcatttaacagattaaaaagt

SEQ ID NO: 8084694 - DNA, 22 bp, Homo sapiens
ctcatttacactatgggaacta

SEQ ID NO: 8084695 - DNA, 22 bp, Homo sapiens
ctcatttacctttgcaatcaag

SEQ ID NO: 8084696 - DNA, 22 bp, Homo sapiens
ctcatttactgtagaacagtta

SEQ ID NO: 8084697 - DNA, 22 bp, Homo sapiens
ctcatttactcatctgcaaaac

SEQ ID NO: 8084698 - DNA, 22 bp, Homo sapiens
ctcatttactactcatgtgacc

SEQ ID NO: 8084699 - DNA, 22 bp, Homo sapiens
ctcatctgtctgggctggtttt

SEQ ID NO: 8084700 - DNA, 22 bp, Homo sapiens
ttcttttaatttctgtctgcag

SEQ ID NO: 8084701 - DNA, 22 bp, Homo sapiens
ctcacaggttagttgtgtggat

SEQ ID NO: 8084702 - DNA, 22 bp, Homo sapiens
ttctttcttagcaatctatggt

SEQ ID NO: 8084703 - DNA, 22 bp, Homo sapiens
ttcttttacattaagatttcag

SEQ ID NO: 8084704 - DNA, 22 bp, Homo sapiens
ttcttttagaatttcctaaggt

SEQ ID NO: 8084705 - DNA, 22 bp, Homo sapiens
ttcttttagtcattcagggaag

SEQ ID NO: 8084706 - DNA, 18 bp, Homo sapiens
ttcttttcatgtgatctc

SEQ ID NO: 8084707 - DNA, 22 bp, Homo sapiens
ctccacggcccattgggcagga

SEQ ID NO: 8084708 - DNA, 22 bp, Homo sapiens
ttgtaattaatggcagcaatta

SEQ ID NO: 8084709 - DNA, 22 bp, Homo sapiens
ctccaaggttttccctgtcctt

SEQ ID NO: 8084710 - DNA, 22 bp, Homo sapiens
tttgcaaagttatttagactca

SEQ ID NO: 8084711 - DNA, 22 bp, Homo sapiens
tttgggaaatagtagaaaatgt

SEQ ID NO: 8084712 - DNA, 22 bp, Homo sapiens
tttggacaaacagaatagagct

SEQ ID NO: 8084713 - DNA, 22 bp, Homo sapiens
tttgggaagtttaaaataagta

SEQ ID NO: 8084714 - DNA, 22 bp, Homo sapiens
tttgccttctctgaacctattt

SEQ ID NO: 8084715 - DNA, 21 bp, Homo sapiens
tttgccttcacgaagcatcct

SEQ ID NO: 8084716 - DNA, 22 bp, Homo sapiens
tttgctaaaaggccattgattt

SEQ ID NO: 8084717 - DNA, 22 bp, Homo sapiens
tttgctaatgcctctgaaatca

SEQ ID NO: 8084718 - DNA, 19 bp, Homo sapiens
ttttaagtgccctttcttc

SEQ ID NO: 8084719 - DNA, 19 bp, Homo sapiens
ttttaagtcctctctattc

SEQ ID NO: 8084720 - DNA, 22 bp, Homo sapiens
ttttaagtgcaatctgaatgcg

SEQ ID NO: 8084721 - DNA, 22 bp, Homo sapiens
ttttaatactgctattgtagga

SEQ ID NO: 8084722 - DNA, 22 bp, Homo sapiens
ttttaatactgctattgtagga

SEQ ID NO: 8084723 - DNA, 22 bp, Homo sapiens
ttttaagtttattccagtacat

SEQ ID NO: 8084724 - DNA, 22 bp, Homo sapiens
ttttaagttaatataattgagg

SEQ ID NO: 8084725 - DNA, 22 bp, Homo sapiens
ttttaagttggattgctaagta

SEQ ID NO: 8084726 - DNA, 22 bp, Homo sapiens
ttttaatactgctattgtagga

SEQ ID NO: 8084727 - DNA, 20 bp, Homo sapiens
ttttagcacttgttatggtg

SEQ ID NO: 8084728 - DNA, 22 bp, Homo sapiens
ttttagcactaagtgatatgct

SEQ ID NO: 8084729 - DNA, 20 bp, Homo sapiens
ttttagcagaaagaaagctc

SEQ ID NO: 8084730 - DNA, 22 bp, Homo sapiens
ttttagcaattggtctctcgtt

SEQ ID NO: 8084731 - DNA, 22 bp, Homo sapiens
ttttagcacactttctttagcg

SEQ ID NO: 8084732 - DNA, 22 bp, Homo sapiens
ttttaagatgctagtatttcag

SEQ ID NO: 8084733 - DNA, 22 bp, Homo sapiens
tttgtacatatataaaatctgt

SEQ ID NO: 8084734 - DNA, 22 bp, Homo sapiens
tttgtacactgtctactatgaa

SEQ ID NO: 8084735 - DNA, 22 bp, Homo sapiens
tttgtacacctacctaatacag

SEQ ID NO: 8084736 - DNA, 22 bp, Homo sapiens
ttttagtgtagtcaccgtgggt

SEQ ID NO: 8084737 - DNA, 22 bp, Homo sapiens
ttttagtgcctgattaatgggt

SEQ ID NO: 8084738 - DNA, 23 bp, Homo sapiens
ttttagtgactcctttatctgcc

SEQ ID NO: 8084739 - DNA, 22 bp, Homo sapiens
ttttagtaccaaccagaagatg

SEQ ID NO: 8084740 - DNA, 22 bp, Homo sapiens
ttttcacttaaggaatttcatg

SEQ ID NO: 8084741 - DNA, 22 bp, Homo sapiens
ttttcagtaatgtctacataat

SEQ ID NO: 8084742 - DNA, 22 bp, Homo sapiens
ctgcaccacagcctgaggcagc

SEQ ID NO: 8084743 - DNA, 22 bp, Homo sapiens
ctgcagggaggttccttgttct

SEQ ID NO: 8084744 - DNA, 22 bp, Homo sapiens
ctgcagggagcagatggcgtgt

SEQ ID NO: 8084745 - DNA, 22 bp, Homo sapiens
ctgcagggcagaagggcataga

SEQ ID NO: 8084746 - DNA, 22 bp, Homo sapiens
ctgcagggcagggcctcctggc

SEQ ID NO: 8084747 - DNA, 22 bp, Homo sapiens
ctgcagggcattgtaactcttt

SEQ ID NO: 8084748 - DNA, 22 bp, Homo sapiens
ctgcagggattgcttctgtata

SEQ ID NO: 8084749 - DNA, 22 bp, Homo sapiens
ctgcagggatgtgaggcccgtt

SEQ ID NO: 8084750 - DNA, 19 bp, Homo sapiens
ctgcagggatgtgcagagt

SEQ ID NO: 8084751 - DNA, 22 bp, Homo sapiens
ctgcaggggcagtccacttcct

SEQ ID NO: 8084752 - DNA, 22 bp, Homo sapiens
ctgcagggcttaccttgctctg

SEQ ID NO: 8084753 - DNA, 22 bp, Homo sapiens
ctgcaggggaccaaagtctgac

SEQ ID NO: 8084754 - DNA, 22 bp, Homo sapiens
ctgcagggcccgcctgagccct

SEQ ID NO: 8084755 - DNA, 22 bp, Homo sapiens
ctgcagggccatgggttctata

SEQ ID NO: 8084756 - DNA, 22 bp, Homo sapiens
ctgcagggcccaaggtcaacgg

SEQ ID NO: 8084757 - DNA, 17 bp, Homo sapiens
ctgaggcccagggccca

SEQ ID NO: 8084758 - DNA, 22 bp, Homo sapiens
ctgaggcccctcttgtgagcat

SEQ ID NO: 8084759 - DNA, 22 bp, Homo sapiens
ctgaggccagagtgggcctctt

SEQ ID NO: 8084760 - DNA, 22 bp, Homo sapiens
ctgaggccgtctgggtctgcag

SEQ ID NO: 8084761 - DNA, 22 bp, Homo sapiens
ctgcacagtggacagtgaagat

SEQ ID NO: 8084762 - DNA, 22 bp, Homo sapiens
ctgactctgcccttcagggcac

SEQ ID NO: 8084763 - DNA, 22 bp, Homo sapiens
ctgactgagaactcatgagtta

SEQ ID NO: 8084764 - DNA, 22 bp, Homo sapiens
ctgactgggttaagttcatgta

SEQ ID NO: 8084765 - DNA, 22 bp, Homo sapiens
ctctttctcattgtcagcagaa

SEQ ID NO: 8084766 - DNA, 22 bp, Homo sapiens
ctctttctggaaggcagagtgg

SEQ ID NO: 8084767 - DNA, 18 bp, Homo sapiens
ctctttctttggcacaaa

SEQ ID NO: 8084768 - DNA, 22 bp, Homo sapiens
ctgaatatcatttatcattggc

SEQ ID NO: 8084769 - DNA, 22 bp, Homo sapiens
ctgacagatacttatgacataa

SEQ ID NO: 8084770 - DNA, 22 bp, Homo sapiens
ccttcccatgcagcctgtctga

SEQ ID NO: 8084771 - DNA, 22 bp, Homo sapiens
ttacttttgcaccaaactaata

SEQ ID NO: 8084772 - DNA, 22 bp, Homo sapiens
ttagaaaaaacgtcttctagtg

SEQ ID NO: 8084773 - DNA, 22 bp, Homo sapiens
ttagacaagggctccttaaaag

SEQ ID NO: 8084774 - DNA, 22 bp, Homo sapiens
ttaaagctgtagagttacttgc

SEQ ID NO: 8084775 - DNA, 22 bp, Homo sapiens
ttaaagctggcgttacagtttg

SEQ ID NO: 8084776 - DNA, 22 bp, Homo sapiens
ttaaagtaatctgtgtgaattt

SEQ ID NO: 8084777 - DNA, 22 bp, Homo sapiens
ttaaagtttgcctatgtgttgt

SEQ ID NO: 8084778 - DNA, 22 bp, Homo sapiens
tgttcattactgctgtttgcca

SEQ ID NO: 8084779 - DNA, 22 bp, Homo sapiens
tgttcattcgctattgtctatg

SEQ ID NO: 8084780 - DNA, 22 bp, Homo sapiens
tgttcattattcttcatctgcc

SEQ ID NO: 8084781 - DNA, 22 bp, Homo sapiens
tgttcattcaacatgtcatcta

SEQ ID NO: 8084782 - DNA, 22 bp, Homo sapiens
tgttcatttgcaacaaccaaat

SEQ ID NO: 8084783 - DNA, 22 bp, Homo sapiens
cctggtgttgtgaagtagccgt

SEQ ID NO: 8084784 - DNA, 22 bp, Homo sapiens
cctggtggaaggtgagtgaggc

SEQ ID NO: 8084785 - DNA, 22 bp, Homo sapiens
cctgggtgtcatgggcagctgg

SEQ ID NO: 8084786 - DNA, 22 bp, Homo sapiens
tgtgtattaatgtttgtatatg

SEQ ID NO: 8084787 - DNA, 22 bp, Homo sapiens
tgtgtatgtctgtatgcacaca

SEQ ID NO: 8084788 - DNA, 23 bp, Homo sapiens
tgtgtatgtatctatgcataggt

SEQ ID NO: 8084789 - DNA, 22 bp, Homo sapiens
cctgggcaacatagggagaccc

SEQ ID NO: 8084790 - DNA, 19 bp, Homo sapiens
cctgggagtcagctgaagg

SEQ ID NO: 8084791 - DNA, 22 bp, Homo sapiens
cctgggagtgtcagacttgctt

SEQ ID NO: 8084792 - DNA, 22 bp, Homo sapiens
tgggggactgcactggcgtcag

SEQ ID NO: 8084793 - DNA, 22 bp, Homo sapiens
tggggctgtggattctcacgaa

SEQ ID NO: 8084794 - DNA, 19 bp, Homo sapiens
tggggctgtgttttgaccc

SEQ ID NO: 8084795 - DNA, 22 bp, Homo sapiens
tggggctgtgagactacaggat

SEQ ID NO: 8084796 - DNA, 22 bp, Homo sapiens
ttcaagttctagtgttcacttc

SEQ ID NO: 8084797 - DNA, 22 bp, Homo sapiens
ttcaagttaactctccttgtac

SEQ ID NO: 8084798 - DNA, 22 bp, Homo sapiens
ttcaagtttgtatttctgtatt

SEQ ID NO: 8084799 - DNA, 20 bp, Homo sapiens
cgcccagtgcggttctgacc

SEQ ID NO: 8084800 - DNA, 22 bp, Homo sapiens
cgccccagccagttgagcggcg

SEQ ID NO: 8084801 - DNA, 22 bp, Homo sapiens
cctttctcattttaagcattag

SEQ ID NO: 8084802 - DNA, 22 bp, Homo sapiens
cctttctaagatactgcaactt

SEQ ID NO: 8084803 - DNA, 22 bp, Homo sapiens
cctttcccgctttgagggcaag

SEQ ID NO: 8084804 - DNA, 22 bp, Homo sapiens
cctttccccgcgggaggtgcca

SEQ ID NO: 8084805 - DNA, 19 bp, Homo sapiens
cctttcagaacagaagcca

SEQ ID NO: 8084806 - DNA, 22 bp, Homo sapiens
cctttcaaaacagaacactagc

SEQ ID NO: 8084807 - DNA, 22 bp, Homo sapiens
cctttctctggcagcaggacag

SEQ ID NO: 8084808 - DNA, 22 bp, Homo sapiens
cgcatgagacctgccggccatc

SEQ ID NO: 8084809 - DNA, 22 bp, Homo sapiens
ttaggcaattttgtcattgtgt

SEQ ID NO: 8084810 - DNA, 22 bp, Homo sapiens
ttaggcaatttgatttttcaag

SEQ ID NO: 8084811 - DNA, 22 bp, Homo sapiens
cggggctgtagcacagctgagc

SEQ ID NO: 8084812 - DNA, 22 bp, Homo sapiens
ttcacagaatggcaagttatgg

SEQ ID NO: 8084813 - DNA, 22 bp, Homo sapiens
ctaaagataaggaaagtatcct

SEQ ID NO: 8084814 - DNA, 22 bp, Homo sapiens
ttcatgaatggaatcaatgctc

SEQ ID NO: 8084815 - DNA, 22 bp, Homo sapiens
ttcatgaatatattgaattagc

SEQ ID NO: 8084816 - DNA, 22 bp, Homo sapiens
cgtaggtggctcagcacctggg

SEQ ID NO: 8084817 - DNA, 22 bp, Homo sapiens
ttcatgaaaaggtctatttctt

SEQ ID NO: 8084818 - DNA, 22 bp, Homo sapiens
ttcatccatatgcagagagctt

SEQ ID NO: 8084819 - DNA, 22 bp, Homo sapiens
cgtcagtgtaaaagacagcacc

SEQ ID NO: 8084820 - DNA, 22 bp, Homo sapiens
cgtcactggcgtgaagtgagga

SEQ ID NO: 8084821 - DNA, 22 bp, Homo sapiens
ctattagaaagcatcttctata

SEQ ID NO: 8084822 - DNA, 22 bp, Homo sapiens
ctattagacacaattagtgatt

SEQ ID NO: 8084823 - DNA, 22 bp, Homo sapiens
ctcaaggccagttcttctgact

SEQ ID NO: 8084824 - DNA, 22 bp, Homo sapiens
ctcacaggagaaagtcatggtc

SEQ ID NO: 8084825 - DNA, 22 bp, Homo sapiens
ctcacaggtaccagcaccctcc

SEQ ID NO: 8084826 - DNA, 22 bp, Homo sapiens
ctcacaggtcatgtggtggctt

SEQ ID NO: 8084827 - DNA, 22 bp, Homo sapiens
ctcacaggcatctcatcaggct

SEQ ID NO: 8084828 - DNA, 22 bp, Homo sapiens
ctcacaggcggtaattcaggga

SEQ ID NO: 8084829 - DNA, 22 bp, Homo sapiens
ctcacactgtgccaaatccttt

SEQ ID NO: 8084830 - DNA, 19 bp, Homo sapiens
ctagattatggaatgctgc

SEQ ID NO: 8084831 - DNA, 22 bp, Homo sapiens
ctagatttctagttcattatcc

SEQ ID NO: 8084832 - DNA, 22 bp, Homo sapiens
ctagatttctagttcattatcc

SEQ ID NO: 8084833 - DNA, 22 bp, Homo sapiens
ctattacaatctgctactatga

SEQ ID NO: 8084834 - DNA, 22 bp, Homo sapiens
ctacccttaagtttctgtgggg

SEQ ID NO: 8084835 - DNA, 22 bp, Homo sapiens
ctactcttttgagtcttcagat

SEQ ID NO: 8084836 - DNA, 22 bp, Homo sapiens
ctagaaacgcctttagcacaac

SEQ ID NO: 8084837 - DNA, 22 bp, Homo sapiens
ctagaaactccatctcactaca

SEQ ID NO: 8084838 - DNA, 22 bp, Homo sapiens
ttctctaagagatgcagaagtt

SEQ ID NO: 8084839 - DNA, 22 bp, Homo sapiens
ctacagcagagaccagccacat

SEQ ID NO: 8084840 - DNA, 22 bp, Homo sapiens
ctacagcagagctacactaact

SEQ ID NO: 8084841 - DNA, 22 bp, Homo sapiens
ctacagctgtgtgtttatgtgc

SEQ ID NO: 8084842 - DNA, 22 bp, Homo sapiens
ctacaggagtaaaataatttca

SEQ ID NO: 8084843 - DNA, 22 bp, Homo sapiens
ttcctggctgtcatgccctagt

SEQ ID NO: 8084844 - DNA, 22 bp, Homo sapiens
ctggctcttgcgactcagcttg

SEQ ID NO: 8084845 - DNA, 22 bp, Homo sapiens
ctggctcttcagtgcttggttc

SEQ ID NO: 8084846 - DNA, 22 bp, Homo sapiens
ctggctgccacttcagggtctt

SEQ ID NO: 8084847 - DNA, 22 bp, Homo sapiens
ctggctgtgcagtcttccagaa

SEQ ID NO: 8084848 - DNA, 22 bp, Homo sapiens
ctggctgtgctgactgagaggg

SEQ ID NO: 8084849 - DNA, 22 bp, Homo sapiens
ctggcctggtctggcctctcca

SEQ ID NO: 8084850 - DNA, 22 bp, Homo sapiens
ctggcctgtcctgacccagcct

SEQ ID NO: 8084851 - DNA, 22 bp, Homo sapiens
ctggccctcggagtccagctgc

SEQ ID NO: 8084852 - DNA, 22 bp, Homo sapiens
ctgcaggggcctcgagcacagg

SEQ ID NO: 8084853 - DNA, 22 bp, Homo sapiens
ctggcttttggaaacaggctca

SEQ ID NO: 8084854 - DNA, 22 bp, Homo sapiens
ctggcttttgcctgtaattcta

SEQ ID NO: 8084855 - DNA, 22 bp, Homo sapiens
ctggcttttttcccattatgca

SEQ ID NO: 8084856 - DNA, 22 bp, Homo sapiens
ctggcttttggaggagggtcag

SEQ ID NO: 8084857 - DNA, 22 bp, Homo sapiens
ctgggaaattgacactgataaa

SEQ ID NO: 8084858 - DNA, 22 bp, Homo sapiens
ctggctttggaaacaatttatc

SEQ ID NO: 8084859 - DNA, 22 bp, Homo sapiens
ctggctttggtcatgtgatcat

SEQ ID NO: 8084860 - DNA, 22 bp, Homo sapiens
ctggctttggaacaaatcatag

SEQ ID NO: 8084861 - DNA, 22 bp, Homo sapiens
ctggctttggtcccctgtgcct

SEQ ID NO: 8084862 - DNA, 22 bp, Homo sapiens
ctggctttgtatagttccctga

SEQ ID NO: 8084863 - DNA, 22 bp, Homo sapiens
ctggctttgttctgattgcttc

SEQ ID NO: 8084864 - DNA, 22 bp, Homo sapiens
ctggcttttgcaggtgttgcta

SEQ ID NO: 8084865 - DNA, 22 bp, Homo sapiens
ctggcttttcctaaactgggaa

SEQ ID NO: 8084866 - DNA, 22 bp, Homo sapiens
ctggcttttcaaactgttcagt

SEQ ID NO: 8084867 - DNA, 22 bp, Homo sapiens
ctggcttttagtgtgaagactt

SEQ ID NO: 8084868 - DNA, 22 bp, Homo sapiens
ctgggaggattcattgaggtga

SEQ ID NO: 8084869 - DNA, 22 bp, Homo sapiens
ctggctttctgacatgttactg

SEQ ID NO: 8084870 - DNA, 22 bp, Homo sapiens
ctggctttctgaacatcagtga

SEQ ID NO: 8084871 - DNA, 22 bp, Homo sapiens
ctggctttctgcacagaattgg

SEQ ID NO: 8084872 - DNA, 22 bp, Homo sapiens
ctggctttctgcaaatctccat

SEQ ID NO: 8084873 - DNA, 22 bp, Homo sapiens
ctggctttctgttataaagaca

SEQ ID NO: 8084874 - DNA, 22 bp, Homo sapiens
ctggctttctctgtggtgttca

SEQ ID NO: 8084875 - DNA, 22 bp, Homo sapiens
ctggctttccttgtctgcatcc

SEQ ID NO: 8084876 - DNA, 22 bp, Homo sapiens
ctggctttctatttggtgctat

SEQ ID NO: 8084877 - DNA, 22 bp, Homo sapiens
ctggctttctccagaaattttt

SEQ ID NO: 8084878 - DNA, 22 bp, Homo sapiens
ctggctttgctggactgggagt

SEQ ID NO: 8084879 - DNA, 22 bp, Homo sapiens
ctggctttgaggatcccctctt

SEQ ID NO: 8084880 - DNA, 22 bp, Homo sapiens
ctggctttgatcagagtgacct

SEQ ID NO: 8084881 - DNA, 22 bp, Homo sapiens
ctggctttgcgtctttgccaca

SEQ ID NO: 8084882 - DNA, 18 bp, Homo sapiens
ctggctttcttatccatc

SEQ ID NO: 8084883 - DNA, 22 bp, Homo sapiens
ctggctttgaaatgcatttcag

SEQ ID NO: 8084884 - DNA, 22 bp, Homo sapiens
ctggctttgaaggtctttccta

SEQ ID NO: 8084885 - DNA, 22 bp, Homo sapiens
ctggctttccctggacaacagc

SEQ ID NO: 8084886 - DNA, 22 bp, Homo sapiens
ctggctttcatttcaagcacgt

SEQ ID NO: 8084887 - DNA, 22 bp, Homo sapiens
ctggctttacctcactggggct

SEQ ID NO: 8084888 - DNA, 22 bp, Homo sapiens
ctggctttaggttggagagctg

SEQ ID NO: 8084889 - DNA, 22 bp, Homo sapiens
ctggctttcattcattcaggcc

SEQ ID NO: 8084890 - DNA, 22 bp, Homo sapiens
ctggctttcatggcgcagttga

SEQ ID NO: 8084891 - DNA, 22 bp, Homo sapiens
ctggcttgttttaagaatacaa

SEQ ID NO: 8084892 - DNA, 22 bp, Homo sapiens
ctggctttaaaatgctcctgga

SEQ ID NO: 8084893 - DNA, 22 bp, Homo sapiens
ctggctttaatgtcatctttct

SEQ ID NO: 8084894 - DNA, 22 bp, Homo sapiens
ctggctttaaccctacaaacct

SEQ ID NO: 8084895 - DNA, 22 bp, Homo sapiens
ctgggcagttttacatcattgc

SEQ ID NO: 8084896 - DNA, 22 bp, Homo sapiens
ctgggcagtttattcagttctg

SEQ ID NO: 8084897 - DNA, 22 bp, Homo sapiens
ctgggcaggagggctctatgga

SEQ ID NO: 8084898 - DNA, 22 bp, Homo sapiens
ctgggcatatacgtgcaagtca

SEQ ID NO: 8084899 - DNA, 22 bp, Homo sapiens
ctgggaggcagaggttgcagtg

SEQ ID NO: 8084900 - DNA, 22 bp, Homo sapiens
ctgggcaggagaggtggttgga

SEQ ID NO: 8084901 - DNA, 22 bp, Homo sapiens
ctgtcctgatggtgccactggt

SEQ ID NO: 8084902 - DNA, 22 bp, Homo sapiens
ctgtcctgcccaccctgcaggg

SEQ ID NO: 8084903 - DNA, 22 bp, Homo sapiens
ctgtcctgggggtggtccttgc

SEQ ID NO: 8084904 - DNA, 22 bp, Homo sapiens
ctgtcctggtgctggggatccc

SEQ ID NO: 8084905 - DNA, 22 bp, Homo sapiens
ctgtggccagatggtgccagtt

SEQ ID NO: 8084906 - DNA, 22 bp, Homo sapiens
ctgtggccagtcccacacctcc

SEQ ID NO: 8084907 - DNA, 22 bp, Homo sapiens
ctgtggctggaataataaatgt

SEQ ID NO: 8084908 - DNA, 22 bp, Homo sapiens
cttcctggatgagcaggctgat

SEQ ID NO: 8084909 - DNA, 22 bp, Homo sapiens
cttcctggatgaagcccagcat

SEQ ID NO: 8084910 - DNA, 22 bp, Homo sapiens
cttgtcaagtcactttaacctc

SEQ ID NO: 8084911 - DNA, 22 bp, Homo sapiens
cttgtcaggtaggtgtcatttc

SEQ ID NO: 8084912 - DNA, 22 bp, Homo sapiens
cttccctttttatgtcttcagc

SEQ ID NO: 8084913 - DNA, 22 bp, Homo sapiens
ctgtttaaccagatctcatatc

SEQ ID NO: 8084914 - DNA, 22 bp, Homo sapiens
cttcaaaagccagaagcctgcg

SEQ ID NO: 8084915 - DNA, 22 bp, Homo sapiens
cttatttactgatccacagatg

SEQ ID NO: 8084916 - DNA, 22 bp, Homo sapiens
cttatttgcccatgtttcttta

SEQ ID NO: 8084917 - DNA, 22 bp, Homo sapiens
gaatacaagccaggcacaaggc

SEQ ID NO: 8084918 - DNA, 22 bp, Homo sapiens
gaagcttgaacagggccaggct

SEQ ID NO: 8084919 - DNA, 22 bp, Homo sapiens
gaagcttcgtggctcttcaaat

SEQ ID NO: 8084920 - DNA, 22 bp, Homo sapiens
gaatagctgtaggctagtgtct

SEQ ID NO: 8084921 - DNA, 22 bp, Homo sapiens
gaatatattggtgaaaatagtt

SEQ ID NO: 8084922 - DNA, 22 bp, Homo sapiens
gaatatattattcagcttttca

SEQ ID NO: 8084923 - DNA, 18 bp, Homo sapiens
gaatactgagagcacaaa

SEQ ID NO: 8084924 - DNA, 22 bp, Homo sapiens
gacacagaatgggtgctcagta

SEQ ID NO: 8084925 - DNA, 22 bp, Homo sapiens
ctttcaatgtgcctgccttggg

SEQ ID NO: 8084926 - DNA, 22 bp, Homo sapiens
ctttcaatcaaagtttctagtg

SEQ ID NO: 8084927 - DNA, 22 bp, Homo sapiens
ctttcagttacagttacacaca

SEQ ID NO: 8084928 - DNA, 22 bp, Homo sapiens
gaacagctataatcatctgtcc

SEQ ID NO: 8084929 - DNA, 22 bp, Homo sapiens
gaacaggaacatattggctctc

SEQ ID NO: 8084930 - DNA, 21 bp, Homo sapiens
gaacaggaaaagctggcttca

SEQ ID NO: 8084931 - DNA, 22 bp, Homo sapiens
gaaatgcataatcttagtagat

SEQ ID NO: 8084932 - DNA, 22 bp, Homo sapiens
gaaatcattagcaaagatatgt

SEQ ID NO: 8084933 - DNA, 22 bp, Homo sapiens
gaaccaagtaggatacaaggag

SEQ ID NO: 8084934 - DNA, 22 bp, Homo sapiens
gaagccaggggcctgacaggca

SEQ ID NO: 8084935 - DNA, 22 bp, Homo sapiens
gaagcaaaatgtctgcacatat

SEQ ID NO: 8084936 - DNA, 22 bp, Homo sapiens
gaagaggttcaacgtggtcatc

SEQ ID NO: 8084937 - DNA, 22 bp, Homo sapiens
gaagattagggttagcataagt

SEQ ID NO: 8084938 - DNA, 22 bp, Homo sapiens
gaagattaatgagaaacctgct

SEQ ID NO: 8084939 - DNA, 22 bp, Homo sapiens
gacctcaggcttctgtaattaa

SEQ ID NO: 8084940 - DNA, 22 bp, Homo sapiens
gagaatctctttgacaagcaga

SEQ ID NO: 8084941 - DNA, 22 bp, Homo sapiens
gagattataagatagagtcatt

SEQ ID NO: 8084942 - DNA, 22 bp, Homo sapiens
gagcagcagctgggccaggttc

SEQ ID NO: 8084943 - DNA, 22 bp, Homo sapiens
gaggcagaagttgcagtgagca

SEQ ID NO: 8084944 - DNA, 22 bp, Homo sapiens
gagcctggattgaagtgggtgg

SEQ ID NO: 8084945 - DNA, 22 bp, Homo sapiens
gagctctatgtggctggcatgt

SEQ ID NO: 8084946 - DNA, 22 bp, Homo sapiens
gagcttcacgggggacagcatt

SEQ ID NO: 8084947 - DNA, 20 bp, Homo sapiens
gagcttcaactcagcaaaca

SEQ ID NO: 8084948 - DNA, 22 bp, Homo sapiens
gtaccaaatctgtattaggaaa

SEQ ID NO: 8084949 - DNA, 22 bp, Homo sapiens
gtaaaacctgcttttcaacacc

SEQ ID NO: 8084950 - DNA, 22 bp, Homo sapiens
ggttttaaccattcacaagtga

SEQ ID NO: 8084951 - DNA, 22 bp, Homo sapiens
ggttttaactacagaattgcaa

SEQ ID NO: 8084952 - DNA, 22 bp, Homo sapiens
ggtttgacagcttggggctgtc

SEQ ID NO: 8084953 - DNA, 22 bp, Homo sapiens
gtattagactgagaaatggagt

SEQ ID NO: 8084954 - DNA, 22 bp, Homo sapiens
gtattagaagaaattataggta

SEQ ID NO: 8084955 - DNA, 22 bp, Homo sapiens
gtagaactaggacttcaggtat

SEQ ID NO: 8084956 - DNA, 22 bp, Homo sapiens
gtagaatatatggttagtattg

SEQ ID NO: 8084957 - DNA, 22 bp, Homo sapiens
gtccccagagctggtggtggtt

SEQ ID NO: 8084958 - DNA, 22 bp, Homo sapiens
gtccacagagggctgggcaggc

SEQ ID NO: 8084959 - DNA, 22 bp, Homo sapiens
gtccccagaaaggtgaggcagg

SEQ ID NO: 8084960 - DNA, 22 bp, Homo sapiens
gtgaagcagggaaggaaaggat

SEQ ID NO: 8084961 - DNA, 22 bp, Homo sapiens
gtctgcctgggacgctgggagt

SEQ ID NO: 8084962 - DNA, 22 bp, Homo sapiens
gtgcagggtcctaattgttaag

SEQ ID NO: 8084963 - DNA, 22 bp, Homo sapiens
gtgcagtgagcagtgcagcacc

SEQ ID NO: 8084964 - DNA, 22 bp, Homo sapiens
ggtccttcagtaggttccagac

SEQ ID NO: 8084965 - DNA, 22 bp, Homo sapiens
ggtccttctgtaggggtcccct

SEQ ID NO: 8084966 - DNA, 22 bp, Homo sapiens
ggtctccagctgggaccctgca

SEQ ID NO: 8084967 - DNA, 22 bp, Homo sapiens
ggtctccaaagctgcattgatg

SEQ ID NO: 8084968 - DNA, 22 bp, Homo sapiens
ggtggcctcgccgcggctctgc

SEQ ID NO: 8084969 - DNA, 22 bp, Homo sapiens
gggcatggtgatgtgcacctgt

SEQ ID NO: 8084970 - DNA, 22 bp, Homo sapiens
gggcatggcgtgtgctggattc

SEQ ID NO: 8084971 - DNA, 22 bp, Homo sapiens
gggctgctgccaatcacagcct

SEQ ID NO: 8084972 - DNA, 22 bp, Homo sapiens
gggctgctgctgccagcgacac

SEQ ID NO: 8084973 - DNA, 22 bp, Homo sapiens
gggcttgctgatttgggcagga

SEQ ID NO: 8084974 - DNA, 22 bp, Homo sapiens
gggcttgcttaaggtcacccgg

SEQ ID NO: 8084975 - DNA, 22 bp, Homo sapiens
gggcttgctgtttagttccatt

SEQ ID NO: 8084976 - DNA, 22 bp, Homo sapiens
ggggctgctcgccgcgcgtttc

SEQ ID NO: 8084977 - DNA, 22 bp, Homo sapiens
ggggctgctggtatttccagtt

SEQ ID NO: 8084978 - DNA, 22 bp, Homo sapiens
ggggctgcttcacctttttacg

SEQ ID NO: 8084979 - DNA, 20 bp, Homo sapiens
ggggctgcatgcagagaaga

SEQ ID NO: 8084980 - DNA, 22 bp, Homo sapiens
ggggctgctcccacccctgagg

SEQ ID NO: 8084981 - DNA, 22 bp, Homo sapiens
ggggccgccagagagagccttg

SEQ ID NO: 8084982 - DNA, 22 bp, Homo sapiens
gggtaggatggtagaagggacc

SEQ ID NO: 8084983 - DNA, 22 bp, Homo sapiens
ggctctggcaaggggaggctac

SEQ ID NO: 8084984 - DNA, 19 bp, Homo sapiens
ggctctggcggctgtagcc

SEQ ID NO: 8084985 - DNA, 22 bp, Homo sapiens
ggctctgctcctggtgccagtg

SEQ ID NO: 8084986 - DNA, 22 bp, Homo sapiens
ggctgggccagggcctgtggac

SEQ ID NO: 8084987 - DNA, 22 bp, Homo sapiens
ggctgggcaggtctgcacaggg

SEQ ID NO: 8084988 - DNA, 22 bp, Homo sapiens
ggcttggcttgggctcagaggc

SEQ ID NO: 8084989 - DNA, 22 bp, Homo sapiens
ggcttgtccttgggctgtgcat

SEQ ID NO: 8084990 - DNA, 22 bp, Homo sapiens
gggacagccatgtgcagatgcc

SEQ ID NO: 8084991 - DNA, 22 bp, Homo sapiens
ggctttaaggagtaaaaatgcc

SEQ ID NO: 8084992 - DNA, 22 bp, Homo sapiens
gggagctggttcctgccctcca

SEQ ID NO: 8084993 - DNA, 22 bp, Homo sapiens
gggcatgcctgcgcagtgcatg

SEQ ID NO: 8084994 - DNA, 22 bp, Homo sapiens
gggcatgcttccttgcttgctt

SEQ ID NO: 8084995 - DNA, 22 bp, Homo sapiens
gggcatggaggtctgtctgcag

SEQ ID NO: 8084996 - DNA, 19 bp, Homo sapiens
gggcatgctggctctagag

SEQ ID NO: 8084997 - DNA, 22 bp, Homo sapiens
gggcagctgtatctgagcttat

SEQ ID NO: 8084998 - DNA, 19 bp, Homo sapiens
gggagctgtctgcccgtgg

SEQ ID NO: 8084999 - DNA, 21 bp, Homo sapiens
gggaggaagctgcttctctct

SEQ ID NO: 8085000 - DNA, 22 bp, Homo sapiens
ggcaggcacatttgggggccgt

SEQ ID NO: 8085001 - DNA, 22 bp, Homo sapiens
ggcaaagagatgatctttgcaa

SEQ ID NO: 8085002 - DNA, 23 bp, Homo sapiens
ggagtgcaatggcgccatctcgg

SEQ ID NO: 8085003 - DNA, 22 bp, Homo sapiens
ggagtcctgtgtcttccaggaa

SEQ ID NO: 8085004 - DNA, 22 bp, Homo sapiens
ggagtatatcgtgtatcatatg

SEQ ID NO: 8085005 - DNA, 22 bp, Homo sapiens
ggcagtgaatgaaacagaggct

SEQ ID NO: 8085006 - DNA, 22 bp, Homo sapiens
ggcagtgaatctgagagcctgg

SEQ ID NO: 8085007 - DNA, 21 bp, Homo sapiens
ggcatggcacctctgggcagg

SEQ ID NO: 8085008 - DNA, 22 bp, Homo sapiens
ggcatggggtgtatgtggcacg

SEQ ID NO: 8085009 - DNA, 22 bp, Homo sapiens
ggcatgggccgaggtgcctcct

SEQ ID NO: 8085010 - DNA, 22 bp, Homo sapiens
ggcaggtggcactgctgctccc

SEQ ID NO: 8085011 - DNA, 22 bp, Homo sapiens
ggccagggcctggggactgtcc

SEQ ID NO: 8085012 - DNA, 21 bp, Homo sapiens
ggccatcctgggaagggctgc

SEQ ID NO: 8085013 - DNA, 22 bp, Homo sapiens
ggccagtggctctgtgcttggg

SEQ ID NO: 8085014 - DNA, 20 bp, Homo sapiens
ggcatgggtggggctcccag

SEQ ID NO: 8085015 - DNA, 22 bp, Homo sapiens
ggcgctggccacggtggctctg

SEQ ID NO: 8085016 - DNA, 22 bp, Homo sapiens
ggccttggtaatgggggactgt

SEQ ID NO: 8085017 - DNA, 22 bp, Homo sapiens
ggccttggtgccatggccagtt

SEQ ID NO: 8085018 - DNA, 17 bp, Homo sapiens
ggccttgggctgctctt

SEQ ID NO: 8085019 - DNA, 22 bp, Homo sapiens
ggccttgggctggctgcagtat

SEQ ID NO: 8085020 - DNA, 22 bp, Homo sapiens
ggccttgggatgtggctgcagc

SEQ ID NO: 8085021 - DNA, 22 bp, Homo sapiens
gcaaagcatcagtagaaatgtt

SEQ ID NO: 8085022 - DNA, 22 bp, Homo sapiens
gcaaataaatgctcactgctgt

SEQ ID NO: 8085023 - DNA, 22 bp, Homo sapiens
gcaaagacaaattagaactcct

SEQ ID NO: 8085024 - DNA, 22 bp, Homo sapiens
gcacacagtatatgctcattaa

SEQ ID NO: 8085025 - DNA, 22 bp, Homo sapiens
gcacaggctccggaggagagct

SEQ ID NO: 8085026 - DNA, 22 bp, Homo sapiens
gcacagttgacaatgattaaga

SEQ ID NO: 8085027 - DNA, 22 bp, Homo sapiens
gcagagttcagtgacttggcct

SEQ ID NO: 8085028 - DNA, 22 bp, Homo sapiens
gcagatgttcgcgttaatgcat

SEQ ID NO: 8085029 - DNA, 22 bp, Homo sapiens
gcagggacacctttgtgaagct

SEQ ID NO: 8085030 - DNA, 22 bp, Homo sapiens
gcagggacatctttgtctagta

SEQ ID NO: 8085031 - DNA, 22 bp, Homo sapiens
gcagggcttgcagcagctagac

SEQ ID NO: 8085032 - DNA, 22 bp, Homo sapiens
gcagggctgttcaggagggtgg

SEQ ID NO: 8085033 - DNA, 22 bp, Homo sapiens
gcagggctgggtgggagacaga

SEQ ID NO: 8085034 - DNA, 22 bp, Homo sapiens
gcagggctgggtcctgtctcat

SEQ ID NO: 8085035 - DNA, 22 bp, Homo sapiens
gcagggctggggctgctcctga

SEQ ID NO: 8085036 - DNA, 22 bp, Homo sapiens
gcagggctgaaggtcccaggcc

SEQ ID NO: 8085037 - DNA, 19 bp, Homo sapiens
gcaggcagtggcattcgga

SEQ ID NO: 8085038 - DNA, 22 bp, Homo sapiens
gcagtgaatctggcaagaattt

SEQ ID NO: 8085039 - DNA, 22 bp, Homo sapiens
gcagtggctaggagtctggcgt

SEQ ID NO: 8085040 - DNA, 22 bp, Homo sapiens
gcagtggctaagctcgcatgca

SEQ ID NO: 8085041 - DNA, 22 bp, Homo sapiens
gccacaggcttaggagggaggt

SEQ ID NO: 8085042 - DNA, 22 bp, Homo sapiens
gccaccagccccatgcgctgtg

SEQ ID NO: 8085043 - DNA, 22 bp, Homo sapiens
gccagctgaagccctggtggaa

SEQ ID NO: 8085044 - DNA, 21 bp, Homo sapiens
gccacccctggcacaggtgct

SEQ ID NO: 8085045 - DNA, 21 bp, Homo sapiens
gccagggagttaaagagtctt

SEQ ID NO: 8085046 - DNA, 22 bp, Homo sapiens
gccagggcaggggagcatctgc

SEQ ID NO: 8085047 - DNA, 22 bp, Homo sapiens
gccccagccctgtggaccatgg

SEQ ID NO: 8085048 - DNA, 22 bp, Homo sapiens
gccccagcctgggaactggagg

SEQ ID NO: 8085049 - DNA, 22 bp, Homo sapiens
gccccaggggaggtgccctgca

SEQ ID NO: 8085050 - DNA, 22 bp, Homo sapiens
gcctctggcttctgcatcagtg

SEQ ID NO: 8085051 - DNA, 22 bp, Homo sapiens
gcctctggagtcgcagcgtctt

SEQ ID NO: 8085052 - DNA, 22 bp, Homo sapiens
gcccagccctgaggtcacagct

SEQ ID NO: 8085053 - DNA, 22 bp, Homo sapiens
gcccagctgcaccctggtgggt

SEQ ID NO: 8085054 - DNA, 22 bp, Homo sapiens
gcccagctccattcttggtgag

SEQ ID NO: 8085055 - DNA, 22 bp, Homo sapiens
gccagggggtcagcaggcactt

SEQ ID NO: 8085056 - DNA, 22 bp, Homo sapiens
gcccatgtgatttcctgggagt

SEQ ID NO: 8085057 - DNA, 21 bp, Homo sapiens
gcccatgtgggaggggtagaa

SEQ ID NO: 8085058 - DNA, 22 bp, Homo sapiens
gctggcttccctacctgcacct

SEQ ID NO: 8085059 - DNA, 22 bp, Homo sapiens
gctggcttgacagaggcctggg

SEQ ID NO: 8085060 - DNA, 22 bp, Homo sapiens
gctggcttccttctgcagctag

SEQ ID NO: 8085061 - DNA, 22 bp, Homo sapiens
gcttctgtggattggctggctt

SEQ ID NO: 8085062 - DNA, 22 bp, Homo sapiens
gcttctgtggtgaggtcacctt

SEQ ID NO: 8085063 - DNA, 22 bp, Homo sapiens
gcttctgtgagtgcagatgctg

SEQ ID NO: 8085064 - DNA, 22 bp, Homo sapiens
gcttctgtatttattgtccttt

SEQ ID NO: 8085065 - DNA, 22 bp, Homo sapiens
gcttctgtcttagctacctccc

SEQ ID NO: 8085066 - DNA, 21 bp, Homo sapiens
gcttctgtatctagcaggaac

SEQ ID NO: 8085067 - DNA, 22 bp, Homo sapiens
gcttctgtggttgtcacgacta

SEQ ID NO: 8085068 - DNA, 22 bp, Homo sapiens
gcttctgttaacttatgttccc

SEQ ID NO: 8085069 - DNA, 22 bp, Homo sapiens
gcttctgtggtgcatctttgct

SEQ ID NO: 8085070 - DNA, 22 bp, Homo sapiens
gcttctgttcaaggatataagg

SEQ ID NO: 8085071 - DNA, 19 bp, Homo sapiens
gcttctgtttgggcttaga

SEQ ID NO: 8085072 - DNA, 22 bp, Homo sapiens
gcttgctctttagccatggcca

SEQ ID NO: 8085073 - DNA, 22 bp, Homo sapiens
gctggggcctgaacagtcagct

SEQ ID NO: 8085074 - DNA, 22 bp, Homo sapiens
ggagacagggttgaaccacgca

SEQ ID NO: 8085075 - DNA, 23 bp, Homo sapiens
ggacacaggccttgtctgcgcct

SEQ ID NO: 8085076 - DNA, 22 bp, Homo sapiens
ggacagtccacctcagtgaaga

SEQ ID NO: 8085077 - DNA, 20 bp, Homo sapiens
gctttctatgagatggactg

SEQ ID NO: 8085078 - DNA, 22 bp, Homo sapiens
gctttctaggcagagatgactg

SEQ ID NO: 8085079 - DNA, 22 bp, Homo sapiens
gctttctacaccaagtatgtgc

SEQ ID NO: 8085080 - DNA, 22 bp, Homo sapiens
gctttctaatctatttccttac

SEQ ID NO: 8085081 - DNA, 22 bp, Homo sapiens
gctttccctgccctcagaagga

SEQ ID NO: 8085082 - DNA, 22 bp, Homo sapiens
gctttcaaggaatttggtattt

SEQ ID NO: 8085083 - DNA, 22 bp, Homo sapiens
ggaagcagcctgaagccaaggg

SEQ ID NO: 8085084 - DNA, 22 bp, Homo sapiens
ggaagattcagcatatatgagt

SEQ ID NO: 8085085 - DNA, 22 bp, Homo sapiens
ggaagatttcccgtagctgtgc

SEQ ID NO: 8085086 - DNA, 22 bp, Homo sapiens
ggaagattttccattcctcttt

SEQ ID NO: 8085087 - DNA, 22 bp, Homo sapiens
ggaagattcagttatctcatga

SEQ ID NO: 8085088 - DNA, 22 bp, Homo sapiens
gctgccctgtttagccagggtt

SEQ ID NO: 8085089 - DNA, 22 bp, Homo sapiens
gctgcctgtcctgaggagtccg

SEQ ID NO: 8085090 - DNA, 22 bp, Homo sapiens
gctgccctgtggtccagcaggt

SEQ ID NO: 8085091 - DNA, 22 bp, Homo sapiens
gctgcctgtgtggccactcact

SEQ ID NO: 8085092 - DNA, 22 bp, Homo sapiens
gctgcgtcgagacagcctggca

SEQ ID NO: 8085093 - DNA, 19 bp, Homo sapiens
gctgctcctggctgaccac

SEQ ID NO: 8085094 - DNA, 22 bp, Homo sapiens
gctctggggcccagggatcaca

SEQ ID NO: 8085095 - DNA, 22 bp, Homo sapiens
gctctgggaattcagaaagcct

SEQ ID NO: 8085096 - DNA, 22 bp, Homo sapiens
gctctgggaaggatcgtagtga

SEQ ID NO: 8085097 - DNA, 22 bp, Homo sapiens
gctctgggaactgactgccttc

SEQ ID NO: 8085098 - DNA, 22 bp, Homo sapiens
gctgacagagtgcctggcctca

SEQ ID NO: 8085099 - DNA, 22 bp, Homo sapiens
gcctctggtccctcatgctgtg

SEQ ID NO: 8085100 - DNA, 22 bp, Homo sapiens
gcctctgggggctcagacctgt

SEQ ID NO: 8085101 - DNA, 22 bp, Homo sapiens
gcctctggggcagctgagtcat

SEQ ID NO: 8085102 - DNA, 22 bp, Homo sapiens
gcctctggggtggagcccagca

SEQ ID NO: 8085103 - DNA, 22 bp, Homo sapiens
gccttgggccagctgctctgga

SEQ ID NO: 8085104 - DNA, 22 bp, Homo sapiens
gctcccagaaccaaggctgggg

SEQ ID NO: 8085105 - DNA, 22 bp, Homo sapiens
gctccagggtggatgacaattc

SEQ ID NO: 8085106 - DNA, 22 bp, Homo sapiens
gctccaggtgaatcctctcacc

SEQ ID NO: 8085107 - DNA, 22 bp, Homo sapiens
gctccaggataataaagttgtt

SEQ ID NO: 8085108 - DNA, 21 bp, Homo sapiens
gctcagagtattgcactgttt

SEQ ID NO: 8085109 - DNA, 19 bp, Homo sapiens
gctcagagtccccctgcgg

SEQ ID NO: 8085110 - DNA, 23 bp, Homo sapiens
gctcagaggtttttctctggatg

SEQ ID NO: 8085111 - DNA, 22 bp, Homo sapiens
tatgtacacatacacttgtaat

SEQ ID NO: 8085112 - DNA, 22 bp, Homo sapiens
tatgtctagacccaagaatatg

SEQ ID NO: 8085113 - DNA, 22 bp, Homo sapiens
tattagcacaaagcaaggtatt

SEQ ID NO: 8085114 - DNA, 22 bp, Homo sapiens
tattagattaactttaatgtct

SEQ ID NO: 8085115 - DNA, 22 bp, Homo sapiens
tattacagttcgagtttctagg

SEQ ID NO: 8085116 - DNA, 22 bp, Homo sapiens
tatttataatctgccaaagaga

SEQ ID NO: 8085117 - DNA, 22 bp, Homo sapiens
tatttaattagtgattgtagag

SEQ ID NO: 8085118 - DNA, 22 bp, Homo sapiens
tattgacagatgcattatgttg

SEQ ID NO: 8085119 - DNA, 22 bp, Homo sapiens
tattctcagtgctataagtaga

SEQ ID NO: 8085120 - DNA, 22 bp, Homo sapiens
tattgacaatttgtgaaactat

SEQ ID NO: 8085121 - DNA, 22 bp, Homo sapiens
tattgacaataggcaactgagg

SEQ ID NO: 8085122 - DNA, 22 bp, Homo sapiens
tattaggtagattttactgatt

SEQ ID NO: 8085123 - DNA, 22 bp, Homo sapiens
tattattaaatggcagaatttt

SEQ ID NO: 8085124 - DNA, 22 bp, Homo sapiens
tattcaaagtaccttcattgcc

SEQ ID NO: 8085125 - DNA, 22 bp, Homo sapiens
tattcaaagtaccttcattgcc

SEQ ID NO: 8085126 - DNA, 22 bp, Homo sapiens
tattccttggcaaaaaatatat

SEQ ID NO: 8085127 - DNA, 22 bp, Homo sapiens
tataggtacttggaaaataagg

SEQ ID NO: 8085128 - DNA, 22 bp, Homo sapiens
tatagcatctaggatgattgca

SEQ ID NO: 8085129 - DNA, 22 bp, Homo sapiens
tatagcatggctatattgttgc

SEQ ID NO: 8085130 - DNA, 22 bp, Homo sapiens
tatagcatatacagataagctg

SEQ ID NO: 8085131 - DNA, 22 bp, Homo sapiens
tatagcaattcagaatacatgt

SEQ ID NO: 8085132 - DNA, 22 bp, Homo sapiens
tatctagaaacagagttttact

SEQ ID NO: 8085133 - DNA, 22 bp, Homo sapiens
taggtgggtgacttccatgggg

SEQ ID NO: 8085134 - DNA, 22 bp, Homo sapiens
tagggcagagcttgtacacgat

SEQ ID NO: 8085135 - DNA, 22 bp, Homo sapiens
tataacactcagaaagaatcat

SEQ ID NO: 8085136 - DNA, 22 bp, Homo sapiens
tataatttatcatgtcacagtt

SEQ ID NO: 8085137 - DNA, 22 bp, Homo sapiens
tataaattattaggctgctaaa

SEQ ID NO: 8085138 - DNA, 20 bp, Homo sapiens
tataaattcagagctttggt

SEQ ID NO: 8085139 - DNA, 20 bp, Homo sapiens
tataaattcagagctttggt

SEQ ID NO: 8085140 - DNA, 22 bp, Homo sapiens
tataaattaatgtgcccatgag

SEQ ID NO: 8085141 - DNA, 22 bp, Homo sapiens
tatacacacctccaaagcagga

SEQ ID NO: 8085142 - DNA, 23 bp, Homo sapiens
tatacacatgtggcagtatagtg

SEQ ID NO: 8085143 - DNA, 22 bp, Homo sapiens
tatacacatcctccaaagatag

SEQ ID NO: 8085144 - DNA, 22 bp, Homo sapiens
tatacacatcctccaaagatag

SEQ ID NO: 8085145 - DNA, 22 bp, Homo sapiens
tatacacatcctccaaagatag

SEQ ID NO: 8085146 - DNA, 22 bp, Homo sapiens
tatacacaggaatctgtgaaaa

SEQ ID NO: 8085147 - DNA, 22 bp, Homo sapiens
tatacacacctccaaagcagga

SEQ ID NO: 8085148 - DNA, 17 bp, Homo sapiens
tatacacagacagactg

SEQ ID NO: 8085149 - DNA, 22 bp, Homo sapiens
tatacagaaagaattcaagtct

SEQ ID NO: 8085150 - DNA, 22 bp, Homo sapiens
tatacacatttttacctatagt

SEQ ID NO: 8085151 - DNA, 22 bp, Homo sapiens
tatacacatgtgtgtattcata

SEQ ID NO: 8085152 - DNA, 22 bp, Homo sapiens
tagacacatacccttgcccaaa

SEQ ID NO: 8085153 - DNA, 22 bp, Homo sapiens
tagacaatgccatcttgtggtt

SEQ ID NO: 8085154 - DNA, 22 bp, Homo sapiens
tagaggccaaaatacccggcga

SEQ ID NO: 8085155 - DNA, 22 bp, Homo sapiens
tagaggccctgctcaccctccc

SEQ ID NO: 8085156 - DNA, 22 bp, Homo sapiens
tagacacatcttcatccacaat

SEQ ID NO: 8085157 - DNA, 22 bp, Homo sapiens
tagaaatgaatgtttaaaagtc

SEQ ID NO: 8085158 - DNA, 22 bp, Homo sapiens
tagaaatccccagtctcatagt

SEQ ID NO: 8085159 - DNA, 22 bp, Homo sapiens
tagaaatcacagaaaatcaggg

SEQ ID NO: 8085160 - DNA, 22 bp, Homo sapiens
tagaaagtgaaggttaattaat

SEQ ID NO: 8085161 - DNA, 22 bp, Homo sapiens
tagaaagtggttgagagtttag

SEQ ID NO: 8085162 - DNA, 22 bp, Homo sapiens
tagaaaggcaagcgtgaaatat

SEQ ID NO: 8085163 - DNA, 21 bp, Homo sapiens
tagaaagtcaaagctatcagc

SEQ ID NO: 8085164 - DNA, 22 bp, Homo sapiens
tagaaagtcatgaattacacca

SEQ ID NO: 8085165 - DNA, 22 bp, Homo sapiens
tagaaagtcaaaacactgtgtt

SEQ ID NO: 8085166 - DNA, 22 bp, Homo sapiens
tagaaagtagggaaggtaggat

SEQ ID NO: 8085167 - DNA, 22 bp, Homo sapiens
tagaaagtagccacttacagag

SEQ ID NO: 8085168 - DNA, 22 bp, Homo sapiens
tagaaagtaaacacgaagtctc

SEQ ID NO: 8085169 - DNA, 22 bp, Homo sapiens
tagaaagtaaatcagttttatt

SEQ ID NO: 8085170 - DNA, 22 bp, Homo sapiens
tagaaaggctgctgccaaccca

SEQ ID NO: 8085171 - DNA, 22 bp, Homo sapiens
tagaaagtactaaatttaactg

SEQ ID NO: 8085172 - DNA, 22 bp, Homo sapiens
tactttttgtctctttgaatgt

SEQ ID NO: 8085173 - DNA, 22 bp, Homo sapiens
tactttttatgataagaactga

SEQ ID NO: 8085174 - DNA, 22 bp, Homo sapiens
tactttttagcacagtgtgtgc

SEQ ID NO: 8085175 - DNA, 22 bp, Homo sapiens
tacttttatgtgatgaaatctg

SEQ ID NO: 8085176 - DNA, 22 bp, Homo sapiens
taccaaagaatattttaaatag

SEQ ID NO: 8085177 - DNA, 22 bp, Homo sapiens
tactttggttgaatatgtaatg

SEQ ID NO: 8085178 - DNA, 22 bp, Homo sapiens
tacttttaaaattcacaggtat

SEQ ID NO: 8085179 - DNA, 22 bp, Homo sapiens
tacttttagcctatttgattct

SEQ ID NO: 8085180 - DNA, 22 bp, Homo sapiens
tagaaacatcagctaaccaaaa

SEQ ID NO: 8085181 - DNA, 22 bp, Homo sapiens
tagaaactgatagtcttgtgct

SEQ ID NO: 8085182 - DNA, 22 bp, Homo sapiens
tagaaacattcagttgcagtcc

SEQ ID NO: 8085183 - DNA, 22 bp, Homo sapiens
tagcagcatttttgtagagtat

SEQ ID NO: 8085184 - DNA, 22 bp, Homo sapiens
tagcagaagttccaatgcatat

SEQ ID NO: 8085185 - DNA, 22 bp, Homo sapiens
tagaggtagcaacaggactaga

SEQ ID NO: 8085186 - DNA, 22 bp, Homo sapiens
tagctttaatgagttggtaaga

SEQ ID NO: 8085187 - DNA, 22 bp, Homo sapiens
tagctttaccatagaagagtat

SEQ ID NO: 8085188 - DNA, 22 bp, Homo sapiens
tacagaaatcacatcgctttga

SEQ ID NO: 8085189 - DNA, 22 bp, Homo sapiens
tacagaaattgccaccagctct

SEQ ID NO: 8085190 - DNA, 22 bp, Homo sapiens
tacagaaattgccaccagctct

SEQ ID NO: 8085191 - DNA, 22 bp, Homo sapiens
tacagaaatactggggggttct

SEQ ID NO: 8085192 - DNA, 22 bp, Homo sapiens
tacagaaatcacatcgctttga

SEQ ID NO: 8085193 - DNA, 22 bp, Homo sapiens
tacagaaatcacatcgctttga

SEQ ID NO: 8085194 - DNA, 22 bp, Homo sapiens
tacagaaatacagtcaggccta

SEQ ID NO: 8085195 - DNA, 22 bp, Homo sapiens
tacagaaattgccaccagctct

SEQ ID NO: 8085196 - DNA, 22 bp, Homo sapiens
tacagaagcttttgaaaagatg

SEQ ID NO: 8085197 - DNA, 22 bp, Homo sapiens
tacagaaggaagtttagctaaa

SEQ ID NO: 8085198 - DNA, 23 bp, Homo sapiens
tacagaaggagtagtcactaaga

SEQ ID NO: 8085199 - DNA, 22 bp, Homo sapiens
tacagatacagatctagataca

SEQ ID NO: 8085200 - DNA, 22 bp, Homo sapiens
tacagaagtaaataccaaaagc

SEQ ID NO: 8085201 - DNA, 22 bp, Homo sapiens
tacagattgaggtttttaatat

SEQ ID NO: 8085202 - DNA, 18 bp, Homo sapiens
tacagattatagatacat

SEQ ID NO: 8085203 - DNA, 22 bp, Homo sapiens
tacagcaaagaaaccctcagtc

SEQ ID NO: 8085204 - DNA, 22 bp, Homo sapiens
tacagattttgtgaagaagtgt

SEQ ID NO: 8085205 - DNA, 22 bp, Homo sapiens
tacagcaataatgacaccgctc

SEQ ID NO: 8085206 - DNA, 23 bp, Homo sapiens
tacagcaaggacaacataggtgg

SEQ ID NO: 8085207 - DNA, 22 bp, Homo sapiens
tacagcaagacagaccgctcaa

SEQ ID NO: 8085208 - DNA, 21 bp, Homo sapiens
tacagcaacggaggttttcta

SEQ ID NO: 8085209 - DNA, 22 bp, Homo sapiens
tacagcacagcaaagaggacgg

SEQ ID NO: 8085210 - DNA, 22 bp, Homo sapiens
tacagcacattgtgatggcact

SEQ ID NO: 8085211 - DNA, 22 bp, Homo sapiens
tacagcaatggttctaagagtc

SEQ ID NO: 8085212 - DNA, 22 bp, Homo sapiens
tacagcacaaagggcctttacc

SEQ ID NO: 8085213 - DNA, 22 bp, Homo sapiens
tacagcaatgctacaagatgac

SEQ ID NO: 8085214 - DNA, 22 bp, Homo sapiens
tacagcaatgcctgaaatagta

SEQ ID NO: 8085215 - DNA, 22 bp, Homo sapiens
tacaacaggaatttcaactttg

SEQ ID NO: 8085216 - DNA, 22 bp, Homo sapiens
tacaacaatttccacattagaa

SEQ ID NO: 8085217 - DNA, 20 bp, Homo sapiens
tacagaaacaggacttttgg

SEQ ID NO: 8085218 - DNA, 20 bp, Homo sapiens
tacagaaacaggacttttgg

SEQ ID NO: 8085219 - DNA, 22 bp, Homo sapiens
tacagaaagggatgattgatct

SEQ ID NO: 8085220 - DNA, 22 bp, Homo sapiens
tacagaaaaacttggaggcttt

SEQ ID NO: 8085221 - DNA, 22 bp, Homo sapiens
tacagaaaaactggcattgaag

SEQ ID NO: 8085222 - DNA, 22 bp, Homo sapiens
tacagaaaaactggcattgaag

SEQ ID NO: 8085223 - DNA, 20 bp, Homo sapiens
tacagaaacaggacttttgg

SEQ ID NO: 8085224 - DNA, 22 bp, Homo sapiens
tacagaaaaacatctggagccg

SEQ ID NO: 8085225 - DNA, 22 bp, Homo sapiens
tacattctactttttcactccc

SEQ ID NO: 8085226 - DNA, 23 bp, Homo sapiens
tacattctgtatttttatagagt

SEQ ID NO: 8085227 - DNA, 22 bp, Homo sapiens
tacatcatgtaagcagaatcat

SEQ ID NO: 8085228 - DNA, 22 bp, Homo sapiens
tacatcattttggagatgagca

SEQ ID NO: 8085229 - DNA, 22 bp, Homo sapiens
tacagtaagatgaaatagcaat

SEQ ID NO: 8085230 - DNA, 22 bp, Homo sapiens
tacagtaataaaatgagctaca

SEQ ID NO: 8085231 - DNA, 21 bp, Homo sapiens
tacagcaccgagtaggccctc

SEQ ID NO: 8085232 - DNA, 22 bp, Homo sapiens
tacagcacggtgcatttactac

SEQ ID NO: 8085233 - DNA, 22 bp, Homo sapiens
tacagcactctggggagcatga

SEQ ID NO: 8085234 - DNA, 19 bp, Homo sapiens
tacaggcagtttctacaat

SEQ ID NO: 8085235 - DNA, 22 bp, Homo sapiens
tacaaagatagtgttagagtaa

SEQ ID NO: 8085236 - DNA, 22 bp, Homo sapiens
tacaaagatggaaggttatgtt

SEQ ID NO: 8085237 - DNA, 22 bp, Homo sapiens
tacaaagatagtgttagagtaa

SEQ ID NO: 8085238 - DNA, 22 bp, Homo sapiens
tacaaagagtttggtctctaga

SEQ ID NO: 8085239 - DNA, 22 bp, Homo sapiens
tacaaagataaaatctcaccat

SEQ ID NO: 8085240 - DNA, 22 bp, Homo sapiens
tacaaagataaaatctcaccat

SEQ ID NO: 8085241 - DNA, 22 bp, Homo sapiens
tacaaaggacagcagaaaaata

SEQ ID NO: 8085242 - DNA, 22 bp, Homo sapiens
tacaaaggagactctgtattta

SEQ ID NO: 8085243 - DNA, 22 bp, Homo sapiens
tacaaaggaaacttcttttccc

SEQ ID NO: 8085244 - DNA, 22 bp, Homo sapiens
tacaaagtagaaattcagtaaa

SEQ ID NO: 8085245 - DNA, 22 bp, Homo sapiens
tacaaagggaatattggcttta

SEQ ID NO: 8085246 - DNA, 22 bp, Homo sapiens
tacaaaggaggtgcatagaaca

SEQ ID NO: 8085247 - DNA, 22 bp, Homo sapiens
tacaaactgttattattattgt

SEQ ID NO: 8085248 - DNA, 22 bp, Homo sapiens
tacaaactctttatatttcata

SEQ ID NO: 8085249 - DNA, 22 bp, Homo sapiens
tacaaagaggtaattgcatata

SEQ ID NO: 8085250 - DNA, 22 bp, Homo sapiens
tacaaagaggcagctccatttt

SEQ ID NO: 8085251 - DNA, 22 bp, Homo sapiens
tacaaagaggtaattgcatata

SEQ ID NO: 8085252 - DNA, 20 bp, Homo sapiens
tacaaagaatgaggttcagg

SEQ ID NO: 8085253 - DNA, 20 bp, Homo sapiens
tacaaagaatgaggttcagg

SEQ ID NO: 8085254 - DNA, 20 bp, Homo sapiens
tacaaagagcccctctcttc

SEQ ID NO: 8085255 - DNA, 22 bp, Homo sapiens
taatggtgcagtgggtgtaact

SEQ ID NO: 8085256 - DNA, 22 bp, Homo sapiens
taatactgctgtgcttgagttg

SEQ ID NO: 8085257 - DNA, 22 bp, Homo sapiens
taatactgggaaatacttgggt

SEQ ID NO: 8085258 - DNA, 22 bp, Homo sapiens
taatactgtaacttggtgggtc

SEQ ID NO: 8085259 - DNA, 23 bp, Homo sapiens
taattagatgttgattcctgaga

SEQ ID NO: 8085260 - DNA, 22 bp, Homo sapiens
taattacaggtccaaaacaatc

SEQ ID NO: 8085261 - DNA, 22 bp, Homo sapiens
taattacagaggtttgccagtt

SEQ ID NO: 8085262 - DNA, 22 bp, Homo sapiens
taattacaggtccaaaacaatc

SEQ ID NO: 8085263 - DNA, 22 bp, Homo sapiens
taatactgactaaagatatcaa

SEQ ID NO: 8085264 - DNA, 22 bp, Homo sapiens
taatactgaaaggagtatcagc

SEQ ID NO: 8085265 - DNA, 22 bp, Homo sapiens
taatacagtttccaagccagct

SEQ ID NO: 8085266 - DNA, 22 bp, Homo sapiens
taatacagatacaaaggaggac

SEQ ID NO: 8085267 - DNA, 22 bp, Homo sapiens
taagtggcagagcttgttctca

SEQ ID NO: 8085268 - DNA, 22 bp, Homo sapiens
taagtgtccctattgtgatttt

SEQ ID NO: 8085269 - DNA, 22 bp, Homo sapiens
taagtgttgctctctctcagct

SEQ ID NO: 8085270 - DNA, 22 bp, Homo sapiens
taagtagctcttggaatatata

SEQ ID NO: 8085271 - DNA, 22 bp, Homo sapiens
taagtagcctacaagtatattt

SEQ ID NO: 8085272 - DNA, 22 bp, Homo sapiens
taagtgcatctgatctttcatg

SEQ ID NO: 8085273 - DNA, 22 bp, Homo sapiens
taagtgcaatgttttacttaaa

SEQ ID NO: 8085274 - DNA, 21 bp, Homo sapiens
taagtgcaaagagacagatac

SEQ ID NO: 8085275 - DNA, 22 bp, Homo sapiens
taagtaaatttataatgtgatt

SEQ ID NO: 8085276 - DNA, 22 bp, Homo sapiens
taaggcttcttggaatactgca

SEQ ID NO: 8085277 - DNA, 22 bp, Homo sapiens
taaggctgtccaaaattttgac

SEQ ID NO: 8085278 - DNA, 22 bp, Homo sapiens
taaggcaatggcattcttgaca

SEQ ID NO: 8085279 - DNA, 22 bp, Homo sapiens
taaggcaaagtgatttcttaaa

SEQ ID NO: 8085280 - DNA, 22 bp, Homo sapiens
gtttcatgccatttccagattg

SEQ ID NO: 8085281 - DNA, 22 bp, Homo sapiens
gttgccttctatgattctcagt

SEQ ID NO: 8085282 - DNA, 23 bp, Homo sapiens
gttgcctttgcatcttcatccat

SEQ ID NO: 8085283 - DNA, 22 bp, Homo sapiens
gttcaattaagttacaaattta

SEQ ID NO: 8085284 - DNA, 22 bp, Homo sapiens
gttcagttttggggctgttaca

SEQ ID NO: 8085285 - DNA, 22 bp, Homo sapiens
gttcagttttgaaatgttaatt

SEQ ID NO: 8085286 - DNA, 22 bp, Homo sapiens
gttcagtttggggtatttgaag

SEQ ID NO: 8085287 - DNA, 22 bp, Homo sapiens
gttcagttatgtgacctcaaaa

SEQ ID NO: 8085288 - DNA, 22 bp, Homo sapiens
gttcagttatttctgaagatat

SEQ ID NO: 8085289 - DNA, 22 bp, Homo sapiens
gttcagtttgacaacctttata

SEQ ID NO: 8085290 - DNA, 22 bp, Homo sapiens
gttcagtttgagattaccatgg

SEQ ID NO: 8085291 - DNA, 22 bp, Homo sapiens
gttcatttatgatgtaacatgt

SEQ ID NO: 8085292 - DNA, 22 bp, Homo sapiens
gttcatttaggaaaggaagagt

SEQ ID NO: 8085293 - DNA, 22 bp, Homo sapiens
gtgtgcctatgagtggtgaaca

SEQ ID NO: 8085294 - DNA, 22 bp, Homo sapiens
gttaagtgaatgtcatgtcagg

SEQ ID NO: 8085295 - DNA, 22 bp, Homo sapiens
gttaagtgggaccagtgtcctt

SEQ ID NO: 8085296 - DNA, 22 bp, Homo sapiens
gttacaaagcacttcaagtgaa

SEQ ID NO: 8085297 - DNA, 18 bp, Homo sapiens
gttaattttgaagttcat

SEQ ID NO: 8085298 - DNA, 22 bp, Homo sapiens
gtgctctgagtttgcatgtcag

SEQ ID NO: 8085299 - DNA, 23 bp, Homo sapiens
gtgctctgcggtctgctagtctg

SEQ ID NO: 8085300 - DNA, 22 bp, Homo sapiens
gtgctctggctggtctcccggt

SEQ ID NO: 8085301 - DNA, 22 bp, Homo sapiens
taaaagttttagttgtacataa

SEQ ID NO: 8085302 - DNA, 22 bp, Homo sapiens
gtttttattgtgtaaatgtggg

SEQ ID NO: 8085303 - DNA, 22 bp, Homo sapiens
gtttttatctaatagcagttat

SEQ ID NO: 8085304 - DNA, 22 bp, Homo sapiens
taaaatttgtccctgagtgttg

SEQ ID NO: 8085305 - DNA, 22 bp, Homo sapiens
gtttcccaggctgtggggccct

SEQ ID NO: 8085306 - DNA, 22 bp, Homo sapiens
gttttgaaatgaaagaaccaag

SEQ ID NO: 8085307 - DNA, 22 bp, Homo sapiens
gttttgaagaagaccttgaaac

SEQ ID NO: 8085308 - DNA, 22 bp, Homo sapiens
gttttgaatactactagaactt

SEQ ID NO: 8085309 - DNA, 22 bp, Homo sapiens
gtttccaggcagggtgattctc

SEQ ID NO: 8085310 - DNA, 22 bp, Homo sapiens
gtttccagtcaacttgtgtgtg

SEQ ID NO: 8085311 - DNA, 22 bp, Homo sapiens
gtttccagcctcctgggtaaag

SEQ ID NO: 8085312 - DNA, 22 bp, Homo sapiens
gtttccagctttctgatgcttg

SEQ ID NO: 8085313 - DNA, 22 bp, Homo sapiens
taaattatgtcacatgactctg

SEQ ID NO: 8085314 - DNA, 20 bp, Homo sapiens
taaattagccttgaagatta

SEQ ID NO: 8085315 - DNA, 23 bp, Homo sapiens
taaattacctttccagtgcaggg

SEQ ID NO: 8085316 - DNA, 22 bp, Homo sapiens
taaagtaatccttcataaggag

SEQ ID NO: 8085317 - DNA, 22 bp, Homo sapiens
taaagtagcgcctaactaatgt

SEQ ID NO: 8085318 - DNA, 22 bp, Homo sapiens
taactgaatgtattacaacaga

SEQ ID NO: 8085319 - DNA, 22 bp, Homo sapiens
taaccaagcaaactttcattgt

SEQ ID NO: 8085320 - DNA, 20 bp, Homo sapiens
taaccaagaattggcaaggg

SEQ ID NO: 8085321 - DNA, 22 bp, Homo sapiens
taaccaataaccaataagatac

SEQ ID NO: 8085322 - DNA, 22 bp, Homo sapiens
taaccagacagaaacagctaga

SEQ ID NO: 8085323 - DNA, 22 bp, Homo sapiens
taaattctgatcaagttccttc

SEQ ID NO: 8085324 - DNA, 22 bp, Homo sapiens
taaattcccaactctgctcttc

SEQ ID NO: 8085325 - DNA, 22 bp, Homo sapiens
tcccagtgagcacaggtagtgc

SEQ ID NO: 8085326 - DNA, 22 bp, Homo sapiens
tcccagtgagatgaaacaggta

SEQ ID NO: 8085327 - DNA, 22 bp, Homo sapiens
tcccagtgggaagcagcacgct

SEQ ID NO: 8085328 - DNA, 22 bp, Homo sapiens
tcccagtggcttcataaggcag

SEQ ID NO: 8085329 - DNA, 19 bp, Homo sapiens
tcccagtggggagaggtgt

SEQ ID NO: 8085330 - DNA, 22 bp, Homo sapiens
tcccagtgctgctaaagaggta

SEQ ID NO: 8085331 - DNA, 22 bp, Homo sapiens
tcccagtgaggtcctggctgtc

SEQ ID NO: 8085332 - DNA, 22 bp, Homo sapiens
tcccagtgctacagacagggca

SEQ ID NO: 8085333 - DNA, 22 bp, Homo sapiens
tcccagtgggtgactggaggct

SEQ ID NO: 8085334 - DNA, 22 bp, Homo sapiens
tcccagtggtcctggccctggg

SEQ ID NO: 8085335 - DNA, 22 bp, Homo sapiens
tcccagtgtggcaggccatgga

SEQ ID NO: 8085336 - DNA, 22 bp, Homo sapiens
tcccagtggtcttgaaacaggg

SEQ ID NO: 8085337 - DNA, 22 bp, Homo sapiens
tcccagtggtgggtgcacattt

SEQ ID NO: 8085338 - DNA, 22 bp, Homo sapiens
tcccagggtgcgcctgccctcg

SEQ ID NO: 8085339 - DNA, 22 bp, Homo sapiens
tcccagggttacagccagggca

SEQ ID NO: 8085340 - DNA, 22 bp, Homo sapiens
tcccagggattaggacatggat

SEQ ID NO: 8085341 - DNA, 22 bp, Homo sapiens
tcccagggatcctccgggtcgc

SEQ ID NO: 8085342 - DNA, 22 bp, Homo sapiens
tcccagggtgaaatgcagtagg

SEQ ID NO: 8085343 - DNA, 21 bp, Homo sapiens
tcccagggtcttatgggatgt

SEQ ID NO: 8085344 - DNA, 22 bp, Homo sapiens
tcccagggactgggctaggctt

SEQ ID NO: 8085345 - DNA, 22 bp, Homo sapiens
tccccaggaaggcccttcctgg

SEQ ID NO: 8085346 - DNA, 22 bp, Homo sapiens
tccccaggaatcaggtggttgc

SEQ ID NO: 8085347 - DNA, 22 bp, Homo sapiens
tccccagggctgcagagggtgt

SEQ ID NO: 8085348 - DNA, 22 bp, Homo sapiens
tccccaggagttttactttgca

SEQ ID NO: 8085349 - DNA, 20 bp, Homo sapiens
tccccagggcatcaggagca

SEQ ID NO: 8085350 - DNA, 22 bp, Homo sapiens
tccccaggggcctgggcacagt

SEQ ID NO: 8085351 - DNA, 22 bp, Homo sapiens
tccccaggggcatctctctgct

SEQ ID NO: 8085352 - DNA, 22 bp, Homo sapiens
tccccagggtccctgcttccat

SEQ ID NO: 8085353 - DNA, 22 bp, Homo sapiens
tccaggaggtgaggggaccaaa

SEQ ID NO: 8085354 - DNA, 20 bp, Homo sapiens
tccaggaggttagtgtggct

SEQ ID NO: 8085355 - DNA, 22 bp, Homo sapiens
tccaggaggttgagactgcagt

SEQ ID NO: 8085356 - DNA, 22 bp, Homo sapiens
tccaggaggttgagtgagttcc

SEQ ID NO: 8085357 - DNA, 22 bp, Homo sapiens
tccaggagtcctgggagtgatt

SEQ ID NO: 8085358 - DNA, 21 bp, Homo sapiens
tccaggagtggctgggcaggg

SEQ ID NO: 8085359 - DNA, 22 bp, Homo sapiens
tccaggagtttgacctgtgggc

SEQ ID NO: 8085360 - DNA, 22 bp, Homo sapiens
tccaggagtttgagactgcagt

SEQ ID NO: 8085361 - DNA, 22 bp, Homo sapiens
tccagggctacaaggcaccaga

SEQ ID NO: 8085362 - DNA, 21 bp, Homo sapiens
tccagggcgggcgcacggaga

SEQ ID NO: 8085363 - DNA, 22 bp, Homo sapiens
tccagggcagggtgcgcatggg

SEQ ID NO: 8085364 - DNA, 22 bp, Homo sapiens
tccagggccacagaggatgcta

SEQ ID NO: 8085365 - DNA, 22 bp, Homo sapiens
tccagggccatgaagttgcaca

SEQ ID NO: 8085366 - DNA, 22 bp, Homo sapiens
tccagggccccccagttgcacg

SEQ ID NO: 8085367 - DNA, 20 bp, Homo sapiens
tccagggccctggctcctct

SEQ ID NO: 8085368 - DNA, 22 bp, Homo sapiens
tcccaaggcacagggcagggac

SEQ ID NO: 8085369 - DNA, 22 bp, Homo sapiens
tccagcatttttcaatagaatt

SEQ ID NO: 8085370 - DNA, 22 bp, Homo sapiens
tccagccaatcaactattgttt

SEQ ID NO: 8085371 - DNA, 23 bp, Homo sapiens
tccagctaagcaataatagaaga

SEQ ID NO: 8085372 - DNA, 22 bp, Homo sapiens
tccagaggggcagccctgtgct

SEQ ID NO: 8085373 - DNA, 20 bp, Homo sapiens
tccagaggccacatccagtg

SEQ ID NO: 8085374 - DNA, 21 bp, Homo sapiens
tccagaggaggacagactcag

SEQ ID NO: 8085375 - DNA, 20 bp, Homo sapiens
tccagagagtggcaaagctc

SEQ ID NO: 8085376 - DNA, 22 bp, Homo sapiens
tcaggtttttctcaaatcaggt

SEQ ID NO: 8085377 - DNA, 22 bp, Homo sapiens
tcaggtggctggttgctggcta

SEQ ID NO: 8085378 - DNA, 22 bp, Homo sapiens
tcagtcttttaactttctgcca

SEQ ID NO: 8085379 - DNA, 22 bp, Homo sapiens
tcagtctttcgaattcagccag

SEQ ID NO: 8085380 - DNA, 22 bp, Homo sapiens
tcagtcttgcttctcttgggtc

SEQ ID NO: 8085381 - DNA, 23 bp, Homo sapiens
tcagtcttggcttctgattttcc

SEQ ID NO: 8085382 - DNA, 22 bp, Homo sapiens
tcagtcttgtttttctggtcca

SEQ ID NO: 8085383 - DNA, 22 bp, Homo sapiens
tcagtgttaatcagtggtacct

SEQ ID NO: 8085384 - DNA, 22 bp, Homo sapiens
tcattatttgctttagttatgt

SEQ ID NO: 8085385 - DNA, 22 bp, Homo sapiens
tcattcactttgaaataaacga

SEQ ID NO: 8085386 - DNA, 22 bp, Homo sapiens
tcattattctctttaatgttct

SEQ ID NO: 8085387 - DNA, 22 bp, Homo sapiens
tcatagttatggagattaagga

SEQ ID NO: 8085388 - DNA, 22 bp, Homo sapiens
tcatagtttagttagtatgatt

SEQ ID NO: 8085389 - DNA, 22 bp, Homo sapiens
tcatagttttacttagtggtgt

SEQ ID NO: 8085390 - DNA, 22 bp, Homo sapiens
tcagtgttacattatatagaac

SEQ ID NO: 8085391 - DNA, 22 bp, Homo sapiens
tcatataccagagagtttatat

SEQ ID NO: 8085392 - DNA, 22 bp, Homo sapiens
tcatgctgaggggattttaaat

SEQ ID NO: 8085393 - DNA, 22 bp, Homo sapiens
tcatatttcaaaatggctggag

SEQ ID NO: 8085394 - DNA, 22 bp, Homo sapiens
tcatattagggtaatgataaga

SEQ ID NO: 8085395 - DNA, 22 bp, Homo sapiens
tcatatttaggcctttaattca

SEQ ID NO: 8085396 - DNA, 19 bp, Homo sapiens
tcaggcagttattcacaaa

SEQ ID NO: 8085397 - DNA, 20 bp, Homo sapiens
tcagcacagctgacaaggtt

SEQ ID NO: 8085398 - DNA, 22 bp, Homo sapiens
tcacttttgatccctatgcagt

SEQ ID NO: 8085399 - DNA, 22 bp, Homo sapiens
tcacttttgggtttccagtaga

SEQ ID NO: 8085400 - DNA, 22 bp, Homo sapiens
tcactttttgatatcattctgc

SEQ ID NO: 8085401 - DNA, 22 bp, Homo sapiens
tcagacagcttgggataactga

SEQ ID NO: 8085402 - DNA, 22 bp, Homo sapiens
tcactgaatgcagatacgtgac

SEQ ID NO: 8085403 - DNA, 22 bp, Homo sapiens
tcactgaatacttgtctcatcc

SEQ ID NO: 8085404 - DNA, 22 bp, Homo sapiens
tcactgaagtcttcaagtagga

SEQ ID NO: 8085405 - DNA, 22 bp, Homo sapiens
tcactgaagactgggctctaaa

SEQ ID NO: 8085406 - DNA, 21 bp, Homo sapiens
tcactgaagcctaagatgttt

SEQ ID NO: 8085407 - DNA, 22 bp, Homo sapiens
tcactgaaggaagacactgtca

SEQ ID NO: 8085408 - DNA, 22 bp, Homo sapiens
tcactgaatttcaagctagtgg

SEQ ID NO: 8085409 - DNA, 22 bp, Homo sapiens
tcactgaatttcaagctagtgg

SEQ ID NO: 8085410 - DNA, 22 bp, Homo sapiens
tcactgaatgcagatacgtgac

SEQ ID NO: 8085411 - DNA, 22 bp, Homo sapiens
tcactctgttttactcactgtt

SEQ ID NO: 8085412 - DNA, 22 bp, Homo sapiens
tcactgaaaaccatacttcttt

SEQ ID NO: 8085413 - DNA, 22 bp, Homo sapiens
tcactgaaagaatgacattatg

SEQ ID NO: 8085414 - DNA, 22 bp, Homo sapiens
tcactgaaagtaattctagtga

SEQ ID NO: 8085415 - DNA, 22 bp, Homo sapiens
tcactgaactctcatagagaaa

SEQ ID NO: 8085416 - DNA, 22 bp, Homo sapiens
tcactgaaccagggatctctag

SEQ ID NO: 8085417 - DNA, 22 bp, Homo sapiens
tcacccaggctggactgcagtg

SEQ ID NO: 8085418 - DNA, 19 bp, Homo sapiens
tcacaggcatctccccaga

SEQ ID NO: 8085419 - DNA, 22 bp, Homo sapiens
tcacagaataaattgagaagac

SEQ ID NO: 8085420 - DNA, 22 bp, Homo sapiens
tcacagaataaatgtactggcc

SEQ ID NO: 8085421 - DNA, 22 bp, Homo sapiens
tcacagaagttgaatttgcatg

SEQ ID NO: 8085422 - DNA, 20 bp, Homo sapiens
tcacaggggaccaggagcag

SEQ ID NO: 8085423 - DNA, 21 bp, Homo sapiens
tcacaggctcagggagagagt

SEQ ID NO: 8085424 - DNA, 22 bp, Homo sapiens
tcacaggctctccaccatgagg

SEQ ID NO: 8085425 - DNA, 22 bp, Homo sapiens
tcacaaagtgaagtgtgtcatg

SEQ ID NO: 8085426 - DNA, 22 bp, Homo sapiens
tcacaaagggagggatagctgg

SEQ ID NO: 8085427 - DNA, 20 bp, Homo sapiens
tcaattttctacaacatttg

SEQ ID NO: 8085428 - DNA, 22 bp, Homo sapiens
tcacaaagagaattgtgggtgt

SEQ ID NO: 8085429 - DNA, 22 bp, Homo sapiens
tcacaaagctttgataagcaga

SEQ ID NO: 8085430 - DNA, 22 bp, Homo sapiens
tcacaaaggatgatgaattctg

SEQ ID NO: 8085431 - DNA, 22 bp, Homo sapiens
tcacacatgagtaaatacaggg

SEQ ID NO: 8085432 - DNA, 22 bp, Homo sapiens
tcacaattcagaaaccaagtag

SEQ ID NO: 8085433 - DNA, 22 bp, Homo sapiens
tcacagaagagatattgacaga

SEQ ID NO: 8085434 - DNA, 22 bp, Homo sapiens
tcacagaagagcattaagatga

SEQ ID NO: 8085435 - DNA, 22 bp, Homo sapiens
tcacagaagagcattaagatga

SEQ ID NO: 8085436 - DNA, 22 bp, Homo sapiens
tcacagaagaagtagattgcat

SEQ ID NO: 8085437 - DNA, 22 bp, Homo sapiens
tcacagaaataagatagttatt

SEQ ID NO: 8085438 - DNA, 22 bp, Homo sapiens
tcacagaaataagatagttatt

SEQ ID NO: 8085439 - DNA, 22 bp, Homo sapiens
tatttcttgagactcgtcttcc

SEQ ID NO: 8085440 - DNA, 22 bp, Homo sapiens
tcaataaaattgttttcctatc

SEQ ID NO: 8085441 - DNA, 20 bp, Homo sapiens
tcaagttttgcttgacaaga

SEQ ID NO: 8085442 - DNA, 22 bp, Homo sapiens
tcaataactttgtttagcattg

SEQ ID NO: 8085443 - DNA, 22 bp, Homo sapiens
tcaataatggcaggataaattt

SEQ ID NO: 8085444 - DNA, 20 bp, Homo sapiens
tcaatttcaggtagcatagt

SEQ ID NO: 8085445 - DNA, 20 bp, Homo sapiens
tttctgtagctcagtattca

SEQ ID NO: 8085446 - DNA, 22 bp, Homo sapiens
tttctgtacacccactattcat

SEQ ID NO: 8085447 - DNA, 22 bp, Homo sapiens
tttctgtaagtggcaaataatg

SEQ ID NO: 8085448 - DNA, 20 bp, Homo sapiens
tttctgtaaggcattaatct

SEQ ID NO: 8085449 - DNA, 22 bp, Homo sapiens
tttctgaaggttaaggaattag

SEQ ID NO: 8085450 - DNA, 22 bp, Homo sapiens
tttctgaagtcttctaacagat

SEQ ID NO: 8085451 - DNA, 18 bp, Homo sapiens
tttctgaatgtctatttc

SEQ ID NO: 8085452 - DNA, 22 bp, Homo sapiens
tttctgaattcctaggatgttg

SEQ ID NO: 8085453 - DNA, 22 bp, Homo sapiens
tttctcgcgtttgagctctcag

SEQ ID NO: 8085454 - DNA, 22 bp, Homo sapiens
tttctctagctattcattaaat

SEQ ID NO: 8085455 - DNA, 22 bp, Homo sapiens
tttctgaaaactgaagtagtgc

SEQ ID NO: 8085456 - DNA, 22 bp, Homo sapiens
tttctgaacaaagccattatca

SEQ ID NO: 8085457 - DNA, 21 bp, Homo sapiens
tttctgaaggcaacatctatc

SEQ ID NO: 8085458 - DNA, 22 bp, Homo sapiens
tttcttcattgacaaggaaaaa

SEQ ID NO: 8085459 - DNA, 22 bp, Homo sapiens
tttcttccaaaggcacgttctc

SEQ ID NO: 8085460 - DNA, 22 bp, Homo sapiens
tttcttcccaagcagtttcaga

SEQ ID NO: 8085461 - DNA, 22 bp, Homo sapiens
tttcttccccaagtgaatttta

SEQ ID NO: 8085462 - DNA, 22 bp, Homo sapiens
tttctgtatttaaaagatctgg

SEQ ID NO: 8085463 - DNA, 22 bp, Homo sapiens
tttctgtaggggatatctttga

SEQ ID NO: 8085464 - DNA, 19 bp, Homo sapiens
tttctgtctgtgttttgcc

SEQ ID NO: 8085465 - DNA, 22 bp, Homo sapiens
tttctgttgtacttaaactagg

SEQ ID NO: 8085466 - DNA, 23 bp, Homo sapiens
tttctgttgggtatatatccaag

SEQ ID NO: 8085467 - DNA, 19 bp, Homo sapiens
tttctgttagaaggataca

SEQ ID NO: 8085468 - DNA, 22 bp, Homo sapiens
tttctgttaggcatcattttaa

SEQ ID NO: 8085469 - DNA, 22 bp, Homo sapiens
tttcttcctggattcctacttc

SEQ ID NO: 8085470 - DNA, 22 bp, Homo sapiens
tttcttcctatgtatcttgctg

SEQ ID NO: 8085471 - DNA, 22 bp, Homo sapiens
tttcttcctgctttgtcccatg

SEQ ID NO: 8085472 - DNA, 22 bp, Homo sapiens
tttcttcctaaatatgatttcc

SEQ ID NO: 8085473 - DNA, 22 bp, Homo sapiens
tttcttctaagatttcaaacta

SEQ ID NO: 8085474 - DNA, 22 bp, Homo sapiens
tttctttaaaggaactctgttt

SEQ ID NO: 8085475 - DNA, 22 bp, Homo sapiens
tttcctgtgactaatctggaca

SEQ ID NO: 8085476 - DNA, 22 bp, Homo sapiens
tttcctgttgccatcaagaatg

SEQ ID NO: 8085477 - DNA, 22 bp, Homo sapiens
tttctaagtctgagggagtata

SEQ ID NO: 8085478 - DNA, 22 bp, Homo sapiens
tttctacattcaaaaactacca

SEQ ID NO: 8085479 - DNA, 22 bp, Homo sapiens
tttctaatctttagttacaaaa

SEQ ID NO: 8085480 - DNA, 20 bp, Homo sapiens
tttcaaaggcacctatgaag

SEQ ID NO: 8085481 - DNA, 22 bp, Homo sapiens
tttcaaagaccattaactatca

SEQ ID NO: 8085482 - DNA, 22 bp, Homo sapiens
tttcaaagggaagttatgaagt

SEQ ID NO: 8085483 - DNA, 22 bp, Homo sapiens
tttccaaataaggtcacactca

SEQ ID NO: 8085484 - DNA, 22 bp, Homo sapiens
tttcattttggttatgccataa

SEQ ID NO: 8085485 - DNA, 22 bp, Homo sapiens
tttcagtggagtgacatgatct

SEQ ID NO: 8085486 - DNA, 22 bp, Homo sapiens
ttgttacagcagcaatagaaaa

SEQ ID NO: 8085487 - DNA, 22 bp, Homo sapiens
ttgttaaaaatagatttccagg

SEQ ID NO: 8085488 - DNA, 22 bp, Homo sapiens
ttgtttaagccacccaatctgt

SEQ ID NO: 8085489 - DNA, 22 bp, Homo sapiens
ttgtttaagccacccaatctgt

SEQ ID NO: 8085490 - DNA, 22 bp, Homo sapiens
ttgtttaagccacccaatctgt

SEQ ID NO: 8085491 - DNA, 22 bp, Homo sapiens
ttgtttaaagaacttctgactt

SEQ ID NO: 8085492 - DNA, 20 bp, Homo sapiens
ttgtttcctggctgttctgc

SEQ ID NO: 8085493 - DNA, 22 bp, Homo sapiens
ttgtttttaaacatgtgactga

SEQ ID NO: 8085494 - DNA, 22 bp, Homo sapiens
ttggtccaaagtcctctgagta

SEQ ID NO: 8085495 - DNA, 22 bp, Homo sapiens
ttggtgagtgctatgtaccaca

SEQ ID NO: 8085496 - DNA, 22 bp, Homo sapiens
ttggtgagtatggacacagaga

SEQ ID NO: 8085497 - DNA, 22 bp, Homo sapiens
ttgcaattaacatatgtcaact

SEQ ID NO: 8085498 - DNA, 18 bp, Homo sapiens
ttgcaaattcttccctgt

SEQ ID NO: 8085499 - DNA, 22 bp, Homo sapiens
ttgcaaattccaatccaatatt

SEQ ID NO: 8085500 - DNA, 23 bp, Homo sapiens
ttgcaaatttcagttagttcatg

SEQ ID NO: 8085501 - DNA, 23 bp, Homo sapiens
ttgtccttctgaaatatatctgg

SEQ ID NO: 8085502 - DNA, 23 bp, Homo sapiens
ttgtaaaacagtgtgacggttcc

SEQ ID NO: 8085503 - DNA, 22 bp, Homo sapiens
tttacaacctcatattctgatg

SEQ ID NO: 8085504 - DNA, 22 bp, Homo sapiens
tttactttctcaagtatatagg

SEQ ID NO: 8085505 - DNA, 22 bp, Homo sapiens
tttactttctcaagtatatagg

SEQ ID NO: 8085506 - DNA, 22 bp, Homo sapiens
tttactgtgcattagaatcacc

SEQ ID NO: 8085507 - DNA, 22 bp, Homo sapiens
tttactgtgtccatctgtgact

SEQ ID NO: 8085508 - DNA, 22 bp, Homo sapiens
tttactgagtgacctagaataa

SEQ ID NO: 8085509 - DNA, 21 bp, Homo sapiens
tttaatttgcatgtatgacgc

SEQ ID NO: 8085510 - DNA, 22 bp, Homo sapiens
tttaattatatctgggcagtta

SEQ ID NO: 8085511 - DNA, 22 bp, Homo sapiens
tttaattctggcataatagctc

SEQ ID NO: 8085512 - DNA, 22 bp, Homo sapiens
tttaattaggaaatgggcaggg

SEQ ID NO: 8085513 - DNA, 22 bp, Homo sapiens
tttaatttgaaatgagtaaccc

SEQ ID NO: 8085514 - DNA, 22 bp, Homo sapiens
tttaaaagttatcatctgtcca

SEQ ID NO: 8085515 - DNA, 22 bp, Homo sapiens
tttaatgtttgagtcagtatat

SEQ ID NO: 8085516 - DNA, 19 bp, Homo sapiens
tttaatgtgtgctgcaatc

SEQ ID NO: 8085517 - DNA, 22 bp, Homo sapiens
tttaatgttaaatttgtagatg

SEQ ID NO: 8085518 - DNA, 22 bp, Homo sapiens
tttattatgatggacaccttcg

SEQ ID NO: 8085519 - DNA, 22 bp, Homo sapiens
tttatttgtcttgccatttagt

SEQ ID NO: 8085520 - DNA, 22 bp, Homo sapiens
tttcaaacttaaatacctttcc

SEQ ID NO: 8085521 - DNA, 22 bp, Homo sapiens
tttcaaaagcgtacgtagtgaa

SEQ ID NO: 8085522 - DNA, 22 bp, Homo sapiens
tttcaaaattttgcagtggtaa

SEQ ID NO: 8085523 - DNA, 22 bp, Homo sapiens
tttcaaaattttgcagtggtaa

SEQ ID NO: 8085524 - DNA, 22 bp, Homo sapiens
tttataattatctctactctta

SEQ ID NO: 8085525 - DNA, 22 bp, Homo sapiens
tttattaagatgcgaatgctga

SEQ ID NO: 8085526 - DNA, 22 bp, Homo sapiens
tttatataacagagactgctat

SEQ ID NO: 8085527 - DNA, 23 bp, Homo sapiens
tttatagcagcatgatttataat

SEQ ID NO: 8085528 - DNA, 23 bp, Homo sapiens
tttatagcagcatgatttatagt

SEQ ID NO: 8085529 - DNA, 22 bp, Homo sapiens
ttttctttaatctggtggggtg

SEQ ID NO: 8085530 - DNA, 22 bp, Homo sapiens
ttttctaagggaaacgtcctcc

SEQ ID NO: 8085531 - DNA, 22 bp, Homo sapiens
ttttctaacatctagtaatttg

SEQ ID NO: 8085532 - DNA, 22 bp, Homo sapiens
ttttctaacatctagtaatttg

SEQ ID NO: 8085533 - DNA, 22 bp, Homo sapiens
ttttccttctgatactccattt

SEQ ID NO: 8085534 - DNA, 22 bp, Homo sapiens
tttttcatgagactagaagtca

SEQ ID NO: 8085535 - DNA, 22 bp, Homo sapiens
ttttggcagattacttaatatg

SEQ ID NO: 8085536 - DNA, 22 bp, Homo sapiens
tttttcattgcagcctctctcc

SEQ ID NO: 8085537 - DNA, 22 bp, Homo sapiens
tttttcctagcgatttgtcagc

SEQ ID NO: 8085538 - DNA, 22 bp, Homo sapiens
tttttccttaggggttactcac

SEQ ID NO: 8085539 - DNA, 22 bp, Homo sapiens
ttttgaaagccaggtttgtatg

SEQ ID NO: 8085540 - DNA, 22 bp, Homo sapiens
ttttgaaagggtgatttggctt

SEQ ID NO: 8085541 - DNA, 22 bp, Homo sapiens
ttttggcaaaggcattctcttt

SEQ ID NO: 8085542 - DNA, 22 bp, Homo sapiens
ttttgcctaagaatctctctga

SEQ ID NO: 8085543 - DNA, 22 bp, Homo sapiens
ttttggaatttatacagtaatg

SEQ ID NO: 8085544 - DNA, 22 bp, Homo sapiens
ttttggaatgaggaacatccag

SEQ ID NO: 8085545 - DNA, 22 bp, Homo sapiens
ttttgcaaagtacattatcagg

SEQ ID NO: 8085546 - DNA, 22 bp, Homo sapiens
tttttgggtccaggctgtatct

SEQ ID NO: 8085547 - DNA, 22 bp, Homo sapiens
tttgtttacaaaaataagcagt

SEQ ID NO: 8085548 - DNA, 22 bp, Homo sapiens
tttgtttacaaaaataagcagt

SEQ ID NO: 8085549 - DNA, 22 bp, Homo sapiens
tttgttcacctagcaaactttt

SEQ ID NO: 8085550 - DNA, 22 bp, Homo sapiens
tttgtagcagcatgatttataa

SEQ ID NO: 8085551 - DNA, 22 bp, Homo sapiens
ttttagtttggatttctaaagc

SEQ ID NO: 8085552 - DNA, 22 bp, Homo sapiens
ttttatagctgaatagtattcc

SEQ ID NO: 8085553 - DNA, 22 bp, Homo sapiens
ttttataagcaagaaagggaaa

SEQ ID NO: 8085554 - DNA, 22 bp, Homo sapiens
ttttatcaatcattaagacatt

SEQ ID NO: 8085555 - DNA, 22 bp, Homo sapiens
ttttatcagcagggataacaag

SEQ ID NO: 8085556 - DNA, 22 bp, Homo sapiens
ttttaaactcccctagttggtg

SEQ ID NO: 8085557 - DNA, 22 bp, Homo sapiens
tttgtttagatggtaaatcagt

SEQ ID NO: 8085558 - DNA, 22 bp, Homo sapiens
tttggcaaagatcaacatgtta

SEQ ID NO: 8085559 - DNA, 22 bp, Homo sapiens
tttggcaacggagaacttactc

SEQ ID NO: 8085560 - DNA, 22 bp, Homo sapiens
tttggcaaagatggctagctgt

SEQ ID NO: 8085561 - DNA, 22 bp, Homo sapiens
tttggagagagttaaatatgtt

SEQ ID NO: 8085562 - DNA, 22 bp, Homo sapiens
tttggaacaagacaaaacatta

SEQ ID NO: 8085563 - DNA, 22 bp, Homo sapiens
tttggacatgagtctttaatct

SEQ ID NO: 8085564 - DNA, 22 bp, Homo sapiens
tttggacacattatttatcttc

SEQ ID NO: 8085565 - DNA, 22 bp, Homo sapiens
tttggacaaatgtctgactttc

SEQ ID NO: 8085566 - DNA, 22 bp, Homo sapiens
tttggcaagcgagtactttctg

SEQ ID NO: 8085567 - DNA, 22 bp, Homo sapiens
tttggcaagcgagtactttctg

SEQ ID NO: 8085568 - DNA, 22 bp, Homo sapiens
tttggcaagtgggaaattagta

SEQ ID NO: 8085569 - DNA, 22 bp, Homo sapiens
tttggcactgttctaggtgcaa

SEQ ID NO: 8085570 - DNA, 22 bp, Homo sapiens
tttctttcaattctcctaatgc

SEQ ID NO: 8085571 - DNA, 22 bp, Homo sapiens
tttctttccatacatattgcta

SEQ ID NO: 8085572 - DNA, 22 bp, Homo sapiens
tttgcaaataccatgaaacttg

SEQ ID NO: 8085573 - DNA, 22 bp, Homo sapiens
tttgcaaatacagaggtcttgc

SEQ ID NO: 8085574 - DNA, 22 bp, Homo sapiens
tttgcaaaatgaggtgaagagt

SEQ ID NO: 8085575 - DNA, 22 bp, Homo sapiens
tttgcaaataaataagtgctcg

SEQ ID NO: 8085576 - DNA, 23 bp, Homo sapiens
ttctttcaagaagttcacagtgc

SEQ ID NO: 8085577 - DNA, 22 bp, Homo sapiens
ttctttctcaacatgaatgttt

SEQ ID NO: 8085578 - DNA, 22 bp, Homo sapiens
ttgattactatgtgttgaaagc

SEQ ID NO: 8085579 - DNA, 22 bp, Homo sapiens
ttgatttcaaaatatatgcttg

SEQ ID NO: 8085580 - DNA, 22 bp, Homo sapiens
ttgcaaataaacaagtatacat

SEQ ID NO: 8085581 - DNA, 22 bp, Homo sapiens
ttgcaaatctttgccagaaggc

SEQ ID NO: 8085582 - DNA, 22 bp, Homo sapiens
ttgcaaatgaccattgccacat

SEQ ID NO: 8085583 - DNA, 22 bp, Homo sapiens
ttgcaaatattgtttacctttc

SEQ ID NO: 8085584 - DNA, 22 bp, Homo sapiens
ttgcaaatcagaagtatagatt

SEQ ID NO: 8085585 - DNA, 22 bp, Homo sapiens
ttgcaaatgtttcataacagta

SEQ ID NO: 8085586 - DNA, 22 bp, Homo sapiens
ttgcaaatggtaccaagggtct

SEQ ID NO: 8085587 - DNA, 22 bp, Homo sapiens
ttgcaaatgggcaaagcagatc

SEQ ID NO: 8085588 - DNA, 22 bp, Homo sapiens
ttctgctatgaaaaaagtgctg

SEQ ID NO: 8085589 - DNA, 19 bp, Homo sapiens
ttctgctagaccatttgtt

SEQ ID NO: 8085590 - DNA, 22 bp, Homo sapiens
ttctgacagtaatcagtttgct

SEQ ID NO: 8085591 - DNA, 22 bp, Homo sapiens
ttctgacacattactacatgga

SEQ ID NO: 8085592 - DNA, 22 bp, Homo sapiens
ttctataagactcatatttctt

SEQ ID NO: 8085593 - DNA, 22 bp, Homo sapiens
ttctagttttgccttatcaaca

SEQ ID NO: 8085594 - DNA, 22 bp, Homo sapiens
ttctcttttgtgatgtgagatg

SEQ ID NO: 8085595 - DNA, 22 bp, Homo sapiens
ttctagtttccattttaagaca

SEQ ID NO: 8085596 - DNA, 22 bp, Homo sapiens
ttctagtgtccttggacttgct

SEQ ID NO: 8085597 - DNA, 22 bp, Homo sapiens
ttcttaaaacttatggacaggt

SEQ ID NO: 8085598 - DNA, 22 bp, Homo sapiens
ttctgttttgcacagacttgaa

SEQ ID NO: 8085599 - DNA, 22 bp, Homo sapiens
ttctgtttactcagaaatacaa

SEQ ID NO: 8085600 - DNA, 22 bp, Homo sapiens
ttctgttatcattaagcattat

SEQ ID NO: 8085601 - DNA, 22 bp, Homo sapiens
ttctgttatcattaagcattat

SEQ ID NO: 8085602 - DNA, 22 bp, Homo sapiens
ttcttgctcaatgtctgtttaa

SEQ ID NO: 8085603 - DNA, 22 bp, Homo sapiens
ttcttggaaactgattccttgt

SEQ ID NO: 8085604 - DNA, 22 bp, Homo sapiens
ttctttaaaatagtgagaaaga

SEQ ID NO: 8085605 - DNA, 18 bp, Homo sapiens
ttctttaattcagtttga

SEQ ID NO: 8085606 - DNA, 22 bp, Homo sapiens
ttcttgagtatctgcacagtgc

SEQ ID NO: 8085607 - DNA, 22 bp, Homo sapiens
ttcttgaaggggatataaatag

SEQ ID NO: 8085608 - DNA, 22 bp, Homo sapiens
ttcttgaatagggattgataaa

SEQ ID NO: 8085609 - DNA, 19 bp, Homo sapiens
ttcttgaacatgtttctca

SEQ ID NO: 8085610 - DNA, 22 bp, Homo sapiens
ttcttctttccccctgtggtac

SEQ ID NO: 8085611 - DNA, 22 bp, Homo sapiens
ttcttctttatctcagtatcct

SEQ ID NO: 8085612 - DNA, 22 bp, Homo sapiens
ttcttcttgtctgccctcacat

SEQ ID NO: 8085613 - DNA, 22 bp, Homo sapiens
ttcttacatcagtttattttgt

SEQ ID NO: 8085614 - DNA, 22 bp, Homo sapiens
ttcttacagccctattactaaa

SEQ ID NO: 8085615 - DNA, 22 bp, Homo sapiens
ttcagtctcctcattttacaaa

SEQ ID NO: 8085616 - DNA, 22 bp, Homo sapiens
ttcagtattcaaatatgtctta

SEQ ID NO: 8085617 - DNA, 22 bp, Homo sapiens
ttcagtatgtgtaaactacttt

SEQ ID NO: 8085618 - DNA, 22 bp, Homo sapiens
ttcagtatgctgaatgattttt

SEQ ID NO: 8085619 - DNA, 22 bp, Homo sapiens
ttcagtatccctgcttggacag

SEQ ID NO: 8085620 - DNA, 22 bp, Homo sapiens
ttcagtatacttcataacattt

SEQ ID NO: 8085621 - DNA, 22 bp, Homo sapiens
ttcatgttggcatgtttttagg

SEQ ID NO: 8085622 - DNA, 22 bp, Homo sapiens
ttcatgttcatgcttaggaaaa

SEQ ID NO: 8085623 - DNA, 22 bp, Homo sapiens
ttccaattgttctttggaatct

SEQ ID NO: 8085624 - DNA, 20 bp, Homo sapiens
ttcatggtgtatttctttct

SEQ ID NO: 8085625 - DNA, 22 bp, Homo sapiens
ttcagtcttgttgaaaacttgg

SEQ ID NO: 8085626 - DNA, 22 bp, Homo sapiens
ttcagtgtcaatttttaaatat

SEQ ID NO: 8085627 - DNA, 22 bp, Homo sapiens
ttcatgcactatttcttctagc

SEQ ID NO: 8085628 - DNA, 22 bp, Homo sapiens
ttcaagaagcccaaagactagc

SEQ ID NO: 8085629 - DNA, 22 bp, Homo sapiens
ttcaatttgtgctaaggcaccg

SEQ ID NO: 8085630 - DNA, 22 bp, Homo sapiens
ttcacaaaatggtttgttgatg

SEQ ID NO: 8085631 - DNA, 22 bp, Homo sapiens
ttcacaaagctggagcatttcc

SEQ ID NO: 8085632 - DNA, 22 bp, Homo sapiens
ttcacaaagctggttccttctg

SEQ ID NO: 8085633 - DNA, 22 bp, Homo sapiens
ttcacagtgagctatgtcttgt

SEQ ID NO: 8085634 - DNA, 22 bp, Homo sapiens
ttcaacaaggctgtcaaaagtt

SEQ ID NO: 8085635 - DNA, 22 bp, Homo sapiens
ttcaacaatgaaagctaaggaa

SEQ ID NO: 8085636 - DNA, 22 bp, Homo sapiens
ttagagttttctgttcctctaa

SEQ ID NO: 8085637 - DNA, 22 bp, Homo sapiens
ttagagttaggatttgtcttta

SEQ ID NO: 8085638 - DNA, 22 bp, Homo sapiens
ttagagttcagcatgactttga

SEQ ID NO: 8085639 - DNA, 22 bp, Homo sapiens
ttcaacagcttccaaagtgtgt

SEQ ID NO: 8085640 - DNA, 22 bp, Homo sapiens
ttctagcttgagtgaataaagg

SEQ ID NO: 8085641 - DNA, 22 bp, Homo sapiens
ttctagcatgccttttagcaca

SEQ ID NO: 8085642 - DNA, 22 bp, Homo sapiens
ttctagatatctagtgtataac

SEQ ID NO: 8085643 - DNA, 22 bp, Homo sapiens
ttctagattgcctgtaagtaaa

SEQ ID NO: 8085644 - DNA, 22 bp, Homo sapiens
ttctaattattcccttgtccca

SEQ ID NO: 8085645 - DNA, 19 bp, Homo sapiens
ttctaatgttacattttgg

SEQ ID NO: 8085646 - DNA, 22 bp, Homo sapiens
ttctaattgtgtttgcatatct

SEQ ID NO: 8085647 - DNA, 20 bp, Homo sapiens
ttctaatttgatggagtagc

SEQ ID NO: 8085648 - DNA, 22 bp, Homo sapiens
ttcctcagggcggatgggcagg

SEQ ID NO: 8085649 - DNA, 22 bp, Homo sapiens
ttcctaggtgtttacattcaac

SEQ ID NO: 8085650 - DNA, 22 bp, Homo sapiens
ttccacagatgtatgaagtggt

SEQ ID NO: 8085651 - DNA, 22 bp, Homo sapiens
ttaccaaatcccgtgcacattc

SEQ ID NO: 8085652 - DNA, 22 bp, Homo sapiens
ttactgaaagtatacatttctg

SEQ ID NO: 8085653 - DNA, 22 bp, Homo sapiens
ttactgaaagtatacatttctg

SEQ ID NO: 8085654 - DNA, 22 bp, Homo sapiens
ttactgaaggtggatagtgagt

SEQ ID NO: 8085655 - DNA, 22 bp, Homo sapiens
ttactgatgtcattagaaacag

SEQ ID NO: 8085656 - DNA, 22 bp, Homo sapiens
ttacttcttacaaaagaaatat

SEQ ID NO: 8085657 - DNA, 22 bp, Homo sapiens
ttactttccagctctagcttca

SEQ ID NO: 8085658 - DNA, 22 bp, Homo sapiens
ttagaagtaaggtcagatttct

SEQ ID NO: 8085659 - DNA, 22 bp, Homo sapiens
ttagacatcaagaagccaatgt

SEQ ID NO: 8085660 - DNA, 22 bp, Homo sapiens
ttacactttggcaagctattaa

SEQ ID NO: 8085661 - DNA, 22 bp, Homo sapiens
ttacatattatccaaaactgct

SEQ ID NO: 8085662 - DNA, 22 bp, Homo sapiens
ttacatcattgagacatacata

SEQ ID NO: 8085663 - DNA, 22 bp, Homo sapiens
ttacatcagaaggaaacagcgt

SEQ ID NO: 8085664 - DNA, 22 bp, Homo sapiens
ttacaaacaacagacatttatt

SEQ ID NO: 8085665 - DNA, 22 bp, Homo sapiens
ttacaaacaacagacatttatt

SEQ ID NO: 8085666 - DNA, 22 bp, Homo sapiens
ttacaaacaacagacatttatt

SEQ ID NO: 8085667 - DNA, 22 bp, Homo sapiens
ttacaaactgtcatatagtatt

SEQ ID NO: 8085668 - DNA, 22 bp, Homo sapiens
ttacaaacaagatcttattctt

SEQ ID NO: 8085669 - DNA, 22 bp, Homo sapiens
ttacacaagttctttaacctat

SEQ ID NO: 8085670 - DNA, 22 bp, Homo sapiens
ttacacaggcacttaaaatgca

SEQ ID NO: 8085671 - DNA, 22 bp, Homo sapiens
ttacacagaaattttattgcct

SEQ ID NO: 8085672 - DNA, 22 bp, Homo sapiens
ttacacagtgcacaagcagagt

SEQ ID NO: 8085673 - DNA, 22 bp, Homo sapiens
ttacactgacagctgaaaagca

SEQ ID NO: 8085674 - DNA, 22 bp, Homo sapiens
ttaaatgctcacataaaggtag

SEQ ID NO: 8085675 - DNA, 22 bp, Homo sapiens
ttaaatgaggctgatgtagatt

SEQ ID NO: 8085676 - DNA, 22 bp, Homo sapiens
ttaacacagggggagacaaagt

SEQ ID NO: 8085677 - DNA, 22 bp, Homo sapiens
ttaacacagggggagacaaagt

SEQ ID NO: 8085678 - DNA, 22 bp, Homo sapiens
ttaacacatatttatcaattgc

SEQ ID NO: 8085679 - DNA, 22 bp, Homo sapiens
ttaacacatatttatcaattgc

SEQ ID NO: 8085680 - DNA, 22 bp, Homo sapiens
ttaacaaagctctgttcctttt

SEQ ID NO: 8085681 - DNA, 22 bp, Homo sapiens
ttaacaaagctctgttcctttt

SEQ ID NO: 8085682 - DNA, 22 bp, Homo sapiens
ttaacaaagtaacgggaaaaga

SEQ ID NO: 8085683 - DNA, 22 bp, Homo sapiens
ttaacaatagagtttcttcagg

SEQ ID NO: 8085684 - DNA, 22 bp, Homo sapiens
ttaaagcatgttgcttaacagg

SEQ ID NO: 8085685 - DNA, 22 bp, Homo sapiens
ttaaagcatcctgtcagtctgt

SEQ ID NO: 8085686 - DNA, 22 bp, Homo sapiens
tgtttttcaaatattgctctgt

SEQ ID NO: 8085687 - DNA, 22 bp, Homo sapiens
ttaaagcagtttgtatacatgg

SEQ ID NO: 8085688 - DNA, 22 bp, Homo sapiens
tgtttttatctctgtgtacaac

SEQ ID NO: 8085689 - DNA, 22 bp, Homo sapiens
tgtttttaaataatgatagaaa

SEQ ID NO: 8085690 - DNA, 19 bp, Homo sapiens
tgttttgttaaagcagtcc

SEQ ID NO: 8085691 - DNA, 22 bp, Homo sapiens
ttaagtgcaaaaatgaaagtat

SEQ ID NO: 8085692 - DNA, 22 bp, Homo sapiens
ttaagtgccagtgctccctcag

SEQ ID NO: 8085693 - DNA, 22 bp, Homo sapiens
ttaagtgcctctaaaacaagcc

SEQ ID NO: 8085694 - DNA, 18 bp, Homo sapiens
ttaagtgctatgcaattg

SEQ ID NO: 8085695 - DNA, 22 bp, Homo sapiens
ttaaggctgtaagatacattca

SEQ ID NO: 8085696 - DNA, 22 bp, Homo sapiens
ttaaggctgtaagatacattca

SEQ ID NO: 8085697 - DNA, 22 bp, Homo sapiens
ttaattactaagcacaatgcaa

SEQ ID NO: 8085698 - DNA, 22 bp, Homo sapiens
ttaattctagtttaacacttag

SEQ ID NO: 8085699 - DNA, 22 bp, Homo sapiens
ttaattgttggaaatagattat

SEQ ID NO: 8085700 - DNA, 22 bp, Homo sapiens
ttaattgtaaagtttgcctgtt

SEQ ID NO: 8085701 - DNA, 22 bp, Homo sapiens
ttaacagtaaagaattgtgcaa

SEQ ID NO: 8085702 - DNA, 22 bp, Homo sapiens
ttaacagttaaacaattggcta

SEQ ID NO: 8085703 - DNA, 22 bp, Homo sapiens
ttaagaaggtactcaaagatct

SEQ ID NO: 8085704 - DNA, 22 bp, Homo sapiens
tgtttccctggaagaggagaga

SEQ ID NO: 8085705 - DNA, 22 bp, Homo sapiens
tgtttcttgggtgctcacatca

SEQ ID NO: 8085706 - DNA, 22 bp, Homo sapiens
tgtttcttgataaagcagaaaa

SEQ ID NO: 8085707 - DNA, 22 bp, Homo sapiens
tgtttctttgtagatattcttt

SEQ ID NO: 8085708 - DNA, 22 bp, Homo sapiens
tgtttcatgtggacatagttgt

SEQ ID NO: 8085709 - DNA, 22 bp, Homo sapiens
tgtttacatgcataagcttaag

SEQ ID NO: 8085710 - DNA, 22 bp, Homo sapiens
tgtttaataattctatgatagt

SEQ ID NO: 8085711 - DNA, 22 bp, Homo sapiens
tgtttaatcttcaggacagtct

SEQ ID NO: 8085712 - DNA, 22 bp, Homo sapiens
tgtttaatttcacaaagttgac

SEQ ID NO: 8085713 - DNA, 22 bp, Homo sapiens
tgtttacagggtgattttacct

SEQ ID NO: 8085714 - DNA, 22 bp, Homo sapiens
tgtttacagggtgattttacct

SEQ ID NO: 8085715 - DNA, 22 bp, Homo sapiens
tgtttacaagccacttgttaag

SEQ ID NO: 8085716 - DNA, 22 bp, Homo sapiens
tgtttacaaggagaatttgagg

SEQ ID NO: 8085717 - DNA, 22 bp, Homo sapiens
tgtttacaaggagtttatattg

SEQ ID NO: 8085718 - DNA, 22 bp, Homo sapiens
tgtgttaattccacaaacattc

SEQ ID NO: 8085719 - DNA, 22 bp, Homo sapiens
tgtgtgcaattcttaacataca

SEQ ID NO: 8085720 - DNA, 21 bp, Homo sapiens
tgtgtgcatatgcatgtacat

SEQ ID NO: 8085721 - DNA, 22 bp, Homo sapiens
tgtgtttcagaaccttctttca

SEQ ID NO: 8085722 - DNA, 22 bp, Homo sapiens
tgtgtttaaagaggaagtgaga

SEQ ID NO: 8085723 - DNA, 22 bp, Homo sapiens
tgtgtttatagtgtatcttcca

SEQ ID NO: 8085724 - DNA, 22 bp, Homo sapiens
tgtgttttggaaggaacatgca

SEQ ID NO: 8085725 - DNA, 22 bp, Homo sapiens
tgttaaaaatgcagattcctat

SEQ ID NO: 8085726 - DNA, 22 bp, Homo sapiens
tgttattgatatctaatgctct

SEQ ID NO: 8085727 - DNA, 22 bp, Homo sapiens
tgttcagaacaaaggtaaatga

SEQ ID NO: 8085728 - DNA, 22 bp, Homo sapiens
tgtgtaaatggcatctctcagc

SEQ ID NO: 8085729 - DNA, 22 bp, Homo sapiens
tgtgtaaagcttgttccagaaa

SEQ ID NO: 8085730 - DNA, 22 bp, Homo sapiens
tgtgtaaaatctgattaatact

SEQ ID NO: 8085731 - DNA, 22 bp, Homo sapiens
tgtgtcttggccaccttgggaa

SEQ ID NO: 8085732 - DNA, 22 bp, Homo sapiens
tgtgtcctgtgatctctagggt

SEQ ID NO: 8085733 - DNA, 22 bp, Homo sapiens
tgtggcagaaagcatgtggaca

SEQ ID NO: 8085734 - DNA, 22 bp, Homo sapiens
tgtggcagtataagagctagaa

SEQ ID NO: 8085735 - DNA, 21 bp, Homo sapiens
tgtggcagatgttgggaggca

SEQ ID NO: 8085736 - DNA, 22 bp, Homo sapiens
tgtggcagtctcactggagggc

SEQ ID NO: 8085737 - DNA, 22 bp, Homo sapiens
tccccccagcctttcacatgag

SEQ ID NO: 8085738 - DNA, 22 bp, Homo sapiens
tcccccagtctgggcgtggtca

SEQ ID NO: 8085739 - DNA, 17 bp, Homo sapiens
tcccccagggctctctc

SEQ ID NO: 8085740 - DNA, 22 bp, Homo sapiens
tccccaggtcctgtcggctcct

SEQ ID NO: 8085741 - DNA, 22 bp, Homo sapiens
gcagtgttacctcttcagtggg

SEQ ID NO: 8085742 - DNA, 20 bp, Homo sapiens
gccaacgcgctggggctgcc

SEQ ID NO: 8085743 - DNA, 22 bp, Homo sapiens
gccaacaggccttgctctgctc

SEQ ID NO: 8085744 - DNA, 22 bp, Homo sapiens
attgtgcaaatattatctgtag

SEQ ID NO: 8085745 - DNA, 22 bp, Homo sapiens
attcttcagtatgtgtggattg

SEQ ID NO: 8085746 - DNA, 22 bp, Homo sapiens
gcaggcggaggttgcagtgagc

SEQ ID NO: 8085747 - DNA, 22 bp, Homo sapiens
gcaggcctttatccctgcctca

SEQ ID NO: 8085748 - DNA, 22 bp, Homo sapiens
attcaaattaagttaattcagc

SEQ ID NO: 8085749 - DNA, 22 bp, Homo sapiens
attagatatttgctgttggatt

SEQ ID NO: 8085750 - DNA, 22 bp, Homo sapiens
attagtaaaacattgtatatgt

SEQ ID NO: 8085751 - DNA, 22 bp, Homo sapiens
attacagtgggtaaacagaatt

SEQ ID NO: 8085752 - DNA, 22 bp, Homo sapiens
attacctatttcattttctgtc

SEQ ID NO: 8085753 - DNA, 22 bp, Homo sapiens
attacctatttcattttctgtc

SEQ ID NO: 8085754 - DNA, 22 bp, Homo sapiens
attacctatttcattttctgtc

SEQ ID NO: 8085755 - DNA, 22 bp, Homo sapiens
attagaggttgttttgtaaaga

SEQ ID NO: 8085756 - DNA, 22 bp, Homo sapiens
gatttctagtaagtcatgaagg

SEQ ID NO: 8085757 - DNA, 22 bp, Homo sapiens
gcagcgacaggcactggtcagg

SEQ ID NO: 8085758 - DNA, 22 bp, Homo sapiens
attcataacggcaaatgtcacc

SEQ ID NO: 8085759 - DNA, 22 bp, Homo sapiens
attcataacggcaaatgtcacc

SEQ ID NO: 8085760 - DNA, 22 bp, Homo sapiens
attcacaatagcagcttgcatg

SEQ ID NO: 8085761 - DNA, 22 bp, Homo sapiens
gcaccttggctttcttggtggc

SEQ ID NO: 8085762 - DNA, 21 bp, Homo sapiens
attcagaaagggaataaactc

SEQ ID NO: 8085763 - DNA, 22 bp, Homo sapiens
caaatagactctagaatttatt

SEQ ID NO: 8085764 - DNA, 22 bp, Homo sapiens
caaatgatacctattactaggc

SEQ ID NO: 8085765 - DNA, 22 bp, Homo sapiens
caaatgcatagtttataagaag

SEQ ID NO: 8085766 - DNA, 22 bp, Homo sapiens
caaatactgggtaagttaattt

SEQ ID NO: 8085767 - DNA, 22 bp, Homo sapiens
caaagctgacgaggtcagcatc

SEQ ID NO: 8085768 - DNA, 22 bp, Homo sapiens
caaaatgtgagtcccacctcaa

SEQ ID NO: 8085769 - DNA, 22 bp, Homo sapiens
caaaatgttctggcacctttaa

SEQ ID NO: 8085770 - DNA, 22 bp, Homo sapiens
attttactttgtgaatattgac

SEQ ID NO: 8085771 - DNA, 22 bp, Homo sapiens
gcctggagttgtggtgaagcca

SEQ ID NO: 8085772 - DNA, 22 bp, Homo sapiens
attttactactccaattaatga

SEQ ID NO: 8085773 - DNA, 22 bp, Homo sapiens
gcccccagacctcagtgggctg

SEQ ID NO: 8085774 - DNA, 22 bp, Homo sapiens
atttccatagagcgtctcacag

SEQ ID NO: 8085775 - DNA, 21 bp, Homo sapiens
gcccacagtgaggaggatccc

SEQ ID NO: 8085776 - DNA, 22 bp, Homo sapiens
gccacaggtactatgggagaga

SEQ ID NO: 8085777 - DNA, 22 bp, Homo sapiens
gccaggctggcaaaaggaaacc

SEQ ID NO: 8085778 - DNA, 22 bp, Homo sapiens
gccaggtgcatattagaagcat

SEQ ID NO: 8085779 - DNA, 22 bp, Homo sapiens
atttccaggagaaaggatttta

SEQ ID NO: 8085780 - DNA, 22 bp, Homo sapiens
atttccagtcctaatgatctgg

SEQ ID NO: 8085781 - DNA, 22 bp, Homo sapiens
gagagcagactctcaaagctgg

SEQ ID NO: 8085782 - DNA, 22 bp, Homo sapiens
gactgggctccaagagggagag

SEQ ID NO: 8085783 - DNA, 22 bp, Homo sapiens
atgggagaaacatcatgaggca

SEQ ID NO: 8085784 - DNA, 22 bp, Homo sapiens
atggggagagaagggctgagct

SEQ ID NO: 8085785 - DNA, 22 bp, Homo sapiens
atggttaaattggttatttatg

SEQ ID NO: 8085786 - DNA, 22 bp, Homo sapiens
gaggcagcctcagtggacctcg

SEQ ID NO: 8085787 - DNA, 20 bp, Homo sapiens
atgtgtctgtaaacaactct

SEQ ID NO: 8085788 - DNA, 22 bp, Homo sapiens
atgttcttccaaatctgtaaca

SEQ ID NO: 8085789 - DNA, 22 bp, Homo sapiens
atgttctttcagccagtgcatc

SEQ ID NO: 8085790 - DNA, 22 bp, Homo sapiens
atgttcttgttcaaatgtcagt

SEQ ID NO: 8085791 - DNA, 22 bp, Homo sapiens
gaggtggcactgtgaggagcac

SEQ ID NO: 8085792 - DNA, 22 bp, Homo sapiens
gatatattttccatggtctgca

SEQ ID NO: 8085793 - DNA, 22 bp, Homo sapiens
gatatatttggaccagagcatt

SEQ ID NO: 8085794 - DNA, 22 bp, Homo sapiens
atgtttaaggaactggtttgct

SEQ ID NO: 8085795 - DNA, 22 bp, Homo sapiens
atgtgaatgcagttatctataa

SEQ ID NO: 8085796 - DNA, 22 bp, Homo sapiens
gagggctctgtctggaagggaa

SEQ ID NO: 8085797 - DNA, 22 bp, Homo sapiens
gagggctctgaaaggaggtcac

SEQ ID NO: 8085798 - DNA, 19 bp, Homo sapiens
gagggctcatttgaacaat

SEQ ID NO: 8085799 - DNA, 22 bp, Homo sapiens
gactggactctgaagatgggtg

SEQ ID NO: 8085800 - DNA, 22 bp, Homo sapiens
gacggggcagccagctggtggc

SEQ ID NO: 8085801 - DNA, 22 bp, Homo sapiens
gaccttgtgatccgcccgcctt

SEQ ID NO: 8085802 - DNA, 22 bp, Homo sapiens
gaccttgtgatccccctgcctt

SEQ ID NO: 8085803 - DNA, 22 bp, Homo sapiens
gaccttgtgatccacctgcctt

SEQ ID NO: 8085804 - DNA, 22 bp, Homo sapiens
gaccttgtgatctgcctgcctt

SEQ ID NO: 8085805 - DNA, 22 bp, Homo sapiens
gacaatttctcaatatagaaac

SEQ ID NO: 8085806 - DNA, 22 bp, Homo sapiens
gacatttcaatctcattatggg

SEQ ID NO: 8085807 - DNA, 22 bp, Homo sapiens
gacatttattagaaaactatca

SEQ ID NO: 8085808 - DNA, 22 bp, Homo sapiens
gaacaactttgaaacatgaaga

SEQ ID NO: 8085809 - DNA, 22 bp, Homo sapiens
gaacaaacagtcaggacagtct

SEQ ID NO: 8085810 - DNA, 19 bp, Homo sapiens
gaacaaacttaaacttttc

SEQ ID NO: 8085811 - DNA, 22 bp, Homo sapiens
atgaagaaaaatccagctgtcc

SEQ ID NO: 8085812 - DNA, 22 bp, Homo sapiens
atgaaacacacacgcgcatact

SEQ ID NO: 8085813 - DNA, 22 bp, Homo sapiens
atgaaacagagtacttaatata

SEQ ID NO: 8085814 - DNA, 22 bp, Homo sapiens
atgaaattcatctgagaatgct

SEQ ID NO: 8085815 - DNA, 22 bp, Homo sapiens
atgaacagcattgaaatccagc

SEQ ID NO: 8085816 - DNA, 22 bp, Homo sapiens
atgaacagtatgcaacatgatt

SEQ ID NO: 8085817 - DNA, 22 bp, Homo sapiens
atgaaacagtgtgtatagcaaa

SEQ ID NO: 8085818 - DNA, 22 bp, Homo sapiens
atgaaacagtgtgtatagcaaa

SEQ ID NO: 8085819 - DNA, 22 bp, Homo sapiens
atgaaacagtgaattagtcaag

SEQ ID NO: 8085820 - DNA, 22 bp, Homo sapiens
gaaacatgtctgacaatttacc

SEQ ID NO: 8085821 - DNA, 22 bp, Homo sapiens
gaaaatgttagcttcatagtca

SEQ ID NO: 8085822 - DNA, 22 bp, Homo sapiens
gaaacagtcaactttctttccc

SEQ ID NO: 8085823 - DNA, 22 bp, Homo sapiens
atgatatttgcaatgtgcttgc

SEQ ID NO: 8085824 - DNA, 22 bp, Homo sapiens
atgatgaaattttctatcatgt

SEQ ID NO: 8085825 - DNA, 22 bp, Homo sapiens
cacagaggatgcccaagcgatc

SEQ ID NO: 8085826 - DNA, 21 bp, Homo sapiens
cacagaggcgctgtatggctg

SEQ ID NO: 8085827 - DNA, 22 bp, Homo sapiens
cacagaggactgtagcggggag

SEQ ID NO: 8085828 - DNA, 17 bp, Homo sapiens
ggactgggcggggcagg

SEQ ID NO: 8085829 - DNA, 22 bp, Homo sapiens
ggactgggccaggggttggact

SEQ ID NO: 8085830 - DNA, 22 bp, Homo sapiens
ggactgggagaatggaggcaag

SEQ ID NO: 8085831 - DNA, 22 bp, Homo sapiens
cacagacagtgtccctttgttg

SEQ ID NO: 8085832 - DNA, 22 bp, Homo sapiens
cacaattttaatacacagtcaa

SEQ ID NO: 8085833 - DNA, 22 bp, Homo sapiens
cacagaactggttaatagcaga

SEQ ID NO: 8085834 - DNA, 20 bp, Homo sapiens
ggaaggggcaaagtgtgtga

SEQ ID NO: 8085835 - DNA, 22 bp, Homo sapiens
ggaaggggagctggaaagggta

SEQ ID NO: 8085836 - DNA, 22 bp, Homo sapiens
ggaaggggagctggaaagggta

SEQ ID NO: 8085837 - DNA, 22 bp, Homo sapiens
cacaggagaaaggggaagctcg

SEQ ID NO: 8085838 - DNA, 22 bp, Homo sapiens
cacaggcttgtcagcatgaggc

SEQ ID NO: 8085839 - DNA, 22 bp, Homo sapiens
cacagaggtgatagtggtcaag

SEQ ID NO: 8085840 - DNA, 22 bp, Homo sapiens
cacagattatgagacgagatac

SEQ ID NO: 8085841 - DNA, 22 bp, Homo sapiens
ggagcctgagcggcccagggcc

SEQ ID NO: 8085842 - DNA, 22 bp, Homo sapiens
ggagcctgagggccctcttgga

SEQ ID NO: 8085843 - DNA, 22 bp, Homo sapiens
ggagcctgacagtgcccagcat

SEQ ID NO: 8085844 - DNA, 22 bp, Homo sapiens
ggagcctgaaaagtctgcattt

SEQ ID NO: 8085845 - DNA, 22 bp, Homo sapiens
ggagcctgacagtgcccagcat

SEQ ID NO: 8085846 - DNA, 22 bp, Homo sapiens
ggagcctgcgggagctcccatt

SEQ ID NO: 8085847 - DNA, 19 bp, Homo sapiens
ggagcctggagcacgtgcc

SEQ ID NO: 8085848 - DNA, 19 bp, Homo sapiens
ggagcctggagcacgtgcc

SEQ ID NO: 8085849 - DNA, 20 bp, Homo sapiens
ggagctggcatccagcctct

SEQ ID NO: 8085850 - DNA, 22 bp, Homo sapiens
ggagctggagagtacagagttt

SEQ ID NO: 8085851 - DNA, 22 bp, Homo sapiens
ggagctggcagcgcaacccaga

SEQ ID NO: 8085852 - DNA, 22 bp, Homo sapiens
caagcagggatactgcagggag

SEQ ID NO: 8085853 - DNA, 22 bp, Homo sapiens
caaatgtaaattcttttgaagc

SEQ ID NO: 8085854 - DNA, 22 bp, Homo sapiens
caaatgtaaattcttttgaagc

SEQ ID NO: 8085855 - DNA, 22 bp, Homo sapiens
caaatgtataaatgtactttct

SEQ ID NO: 8085856 - DNA, 22 bp, Homo sapiens
caaatgtataaatgtactttct

SEQ ID NO: 8085857 - DNA, 22 bp, Homo sapiens
caaatgtattctcacttcaggg

SEQ ID NO: 8085858 - DNA, 22 bp, Homo sapiens
caaggggttcagaaagaggtga

SEQ ID NO: 8085859 - DNA, 22 bp, Homo sapiens
caaggcctcctgggcccagaga

SEQ ID NO: 8085860 - DNA, 22 bp, Homo sapiens
caagtaattctgcaagaaacca

SEQ ID NO: 8085861 - DNA, 20 bp, Homo sapiens
caagggtttgcattggcttt

SEQ ID NO: 8085862 - DNA, 22 bp, Homo sapiens
gctgtggcggcagcagctggtg

SEQ ID NO: 8085863 - DNA, 22 bp, Homo sapiens
caagtttaaggcactgataagt

SEQ ID NO: 8085864 - DNA, 22 bp, Homo sapiens
caagtttacaatgtgtatgtgt

SEQ ID NO: 8085865 - DNA, 22 bp, Homo sapiens
ggctgttgacagacataggttt

SEQ ID NO: 8085866 - DNA, 23 bp, Homo sapiens
cagaaataaactggtttgtagat

SEQ ID NO: 8085867 - DNA, 22 bp, Homo sapiens
cagaaacatgtataaagttgta

SEQ ID NO: 8085868 - DNA, 22 bp, Homo sapiens
ggctgccccatgggctgggctg

SEQ ID NO: 8085869 - DNA, 22 bp, Homo sapiens
ggaggtcccaggcctggcagca

SEQ ID NO: 8085870 - DNA, 22 bp, Homo sapiens
ggaggtgatcagagttttgagg

SEQ ID NO: 8085871 - DNA, 22 bp, Homo sapiens
ggcagggaggaggtgaaagtga

SEQ ID NO: 8085872 - DNA, 22 bp, Homo sapiens
ggccactccgctgctactggaa

SEQ ID NO: 8085873 - DNA, 22 bp, Homo sapiens
ggccactgcctccgccatggct

SEQ ID NO: 8085874 - DNA, 22 bp, Homo sapiens
ggccactgcctccgccatggct

SEQ ID NO: 8085875 - DNA, 22 bp, Homo sapiens
ggccactgtcctctagcccaga

SEQ ID NO: 8085876 - DNA, 22 bp, Homo sapiens
ggccccaggtagaagatataga

SEQ ID NO: 8085877 - DNA, 22 bp, Homo sapiens
ggccccaggtagaagatataga

SEQ ID NO: 8085878 - DNA, 22 bp, Homo sapiens
cacctgggtcattgctggtgtt

SEQ ID NO: 8085879 - DNA, 22 bp, Homo sapiens
caccttggccttgctatttctc

SEQ ID NO: 8085880 - DNA, 22 bp, Homo sapiens
cacgagggcacacgtgggaggg

SEQ ID NO: 8085881 - DNA, 20 bp, Homo sapiens
cagctagtggtaggagtcgg

SEQ ID NO: 8085882 - DNA, 22 bp, Homo sapiens
cagctagggagtggcagagctt

SEQ ID NO: 8085883 - DNA, 22 bp, Homo sapiens
cagctaggaaaccagagggcag

SEQ ID NO: 8085884 - DNA, 22 bp, Homo sapiens
cagctacaggacctgatgcacc

SEQ ID NO: 8085885 - DNA, 22 bp, Homo sapiens
cagctacaggacgggcatctgc

SEQ ID NO: 8085886 - DNA, 22 bp, Homo sapiens
cagctacagaggccacatggct

SEQ ID NO: 8085887 - DNA, 22 bp, Homo sapiens
cagcctggtccccggctcaccc

SEQ ID NO: 8085888 - DNA, 21 bp, Homo sapiens
cagcctgctgctccagggcca

SEQ ID NO: 8085889 - DNA, 20 bp, Homo sapiens
cagcctccactcactcagct

SEQ ID NO: 8085890 - DNA, 18 bp, Homo sapiens
gtgctgtgggcagtggcc

SEQ ID NO: 8085891 - DNA, 22 bp, Homo sapiens
gtgctgtgtctatcaggaataa

SEQ ID NO: 8085892 - DNA, 22 bp, Homo sapiens
gtcatatacactgcatgtaatc

SEQ ID NO: 8085893 - DNA, 20 bp, Homo sapiens
cagcaggctatggggcaccc

SEQ ID NO: 8085894 - DNA, 22 bp, Homo sapiens
gtcccaggagttgctgggcctt

SEQ ID NO: 8085895 - DNA, 22 bp, Homo sapiens
gtcccaggcagagtcaggaggg

SEQ ID NO: 8085896 - DNA, 22 bp, Homo sapiens
gtcccaggctccatggcagcca

SEQ ID NO: 8085897 - DNA, 22 bp, Homo sapiens
gtcccaggcaggccactggcag

SEQ ID NO: 8085898 - DNA, 22 bp, Homo sapiens
gtcccaggaacattctggctag

SEQ ID NO: 8085899 - DNA, 20 bp, Homo sapiens
cagcaggaaaagtgcctcag

SEQ ID NO: 8085900 - DNA, 22 bp, Homo sapiens
cagcagctggtgagacacagcc

SEQ ID NO: 8085901 - DNA, 22 bp, Homo sapiens
cagcaggacatggaggagtaaa

SEQ ID NO: 8085902 - DNA, 22 bp, Homo sapiens
cagcaggaaggtttcccctgca

SEQ ID NO: 8085903 - DNA, 22 bp, Homo sapiens
cagcaggaaagacatctgagca

SEQ ID NO: 8085904 - DNA, 22 bp, Homo sapiens
cagcaggaaaatcaattctgtg

SEQ ID NO: 8085905 - DNA, 22 bp, Homo sapiens
cagcagctgcaaatggaaacag

SEQ ID NO: 8085906 - DNA, 22 bp, Homo sapiens
cagcagctagaggaagggcaga

SEQ ID NO: 8085907 - DNA, 22 bp, Homo sapiens
cagcacctgctcttagacacgg

SEQ ID NO: 8085908 - DNA, 22 bp, Homo sapiens
cagcacctccgcagttcacctg

SEQ ID NO: 8085909 - DNA, 22 bp, Homo sapiens
gtcccaggcttatgtggagctt

SEQ ID NO: 8085910 - DNA, 22 bp, Homo sapiens
gtcccagggaagaaggcagcac

SEQ ID NO: 8085911 - DNA, 22 bp, Homo sapiens
cagccagggagggcaaatgaga

SEQ ID NO: 8085912 - DNA, 22 bp, Homo sapiens
cagcccaggctcagatgttggg

SEQ ID NO: 8085913 - DNA, 16 bp, Homo sapiens
cagcccaggggcgggc

SEQ ID NO: 8085914 - DNA, 17 bp, Homo sapiens
cagacctctgtgaagcc

SEQ ID NO: 8085915 - DNA, 22 bp, Homo sapiens
cagacctcaaagctgcagtgct

SEQ ID NO: 8085916 - DNA, 22 bp, Homo sapiens
gggcagcagagccctgccgagt

SEQ ID NO: 8085917 - DNA, 22 bp, Homo sapiens
gggcagcagcaggaggtctctg

SEQ ID NO: 8085918 - DNA, 22 bp, Homo sapiens
gggcagcagttgccctaatcaa

SEQ ID NO: 8085919 - DNA, 22 bp, Homo sapiens
gggcagcatgaggaccctcatc

SEQ ID NO: 8085920 - DNA, 22 bp, Homo sapiens
gggcagtggttacacagctgag

SEQ ID NO: 8085921 - DNA, 22 bp, Homo sapiens
gggcagtggtccaggctacagc

SEQ ID NO: 8085922 - DNA, 22 bp, Homo sapiens
gggcagtgggaccaggcaccag

SEQ ID NO: 8085923 - DNA, 22 bp, Homo sapiens
gggcagtggctcacgcctgtaa

SEQ ID NO: 8085924 - DNA, 20 bp, Homo sapiens
gggcagtggcgctatctcag

SEQ ID NO: 8085925 - DNA, 22 bp, Homo sapiens
gggcagtgggtggctgcagcct

SEQ ID NO: 8085926 - DNA, 22 bp, Homo sapiens
cagagcctaaaacgactccact

SEQ ID NO: 8085927 - DNA, 22 bp, Homo sapiens
cagagcctccctcctctgccat

SEQ ID NO: 8085928 - DNA, 19 bp, Homo sapiens
cagagcctcagagctagaa

SEQ ID NO: 8085929 - DNA, 22 bp, Homo sapiens
gggcagtgtctggcccccaggc

SEQ ID NO: 8085930 - DNA, 22 bp, Homo sapiens
gggcagtgtcgaggtctggtcc

SEQ ID NO: 8085931 - DNA, 22 bp, Homo sapiens
gggcagtgtcggggcccaggga

SEQ ID NO: 8085932 - DNA, 22 bp, Homo sapiens
gggccagcagtatcggaggcat

SEQ ID NO: 8085933 - DNA, 22 bp, Homo sapiens
gggccagagcttggcagctggg

SEQ ID NO: 8085934 - DNA, 22 bp, Homo sapiens
gggccagctctgtgatgtaggg

SEQ ID NO: 8085935 - DNA, 22 bp, Homo sapiens
gggccagcagtatcggaggcat

SEQ ID NO: 8085936 - DNA, 22 bp, Homo sapiens
cagagctgggtttgggaaacct

SEQ ID NO: 8085937 - DNA, 22 bp, Homo sapiens
cagagctgggatcccatgggcg

SEQ ID NO: 8085938 - DNA, 23 bp, Homo sapiens
cagagctggcttcatgggtgtgc

SEQ ID NO: 8085939 - DNA, 22 bp, Homo sapiens
cagagctggggactgttggatg

SEQ ID NO: 8085940 - DNA, 22 bp, Homo sapiens
cagagctgggcatggtgaaagg

SEQ ID NO: 8085941 - DNA, 20 bp, Homo sapiens
cagagctgggatttgaacac

SEQ ID NO: 8085942 - DNA, 22 bp, Homo sapiens
cagagctggctctgcatgtaca

SEQ ID NO: 8085943 - DNA, 22 bp, Homo sapiens
cagagctgcttcccagtttgtg

SEQ ID NO: 8085944 - DNA, 22 bp, Homo sapiens
cagagcctgcctctggctgtgg

SEQ ID NO: 8085945 - DNA, 22 bp, Homo sapiens
cagagcctctgccctgggcact

SEQ ID NO: 8085946 - DNA, 22 bp, Homo sapiens
cagagcctctcagccccttggg

SEQ ID NO: 8085947 - DNA, 22 bp, Homo sapiens
ggggagcaatagttgaggtgtg

SEQ ID NO: 8085948 - DNA, 22 bp, Homo sapiens
ggggagcaggctgggctgtctg

SEQ ID NO: 8085949 - DNA, 22 bp, Homo sapiens
cagagtccaattgctcagagcg

SEQ ID NO: 8085950 - DNA, 22 bp, Homo sapiens
cagagtcccagatgcccctcct

SEQ ID NO: 8085951 - DNA, 22 bp, Homo sapiens
cagagtcctgcaccagctccag

SEQ ID NO: 8085952 - DNA, 19 bp, Homo sapiens
cagagtccttgaccagtcc

SEQ ID NO: 8085953 - DNA, 21 bp, Homo sapiens
cagcaaggaagtcgagtaggt

SEQ ID NO: 8085954 - DNA, 22 bp, Homo sapiens
ggtgacctcacctggtcccacc

SEQ ID NO: 8085955 - DNA, 22 bp, Homo sapiens
ggtgacctcacctggtcccacc

SEQ ID NO: 8085956 - DNA, 22 bp, Homo sapiens
ggtgacatagttacttcaggct

SEQ ID NO: 8085957 - DNA, 22 bp, Homo sapiens
ggtgacatctagagacatccaa

SEQ ID NO: 8085958 - DNA, 22 bp, Homo sapiens
ggtgacatcagtaaccgtggtt

SEQ ID NO: 8085959 - DNA, 22 bp, Homo sapiens
ggtgacatgcacctatcccttg

SEQ ID NO: 8085960 - DNA, 22 bp, Homo sapiens
ggtgacattatcattattttaa

SEQ ID NO: 8085961 - DNA, 22 bp, Homo sapiens
cagcacacagtgactcgcacct

SEQ ID NO: 8085962 - DNA, 21 bp, Homo sapiens
cagcacagtactgggtcttgc

SEQ ID NO: 8085963 - DNA, 22 bp, Homo sapiens
cagcacagtttgcttggcagag

SEQ ID NO: 8085964 - DNA, 22 bp, Homo sapiens
cagcacagtgcagatgctgact

SEQ ID NO: 8085965 - DNA, 22 bp, Homo sapiens
cagcacagtagagtagttgtaa

SEQ ID NO: 8085966 - DNA, 22 bp, Homo sapiens
agttataatctgctactgatat

SEQ ID NO: 8085967 - DNA, 22 bp, Homo sapiens
ctctggctttgctcatgcatcc

SEQ ID NO: 8085968 - DNA, 22 bp, Homo sapiens
ctctgggaccacgtgactctgc

SEQ ID NO: 8085969 - DNA, 22 bp, Homo sapiens
ctctgcctgcccaccgacccat

SEQ ID NO: 8085970 - DNA, 22 bp, Homo sapiens
ctctgcctgtctcatcctgcaa

SEQ ID NO: 8085971 - DNA, 22 bp, Homo sapiens
ctctgcctgtgtcgccaccaca

SEQ ID NO: 8085972 - DNA, 22 bp, Homo sapiens
ctctgcaggccttgagtgtggt

SEQ ID NO: 8085973 - DNA, 22 bp, Homo sapiens
ctccagctagggctggcttact

SEQ ID NO: 8085974 - DNA, 22 bp, Homo sapiens
ctccaggcttcaagggccggcc

SEQ ID NO: 8085975 - DNA, 22 bp, Homo sapiens
ctccaggctggggtgcaggttg

SEQ ID NO: 8085976 - DNA, 22 bp, Homo sapiens
ctccaggctggatccaagtcaa

SEQ ID NO: 8085977 - DNA, 22 bp, Homo sapiens
ctccaggctcgtccaagatcga

SEQ ID NO: 8085978 - DNA, 22 bp, Homo sapiens
ctccaggcgggaggcggttcca

SEQ ID NO: 8085979 - DNA, 22 bp, Homo sapiens
agtcctcccttggggccacctt

SEQ ID NO: 8085980 - DNA, 22 bp, Homo sapiens
ctcattgcaacctccgcctccc

SEQ ID NO: 8085981 - DNA, 22 bp, Homo sapiens
ctcctgggaaaggctggacaca

SEQ ID NO: 8085982 - DNA, 20 bp, Homo sapiens
ctcctgggactgctggttat

SEQ ID NO: 8085983 - DNA, 22 bp, Homo sapiens
ctcctggggccatggaaggaac

SEQ ID NO: 8085984 - DNA, 22 bp, Homo sapiens
ctcctggggcacttagaagcaa

SEQ ID NO: 8085985 - DNA, 22 bp, Homo sapiens
agtggcagaggttgactgcagt

SEQ ID NO: 8085986 - DNA, 20 bp, Homo sapiens
ctccagggaacagactggag

SEQ ID NO: 8085987 - DNA, 22 bp, Homo sapiens
ctccagggaaaggggcgtccgc

SEQ ID NO: 8085988 - DNA, 22 bp, Homo sapiens
ctcccaggttgattctttccct

SEQ ID NO: 8085989 - DNA, 22 bp, Homo sapiens
ctccctcagaggagcacctgtt

SEQ ID NO: 8085990 - DNA, 22 bp, Homo sapiens
ctccctctctaaggcaaagaga

SEQ ID NO: 8085991 - DNA, 22 bp, Homo sapiens
ctcctcactttccagactgggc

SEQ ID NO: 8085992 - DNA, 22 bp, Homo sapiens
cctggatcgatgccgagggaaa

SEQ ID NO: 8085993 - DNA, 22 bp, Homo sapiens
cctggattataggccctctgaa

SEQ ID NO: 8085994 - DNA, 22 bp, Homo sapiens
cctgggcataaatcactccaag

SEQ ID NO: 8085995 - DNA, 20 bp, Homo sapiens
cctgggctccaggagccccg

SEQ ID NO: 8085996 - DNA, 22 bp, Homo sapiens
cctgtcccccaggcctgtacca

SEQ ID NO: 8085997 - DNA, 22 bp, Homo sapiens
aggtgggcaatgaggcctgagt

SEQ ID NO: 8085998 - DNA, 22 bp, Homo sapiens
aggtggggccaaatgctacagt

SEQ ID NO: 8085999 - DNA, 22 bp, Homo sapiens
agtccaaggttcatggcacaga

SEQ ID NO: 8086000 - DNA, 22 bp, Homo sapiens
agtccaccacccatgctcctct

SEQ ID NO: 8086001 - DNA, 22 bp, Homo sapiens
ctagaacagaaagtacaggaaa

SEQ ID NO: 8086002 - DNA, 22 bp, Homo sapiens
agtccagggctctctgtgggat

SEQ ID NO: 8086003 - DNA, 22 bp, Homo sapiens
agtccagggagcccaggctttg

SEQ ID NO: 8086004 - DNA, 19 bp, Homo sapiens
agtccatgaatggaggatg

SEQ ID NO: 8086005 - DNA, 22 bp, Homo sapiens
agtccatggttctgactcatct

SEQ ID NO: 8086006 - DNA, 22 bp, Homo sapiens
agtccatgctgtctacagaatc

SEQ ID NO: 8086007 - DNA, 22 bp, Homo sapiens
ctagtccactgtcctgcctcca

SEQ ID NO: 8086008 - DNA, 22 bp, Homo sapiens
ctagtccagtctcaaaatgcta

SEQ ID NO: 8086009 - DNA, 22 bp, Homo sapiens
ctagtccaaaccagggtccctc

SEQ ID NO: 8086010 - DNA, 22 bp, Homo sapiens
agtattgtgactcaagtattct

SEQ ID NO: 8086011 - DNA, 22 bp, Homo sapiens
ctacagaatctacctcaagcca

SEQ ID NO: 8086012 - DNA, 22 bp, Homo sapiens
agtatttcagttactttaaaat

SEQ ID NO: 8086013 - DNA, 22 bp, Homo sapiens
agtatttcctggcttatctgct

SEQ ID NO: 8086014 - DNA, 22 bp, Homo sapiens
ctacattttgtgattatgaaat

SEQ ID NO: 8086015 - DNA, 22 bp, Homo sapiens
ctacattttaataagctgctta

SEQ ID NO: 8086016 - DNA, 22 bp, Homo sapiens
ctacatttgttctatagctttt

SEQ ID NO: 8086017 - DNA, 22 bp, Homo sapiens
ctacatttggagagtataggaa

SEQ ID NO: 8086018 - DNA, 22 bp, Homo sapiens
ctacatttcccagctgccttcc

SEQ ID NO: 8086019 - DNA, 22 bp, Homo sapiens
ctacatttgttcaaataagctg

SEQ ID NO: 8086020 - DNA, 22 bp, Homo sapiens
ctacatttttcaccgagcctct

SEQ ID NO: 8086021 - DNA, 22 bp, Homo sapiens
cgggcacacacttgacaggttc

SEQ ID NO: 8086022 - DNA, 17 bp, Homo sapiens
cgggcatggagggcagg

SEQ ID NO: 8086023 - DNA, 22 bp, Homo sapiens
ctaaactttgtttatactctga

SEQ ID NO: 8086024 - DNA, 22 bp, Homo sapiens
ctaaacttcttggcaattttat

SEQ ID NO: 8086025 - DNA, 22 bp, Homo sapiens
cggctcagctagcttggcccca

SEQ ID NO: 8086026 - DNA, 22 bp, Homo sapiens
atattactctgatttagtaaat

SEQ ID NO: 8086027 - DNA, 22 bp, Homo sapiens
atatgtttttggaaagaacaca

SEQ ID NO: 8086028 - DNA, 22 bp, Homo sapiens
ctggctgggagcgagctgctca

SEQ ID NO: 8086029 - DNA, 22 bp, Homo sapiens
atatgcagagagcatgaatagg

SEQ ID NO: 8086030 - DNA, 20 bp, Homo sapiens
ctgggctcaagtgatcctcc

SEQ ID NO: 8086031 - DNA, 22 bp, Homo sapiens
atcaaatataataattttcgct

SEQ ID NO: 8086032 - DNA, 22 bp, Homo sapiens
atcaactgccccaaatgtattt

SEQ ID NO: 8086033 - DNA, 23 bp, Homo sapiens
atctgaaaagcatttgcagtttg

SEQ ID NO: 8086034 - DNA, 22 bp, Homo sapiens
atctgaaaagctttaatgagct

SEQ ID NO: 8086035 - DNA, 22 bp, Homo sapiens
cttcctcctccatctcgaaggc

SEQ ID NO: 8086036 - DNA, 22 bp, Homo sapiens
cttcctcacggtgcaacaggaa

SEQ ID NO: 8086037 - DNA, 21 bp, Homo sapiens
cttcccaaggcttcaaagcct

SEQ ID NO: 8086038 - DNA, 22 bp, Homo sapiens
ctgtggcctggggacactatct

SEQ ID NO: 8086039 - DNA, 21 bp, Homo sapiens
ctgtggcctggctagcaccgt

SEQ ID NO: 8086040 - DNA, 22 bp, Homo sapiens
ctgtggagttccatcaggggag

SEQ ID NO: 8086041 - DNA, 21 bp, Homo sapiens
ctgtgggaccaagcactggga

SEQ ID NO: 8086042 - DNA, 22 bp, Homo sapiens
ctgtgggagaagctagcacagg

SEQ ID NO: 8086043 - DNA, 22 bp, Homo sapiens
ctgtgggagaggtgcctggatt

SEQ ID NO: 8086044 - DNA, 22 bp, Homo sapiens
ctgtgggagaagttgctggagt

SEQ ID NO: 8086045 - DNA, 22 bp, Homo sapiens
ctgtgggaacactgaggacttc

SEQ ID NO: 8086046 - DNA, 22 bp, Homo sapiens
ctgtgggaatactgcgagtgta

SEQ ID NO: 8086047 - DNA, 22 bp, Homo sapiens
atccaggcttaatgggagccac

SEQ ID NO: 8086048 - DNA, 22 bp, Homo sapiens
atccaggcttaatgggagccac

SEQ ID NO: 8086049 - DNA, 22 bp, Homo sapiens
atccaggcttcagctgcctact

SEQ ID NO: 8086050 - DNA, 22 bp, Homo sapiens
atccaggctggagtgcattggt

SEQ ID NO: 8086051 - DNA, 22 bp, Homo sapiens
atccaggctgctttctatgccc

SEQ ID NO: 8086052 - DNA, 22 bp, Homo sapiens
atccaggctgctatgaggatga

SEQ ID NO: 8086053 - DNA, 22 bp, Homo sapiens
atccaggctgggtgtggctact

SEQ ID NO: 8086054 - DNA, 22 bp, Homo sapiens
atccaggctgtctaatgggaga

SEQ ID NO: 8086055 - DNA, 22 bp, Homo sapiens
atccaggctgcgggtctcaagt

SEQ ID NO: 8086056 - DNA, 22 bp, Homo sapiens
atccaggcgaatgcagaaggcc

SEQ ID NO: 8086057 - DNA, 22 bp, Homo sapiens
atccaggctgctatgaggatga

SEQ ID NO: 8086058 - DNA, 22 bp, Homo sapiens
atccaggccccaagaccccgac

SEQ ID NO: 8086059 - DNA, 22 bp, Homo sapiens
atccaggcctgagtctggtcct

SEQ ID NO: 8086060 - DNA, 22 bp, Homo sapiens
atccaggccttgaagtaccagt

SEQ ID NO: 8086061 - DNA, 22 bp, Homo sapiens
ctggcccattgccttctctctc

SEQ ID NO: 8086062 - DNA, 20 bp, Homo sapiens
ctggcccatctaccgctctg

SEQ ID NO: 8086063 - DNA, 22 bp, Homo sapiens
atactaaagtatagaacttagt

SEQ ID NO: 8086064 - DNA, 22 bp, Homo sapiens
ctggctcccgaagccctcagtg

SEQ ID NO: 8086065 - DNA, 19 bp, Homo sapiens
atacagatgtatccatgat

SEQ ID NO: 8086066 - DNA, 22 bp, Homo sapiens
ctggaagagcatttgcataggg

SEQ ID NO: 8086067 - DNA, 22 bp, Homo sapiens
ataccaccatctatgaaaggta

SEQ ID NO: 8086068 - DNA, 21 bp, Homo sapiens
atacattctattaagcattta

SEQ ID NO: 8086069 - DNA, 17 bp, Homo sapiens
atacagtttattttaca

SEQ ID NO: 8086070 - DNA, 22 bp, Homo sapiens
atacatacatgtatgcacatac

SEQ ID NO: 8086071 - DNA, 22 bp, Homo sapiens
ctgcaaatcaagttcttataat

SEQ ID NO: 8086072 - DNA, 22 bp, Homo sapiens
agttatttaaaatgattgtcct

SEQ ID NO: 8086073 - DNA, 22 bp, Homo sapiens
agttattactctttaacatatt

SEQ ID NO: 8086074 - DNA, 22 bp, Homo sapiens
agttatatgtgaaaacacgtat

SEQ ID NO: 8086075 - DNA, 22 bp, Homo sapiens
ctgcattagtcatgctttgcag

SEQ ID NO: 8086076 - DNA, 22 bp, Homo sapiens
ctgcctctcagcctgaccgcca

SEQ ID NO: 8086077 - DNA, 21 bp, Homo sapiens
ataagcatgctgattacattt

SEQ ID NO: 8086078 - DNA, 22 bp, Homo sapiens
ataagcatgttagaatatttga

SEQ ID NO: 8086079 - DNA, 22 bp, Homo sapiens
atacaacagaaaatgattattc

SEQ ID NO: 8086080 - DNA, 22 bp, Homo sapiens
atacaactttacatgcaattcc

SEQ ID NO: 8086081 - DNA, 22 bp, Homo sapiens
atacaactttacatgcaattcc

SEQ ID NO: 8086082 - DNA, 22 bp, Homo sapiens
ccaggaggtggcaggacttgcc

SEQ ID NO: 8086083 - DNA, 22 bp, Homo sapiens
ccaggaggtctgagtgtggaca

SEQ ID NO: 8086084 - DNA, 21 bp, Homo sapiens
aggctcagagagaaactcttg

SEQ ID NO: 8086085 - DNA, 22 bp, Homo sapiens
aggctcagagagctgtgtccat

SEQ ID NO: 8086086 - DNA, 22 bp, Homo sapiens
aggctcagagatgagtaagcac

SEQ ID NO: 8086087 - DNA, 21 bp, Homo sapiens
aggctcagagatcaaacagta

SEQ ID NO: 8086088 - DNA, 22 bp, Homo sapiens
ccaggcactcagagactgggac

SEQ ID NO: 8086089 - DNA, 22 bp, Homo sapiens
ccaggcactgctcgaggtgcta

SEQ ID NO: 8086090 - DNA, 22 bp, Homo sapiens
ccaggcactcagagactgggac

SEQ ID NO: 8086091 - DNA, 22 bp, Homo sapiens
ccaggcacggtggctcatgcct

SEQ ID NO: 8086092 - DNA, 20 bp, Homo sapiens
aggctcagatacccagggaa

SEQ ID NO: 8086093 - DNA, 20 bp, Homo sapiens
aggctcagagcagtagtaca

SEQ ID NO: 8086094 - DNA, 22 bp, Homo sapiens
aggctcagaggtgagcatctgc

SEQ ID NO: 8086095 - DNA, 16 bp, Homo sapiens
aggctcagaggctgga

SEQ ID NO: 8086096 - DNA, 20 bp, Homo sapiens
ccagagctgatggctgcccg

SEQ ID NO: 8086097 - DNA, 19 bp, Homo sapiens
ccagagtcatgtctccccc

SEQ ID NO: 8086098 - DNA, 22 bp, Homo sapiens
ccagagtcccttgcagctcagt

SEQ ID NO: 8086099 - DNA, 22 bp, Homo sapiens
ccagagtccctgttctcggcct

SEQ ID NO: 8086100 - DNA, 22 bp, Homo sapiens
ccagcagggaaaaacccaccaa

SEQ ID NO: 8086101 - DNA, 22 bp, Homo sapiens
ccagccagctgcccttggggcc

SEQ ID NO: 8086102 - DNA, 22 bp, Homo sapiens
ccagccagctgcccttggggcc

SEQ ID NO: 8086103 - DNA, 22 bp, Homo sapiens
ccagccagccttgatctgagta

SEQ ID NO: 8086104 - DNA, 22 bp, Homo sapiens
ccagccaggcattgcaaactga

SEQ ID NO: 8086105 - DNA, 22 bp, Homo sapiens
ccagccagtatattccaaagcc

SEQ ID NO: 8086106 - DNA, 22 bp, Homo sapiens
ccagggcagaaaaagagggaat

SEQ ID NO: 8086107 - DNA, 22 bp, Homo sapiens
ccagggcacttaggcccagccc

SEQ ID NO: 8086108 - DNA, 22 bp, Homo sapiens
aggctctgtatgaaggtttggg

SEQ ID NO: 8086109 - DNA, 22 bp, Homo sapiens
ccagggcagcagaattggggca

SEQ ID NO: 8086110 - DNA, 22 bp, Homo sapiens
ccagggcagccaacccagatgc

SEQ ID NO: 8086111 - DNA, 22 bp, Homo sapiens
ccagggcagcgcccctccacgc

SEQ ID NO: 8086112 - DNA, 22 bp, Homo sapiens
aggctcagatccttgtgtcctg

SEQ ID NO: 8086113 - DNA, 22 bp, Homo sapiens
aggctcagattcacatttggtt

SEQ ID NO: 8086114 - DNA, 22 bp, Homo sapiens
aggctctgggctctagattttg

SEQ ID NO: 8086115 - DNA, 22 bp, Homo sapiens
aggctctggttcatcatgatgg

SEQ ID NO: 8086116 - DNA, 22 bp, Homo sapiens
aggctcagcccaaggtggagag

SEQ ID NO: 8086117 - DNA, 21 bp, Homo sapiens
aggctcagcaggtgtataaag

SEQ ID NO: 8086118 - DNA, 22 bp, Homo sapiens
aggctcagcatctgattcatat

SEQ ID NO: 8086119 - DNA, 22 bp, Homo sapiens
aggctcagcctgggcctagagc

SEQ ID NO: 8086120 - DNA, 22 bp, Homo sapiens
aggctcagcccctgggaggaga

SEQ ID NO: 8086121 - DNA, 22 bp, Homo sapiens
ccagtgggtaggccatggtgag

SEQ ID NO: 8086122 - DNA, 22 bp, Homo sapiens
ccagtgggagggagctaggcca

SEQ ID NO: 8086123 - DNA, 19 bp, Homo sapiens
ccagtgtctagcgcacagc

SEQ ID NO: 8086124 - DNA, 22 bp, Homo sapiens
aggctgtggcatcacatcagga

SEQ ID NO: 8086125 - DNA, 22 bp, Homo sapiens
aggctgtgctcagccaatggga

SEQ ID NO: 8086126 - DNA, 21 bp, Homo sapiens
cccacggaatgatgaggcact

SEQ ID NO: 8086127 - DNA, 21 bp, Homo sapiens
cccacggaatgatgaggcact

SEQ ID NO: 8086128 - DNA, 22 bp, Homo sapiens
cccacctctcagagagccttgc

SEQ ID NO: 8086129 - DNA, 22 bp, Homo sapiens
agggcccagtggagagctgagc

SEQ ID NO: 8086130 - DNA, 20 bp, Homo sapiens
agggcctgttgcaagcgttt

SEQ ID NO: 8086131 - DNA, 22 bp, Homo sapiens
agggcctgtgaattctccctgc

SEQ ID NO: 8086132 - DNA, 22 bp, Homo sapiens
agggctgggctgcttgttgtca

SEQ ID NO: 8086133 - DNA, 22 bp, Homo sapiens
cctcaggggtgcccacagctgc

SEQ ID NO: 8086134 - DNA, 22 bp, Homo sapiens
cctcagggtcatcctagtaata

SEQ ID NO: 8086135 - DNA, 22 bp, Homo sapiens
cctcagggtctctcacagcacc

SEQ ID NO: 8086136 - DNA, 22 bp, Homo sapiens
agggggctggagacacctcctc

SEQ ID NO: 8086137 - DNA, 22 bp, Homo sapiens
agggggagcttggctactcctg

SEQ ID NO: 8086138 - DNA, 22 bp, Homo sapiens
agggggtgtctctgattgggtt

SEQ ID NO: 8086139 - DNA, 22 bp, Homo sapiens
aggggcgtgctcttccccgacg

SEQ ID NO: 8086140 - DNA, 22 bp, Homo sapiens
aggggcgtctgtaggcagtggg

SEQ ID NO: 8086141 - DNA, 22 bp, Homo sapiens
cccaggtgggcacctcgaggaa

SEQ ID NO: 8086142 - DNA, 22 bp, Homo sapiens
agggatggtggaggaatttcaa

SEQ ID NO: 8086143 - DNA, 22 bp, Homo sapiens
cccctgccagctatccctgaac

SEQ ID NO: 8086144 - DNA, 23 bp, Homo sapiens
agggccaggtgcggaaacagctc

SEQ ID NO: 8086145 - DNA, 22 bp, Homo sapiens
agggccaccagggagtctcagg

SEQ ID NO: 8086146 - DNA, 19 bp, Homo sapiens
agggccacggggaggtatt

SEQ ID NO: 8086147 - DNA, 22 bp, Homo sapiens
agggccacagtggggcctgaga

SEQ ID NO: 8086148 - DNA, 22 bp, Homo sapiens
agggccaccagagcagggcagt

SEQ ID NO: 8086149 - DNA, 22 bp, Homo sapiens
agggcagcttccatagtctggc

SEQ ID NO: 8086150 - DNA, 22 bp, Homo sapiens
agggcatgtgggagaggagcct

SEQ ID NO: 8086151 - DNA, 22 bp, Homo sapiens
agggaccctgatgactgaggag

SEQ ID NO: 8086152 - DNA, 22 bp, Homo sapiens
agggaatggatgatggcaggtt

SEQ ID NO: 8086153 - DNA, 22 bp, Homo sapiens
agggaaaggtagtgaggtcaca

SEQ ID NO: 8086154 - DNA, 23 bp, Homo sapiens
aggacagcaaaccccgcctcccc

SEQ ID NO: 8086155 - DNA, 22 bp, Homo sapiens
aggaagtggggttctctcactg

SEQ ID NO: 8086156 - DNA, 22 bp, Homo sapiens
aggacagacctaggactggagc

SEQ ID NO: 8086157 - DNA, 22 bp, Homo sapiens
cagggatgtgatgagctgagcc

SEQ ID NO: 8086158 - DNA, 22 bp, Homo sapiens
cagggcagggatgttgcggcag

SEQ ID NO: 8086159 - DNA, 22 bp, Homo sapiens
cagggcagggccacaccccctg

SEQ ID NO: 8086160 - DNA, 20 bp, Homo sapiens
cagggctctgggcctggcct

SEQ ID NO: 8086161 - DNA, 23 bp, Homo sapiens
cagggctgggcttggtgttaggc

SEQ ID NO: 8086162 - DNA, 22 bp, Homo sapiens
cagggctggcttccaagttgtt

SEQ ID NO: 8086163 - DNA, 22 bp, Homo sapiens
cagggctgggttaaaagcaggg

SEQ ID NO: 8086164 - DNA, 22 bp, Homo sapiens
aggaagaaacctactagagttt

SEQ ID NO: 8086165 - DNA, 18 bp, Homo sapiens
cagggctgtggggtcact

SEQ ID NO: 8086166 - DNA, 22 bp, Homo sapiens
cagggctgttagctgctgctct

SEQ ID NO: 8086167 - DNA, 22 bp, Homo sapiens
aggaagagctggaccagaggac

SEQ ID NO: 8086168 - DNA, 22 bp, Homo sapiens
caggagcaaggagcagtgggat

SEQ ID NO: 8086169 - DNA, 22 bp, Homo sapiens
caggactgaagggcacagggaa

SEQ ID NO: 8086170 - DNA, 22 bp, Homo sapiens
caggactggctcgcagtgggtg

SEQ ID NO: 8086171 - DNA, 20 bp, Homo sapiens
caggacagcgcaatcggagg

SEQ ID NO: 8086172 - DNA, 20 bp, Homo sapiens
caggcacactcattcctgct

SEQ ID NO: 8086173 - DNA, 22 bp, Homo sapiens
caggagccagaggcggatggag

SEQ ID NO: 8086174 - DNA, 22 bp, Homo sapiens
caggcagcgctcgtggcctggc

SEQ ID NO: 8086175 - DNA, 22 bp, Homo sapiens
agctgtcaggcagaactgagct

SEQ ID NO: 8086176 - DNA, 22 bp, Homo sapiens
agcttccctagcagttctaaac

SEQ ID NO: 8086177 - DNA, 18 bp, Homo sapiens
agcttccctctgagaggg

SEQ ID NO: 8086178 - DNA, 22 bp, Homo sapiens
agcttcccggcaggcacgtcct

SEQ ID NO: 8086179 - DNA, 22 bp, Homo sapiens
agcttcccacactctagtttcc

SEQ ID NO: 8086180 - DNA, 22 bp, Homo sapiens
agcttcccaggagaatcaggga

SEQ ID NO: 8086181 - DNA, 22 bp, Homo sapiens
agcttcccaaggttggaaggtt

SEQ ID NO: 8086182 - DNA, 22 bp, Homo sapiens
caggcccagtgatcagggctct

SEQ ID NO: 8086183 - DNA, 23 bp, Homo sapiens
ccactagcacctgttcaacttct

SEQ ID NO: 8086184 - DNA, 23 bp, Homo sapiens
ccactagcacctgttcaacttct

SEQ ID NO: 8086185 - DNA, 22 bp, Homo sapiens
ccacccagccagatgcaggaag

SEQ ID NO: 8086186 - DNA, 22 bp, Homo sapiens
ccacccagcagaggaggcaaga

SEQ ID NO: 8086187 - DNA, 22 bp, Homo sapiens
ccacccagaccagggatctggg

SEQ ID NO: 8086188 - DNA, 18 bp, Homo sapiens
ccacccagggggagagga

SEQ ID NO: 8086189 - DNA, 20 bp, Homo sapiens
ccacctggccaaggctgtgc

SEQ ID NO: 8086190 - DNA, 22 bp, Homo sapiens
ccacctggggcctctgagtctc

SEQ ID NO: 8086191 - DNA, 21 bp, Homo sapiens
ccaccaggtcttctgctcggg

SEQ ID NO: 8086192 - DNA, 22 bp, Homo sapiens
ccaccaggctctgtccgagcgg

SEQ ID NO: 8086193 - DNA, 19 bp, Homo sapiens
ccacagagcatgctgaggc

SEQ ID NO: 8086194 - DNA, 22 bp, Homo sapiens
ccacagagcattagatttcaga

SEQ ID NO: 8086195 - DNA, 22 bp, Homo sapiens
ccacagagcattagatttcaga

SEQ ID NO: 8086196 - DNA, 23 bp, Homo sapiens
ccacagagctgccaattcctgtg

SEQ ID NO: 8086197 - DNA, 22 bp, Homo sapiens
ccaatgatggtgcccacgatga

SEQ ID NO: 8086198 - DNA, 22 bp, Homo sapiens
ccacagagacagggtccttgct

SEQ ID NO: 8086199 - DNA, 22 bp, Homo sapiens
ccacagagactctgcaggactg

SEQ ID NO: 8086200 - DNA, 22 bp, Homo sapiens
aggcactgtgggtgtggccgga

SEQ ID NO: 8086201 - DNA, 22 bp, Homo sapiens
aggcactgttcccagttatcct

SEQ ID NO: 8086202 - DNA, 21 bp, Homo sapiens
aggcactgtttgtggtttggg

SEQ ID NO: 8086203 - DNA, 20 bp, Homo sapiens
aggcactgttgtctgtatcc

SEQ ID NO: 8086204 - DNA, 22 bp, Homo sapiens
aggcaagcattgggaacagggc

SEQ ID NO: 8086205 - DNA, 22 bp, Homo sapiens
aggcaagcgcagaagcggagga

SEQ ID NO: 8086206 - DNA, 22 bp, Homo sapiens
aggcaagaacagacatgggagt

SEQ ID NO: 8086207 - DNA, 22 bp, Homo sapiens
aggcaagaaactttctgggaga

SEQ ID NO: 8086208 - DNA, 19 bp, Homo sapiens
catcttggagtactccttt

SEQ ID NO: 8086209 - DNA, 22 bp, Homo sapiens
catgaggatgggcagctgggga

SEQ ID NO: 8086210 - DNA, 20 bp, Homo sapiens
catctcctgcctccatgttc

SEQ ID NO: 8086211 - DNA, 22 bp, Homo sapiens
catacaatcaagttctttatta

SEQ ID NO: 8086212 - DNA, 22 bp, Homo sapiens
aggagctgtgaatgggaggggt

SEQ ID NO: 8086213 - DNA, 22 bp, Homo sapiens
aggagctgtcagagtgccagag

SEQ ID NO: 8086214 - DNA, 22 bp, Homo sapiens
cataatatactacattgatgaa

SEQ ID NO: 8086215 - DNA, 22 bp, Homo sapiens
cagtgtgggtttgggaggagta

SEQ ID NO: 8086216 - DNA, 20 bp, Homo sapiens
cagtccaggctgcagcatct

SEQ ID NO: 8086217 - DNA, 22 bp, Homo sapiens
cagtccaggcctggaggagcca

SEQ ID NO: 8086218 - DNA, 22 bp, Homo sapiens
cagtccaggcctggaggagcca

SEQ ID NO: 8086219 - DNA, 22 bp, Homo sapiens
cagtccagagcccaccagagga

SEQ ID NO: 8086220 - DNA, 21 bp, Homo sapiens
cagtgtggtgaccagggtctc

SEQ ID NO: 8086221 - DNA, 22 bp, Homo sapiens
cagtgtggtgagattccaggtg

SEQ ID NO: 8086222 - DNA, 22 bp, Homo sapiens
cagtgtggtgtgcacagcttag

SEQ ID NO: 8086223 - DNA, 22 bp, Homo sapiens
aggagccacttaggtgagataa

SEQ ID NO: 8086224 - DNA, 22 bp, Homo sapiens
aggggagccagggctgcgagtt

SEQ ID NO: 8086225 - DNA, 22 bp, Homo sapiens
agggctcagaacaatgagtgta

SEQ ID NO: 8086226 - DNA, 22 bp, Homo sapiens
aggggtgtgcatcctggaggat

SEQ ID NO: 8086227 - DNA, 22 bp, Homo sapiens
agggtcagtgatgagggagccc

SEQ ID NO: 8086228 - DNA, 22 bp, Homo sapiens
acctcccagaaagttttgcagg

SEQ ID NO: 8086229 - DNA, 20 bp, Homo sapiens
aggggtgatcgggtgacact

SEQ ID NO: 8086230 - DNA, 22 bp, Homo sapiens
acctcccagctctgagcttggg

SEQ ID NO: 8086231 - DNA, 22 bp, Homo sapiens
acctccaggaagctcttggtac

SEQ ID NO: 8086232 - DNA, 19 bp, Homo sapiens
agggcacagggacagaagg

SEQ ID NO: 8086233 - DNA, 22 bp, Homo sapiens
agggcaagttgagtgtgcgtgg

SEQ ID NO: 8086234 - DNA, 22 bp, Homo sapiens
agggcaagttgagtgtgcgtgg

SEQ ID NO: 8086235 - DNA, 22 bp, Homo sapiens
agggatgttgtcaaggatgtgg

SEQ ID NO: 8086236 - DNA, 22 bp, Homo sapiens
agggctcaatggtgggcatgta

SEQ ID NO: 8086237 - DNA, 22 bp, Homo sapiens
agggctcaccactgtgcactcc

SEQ ID NO: 8086238 - DNA, 22 bp, Homo sapiens
agggccagttctacctctgaat

SEQ ID NO: 8086239 - DNA, 22 bp, Homo sapiens
agggccagtcgtgtattactgt

SEQ ID NO: 8086240 - DNA, 22 bp, Homo sapiens
agggccagttcagaggacatgg

SEQ ID NO: 8086241 - DNA, 22 bp, Homo sapiens
agggccagtaccaggtgggtgg

SEQ ID NO: 8086242 - DNA, 22 bp, Homo sapiens
agggccagtaccaggtgggtgg

SEQ ID NO: 8086243 - DNA, 22 bp, Homo sapiens
agggccagtaaatgtttcctca

SEQ ID NO: 8086244 - DNA, 22 bp, Homo sapiens
agggccagtattaaggtaatta

SEQ ID NO: 8086245 - DNA, 22 bp, Homo sapiens
agggccagcccataatgccaaa

SEQ ID NO: 8086246 - DNA, 22 bp, Homo sapiens
agggccagccaggccctacaaa

SEQ ID NO: 8086247 - DNA, 22 bp, Homo sapiens
agggccagcactcctggcagga

SEQ ID NO: 8086248 - DNA, 22 bp, Homo sapiens
agggccagcagcttggccaacc

SEQ ID NO: 8086249 - DNA, 22 bp, Homo sapiens
agggcatgctggaggagagaca

SEQ ID NO: 8086250 - DNA, 22 bp, Homo sapiens
agggccagatgaagccacaagc

SEQ ID NO: 8086251 - DNA, 22 bp, Homo sapiens
agggccagcactcctggcagga

SEQ ID NO: 8086252 - DNA, 22 bp, Homo sapiens
agggccagcactcctggcagga

SEQ ID NO: 8086253 - DNA, 22 bp, Homo sapiens
aggctcaggtctcaggtctggc

SEQ ID NO: 8086254 - DNA, 20 bp, Homo sapiens
aggctcagggtgtttaggaa

SEQ ID NO: 8086255 - DNA, 22 bp, Homo sapiens
aggctctggagtgtggtgctgg

SEQ ID NO: 8086256 - DNA, 22 bp, Homo sapiens
aggctctgacgtcacacgtggc

SEQ ID NO: 8086257 - DNA, 22 bp, Homo sapiens
aggctctctctgccagccgtgc

SEQ ID NO: 8086258 - DNA, 22 bp, Homo sapiens
aggctctcctccccaggaccat

SEQ ID NO: 8086259 - DNA, 22 bp, Homo sapiens
aggctctcactatcctcctagc

SEQ ID NO: 8086260 - DNA, 22 bp, Homo sapiens
aggctctcaccctctgaccaga

SEQ ID NO: 8086261 - DNA, 22 bp, Homo sapiens
aggctctcaatatgatccagtc

SEQ ID NO: 8086262 - DNA, 22 bp, Homo sapiens
acatgtaaaaggaacatgcatg

SEQ ID NO: 8086263 - DNA, 22 bp, Homo sapiens
aggcagtgttcttctaagggca

SEQ ID NO: 8086264 - DNA, 22 bp, Homo sapiens
aggctcagacaggaaaagtaac

SEQ ID NO: 8086265 - DNA, 20 bp, Homo sapiens
aggctcagctgagctcttgg

SEQ ID NO: 8086266 - DNA, 22 bp, Homo sapiens
aggctcagctggtggtgatcgc

SEQ ID NO: 8086267 - DNA, 22 bp, Homo sapiens
aggctcagggacggggcccctt

SEQ ID NO: 8086268 - DNA, 22 bp, Homo sapiens
aggctcagggactccctccctc

SEQ ID NO: 8086269 - DNA, 22 bp, Homo sapiens
aggctcaggcaggaatggcgga

SEQ ID NO: 8086270 - DNA, 22 bp, Homo sapiens
aggctcaggaggagctgccgga

SEQ ID NO: 8086271 - DNA, 22 bp, Homo sapiens
acatgtggtcaatctgtgtagg

SEQ ID NO: 8086272 - DNA, 22 bp, Homo sapiens
acatgtggaggaggcgagggta

SEQ ID NO: 8086273 - DNA, 22 bp, Homo sapiens
aggctgggaaacctgaagttgt

SEQ ID NO: 8086274 - DNA, 22 bp, Homo sapiens
aggctgggaaatgtattccagc

SEQ ID NO: 8086275 - DNA, 22 bp, Homo sapiens
aggctgggaaatgtagtcttcc

SEQ ID NO: 8086276 - DNA, 22 bp, Homo sapiens
aggctggccagtgctgcagtgg

SEQ ID NO: 8086277 - DNA, 22 bp, Homo sapiens
aggctgctctgcgaagtcagct

SEQ ID NO: 8086278 - DNA, 22 bp, Homo sapiens
aggctctggcaacagctggtgt

SEQ ID NO: 8086279 - DNA, 22 bp, Homo sapiens
aggctgcttcaatggataagat

SEQ ID NO: 8086280 - DNA, 22 bp, Homo sapiens
aggctgctgccttggagagtgt

SEQ ID NO: 8086281 - DNA, 21 bp, Homo sapiens
acagcatgtttgtgtgtttgc

SEQ ID NO: 8086282 - DNA, 22 bp, Homo sapiens
acaggacaaaaatctggatggc

SEQ ID NO: 8086283 - DNA, 22 bp, Homo sapiens
acaggacaggctgggctagact

SEQ ID NO: 8086284 - DNA, 22 bp, Homo sapiens
acaggacaatttataatgggca

SEQ ID NO: 8086285 - DNA, 22 bp, Homo sapiens
acaggacaactcagcagccagc

SEQ ID NO: 8086286 - DNA, 20 bp, Homo sapiens
acagccagaggaggcagaca

SEQ ID NO: 8086287 - DNA, 22 bp, Homo sapiens
acaggacatgtaccaggtggtc

SEQ ID NO: 8086288 - DNA, 22 bp, Homo sapiens
acaggacatggcttctgtgacg

SEQ ID NO: 8086289 - DNA, 22 bp, Homo sapiens
acaggacttaagtcatttataa

SEQ ID NO: 8086290 - DNA, 22 bp, Homo sapiens
acaggacaggtaggattcgcag

SEQ ID NO: 8086291 - DNA, 20 bp, Homo sapiens
agcttcttctgtctaatttt

SEQ ID NO: 8086292 - DNA, 22 bp, Homo sapiens
agcttcttggctcagcacttgg

SEQ ID NO: 8086293 - DNA, 22 bp, Homo sapiens
agcttcttcaaagcaggaggcc

SEQ ID NO: 8086294 - DNA, 22 bp, Homo sapiens
agcttctttaattcagcatgat

SEQ ID NO: 8086295 - DNA, 22 bp, Homo sapiens
agcttctttgtgggctccagaa

SEQ ID NO: 8086296 - DNA, 23 bp, Homo sapiens
acagggcattgctggcctcgagg

SEQ ID NO: 8086297 - DNA, 22 bp, Homo sapiens
acagggcatttcctctatgtgt

SEQ ID NO: 8086298 - DNA, 22 bp, Homo sapiens
acagggcatgtgcaagagacat

SEQ ID NO: 8086299 - DNA, 21 bp, Homo sapiens
acagggcatgcagctggctgt

SEQ ID NO: 8086300 - DNA, 22 bp, Homo sapiens
acagggcagtgtcttgaaaaat

SEQ ID NO: 8086301 - DNA, 22 bp, Homo sapiens
acagggcaggtggctactggtc

SEQ ID NO: 8086302 - DNA, 21 bp, Homo sapiens
acaggctctggggatgctggg

SEQ ID NO: 8086303 - DNA, 21 bp, Homo sapiens
acaggctcacgatccatttct

SEQ ID NO: 8086304 - DNA, 22 bp, Homo sapiens
acaggctcagttcactggattt

SEQ ID NO: 8086305 - DNA, 22 bp, Homo sapiens
acaggctctcagccagttggca

SEQ ID NO: 8086306 - DNA, 22 bp, Homo sapiens
acaggctcgtgcgcgcacgtgt

SEQ ID NO: 8086307 - DNA, 22 bp, Homo sapiens
acaggctctctattgagtgcag

SEQ ID NO: 8086308 - DNA, 22 bp, Homo sapiens
acaggctcacagtcatttcatt

SEQ ID NO: 8086309 - DNA, 22 bp, Homo sapiens
acaggcctggtgctgctgacag

SEQ ID NO: 8086310 - DNA, 23 bp, Homo sapiens
aggacagtggaatttagggattg

SEQ ID NO: 8086311 - DNA, 22 bp, Homo sapiens
aggacagtgtggaagagggtgc

SEQ ID NO: 8086312 - DNA, 22 bp, Homo sapiens
aggacagtggcaaggcaggaca

SEQ ID NO: 8086313 - DNA, 22 bp, Homo sapiens
aggacagtggtgttctggagtg

SEQ ID NO: 8086314 - DNA, 22 bp, Homo sapiens
aggacagtggcagggtgacaga

SEQ ID NO: 8086315 - DNA, 22 bp, Homo sapiens
acagtgaatgcccaagaaaagt

SEQ ID NO: 8086316 - DNA, 22 bp, Homo sapiens
acagtgaatgagaatggagaaa

SEQ ID NO: 8086317 - DNA, 22 bp, Homo sapiens
aggcactggtccattttctgca

SEQ ID NO: 8086318 - DNA, 22 bp, Homo sapiens
acagtggagctcagatgaaaat

SEQ ID NO: 8086319 - DNA, 22 bp, Homo sapiens
aggcacagcacacctggccccc

SEQ ID NO: 8086320 - DNA, 22 bp, Homo sapiens
aggcacagcacacctggccccc

SEQ ID NO: 8086321 - DNA, 22 bp, Homo sapiens
aggcagtgtattgctagcggct

SEQ ID NO: 8086322 - DNA, 22 bp, Homo sapiens
acatatattactagtaaagaca

SEQ ID NO: 8086323 - DNA, 22 bp, Homo sapiens
agaagcacggttttgtctagca

SEQ ID NO: 8086324 - DNA, 22 bp, Homo sapiens
atcctgggaatgggagggtcat

SEQ ID NO: 8086325 - DNA, 22 bp, Homo sapiens
atcctgagctacacctgctcct

SEQ ID NO: 8086326 - DNA, 18 bp, Homo sapiens
atcaaggaggggaaggtc

SEQ ID NO: 8086327 - DNA, 20 bp, Homo sapiens
agaaatcagcatgtcctctg

SEQ ID NO: 8086328 - DNA, 22 bp, Homo sapiens
atcaattttgaggatacaagaa

SEQ ID NO: 8086329 - DNA, 20 bp, Homo sapiens
agaaatattgagttcagagg

SEQ ID NO: 8086330 - DNA, 22 bp, Homo sapiens
agaaatcaatatctatatgttg

SEQ ID NO: 8086331 - DNA, 22 bp, Homo sapiens
atatagaaggtgctatttacat

SEQ ID NO: 8086332 - DNA, 22 bp, Homo sapiens
agaaactgcagctcagagaagt

SEQ ID NO: 8086333 - DNA, 22 bp, Homo sapiens
actttagaagtaaggatgagtt

SEQ ID NO: 8086334 - DNA, 22 bp, Homo sapiens
actttagaaaaggaacagagga

SEQ ID NO: 8086335 - DNA, 22 bp, Homo sapiens
actttagaccatcttccacagt

SEQ ID NO: 8086336 - DNA, 22 bp, Homo sapiens
actttagagaaatgtagaagta

SEQ ID NO: 8086337 - DNA, 22 bp, Homo sapiens
actttagaaaagcatccataga

SEQ ID NO: 8086338 - DNA, 22 bp, Homo sapiens
actttagatattcctctgtaca

SEQ ID NO: 8086339 - DNA, 23 bp, Homo sapiens
actttagataaattatgtgcaca

SEQ ID NO: 8086340 - DNA, 22 bp, Homo sapiens
atagaatagcatagaaaattga

SEQ ID NO: 8086341 - DNA, 22 bp, Homo sapiens
actttacagatggtttcctgac

SEQ ID NO: 8086342 - DNA, 22 bp, Homo sapiens
actttacaggcacttcaagtat

SEQ ID NO: 8086343 - DNA, 22 bp, Homo sapiens
agaaaaatcttggcgcttgtct

SEQ ID NO: 8086344 - DNA, 22 bp, Homo sapiens
agttcacagaatggccagaact

SEQ ID NO: 8086345 - DNA, 22 bp, Homo sapiens
agttcacaatagaagaggtggc

SEQ ID NO: 8086346 - DNA, 22 bp, Homo sapiens
agttgaattatgagtgtctttg

SEQ ID NO: 8086347 - DNA, 22 bp, Homo sapiens
atacacagctacattgaacaat

SEQ ID NO: 8086348 - DNA, 22 bp, Homo sapiens
atacacgtgccatgttggtgtg

SEQ ID NO: 8086349 - DNA, 22 bp, Homo sapiens
atacaattattctgcagatatt

SEQ ID NO: 8086350 - DNA, 22 bp, Homo sapiens
actctgggctgttaggagctgt

SEQ ID NO: 8086351 - DNA, 21 bp, Homo sapiens
agtccaggagtcacccaagcc

SEQ ID NO: 8086352 - DNA, 22 bp, Homo sapiens
actctgggcccaccctcagagt

SEQ ID NO: 8086353 - DNA, 22 bp, Homo sapiens
agtccaggcctccctctcctgc

SEQ ID NO: 8086354 - DNA, 22 bp, Homo sapiens
agtccaggcattccagccattc

SEQ ID NO: 8086355 - DNA, 22 bp, Homo sapiens
agtccaggcattccagccattc

SEQ ID NO: 8086356 - DNA, 22 bp, Homo sapiens
actcagaggcagctgctcaccc

SEQ ID NO: 8086357 - DNA, 22 bp, Homo sapiens
actcagaggaaaccctcctagg

SEQ ID NO: 8086358 - DNA, 22 bp, Homo sapiens
aggtgggtcctggctctgccat

SEQ ID NO: 8086359 - DNA, 22 bp, Homo sapiens
aggtgggtgccgtctgtcctct

SEQ ID NO: 8086360 - DNA, 21 bp, Homo sapiens
aggtgcaggcctcaagcccca

SEQ ID NO: 8086361 - DNA, 22 bp, Homo sapiens
agggtcccgtccctctgcaccc

SEQ ID NO: 8086362 - DNA, 22 bp, Homo sapiens
agtggcagagaccccagccagc

SEQ ID NO: 8086363 - DNA, 22 bp, Homo sapiens
agtggcagacagagacagtacc

SEQ ID NO: 8086364 - DNA, 22 bp, Homo sapiens
agtggcagacacaatgtgggca

SEQ ID NO: 8086365 - DNA, 22 bp, Homo sapiens
agtgggaggaagtggtgatatt

SEQ ID NO: 8086366 - DNA, 16 bp, Homo sapiens
agtgggaggagaaaga

SEQ ID NO: 8086367 - DNA, 22 bp, Homo sapiens
agtgggaggcggctgacgggcg

SEQ ID NO: 8086368 - DNA, 22 bp, Homo sapiens
agtgggagcggcagtcggggac

SEQ ID NO: 8086369 - DNA, 22 bp, Homo sapiens
agtgggagccagcagcttgggg

SEQ ID NO: 8086370 - DNA, 22 bp, Homo sapiens
agtgggagataacttaacagct

SEQ ID NO: 8086371 - DNA, 20 bp, Homo sapiens
agtgggagagggcagactgc

SEQ ID NO: 8086372 - DNA, 22 bp, Homo sapiens
agtggcagagccaagtagagcc

SEQ ID NO: 8086373 - DNA, 22 bp, Homo sapiens
agtgctgtctccttcccccggg

SEQ ID NO: 8086374 - DNA, 22 bp, Homo sapiens
agttcaacaccagcctgaccaa

SEQ ID NO: 8086375 - DNA, 22 bp, Homo sapiens
actggttgaagaaaagctagta

SEQ ID NO: 8086376 - DNA, 22 bp, Homo sapiens
actggggattagggactcagtg

SEQ ID NO: 8086377 - DNA, 22 bp, Homo sapiens
agtgtgtccagaaatctgtatt

SEQ ID NO: 8086378 - DNA, 22 bp, Homo sapiens
agtgtgtctgatcacttgtgag

SEQ ID NO: 8086379 - DNA, 22 bp, Homo sapiens
cagcatggtgccagtgagtcca

SEQ ID NO: 8086380 - DNA, 22 bp, Homo sapiens
agcgccactgcactccagcctg

SEQ ID NO: 8086381 - DNA, 22 bp, Homo sapiens
agcgaggttttgcagatacagc

SEQ ID NO: 8086382 - DNA, 22 bp, Homo sapiens
cagcatggggatcactgtaggc

SEQ ID NO: 8086383 - DNA, 22 bp, Homo sapiens
cagcatggacccatcgctgagt

SEQ ID NO: 8086384 - DNA, 22 bp, Homo sapiens
cagcatcatactacctaaatga

SEQ ID NO: 8086385 - DNA, 22 bp, Homo sapiens
cagcactgttcccagaccactg

SEQ ID NO: 8086386 - DNA, 22 bp, Homo sapiens
cagcactgcttcgcagccaggg

SEQ ID NO: 8086387 - DNA, 22 bp, Homo sapiens
cagcctcctgggacactcaccg

SEQ ID NO: 8086388 - DNA, 22 bp, Homo sapiens
cagcccattcctgccatgccgc

SEQ ID NO: 8086389 - DNA, 22 bp, Homo sapiens
cagcccaggtggcggaggttgc

SEQ ID NO: 8086390 - DNA, 22 bp, Homo sapiens
cagcccagtaccaagcagttgg

SEQ ID NO: 8086391 - DNA, 22 bp, Homo sapiens
cagcccagtgcacgcccgtttc

SEQ ID NO: 8086392 - DNA, 22 bp, Homo sapiens
cagcccaggtctctcttccagt

SEQ ID NO: 8086393 - DNA, 22 bp, Homo sapiens
cagcccagtgcatttgtgtact

SEQ ID NO: 8086394 - DNA, 22 bp, Homo sapiens
cagcccaggtggcggaggttgc

SEQ ID NO: 8086395 - DNA, 22 bp, Homo sapiens
cagcccaggtctctcttccagt

SEQ ID NO: 8086396 - DNA, 22 bp, Homo sapiens
cagcccaggtctctcttccagt

SEQ ID NO: 8086397 - DNA, 19 bp, Homo sapiens
cagcccagggtgctaccaa

SEQ ID NO: 8086398 - DNA, 22 bp, Homo sapiens
cagcccacctggcacgtgtgtt

SEQ ID NO: 8086399 - DNA, 22 bp, Homo sapiens
cagcccagagatgttatctagt

SEQ ID NO: 8086400 - DNA, 22 bp, Homo sapiens
cagcccagagaaggggcccgtg

SEQ ID NO: 8086401 - DNA, 21 bp, Homo sapiens
cagcccagagcagtggggcca

SEQ ID NO: 8086402 - DNA, 21 bp, Homo sapiens
cagcccagagcagtggggcca

SEQ ID NO: 8086403 - DNA, 16 bp, Homo sapiens
cagcccaggggcgggc

SEQ ID NO: 8086404 - DNA, 19 bp, Homo sapiens
cagcccagggtgctaccaa

SEQ ID NO: 8086405 - DNA, 22 bp, Homo sapiens
cagcccactgcctctgtggtag

SEQ ID NO: 8086406 - DNA, 22 bp, Homo sapiens
cagcccagaactcacgtctcca

SEQ ID NO: 8086407 - DNA, 22 bp, Homo sapiens
cagcccagagaaggggcccgtg

SEQ ID NO: 8086408 - DNA, 22 bp, Homo sapiens
cagcccagacaccatcattcta

SEQ ID NO: 8086409 - DNA, 22 bp, Homo sapiens
cagcgctggggtaggagcacct

SEQ ID NO: 8086410 - DNA, 22 bp, Homo sapiens
cagctgcccaggccacctggag

SEQ ID NO: 8086411 - DNA, 22 bp, Homo sapiens
agctgaggaggaatgatgggta

SEQ ID NO: 8086412 - DNA, 22 bp, Homo sapiens
agctgaggacgtgaagggcggc

SEQ ID NO: 8086413 - DNA, 22 bp, Homo sapiens
agccaggggagtcagctgctgg

SEQ ID NO: 8086414 - DNA, 22 bp, Homo sapiens
agccagggacgctgcaggctac

SEQ ID NO: 8086415 - DNA, 22 bp, Homo sapiens
agccaggctcaaggcctgctcc

SEQ ID NO: 8086416 - DNA, 22 bp, Homo sapiens
agccaggccttttctcaaggtt

SEQ ID NO: 8086417 - DNA, 22 bp, Homo sapiens
agccaagcactcaactcctgga

SEQ ID NO: 8086418 - DNA, 21 bp, Homo sapiens
cagagctgtccaaaccctgac

SEQ ID NO: 8086419 - DNA, 23 bp, Homo sapiens
cagagctggctcagagctgcctg

SEQ ID NO: 8086420 - DNA, 22 bp, Homo sapiens
cagagctgtgataaatagatat

SEQ ID NO: 8086421 - DNA, 22 bp, Homo sapiens
cagagctgttactattcatgaa

SEQ ID NO: 8086422 - DNA, 22 bp, Homo sapiens
cagagctgtccaaaccctgaca

SEQ ID NO: 8086423 - DNA, 22 bp, Homo sapiens
cagagctgttgcggggcttggc

SEQ ID NO: 8086424 - DNA, 20 bp, Homo sapiens
cagagctgttatggatgatg

SEQ ID NO: 8086425 - DNA, 22 bp, Homo sapiens
cagagcagtaaatctggggcac

SEQ ID NO: 8086426 - DNA, 22 bp, Homo sapiens
cagatgaactgtgactgaaaat

SEQ ID NO: 8086427 - DNA, 22 bp, Homo sapiens
agccggccatgtggtcttgtgc

SEQ ID NO: 8086428 - DNA, 22 bp, Homo sapiens
agcctacagagggcaggtggag

SEQ ID NO: 8086429 - DNA, 22 bp, Homo sapiens
agccctcctggggccacgctgg

SEQ ID NO: 8086430 - DNA, 22 bp, Homo sapiens
cactgcaacctccagctctcag

SEQ ID NO: 8086431 - DNA, 22 bp, Homo sapiens
cactgcaacctccgcctcttgg

SEQ ID NO: 8086432 - DNA, 22 bp, Homo sapiens
cactgcaacctccatcttctgg

SEQ ID NO: 8086433 - DNA, 22 bp, Homo sapiens
cactgcaagctccgcctctggg

SEQ ID NO: 8086434 - DNA, 20 bp, Homo sapiens
cactgcaagtatttaaccca

SEQ ID NO: 8086435 - DNA, 22 bp, Homo sapiens
cactgcaatctccatctcctgg

SEQ ID NO: 8086436 - DNA, 22 bp, Homo sapiens
cactgcaatatctgcatcctgg

SEQ ID NO: 8086437 - DNA, 23 bp, Homo sapiens
cactgcaatctctgcctcctggg

SEQ ID NO: 8086438 - DNA, 22 bp, Homo sapiens
cactgcactgcagcctggagac

SEQ ID NO: 8086439 - DNA, 22 bp, Homo sapiens
cactgcacttcagcctgggtga

SEQ ID NO: 8086440 - DNA, 22 bp, Homo sapiens
cactgcacttcagcctgggtga

SEQ ID NO: 8086441 - DNA, 20 bp, Homo sapiens
agcatttagcctttatccac

SEQ ID NO: 8086442 - DNA, 22 bp, Homo sapiens
agcatttatgactaatgtaaaa

SEQ ID NO: 8086443 - DNA, 22 bp, Homo sapiens
cactgaacaacaaatagtgaat

SEQ ID NO: 8086444 - DNA, 22 bp, Homo sapiens
agcaggtgggatcaagctggca

SEQ ID NO: 8086445 - DNA, 22 bp, Homo sapiens
agcaggtggatttagacgggag

SEQ ID NO: 8086446 - DNA, 22 bp, Homo sapiens
cacaggctccggccttgcagcc

SEQ ID NO: 8086447 - DNA, 19 bp, Homo sapiens
agcaggctaggctgcctct

SEQ ID NO: 8086448 - DNA, 22 bp, Homo sapiens
agcaggctaggaacctcactgc

SEQ ID NO: 8086449 - DNA, 22 bp, Homo sapiens
agcaggcctgccacctcggggt

SEQ ID NO: 8086450 - DNA, 22 bp, Homo sapiens
cacatgaagacctaattggatt

SEQ ID NO: 8086451 - DNA, 22 bp, Homo sapiens
cacatgaagagagtctagtaat

SEQ ID NO: 8086452 - DNA, 22 bp, Homo sapiens
cacaggctcttctcacttgatt

SEQ ID NO: 8086453 - DNA, 22 bp, Homo sapiens
cacaggctgcccgcagctggga

SEQ ID NO: 8086454 - DNA, 22 bp, Homo sapiens
cacatgggcttagcaggcaggg

SEQ ID NO: 8086455 - DNA, 22 bp, Homo sapiens
caatttctggaactaattctga

SEQ ID NO: 8086456 - DNA, 22 bp, Homo sapiens
caatttttaaactatgaagttg

SEQ ID NO: 8086457 - DNA, 22 bp, Homo sapiens
cacagcagcgttcctccgtgtg

SEQ ID NO: 8086458 - DNA, 22 bp, Homo sapiens
cacaggaagaggtatacaattc

SEQ ID NO: 8086459 - DNA, 22 bp, Homo sapiens
cacagctggggaagctgaggcc

SEQ ID NO: 8086460 - DNA, 22 bp, Homo sapiens
agcaattttcccttagtctttg

SEQ ID NO: 8086461 - DNA, 22 bp, Homo sapiens
caagcttgtttctcctgggggt

SEQ ID NO: 8086462 - DNA, 22 bp, Homo sapiens
caagggaaggctaagggcaaca

SEQ ID NO: 8086463 - DNA, 22 bp, Homo sapiens
caattatatttagaatgataca

SEQ ID NO: 8086464 - DNA, 22 bp, Homo sapiens
caattattcagtgacttaagag

SEQ ID NO: 8086465 - DNA, 22 bp, Homo sapiens
caagggctcttttgaggaatgt

SEQ ID NO: 8086466 - DNA, 22 bp, Homo sapiens
caagggctgaacacaggtttca

SEQ ID NO: 8086467 - DNA, 22 bp, Homo sapiens
attatttgagttcctctctacc

SEQ ID NO: 8086468 - DNA, 22 bp, Homo sapiens
attgtataacagcatgtatttt

SEQ ID NO: 8086469 - DNA, 22 bp, Homo sapiens
agatacaactgtttaaacatta

SEQ ID NO: 8086470 - DNA, 22 bp, Homo sapiens
attgttaataactattacattg

SEQ ID NO: 8086471 - DNA, 22 bp, Homo sapiens
agatttaaatttgctacaattc

SEQ ID NO: 8086472 - DNA, 22 bp, Homo sapiens
agatgtttgtgttatctccatt

SEQ ID NO: 8086473 - DNA, 22 bp, Homo sapiens
agatgtttcagtaatttatctt

SEQ ID NO: 8086474 - DNA, 22 bp, Homo sapiens
atgccaggccccacgctgggca

SEQ ID NO: 8086475 - DNA, 23 bp, Homo sapiens
atgccaggctgcctggccagcct

SEQ ID NO: 8086476 - DNA, 22 bp, Homo sapiens
agacagtggctcagccccagtc

SEQ ID NO: 8086477 - DNA, 20 bp, Homo sapiens
agacagtggggagctcctag

SEQ ID NO: 8086478 - DNA, 22 bp, Homo sapiens
agacagtggatcgggatgcact

SEQ ID NO: 8086479 - DNA, 19 bp, Homo sapiens
agacagtggctaggactta

SEQ ID NO: 8086480 - DNA, 23 bp, Homo sapiens
agacagtggccgagaggtactag

SEQ ID NO: 8086481 - DNA, 22 bp, Homo sapiens
atgaggaagtctgataatggta

SEQ ID NO: 8086482 - DNA, 22 bp, Homo sapiens
atgaggcacatcacagccaatg

SEQ ID NO: 8086483 - DNA, 22 bp, Homo sapiens
atgattgaaaatgacattgcca

SEQ ID NO: 8086484 - DNA, 22 bp, Homo sapiens
agagccaggactgtgtctcact

SEQ ID NO: 8086485 - DNA, 22 bp, Homo sapiens
agagccaggatgtcttctgggg

SEQ ID NO: 8086486 - DNA, 22 bp, Homo sapiens
atgttacagaaagcaaagatga

SEQ ID NO: 8086487 - DNA, 22 bp, Homo sapiens
agagccagcatttgacactggc

SEQ ID NO: 8086488 - DNA, 22 bp, Homo sapiens
agagccagcatttgggccctgc

SEQ ID NO: 8086489 - DNA, 22 bp, Homo sapiens
agagccagccttctcagcttac

SEQ ID NO: 8086490 - DNA, 22 bp, Homo sapiens
agagccaggaagtggcgtgggg

SEQ ID NO: 8086491 - DNA, 22 bp, Homo sapiens
agagctccaagaagtcctgcag

SEQ ID NO: 8086492 - DNA, 22 bp, Homo sapiens
agagctccgtgcctggctgcca

SEQ ID NO: 8086493 - DNA, 22 bp, Homo sapiens
atgggcagtgtattggaaggaa

SEQ ID NO: 8086494 - DNA, 22 bp, Homo sapiens
atgggcagttaggaggccagga

SEQ ID NO: 8086495 - DNA, 22 bp, Homo sapiens
atgggccaagtaaacattctca

SEQ ID NO: 8086496 - DNA, 23 bp, Homo sapiens
atgggccaagcaagacccatgac

SEQ ID NO: 8086497 - DNA, 22 bp, Homo sapiens
atgggccaggcttgggatgaca

SEQ ID NO: 8086498 - DNA, 22 bp, Homo sapiens
atgggccagcaccatgttaagc

SEQ ID NO: 8086499 - DNA, 22 bp, Homo sapiens
atgggccacacacgattgggtg

SEQ ID NO: 8086500 - DNA, 21 bp, Homo sapiens
atgggccagggatacagagag

SEQ ID NO: 8086501 - DNA, 18 bp, Homo sapiens
atgggaggggccaagaga

SEQ ID NO: 8086502 - DNA, 22 bp, Homo sapiens
atgggcagtaacagtggcagtc

SEQ ID NO: 8086503 - DNA, 22 bp, Homo sapiens
atggacagggcacaggcgcaga

SEQ ID NO: 8086504 - DNA, 23 bp, Homo sapiens
atggacagggtttcagggtcaca

SEQ ID NO: 8086505 - DNA, 22 bp, Homo sapiens
atggacaggtactgcagtgggt

SEQ ID NO: 8086506 - DNA, 22 bp, Homo sapiens
agagaacatattttgtatgatt

SEQ ID NO: 8086507 - DNA, 22 bp, Homo sapiens
agagacttaaaactgttttcac

SEQ ID NO: 8086508 - DNA, 22 bp, Homo sapiens
agagactttgtctattttgttc

SEQ ID NO: 8086509 - DNA, 18 bp, Homo sapiens
aagttccacaagagatct

SEQ ID NO: 8086510 - DNA, 22 bp, Homo sapiens
aagttcatcaaagagtaaatat

SEQ ID NO: 8086511 - DNA, 22 bp, Homo sapiens
actgaaaatgaattagaaacag

SEQ ID NO: 8086512 - DNA, 22 bp, Homo sapiens
actgaaaaagacatcttggtaa

SEQ ID NO: 8086513 - DNA, 22 bp, Homo sapiens
actctttagaggtacatctctt

SEQ ID NO: 8086514 - DNA, 22 bp, Homo sapiens
aagtgtttccgggagacttggt

SEQ ID NO: 8086515 - DNA, 22 bp, Homo sapiens
aagtgtttcttggaatgttgcg

SEQ ID NO: 8086516 - DNA, 22 bp, Homo sapiens
actcttggccactcttggtgtc

SEQ ID NO: 8086517 - DNA, 22 bp, Homo sapiens
aagtgtttatggttattgttaa

SEQ ID NO: 8086518 - DNA, 22 bp, Homo sapiens
aagtgtttccattgtgcaggct

SEQ ID NO: 8086519 - DNA, 22 bp, Homo sapiens
aagtgtttatttataacgatct

SEQ ID NO: 8086520 - DNA, 22 bp, Homo sapiens
aagtgtttaaattatttgcagg

SEQ ID NO: 8086521 - DNA, 22 bp, Homo sapiens
aagtgtttaatggttttgatga

SEQ ID NO: 8086522 - DNA, 22 bp, Homo sapiens
aagtgtttaacggtgattgagc

SEQ ID NO: 8086523 - DNA, 22 bp, Homo sapiens
actgggaggcaaagagcaagga

SEQ ID NO: 8086524 - DNA, 22 bp, Homo sapiens
actgggagggtcttgaagaggg

SEQ ID NO: 8086525 - DNA, 22 bp, Homo sapiens
actgggagtcatgaggaaggag

SEQ ID NO: 8086526 - DNA, 22 bp, Homo sapiens
actgtacacacttctctgtctt

SEQ ID NO: 8086527 - DNA, 22 bp, Homo sapiens
actgtacacgtgtcatttacag

SEQ ID NO: 8086528 - DNA, 22 bp, Homo sapiens
actgtacatgcatcttgtctat

SEQ ID NO: 8086529 - DNA, 22 bp, Homo sapiens
actgtcctagaacctgcagctc

SEQ ID NO: 8086530 - DNA, 22 bp, Homo sapiens
aatagaatgtaatctaatacat

SEQ ID NO: 8086531 - DNA, 22 bp, Homo sapiens
aatagaatgtaatctaatacat

SEQ ID NO: 8086532 - DNA, 22 bp, Homo sapiens
agaaactgaattatttctgagg

SEQ ID NO: 8086533 - DNA, 22 bp, Homo sapiens
agaaaggacatctccctttaag

SEQ ID NO: 8086534 - DNA, 22 bp, Homo sapiens
aatagcatgttcatgataaaat

SEQ ID NO: 8086535 - DNA, 21 bp, Homo sapiens
aatgcattaacataaagctga

SEQ ID NO: 8086536 - DNA, 21 bp, Homo sapiens
aatgcattaacataaagctga

SEQ ID NO: 8086537 - DNA, 22 bp, Homo sapiens
aatgcatatgtaggcaagcagt

SEQ ID NO: 8086538 - DNA, 22 bp, Homo sapiens
agaaggaaggataactgcatta

SEQ ID NO: 8086539 - DNA, 22 bp, Homo sapiens
agaaggaaggaagcattctgtt

SEQ ID NO: 8086540 - DNA, 22 bp, Homo sapiens
agaagaaactgtcggggatatt

SEQ ID NO: 8086541 - DNA, 22 bp, Homo sapiens
agaagaaagattgaaggttcct

SEQ ID NO: 8086542 - DNA, 22 bp, Homo sapiens
aatgaactgtgttaactgaata

SEQ ID NO: 8086543 - DNA, 22 bp, Homo sapiens
agaagccactggaggttgagat

SEQ ID NO: 8086544 - DNA, 22 bp, Homo sapiens
aatgaatgaaccacatataaca

SEQ ID NO: 8086545 - DNA, 22 bp, Homo sapiens
aatgaagccactgaagacaatc

SEQ ID NO: 8086546 - DNA, 22 bp, Homo sapiens
aatgaagcagttttcatcaagt

SEQ ID NO: 8086547 - DNA, 22 bp, Homo sapiens
aatgaagcagtccatctgctct

SEQ ID NO: 8086548 - DNA, 22 bp, Homo sapiens
aagggatgtaaacatgaataag

SEQ ID NO: 8086549 - DNA, 22 bp, Homo sapiens
aagggatgcaggaaagaaggtt

SEQ ID NO: 8086550 - DNA, 22 bp, Homo sapiens
acatttcagtaagtgttaattt

SEQ ID NO: 8086551 - DNA, 22 bp, Homo sapiens
accagaggctctgccacctcca

SEQ ID NO: 8086552 - DNA, 22 bp, Homo sapiens
aagggggcggcagccagtggaa

SEQ ID NO: 8086553 - DNA, 22 bp, Homo sapiens
aagggggcggcagccagtggaa

SEQ ID NO: 8086554 - DNA, 22 bp, Homo sapiens
aagggttggggaagagcaaatt

SEQ ID NO: 8086555 - DNA, 22 bp, Homo sapiens
aagggttgcaaggtcagaggaa

SEQ ID NO: 8086556 - DNA, 22 bp, Homo sapiens
acccaggggcagccttgctgtg

SEQ ID NO: 8086557 - DNA, 22 bp, Homo sapiens
acccagggccacagcccgcagt

SEQ ID NO: 8086558 - DNA, 22 bp, Homo sapiens
acccaggccattggcaagagtc

SEQ ID NO: 8086559 - DNA, 22 bp, Homo sapiens
acccaggggcgaagctggccac

SEQ ID NO: 8086560 - DNA, 22 bp, Homo sapiens
acctctgccactttctaactct

SEQ ID NO: 8086561 - DNA, 22 bp, Homo sapiens
aagtataagctattcttcatga

SEQ ID NO: 8086562 - DNA, 22 bp, Homo sapiens
aagtccatgatcaagatgtggc

SEQ ID NO: 8086563 - DNA, 21 bp, Homo sapiens
aagctgtgttccactgatagc

SEQ ID NO: 8086564 - DNA, 22 bp, Homo sapiens
acagctggaggtctgtgagcac

SEQ ID NO: 8086565 - DNA, 22 bp, Homo sapiens
acagctggagtgaggatggagt

SEQ ID NO: 8086566 - DNA, 22 bp, Homo sapiens
acagctggaggtctgtgagcac

SEQ ID NO: 8086567 - DNA, 22 bp, Homo sapiens
aagctgttggcagatagctctg

SEQ ID NO: 8086568 - DNA, 22 bp, Homo sapiens
aagcttaatcagtctggttgca

SEQ ID NO: 8086569 - DNA, 23 bp, Homo sapiens
aagcttccttcacgtctcctggg

SEQ ID NO: 8086570 - DNA, 21 bp, Homo sapiens
aagcttccaaactgctggact

SEQ ID NO: 8086571 - DNA, 22 bp, Homo sapiens
acatgacagtgcttagcaaact

SEQ ID NO: 8086572 - DNA, 22 bp, Homo sapiens
acatgacatagtagaaaagccc

SEQ ID NO: 8086573 - DNA, 22 bp, Homo sapiens
acatgcatacacgtacatacct

SEQ ID NO: 8086574 - DNA, 22 bp, Homo sapiens
acatgcataggagaagtcttta

SEQ ID NO: 8086575 - DNA, 22 bp, Homo sapiens
acatctatgaacatttaagtag

SEQ ID NO: 8086576 - DNA, 22 bp, Homo sapiens
acatcctcccgatctactggct

SEQ ID NO: 8086577 - DNA, 22 bp, Homo sapiens
acatgaacatgctcaaataact

SEQ ID NO: 8086578 - DNA, 22 bp, Homo sapiens
acatgaacattatatcagcaag

SEQ ID NO: 8086579 - DNA, 22 bp, Homo sapiens
aaggccagagcgtgtcctgcct

SEQ ID NO: 8086580 - DNA, 22 bp, Homo sapiens
aaggccagcctgagagctaaca

SEQ ID NO: 8086581 - DNA, 22 bp, Homo sapiens
agacatttattcacacatttat

SEQ ID NO: 8086582 - DNA, 22 bp, Homo sapiens
agagcaattagcttaggtaaaa

SEQ ID NO: 8086583 - DNA, 22 bp, Homo sapiens
agagaaattctcagtggaagat

SEQ ID NO: 8086584 - DNA, 22 bp, Homo sapiens
aatgtattcctcatgcaagagt

SEQ ID NO: 8086585 - DNA, 22 bp, Homo sapiens
aatgtattcctcatgcaagagt

SEQ ID NO: 8086586 - DNA, 18 bp, Homo sapiens
aatttccatatgaattgc

SEQ ID NO: 8086587 - DNA, 18 bp, Homo sapiens
aatttccatatgaattgc

SEQ ID NO: 8086588 - DNA, 22 bp, Homo sapiens
agaggaggtggtgatgctttaa

SEQ ID NO: 8086589 - DNA, 22 bp, Homo sapiens
aattaagaaaatgttttatgat

SEQ ID NO: 8086590 - DNA, 22 bp, Homo sapiens
agagctgccgagctggggccat

SEQ ID NO: 8086591 - DNA, 22 bp, Homo sapiens
agagctgcccacacagcagatt

SEQ ID NO: 8086592 - DNA, 22 bp, Homo sapiens
agagctgcagggtggacccagg

SEQ ID NO: 8086593 - DNA, 22 bp, Homo sapiens
agagctgatttgattacagtgc

SEQ ID NO: 8086594 - DNA, 22 bp, Homo sapiens
agagctgagcaccaagcatggt

SEQ ID NO: 8086595 - DNA, 22 bp, Homo sapiens
agcacactgacctgaagccttg

SEQ ID NO: 8086596 - DNA, 22 bp, Homo sapiens
acaatttttcaaagaagcttat

SEQ ID NO: 8086597 - DNA, 22 bp, Homo sapiens
acacaaattgtaggataattgc

SEQ ID NO: 8086598 - DNA, 22 bp, Homo sapiens
acacaaattgtaggataattgc

SEQ ID NO: 8086599 - DNA, 22 bp, Homo sapiens
agcacaggacgtagagcttgga

SEQ ID NO: 8086600 - DNA, 22 bp, Homo sapiens
agcacagggcccagcctaggcc

SEQ ID NO: 8086601 - DNA, 22 bp, Homo sapiens
acaacattatacatagaaagct

SEQ ID NO: 8086602 - DNA, 22 bp, Homo sapiens
acaacattcttaaatacactga

SEQ ID NO: 8086603 - DNA, 22 bp, Homo sapiens
acaagtttcattgtttagaacc

SEQ ID NO: 8086604 - DNA, 22 bp, Homo sapiens
agcaaatacttgaataaaaaga

SEQ ID NO: 8086605 - DNA, 22 bp, Homo sapiens
acaataatgtattgccaaaagt

SEQ ID NO: 8086606 - DNA, 22 bp, Homo sapiens
acaatacaggcttctggactta

SEQ ID NO: 8086607 - DNA, 22 bp, Homo sapiens
aatttgattcagcaaatgttca

SEQ ID NO: 8086608 - DNA, 22 bp, Homo sapiens
aatttgatgagtttgtaagtct

SEQ ID NO: 8086609 - DNA, 22 bp, Homo sapiens
acacttcaaagggtgacttgat

SEQ ID NO: 8086610 - DNA, 22 bp, Homo sapiens
acactgtgtggtctctctcgga

SEQ ID NO: 8086611 - DNA, 22 bp, Homo sapiens
acactgtgtttacatagagaat

SEQ ID NO: 8086612 - DNA, 14 bp, Homo sapiens
acactgtgtttaga

SEQ ID NO: 8086613 - DNA, 22 bp, Homo sapiens
agccacagtctgtagccagctt

SEQ ID NO: 8086614 - DNA, 23 bp, Homo sapiens
acacttcacccattgtgatagga

SEQ ID NO: 8086615 - DNA, 22 bp, Homo sapiens
acacttcaaatggttggaaaat

SEQ ID NO: 8086616 - DNA, 22 bp, Homo sapiens
agccagaggccagcctgcctca

SEQ ID NO: 8086617 - DNA, 22 bp, Homo sapiens
agccaggaagaaggtcacacca

SEQ ID NO: 8086618 - DNA, 22 bp, Homo sapiens
acactgtgtgacttctgagact

SEQ ID NO: 8086619 - DNA, 22 bp, Homo sapiens
agccaaggcagctagagctctg

SEQ ID NO: 8086620 - DNA, 22 bp, Homo sapiens
agccaaggactcagtggtaggc

SEQ ID NO: 8086621 - DNA, 22 bp, Homo sapiens
agcaggtgtatcggtcacctac

SEQ ID NO: 8086622 - DNA, 22 bp, Homo sapiens
acacccagagcgccagtgccga

SEQ ID NO: 8086623 - DNA, 22 bp, Homo sapiens
acacccagattatgcacacaaa

SEQ ID NO: 8086624 - DNA, 22 bp, Homo sapiens
acacacaactcattgtgtaata

SEQ ID NO: 8086625 - DNA, 22 bp, Homo sapiens
acacaatgcatatttttccaga

SEQ ID NO: 8086626 - DNA, 22 bp, Homo sapiens
acacaagttctaaagattgcgc

SEQ ID NO: 8086627 - DNA, 23 bp, Homo sapiens
acacaatagagtactattcagcc

SEQ ID NO: 8086628 - DNA, 22 bp, Homo sapiens
acacaatacagggctcaaaata

SEQ ID NO: 8086629 - DNA, 22 bp, Homo sapiens
acacatattcatatgtacttac

SEQ ID NO: 8086630 - DNA, 22 bp, Homo sapiens
agcagggactgagccagtggga

SEQ ID NO: 8086631 - DNA, 22 bp, Homo sapiens
acagataatttaattaatgcat

SEQ ID NO: 8086632 - DNA, 22 bp, Homo sapiens
acagatactataatgtaaagtg

SEQ ID NO: 8086633 - DNA, 22 bp, Homo sapiens
acagcagaccccagtgccatgg

SEQ ID NO: 8086634 - DNA, 22 bp, Homo sapiens
acagcagagtgtgagatagcca

SEQ ID NO: 8086635 - DNA, 22 bp, Homo sapiens
acagcagatctgtggagcttat

SEQ ID NO: 8086636 - DNA, 22 bp, Homo sapiens
acagcagcaatagcagtgacat

SEQ ID NO: 8086637 - DNA, 21 bp, Homo sapiens
acagcagcaatctgtctttcc

SEQ ID NO: 8086638 - DNA, 22 bp, Homo sapiens
acagcagccagccactgtgagc

SEQ ID NO: 8086639 - DNA, 22 bp, Homo sapiens
acagcagcactattgacatttt

SEQ ID NO: 8086640 - DNA, 22 bp, Homo sapiens
agctgatgccatgtggaacagt

SEQ ID NO: 8086641 - DNA, 22 bp, Homo sapiens
acagcagccttgttggtttcga

SEQ ID NO: 8086642 - DNA, 22 bp, Homo sapiens
acagcagcgtgaagtgtgttat

SEQ ID NO: 8086643 - DNA, 22 bp, Homo sapiens
acagcaggttttaactttgaag

SEQ ID NO: 8086644 - DNA, 21 bp, Homo sapiens
acagcagggctggcatgacag

SEQ ID NO: 8086645 - DNA, 18 bp, Homo sapiens
acagcaggtttcattctt

SEQ ID NO: 8086646 - DNA, 22 bp, Homo sapiens
acagcaggttattgttatggca

SEQ ID NO: 8086647 - DNA, 22 bp, Homo sapiens
acagcaggcccatactggaagg

SEQ ID NO: 8086648 - DNA, 17 bp, Homo sapiens
acagcaggcccggaggg

SEQ ID NO: 8086649 - DNA, 17 bp, Homo sapiens
acagcagggaagtgttg

SEQ ID NO: 8086650 - DNA, 22 bp, Homo sapiens
acagcagggaatatgggaattg

SEQ ID NO: 8086651 - DNA, 19 bp, Homo sapiens
acagcagggatttttggag

SEQ ID NO: 8086652 - DNA, 22 bp, Homo sapiens
acagataattagcataaatgct

SEQ ID NO: 8086653 - DNA, 22 bp, Homo sapiens
agcgggtctgcaagccttccct

SEQ ID NO: 8086654 - DNA, 22 bp, Homo sapiens
agcgggcagaagtggggtctgc

SEQ ID NO: 8086655 - DNA, 23 bp, Homo sapiens
acagaggcttaaatgagtggcag

SEQ ID NO: 8086656 - DNA, 19 bp, Homo sapiens
acagagggcaactgagaaa

SEQ ID NO: 8086657 - DNA, 22 bp, Homo sapiens
acagagggtctgggcacaggac

SEQ ID NO: 8086658 - DNA, 22 bp, Homo sapiens
acagagggtctgggcacaggac

SEQ ID NO: 8086659 - DNA, 22 bp, Homo sapiens
acagagggggccttggagtgca

SEQ ID NO: 8086660 - DNA, 22 bp, Homo sapiens
acagaatattggttactgttgc

SEQ ID NO: 8086661 - DNA, 22 bp, Homo sapiens
acagagctgtacatgtgccatg

SEQ ID NO: 8086662 - DNA, 22 bp, Homo sapiens
acagaggccatgagctgccacc

SEQ ID NO: 8086663 - DNA, 22 bp, Homo sapiens
acagaataactcttgcttgagt

SEQ ID NO: 8086664 - DNA, 22 bp, Homo sapiens
acagaaggcggggacaaggcgg

SEQ ID NO: 8086665 - DNA, 22 bp, Homo sapiens
aaagttgaccgaaagattttga

SEQ ID NO: 8086666 - DNA, 22 bp, Homo sapiens
aaagttgagttttatgtgttac

SEQ ID NO: 8086667 - DNA, 19 bp, Homo sapiens
aaatatcagagagatgata

SEQ ID NO: 8086668 - DNA, 22 bp, Homo sapiens
aaatatagtgacacttatagtc

SEQ ID NO: 8086669 - DNA, 22 bp, Homo sapiens
aaatatagtaaatgcatagttc

SEQ ID NO: 8086670 - DNA, 22 bp, Homo sapiens
aagagtttctgggtcaaggatt

SEQ ID NO: 8086671 - DNA, 22 bp, Homo sapiens
aagagagacaataggtagcatt

SEQ ID NO: 8086672 - DNA, 22 bp, Homo sapiens
aaatcagagtctgattttaagg

SEQ ID NO: 8086673 - DNA, 23 bp, Homo sapiens
aaatgacatatggtttctgaagg

SEQ ID NO: 8086674 - DNA, 22 bp, Homo sapiens
aaatcaaggagggattatattt

SEQ ID NO: 8086675 - DNA, 22 bp, Homo sapiens
aaatcacagggtctctaagtat

SEQ ID NO: 8086676 - DNA, 22 bp, Homo sapiens
aaatgcaagttcatattttgtt

SEQ ID NO: 8086677 - DNA, 22 bp, Homo sapiens
aaatgcacaataaagtaaaggc

SEQ ID NO: 8086678 - DNA, 22 bp, Homo sapiens
aaatgcacagaggccagagagg

SEQ ID NO: 8086679 - DNA, 22 bp, Homo sapiens
aaatgcaaggccatgtgaagga

SEQ ID NO: 8086680 - DNA, 22 bp, Homo sapiens
aaatgcttagaggtgttcaaat

SEQ ID NO: 8086681 - DNA, 22 bp, Homo sapiens
aaaggcacaaattcagcatttt

SEQ ID NO: 8086682 - DNA, 22 bp, Homo sapiens
aaaggcacacactccttgttat

SEQ ID NO: 8086683 - DNA, 22 bp, Homo sapiens
aaaggcacagaagggaaaccaa

SEQ ID NO: 8086684 - DNA, 22 bp, Homo sapiens
aaaggaatattcaaaacagtca

SEQ ID NO: 8086685 - DNA, 23 bp, Homo sapiens
aaaggcacagcattgtctagcag

SEQ ID NO: 8086686 - DNA, 20 bp, Homo sapiens
aaaggcacagcaacagagct

SEQ ID NO: 8086687 - DNA, 22 bp, Homo sapiens
aaaggcactagaagttaccttt

SEQ ID NO: 8086688 - DNA, 22 bp, Homo sapiens
aaaggcactggatagctgggga

SEQ ID NO: 8086689 - DNA, 22 bp, Homo sapiens
aaaggcactgatcttatccagt

SEQ ID NO: 8086690 - DNA, 22 bp, Homo sapiens
aaaggcactgatcttatccagt

SEQ ID NO: 8086691 - DNA, 22 bp, Homo sapiens
aacatgaaacccaaacagaata

SEQ ID NO: 8086692 - DNA, 22 bp, Homo sapiens
aaagcattgtttcaagattaac

SEQ ID NO: 8086693 - DNA, 22 bp, Homo sapiens
aaagcatttcatgtctagaaag

SEQ ID NO: 8086694 - DNA, 22 bp, Homo sapiens
aacttgaagttgcagaaagtac

SEQ ID NO: 8086695 - DNA, 22 bp, Homo sapiens
aaagtctgaaagataagagtga

SEQ ID NO: 8086696 - DNA, 22 bp, Homo sapiens
aaagtccagagggcacactgaa

SEQ ID NO: 8086697 - DNA, 22 bp, Homo sapiens
aaagtctatcagttactaatca

SEQ ID NO: 8086698 - DNA, 22 bp, Homo sapiens
aacatgatttagtataatgcag

SEQ ID NO: 8086699 - DNA, 22 bp, Homo sapiens
aacatgatggggaagaacaaga

SEQ ID NO: 8086700 - DNA, 22 bp, Homo sapiens
aaaggacatgtcaatatcaggc

SEQ ID NO: 8086701 - DNA, 22 bp, Homo sapiens
aaactgttgtggtttatcatta

SEQ ID NO: 8086702 - DNA, 22 bp, Homo sapiens
aaatacacgtacatgtgtaaaa

SEQ ID NO: 8086703 - DNA, 22 bp, Homo sapiens
aaatacagagttgcttaaaagc

SEQ ID NO: 8086704 - DNA, 21 bp, Homo sapiens
aaatacagaaacttgttttca

SEQ ID NO: 8086705 - DNA, 22 bp, Homo sapiens
aaagacagatggcaaggatgat

SEQ ID NO: 8086706 - DNA, 17 bp, Homo sapiens
aaacttcattctcagga

SEQ ID NO: 8086707 - DNA, 22 bp, Homo sapiens
aaaacagtttaggcatcacagt

SEQ ID NO: 8086708 - DNA, 22 bp, Homo sapiens
aaaacagtttaggcatcacagt

SEQ ID NO: 8086709 - DNA, 22 bp, Homo sapiens
aaaacagttataaacagagtca

SEQ ID NO: 8086710 - DNA, 22 bp, Homo sapiens
aaaacagttataaacagagtca

SEQ ID NO: 8086711 - DNA, 22 bp, Homo sapiens
aaaagcaagaggctggattaaa

SEQ ID NO: 8086712 - DNA, 22 bp, Homo sapiens
aaaaatgttatctactgtccga

SEQ ID NO: 8086713 - DNA, 18 bp, Homo sapiens
aaaataacaaagttggct

SEQ ID NO: 8086714 - DNA, 22 bp, Homo sapiens
aaaataacttctactatttgca

SEQ ID NO: 8086715 - DNA, 22 bp, Homo sapiens
aaaataacttctactatttgca

SEQ ID NO: 8086716 - DNA, 22 bp, Homo sapiens
aaaatactgtggagtgttgaaa

SEQ ID NO: 8086717 - DNA, 18 bp, Homo sapiens
aaaatgcaggcgacatgg

SEQ ID NO: 8086718 - DNA, 22 bp, Homo sapiens
aaaatgcatgagaatgtgctcg

SEQ ID NO: 8086719 - DNA, 22 bp, Homo sapiens
aaaatgatgctgtaatttggca

SEQ ID NO: 8086720 - DNA, 22 bp, Homo sapiens
aaaatgcaaacctacctacata

SEQ ID NO: 8086721 - DNA, 22 bp, Homo sapiens
aaggagaagggtaatcaacaca

SEQ ID NO: 8086722 - DNA, 22 bp, Homo sapiens
aaatggaatgtgtttataattc

SEQ ID NO: 8086723 - DNA, 22 bp, Homo sapiens
aaatggaagaagtgcaatactg

SEQ ID NO: 8086724 - DNA, 22 bp, Homo sapiens
aaatggaactgttgtgcatttg

SEQ ID NO: 8086725 - DNA, 22 bp, Homo sapiens
aaatggaagctatttatgattc

SEQ ID NO: 8086726 - DNA, 22 bp, Homo sapiens
aaggcactgaaaaattgtgtgt

SEQ ID NO: 8086727 - DNA, 22 bp, Homo sapiens
aaggcactgactgtgcagggga

SEQ ID NO: 8086728 - DNA, 22 bp, Homo sapiens
aaggcactgagccagccgtctc

SEQ ID NO: 8086729 - DNA, 22 bp, Homo sapiens
aaggcactgaacttaaattctg

SEQ ID NO: 8086730 - DNA, 22 bp, Homo sapiens
aaggcactagcagaattagtga

SEQ ID NO: 8086731 - DNA, 20 bp, Homo sapiens
aaggcactatgtctgctagc

SEQ ID NO: 8086732 - DNA, 22 bp, Homo sapiens
aaggcactcagccttgggacag

SEQ ID NO: 8086733 - DNA, 22 bp, Homo sapiens
aaggcactcattcaaggagata

SEQ ID NO: 8086734 - DNA, 22 bp, Homo sapiens
aaggcactagcaagctgcctgg

SEQ ID NO: 8086735 - DNA, 22 bp, Homo sapiens
aaggcactgctttgctgcgccc

SEQ ID NO: 8086736 - DNA, 23 bp, Homo sapiens
aaggccagagagaggctagtgtc

SEQ ID NO: 8086737 - DNA, 23 bp, Homo sapiens
aaggtgttctgtatttaactcag

SEQ ID NO: 8086738 - DNA, 22 bp, Homo sapiens
aacagtgtgtacacatcatagg

SEQ ID NO: 8086739 - DNA, 22 bp, Homo sapiens
aatatctgtctctaatgcatat

SEQ ID NO: 8086740 - DNA, 22 bp, Homo sapiens
aatatctgtggccatacaattt

SEQ ID NO: 8086741 - DNA, 22 bp, Homo sapiens
aatatccacactgtgtccctgc

SEQ ID NO: 8086742 - DNA, 22 bp, Homo sapiens
aatataattttattcctagagt

SEQ ID NO: 8086743 - DNA, 22 bp, Homo sapiens
aatacatatggaattccatgtt

SEQ ID NO: 8086744 - DNA, 19 bp, Homo sapiens
aatacagtgttatagaatt

SEQ ID NO: 8086745 - DNA, 22 bp, Homo sapiens
aatacagtaggtaatagttcat

SEQ ID NO: 8086746 - DNA, 22 bp, Homo sapiens
aatacagtaattttgatgagtt

SEQ ID NO: 8086747 - DNA, 22 bp, Homo sapiens
aataagaacttgtctctggcag

SEQ ID NO: 8086748 - DNA, 22 bp, Homo sapiens
aagttacagtcagaggttaaca

SEQ ID NO: 8086749 - DNA, 22 bp, Homo sapiens
aagttacacattttcattgtaa

SEQ ID NO: 8086750 - DNA, 22 bp, Homo sapiens
aataatgaacatttaaaacctg

SEQ ID NO: 8086751 - DNA, 22 bp, Homo sapiens
aatctctctggggttcagtcct

SEQ ID NO: 8086752 - DNA, 22 bp, Homo sapiens
aatctgaatatttatgtgtatt

SEQ ID NO: 8086753 - DNA, 22 bp, Homo sapiens
aatgaaatgtagcttatccata

SEQ ID NO: 8086754 - DNA, 22 bp, Homo sapiens
aatgcagtgagccattaaatgg

SEQ ID NO: 8086755 - DNA, 22 bp, Homo sapiens
acacttcatttacattataggc

SEQ ID NO: 8086756 - DNA, 20 bp, Homo sapiens
acacttcatttgcagcagct

SEQ ID NO: 8086757 - DNA, 22 bp, Homo sapiens
acacttcatgcattcttcactc

SEQ ID NO: 8086758 - DNA, 21 bp, Homo sapiens
acacttcagtttttaaaggga

SEQ ID NO: 8086759 - DNA, 22 bp, Homo sapiens
acacttcatagcaaggttggag

SEQ ID NO: 8086760 - DNA, 22 bp, Homo sapiens
acacttcaggactctggggcaa

SEQ ID NO: 8086761 - DNA, 22 bp, Homo sapiens
acacttcagctccacaaacatt

SEQ ID NO: 8086762 - DNA, 22 bp, Homo sapiens
aagatacacgttgtattgaata

SEQ ID NO: 8086763 - DNA, 22 bp, Homo sapiens
aagatacacgttgtattgaata

SEQ ID NO: 8086764 - DNA, 22 bp, Homo sapiens
aagatacatatttgttctagtg

SEQ ID NO: 8086765 - DNA, 22 bp, Homo sapiens
acagagcaactttatttcatgg

SEQ ID NO: 8086766 - DNA, 22 bp, Homo sapiens
acagactggcctgtctcgcacc

SEQ ID NO: 8086767 - DNA, 23 bp, Homo sapiens
acagacaacactgatgagagaaa

SEQ ID NO: 8086768 - DNA, 23 bp, Homo sapiens
acagaaatcatttgtaaggtacc

SEQ ID NO: 8086769 - DNA, 22 bp, Homo sapiens
acagacattttaagacacttta

SEQ ID NO: 8086770 - DNA, 22 bp, Homo sapiens
acagacattttaagacacttta

SEQ ID NO: 8086771 - DNA, 22 bp, Homo sapiens
aagcaggaaggagcccagggca

SEQ ID NO: 8086772 - DNA, 22 bp, Homo sapiens
acagcaggaagctggagggaaa

SEQ ID NO: 8086773 - DNA, 22 bp, Homo sapiens
acagcagggggagctgttggac

SEQ ID NO: 8086774 - DNA, 22 bp, Homo sapiens
acagcaggtagctttgtgcctc

SEQ ID NO: 8086775 - DNA, 22 bp, Homo sapiens
acagcaggggtggaataaacgt

SEQ ID NO: 8086776 - DNA, 22 bp, Homo sapiens
acagcagggtcacattccctct

SEQ ID NO: 8086777 - DNA, 22 bp, Homo sapiens
acagccaggcccagcacgcagg

SEQ ID NO: 8086778 - DNA, 22 bp, Homo sapiens
aagcccagcatccctgcaccag

SEQ ID NO: 8086779 - DNA, 22 bp, Homo sapiens
acagcaggttacagtggcacag

SEQ ID NO: 8086780 - DNA, 19 bp, Homo sapiens
acagcaggtgtggggataa

SEQ ID NO: 8086781 - DNA, 22 bp, Homo sapiens
acagccaggacttggccctctt

SEQ ID NO: 8086782 - DNA, 22 bp, Homo sapiens
acagccaggagccatgggcagg

SEQ ID NO: 8086783 - DNA, 22 bp, Homo sapiens
aagcccagtttcacactgagac

SEQ ID NO: 8086784 - DNA, 19 bp, Homo sapiens
aagcccagtgtatgctctt

SEQ ID NO: 8086785 - DNA, 22 bp, Homo sapiens
aagcccagtaccttcagtgagg

SEQ ID NO: 8086786 - DNA, 22 bp, Homo sapiens
aagcccagggaatggtcgggag

SEQ ID NO: 8086787 - DNA, 22 bp, Homo sapiens
aagcccaggtaagtggctcatg

SEQ ID NO: 8086788 - DNA, 22 bp, Homo sapiens
aagcccagctgaaagcattttt

SEQ ID NO: 8086789 - DNA, 22 bp, Homo sapiens
aagcccagctctgcctgctctg

SEQ ID NO: 8086790 - DNA, 22 bp, Homo sapiens
acaatattgtacccagaagttt

SEQ ID NO: 8086791 - DNA, 22 bp, Homo sapiens
acaatcacacatgcaattatac

SEQ ID NO: 8086792 - DNA, 22 bp, Homo sapiens
acaatgtgtttttatacatttg

SEQ ID NO: 8086793 - DNA, 22 bp, Homo sapiens
acacagagcaaatcatgacaga

SEQ ID NO: 8086794 - DNA, 22 bp, Homo sapiens
acacagagcttctcaactggga

SEQ ID NO: 8086795 - DNA, 22 bp, Homo sapiens
acacagccccacggtgagcaaa

SEQ ID NO: 8086796 - DNA, 22 bp, Homo sapiens
aagatacaaatgtcaatattgg

SEQ ID NO: 8086797 - DNA, 22 bp, Homo sapiens
aagatacacggtcaactctcaa

SEQ ID NO: 8086798 - DNA, 22 bp, Homo sapiens
aagatacacggtcaactctcaa

SEQ ID NO: 8086799 - DNA, 22 bp, Homo sapiens
aagaagaattattccctaatca

SEQ ID NO: 8086800 - DNA, 22 bp, Homo sapiens
aagaacattttgtagaatgaca

SEQ ID NO: 8086801 - DNA, 22 bp, Homo sapiens
aagaacattgatattgtctatg

SEQ ID NO: 8086802 - DNA, 22 bp, Homo sapiens
aagaacattcgaactattttct

SEQ ID NO: 8086803 - DNA, 22 bp, Homo sapiens
acaaatatttactgaatccact

SEQ ID NO: 8086804 - DNA, 22 bp, Homo sapiens
acaaatgaatcatacataatgt

SEQ ID NO: 8086805 - DNA, 22 bp, Homo sapiens
acaaatgaatcatacataatgt

SEQ ID NO: 8086806 - DNA, 22 bp, Homo sapiens
acaaatgaacctgaaatctcag

SEQ ID NO: 8086807 - DNA, 22 bp, Homo sapiens
aagaatcattgtaaagttctgt

SEQ ID NO: 8086808 - DNA, 22 bp, Homo sapiens
acaaaatagagttctcccctgg

SEQ ID NO: 8086809 - DNA, 22 bp, Homo sapiens
acaaaagtagttgcggtttttg

SEQ ID NO: 8086810 - DNA, 22 bp, Homo sapiens
tcaatacagaaaggatattttg

SEQ ID NO: 8086811 - DNA, 22 bp, Homo sapiens
tcaagtcctgctgtggaccaca

SEQ ID NO: 8086812 - DNA, 22 bp, Homo sapiens
tcaagtcccagctcttcactta

SEQ ID NO: 8086813 - DNA, 22 bp, Homo sapiens
tatttcttgagactcgtcttcc

SEQ ID NO: 8086814 - DNA, 22 bp, Homo sapiens
tatttcttcgggattcaagcta

SEQ ID NO: 8086815 - DNA, 22 bp, Homo sapiens
tatttcttgagtggtcagtttc

SEQ ID NO: 8086816 - DNA, 22 bp, Homo sapiens
tatttctgtttatttgtacatc

SEQ ID NO: 8086817 - DNA, 22 bp, Homo sapiens
tcaagagaaggggaaatagact

SEQ ID NO: 8086818 - DNA, 22 bp, Homo sapiens
tcacaaatagctatattaagga

SEQ ID NO: 8086819 - DNA, 22 bp, Homo sapiens
tcacagggtgtacatcacctat

SEQ ID NO: 8086820 - DNA, 22 bp, Homo sapiens
tcacccaggctggactgcagtg

SEQ ID NO: 8086821 - DNA, 19 bp, Homo sapiens
tcacccaggctgctggctc

SEQ ID NO: 8086822 - DNA, 22 bp, Homo sapiens
tcacccaggatattgaagtcag

SEQ ID NO: 8086823 - DNA, 22 bp, Homo sapiens
tcacccagcgggcgcacactcg

SEQ ID NO: 8086824 - DNA, 22 bp, Homo sapiens
tcacccaggctggagtgcagtg

SEQ ID NO: 8086825 - DNA, 22 bp, Homo sapiens
tcacccaggctggtgcgcagtg

SEQ ID NO: 8086826 - DNA, 22 bp, Homo sapiens
tcacccaggctggtatgcagtg

SEQ ID NO: 8086827 - DNA, 22 bp, Homo sapiens
tcacccaggctggagtgtagtg

SEQ ID NO: 8086828 - DNA, 22 bp, Homo sapiens
tcacattttctactactgtacg

SEQ ID NO: 8086829 - DNA, 22 bp, Homo sapiens
tcactgaggcattcatgctctg

SEQ ID NO: 8086830 - DNA, 22 bp, Homo sapiens
tcactgtgctctctagataggc

SEQ ID NO: 8086831 - DNA, 22 bp, Homo sapiens
tcactgtgctctctagataggc

SEQ ID NO: 8086832 - DNA, 23 bp, Homo sapiens
tcactgtgcccattgaggtagag

SEQ ID NO: 8086833 - DNA, 22 bp, Homo sapiens
tcactgtggtatatatgtatca

SEQ ID NO: 8086834 - DNA, 22 bp, Homo sapiens
tcactgtggtatatatgtatca

SEQ ID NO: 8086835 - DNA, 22 bp, Homo sapiens
tcactgtgtcctttctgcgtag

SEQ ID NO: 8086836 - DNA, 18 bp, Homo sapiens
tcactgtgtgtcttgggt

SEQ ID NO: 8086837 - DNA, 22 bp, Homo sapiens
tcactttacagatgggaaaact

SEQ ID NO: 8086838 - DNA, 22 bp, Homo sapiens
tcactttacagctaaggttgtt

SEQ ID NO: 8086839 - DNA, 22 bp, Homo sapiens
tcactttactttgttaatctgg

SEQ ID NO: 8086840 - DNA, 22 bp, Homo sapiens
tcagaaaagaccacattattct

SEQ ID NO: 8086841 - DNA, 22 bp, Homo sapiens
tcagaaaagagaaaatcttata

SEQ ID NO: 8086842 - DNA, 22 bp, Homo sapiens
tcagagcccctccgctgtccca

SEQ ID NO: 8086843 - DNA, 22 bp, Homo sapiens
tcagagccctgctcctccccaa

SEQ ID NO: 8086844 - DNA, 22 bp, Homo sapiens
tcagagcacttggctcatggca

SEQ ID NO: 8086845 - DNA, 22 bp, Homo sapiens
tcagagcaccacacagttccct

SEQ ID NO: 8086846 - DNA, 22 bp, Homo sapiens
tcaggccagcaccatccctatc

SEQ ID NO: 8086847 - DNA, 22 bp, Homo sapiens
tcaggagtaaagaagacttgac

SEQ ID NO: 8086848 - DNA, 22 bp, Homo sapiens
tcagcaggcaccggaagtgttt

SEQ ID NO: 8086849 - DNA, 22 bp, Homo sapiens
tcagcaggcacggacaggctgc

SEQ ID NO: 8086850 - DNA, 21 bp, Homo sapiens
tcagcaggcaccagaaggctg

SEQ ID NO: 8086851 - DNA, 22 bp, Homo sapiens
tcagcaggcagaaatctgcaga

SEQ ID NO: 8086852 - DNA, 21 bp, Homo sapiens
tcagcagcttttgcagtccct

SEQ ID NO: 8086853 - DNA, 22 bp, Homo sapiens
tcagcaggcacaccaaaaactg

SEQ ID NO: 8086854 - DNA, 22 bp, Homo sapiens
tcagcagaacaaggaagcttaa

SEQ ID NO: 8086855 - DNA, 22 bp, Homo sapiens
tcagctacagcatctctgcttt

SEQ ID NO: 8086856 - DNA, 22 bp, Homo sapiens
tcataggagtagcagtgagagg

SEQ ID NO: 8086857 - DNA, 22 bp, Homo sapiens
tcattatcctagtatcttgaat

SEQ ID NO: 8086858 - DNA, 22 bp, Homo sapiens
tcatggctgaaacagtaacaca

SEQ ID NO: 8086859 - DNA, 22 bp, Homo sapiens
tcattattttggactggagtgt

SEQ ID NO: 8086860 - DNA, 22 bp, Homo sapiens
tcagtgtctagggacagtaatc

SEQ ID NO: 8086861 - DNA, 22 bp, Homo sapiens
tcagtgtccataaataaagttt

SEQ ID NO: 8086862 - DNA, 22 bp, Homo sapiens
tcagtgtcatatcaagaagatg

SEQ ID NO: 8086863 - DNA, 22 bp, Homo sapiens
tcagtctttgcttatgacaata

SEQ ID NO: 8086864 - DNA, 22 bp, Homo sapiens
tcagtgcaaaaaatgggctaga

SEQ ID NO: 8086865 - DNA, 22 bp, Homo sapiens
tcagggacatttagacactgat

SEQ ID NO: 8086866 - DNA, 22 bp, Homo sapiens
tcagtcttccctccagtgcaac

SEQ ID NO: 8086867 - DNA, 22 bp, Homo sapiens
tccagagcctgcgcactggctg

SEQ ID NO: 8086868 - DNA, 22 bp, Homo sapiens
tccagagcctgcgcactggctg

SEQ ID NO: 8086869 - DNA, 22 bp, Homo sapiens
tccagagcctatatgttcaact

SEQ ID NO: 8086870 - DNA, 18 bp, Homo sapiens
tccagagctactgtggtg

SEQ ID NO: 8086871 - DNA, 22 bp, Homo sapiens
tccagagctacttgctcaactt

SEQ ID NO: 8086872 - DNA, 22 bp, Homo sapiens
tccagagccccagtctagtggg

SEQ ID NO: 8086873 - DNA, 22 bp, Homo sapiens
tccagaggcaaaaaggtatgga

SEQ ID NO: 8086874 - DNA, 22 bp, Homo sapiens
tccagagctgtcctactgtgag

SEQ ID NO: 8086875 - DNA, 22 bp, Homo sapiens
tccagagctgggtctgtgctca

SEQ ID NO: 8086876 - DNA, 22 bp, Homo sapiens
tccagagggcgatggctggggg

SEQ ID NO: 8086877 - DNA, 22 bp, Homo sapiens
tccagcctttctactcactgag

SEQ ID NO: 8086878 - DNA, 22 bp, Homo sapiens
tccaggaaagcactgggctggg

SEQ ID NO: 8086879 - DNA, 22 bp, Homo sapiens
tccaggaaagtgggatgtgtgt

SEQ ID NO: 8086880 - DNA, 22 bp, Homo sapiens
tcccaaggtgctcggcaacagg

SEQ ID NO: 8086881 - DNA, 22 bp, Homo sapiens
tccatgcagaggagctggtggc

SEQ ID NO: 8086882 - DNA, 21 bp, Homo sapiens
tcccaagctgctggctcagct

SEQ ID NO: 8086883 - DNA, 22 bp, Homo sapiens
tcccaagcttagggctctcagt

SEQ ID NO: 8086884 - DNA, 22 bp, Homo sapiens
tcccacagatgctgtccagagt

SEQ ID NO: 8086885 - DNA, 22 bp, Homo sapiens
tccatgcagagaactgaagtac

SEQ ID NO: 8086886 - DNA, 22 bp, Homo sapiens
tccatgcagagaactgaagtac

SEQ ID NO: 8086887 - DNA, 22 bp, Homo sapiens
tccatgagtttgaggaaaagag

SEQ ID NO: 8086888 - DNA, 20 bp, Homo sapiens
tccatgagttagagactata

SEQ ID NO: 8086889 - DNA, 22 bp, Homo sapiens
tccatgagggacactggatgct

SEQ ID NO: 8086890 - DNA, 22 bp, Homo sapiens
tccatgagaggtaactttacaa

SEQ ID NO: 8086891 - DNA, 17 bp, Homo sapiens
tccatgagacatgaaga

SEQ ID NO: 8086892 - DNA, 22 bp, Homo sapiens
tccatgagacagatactgtaag

SEQ ID NO: 8086893 - DNA, 22 bp, Homo sapiens
tccatgagaacccttggagata

SEQ ID NO: 8086894 - DNA, 22 bp, Homo sapiens
tccatgaggcagggaggctggc

SEQ ID NO: 8086895 - DNA, 22 bp, Homo sapiens
tccatgaggaccaaattcgtag

SEQ ID NO: 8086896 - DNA, 23 bp, Homo sapiens
tccatgagatgtgggcttctagt

SEQ ID NO: 8086897 - DNA, 22 bp, Homo sapiens
tccatgagctagctttccaaag

SEQ ID NO: 8086898 - DNA, 22 bp, Homo sapiens
tccatgagctagggattcatca

SEQ ID NO: 8086899 - DNA, 20 bp, Homo sapiens
tccagggccctggctcctct

SEQ ID NO: 8086900 - DNA, 22 bp, Homo sapiens
tccagggccacagaggatgcta

SEQ ID NO: 8086901 - DNA, 22 bp, Homo sapiens
tccagggcagggtgcgcatggg

SEQ ID NO: 8086902 - DNA, 22 bp, Homo sapiens
tccagggcgtgtgtgaaggaaa

SEQ ID NO: 8086903 - DNA, 22 bp, Homo sapiens
tccagggcctgaggttgaagtg

SEQ ID NO: 8086904 - DNA, 20 bp, Homo sapiens
tccagggctagggagctcat

SEQ ID NO: 8086905 - DNA, 22 bp, Homo sapiens
tccagttgcctgtctctgatta

SEQ ID NO: 8086906 - DNA, 22 bp, Homo sapiens
tccaggagtttgagactgcagt

SEQ ID NO: 8086907 - DNA, 22 bp, Homo sapiens
tccaggagtcctgggagtgatt

SEQ ID NO: 8086908 - DNA, 22 bp, Homo sapiens
tccaggaggttgagactgcagt

SEQ ID NO: 8086909 - DNA, 20 bp, Homo sapiens
tccaggaggttagtgtggct

SEQ ID NO: 8086910 - DNA, 22 bp, Homo sapiens
tccaggagggattgggctgtgg

SEQ ID NO: 8086911 - DNA, 22 bp, Homo sapiens
tccaggccacgacctcctggat

SEQ ID NO: 8086912 - DNA, 23 bp, Homo sapiens
tccaggctgaaggagcagatttt

SEQ ID NO: 8086913 - DNA, 19 bp, Homo sapiens
tccaggctgagagtcagct

SEQ ID NO: 8086914 - DNA, 22 bp, Homo sapiens
tccaggctctaggctgctctcc

SEQ ID NO: 8086915 - DNA, 22 bp, Homo sapiens
tccccaggggcctgggcacagt

SEQ ID NO: 8086916 - DNA, 22 bp, Homo sapiens
tccccacatctctgcatcaggc

SEQ ID NO: 8086917 - DNA, 22 bp, Homo sapiens
tcccagggactgggctaggctt

SEQ ID NO: 8086918 - DNA, 22 bp, Homo sapiens
tcccagggatcctccgggtcgc

SEQ ID NO: 8086919 - DNA, 22 bp, Homo sapiens
tcccacaggagcctgagtccca

SEQ ID NO: 8086920 - DNA, 22 bp, Homo sapiens
tcccagggattaggacatggat

SEQ ID NO: 8086921 - DNA, 22 bp, Homo sapiens
tcccagggttacagccagggca

SEQ ID NO: 8086922 - DNA, 22 bp, Homo sapiens
tcccaggttccaccatccaggg

SEQ ID NO: 8086923 - DNA, 22 bp, Homo sapiens
tcccaggttccaccatccaggg

SEQ ID NO: 8086924 - DNA, 22 bp, Homo sapiens
taacattaaaagagataattga

SEQ ID NO: 8086925 - DNA, 22 bp, Homo sapiens
taaagtgctggatttgagtaaa

SEQ ID NO: 8086926 - DNA, 22 bp, Homo sapiens
taaattatggctggcagagcag

SEQ ID NO: 8086927 - DNA, 22 bp, Homo sapiens
taaattatgtcacatgactctg

SEQ ID NO: 8086928 - DNA, 22 bp, Homo sapiens
taaattatgttccatgtccttt

SEQ ID NO: 8086929 - DNA, 22 bp, Homo sapiens
taaaatgtttgcaagagaccag

SEQ ID NO: 8086930 - DNA, 22 bp, Homo sapiens
taaaatgatctctcatgttctt

SEQ ID NO: 8086931 - DNA, 22 bp, Homo sapiens
taaaatgtagcttctaggctgg

SEQ ID NO: 8086932 - DNA, 19 bp, Homo sapiens
taaaatgtctgtggtcagt

SEQ ID NO: 8086933 - DNA, 22 bp, Homo sapiens
taaaatgtgtttctgtatggtt

SEQ ID NO: 8086934 - DNA, 22 bp, Homo sapiens
gttcagtgtttttattgacagg

SEQ ID NO: 8086935 - DNA, 22 bp, Homo sapiens
gttcagtgtttgatttctgctg

SEQ ID NO: 8086936 - DNA, 22 bp, Homo sapiens
gttcagtgtttacatgattgtt

SEQ ID NO: 8086937 - DNA, 22 bp, Homo sapiens
gttcagtgccagttctaagact

SEQ ID NO: 8086938 - DNA, 22 bp, Homo sapiens
gttcagtggtgtatccccagtg

SEQ ID NO: 8086939 - DNA, 22 bp, Homo sapiens
gttcagtggggccttgggggac

SEQ ID NO: 8086940 - DNA, 22 bp, Homo sapiens
gttcagtgtctctctattttat

SEQ ID NO: 8086941 - DNA, 22 bp, Homo sapiens
gttcagtgattctcggtgttca

SEQ ID NO: 8086942 - DNA, 22 bp, Homo sapiens
gttggtccagcattgcctcact

SEQ ID NO: 8086943 - DNA, 22 bp, Homo sapiens
gttggtgatgccacacatattt

SEQ ID NO: 8086944 - DNA, 22 bp, Homo sapiens
gttggtcctttgagcaagatcc

SEQ ID NO: 8086945 - DNA, 22 bp, Homo sapiens
gttggtccaggagagtcacttc

SEQ ID NO: 8086946 - DNA, 22 bp, Homo sapiens
gttggtgagtttctgatcacaa

SEQ ID NO: 8086947 - DNA, 22 bp, Homo sapiens
taactgcaggtcatcctcgcat

SEQ ID NO: 8086948 - DNA, 22 bp, Homo sapiens
taactgcaacctccatcttgtg

SEQ ID NO: 8086949 - DNA, 22 bp, Homo sapiens
taactgcagaggaaatgcatct

SEQ ID NO: 8086950 - DNA, 22 bp, Homo sapiens
taactgcactgacagtgagtga

SEQ ID NO: 8086951 - DNA, 22 bp, Homo sapiens
taactgcaccatcaaattagag

SEQ ID NO: 8086952 - DNA, 22 bp, Homo sapiens
taactgcatttttggttggagc

SEQ ID NO: 8086953 - DNA, 22 bp, Homo sapiens
taatacatcattcatctaagga

SEQ ID NO: 8086954 - DNA, 22 bp, Homo sapiens
taattagagtcacaagtaacca

SEQ ID NO: 8086955 - DNA, 22 bp, Homo sapiens
taatgtttttctcaacattgct

SEQ ID NO: 8086956 - DNA, 22 bp, Homo sapiens
taattagagtttggtaaacaat

SEQ ID NO: 8086957 - DNA, 22 bp, Homo sapiens
taatactttgaatgagagctaa

SEQ ID NO: 8086958 - DNA, 22 bp, Homo sapiens
taatgtttagaagcagacagct

SEQ ID NO: 8086959 - DNA, 22 bp, Homo sapiens
tacaaactgttattattattgt

SEQ ID NO: 8086960 - DNA, 22 bp, Homo sapiens
tacaaagtagaaattcagtaaa

SEQ ID NO: 8086961 - DNA, 22 bp, Homo sapiens
tacaaagtaatgtataatatcg

SEQ ID NO: 8086962 - DNA, 22 bp, Homo sapiens
tacaggcactgaaatgcttatt

SEQ ID NO: 8086963 - DNA, 22 bp, Homo sapiens
tacagtaagatgaaatagcaat

SEQ ID NO: 8086964 - DNA, 22 bp, Homo sapiens
tacaggcatgaatgaaatctgt

SEQ ID NO: 8086965 - DNA, 22 bp, Homo sapiens
tacaggcatgtagcatggtgat

SEQ ID NO: 8086966 - DNA, 22 bp, Homo sapiens
tacagtaatctggacatgattt

SEQ ID NO: 8086967 - DNA, 22 bp, Homo sapiens
tacatgaaataggattctggag

SEQ ID NO: 8086968 - DNA, 22 bp, Homo sapiens
tacatttgctttgattttcagc

SEQ ID NO: 8086969 - DNA, 22 bp, Homo sapiens
tacatttgatttccactcatct

SEQ ID NO: 8086970 - DNA, 22 bp, Homo sapiens
tacatttgattctctcctccaa

SEQ ID NO: 8086971 - DNA, 22 bp, Homo sapiens
tacatttccttgactcctcaac

SEQ ID NO: 8086972 - DNA, 22 bp, Homo sapiens
tacacttttctggttactcttg

SEQ ID NO: 8086973 - DNA, 22 bp, Homo sapiens
tacactgaagtgtcttggtata

SEQ ID NO: 8086974 - DNA, 22 bp, Homo sapiens
tacagaaatcacatcgctttga

SEQ ID NO: 8086975 - DNA, 22 bp, Homo sapiens
tagctttaccatagaagagtat

SEQ ID NO: 8086976 - DNA, 22 bp, Homo sapiens
tagctttagaaatattctcaga

SEQ ID NO: 8086977 - DNA, 22 bp, Homo sapiens
tagctttaatgagttggtaaga

SEQ ID NO: 8086978 - DNA, 22 bp, Homo sapiens
tagctttacaaagtgctgcacc

SEQ ID NO: 8086979 - DNA, 22 bp, Homo sapiens
tagctttagtgaaaaatatcag

SEQ ID NO: 8086980 - DNA, 22 bp, Homo sapiens
tagctttaggcacgtttgaatt

SEQ ID NO: 8086981 - DNA, 22 bp, Homo sapiens
tagctttaggatggttctcttg

SEQ ID NO: 8086982 - DNA, 22 bp, Homo sapiens
taggacagtagctggtgcacag

SEQ ID NO: 8086983 - DNA, 22 bp, Homo sapiens
taggcactagacatggttacca

SEQ ID NO: 8086984 - DNA, 22 bp, Homo sapiens
tagggaggctacttcttgtagg

SEQ ID NO: 8086985 - DNA, 22 bp, Homo sapiens
tagggatgaagttgctatttac

SEQ ID NO: 8086986 - DNA, 22 bp, Homo sapiens
tagggatgaagatggtatttct

SEQ ID NO: 8086987 - DNA, 22 bp, Homo sapiens
tagggatgactatgattcccac

SEQ ID NO: 8086988 - DNA, 22 bp, Homo sapiens
tagggatgacgaaaggacagag

SEQ ID NO: 8086989 - DNA, 22 bp, Homo sapiens
tagggatgagcaactggtagtg

SEQ ID NO: 8086990 - DNA, 22 bp, Homo sapiens
tagggatgaggatagatttttc

SEQ ID NO: 8086991 - DNA, 22 bp, Homo sapiens
tagggatgagccagtgggtagt

SEQ ID NO: 8086992 - DNA, 22 bp, Homo sapiens
tagggatgtggtgagaactgag

SEQ ID NO: 8086993 - DNA, 22 bp, Homo sapiens
tagggcaatatttcccagaaaa

SEQ ID NO: 8086994 - DNA, 22 bp, Homo sapiens
tagggatgtaaacatagtaatt

SEQ ID NO: 8086995 - DNA, 22 bp, Homo sapiens
tagggatgtcctgagacttggc

SEQ ID NO: 8086996 - DNA, 22 bp, Homo sapiens
tagggatggaaacccgttttct

SEQ ID NO: 8086997 - DNA, 22 bp, Homo sapiens
tagggatgcttagtaggaccca

SEQ ID NO: 8086998 - DNA, 22 bp, Homo sapiens
tagggatgatgtctaaaatcat

SEQ ID NO: 8086999 - DNA, 20 bp, Homo sapiens
tagggatgccagtacttctc

SEQ ID NO: 8087000 - DNA, 22 bp, Homo sapiens
tagggatgatggagcctatgta

SEQ ID NO: 8087001 - DNA, 22 bp, Homo sapiens
tagggatggatgatgcctggca

SEQ ID NO: 8087002 - DNA, 22 bp, Homo sapiens
tagggatggaaactaggaatct

SEQ ID NO: 8087003 - DNA, 22 bp, Homo sapiens
tagggatggcagcatgtagctt

SEQ ID NO: 8087004 - DNA, 22 bp, Homo sapiens
tagggatgggagattctcaaac

SEQ ID NO: 8087005 - DNA, 21 bp, Homo sapiens
tagctttaatattcccacatt

SEQ ID NO: 8087006 - DNA, 22 bp, Homo sapiens
tagccccagctactcggaagct

SEQ ID NO: 8087007 - DNA, 22 bp, Homo sapiens
tagcccctgcctttgaacctgg

SEQ ID NO: 8087008 - DNA, 22 bp, Homo sapiens
tagcccagcatgagcagagctg

SEQ ID NO: 8087009 - DNA, 22 bp, Homo sapiens
tagcccaggctggagggcagtg

SEQ ID NO: 8087010 - DNA, 22 bp, Homo sapiens
tagcccaggagaattgtctttc

SEQ ID NO: 8087011 - DNA, 22 bp, Homo sapiens
tagcccagcttggcctatttct

SEQ ID NO: 8087012 - DNA, 22 bp, Homo sapiens
tagcccagctcaaatgaccggt

SEQ ID NO: 8087013 - DNA, 22 bp, Homo sapiens
tagcccagctaactcggtgagc

SEQ ID NO: 8087014 - DNA, 22 bp, Homo sapiens
tagcccaggctggagtgcaggg

SEQ ID NO: 8087015 - DNA, 22 bp, Homo sapiens
tagcccaggctgtagtgcagtg

SEQ ID NO: 8087016 - DNA, 22 bp, Homo sapiens
tagaggtataccaaaaaggcat

SEQ ID NO: 8087017 - DNA, 22 bp, Homo sapiens
tagaggttggccttagaaagat

SEQ ID NO: 8087018 - DNA, 22 bp, Homo sapiens
tagcagcccagtttctggccaa

SEQ ID NO: 8087019 - DNA, 22 bp, Homo sapiens
tagaaacattcagttgcagtcc

SEQ ID NO: 8087020 - DNA, 22 bp, Homo sapiens
tagaaacattcagttgcagtcc

SEQ ID NO: 8087021 - DNA, 22 bp, Homo sapiens
tagaaacatcagctaaccaaaa

SEQ ID NO: 8087022 - DNA, 22 bp, Homo sapiens
tagaaacatgagagaaactctt

SEQ ID NO: 8087023 - DNA, 22 bp, Homo sapiens
tagaaacatgttctgttctgtt

SEQ ID NO: 8087024 - DNA, 22 bp, Homo sapiens
tagaaacagaaaactgtaatag

SEQ ID NO: 8087025 - DNA, 22 bp, Homo sapiens
tagaaacacagatctggtgtca

SEQ ID NO: 8087026 - DNA, 22 bp, Homo sapiens
tagaaacagaatatgagtgaga

SEQ ID NO: 8087027 - DNA, 22 bp, Homo sapiens
tagaaacagatgtttttgaaga

SEQ ID NO: 8087028 - DNA, 22 bp, Homo sapiens
tacttttagcctatttgattct

SEQ ID NO: 8087029 - DNA, 22 bp, Homo sapiens
tacatttgttatagaaatgaag

SEQ ID NO: 8087030 - DNA, 22 bp, Homo sapiens
tagaaataaatctgcagctggg

SEQ ID NO: 8087031 - DNA, 22 bp, Homo sapiens
tagagggccagctggacagcga

SEQ ID NO: 8087032 - DNA, 22 bp, Homo sapiens
tagaatgtagtgcttcaagatt

SEQ ID NO: 8087033 - DNA, 22 bp, Homo sapiens
tagaatgtggaggtaacagact

SEQ ID NO: 8087034 - DNA, 22 bp, Homo sapiens
tatacacacctccaaagcagga

SEQ ID NO: 8087035 - DNA, 22 bp, Homo sapiens
taggtgggtgacttccatgggg

SEQ ID NO: 8087036 - DNA, 22 bp, Homo sapiens
tatctaaatggaatattccaga

SEQ ID NO: 8087037 - DNA, 22 bp, Homo sapiens
tatctaaaggatttaatttagt

SEQ ID NO: 8087038 - DNA, 22 bp, Homo sapiens
tatagcagtataacatgtttac

SEQ ID NO: 8087039 - DNA, 22 bp, Homo sapiens
tatagcagcatgatttatagtc

SEQ ID NO: 8087040 - DNA, 21 bp, Homo sapiens
tatagcagcatgatttataat

SEQ ID NO: 8087041 - DNA, 19 bp, Homo sapiens
tatatattttggggttgtg

SEQ ID NO: 8087042 - DNA, 22 bp, Homo sapiens
tatatattcttaagtagtgtag

SEQ ID NO: 8087043 - DNA, 22 bp, Homo sapiens
tatatcatggagattaacattc

SEQ ID NO: 8087044 - DNA, 22 bp, Homo sapiens
tattcaaagtaccttcattgcc

SEQ ID NO: 8087045 - DNA, 22 bp, Homo sapiens
tattattaaatggcagaatttt

SEQ ID NO: 8087046 - DNA, 19 bp, Homo sapiens
gctcagagtccccctgcgg

SEQ ID NO: 8087047 - DNA, 22 bp, Homo sapiens
gctcagagtggcctggctaggg

SEQ ID NO: 8087048 - DNA, 22 bp, Homo sapiens
gctcagaggccactgttggaaa

SEQ ID NO: 8087049 - DNA, 19 bp, Homo sapiens
gctcagagggccctgtgct

SEQ ID NO: 8087050 - DNA, 22 bp, Homo sapiens
gctccaggataataaagttgtt

SEQ ID NO: 8087051 - DNA, 22 bp, Homo sapiens
gctcagagttaattggatgggt

SEQ ID NO: 8087052 - DNA, 23 bp, Homo sapiens
gctcagcctcagcaggcccagga

SEQ ID NO: 8087053 - DNA, 20 bp, Homo sapiens
gctccaggtcagagaggacg

SEQ ID NO: 8087054 - DNA, 22 bp, Homo sapiens
gctccaggtgtcccaggtaaaa

SEQ ID NO: 8087055 - DNA, 22 bp, Homo sapiens
gctcccagaaccaaggctgggg

SEQ ID NO: 8087056 - DNA, 22 bp, Homo sapiens
gctcccaccttaaccttcacat

SEQ ID NO: 8087057 - DNA, 22 bp, Homo sapiens
gctccctgcatttcccaccctt

SEQ ID NO: 8087058 - DNA, 22 bp, Homo sapiens
gctccctgcactctgcagccct

SEQ ID NO: 8087059 - DNA, 22 bp, Homo sapiens
gctccctggtattgctgccact

SEQ ID NO: 8087060 - DNA, 22 bp, Homo sapiens
gctccctggtagccatgctctc

SEQ ID NO: 8087061 - DNA, 22 bp, Homo sapiens
gcgtctcaaggcccccaggcca

SEQ ID NO: 8087062 - DNA, 22 bp, Homo sapiens
gcgtctcaaggcccccaggcca

SEQ ID NO: 8087063 - DNA, 22 bp, Homo sapiens
gcgtccacgctgccgctcagga

SEQ ID NO: 8087064 - DNA, 22 bp, Homo sapiens
gcggtggggaaaggaggtgctg

SEQ ID NO: 8087065 - DNA, 22 bp, Homo sapiens
gcgtgggctggactgggatgaa

SEQ ID NO: 8087066 - DNA, 22 bp, Homo sapiens
gcgggtggatcatgaggtcagg

SEQ ID NO: 8087067 - DNA, 22 bp, Homo sapiens
gctgaggcctcagaaggctgag

SEQ ID NO: 8087068 - DNA, 22 bp, Homo sapiens
gctgaggccaggccccaccgga

SEQ ID NO: 8087069 - DNA, 22 bp, Homo sapiens
gctgaggctgggagcagcctgt

SEQ ID NO: 8087070 - DNA, 22 bp, Homo sapiens
gctcctctcccagagctgcagg

SEQ ID NO: 8087071 - DNA, 22 bp, Homo sapiens
gctccctgttctcagccatgat

SEQ ID NO: 8087072 - DNA, 22 bp, Homo sapiens
gctgctgttcctccagtggatc

SEQ ID NO: 8087073 - DNA, 22 bp, Homo sapiens
gctgcggtcactgcgggggctg

SEQ ID NO: 8087074 - DNA, 22 bp, Homo sapiens
gctgccccccggactcggcggg

SEQ ID NO: 8087075 - DNA, 22 bp, Homo sapiens
gctgcctcaggcacctcctggc

SEQ ID NO: 8087076 - DNA, 22 bp, Homo sapiens
gctttattttgtgagggattac

SEQ ID NO: 8087077 - DNA, 22 bp, Homo sapiens
gctttggaaatatagactcaag

SEQ ID NO: 8087078 - DNA, 22 bp, Homo sapiens
ggaagaggctgaggccatgctg

SEQ ID NO: 8087079 - DNA, 22 bp, Homo sapiens
ggacagtgaatctggaggtata

SEQ ID NO: 8087080 - DNA, 22 bp, Homo sapiens
ggacagtgaatgtggggatgca

SEQ ID NO: 8087081 - DNA, 22 bp, Homo sapiens
ggacagtgtgggccatctcact

SEQ ID NO: 8087082 - DNA, 22 bp, Homo sapiens
ggacacaggtaaataccactga

SEQ ID NO: 8087083 - DNA, 19 bp, Homo sapiens
ggaccaggtcctgggcagc

SEQ ID NO: 8087084 - DNA, 17 bp, Homo sapiens
ggaccaggggttgccat

SEQ ID NO: 8087085 - DNA, 22 bp, Homo sapiens
ggacatcttggttgcttccaag

SEQ ID NO: 8087086 - DNA, 22 bp, Homo sapiens
ggaccaggcaagctgaggcggg

SEQ ID NO: 8087087 - DNA, 22 bp, Homo sapiens
ggagagaattccatggacatgt

SEQ ID NO: 8087088 - DNA, 22 bp, Homo sapiens
ggagcagggaattacagcgcag

SEQ ID NO: 8087089 - DNA, 22 bp, Homo sapiens
gctggggcctgaacagtcagct

SEQ ID NO: 8087090 - DNA, 19 bp, Homo sapiens
gctggggcctgaccagaca

SEQ ID NO: 8087091 - DNA, 19 bp, Homo sapiens
gctgtgcctctctcctgct

SEQ ID NO: 8087092 - DNA, 20 bp, Homo sapiens
gctgtgcctccagctggtgg

SEQ ID NO: 8087093 - DNA, 22 bp, Homo sapiens
gctgtgggtacaaatacacaat

SEQ ID NO: 8087094 - DNA, 22 bp, Homo sapiens
gctgtgggtgctggctccaccc

SEQ ID NO: 8087095 - DNA, 22 bp, Homo sapiens
gctgtgggttcctggcatttga

SEQ ID NO: 8087096 - DNA, 22 bp, Homo sapiens
gctgtggtccctctgtcctcat

SEQ ID NO: 8087097 - DNA, 22 bp, Homo sapiens
gctgtgggacaggtccagccag

SEQ ID NO: 8087098 - DNA, 22 bp, Homo sapiens
gctgtgggccacacggctgagt

SEQ ID NO: 8087099 - DNA, 22 bp, Homo sapiens
gctgtgggtaaacgctgagggt

SEQ ID NO: 8087100 - DNA, 22 bp, Homo sapiens
gctgtgggccatggccaagtga

SEQ ID NO: 8087101 - DNA, 22 bp, Homo sapiens
gctgtggggagagaacacacaa

SEQ ID NO: 8087102 - DNA, 22 bp, Homo sapiens
gctgtggctgaccaccaggggg

SEQ ID NO: 8087103 - DNA, 22 bp, Homo sapiens
gctgtggctgaagatgcaggga

SEQ ID NO: 8087104 - DNA, 22 bp, Homo sapiens
gctgtggctccaatggtgagcc

SEQ ID NO: 8087105 - DNA, 22 bp, Homo sapiens
gctgtggctctcacaagcaaat

SEQ ID NO: 8087106 - DNA, 22 bp, Homo sapiens
gctgtggcttgcagctggggct

SEQ ID NO: 8087107 - DNA, 19 bp, Homo sapiens
gctgtgggacagcagggtg

SEQ ID NO: 8087108 - DNA, 18 bp, Homo sapiens
gctttatttcttggggaa

SEQ ID NO: 8087109 - DNA, 22 bp, Homo sapiens
gcttgagggtctgagatccact

SEQ ID NO: 8087110 - DNA, 22 bp, Homo sapiens
gctggcttgatagtttctgctt

SEQ ID NO: 8087111 - DNA, 22 bp, Homo sapiens
gctgggctggaaggccaaggca

SEQ ID NO: 8087112 - DNA, 22 bp, Homo sapiens
gctgggcttctcaatgctgcct

SEQ ID NO: 8087113 - DNA, 22 bp, Homo sapiens
gctgggcttcacctccagagtt

SEQ ID NO: 8087114 - DNA, 22 bp, Homo sapiens
gcccatggcagaactgtgagca

SEQ ID NO: 8087115 - DNA, 22 bp, Homo sapiens
gcccaggagaggccagggctga

SEQ ID NO: 8087116 - DNA, 22 bp, Homo sapiens
gcccagctttttgaggcaggca

SEQ ID NO: 8087117 - DNA, 22 bp, Homo sapiens
gccaggggtgcccacccaagga

SEQ ID NO: 8087118 - DNA, 22 bp, Homo sapiens
gcccagctggcttccagcacat

SEQ ID NO: 8087119 - DNA, 22 bp, Homo sapiens
gcccagccctgaggtcacagct

SEQ ID NO: 8087120 - DNA, 22 bp, Homo sapiens
gcccagccctgaggtcacagct

SEQ ID NO: 8087121 - DNA, 22 bp, Homo sapiens
gcccagcctccaagctccaagg

SEQ ID NO: 8087122 - DNA, 22 bp, Homo sapiens
gcccagcctccaagctccaagg

SEQ ID NO: 8087123 - DNA, 22 bp, Homo sapiens
gcctcctgagaagccacaggct

SEQ ID NO: 8087124 - DNA, 22 bp, Homo sapiens
gcctcctgcccagatgagtgat

SEQ ID NO: 8087125 - DNA, 22 bp, Homo sapiens
gcctcctcttgagggtcaggga

SEQ ID NO: 8087126 - DNA, 22 bp, Homo sapiens
gcctcctcacaatgtacccacg

SEQ ID NO: 8087127 - DNA, 22 bp, Homo sapiens
gcctcctaccacaccctcagtc

SEQ ID NO: 8087128 - DNA, 22 bp, Homo sapiens
gccccagaaagttcaaggcaca

SEQ ID NO: 8087129 - DNA, 22 bp, Homo sapiens
gccccagcagcaatgcggttga

SEQ ID NO: 8087130 - DNA, 22 bp, Homo sapiens
gccctgggattgggtggaggct

SEQ ID NO: 8087131 - DNA, 22 bp, Homo sapiens
gccagggagtctgggccacaga

SEQ ID NO: 8087132 - DNA, 22 bp, Homo sapiens
gccaggcaggtgtcggagccct

SEQ ID NO: 8087133 - DNA, 22 bp, Homo sapiens
gccaggcagccaccctctgcga

SEQ ID NO: 8087134 - DNA, 22 bp, Homo sapiens
gccaccagtgggggcctgggca

SEQ ID NO: 8087135 - DNA, 20 bp, Homo sapiens
gccagccctgacacaggagc

SEQ ID NO: 8087136 - DNA, 20 bp, Homo sapiens
gccagccctgacacaggagc

SEQ ID NO: 8087137 - DNA, 18 bp, Homo sapiens
gccagccctccaacctcc

SEQ ID NO: 8087138 - DNA, 22 bp, Homo sapiens
gccaggcagagccccgtgcagc

SEQ ID NO: 8087139 - DNA, 20 bp, Homo sapiens
gccaggcactgttctcaata

SEQ ID NO: 8087140 - DNA, 22 bp, Homo sapiens
gccagctagaggctgcagtgca

SEQ ID NO: 8087141 - DNA, 22 bp, Homo sapiens
gccaccagccccatgcgctgtg

SEQ ID NO: 8087142 - DNA, 22 bp, Homo sapiens
gccaccagcagaaaaggggcca

SEQ ID NO: 8087143 - DNA, 22 bp, Homo sapiens
gccaccaggagcccagtccaaa

SEQ ID NO: 8087144 - DNA, 22 bp, Homo sapiens
gccaccaggagcccagtccaaa

SEQ ID NO: 8087145 - DNA, 22 bp, Homo sapiens
gccaccaggttagatccagcct

SEQ ID NO: 8087146 - DNA, 22 bp, Homo sapiens
gccaccagtagctaacaacagt

SEQ ID NO: 8087147 - DNA, 22 bp, Homo sapiens
gccaccaggttctgggttaagc

SEQ ID NO: 8087148 - DNA, 22 bp, Homo sapiens
gccaccagggggtgcaaggtcc

SEQ ID NO: 8087149 - DNA, 22 bp, Homo sapiens
gccaccagggggctccagtgag

SEQ ID NO: 8087150 - DNA, 22 bp, Homo sapiens
gcagtggcccagcttgcaggct

SEQ ID NO: 8087151 - DNA, 22 bp, Homo sapiens
gcagtggctaggagtctggcgt

SEQ ID NO: 8087152 - DNA, 22 bp, Homo sapiens
gcagtgggaaggttggcacatg

SEQ ID NO: 8087153 - DNA, 22 bp, Homo sapiens
gcagtgggagcttaggcagtgc

SEQ ID NO: 8087154 - DNA, 22 bp, Homo sapiens
gcatgcaattatggtattagat

SEQ ID NO: 8087155 - DNA, 23 bp, Homo sapiens
gcatgcaacttgcagtagtattc

SEQ ID NO: 8087156 - DNA, 22 bp, Homo sapiens
gcagtggatggccagcaggggc

SEQ ID NO: 8087157 - DNA, 22 bp, Homo sapiens
gcagtggcaccgctggctctgg

SEQ ID NO: 8087158 - DNA, 22 bp, Homo sapiens
gcagtggcatgatgtgggctca

SEQ ID NO: 8087159 - DNA, 22 bp, Homo sapiens
gcaggacacagatgcaaggcca

SEQ ID NO: 8087160 - DNA, 22 bp, Homo sapiens
gcaggcagatcacctgtcagga

SEQ ID NO: 8087161 - DNA, 22 bp, Homo sapiens
gcagggacagggcagggccttt

SEQ ID NO: 8087162 - DNA, 22 bp, Homo sapiens
gcagcccagagcgcaggacccc

SEQ ID NO: 8087163 - DNA, 22 bp, Homo sapiens
gcagcccagcagggcccggagc

SEQ ID NO: 8087164 - DNA, 22 bp, Homo sapiens
gcagcccaggaccctggacaga

SEQ ID NO: 8087165 - DNA, 22 bp, Homo sapiens
gcagcccaggtgtagctctttg

SEQ ID NO: 8087166 - DNA, 22 bp, Homo sapiens
gcagcccaggtggagtaatcta

SEQ ID NO: 8087167 - DNA, 22 bp, Homo sapiens
gcagcccaggtctctctcactc

SEQ ID NO: 8087168 - DNA, 22 bp, Homo sapiens
gcagcccaggctcgctcactgc

SEQ ID NO: 8087169 - DNA, 22 bp, Homo sapiens
gcagcccaggagcaggcgaccc

SEQ ID NO: 8087170 - DNA, 22 bp, Homo sapiens
gcagcccaggaggcgggagccc

SEQ ID NO: 8087171 - DNA, 22 bp, Homo sapiens
gcagccccaggagacgcccagg

SEQ ID NO: 8087172 - DNA, 22 bp, Homo sapiens
gcagcccataacatttgaggcc

SEQ ID NO: 8087173 - DNA, 22 bp, Homo sapiens
gcagcctcagggcactcagatg

SEQ ID NO: 8087174 - DNA, 22 bp, Homo sapiens
gcagcctcaaactccccagctc

SEQ ID NO: 8087175 - DNA, 22 bp, Homo sapiens
gcagcctcaaactccccagctc

SEQ ID NO: 8087176 - DNA, 22 bp, Homo sapiens
gcaggaagaggctcgaagcccc

SEQ ID NO: 8087177 - DNA, 22 bp, Homo sapiens
gcaggacaaaatttccagggtg

SEQ ID NO: 8087178 - DNA, 23 bp, Homo sapiens
gcaggacaacagagtgggaaggc

SEQ ID NO: 8087179 - DNA, 22 bp, Homo sapiens
gcaggaagccttaccaagccca

SEQ ID NO: 8087180 - DNA, 22 bp, Homo sapiens
gcagagggtcctgtgccagcag

SEQ ID NO: 8087181 - DNA, 19 bp, Homo sapiens
gcagacaggtccagagagg

SEQ ID NO: 8087182 - DNA, 22 bp, Homo sapiens
gcacatgaggctgtctttgtct

SEQ ID NO: 8087183 - DNA, 22 bp, Homo sapiens
gcacactgcggtgatgtgagtc

SEQ ID NO: 8087184 - DNA, 19 bp, Homo sapiens
gcacacagtagggctggca

SEQ ID NO: 8087185 - DNA, 22 bp, Homo sapiens
gcacacagaatcagtgggcata

SEQ ID NO: 8087186 - DNA, 22 bp, Homo sapiens
gcaaatattcaagacttttcca

SEQ ID NO: 8087187 - DNA, 22 bp, Homo sapiens
gaggccaggaggatctctctaa

SEQ ID NO: 8087188 - DNA, 22 bp, Homo sapiens
ggcgctggccacggtggctctg

SEQ ID NO: 8087189 - DNA, 22 bp, Homo sapiens
ggcgaggccgggacaggctgga

SEQ ID NO: 8087190 - DNA, 22 bp, Homo sapiens
ggccatggaccccgagctgacc

SEQ ID NO: 8087191 - DNA, 19 bp, Homo sapiens
ggcatggtcggaagagctc

SEQ ID NO: 8087192 - DNA, 22 bp, Homo sapiens
ggccaatgggaatggccagtag

SEQ ID NO: 8087193 - DNA, 19 bp, Homo sapiens
ggccaggctgactgtggtc

SEQ ID NO: 8087194 - DNA, 22 bp, Homo sapiens
ggccagggggcttcagactcca

SEQ ID NO: 8087195 - DNA, 22 bp, Homo sapiens
ggccaggtgcggtggctcacac

SEQ ID NO: 8087196 - DNA, 22 bp, Homo sapiens
ggcatggggtgtatgtggcacg

SEQ ID NO: 8087197 - DNA, 22 bp, Homo sapiens
ggcatggggtgtatgtggcacg

SEQ ID NO: 8087198 - DNA, 21 bp, Homo sapiens
ggcatggcacctctgggcagg

SEQ ID NO: 8087199 - DNA, 22 bp, Homo sapiens
ggcatggcctgtaagacggaga

SEQ ID NO: 8087200 - DNA, 22 bp, Homo sapiens
ggcagtgaatgaaacagaggct

SEQ ID NO: 8087201 - DNA, 17 bp, Homo sapiens
ggagccaggagcccacc

SEQ ID NO: 8087202 - DNA, 22 bp, Homo sapiens
ggagccagcagggtgacactga

SEQ ID NO: 8087203 - DNA, 23 bp, Homo sapiens
ggagccagcctgtggggagcggg

SEQ ID NO: 8087204 - DNA, 22 bp, Homo sapiens
ggagccagagtctgcagtgtaa

SEQ ID NO: 8087205 - DNA, 22 bp, Homo sapiens
ggagccagcagggtgacactga

SEQ ID NO: 8087206 - DNA, 22 bp, Homo sapiens
ggagccagaggctgctgctgtg

SEQ ID NO: 8087207 - DNA, 22 bp, Homo sapiens
ggagccagagcactggggagcc

SEQ ID NO: 8087208 - DNA, 22 bp, Homo sapiens
ggagccagaggctgctgctgtg

SEQ ID NO: 8087209 - DNA, 22 bp, Homo sapiens
ggagtccaacgtgcagccagga

SEQ ID NO: 8087210 - DNA, 22 bp, Homo sapiens
ggagtcagaggaaggcttgctc

SEQ ID NO: 8087211 - DNA, 23 bp, Homo sapiens
ggagtgcaatggcgccatctcgg

SEQ ID NO: 8087212 - DNA, 22 bp, Homo sapiens
ggcaagatccaaggggctagga

SEQ ID NO: 8087213 - DNA, 22 bp, Homo sapiens
ggcaagagttgaagctccagga

SEQ ID NO: 8087214 - DNA, 22 bp, Homo sapiens
ggcagaggtagctggaaccagg

SEQ ID NO: 8087215 - DNA, 22 bp, Homo sapiens
ggcaggaggtgagtggcgggtg

SEQ ID NO: 8087216 - DNA, 22 bp, Homo sapiens
ggcacaggagctagtcaaagcc

SEQ ID NO: 8087217 - DNA, 22 bp, Homo sapiens
ggcacagctgatgcagacacac

SEQ ID NO: 8087218 - DNA, 22 bp, Homo sapiens
ggcacagctcaggtcccagctc

SEQ ID NO: 8087219 - DNA, 22 bp, Homo sapiens
ggcacagctacttgctcactct

SEQ ID NO: 8087220 - DNA, 22 bp, Homo sapiens
gggatggggggaagcgtccatg

SEQ ID NO: 8087221 - DNA, 22 bp, Homo sapiens
gggcaaagtggtggaggcagtt

SEQ ID NO: 8087222 - DNA, 22 bp, Homo sapiens
gggcacagcccagtggggtccc

SEQ ID NO: 8087223 - DNA, 22 bp, Homo sapiens
gggcacagcccagtggggtccc

SEQ ID NO: 8087224 - DNA, 22 bp, Homo sapiens
gggcaagcacagcgagcgtgcg

SEQ ID NO: 8087225 - DNA, 22 bp, Homo sapiens
gggcacagctgctacccagtgc

SEQ ID NO: 8087226 - DNA, 19 bp, Homo sapiens
gggcacagcctccccccag

SEQ ID NO: 8087227 - DNA, 22 bp, Homo sapiens
gggcacagctgctacccagtgc

SEQ ID NO: 8087228 - DNA, 22 bp, Homo sapiens
gggcacagcctaactatggaga

SEQ ID NO: 8087229 - DNA, 22 bp, Homo sapiens
gggcacagcctaactatggaga

SEQ ID NO: 8087230 - DNA, 22 bp, Homo sapiens
gggattgaattgggggatcaca

SEQ ID NO: 8087231 - DNA, 22 bp, Homo sapiens
gggatggggtcgggaccctgct

SEQ ID NO: 8087232 - DNA, 22 bp, Homo sapiens
gggcaggagaaggtggatgtcc

SEQ ID NO: 8087233 - DNA, 22 bp, Homo sapiens
gggcatgcctgcgcagtgcatg

SEQ ID NO: 8087234 - DNA, 22 bp, Homo sapiens
gggcacaggaatttgggatgtg

SEQ ID NO: 8087235 - DNA, 22 bp, Homo sapiens
gggcacaggagaaggatctggc

SEQ ID NO: 8087236 - DNA, 22 bp, Homo sapiens
gggcacaggaatttgggatgtg

SEQ ID NO: 8087237 - DNA, 22 bp, Homo sapiens
gggcagctgcagggatggtgac

SEQ ID NO: 8087238 - DNA, 22 bp, Homo sapiens
gggagctggttcctgccctcca

SEQ ID NO: 8087239 - DNA, 22 bp, Homo sapiens
gggagctgtaagggacaggtag

SEQ ID NO: 8087240 - DNA, 19 bp, Homo sapiens
gggagctgtctgcccgtgg

SEQ ID NO: 8087241 - DNA, 18 bp, Homo sapiens
gggagctgggaagctggt

SEQ ID NO: 8087242 - DNA, 22 bp, Homo sapiens
gggagagcgggaggtgccacag

SEQ ID NO: 8087243 - DNA, 22 bp, Homo sapiens
ggcttgggagcaggcatgtgac

SEQ ID NO: 8087244 - DNA, 22 bp, Homo sapiens
gggacatgaagcatcggaggca

SEQ ID NO: 8087245 - DNA, 22 bp, Homo sapiens
gggaccagaggctgtgcacaat

SEQ ID NO: 8087246 - DNA, 22 bp, Homo sapiens
gggacatgcccctcagtgggtg

SEQ ID NO: 8087247 - DNA, 22 bp, Homo sapiens
gggacatggaggcgcgcaggca

SEQ ID NO: 8087248 - DNA, 22 bp, Homo sapiens
gggaccagaagaaggatggtga

SEQ ID NO: 8087249 - DNA, 22 bp, Homo sapiens
ggctgggcaggtctgcacaggg

SEQ ID NO: 8087250 - DNA, 21 bp, Homo sapiens
ggctgggcaggacccacccct

SEQ ID NO: 8087251 - DNA, 22 bp, Homo sapiens
ggctgggccagggcctgtggac

SEQ ID NO: 8087252 - DNA, 22 bp, Homo sapiens
ggctgggcatccatccatgaga

SEQ ID NO: 8087253 - DNA, 22 bp, Homo sapiens
ggctgggcctctccctcagctg

SEQ ID NO: 8087254 - DNA, 22 bp, Homo sapiens
ggctgggccgcggctacccaga

SEQ ID NO: 8087255 - DNA, 22 bp, Homo sapiens
ggctgggctccgggagcatgcg

SEQ ID NO: 8087256 - DNA, 22 bp, Homo sapiens
ggctgggctgcggctgtacctg

SEQ ID NO: 8087257 - DNA, 22 bp, Homo sapiens
ggctgggctgctgggtcagagc

SEQ ID NO: 8087258 - DNA, 22 bp, Homo sapiens
ggctgggaggccgtgctgacct

SEQ ID NO: 8087259 - DNA, 22 bp, Homo sapiens
ggctgggcaaacaagactcttc

SEQ ID NO: 8087260 - DNA, 22 bp, Homo sapiens
ggcggggcctcgcgaacggcct

SEQ ID NO: 8087261 - DNA, 22 bp, Homo sapiens
ggcgggcagcgtcttgctggcc

SEQ ID NO: 8087262 - DNA, 22 bp, Homo sapiens
gggtaggctgctcctggggccc

SEQ ID NO: 8087263 - DNA, 22 bp, Homo sapiens
gggtagggtgacttaggctggc

SEQ ID NO: 8087264 - DNA, 22 bp, Homo sapiens
ggggtgtgagtagagctgggga

SEQ ID NO: 8087265 - DNA, 21 bp, Homo sapiens
ggggttggcaagagcagagac

SEQ ID NO: 8087266 - DNA, 22 bp, Homo sapiens
ggggtgggcgtgcagggacacc

SEQ ID NO: 8087267 - DNA, 22 bp, Homo sapiens
ggggctcaggggaagtgtccag

SEQ ID NO: 8087268 - DNA, 22 bp, Homo sapiens
ggggaagaggcgtgatggatcc

SEQ ID NO: 8087269 - DNA, 20 bp, Homo sapiens
gggcttggaggactcgaggg

SEQ ID NO: 8087270 - DNA, 22 bp, Homo sapiens
gggcttggccccagaagagcta

SEQ ID NO: 8087271 - DNA, 22 bp, Homo sapiens
gggctgaggctaccactggtct

SEQ ID NO: 8087272 - DNA, 22 bp, Homo sapiens
gggctgagtgtcccaggccgaa

SEQ ID NO: 8087273 - DNA, 22 bp, Homo sapiens
gggcatggccaggtgaggggtc

SEQ ID NO: 8087274 - DNA, 22 bp, Homo sapiens
gggcatggtggtgcacacctgt

SEQ ID NO: 8087275 - DNA, 22 bp, Homo sapiens
gggccacacagggcagctccct

SEQ ID NO: 8087276 - DNA, 21 bp, Homo sapiens
gggccacaccttctgcagacc

SEQ ID NO: 8087277 - DNA, 22 bp, Homo sapiens
ggtgttgggctcactggtcctt

SEQ ID NO: 8087278 - DNA, 22 bp, Homo sapiens
ggtgttgggagagctggttttg

SEQ ID NO: 8087279 - DNA, 22 bp, Homo sapiens
ggtgttggaacatggtgagatt

SEQ ID NO: 8087280 - DNA, 22 bp, Homo sapiens
ggtgttggtctacaccagcact

SEQ ID NO: 8087281 - DNA, 22 bp, Homo sapiens
ggtgtccttgctccttcagctt

SEQ ID NO: 8087282 - DNA, 22 bp, Homo sapiens
ggtgtccttcgtccgctggcat

SEQ ID NO: 8087283 - DNA, 22 bp, Homo sapiens
ggtctcctgacctttagtccct

SEQ ID NO: 8087284 - DNA, 22 bp, Homo sapiens
ggtctcctgaggctgccacacc

SEQ ID NO: 8087285 - DNA, 22 bp, Homo sapiens
ggtctcctgggttgaccagctg

SEQ ID NO: 8087286 - DNA, 22 bp, Homo sapiens
ggtctccttgggaaagcaggaa

SEQ ID NO: 8087287 - DNA, 22 bp, Homo sapiens
ggtcactgtcttctgggctctg

SEQ ID NO: 8087288 - DNA, 22 bp, Homo sapiens
gggtggcatctctctgagctgt

SEQ ID NO: 8087289 - DNA, 22 bp, Homo sapiens
gggtggcatctctctgagctgt

SEQ ID NO: 8087290 - DNA, 22 bp, Homo sapiens
gggtggccttcatagctcaggg

SEQ ID NO: 8087291 - DNA, 22 bp, Homo sapiens
gggtggcatagggtgatggctt

SEQ ID NO: 8087292 - DNA, 22 bp, Homo sapiens
gggtggcaaaggcgctgaaagg

SEQ ID NO: 8087293 - DNA, 22 bp, Homo sapiens
gggtggcacaggtgcagagggt

SEQ ID NO: 8087294 - DNA, 22 bp, Homo sapiens
gggtggcagctgttgccaaggt

SEQ ID NO: 8087295 - DNA, 22 bp, Homo sapiens
gtctgcctgtctggatgacaga

SEQ ID NO: 8087296 - DNA, 22 bp, Homo sapiens
gtctgcctgggacgctgggagt

SEQ ID NO: 8087297 - DNA, 22 bp, Homo sapiens
gtctgcctggaggcagctgctg

SEQ ID NO: 8087298 - DNA, 22 bp, Homo sapiens
gtctgcctgctagtggctgcct

SEQ ID NO: 8087299 - DNA, 22 bp, Homo sapiens
gtctgcctgcaatccagagact

SEQ ID NO: 8087300 - DNA, 22 bp, Homo sapiens
gtctgcctctttctttctgggt

SEQ ID NO: 8087301 - DNA, 22 bp, Homo sapiens
gtctgcctcagccgggggccgc

SEQ ID NO: 8087302 - DNA, 22 bp, Homo sapiens
gtctgcctctattgcctacctg

SEQ ID NO: 8087303 - DNA, 18 bp, Homo sapiens
gtctgccttctcccttcc

SEQ ID NO: 8087304 - DNA, 22 bp, Homo sapiens
gtctgcctttatcatctcctta

SEQ ID NO: 8087305 - DNA, 22 bp, Homo sapiens
gtctgcccttggcctgggactt

SEQ ID NO: 8087306 - DNA, 22 bp, Homo sapiens
gtcctgggcggagggctgctgt

SEQ ID NO: 8087307 - DNA, 22 bp, Homo sapiens
gtgaccatcatctcagctagtt

SEQ ID NO: 8087308 - DNA, 22 bp, Homo sapiens
gtgaaagagatgcagcataatg

SEQ ID NO: 8087309 - DNA, 22 bp, Homo sapiens
gtccactctagggcagctctcg

SEQ ID NO: 8087310 - DNA, 22 bp, Homo sapiens
gtccaccatagggagggcgtgg

SEQ ID NO: 8087311 - DNA, 22 bp, Homo sapiens
gtccactcccagtgcctgaggc

SEQ ID NO: 8087312 - DNA, 22 bp, Homo sapiens
gtccaagagtcaagaagggggc

SEQ ID NO: 8087313 - DNA, 22 bp, Homo sapiens
gtccaaaagagccagccgggcg

SEQ ID NO: 8087314 - DNA, 20 bp, Homo sapiens
gtcctgggagccacagcaca

SEQ ID NO: 8087315 - DNA, 22 bp, Homo sapiens
gtcctgggagatgggaccctga

SEQ ID NO: 8087316 - DNA, 17 bp, Homo sapiens
gtcctgggaggagagag

SEQ ID NO: 8087317 - DNA, 17 bp, Homo sapiens
gtcctgggaggagagag

SEQ ID NO: 8087318 - DNA, 22 bp, Homo sapiens
gtcctgggcccaggggctgcct

SEQ ID NO: 8087319 - DNA, 22 bp, Homo sapiens
gtcctgggcctgctgaggctga

SEQ ID NO: 8087320 - DNA, 22 bp, Homo sapiens
gtagaatatatggttagtattg

SEQ ID NO: 8087321 - DNA, 22 bp, Homo sapiens
gtaccctgtggccagccagcca

SEQ ID NO: 8087322 - DNA, 22 bp, Homo sapiens
gtaaaacatgttttaactagga

SEQ ID NO: 8087323 - DNA, 22 bp, Homo sapiens
gtaaaacaagctttatggttcc

SEQ ID NO: 8087324 - DNA, 23 bp, Homo sapiens
gtaaaatacgcagtgcagtgtga

SEQ ID NO: 8087325 - DNA, 22 bp, Homo sapiens
gtacatttcatttaaatgatgt

SEQ ID NO: 8087326 - DNA, 22 bp, Homo sapiens
gtacatttcagtttccttaaga

SEQ ID NO: 8087327 - DNA, 22 bp, Homo sapiens
gtacatttatttttgcagcata

SEQ ID NO: 8087328 - DNA, 22 bp, Homo sapiens
gtacattttgaggttaaaacaa

SEQ ID NO: 8087329 - DNA, 20 bp, Homo sapiens
gtacattttcaggaggggat

SEQ ID NO: 8087330 - DNA, 22 bp, Homo sapiens
gtacattttactttgtttgaat

SEQ ID NO: 8087331 - DNA, 22 bp, Homo sapiens
gtacatttctcttgttcttatt

SEQ ID NO: 8087332 - DNA, 22 bp, Homo sapiens
gtacatttctcccaacactaaa

SEQ ID NO: 8087333 - DNA, 22 bp, Homo sapiens
gagcttccactctagaaggagt

SEQ ID NO: 8087334 - DNA, 22 bp, Homo sapiens
gagcttccatccttactgtgtg

SEQ ID NO: 8087335 - DNA, 22 bp, Homo sapiens
gagcttcctgcaggtcactgtg

SEQ ID NO: 8087336 - DNA, 22 bp, Homo sapiens
gagcttcctttttctgcatgac

SEQ ID NO: 8087337 - DNA, 22 bp, Homo sapiens
gagcctggacatctcaggccca

SEQ ID NO: 8087338 - DNA, 22 bp, Homo sapiens
gagcctgcctctagtctctaga

SEQ ID NO: 8087339 - DNA, 22 bp, Homo sapiens
gagcctgcccagccctgtccac

SEQ ID NO: 8087340 - DNA, 22 bp, Homo sapiens
gagcctcctcctggtgtgccga

SEQ ID NO: 8087341 - DNA, 22 bp, Homo sapiens
gaggcagaagttgcagtgagca

SEQ ID NO: 8087342 - DNA, 22 bp, Homo sapiens
gaggcactgcagtacagtgact

SEQ ID NO: 8087343 - DNA, 22 bp, Homo sapiens
gaggccagcgcgcagcactttt

SEQ ID NO: 8087344 - DNA, 22 bp, Homo sapiens
gaggccagctacccaagggtca

SEQ ID NO: 8087345 - DNA, 22 bp, Homo sapiens
gaggccagctagtccaggaagt

SEQ ID NO: 8087346 - DNA, 22 bp, Homo sapiens
gaggaggctatcagcaatcagg

SEQ ID NO: 8087347 - DNA, 22 bp, Homo sapiens
gagcagcagctgggccaggttc

SEQ ID NO: 8087348 - DNA, 22 bp, Homo sapiens
gagcagcaggtggggctggctt

SEQ ID NO: 8087349 - DNA, 22 bp, Homo sapiens
gagcagcacttgaggcatgtca

SEQ ID NO: 8087350 - DNA, 22 bp, Homo sapiens
gagccaagcaccacattaagtt

SEQ ID NO: 8087351 - DNA, 22 bp, Homo sapiens
gagccagaaaagctgcctgact

SEQ ID NO: 8087352 - DNA, 22 bp, Homo sapiens
gagccaggttggaggctgcagt

SEQ ID NO: 8087353 - DNA, 22 bp, Homo sapiens
gagccagggtttgaaactagac

SEQ ID NO: 8087354 - DNA, 22 bp, Homo sapiens
gagccagggctgtgagctgagc

SEQ ID NO: 8087355 - DNA, 22 bp, Homo sapiens
gagaggcatggaacagattctt

SEQ ID NO: 8087356 - DNA, 22 bp, Homo sapiens
gaagccagcatccctctcccat

SEQ ID NO: 8087357 - DNA, 22 bp, Homo sapiens
gaagcaaaatgtctgcacatat

SEQ ID NO: 8087358 - DNA, 22 bp, Homo sapiens
gaaccacaatgtgaagaaggag

SEQ ID NO: 8087359 - DNA, 22 bp, Homo sapiens
gaagaggcaattgaataagcta

SEQ ID NO: 8087360 - DNA, 22 bp, Homo sapiens
gaaatgcaggcttggattcagc

SEQ ID NO: 8087361 - DNA, 21 bp, Homo sapiens
gaacaggaaaagctggcttca

SEQ ID NO: 8087362 - DNA, 22 bp, Homo sapiens
gaacaggtaatcagtaaaatgt

SEQ ID NO: 8087363 - DNA, 22 bp, Homo sapiens
gaacagtgaactgatttgtaaa

SEQ ID NO: 8087364 - DNA, 22 bp, Homo sapiens
ctttcagaggttactcaggaaa

SEQ ID NO: 8087365 - DNA, 22 bp, Homo sapiens
gacaggggtccctctgggctgt

SEQ ID NO: 8087366 - DNA, 22 bp, Homo sapiens
gacagggaaacattgaagtgtc

SEQ ID NO: 8087367 - DNA, 22 bp, Homo sapiens
gaatacatttgccgtggttctc

SEQ ID NO: 8087368 - DNA, 22 bp, Homo sapiens
gaatacattggaaatcagaata

SEQ ID NO: 8087369 - DNA, 22 bp, Homo sapiens
gaatacatgtgtgtatagaggt

SEQ ID NO: 8087370 - DNA, 22 bp, Homo sapiens
gacaactgatgtgcttgtggga

SEQ ID NO: 8087371 - DNA, 22 bp, Homo sapiens
gacaactgagcagaggaaatga

SEQ ID NO: 8087372 - DNA, 22 bp, Homo sapiens
gacaactgtcagtatattgtta

SEQ ID NO: 8087373 - DNA, 22 bp, Homo sapiens
gacaactgccccattttaaatg

SEQ ID NO: 8087374 - DNA, 22 bp, Homo sapiens
gaaggaaaacagatctgcctga

SEQ ID NO: 8087375 - DNA, 22 bp, Homo sapiens
gaaggaaaggtctcatgccttt

SEQ ID NO: 8087376 - DNA, 22 bp, Homo sapiens
gaataacattggaaccctgaag

SEQ ID NO: 8087377 - DNA, 22 bp, Homo sapiens
gaatacatgatacatgaactgc

SEQ ID NO: 8087378 - DNA, 22 bp, Homo sapiens
cttatttactgatccacagatg

SEQ ID NO: 8087379 - DNA, 22 bp, Homo sapiens
cttatttatgtctgtctctaat

SEQ ID NO: 8087380 - DNA, 22 bp, Homo sapiens
cttcaaaagccagaagcctgcg

SEQ ID NO: 8087381 - DNA, 22 bp, Homo sapiens
ctgttggcctttcatcagtaat

SEQ ID NO: 8087382 - DNA, 22 bp, Homo sapiens
cttattggtgctttttctcata

SEQ ID NO: 8087383 - DNA, 22 bp, Homo sapiens
cttatttaatgagggttagaat

SEQ ID NO: 8087384 - DNA, 22 bp, Homo sapiens
cttcagtgttgccagggcctag

SEQ ID NO: 8087385 - DNA, 22 bp, Homo sapiens
cttcagtgttcccatctgtaaa

SEQ ID NO: 8087386 - DNA, 19 bp, Homo sapiens
cttcagtgttcacctggcc

SEQ ID NO: 8087387 - DNA, 22 bp, Homo sapiens
cttcagtgtcctctctagtaga

SEQ ID NO: 8087388 - DNA, 23 bp, Homo sapiens
cttcagtgtgggactgcagcgtg

SEQ ID NO: 8087389 - DNA, 18 bp, Homo sapiens
cttcagtggctgctctgc

SEQ ID NO: 8087390 - DNA, 22 bp, Homo sapiens
cttcagtggtcatttgtgataa

SEQ ID NO: 8087391 - DNA, 22 bp, Homo sapiens
cttcagtgacattccttccctc

SEQ ID NO: 8087392 - DNA, 18 bp, Homo sapiens
cttcagtgacagtctggc

SEQ ID NO: 8087393 - DNA, 22 bp, Homo sapiens
cttcagtgacagccacccaggc

SEQ ID NO: 8087394 - DNA, 22 bp, Homo sapiens
cttcagtgaatgttgagtaagg

SEQ ID NO: 8087395 - DNA, 22 bp, Homo sapiens
cttcagtgattgcagaaagcct

SEQ ID NO: 8087396 - DNA, 22 bp, Homo sapiens
cttcagtgcatgtttataatca

SEQ ID NO: 8087397 - DNA, 22 bp, Homo sapiens
cttcagtgatataggcttctcc

SEQ ID NO: 8087398 - DNA, 22 bp, Homo sapiens
cttgtccccagcaggttggttt

SEQ ID NO: 8087399 - DNA, 22 bp, Homo sapiens
cttgccagcacttggccagctg

SEQ ID NO: 8087400 - DNA, 21 bp, Homo sapiens
cttgacatagcctgtcagctt

SEQ ID NO: 8087401 - DNA, 22 bp, Homo sapiens
cttgcacacatgtacatgtgta

SEQ ID NO: 8087402 - DNA, 22 bp, Homo sapiens
ctgtggccagtcccacacctcc

SEQ ID NO: 8087403 - DNA, 22 bp, Homo sapiens
ctgtggccagatggtgccagtt

SEQ ID NO: 8087404 - DNA, 23 bp, Homo sapiens
ctgtgcccggggctccacctgat

SEQ ID NO: 8087405 - DNA, 22 bp, Homo sapiens
ctgtgcccaggcccctggggat

SEQ ID NO: 8087406 - DNA, 22 bp, Homo sapiens
ctgtgccatcctagggctgctg

SEQ ID NO: 8087407 - DNA, 22 bp, Homo sapiens
ctgtgccaggcccgggtgggtg

SEQ ID NO: 8087408 - DNA, 22 bp, Homo sapiens
ctgtgccagcctgtcccaggag

SEQ ID NO: 8087409 - DNA, 22 bp, Homo sapiens
ctgtgccactgggggccggcaa

SEQ ID NO: 8087410 - DNA, 22 bp, Homo sapiens
ctgtgccactgccctgccacgc

SEQ ID NO: 8087411 - DNA, 22 bp, Homo sapiens
ctgtgccacctgagggactcta

SEQ ID NO: 8087412 - DNA, 22 bp, Homo sapiens
ctgtgagggccagagtcagggc

SEQ ID NO: 8087413 - DNA, 22 bp, Homo sapiens
ctgtgagggccagagtcagggc

SEQ ID NO: 8087414 - DNA, 22 bp, Homo sapiens
ctgtcccttcattattcactac

SEQ ID NO: 8087415 - DNA, 22 bp, Homo sapiens
ctgggcaggagaggtggttgga

SEQ ID NO: 8087416 - DNA, 22 bp, Homo sapiens
ctgggccaagaagttgtgtatg

SEQ ID NO: 8087417 - DNA, 22 bp, Homo sapiens
ctgggccaaaagaagtgttctt

SEQ ID NO: 8087418 - DNA, 22 bp, Homo sapiens
ctgggccacaaaaaactcctgt

SEQ ID NO: 8087419 - DNA, 22 bp, Homo sapiens
ctgggcaggagggctctatgga

SEQ ID NO: 8087420 - DNA, 22 bp, Homo sapiens
ctgggccactccagatgcccac

SEQ ID NO: 8087421 - DNA, 22 bp, Homo sapiens
ctgggccagaagacatttagga

SEQ ID NO: 8087422 - DNA, 22 bp, Homo sapiens
ctgggccacttcctcaggggaa

SEQ ID NO: 8087423 - DNA, 19 bp, Homo sapiens
ctgggccagaatcagctca

SEQ ID NO: 8087424 - DNA, 22 bp, Homo sapiens
ctgggccacaagcctgtgtgat

SEQ ID NO: 8087425 - DNA, 22 bp, Homo sapiens
ctgggccacagactcaaggcag

SEQ ID NO: 8087426 - DNA, 22 bp, Homo sapiens
ctgggccacatcagatgaagac

SEQ ID NO: 8087427 - DNA, 22 bp, Homo sapiens
ctggcttgcagctcatcataaa

SEQ ID NO: 8087428 - DNA, 22 bp, Homo sapiens
ctgggaaatggcttcgagctca

SEQ ID NO: 8087429 - DNA, 22 bp, Homo sapiens
ctgggccagatccagcctcaca

SEQ ID NO: 8087430 - DNA, 18 bp, Homo sapiens
ctgggccagagtttctgc

SEQ ID NO: 8087431 - DNA, 19 bp, Homo sapiens
ctgggccagagctgtcctc

SEQ ID NO: 8087432 - DNA, 22 bp, Homo sapiens
ctgggccagaccttgtggtctt

SEQ ID NO: 8087433 - DNA, 22 bp, Homo sapiens
ctggggctgcggtggaggagcc

SEQ ID NO: 8087434 - DNA, 22 bp, Homo sapiens
ctggggctcactttggtcaggc

SEQ ID NO: 8087435 - DNA, 22 bp, Homo sapiens
ctgcatcagtggatatgatggt

SEQ ID NO: 8087436 - DNA, 22 bp, Homo sapiens
ctgccaccatgccccagcagag

SEQ ID NO: 8087437 - DNA, 22 bp, Homo sapiens
ctggcagccaagtgggatactc

SEQ ID NO: 8087438 - DNA, 22 bp, Homo sapiens
ctggcagcccaacctagagtct

SEQ ID NO: 8087439 - DNA, 19 bp, Homo sapiens
ctggcagcctgtctgtgtc

SEQ ID NO: 8087440 - DNA, 22 bp, Homo sapiens
ctggccagagttggagggtgtg

SEQ ID NO: 8087441 - DNA, 22 bp, Homo sapiens
ctggccagatgttacgtccaat

SEQ ID NO: 8087442 - DNA, 22 bp, Homo sapiens
ctggccaggcatcccctgatcc

SEQ ID NO: 8087443 - DNA, 22 bp, Homo sapiens
ctggccagcctgtcgatgccct

SEQ ID NO: 8087444 - DNA, 22 bp, Homo sapiens
ctggctcattttagcatcaggt

SEQ ID NO: 8087445 - DNA, 22 bp, Homo sapiens
ttctccttttccagttcccagt

SEQ ID NO: 8087446 - DNA, 22 bp, Homo sapiens
ctacttgttcactgtaggtcgc

SEQ ID NO: 8087447 - DNA, 22 bp, Homo sapiens
ctacatttcatccagggagagc

SEQ ID NO: 8087448 - DNA, 22 bp, Homo sapiens
ctattacaatctgctactatga

SEQ ID NO: 8087449 - DNA, 22 bp, Homo sapiens
ctagcaggtcaaaccagctgat

SEQ ID NO: 8087450 - DNA, 22 bp, Homo sapiens
ctcacagatgttctcctttagg

SEQ ID NO: 8087451 - DNA, 22 bp, Homo sapiens
ctcacagctgcttcaggatcca

SEQ ID NO: 8087452 - DNA, 22 bp, Homo sapiens
ctcaagatattccagctctcaa

SEQ ID NO: 8087453 - DNA, 22 bp, Homo sapiens
ctcaagtcagaaataaaagcat

SEQ ID NO: 8087454 - DNA, 22 bp, Homo sapiens
ctcaagtccatagaatcaggaa

SEQ ID NO: 8087455 - DNA, 22 bp, Homo sapiens
ctcaagtctgatgggttaggtt

SEQ ID NO: 8087456 - DNA, 22 bp, Homo sapiens
ctcaagtctattgataagtgca

SEQ ID NO: 8087457 - DNA, 22 bp, Homo sapiens
ctcaagtctgagtactggctct

SEQ ID NO: 8087458 - DNA, 22 bp, Homo sapiens
ctcaaaagacttaaacataaga

SEQ ID NO: 8087459 - DNA, 22 bp, Homo sapiens
cgtatttcatctcctttctgct

SEQ ID NO: 8087460 - DNA, 22 bp, Homo sapiens
ttcatgaaacttaactgttggg

SEQ ID NO: 8087461 - DNA, 22 bp, Homo sapiens
ttcatgaatatattgaattagc

SEQ ID NO: 8087462 - DNA, 22 bp, Homo sapiens
ttcatgaaattctcgtgtacct

SEQ ID NO: 8087463 - DNA, 22 bp, Homo sapiens
ctaaacttttataacattgaga

SEQ ID NO: 8087464 - DNA, 22 bp, Homo sapiens
ttcatgaatgttccatgtgagt

SEQ ID NO: 8087465 - DNA, 22 bp, Homo sapiens
ttcacagaagaggtcacatttc

SEQ ID NO: 8087466 - DNA, 22 bp, Homo sapiens
ttcacactgtttttcatagtgg

SEQ ID NO: 8087467 - DNA, 22 bp, Homo sapiens
ttcagatgattagaatagtatt

SEQ ID NO: 8087468 - DNA, 22 bp, Homo sapiens
ttcagcaaacacgatgcttgtt

SEQ ID NO: 8087469 - DNA, 22 bp, Homo sapiens
ttcagcaaatggactgttcagg

SEQ ID NO: 8087470 - DNA, 20 bp, Homo sapiens
cgcatagtttccatcattcc

SEQ ID NO: 8087471 - DNA, 22 bp, Homo sapiens
cgccccggacgtctgaccaaac

SEQ ID NO: 8087472 - DNA, 22 bp, Homo sapiens
cgccctccacacagcccctggc

SEQ ID NO: 8087473 - DNA, 19 bp, Homo sapiens
ttcacaattatgaaattag

SEQ ID NO: 8087474 - DNA, 23 bp, Homo sapiens
tggggccaagtgaggaagggtct

SEQ ID NO: 8087475 - DNA, 22 bp, Homo sapiens
tgggggactgcactggcgtcag

SEQ ID NO: 8087476 - DNA, 19 bp, Homo sapiens
cctgggagtcagctgaagg

SEQ ID NO: 8087477 - DNA, 22 bp, Homo sapiens
cctgggcaacatagtgagaccc

SEQ ID NO: 8087478 - DNA, 22 bp, Homo sapiens
cctgggcaacatagtgagacct

SEQ ID NO: 8087479 - DNA, 22 bp, Homo sapiens
cctggtggacagcagccagcag

SEQ ID NO: 8087480 - DNA, 21 bp, Homo sapiens
cctggttcaagtgatgcccct

SEQ ID NO: 8087481 - DNA, 21 bp, Homo sapiens
cctggttggcgtagctcagtc

SEQ ID NO: 8087482 - DNA, 22 bp, Homo sapiens
cctgggctggagtacagcagtg

SEQ ID NO: 8087483 - DNA, 22 bp, Homo sapiens
cctgtgccctgccaggctggtg

SEQ ID NO: 8087484 - DNA, 20 bp, Homo sapiens
cctttagaaactcatatgta

SEQ ID NO: 8087485 - DNA, 20 bp, Homo sapiens
ttactaatctcaatgacctg

SEQ ID NO: 8087486 - DNA, 21 bp, Homo sapiens
ccttctccacagggtctccgg

SEQ ID NO: 8087487 - DNA, 22 bp, Homo sapiens
ccttcccatgcagcctgtctga

SEQ ID NO: 8087488 - DNA, 22 bp, Homo sapiens
ccttccccaggtgctcactgtc

SEQ ID NO: 8087489 - DNA, 19 bp, Homo sapiens
ccttcctccccagggccat

SEQ ID NO: 8087490 - DNA, 22 bp, Homo sapiens
ctgacatttactgagcacttac

SEQ ID NO: 8087491 - DNA, 22 bp, Homo sapiens
ctgacctgctaagcccctgtcc

SEQ ID NO: 8087492 - DNA, 22 bp, Homo sapiens
ctgagccataagggaggctggg

SEQ ID NO: 8087493 - DNA, 22 bp, Homo sapiens
ctgagccagtagtcagggacaa

SEQ ID NO: 8087494 - DNA, 22 bp, Homo sapiens
ctgagcccgggtgctctacccc

SEQ ID NO: 8087495 - DNA, 22 bp, Homo sapiens
ctgcacagcctgtctgggggcc

SEQ ID NO: 8087496 - DNA, 22 bp, Homo sapiens
ctgaggccagctgcagagctct

SEQ ID NO: 8087497 - DNA, 17 bp, Homo sapiens
ctgaggcccagggccca

SEQ ID NO: 8087498 - DNA, 22 bp, Homo sapiens
ctgcagggcttaccttgctctg

SEQ ID NO: 8087499 - DNA, 22 bp, Homo sapiens
ttttcagtaatgtctacataat

SEQ ID NO: 8087500 - DNA, 22 bp, Homo sapiens
ttttcagtggcttgcatatgtt

SEQ ID NO: 8087501 - DNA, 22 bp, Homo sapiens
ttttcagtgggcaatgatgtga

SEQ ID NO: 8087502 - DNA, 22 bp, Homo sapiens
ttttcagaggcctaagaggttt

SEQ ID NO: 8087503 - DNA, 22 bp, Homo sapiens
ctcttcttgctagactgagtgc

SEQ ID NO: 8087504 - DNA, 22 bp, Homo sapiens
ctcttcttgcctgatgaggcag

SEQ ID NO: 8087505 - DNA, 22 bp, Homo sapiens
ttttcagttatagaatggtaga

SEQ ID NO: 8087506 - DNA, 20 bp, Homo sapiens
ctcttcaaatattttattct

SEQ ID NO: 8087507 - DNA, 22 bp, Homo sapiens
ttttaatactgctattgtagga

SEQ ID NO: 8087508 - DNA, 19 bp, Homo sapiens
ctctgcctctggctgtggc

SEQ ID NO: 8087509 - DNA, 22 bp, Homo sapiens
ctctgcctcccaggttcaagcg

SEQ ID NO: 8087510 - DNA, 19 bp, Homo sapiens
ctctgcctccctcctgggt

SEQ ID NO: 8087511 - DNA, 22 bp, Homo sapiens
ctctgcctcagtgatttcttta

SEQ ID NO: 8087512 - DNA, 22 bp, Homo sapiens
ctccaaggttttccctgtcctt

SEQ ID NO: 8087513 - DNA, 22 bp, Homo sapiens
ctccacagcccctccagtggca

SEQ ID NO: 8087514 - DNA, 22 bp, Homo sapiens
ctccaagggtcttccaccagga

SEQ ID NO: 8087515 - DNA, 22 bp, Homo sapiens
ctccaaggaagccccaagggat

SEQ ID NO: 8087516 - DNA, 22 bp, Homo sapiens
ctccaccacacatctgtccacc

SEQ ID NO: 8087517 - DNA, 22 bp, Homo sapiens
ttcttttcctacacagcgattt

SEQ ID NO: 8087518 - DNA, 22 bp, Homo sapiens
ttgaaatactgcattgttcagt

SEQ ID NO: 8087519 - DNA, 22 bp, Homo sapiens
ctccatggctttcgcatctgca

SEQ ID NO: 8087520 - DNA, 22 bp, Homo sapiens
ctcccaggactggctctaactg

SEQ ID NO: 8087521 - DNA, 22 bp, Homo sapiens
ctcccaggactcagaggagaag

SEQ ID NO: 8087522 - DNA, 22 bp, Homo sapiens
ctcccaaggggtaagggagctg

SEQ ID NO: 8087523 - DNA, 22 bp, Homo sapiens
ctcccagggccatcgagtcact

SEQ ID NO: 8087524 - DNA, 22 bp, Homo sapiens
ctcccaggcagggctgcccact

SEQ ID NO: 8087525 - DNA, 22 bp, Homo sapiens
ctcccaggccatgctctagcca

SEQ ID NO: 8087526 - DNA, 22 bp, Homo sapiens
ctcccaggcacagggaggagcc

SEQ ID NO: 8087527 - DNA, 22 bp, Homo sapiens
tttaatatctcacacttccatg

SEQ ID NO: 8087528 - DNA, 22 bp, Homo sapiens
tttaatatctcacacttccatg

SEQ ID NO: 8087529 - DNA, 22 bp, Homo sapiens
tttagtctgactattacctcca

SEQ ID NO: 8087530 - DNA, 22 bp, Homo sapiens
ctcccctccttaggtcttctag

SEQ ID NO: 8087531 - DNA, 20 bp, Homo sapiens
ctcccctctacagagggctg

SEQ ID NO: 8087532 - DNA, 22 bp, Homo sapiens
ctcccgcaggagcagctcgcag

SEQ ID NO: 8087533 - DNA, 21 bp, Homo sapiens
tttagagaatactcactattt

SEQ ID NO: 8087534 - DNA, 22 bp, Homo sapiens
tttatttaccttatgtcctcca

SEQ ID NO: 8087535 - DNA, 22 bp, Homo sapiens
tttatttaaagtcgtgtgttaa

SEQ ID NO: 8087536 - DNA, 22 bp, Homo sapiens
tttatttaaagtcgtgtgttaa

SEQ ID NO: 8087537 - DNA, 22 bp, Homo sapiens
ctcctccagtgggtccctcagg

SEQ ID NO: 8087538 - DNA, 22 bp, Homo sapiens
ctcctccagctctccctggggg

SEQ ID NO: 8087539 - DNA, 20 bp, Homo sapiens
tttcacagtccctgtttcct

SEQ ID NO: 8087540 - DNA, 22 bp, Homo sapiens
tttccagagcatgtctgctcag

SEQ ID NO: 8087541 - DNA, 22 bp, Homo sapiens
tttcctaggagattgatcacat

SEQ ID NO: 8087542 - DNA, 21 bp, Homo sapiens
tttcacaaaagtatgtgacaa

SEQ ID NO: 8087543 - DNA, 22 bp, Homo sapiens
tttcacaggtaagcaatacagg

SEQ ID NO: 8087544 - DNA, 22 bp, Homo sapiens
tttcacaaatgtctttaacttg

SEQ ID NO: 8087545 - DNA, 22 bp, Homo sapiens
tttcctagttctaagaaatgta

SEQ ID NO: 8087546 - DNA, 17 bp, Homo sapiens
ctctccttcctctgagg

SEQ ID NO: 8087547 - DNA, 22 bp, Homo sapiens
catttattgagtggccacagtg

SEQ ID NO: 8087548 - DNA, 18 bp, Homo sapiens
tccctggggctgccaccc

SEQ ID NO: 8087549 - DNA, 22 bp, Homo sapiens
tccctggggtatcgctgaggca

SEQ ID NO: 8087550 - DNA, 22 bp, Homo sapiens
tccctgggtcctgcttgctctc

SEQ ID NO: 8087551 - DNA, 22 bp, Homo sapiens
tccctcctgcatgaggctcggc

SEQ ID NO: 8087552 - DNA, 22 bp, Homo sapiens
tcccactcccaggcaggcctct

SEQ ID NO: 8087553 - DNA, 22 bp, Homo sapiens
cattgttatagcattacacacc

SEQ ID NO: 8087554 - DNA, 22 bp, Homo sapiens
cattgttaattggtatcttaca

SEQ ID NO: 8087555 - DNA, 22 bp, Homo sapiens
cattcatttatgaaatatctat

SEQ ID NO: 8087556 - DNA, 17 bp, Homo sapiens
cattctgtaatctttct

SEQ ID NO: 8087557 - DNA, 22 bp, Homo sapiens
cattcttacacaatattttaat

SEQ ID NO: 8087558 - DNA, 22 bp, Homo sapiens
cattctgtgattctaaatccct

SEQ ID NO: 8087559 - DNA, 22 bp, Homo sapiens
cattcttatatttactcattca

SEQ ID NO: 8087560 - DNA, 22 bp, Homo sapiens
tccaggagcatccaggtgaagc

SEQ ID NO: 8087561 - DNA, 22 bp, Homo sapiens
catgggaggcctgctgctggtg

SEQ ID NO: 8087562 - DNA, 21 bp, Homo sapiens
tccaggagcacgggactagga

SEQ ID NO: 8087563 - DNA, 23 bp, Homo sapiens
catgggagtgagaatgccagctc

SEQ ID NO: 8087564 - DNA, 22 bp, Homo sapiens
catgggcagaagtggcatcatt

SEQ ID NO: 8087565 - DNA, 22 bp, Homo sapiens
catgggaggtctgcaaggtgct

SEQ ID NO: 8087566 - DNA, 22 bp, Homo sapiens
tccaggagaggtgtggggactg

SEQ ID NO: 8087567 - DNA, 22 bp, Homo sapiens
tccattttagaagaaaatccac

SEQ ID NO: 8087568 - DNA, 22 bp, Homo sapiens
tccattttagagatgaagaaac

SEQ ID NO: 8087569 - DNA, 22 bp, Homo sapiens
catgggccatggtgaagccagg

SEQ ID NO: 8087570 - DNA, 22 bp, Homo sapiens
catgggcccgtgagaggcaggg

SEQ ID NO: 8087571 - DNA, 22 bp, Homo sapiens
tctaagtttggtgattaccaat

SEQ ID NO: 8087572 - DNA, 22 bp, Homo sapiens
ccactgtgtccaccaggaatgc

SEQ ID NO: 8087573 - DNA, 22 bp, Homo sapiens
ccactgtggaaagcagttcaga

SEQ ID NO: 8087574 - DNA, 22 bp, Homo sapiens
ccactgtgcccagcctcatggg

SEQ ID NO: 8087575 - DNA, 22 bp, Homo sapiens
ccactgtgagcatgaacaggac

SEQ ID NO: 8087576 - DNA, 20 bp, Homo sapiens
tccttccctctctttttgca

SEQ ID NO: 8087577 - DNA, 19 bp, Homo sapiens
tccttccccccagcacaga

SEQ ID NO: 8087578 - DNA, 21 bp, Homo sapiens
tccttcccccttggcctggga

SEQ ID NO: 8087579 - DNA, 22 bp, Homo sapiens
tccttccccctcaagagaactt

SEQ ID NO: 8087580 - DNA, 22 bp, Homo sapiens
tccttcccaggtgtcgccgcct

SEQ ID NO: 8087581 - DNA, 22 bp, Homo sapiens
tcctacagatactaaggagatc

SEQ ID NO: 8087582 - DNA, 22 bp, Homo sapiens
tcctggcactttgggggctcgc

SEQ ID NO: 8087583 - DNA, 18 bp, Homo sapiens
ccaaggcccctgctgggg

SEQ ID NO: 8087584 - DNA, 22 bp, Homo sapiens
tcctgggactttcaaggctagg

SEQ ID NO: 8087585 - DNA, 22 bp, Homo sapiens
tcctgggcttaagtgatcctcc

SEQ ID NO: 8087586 - DNA, 22 bp, Homo sapiens
ccacactgaacctcagtgtctt

SEQ ID NO: 8087587 - DNA, 22 bp, Homo sapiens
ccacactgtctaacaaggcata

SEQ ID NO: 8087588 - DNA, 22 bp, Homo sapiens
ccacagaaaataaagcacgatt

SEQ ID NO: 8087589 - DNA, 22 bp, Homo sapiens
ccacactgaccagctgtgagac

SEQ ID NO: 8087590 - DNA, 22 bp, Homo sapiens
tcctggcagcccgcaggtgctg

SEQ ID NO: 8087591 - DNA, 22 bp, Homo sapiens
tcctggcagggaacttgtcagc

SEQ ID NO: 8087592 - DNA, 22 bp, Homo sapiens
tcagagcaacttttcctgcttt

SEQ ID NO: 8087593 - DNA, 22 bp, Homo sapiens
tcaatatattccatgttttctc

SEQ ID NO: 8087594 - DNA, 22 bp, Homo sapiens
tcaatatagcagtgtacttgag

SEQ ID NO: 8087595 - DNA, 22 bp, Homo sapiens
cagttcttaataccatgtggtt

SEQ ID NO: 8087596 - DNA, 22 bp, Homo sapiens
cagttcttatttggccagtgtc

SEQ ID NO: 8087597 - DNA, 22 bp, Homo sapiens
cagttctttgtggggagttctc

SEQ ID NO: 8087598 - DNA, 22 bp, Homo sapiens
tcagatccgagtgtgccaagga

SEQ ID NO: 8087599 - DNA, 22 bp, Homo sapiens
tcagggagaggtgagagcctgt

SEQ ID NO: 8087600 - DNA, 22 bp, Homo sapiens
catagaatggattgacaagatt

SEQ ID NO: 8087601 - DNA, 22 bp, Homo sapiens
catagaatgcagcaggaaagtt

SEQ ID NO: 8087602 - DNA, 22 bp, Homo sapiens
catagaatcatagcacatttga

SEQ ID NO: 8087603 - DNA, 22 bp, Homo sapiens
tcaggcctcagcagcccacagg

SEQ ID NO: 8087604 - DNA, 22 bp, Homo sapiens
cataatatctccgattacttgc

SEQ ID NO: 8087605 - DNA, 22 bp, Homo sapiens
tcagcaggtggtgggcaggtga

SEQ ID NO: 8087606 - DNA, 22 bp, Homo sapiens
tcagcaggtgctttgtttactc

SEQ ID NO: 8087607 - DNA, 22 bp, Homo sapiens
tcagcaggtgcctcagattctt

SEQ ID NO: 8087608 - DNA, 22 bp, Homo sapiens
tcagcagggtttgacttctaat

SEQ ID NO: 8087609 - DNA, 22 bp, Homo sapiens
tcagcaggtctgaggcggggcc

SEQ ID NO: 8087610 - DNA, 22 bp, Homo sapiens
tcagcaggtgaacatcatgcca

SEQ ID NO: 8087611 - DNA, 22 bp, Homo sapiens
tcagtccataggtgggcctgag

SEQ ID NO: 8087612 - DNA, 22 bp, Homo sapiens
tcagggaggtgtctgccagaga

SEQ ID NO: 8087613 - DNA, 22 bp, Homo sapiens
tcagggagcctggacttcaagg

SEQ ID NO: 8087614 - DNA, 22 bp, Homo sapiens
tcagggagatttggggactcaa

SEQ ID NO: 8087615 - DNA, 22 bp, Homo sapiens
tcagggagggacctgaggctgg

SEQ ID NO: 8087616 - DNA, 22 bp, Homo sapiens
catgaagctcttgcacctctag

SEQ ID NO: 8087617 - DNA, 22 bp, Homo sapiens
catgaacattcagaaatacagc

SEQ ID NO: 8087618 - DNA, 22 bp, Homo sapiens
catgaacaccaggcatgaacaa

SEQ ID NO: 8087619 - DNA, 22 bp, Homo sapiens
catgcaggtgaccaggtgtggg

SEQ ID NO: 8087620 - DNA, 22 bp, Homo sapiens
catgcagggagcagaggagaca

SEQ ID NO: 8087621 - DNA, 22 bp, Homo sapiens
catgcaggcctatggagcagtg

SEQ ID NO: 8087622 - DNA, 22 bp, Homo sapiens
catggcaggcttcttcagcctt

SEQ ID NO: 8087623 - DNA, 22 bp, Homo sapiens
catggcagctttgggaggagga

SEQ ID NO: 8087624 - DNA, 22 bp, Homo sapiens
taatacagaagtgtattaaaat

SEQ ID NO: 8087625 - DNA, 21 bp, Homo sapiens
taataattccactacagagta

SEQ ID NO: 8087626 - DNA, 22 bp, Homo sapiens
caggcagcagaggagtgtggga

SEQ ID NO: 8087627 - DNA, 22 bp, Homo sapiens
caggcaccagtgagaagggcct

SEQ ID NO: 8087628 - DNA, 22 bp, Homo sapiens
caggcaccctctgaggggaagc

SEQ ID NO: 8087629 - DNA, 22 bp, Homo sapiens
caggccagtgggaaatagggat

SEQ ID NO: 8087630 - DNA, 19 bp, Homo sapiens
caggccagtgtcagggggc

SEQ ID NO: 8087631 - DNA, 19 bp, Homo sapiens
caggccagtgtcagggggc

SEQ ID NO: 8087632 - DNA, 22 bp, Homo sapiens
caggccagggttgagaagagaa

SEQ ID NO: 8087633 - DNA, 22 bp, Homo sapiens
caggccaggtgctctagaatca

SEQ ID NO: 8087634 - DNA, 22 bp, Homo sapiens
taatcacatcagggtaaatggg

SEQ ID NO: 8087635 - DNA, 22 bp, Homo sapiens
taatgtgaagacataaatcaga

SEQ ID NO: 8087636 - DNA, 22 bp, Homo sapiens
taatgttacactgcatggttca

SEQ ID NO: 8087637 - DNA, 22 bp, Homo sapiens
taatgtcagcatagtttatttt

SEQ ID NO: 8087638 - DNA, 22 bp, Homo sapiens
taatgtcaaggtgatagatttg

SEQ ID NO: 8087639 - DNA, 22 bp, Homo sapiens
caggcagggagctggaaaggat

SEQ ID NO: 8087640 - DNA, 22 bp, Homo sapiens
caggcatgatcataggagttta

SEQ ID NO: 8087641 - DNA, 22 bp, Homo sapiens
caggcctcttccatgcagcagc

SEQ ID NO: 8087642 - DNA, 22 bp, Homo sapiens
caggcccagggagggagaccaa

SEQ ID NO: 8087643 - DNA, 18 bp, Homo sapiens
tactttattccccctcca

SEQ ID NO: 8087644 - DNA, 22 bp, Homo sapiens
tactgtggtaacattttaaatt

SEQ ID NO: 8087645 - DNA, 22 bp, Homo sapiens
tactgtggggatattgattgta

SEQ ID NO: 8087646 - DNA, 22 bp, Homo sapiens
tactgtggttactgctattaga

SEQ ID NO: 8087647 - DNA, 22 bp, Homo sapiens
caggctagattggggccagtag

SEQ ID NO: 8087648 - DNA, 18 bp, Homo sapiens
tactgtggatcaggggtt

SEQ ID NO: 8087649 - DNA, 18 bp, Homo sapiens
tactgtggatcaggggtt

SEQ ID NO: 8087650 - DNA, 22 bp, Homo sapiens
tactgtgggatgttgtgattag

SEQ ID NO: 8087651 - DNA, 22 bp, Homo sapiens
tactgtgggatgttgtgattag

SEQ ID NO: 8087652 - DNA, 22 bp, Homo sapiens
tacatttcctgtcagagatata

SEQ ID NO: 8087653 - DNA, 22 bp, Homo sapiens
caggcgggacgtgggaggatca

SEQ ID NO: 8087654 - DNA, 22 bp, Homo sapiens
tacatttcagagctcctctctg

SEQ ID NO: 8087655 - DNA, 22 bp, Homo sapiens
caggctgccaaggctggggagg

SEQ ID NO: 8087656 - DNA, 22 bp, Homo sapiens
caggctgccaaggctggggagg

SEQ ID NO: 8087657 - DNA, 22 bp, Homo sapiens
caggctgcagtgcagtggctat

SEQ ID NO: 8087658 - DNA, 22 bp, Homo sapiens
caggctggagttcagtggtgtg

SEQ ID NO: 8087659 - DNA, 22 bp, Homo sapiens
caggctggagtgcagtggtgcc

SEQ ID NO: 8087660 - DNA, 22 bp, Homo sapiens
tagaaacaaaatctgatgactc

SEQ ID NO: 8087661 - DNA, 22 bp, Homo sapiens
tagaaacaagggagaggattct

SEQ ID NO: 8087662 - DNA, 22 bp, Homo sapiens
cagggaaactaggaaataagct

SEQ ID NO: 8087663 - DNA, 22 bp, Homo sapiens
cagggaaactaggaaataagct

SEQ ID NO: 8087664 - DNA, 22 bp, Homo sapiens
cagggctcttccggagcaggga

SEQ ID NO: 8087665 - DNA, 22 bp, Homo sapiens
cagggctgaactgagcttgtga

SEQ ID NO: 8087666 - DNA, 22 bp, Homo sapiens
cagggctgaaatcaaggtgtag

SEQ ID NO: 8087667 - DNA, 22 bp, Homo sapiens
cagggctgtaaattagtgctga

SEQ ID NO: 8087668 - DNA, 22 bp, Homo sapiens
cagggctgtggctttgtgctgt

SEQ ID NO: 8087669 - DNA, 22 bp, Homo sapiens
cagggctgtggaaaactggtgc

SEQ ID NO: 8087670 - DNA, 22 bp, Homo sapiens
caggggcttaagtgacagaagg

SEQ ID NO: 8087671 - DNA, 22 bp, Homo sapiens
cagggggctgtggctgtccagt

SEQ ID NO: 8087672 - DNA, 22 bp, Homo sapiens
cagggtggggctggctatcaaa

SEQ ID NO: 8087673 - DNA, 22 bp, Homo sapiens
tagcttccctgctggatcataa

SEQ ID NO: 8087674 - DNA, 22 bp, Homo sapiens
tagctttaaaaatcatcaaagc

SEQ ID NO: 8087675 - DNA, 22 bp, Homo sapiens
cagggctccatgcagggactcc

SEQ ID NO: 8087676 - DNA, 22 bp, Homo sapiens
cagggccatgaggcacagggtc

SEQ ID NO: 8087677 - DNA, 22 bp, Homo sapiens
cagggccattggcgtggctgtc

SEQ ID NO: 8087678 - DNA, 22 bp, Homo sapiens
cagggccaggctgatggcctgg

SEQ ID NO: 8087679 - DNA, 22 bp, Homo sapiens
cagggccactgtagatgaggag

SEQ ID NO: 8087680 - DNA, 22 bp, Homo sapiens
cagggccagttctcgcagcagt

SEQ ID NO: 8087681 - DNA, 22 bp, Homo sapiens
cagggccagttctcgcagcagt

SEQ ID NO: 8087682 - DNA, 22 bp, Homo sapiens
cagggagccccaattccatgcc

SEQ ID NO: 8087683 - DNA, 22 bp, Homo sapiens
cagggagcagcatgggcaaagg

SEQ ID NO: 8087684 - DNA, 22 bp, Homo sapiens
caggtgggtacatcacagagac

SEQ ID NO: 8087685 - DNA, 22 bp, Homo sapiens
caggtgggtacatcacagagac

SEQ ID NO: 8087686 - DNA, 22 bp, Homo sapiens
caggtggccttgccatctcctg

SEQ ID NO: 8087687 - DNA, 22 bp, Homo sapiens
caggtcagctggtgccccaggt

SEQ ID NO: 8087688 - DNA, 22 bp, Homo sapiens
caggtagctgcagagactattt

SEQ ID NO: 8087689 - DNA, 22 bp, Homo sapiens
tattttcaccatgtatccctgt

SEQ ID NO: 8087690 - DNA, 22 bp, Homo sapiens
tcaaaacaacactcaggtgtaa

SEQ ID NO: 8087691 - DNA, 22 bp, Homo sapiens
tattttacagactactttagat

SEQ ID NO: 8087692 - DNA, 22 bp, Homo sapiens
ccagggcttcagaggttttggc

SEQ ID NO: 8087693 - DNA, 22 bp, Homo sapiens
tgacagttaaggtatacattca

SEQ ID NO: 8087694 - DNA, 21 bp, Homo sapiens
tgacagtgtggcatggaaggt

SEQ ID NO: 8087695 - DNA, 22 bp, Homo sapiens
tgacagtgtcagtttcctaata

SEQ ID NO: 8087696 - DNA, 22 bp, Homo sapiens
tgacagtgtttgcacttcaggt

SEQ ID NO: 8087697 - DNA, 22 bp, Homo sapiens
tgacagtgttgggggtaaattt

SEQ ID NO: 8087698 - DNA, 22 bp, Homo sapiens
ccaggctggagtgcagtagtgt

SEQ ID NO: 8087699 - DNA, 22 bp, Homo sapiens
ccaggctggagtgcaatggtgc

SEQ ID NO: 8087700 - DNA, 22 bp, Homo sapiens
ccagggggcttggtgaggccat

SEQ ID NO: 8087701 - DNA, 22 bp, Homo sapiens
ccaggggggcgtagatgctggg

SEQ ID NO: 8087702 - DNA, 21 bp, Homo sapiens
ccagggtccagctgccatggt

SEQ ID NO: 8087703 - DNA, 22 bp, Homo sapiens
ccaggtggaaggtctgtgctct

SEQ ID NO: 8087704 - DNA, 22 bp, Homo sapiens
tgagaaggcctgtgtgacaggg

SEQ ID NO: 8087705 - DNA, 22 bp, Homo sapiens
ccaggtgtggccacatggctgg

SEQ ID NO: 8087706 - DNA, 22 bp, Homo sapiens
ccatcctggcctcgctgtccac

SEQ ID NO: 8087707 - DNA, 22 bp, Homo sapiens
ccatcctggccttgctgtccac

SEQ ID NO: 8087708 - DNA, 22 bp, Homo sapiens
ccatgctggagtccctagctgt

SEQ ID NO: 8087709 - DNA, 22 bp, Homo sapiens
tgaggtaggtggtgaaaaatga

SEQ ID NO: 8087710 - DNA, 22 bp, Homo sapiens
tgaggggaactgatgcccattg

SEQ ID NO: 8087711 - DNA, 22 bp, Homo sapiens
tgagggctgcttccagagctag

SEQ ID NO: 8087712 - DNA, 22 bp, Homo sapiens
tgagggctgacaggaggacagc

SEQ ID NO: 8087713 - DNA, 22 bp, Homo sapiens
tgagggctaaattgtggcaggt

SEQ ID NO: 8087714 - DNA, 22 bp, Homo sapiens
tgagggctaaattgtggcaggt

SEQ ID NO: 8087715 - DNA, 22 bp, Homo sapiens
tgcaaatacaaaatggtacagc

SEQ ID NO: 8087716 - DNA, 23 bp, Homo sapiens
tgcaaataacaaggagtttaagg

SEQ ID NO: 8087717 - DNA, 22 bp, Homo sapiens
tgcaaataaatttctgttcatt

SEQ ID NO: 8087718 - DNA, 22 bp, Homo sapiens
tgcaaagtcgcaaaattcttct

SEQ ID NO: 8087719 - DNA, 22 bp, Homo sapiens
tgcaaataggggacaactcttt

SEQ ID NO: 8087720 - DNA, 22 bp, Homo sapiens
ccaggaggttgaggctgcagtg

SEQ ID NO: 8087721 - DNA, 22 bp, Homo sapiens
tcttcagactccaaatgtttta

SEQ ID NO: 8087722 - DNA, 22 bp, Homo sapiens
tcttcagacccttagctgtgat

SEQ ID NO: 8087723 - DNA, 22 bp, Homo sapiens
tcttcagagtgaaagtctgtga

SEQ ID NO: 8087724 - DNA, 22 bp, Homo sapiens
tcttcagaggaagtcagtcttt

SEQ ID NO: 8087725 - DNA, 22 bp, Homo sapiens
tcttcagataaagggagagtat

SEQ ID NO: 8087726 - DNA, 22 bp, Homo sapiens
ccaggccagagtgcagtggcac

SEQ ID NO: 8087727 - DNA, 22 bp, Homo sapiens
ccaggcaggctagaatgtaaat

SEQ ID NO: 8087728 - DNA, 22 bp, Homo sapiens
ccaggcagggagctgtttggcc

SEQ ID NO: 8087729 - DNA, 22 bp, Homo sapiens
tcttccctaatcaccatcttca

SEQ ID NO: 8087730 - DNA, 22 bp, Homo sapiens
ccaggctctgtctggtcagaag

SEQ ID NO: 8087731 - DNA, 22 bp, Homo sapiens
ccaggctctgtgtgggctagag

SEQ ID NO: 8087732 - DNA, 22 bp, Homo sapiens
ccaggctctgttccccgaggag

SEQ ID NO: 8087733 - DNA, 23 bp, Homo sapiens
ccaggctctttcacctgctattc

SEQ ID NO: 8087734 - DNA, 22 bp, Homo sapiens
ccaggctgctgttggtgtccgc

SEQ ID NO: 8087735 - DNA, 22 bp, Homo sapiens
ccaggccattcccagagttgct

SEQ ID NO: 8087736 - DNA, 22 bp, Homo sapiens
ccagagagaaatggatttgagt

SEQ ID NO: 8087737 - DNA, 22 bp, Homo sapiens
tctcagagaacagttggtgctt

SEQ ID NO: 8087738 - DNA, 22 bp, Homo sapiens
tctcagagaaatgtgtcaccat

SEQ ID NO: 8087739 - DNA, 22 bp, Homo sapiens
ccagctctgcagggcctggggt

SEQ ID NO: 8087740 - DNA, 22 bp, Homo sapiens
ccaggacacgatttttagtctg

SEQ ID NO: 8087741 - DNA, 22 bp, Homo sapiens
ccaggacactgcttcacagcag

SEQ ID NO: 8087742 - DNA, 22 bp, Homo sapiens
ccaggacaggagttggcttcgc

SEQ ID NO: 8087743 - DNA, 18 bp, Homo sapiens
ccaggacaggcaaaaggt

SEQ ID NO: 8087744 - DNA, 22 bp, Homo sapiens
tctggtgtcagtattctttgaa

SEQ ID NO: 8087745 - DNA, 22 bp, Homo sapiens
cccggacagaggggcagagtgt

SEQ ID NO: 8087746 - DNA, 22 bp, Homo sapiens
cccgagtgtctactcactccca

SEQ ID NO: 8087747 - DNA, 22 bp, Homo sapiens
tgctgggcacacagtaggtgct

SEQ ID NO: 8087748 - DNA, 22 bp, Homo sapiens
tgctggcctcggcgctgggcct

SEQ ID NO: 8087749 - DNA, 22 bp, Homo sapiens
tgctggcctgggctgcaccttg

SEQ ID NO: 8087750 - DNA, 22 bp, Homo sapiens
cccaggtctccctgcagccctg

SEQ ID NO: 8087751 - DNA, 22 bp, Homo sapiens
cccaggtcccggggccagctgc

SEQ ID NO: 8087752 - DNA, 23 bp, Homo sapiens
cccaggtcaaaattcacaggcct

SEQ ID NO: 8087753 - DNA, 22 bp, Homo sapiens
cccaggtcccgccccagctcta

SEQ ID NO: 8087754 - DNA, 22 bp, Homo sapiens
ccccacagcttgtggagagaat

SEQ ID NO: 8087755 - DNA, 22 bp, Homo sapiens
ccccacagtccgtgaggagcca

SEQ ID NO: 8087756 - DNA, 22 bp, Homo sapiens
ccccacagccgccagcagggag

SEQ ID NO: 8087757 - DNA, 21 bp, Homo sapiens
tgctggccatgtgctgggcat

SEQ ID NO: 8087758 - DNA, 22 bp, Homo sapiens
ccctctcctggctgcatggagc

SEQ ID NO: 8087759 - DNA, 22 bp, Homo sapiens
ccctctccctgcagaatgtggc

SEQ ID NO: 8087760 - DNA, 19 bp, Homo sapiens
ccctcttgcacaaagcaaa

SEQ ID NO: 8087761 - DNA, 22 bp, Homo sapiens
ccctcgggtcgcggactgcgct

SEQ ID NO: 8087762 - DNA, 22 bp, Homo sapiens
ccctcctgtgcctgaggccagc

SEQ ID NO: 8087763 - DNA, 22 bp, Homo sapiens
ccctcctggaggcggatgccca

SEQ ID NO: 8087764 - DNA, 22 bp, Homo sapiens
ccctcctggaggcggatgccca

SEQ ID NO: 8087765 - DNA, 22 bp, Homo sapiens
tgctgtggattcagagatgaaa

SEQ ID NO: 8087766 - DNA, 23 bp, Homo sapiens
tgctgtgcctttgtctgcctcca

SEQ ID NO: 8087767 - DNA, 18 bp, Homo sapiens
cccggctaatttttggta

SEQ ID NO: 8087768 - DNA, 22 bp, Homo sapiens
tgctgtggttcccagagtggat

SEQ ID NO: 8087769 - DNA, 19 bp, Homo sapiens
cccaggctacatggagagg

SEQ ID NO: 8087770 - DNA, 22 bp, Homo sapiens
cccaggctagtatgatatcagt

SEQ ID NO: 8087771 - DNA, 22 bp, Homo sapiens
cccagggacagatgggcagcta

SEQ ID NO: 8087772 - DNA, 17 bp, Homo sapiens
cccagggaccactgctt

SEQ ID NO: 8087773 - DNA, 22 bp, Homo sapiens
tgccttcctggagctgaaggct

SEQ ID NO: 8087774 - DNA, 20 bp, Homo sapiens
cccaggggttgtggtgagga

SEQ ID NO: 8087775 - DNA, 22 bp, Homo sapiens
cccagggaaggcagatggagga

SEQ ID NO: 8087776 - DNA, 22 bp, Homo sapiens
cccagggaaggcagatggagga

SEQ ID NO: 8087777 - DNA, 23 bp, Homo sapiens
cccagggacacgatgacacctcc

SEQ ID NO: 8087778 - DNA, 22 bp, Homo sapiens
cccaggctggcactgctgaagt

SEQ ID NO: 8087779 - DNA, 22 bp, Homo sapiens
cccaggctggagggcagtgtca

SEQ ID NO: 8087780 - DNA, 22 bp, Homo sapiens
cctcagaggtgtggcatctctg

SEQ ID NO: 8087781 - DNA, 22 bp, Homo sapiens
cctcagaaggacaagagacaaa

SEQ ID NO: 8087782 - DNA, 22 bp, Homo sapiens
cctagagctctgctttatctaa

SEQ ID NO: 8087783 - DNA, 22 bp, Homo sapiens
cccttcctcctcgcctgtcaga

SEQ ID NO: 8087784 - DNA, 22 bp, Homo sapiens
ccctgtggtgacaggcctgtct

SEQ ID NO: 8087785 - DNA, 22 bp, Homo sapiens
cccttcctggagtaccctctgt

SEQ ID NO: 8087786 - DNA, 22 bp, Homo sapiens
tggcctggggaagaccatgggc

SEQ ID NO: 8087787 - DNA, 22 bp, Homo sapiens
tggcctggggacctgtgagacc

SEQ ID NO: 8087788 - DNA, 22 bp, Homo sapiens
cctccaaccataggtccagggg

SEQ ID NO: 8087789 - DNA, 22 bp, Homo sapiens
cctcagggactccatgctgcag

SEQ ID NO: 8087790 - DNA, 18 bp, Homo sapiens
cctcagggagatccagtg

SEQ ID NO: 8087791 - DNA, 22 bp, Homo sapiens
tggcccagagcactgctgggca

SEQ ID NO: 8087792 - DNA, 22 bp, Homo sapiens
cctcagggacgggatcacttgg

SEQ ID NO: 8087793 - DNA, 22 bp, Homo sapiens
cctcttccagctgttgcttcca

SEQ ID NO: 8087794 - DNA, 22 bp, Homo sapiens
tggctggctgtccagctgggca

SEQ ID NO: 8087795 - DNA, 22 bp, Homo sapiens
tggctggctagtgggcaggatt

SEQ ID NO: 8087796 - DNA, 18 bp, Homo sapiens
tgggagtgggagtggata

SEQ ID NO: 8087797 - DNA, 22 bp, Homo sapiens
tgggagtggggcatagaaggta

SEQ ID NO: 8087798 - DNA, 22 bp, Homo sapiens
cctcttcctcaccatctacaac

SEQ ID NO: 8087799 - DNA, 17 bp, Homo sapiens
cctcttcctctcagctg

SEQ ID NO: 8087800 - DNA, 19 bp, Homo sapiens
cctcttcctctgacactat

SEQ ID NO: 8087801 - DNA, 22 bp, Homo sapiens
cctcttccttctcactgtggaa

SEQ ID NO: 8087802 - DNA, 22 bp, Homo sapiens
cctcttcctgcactgacatttt

SEQ ID NO: 8087803 - DNA, 22 bp, Homo sapiens
cctgagccaagagtcagaatct

SEQ ID NO: 8087804 - DNA, 22 bp, Homo sapiens
cctgagcctgagtggtgcaggg

SEQ ID NO: 8087805 - DNA, 22 bp, Homo sapiens
tgggctggcccaccacacctcg

SEQ ID NO: 8087806 - DNA, 22 bp, Homo sapiens
cctgagctgactctcctttcag

SEQ ID NO: 8087807 - DNA, 22 bp, Homo sapiens
tgggcccaagtgcaatgcagtg

SEQ ID NO: 8087808 - DNA, 22 bp, Homo sapiens
tgggcccatcattgctgtgggc

SEQ ID NO: 8087809 - DNA, 21 bp, Homo sapiens
tgggcccagttcccgctgggc

SEQ ID NO: 8087810 - DNA, 23 bp, Homo sapiens
tcccctcaggcagccagtgccct

SEQ ID NO: 8087811 - DNA, 22 bp, Homo sapiens
tcccctcccttccaacagagct

SEQ ID NO: 8087812 - DNA, 22 bp, Homo sapiens
tgtggcagtataagagctagaa

SEQ ID NO: 8087813 - DNA, 22 bp, Homo sapiens
tgtggccaggcccctgatggtg

SEQ ID NO: 8087814 - DNA, 22 bp, Homo sapiens
tgtggccagccacaggcatggt

SEQ ID NO: 8087815 - DNA, 22 bp, Homo sapiens
tgtggcccagatgagtgtgcta

SEQ ID NO: 8087816 - DNA, 22 bp, Homo sapiens
tgtggcagaactgggactcaaa

SEQ ID NO: 8087817 - DNA, 22 bp, Homo sapiens
tgtggcagaactgggactcaaa

SEQ ID NO: 8087818 - DNA, 22 bp, Homo sapiens
tgtggcagctgctgcaggagct

SEQ ID NO: 8087819 - DNA, 21 bp, Homo sapiens
tgtggcagatgttgggaggca

SEQ ID NO: 8087820 - DNA, 22 bp, Homo sapiens
tgtggcagagtaaggacccagt

SEQ ID NO: 8087821 - DNA, 22 bp, Homo sapiens
tgtgtcctgtgcaaggggatga

SEQ ID NO: 8087822 - DNA, 22 bp, Homo sapiens
tgtgtcctgtgatctctagggt

SEQ ID NO: 8087823 - DNA, 22 bp, Homo sapiens
tgtgtcctgtccccttgctgct

SEQ ID NO: 8087824 - DNA, 22 bp, Homo sapiens
tgtgtcctccagggagatgtaa

SEQ ID NO: 8087825 - DNA, 22 bp, Homo sapiens
tgtgtcctcttacctctgaccc

SEQ ID NO: 8087826 - DNA, 22 bp, Homo sapiens
tgtgtcctttcttaagagtgag

SEQ ID NO: 8087827 - DNA, 22 bp, Homo sapiens
tgtgtcctactgaggagctcct

SEQ ID NO: 8087828 - DNA, 22 bp, Homo sapiens
tgtgtcctcatgaggtttgcag

SEQ ID NO: 8087829 - DNA, 22 bp, Homo sapiens
tgtgtcctatgaaagagggtta

SEQ ID NO: 8087830 - DNA, 22 bp, Homo sapiens
tgtgtgaggtggttctgagaag

SEQ ID NO: 8087831 - DNA, 22 bp, Homo sapiens
tgtgtgagtaaggctgagagag

SEQ ID NO: 8087832 - DNA, 22 bp, Homo sapiens
tgtgtaaaagattagtttacta

SEQ ID NO: 8087833 - DNA, 22 bp, Homo sapiens
tgtggtggtaatgagccagatg

SEQ ID NO: 8087834 - DNA, 22 bp, Homo sapiens
tgtgtaaatttatttacataaa

SEQ ID NO: 8087835 - DNA, 21 bp, Homo sapiens
tgtgtaattggccaaatgcac

SEQ ID NO: 8087836 - DNA, 22 bp, Homo sapiens
tgtggtagagggcagatgggca

SEQ ID NO: 8087837 - DNA, 22 bp, Homo sapiens
tgtggcctcaaggctgccctca

SEQ ID NO: 8087838 - DNA, 19 bp, Homo sapiens
tgtggcctggggacaggcc

SEQ ID NO: 8087839 - DNA, 22 bp, Homo sapiens
tgttcaaaaatatcttctgcaa

SEQ ID NO: 8087840 - DNA, 22 bp, Homo sapiens
tgttatataacttacaacctgt

SEQ ID NO: 8087841 - DNA, 22 bp, Homo sapiens
tgtgttattgccactgaagacc

SEQ ID NO: 8087842 - DNA, 22 bp, Homo sapiens
tgtgttggtagatctgaggtct

SEQ ID NO: 8087843 - DNA, 22 bp, Homo sapiens
tgtgttggcttgcctgttaggc

SEQ ID NO: 8087844 - DNA, 22 bp, Homo sapiens
tgtgttggctgccggcacagga

SEQ ID NO: 8087845 - DNA, 22 bp, Homo sapiens
tgtgttggaaatagggtctttg

SEQ ID NO: 8087846 - DNA, 22 bp, Homo sapiens
tgtttacagggtgattttacct

SEQ ID NO: 8087847 - DNA, 22 bp, Homo sapiens
tgtttacagaaggcagacttcc

SEQ ID NO: 8087848 - DNA, 22 bp, Homo sapiens
tgtttacatgcataagcttaag

SEQ ID NO: 8087849 - DNA, 22 bp, Homo sapiens
tgtttacatggaggttttcagc

SEQ ID NO: 8087850 - DNA, 22 bp, Homo sapiens
tgtttcatgtggacatagttgt

SEQ ID NO: 8087851 - DNA, 22 bp, Homo sapiens
tgtttgaactgaataacatagt

SEQ ID NO: 8087852 - DNA, 22 bp, Homo sapiens
ttaacatacatcatgaacaatg

SEQ ID NO: 8087853 - DNA, 22 bp, Homo sapiens
ttaacatttgtgaagcatttag

SEQ ID NO: 8087854 - DNA, 22 bp, Homo sapiens
ttaacattaaaagcagcatttt

SEQ ID NO: 8087855 - DNA, 22 bp, Homo sapiens
ttaataaacaggtgcagctgaa

SEQ ID NO: 8087856 - DNA, 22 bp, Homo sapiens
ttaaatattttcagcagggtca

SEQ ID NO: 8087857 - DNA, 22 bp, Homo sapiens
ttaaatattatgttgtctgcaa

SEQ ID NO: 8087858 - DNA, 22 bp, Homo sapiens
ttaaatattatgttgtctgcaa

SEQ ID NO: 8087859 - DNA, 22 bp, Homo sapiens
ttaacaaggtgactgcattaaa

SEQ ID NO: 8087860 - DNA, 22 bp, Homo sapiens
ttaacacatatttatcaattgc

SEQ ID NO: 8087861 - DNA, 22 bp, Homo sapiens
ttaaatgctcacataaaggtag

SEQ ID NO: 8087862 - DNA, 22 bp, Homo sapiens
ttaaatgacttttattattctc

SEQ ID NO: 8087863 - DNA, 22 bp, Homo sapiens
ttaaatattttcagcagggtca

SEQ ID NO: 8087864 - DNA, 22 bp, Homo sapiens
ttacacaacatctgtattatta

SEQ ID NO: 8087865 - DNA, 22 bp, Homo sapiens
ttacatattgtctattgttcaa

SEQ ID NO: 8087866 - DNA, 23 bp, Homo sapiens
ttacagcttcagcagctaacccc

SEQ ID NO: 8087867 - DNA, 22 bp, Homo sapiens
ttacacttctaaaaaaagcagg

SEQ ID NO: 8087868 - DNA, 22 bp, Homo sapiens
ttagagccagttacaaggtcaa

SEQ ID NO: 8087869 - DNA, 22 bp, Homo sapiens
ttactgttggtgtatccatagc

SEQ ID NO: 8087870 - DNA, 22 bp, Homo sapiens
ttactgttcctctctcaaagag

SEQ ID NO: 8087871 - DNA, 22 bp, Homo sapiens
ttactgcacgtgggacatatat

SEQ ID NO: 8087872 - DNA, 22 bp, Homo sapiens
ttactgctgttaggatattttt

SEQ ID NO: 8087873 - DNA, 22 bp, Homo sapiens
ttactgtgtttggctttagatg

SEQ ID NO: 8087874 - DNA, 21 bp, Homo sapiens
ttccagagattgtttcacctg

SEQ ID NO: 8087875 - DNA, 22 bp, Homo sapiens
ttcctctgtatgctttgctgct

SEQ ID NO: 8087876 - DNA, 22 bp, Homo sapiens
ttctacaatatgaataatgaag

SEQ ID NO: 8087877 - DNA, 22 bp, Homo sapiens
ttctacaatatgaataatgaag

SEQ ID NO: 8087878 - DNA, 22 bp, Homo sapiens
ttctacaaatatttactgttcc

SEQ ID NO: 8087879 - DNA, 22 bp, Homo sapiens
ttcaacagtgatggcctttgta

SEQ ID NO: 8087880 - DNA, 22 bp, Homo sapiens
ttcaactaatgtttattttatg

SEQ ID NO: 8087881 - DNA, 22 bp, Homo sapiens
ttcaactattatgaataaaatt

SEQ ID NO: 8087882 - DNA, 22 bp, Homo sapiens
ttcaactagatttatacaattc

SEQ ID NO: 8087883 - DNA, 21 bp, Homo sapiens
ttcacaacctgctttagtggg

SEQ ID NO: 8087884 - DNA, 22 bp, Homo sapiens
ttcacaaagctggagcatttcc

SEQ ID NO: 8087885 - DNA, 22 bp, Homo sapiens
ttcacaaagctggagcatttcc

SEQ ID NO: 8087886 - DNA, 22 bp, Homo sapiens
ttcacaaaatggtttgttgatg

SEQ ID NO: 8087887 - DNA, 22 bp, Homo sapiens
ttcaatgtctatgtacatttta

SEQ ID NO: 8087888 - DNA, 22 bp, Homo sapiens
ttcagtgctaaaaagtctcaag

SEQ ID NO: 8087889 - DNA, 22 bp, Homo sapiens
ttcatgtgataaatgtgtgact

SEQ ID NO: 8087890 - DNA, 22 bp, Homo sapiens
ttcatgtgaatatatttgtctt

SEQ ID NO: 8087891 - DNA, 22 bp, Homo sapiens
ttcatgttgtagtatgtatcag

SEQ ID NO: 8087892 - DNA, 22 bp, Homo sapiens
ttcatgtgtctgtagcacatat

SEQ ID NO: 8087893 - DNA, 22 bp, Homo sapiens
ttcagtaaaacactgcaatgtc

SEQ ID NO: 8087894 - DNA, 22 bp, Homo sapiens
ttcttacagagtttacagagcc

SEQ ID NO: 8087895 - DNA, 21 bp, Homo sapiens
ttcttcttggactgttttggc

SEQ ID NO: 8087896 - DNA, 22 bp, Homo sapiens
ttcttcttgtctgccctcacat

SEQ ID NO: 8087897 - DNA, 22 bp, Homo sapiens
ttcttctttatctcagtatcct

SEQ ID NO: 8087898 - DNA, 22 bp, Homo sapiens
ttcttctttccccctgtggtac

SEQ ID NO: 8087899 - DNA, 22 bp, Homo sapiens
ttcttctttcctataattaatt

SEQ ID NO: 8087900 - DNA, 22 bp, Homo sapiens
ttcttaaaacttatggacaggt

SEQ ID NO: 8087901 - DNA, 22 bp, Homo sapiens
ttctcttttcaccagttgctaa

SEQ ID NO: 8087902 - DNA, 22 bp, Homo sapiens
ttctgacacattactacatgga

SEQ ID NO: 8087903 - DNA, 21 bp, Homo sapiens
ttctgccttcgaggtctcagg

SEQ ID NO: 8087904 - DNA, 22 bp, Homo sapiens
ttctgccttggcagggtggtcc

SEQ ID NO: 8087905 - DNA, 22 bp, Homo sapiens
ttctgccttcagtcctctgact

SEQ ID NO: 8087906 - DNA, 21 bp, Homo sapiens
ttctgccttcccctagctggg

SEQ ID NO: 8087907 - DNA, 22 bp, Homo sapiens
ttctgcctgccccagagaggcc

SEQ ID NO: 8087908 - DNA, 22 bp, Homo sapiens
ttctgcctggcaggaggactgt

SEQ ID NO: 8087909 - DNA, 22 bp, Homo sapiens
ttctgccttacgatattttcaa

SEQ ID NO: 8087910 - DNA, 23 bp, Homo sapiens
ttgatttcaaatgcagagaacac

SEQ ID NO: 8087911 - DNA, 22 bp, Homo sapiens
ttgatgttcctgtacaatctga

SEQ ID NO: 8087912 - DNA, 22 bp, Homo sapiens
ttgatgtttccccttggacatt

SEQ ID NO: 8087913 - DNA, 20 bp, Homo sapiens
ttgaggcatgtctagaagta

SEQ ID NO: 8087914 - DNA, 22 bp, Homo sapiens
ttgaagattctttttgttagta

SEQ ID NO: 8087915 - DNA, 23 bp, Homo sapiens
ttctttcaagaagttcacagtgc

SEQ ID NO: 8087916 - DNA, 22 bp, Homo sapiens
tttgcaaataccatgaaacttg

SEQ ID NO: 8087917 - DNA, 22 bp, Homo sapiens
tttgcagtagacatcttatttt

SEQ ID NO: 8087918 - DNA, 22 bp, Homo sapiens
tttgcactagcatttgtccatg

SEQ ID NO: 8087919 - DNA, 22 bp, Homo sapiens
tttggacttagcctgcagaatt

SEQ ID NO: 8087920 - DNA, 22 bp, Homo sapiens
tttgcagtgattcttgcagtga

SEQ ID NO: 8087921 - DNA, 23 bp, Homo sapiens
tttggacttgtgactcttctcct

SEQ ID NO: 8087922 - DNA, 22 bp, Homo sapiens
ttttatagctgaatagtattcc

SEQ ID NO: 8087923 - DNA, 22 bp, Homo sapiens
tttgttcacctagcaaactttt

SEQ ID NO: 8087924 - DNA, 22 bp, Homo sapiens
ttttctagggtgctaaatgaac

SEQ ID NO: 8087925 - DNA, 22 bp, Homo sapiens
tttataaacagtaccacggtgc

SEQ ID NO: 8087926 - DNA, 22 bp, Homo sapiens
tttataaaatagactgggtcta

SEQ ID NO: 8087927 - DNA, 22 bp, Homo sapiens
tttcaaacatatcttcattact

SEQ ID NO: 8087928 - DNA, 22 bp, Homo sapiens
tttcaaaattttgcagtggtaa

SEQ ID NO: 8087929 - DNA, 22 bp, Homo sapiens
tttcaaacctacttgtatgttt

SEQ ID NO: 8087930 - DNA, 22 bp, Homo sapiens
tttattatgatggacaccttcg

SEQ ID NO: 8087931 - DNA, 22 bp, Homo sapiens
tttattacaccaggttaactca

SEQ ID NO: 8087932 - DNA, 22 bp, Homo sapiens
tttattatccagtgttgtcatg

SEQ ID NO: 8087933 - DNA, 22 bp, Homo sapiens
tttaaaatttagacctctccac

SEQ ID NO: 8087934 - DNA, 22 bp, Homo sapiens
tttaaaatcagatgggagttgg

SEQ ID NO: 8087935 - DNA, 22 bp, Homo sapiens
tttaatttgtatttctagaggg

SEQ ID NO: 8087936 - DNA, 22 bp, Homo sapiens
tttaattttctgggcccagcag

SEQ ID NO: 8087937 - DNA, 22 bp, Homo sapiens
tttactcttgctacacaactgt

SEQ ID NO: 8087938 - DNA, 22 bp, Homo sapiens
tttagttattgttacagtatga

SEQ ID NO: 8087939 - DNA, 22 bp, Homo sapiens
tttactaagcccagttatatgc

SEQ ID NO: 8087940 - DNA, 22 bp, Homo sapiens
tttactaacaccatacatgctg

SEQ ID NO: 8087941 - DNA, 22 bp, Homo sapiens
ttgtgaatagtgccacaataaa

SEQ ID NO: 8087942 - DNA, 22 bp, Homo sapiens
ttggtgagtatggacacagaga

SEQ ID NO: 8087943 - DNA, 22 bp, Homo sapiens
ttggtgagcctcttagcagcag

SEQ ID NO: 8087944 - DNA, 22 bp, Homo sapiens
ttggtcctcagtttccctatct

SEQ ID NO: 8087945 - DNA, 22 bp, Homo sapiens
ttggtcctgccccctccaggtc

SEQ ID NO: 8087946 - DNA, 22 bp, Homo sapiens
ttggtcctgcagaggggtctgg

SEQ ID NO: 8087947 - DNA, 22 bp, Homo sapiens
ttgttttatctttctacagact

SEQ ID NO: 8087948 - DNA, 22 bp, Homo sapiens
ttgttataaagactaaatatgt

SEQ ID NO: 8087949 - DNA, 22 bp, Homo sapiens
ttgttagtgcaatgtttggtga

SEQ ID NO: 8087950 - DNA, 22 bp, Homo sapiens
ttgttaaaaatagatttccagg

SEQ ID NO: 8087951 - DNA, 22 bp, Homo sapiens
ttgttacatggacaactgtatg

SEQ ID NO: 8087952 - DNA, 22 bp, Homo sapiens
tttcagtggagtgacatgatct

SEQ ID NO: 8087953 - DNA, 22 bp, Homo sapiens
tttcagtgcttctgtttaccgg

SEQ ID NO: 8087954 - DNA, 22 bp, Homo sapiens
tttcagtggaccacagtttgat

SEQ ID NO: 8087955 - DNA, 22 bp, Homo sapiens
tttccaaataaggtcacactca

SEQ ID NO: 8087956 - DNA, 22 bp, Homo sapiens
tttccaaaggtggcaggaacaa

SEQ ID NO: 8087957 - DNA, 22 bp, Homo sapiens
tttccaaaggaggaaccagttt

SEQ ID NO: 8087958 - DNA, 22 bp, Homo sapiens
tttcaaagaccattaactatca

SEQ ID NO: 8087959 - DNA, 22 bp, Homo sapiens
tttcaaagagttgtaaattact

SEQ ID NO: 8087960 - DNA, 22 bp, Homo sapiens
tttcagtgcacgtagtttattt

SEQ ID NO: 8087961 - DNA, 22 bp, Homo sapiens
tttcagtgcccagagctttgca

SEQ ID NO: 8087962 - DNA, 22 bp, Homo sapiens
tttcagtgaaagctactgttag

SEQ ID NO: 8087963 - DNA, 22 bp, Homo sapiens
tttctacatgttttctattgaa

SEQ ID NO: 8087964 - DNA, 20 bp, Homo sapiens
tttctgtgcccaggtctgtt

SEQ ID NO: 8087965 - DNA, 20 bp, Homo sapiens
tttctgtgagaaacactgtt

SEQ ID NO: 8087966 - DNA, 22 bp, Homo sapiens
tttcttcattcaccttcacccc

SEQ ID NO: 8087967 - DNA, 22 bp, Homo sapiens
tttcttcatagaccttgtcttg

SEQ ID NO: 8087968 - DNA, 22 bp, Homo sapiens
tttcttcagccttcacaacctg

SEQ ID NO: 8087969 - DNA, 22 bp, Homo sapiens
tttcttcagccttcacaacctg

SEQ ID NO: 8087970 - DNA, 22 bp, Homo sapiens
tttcttcaattgctaacaagga

SEQ ID NO: 8087971 - DNA, 22 bp, Homo sapiens
tttcttcacagggtattgggtg

SEQ ID NO: 8087972 - DNA, 23 bp, Homo sapiens
tttcttcagaagccttgcgaggc

SEQ ID NO: 8087973 - DNA, 21 bp, Homo sapiens
tttcttcactttgccccatgt

SEQ ID NO: 8087974 - DNA, 22 bp, Homo sapiens
tttcttcagagagagctttccc

SEQ ID NO: 8087975 - DNA, 22 bp, Homo sapiens
tttcttcagccactccaaactg

SEQ ID NO: 8087976 - DNA, 22 bp, Homo sapiens
tttctgaacttggtactggagc

SEQ ID NO: 8087977 - DNA, 22 bp, Homo sapiens
tttctctgggctgttggcagcc

SEQ ID NO: 8087978 - DNA, 22 bp, Homo sapiens
tttctcctgtgaggtcagaagt

SEQ ID NO: 8087979 - DNA, 22 bp, Homo sapiens
tttctcctgtgtaagccgccca

SEQ ID NO: 8087980 - DNA, 17 bp, Homo sapiens
tttctccttccatctca

SEQ ID NO: 8087981 - DNA, 22 bp, Homo sapiens
tttctcctgagttccacgctac

SEQ ID NO: 8087982 - DNA, 22 bp, Homo sapiens
tttctcctgctagaacaaggag

SEQ ID NO: 8087983 - DNA, 22 bp, Homo sapiens
tttctcctgctagaacaaggag

SEQ ID NO: 8087984 - DNA, 22 bp, Homo sapiens
tttctgaaggttaaggaattag

SEQ ID NO: 8087985 - DNA, 22 bp, Homo sapiens
tttctgaataactctatgatat

SEQ ID NO: 8087986 - DNA, 23 bp, Homo sapiens
tttctgaagttgagatggacttt

SEQ ID NO: 8087987 - DNA, 21 bp, Homo sapiens
cactcagggtatgtgccaggc

SEQ ID NO: 8087988 - DNA, 22 bp, Homo sapiens
cactatgtgcattgttttctcc

SEQ ID NO: 8087989 - DNA, 21 bp, Homo sapiens
cactctcccaatccttgctga

SEQ ID NO: 8087990 - DNA, 22 bp, Homo sapiens
cactcccttcaggagcctagga

SEQ ID NO: 8087991 - DNA, 22 bp, Homo sapiens
cactgcaacctccacctcctgg

SEQ ID NO: 8087992 - DNA, 22 bp, Homo sapiens
cactgcaacctccacctcctgg

SEQ ID NO: 8087993 - DNA, 22 bp, Homo sapiens
caccaggatgggcaggtaggtc

SEQ ID NO: 8087994 - DNA, 22 bp, Homo sapiens
cacctgcctcatttgtccctgc

SEQ ID NO: 8087995 - DNA, 22 bp, Homo sapiens
ggccaggctggtctcagacttc

SEQ ID NO: 8087996 - DNA, 22 bp, Homo sapiens
ggccagggaggagaggcccctg

SEQ ID NO: 8087997 - DNA, 22 bp, Homo sapiens
ggccaggctgccctgggagcag

SEQ ID NO: 8087998 - DNA, 22 bp, Homo sapiens
ggccaggctgccctgggagcag

SEQ ID NO: 8087999 - DNA, 22 bp, Homo sapiens
cacctgggctttctctgggact

SEQ ID NO: 8088000 - DNA, 21 bp, Homo sapiens
cactttaaaaatatctttata

SEQ ID NO: 8088001 - DNA, 21 bp, Homo sapiens
cactttaaaaatatctttata

SEQ ID NO: 8088002 - DNA, 22 bp, Homo sapiens
cacttgaactgtttgaatgaga

SEQ ID NO: 8088003 - DNA, 19 bp, Homo sapiens
cacttcaatcctttatcaa

SEQ ID NO: 8088004 - DNA, 22 bp, Homo sapiens
cacttcaaggaatatctagaaa

SEQ ID NO: 8088005 - DNA, 22 bp, Homo sapiens
cacttcaattaacttcagcatt

SEQ ID NO: 8088006 - DNA, 22 bp, Homo sapiens
cacttcaatctctgcctccatc

SEQ ID NO: 8088007 - DNA, 22 bp, Homo sapiens
cacttcaacagttatttcttag

SEQ ID NO: 8088008 - DNA, 22 bp, Homo sapiens
cacttcaacctctgagtcctgg

SEQ ID NO: 8088009 - DNA, 22 bp, Homo sapiens
cacttcaagagcaagggtgcca

SEQ ID NO: 8088010 - DNA, 22 bp, Homo sapiens
cacttcaaataagctcttctca

SEQ ID NO: 8088011 - DNA, 22 bp, Homo sapiens
cacttcaaatatggcttcatga

SEQ ID NO: 8088012 - DNA, 22 bp, Homo sapiens
cactgtggaattagaataacct

SEQ ID NO: 8088013 - DNA, 22 bp, Homo sapiens
cactgtggagcaaatttattta

SEQ ID NO: 8088014 - DNA, 22 bp, Homo sapiens
cactgtggatacagaaattagt

SEQ ID NO: 8088015 - DNA, 22 bp, Homo sapiens
cactgtggcaacctgtgcccaa

SEQ ID NO: 8088016 - DNA, 22 bp, Homo sapiens
cactgtggcttaccaaagctaa

SEQ ID NO: 8088017 - DNA, 20 bp, Homo sapiens
cactgtggcacattggttta

SEQ ID NO: 8088018 - DNA, 22 bp, Homo sapiens
cactgcactccagcctgggtca

SEQ ID NO: 8088019 - DNA, 22 bp, Homo sapiens
cactgcactccagcctgggtca

SEQ ID NO: 8088020 - DNA, 22 bp, Homo sapiens
cactgggagtacaaagaatggg

SEQ ID NO: 8088021 - DNA, 22 bp, Homo sapiens
cactgcactccagcttgggtga

SEQ ID NO: 8088022 - DNA, 22 bp, Homo sapiens
cactgcactccagcctgggtga

SEQ ID NO: 8088023 - DNA, 22 bp, Homo sapiens
cactgcactccagcctgggtga

SEQ ID NO: 8088024 - DNA, 22 bp, Homo sapiens
ggcaagtggtagaacatctgag

SEQ ID NO: 8088025 - DNA, 22 bp, Homo sapiens
ggcaagtgatcctggagcaccg

SEQ ID NO: 8088026 - DNA, 22 bp, Homo sapiens
cacagtgcaatcggccacaaat

SEQ ID NO: 8088027 - DNA, 22 bp, Homo sapiens
cacagtgacagctatacagaga

SEQ ID NO: 8088028 - DNA, 23 bp, Homo sapiens
cacaggcagaaatcaagacggta

SEQ ID NO: 8088029 - DNA, 22 bp, Homo sapiens
cacaggcagccttgtagaagaa

SEQ ID NO: 8088030 - DNA, 22 bp, Homo sapiens
cacaggcaggaggttctccagt

SEQ ID NO: 8088031 - DNA, 18 bp, Homo sapiens
cacaggcaggtgataggt

SEQ ID NO: 8088032 - DNA, 20 bp, Homo sapiens
cacaggccttgtgagcagac

SEQ ID NO: 8088033 - DNA, 22 bp, Homo sapiens
cacagggcaggtactctcagag

SEQ ID NO: 8088034 - DNA, 20 bp, Homo sapiens
cacaggccttgtgagcagac

SEQ ID NO: 8088035 - DNA, 22 bp, Homo sapiens
cacatgaagattcaactggatg

SEQ ID NO: 8088036 - DNA, 22 bp, Homo sapiens
cacatgaattgatgccaagtgc

SEQ ID NO: 8088037 - DNA, 22 bp, Homo sapiens
cacatgagtcctgccaggtatg

SEQ ID NO: 8088038 - DNA, 22 bp, Homo sapiens
caccaggacttaacacattccc

SEQ ID NO: 8088039 - DNA, 22 bp, Homo sapiens
ggactgggtaggagcccagggc

SEQ ID NO: 8088040 - DNA, 22 bp, Homo sapiens
cacacaggtaagcctctttcaa

SEQ ID NO: 8088041 - DNA, 22 bp, Homo sapiens
cacacagggagaaagaaagcct

SEQ ID NO: 8088042 - DNA, 22 bp, Homo sapiens
cacaaataccagtttcctaaca

SEQ ID NO: 8088043 - DNA, 22 bp, Homo sapiens
cacaaataccagtttcctaaca

SEQ ID NO: 8088044 - DNA, 22 bp, Homo sapiens
ggaagctggtaattgttgggac

SEQ ID NO: 8088045 - DNA, 22 bp, Homo sapiens
ggaagctgaatccagagacagg

SEQ ID NO: 8088046 - DNA, 22 bp, Homo sapiens
cacaaatggccgtgttcaaaga

SEQ ID NO: 8088047 - DNA, 22 bp, Homo sapiens
cacaaatggttgtagacattaa

SEQ ID NO: 8088048 - DNA, 22 bp, Homo sapiens
cacaaatgtgcagaaatgtgag

SEQ ID NO: 8088049 - DNA, 22 bp, Homo sapiens
cacaactgccatctgagcagca

SEQ ID NO: 8088050 - DNA, 17 bp, Homo sapiens
cacaactggctgattga

SEQ ID NO: 8088051 - DNA, 20 bp, Homo sapiens
cacaactgagaaccctatgg

SEQ ID NO: 8088052 - DNA, 22 bp, Homo sapiens
cacaactgccagccaggaaagg

SEQ ID NO: 8088053 - DNA, 17 bp, Homo sapiens
cacaactgaaaccacta

SEQ ID NO: 8088054 - DNA, 20 bp, Homo sapiens
cacaactgtccacatgctcc

SEQ ID NO: 8088055 - DNA, 22 bp, Homo sapiens
caatttcatgccatgtattgct

SEQ ID NO: 8088056 - DNA, 22 bp, Homo sapiens
caatttcactaataatatttac

SEQ ID NO: 8088057 - DNA, 22 bp, Homo sapiens
caattgaacagatgagttaaat

SEQ ID NO: 8088058 - DNA, 19 bp, Homo sapiens
caatatatagtgagtggat

SEQ ID NO: 8088059 - DNA, 22 bp, Homo sapiens
caatcacaaagagacaagtgtc

SEQ ID NO: 8088060 - DNA, 22 bp, Homo sapiens
gctggggagctagacctcagca

SEQ ID NO: 8088061 - DNA, 22 bp, Homo sapiens
caatacttccttgttagaggca

SEQ ID NO: 8088062 - DNA, 22 bp, Homo sapiens
caatagcagacctagaaagcaa

SEQ ID NO: 8088063 - DNA, 22 bp, Homo sapiens
caatatataatgagtactttcc

SEQ ID NO: 8088064 - DNA, 22 bp, Homo sapiens
caatatataggaacaacttagg

SEQ ID NO: 8088065 - DNA, 22 bp, Homo sapiens
gctggcccagcgtggggccgtg

SEQ ID NO: 8088066 - DNA, 22 bp, Homo sapiens
caagcccactgctcagagccaa

SEQ ID NO: 8088067 - DNA, 22 bp, Homo sapiens
caagcccactgctcagagccaa

SEQ ID NO: 8088068 - DNA, 22 bp, Homo sapiens
caagcctcagaatcttctccat

SEQ ID NO: 8088069 - DNA, 22 bp, Homo sapiens
gctgggctcagacctagtgaac

SEQ ID NO: 8088070 - DNA, 22 bp, Homo sapiens
gctgggcttgtggccagctggg

SEQ ID NO: 8088071 - DNA, 22 bp, Homo sapiens
gctggacaggccacatggagga

SEQ ID NO: 8088072 - DNA, 22 bp, Homo sapiens
caactttagcaatgttagtata

SEQ ID NO: 8088073 - DNA, 22 bp, Homo sapiens
caacaatatgctgagtttttca

SEQ ID NO: 8088074 - DNA, 22 bp, Homo sapiens
caagaacattgtgatcacttca

SEQ ID NO: 8088075 - DNA, 22 bp, Homo sapiens
gtactttaaatcaatgtagatt

SEQ ID NO: 8088076 - DNA, 22 bp, Homo sapiens
cagccagaacctaggatgagct

SEQ ID NO: 8088077 - DNA, 22 bp, Homo sapiens
cagccagcttcagatccaagcc

SEQ ID NO: 8088078 - DNA, 22 bp, Homo sapiens
cagccaggagctccccctgctc

SEQ ID NO: 8088079 - DNA, 22 bp, Homo sapiens
cagccaggagctccccctgctc

SEQ ID NO: 8088080 - DNA, 22 bp, Homo sapiens
cagccaggagcctctgcaacta

SEQ ID NO: 8088081 - DNA, 22 bp, Homo sapiens
cagccaggcccagatcatgctg

SEQ ID NO: 8088082 - DNA, 22 bp, Homo sapiens
gtcacactcttccctccacatg

SEQ ID NO: 8088083 - DNA, 22 bp, Homo sapiens
gtagggagcccagagcccagtg

SEQ ID NO: 8088084 - DNA, 22 bp, Homo sapiens
cagccaggcccccgagtcgttg

SEQ ID NO: 8088085 - DNA, 22 bp, Homo sapiens
ggggcctgcgaggttcaacttc

SEQ ID NO: 8088086 - DNA, 22 bp, Homo sapiens
ggggttggtttaaatgcttgag

SEQ ID NO: 8088087 - DNA, 20 bp, Homo sapiens
ggggttggctggcacaggga

SEQ ID NO: 8088088 - DNA, 22 bp, Homo sapiens
ggggcctgtagagcttcaggga

SEQ ID NO: 8088089 - DNA, 22 bp, Homo sapiens
gggctgtgagagtggggctgct

SEQ ID NO: 8088090 - DNA, 18 bp, Homo sapiens
gggctgtgagatgggaag

SEQ ID NO: 8088091 - DNA, 22 bp, Homo sapiens
gggctgtggagccgcgagggct

SEQ ID NO: 8088092 - DNA, 22 bp, Homo sapiens
gggctgtgtaatgtgctctttt

SEQ ID NO: 8088093 - DNA, 22 bp, Homo sapiens
gggctgtgctgagtaggaggtg

SEQ ID NO: 8088094 - DNA, 22 bp, Homo sapiens
gggctgtgcctcaggtggggtc

SEQ ID NO: 8088095 - DNA, 22 bp, Homo sapiens
ggtatttcagtattatacaact

SEQ ID NO: 8088096 - DNA, 22 bp, Homo sapiens
ggtatttccttgcctctgccta

SEQ ID NO: 8088097 - DNA, 22 bp, Homo sapiens
ggtcacagctttttcagcagca

SEQ ID NO: 8088098 - DNA, 20 bp, Homo sapiens
gggtgtgggcccggccaggc

SEQ ID NO: 8088099 - DNA, 22 bp, Homo sapiens
gggtacagttcttccagtgtca

SEQ ID NO: 8088100 - DNA, 22 bp, Homo sapiens
gggcaggggtcagtggccccaa

SEQ ID NO: 8088101 - DNA, 22 bp, Homo sapiens
cagagcagtggagagtaggtct

SEQ ID NO: 8088102 - DNA, 22 bp, Homo sapiens
cagagcagaagcggtcctcaca

SEQ ID NO: 8088103 - DNA, 22 bp, Homo sapiens
gggatgagagctgggacagaag

SEQ ID NO: 8088104 - DNA, 22 bp, Homo sapiens
gggagctgcacacgccccggaa

SEQ ID NO: 8088105 - DNA, 22 bp, Homo sapiens
gggagctgatgatgtaagtccc

SEQ ID NO: 8088106 - DNA, 22 bp, Homo sapiens
gggagctgccaccacccctggg

SEQ ID NO: 8088107 - DNA, 21 bp, Homo sapiens
gggagctggaaactgggtgac

SEQ ID NO: 8088108 - DNA, 22 bp, Homo sapiens
cagaaacaggcaacgtgtgcac

SEQ ID NO: 8088109 - DNA, 22 bp, Homo sapiens
cagaaacagagaaatattggct

SEQ ID NO: 8088110 - DNA, 22 bp, Homo sapiens
cagaaacactgtatttagggaa

SEQ ID NO: 8088111 - DNA, 22 bp, Homo sapiens
cagaaacacttgtagagaagtt

SEQ ID NO: 8088112 - DNA, 22 bp, Homo sapiens
ggctggcacccttggggatagg

SEQ ID NO: 8088113 - DNA, 22 bp, Homo sapiens
gagaaggggtgatgtgggtaat

SEQ ID NO: 8088114 - DNA, 22 bp, Homo sapiens
atgcttaacttcctagtctata

SEQ ID NO: 8088115 - DNA, 22 bp, Homo sapiens
atgctgtgtcctagtgaaagaa

SEQ ID NO: 8088116 - DNA, 22 bp, Homo sapiens
atgctgtgtggtcaagttaatt

SEQ ID NO: 8088117 - DNA, 22 bp, Homo sapiens
atgctgtgaaaaagaaggctga

SEQ ID NO: 8088118 - DNA, 22 bp, Homo sapiens
atgctgtggccagagttcaact

SEQ ID NO: 8088119 - DNA, 22 bp, Homo sapiens
atgctgtggatgccttgcccca

SEQ ID NO: 8088120 - DNA, 22 bp, Homo sapiens
atgctgggaaactgaaaggaat

SEQ ID NO: 8088121 - DNA, 22 bp, Homo sapiens
atgggcagacagggagctcacg

SEQ ID NO: 8088122 - DNA, 22 bp, Homo sapiens
atgggcagagctggtgggaggc

SEQ ID NO: 8088123 - DNA, 22 bp, Homo sapiens
gagccccaccctagacattctg

SEQ ID NO: 8088124 - DNA, 22 bp, Homo sapiens
gagccccaggacagctctagtt

SEQ ID NO: 8088125 - DNA, 21 bp, Homo sapiens
atgggcagaggcagagaggct

SEQ ID NO: 8088126 - DNA, 22 bp, Homo sapiens
gagcacagggaatagacagata

SEQ ID NO: 8088127 - DNA, 22 bp, Homo sapiens
gagcacagccaaagtaagaagg

SEQ ID NO: 8088128 - DNA, 22 bp, Homo sapiens
atggctctgctgggcaaagcaa

SEQ ID NO: 8088129 - DNA, 22 bp, Homo sapiens
atgtattatggttttccttaag

SEQ ID NO: 8088130 - DNA, 23 bp, Homo sapiens
atgtatttaaatttcagtgatga

SEQ ID NO: 8088131 - DNA, 22 bp, Homo sapiens
atgtatttctatgtagtgaaga

SEQ ID NO: 8088132 - DNA, 22 bp, Homo sapiens
atgtatttctatgtagtgaaga

SEQ ID NO: 8088133 - DNA, 22 bp, Homo sapiens
gaggagggcagttcctctttta

SEQ ID NO: 8088134 - DNA, 22 bp, Homo sapiens
gaggaggggacagtacttgtgc

SEQ ID NO: 8088135 - DNA, 22 bp, Homo sapiens
atgggcaggcaaggtggcgagt

SEQ ID NO: 8088136 - DNA, 22 bp, Homo sapiens
atgggcaggcactggctctcag

SEQ ID NO: 8088137 - DNA, 22 bp, Homo sapiens
atgggcagctgcagcagtggtg

SEQ ID NO: 8088138 - DNA, 22 bp, Homo sapiens
atgggcagctgcagcagtggtg

SEQ ID NO: 8088139 - DNA, 22 bp, Homo sapiens
atgttacattgagaggtggttg

SEQ ID NO: 8088140 - DNA, 22 bp, Homo sapiens
atgttatagttataaaatgagg

SEQ ID NO: 8088141 - DNA, 22 bp, Homo sapiens
gaggtgtggtcctcagccccca

SEQ ID NO: 8088142 - DNA, 22 bp, Homo sapiens
atgtggcagtgggaggtgaatt

SEQ ID NO: 8088143 - DNA, 22 bp, Homo sapiens
atgtggcacagcacagtaagag

SEQ ID NO: 8088144 - DNA, 22 bp, Homo sapiens
atgtgaggtagataggatgcag

SEQ ID NO: 8088145 - DNA, 23 bp, Homo sapiens
atgacactcctgtgcgcaccctg

SEQ ID NO: 8088146 - DNA, 22 bp, Homo sapiens
atctttctatttctaaaaacta

SEQ ID NO: 8088147 - DNA, 22 bp, Homo sapiens
atctttctccatatacatcttt

SEQ ID NO: 8088148 - DNA, 22 bp, Homo sapiens
atctttcagggccatttgtatt

SEQ ID NO: 8088149 - DNA, 22 bp, Homo sapiens
atctttcaatcaggaaaaatct

SEQ ID NO: 8088150 - DNA, 22 bp, Homo sapiens
atctttcagtttcataccaatt

SEQ ID NO: 8088151 - DNA, 22 bp, Homo sapiens
cttctcctctgagtcctgggag

SEQ ID NO: 8088152 - DNA, 22 bp, Homo sapiens
ctttatgtgtactttccatttt

SEQ ID NO: 8088153 - DNA, 22 bp, Homo sapiens
gaagtacagttttatctagcca

SEQ ID NO: 8088154 - DNA, 22 bp, Homo sapiens
atgccactgcacttcagcctgg

SEQ ID NO: 8088155 - DNA, 22 bp, Homo sapiens
atgctacatagatacaaaaatg

SEQ ID NO: 8088156 - DNA, 22 bp, Homo sapiens
gaatttcctctaaacccctgag

SEQ ID NO: 8088157 - DNA, 22 bp, Homo sapiens
gaaggagggtgcggatctgagc

SEQ ID NO: 8088158 - DNA, 22 bp, Homo sapiens
atgatgttgataaattacttta

SEQ ID NO: 8088159 - DNA, 22 bp, Homo sapiens
atgagctgggccatccagtgat

SEQ ID NO: 8088160 - DNA, 22 bp, Homo sapiens
gctcccagggacactggccact

SEQ ID NO: 8088161 - DNA, 22 bp, Homo sapiens
gctcccagggacactggccact

SEQ ID NO: 8088162 - DNA, 22 bp, Homo sapiens
gctcccaggcatggaggtaatt

SEQ ID NO: 8088163 - DNA, 22 bp, Homo sapiens
gctcccagttcccaaagtgacc

SEQ ID NO: 8088164 - DNA, 22 bp, Homo sapiens
gctcccagggcagcgcagaaga

SEQ ID NO: 8088165 - DNA, 22 bp, Homo sapiens
gctcccaggttcttgggccttg

SEQ ID NO: 8088166 - DNA, 22 bp, Homo sapiens
gctcagagaatttactgctgcc

SEQ ID NO: 8088167 - DNA, 22 bp, Homo sapiens
caaaagaagctcttggggctag

SEQ ID NO: 8088168 - DNA, 22 bp, Homo sapiens
attttgatgctatctaatgaat

SEQ ID NO: 8088169 - DNA, 22 bp, Homo sapiens
gccttctccctaaccaaatcct

SEQ ID NO: 8088170 - DNA, 22 bp, Homo sapiens
gctcagagaaaactggggcttg

SEQ ID NO: 8088171 - DNA, 22 bp, Homo sapiens
gctcaaatgtcatggggagcct

SEQ ID NO: 8088172 - DNA, 22 bp, Homo sapiens
gctcaaatcccagcgggctcct

SEQ ID NO: 8088173 - DNA, 22 bp, Homo sapiens
gctcagagaaagattagtccct

SEQ ID NO: 8088174 - DNA, 22 bp, Homo sapiens
gccttccctggctaggcaagca

SEQ ID NO: 8088175 - DNA, 22 bp, Homo sapiens
gccttcccaccctgcgaggctg

SEQ ID NO: 8088176 - DNA, 22 bp, Homo sapiens
gccttccctctcatcctgctgg

SEQ ID NO: 8088177 - DNA, 19 bp, Homo sapiens
gccttcccaccacccgtcc

SEQ ID NO: 8088178 - DNA, 22 bp, Homo sapiens
gccttcccaagacgcctgagtt

SEQ ID NO: 8088179 - DNA, 22 bp, Homo sapiens
attttcagtgatcatagcacac

SEQ ID NO: 8088180 - DNA, 22 bp, Homo sapiens
attttcagcccccactcgtggc

SEQ ID NO: 8088181 - DNA, 22 bp, Homo sapiens
attttcagtctggctggaccca

SEQ ID NO: 8088182 - DNA, 22 bp, Homo sapiens
gcccaggttggagagcagtggc

SEQ ID NO: 8088183 - DNA, 22 bp, Homo sapiens
atttcaaggctattaatataaa

SEQ ID NO: 8088184 - DNA, 22 bp, Homo sapiens
gccatgactctccataccaaag

SEQ ID NO: 8088185 - DNA, 22 bp, Homo sapiens
atttcccatgtgaatcaattgg

SEQ ID NO: 8088186 - DNA, 22 bp, Homo sapiens
atttcccagctttgatcagttt

SEQ ID NO: 8088187 - DNA, 22 bp, Homo sapiens
atttcttaaaacttcagggaga

SEQ ID NO: 8088188 - DNA, 22 bp, Homo sapiens
atttcttatctgaggtctacat

SEQ ID NO: 8088189 - DNA, 22 bp, Homo sapiens
atttcttacataacaaattgtt

SEQ ID NO: 8088190 - DNA, 22 bp, Homo sapiens
atttcttatgaatattgactgt

SEQ ID NO: 8088191 - DNA, 22 bp, Homo sapiens
gccagccataggccagcactgg

SEQ ID NO: 8088192 - DNA, 22 bp, Homo sapiens
gccagccacttcccagactggc

SEQ ID NO: 8088193 - DNA, 22 bp, Homo sapiens
gccagccacaagggaggcttgt

SEQ ID NO: 8088194 - DNA, 22 bp, Homo sapiens
gccatcatatcccctgtgacct

SEQ ID NO: 8088195 - DNA, 22 bp, Homo sapiens
atttattaagcatctgctatgt

SEQ ID NO: 8088196 - DNA, 22 bp, Homo sapiens
attcacaaagaagggaagtaca

SEQ ID NO: 8088197 - DNA, 22 bp, Homo sapiens
attcacaaaatgatatagatac

SEQ ID NO: 8088198 - DNA, 22 bp, Homo sapiens
attccacaagaccataaattag

SEQ ID NO: 8088199 - DNA, 22 bp, Homo sapiens
attctgatatcttattctagct

SEQ ID NO: 8088200 - DNA, 22 bp, Homo sapiens
attctgaattctgagcctttca

SEQ ID NO: 8088201 - DNA, 22 bp, Homo sapiens
attctctttgtataacatcttg

SEQ ID NO: 8088202 - DNA, 20 bp, Homo sapiens
gcaggcagggaatgggggtg

SEQ ID NO: 8088203 - DNA, 22 bp, Homo sapiens
gcagcttggtgaaaggtgatgg

SEQ ID NO: 8088204 - DNA, 22 bp, Homo sapiens
gcagggcatagaggcacggagg

SEQ ID NO: 8088205 - DNA, 22 bp, Homo sapiens
gcagggcatccctgagcgggtg

SEQ ID NO: 8088206 - DNA, 20 bp, Homo sapiens
gcagggcatcttggccccca

SEQ ID NO: 8088207 - DNA, 22 bp, Homo sapiens
gcagggcagtgtgtctgtgggg

SEQ ID NO: 8088208 - DNA, 22 bp, Homo sapiens
gcagggcaaacccaggtgttca

SEQ ID NO: 8088209 - DNA, 22 bp, Homo sapiens
gcatggagaagtgggaacaggt

SEQ ID NO: 8088210 - DNA, 22 bp, Homo sapiens
gcacacaggcagtttccagcca

SEQ ID NO: 8088211 - DNA, 16 bp, Homo sapiens
gcacacagccagcctt

SEQ ID NO: 8088212 - DNA, 22 bp, Homo sapiens
gcacacagctagattaccattc

SEQ ID NO: 8088213 - DNA, 22 bp, Homo sapiens
gcaccaggcagctgagcaggcc

SEQ ID NO: 8088214 - DNA, 22 bp, Homo sapiens
attatataggacttgcccttcc

SEQ ID NO: 8088215 - DNA, 22 bp, Homo sapiens
attataggcttgagccaccgtg

SEQ ID NO: 8088216 - DNA, 22 bp, Homo sapiens
attatgtatttggtatagtttg

SEQ ID NO: 8088217 - DNA, 21 bp, Homo sapiens
attatgttcccatctgtttgg

SEQ ID NO: 8088218 - DNA, 22 bp, Homo sapiens
attatctatgtagaatgatttt

SEQ ID NO: 8088219 - DNA, 22 bp, Homo sapiens
gatgtgagtggtagctgggatt

SEQ ID NO: 8088220 - DNA, 22 bp, Homo sapiens
gatgtgaggactcatgtggagg

SEQ ID NO: 8088221 - DNA, 22 bp, Homo sapiens
gagtggggcgtggatccagcgt

SEQ ID NO: 8088222 - DNA, 21 bp, Homo sapiens
gagtgggctgagatggggctg

SEQ ID NO: 8088223 - DNA, 22 bp, Homo sapiens
gagtgggcaccgtgggcacact

SEQ ID NO: 8088224 - DNA, 20 bp, Homo sapiens
gagtgggccatggagtgaga

SEQ ID NO: 8088225 - DNA, 20 bp, Homo sapiens
aggtctgattccagaatcag

SEQ ID NO: 8088226 - DNA, 19 bp, Homo sapiens
aggtgaggggcaccatgtc

SEQ ID NO: 8088227 - DNA, 21 bp, Homo sapiens
aggtgcagagccagggaccag

SEQ ID NO: 8088228 - DNA, 22 bp, Homo sapiens
aggtgcttggctcgtgcacaca

SEQ ID NO: 8088229 - DNA, 22 bp, Homo sapiens
agggtggcagttactggagcaa

SEQ ID NO: 8088230 - DNA, 22 bp, Homo sapiens
agggtggcacctggaagggatg

SEQ ID NO: 8088231 - DNA, 22 bp, Homo sapiens
cctgcctggagctgagtgtgga

SEQ ID NO: 8088232 - DNA, 22 bp, Homo sapiens
cctgcctggctgtcagcagagc

SEQ ID NO: 8088233 - DNA, 22 bp, Homo sapiens
cctgcctggcttccagaagaga

SEQ ID NO: 8088234 - DNA, 22 bp, Homo sapiens
aggttgggatgagtgggtgagc

SEQ ID NO: 8088235 - DNA, 19 bp, Homo sapiens
aggtgtgggggctgcagac

SEQ ID NO: 8088236 - DNA, 22 bp, Homo sapiens
cgcctggaacctctaggaccag

SEQ ID NO: 8088237 - DNA, 22 bp, Homo sapiens
cctttagaattctgcccctcct

SEQ ID NO: 8088238 - DNA, 22 bp, Homo sapiens
cctttagagcaaacgccaccta

SEQ ID NO: 8088239 - DNA, 22 bp, Homo sapiens
cctttagatgatctcttggaca

SEQ ID NO: 8088240 - DNA, 21 bp, Homo sapiens
cctttagatttctatgcagtt

SEQ ID NO: 8088241 - DNA, 20 bp, Homo sapiens
cctttattatttgtatgatg

SEQ ID NO: 8088242 - DNA, 19 bp, Homo sapiens
aggtttatggggagggtga

SEQ ID NO: 8088243 - DNA, 22 bp, Homo sapiens
cctttagaatacagactttcta

SEQ ID NO: 8088244 - DNA, 22 bp, Homo sapiens
cctttagaaagtcagtagttgc

SEQ ID NO: 8088245 - DNA, 21 bp, Homo sapiens
ctacagaatcgagcattctgg

SEQ ID NO: 8088246 - DNA, 21 bp, Homo sapiens
ctacagaagctctcctatcca

SEQ ID NO: 8088247 - DNA, 22 bp, Homo sapiens
ctacagaagaaactatcactat

SEQ ID NO: 8088248 - DNA, 22 bp, Homo sapiens
agtcagaagggcccttccttcc

SEQ ID NO: 8088249 - DNA, 22 bp, Homo sapiens
cgtgccactgcactctagcctg

SEQ ID NO: 8088250 - DNA, 22 bp, Homo sapiens
cgtgcgcctcagcctcgtgcgc

SEQ ID NO: 8088251 - DNA, 22 bp, Homo sapiens
ctaaacaagggattataattga

SEQ ID NO: 8088252 - DNA, 22 bp, Homo sapiens
cgtggcagtggtgtttcttagg

SEQ ID NO: 8088253 - DNA, 22 bp, Homo sapiens
cgtggcagtggaaggctgggtg

SEQ ID NO: 8088254 - DNA, 15 bp, Homo sapiens
ctccatgattttgca

SEQ ID NO: 8088255 - DNA, 22 bp, Homo sapiens
ctccatgaatttgagctttgtg

SEQ ID NO: 8088256 - DNA, 22 bp, Homo sapiens
ctccagggagctgcgggagcca

SEQ ID NO: 8088257 - DNA, 22 bp, Homo sapiens
ctccagttggccccagttggtt

SEQ ID NO: 8088258 - DNA, 22 bp, Homo sapiens
ctcctctccatcagcgccaccc

SEQ ID NO: 8088259 - DNA, 22 bp, Homo sapiens
ctcctccctctttgccacacat

SEQ ID NO: 8088260 - DNA, 22 bp, Homo sapiens
ctcctcctggacacaggctgtg

SEQ ID NO: 8088261 - DNA, 22 bp, Homo sapiens
ctcctccctgggaggctggcat

SEQ ID NO: 8088262 - DNA, 21 bp, Homo sapiens
ctcccagggtgactgttcaac

SEQ ID NO: 8088263 - DNA, 22 bp, Homo sapiens
ctcccaggtgtcccttctgcca

SEQ ID NO: 8088264 - DNA, 22 bp, Homo sapiens
ctcccaggttacatctgagcct

SEQ ID NO: 8088265 - DNA, 22 bp, Homo sapiens
ctcctcccacggtctcaggaag

SEQ ID NO: 8088266 - DNA, 22 bp, Homo sapiens
ctcctcagctgggaggagtccc

SEQ ID NO: 8088267 - DNA, 22 bp, Homo sapiens
ctcccaggttccgacgcctctt

SEQ ID NO: 8088268 - DNA, 22 bp, Homo sapiens
ctcccagggtctaggctgctgg

SEQ ID NO: 8088269 - DNA, 22 bp, Homo sapiens
ctcccagggtagggagagacta

SEQ ID NO: 8088270 - DNA, 22 bp, Homo sapiens
ctcccaggggagtcatctgctt

SEQ ID NO: 8088271 - DNA, 22 bp, Homo sapiens
agtccaaagcagatgagggcca

SEQ ID NO: 8088272 - DNA, 22 bp, Homo sapiens
agtcatatgacccttcacaaac

SEQ ID NO: 8088273 - DNA, 22 bp, Homo sapiens
agtccaaggccatacagttgtg

SEQ ID NO: 8088274 - DNA, 22 bp, Homo sapiens
agtccaagattagggtgacagc

SEQ ID NO: 8088275 - DNA, 22 bp, Homo sapiens
agtccaaggagagacagcattt

SEQ ID NO: 8088276 - DNA, 17 bp, Homo sapiens
agtggcaggcagatggg

SEQ ID NO: 8088277 - DNA, 22 bp, Homo sapiens
agtggcagccgagcaggagatg

SEQ ID NO: 8088278 - DNA, 22 bp, Homo sapiens
agtgcaggccccaggccaggcc

SEQ ID NO: 8088279 - DNA, 22 bp, Homo sapiens
agtgggcagcccaggaggtctt

SEQ ID NO: 8088280 - DNA, 19 bp, Homo sapiens
agtgggcaaggaagatgac

SEQ ID NO: 8088281 - DNA, 22 bp, Homo sapiens
agtgggcaaaacagctcagagc

SEQ ID NO: 8088282 - DNA, 22 bp, Homo sapiens
agtgggcatatgaagtctcaag

SEQ ID NO: 8088283 - DNA, 22 bp, Homo sapiens
agtgggcaggcagggtgcgcag

SEQ ID NO: 8088284 - DNA, 22 bp, Homo sapiens
agtgggagggccatatggtgaa

SEQ ID NO: 8088285 - DNA, 22 bp, Homo sapiens
agtgggagggccatatggtgaa

SEQ ID NO: 8088286 - DNA, 22 bp, Homo sapiens
ctctgagcagaggccgtggcta

SEQ ID NO: 8088287 - DNA, 22 bp, Homo sapiens
agtgggcccttgtcacactgat

SEQ ID NO: 8088288 - DNA, 22 bp, Homo sapiens
agtgggcatgatctggtgtctg

SEQ ID NO: 8088289 - DNA, 22 bp, Homo sapiens
agtggctggtctaaggtcacag

SEQ ID NO: 8088290 - DNA, 22 bp, Homo sapiens
ctctgagaagagttcaagtaaa

SEQ ID NO: 8088291 - DNA, 22 bp, Homo sapiens
ctctgagaggatcctgcccggg

SEQ ID NO: 8088292 - DNA, 21 bp, Homo sapiens
agtgtgttcttggcattacct

SEQ ID NO: 8088293 - DNA, 22 bp, Homo sapiens
ctgaagctgaaaacttccagca

SEQ ID NO: 8088294 - DNA, 22 bp, Homo sapiens
ctgaagctgcataccaaagact

SEQ ID NO: 8088295 - DNA, 20 bp, Homo sapiens
agtggggagtcaggagtgcc

SEQ ID NO: 8088296 - DNA, 22 bp, Homo sapiens
atattttcacagaacttgcaaa

SEQ ID NO: 8088297 - DNA, 22 bp, Homo sapiens
atattttcactgaaccaaagta

SEQ ID NO: 8088298 - DNA, 22 bp, Homo sapiens
atattttccgaacttgaggtag

SEQ ID NO: 8088299 - DNA, 22 bp, Homo sapiens
atattttctggaactatgcctg

SEQ ID NO: 8088300 - DNA, 22 bp, Homo sapiens
ctggtgggaggcaaggtggaag

SEQ ID NO: 8088301 - DNA, 22 bp, Homo sapiens
ctggtgggagcagcaggcagct

SEQ ID NO: 8088302 - DNA, 22 bp, Homo sapiens
ctggggcagagcccagcaattt

SEQ ID NO: 8088303 - DNA, 22 bp, Homo sapiens
ctgggccatctctctgcaagtg

SEQ ID NO: 8088304 - DNA, 22 bp, Homo sapiens
ctgggccatggaagtctctgcc

SEQ ID NO: 8088305 - DNA, 22 bp, Homo sapiens
ctgggccatgggccagcgaggc

SEQ ID NO: 8088306 - DNA, 17 bp, Homo sapiens
ctgggcctctgcccttt

SEQ ID NO: 8088307 - DNA, 22 bp, Homo sapiens
ctgggccagtctcggccgctct

SEQ ID NO: 8088308 - DNA, 22 bp, Homo sapiens
ctgggccagggaggtgtctgta

SEQ ID NO: 8088309 - DNA, 22 bp, Homo sapiens
ctgggccagttatgtctcatct

SEQ ID NO: 8088310 - DNA, 22 bp, Homo sapiens
ctgggccatctcctttgtgtgg

SEQ ID NO: 8088311 - DNA, 20 bp, Homo sapiens
ctgggccatccttttacaat

SEQ ID NO: 8088312 - DNA, 22 bp, Homo sapiens
ctgggccatcagaggggctgga

SEQ ID NO: 8088313 - DNA, 22 bp, Homo sapiens
atatcagtatctatgtatttgt

SEQ ID NO: 8088314 - DNA, 22 bp, Homo sapiens
atatcattatgttatgagcaca

SEQ ID NO: 8088315 - DNA, 22 bp, Homo sapiens
atatcaaacgaagttattttaa

SEQ ID NO: 8088316 - DNA, 22 bp, Homo sapiens
atagtatttccagaaatagtct

SEQ ID NO: 8088317 - DNA, 22 bp, Homo sapiens
atatattttttgagacagagtc

SEQ ID NO: 8088318 - DNA, 22 bp, Homo sapiens
cttcagaattcctcagcctcag

SEQ ID NO: 8088319 - DNA, 22 bp, Homo sapiens
cttcagaatccagaatcagaat

SEQ ID NO: 8088320 - DNA, 22 bp, Homo sapiens
cttcagagtgactcagcatctt

SEQ ID NO: 8088321 - DNA, 22 bp, Homo sapiens
cttcagaggggactcaaagtca

SEQ ID NO: 8088322 - DNA, 22 bp, Homo sapiens
cttcagagtgcagaagattggg

SEQ ID NO: 8088323 - DNA, 22 bp, Homo sapiens
atccttggcagctcagacctac

SEQ ID NO: 8088324 - DNA, 22 bp, Homo sapiens
atctattctctacagtagacag

SEQ ID NO: 8088325 - DNA, 22 bp, Homo sapiens
atccttccagagttattctcaa

SEQ ID NO: 8088326 - DNA, 22 bp, Homo sapiens
atccttccttcatttgacaggt

SEQ ID NO: 8088327 - DNA, 23 bp, Homo sapiens
cttcagcagaaacataaattctc

SEQ ID NO: 8088328 - DNA, 18 bp, Homo sapiens
atctcccattggccaagg

SEQ ID NO: 8088329 - DNA, 22 bp, Homo sapiens
atctcccaaattagcctcttga

SEQ ID NO: 8088330 - DNA, 22 bp, Homo sapiens
cttcatgaggaagatttcacaa

SEQ ID NO: 8088331 - DNA, 22 bp, Homo sapiens
atcattctagctgttgtgttga

SEQ ID NO: 8088332 - DNA, 23 bp, Homo sapiens
atcattactttgataccttttct

SEQ ID NO: 8088333 - DNA, 22 bp, Homo sapiens
atcattactcctgtaaaattgt

SEQ ID NO: 8088334 - DNA, 22 bp, Homo sapiens
ctgtttattacgtaattaatat

SEQ ID NO: 8088335 - DNA, 22 bp, Homo sapiens
ctgtttatgaagctgtggttta

SEQ ID NO: 8088336 - DNA, 22 bp, Homo sapiens
ctgtttcaaaactagtacaaca

SEQ ID NO: 8088337 - DNA, 22 bp, Homo sapiens
ctgtttatctaggagttgcagg

SEQ ID NO: 8088338 - DNA, 22 bp, Homo sapiens
ctgtgggagcacatgacagata

SEQ ID NO: 8088339 - DNA, 22 bp, Homo sapiens
agtttatttttgataagtcttg

SEQ ID NO: 8088340 - DNA, 22 bp, Homo sapiens
agtgttcactctgtggagccca

SEQ ID NO: 8088341 - DNA, 22 bp, Homo sapiens
agtttatgtctttacttcagct

SEQ ID NO: 8088342 - DNA, 18 bp, Homo sapiens
ctgataggggtggcagct

SEQ ID NO: 8088343 - DNA, 22 bp, Homo sapiens
ctgatacactccctaaaatata

SEQ ID NO: 8088344 - DNA, 22 bp, Homo sapiens
agttttattccaatgtgcagca

SEQ ID NO: 8088345 - DNA, 22 bp, Homo sapiens
ataagccataatttctgccttt

SEQ ID NO: 8088346 - DNA, 22 bp, Homo sapiens
ctgccctgtggctctgagtcat

SEQ ID NO: 8088347 - DNA, 22 bp, Homo sapiens
ctgccctgtctgcagcctggct

SEQ ID NO: 8088348 - DNA, 23 bp, Homo sapiens
ataataattatggcagcaaagtg

SEQ ID NO: 8088349 - DNA, 18 bp, Homo sapiens
ctgcctgctctccagctt

SEQ ID NO: 8088350 - DNA, 22 bp, Homo sapiens
ataataacacctgaataggaaa

SEQ ID NO: 8088351 - DNA, 22 bp, Homo sapiens
ctgcctgctgccctccagagcc

SEQ ID NO: 8088352 - DNA, 22 bp, Homo sapiens
ctgcctgcttctgagccagagg

SEQ ID NO: 8088353 - DNA, 22 bp, Homo sapiens
agttttcacactcaccaaaagg

SEQ ID NO: 8088354 - DNA, 18 bp, Homo sapiens
ctgccccttctctgagat

SEQ ID NO: 8088355 - DNA, 22 bp, Homo sapiens
ctgccctgacctgcctcagagt

SEQ ID NO: 8088356 - DNA, 22 bp, Homo sapiens
ctggaaattggagatgatgttt

SEQ ID NO: 8088357 - DNA, 22 bp, Homo sapiens
atacatatatggtacttcctgg

SEQ ID NO: 8088358 - DNA, 22 bp, Homo sapiens
atacatgatacttagtacgtag

SEQ ID NO: 8088359 - DNA, 22 bp, Homo sapiens
atacactttagaaaaacgctgc

SEQ ID NO: 8088360 - DNA, 18 bp, Homo sapiens
atagaaacctttaatcag

SEQ ID NO: 8088361 - DNA, 22 bp, Homo sapiens
ctggccagaggttcctctgccc

SEQ ID NO: 8088362 - DNA, 22 bp, Homo sapiens
ctggccagtgcctgtgggcccc

SEQ ID NO: 8088363 - DNA, 22 bp, Homo sapiens
ctggccagtgactgctcacccg

SEQ ID NO: 8088364 - DNA, 22 bp, Homo sapiens
atagtaactggcatgtttatga

SEQ ID NO: 8088365 - DNA, 20 bp, Homo sapiens
ccacaggagtccagtcgacc

SEQ ID NO: 8088366 - DNA, 22 bp, Homo sapiens
ccacaggaggaacaattagatg

SEQ ID NO: 8088367 - DNA, 22 bp, Homo sapiens
ccacaggacagttaatgtgcag

SEQ ID NO: 8088368 - DNA, 22 bp, Homo sapiens
ccacaggacacaactgctgacc

SEQ ID NO: 8088369 - DNA, 22 bp, Homo sapiens
ccacaggaagttatgagtacta

SEQ ID NO: 8088370 - DNA, 21 bp, Homo sapiens
aggcatggaaatggcacactg

SEQ ID NO: 8088371 - DNA, 22 bp, Homo sapiens
aggcatggcactgagcagcttc

SEQ ID NO: 8088372 - DNA, 22 bp, Homo sapiens
aggcatggatgtagcagtgacc

SEQ ID NO: 8088373 - DNA, 22 bp, Homo sapiens
aggcccagctggacaaactgct

SEQ ID NO: 8088374 - DNA, 19 bp, Homo sapiens
ccagctggcctgggacctc

SEQ ID NO: 8088375 - DNA, 22 bp, Homo sapiens
ccagcctggactgggtcttgtg

SEQ ID NO: 8088376 - DNA, 22 bp, Homo sapiens
ccagcctccatgtagatagctg

SEQ ID NO: 8088377 - DNA, 22 bp, Homo sapiens
ccaggacaagtgtggccatggc

SEQ ID NO: 8088378 - DNA, 21 bp, Homo sapiens
ccatgggagctgttaatcctg

SEQ ID NO: 8088379 - DNA, 21 bp, Homo sapiens
ccatgggaagcatcctcgcgg

SEQ ID NO: 8088380 - DNA, 22 bp, Homo sapiens
ccatgggacctacctcctgtgc

SEQ ID NO: 8088381 - DNA, 17 bp, Homo sapiens
aggctggctcacaggga

SEQ ID NO: 8088382 - DNA, 22 bp, Homo sapiens
cccagagccggtggtgctcaca

SEQ ID NO: 8088383 - DNA, 22 bp, Homo sapiens
ccagggtgagtgtcatgggtta

SEQ ID NO: 8088384 - DNA, 22 bp, Homo sapiens
aggctcctgcaggccttgtagg

SEQ ID NO: 8088385 - DNA, 22 bp, Homo sapiens
aggctcctgatcctggggtctg

SEQ ID NO: 8088386 - DNA, 20 bp, Homo sapiens
aggctcctgtacctgaggaa

SEQ ID NO: 8088387 - DNA, 22 bp, Homo sapiens
ccagggagcggggctgggtctc

SEQ ID NO: 8088388 - DNA, 17 bp, Homo sapiens
ccagggaggggccgcgc

SEQ ID NO: 8088389 - DNA, 22 bp, Homo sapiens
aggctcagtttggtttccattg

SEQ ID NO: 8088390 - DNA, 22 bp, Homo sapiens
aggctcagtgcaaatcattctg

SEQ ID NO: 8088391 - DNA, 22 bp, Homo sapiens
aggctcagttcacgtcaacttt

SEQ ID NO: 8088392 - DNA, 22 bp, Homo sapiens
aggctcagttctgtggtgagcc

SEQ ID NO: 8088393 - DNA, 22 bp, Homo sapiens
aggctcagtcccggcccgcgcc

SEQ ID NO: 8088394 - DNA, 22 bp, Homo sapiens
aggctcagtctgttcatgcact

SEQ ID NO: 8088395 - DNA, 22 bp, Homo sapiens
aggctcagtgatgtaaaatata

SEQ ID NO: 8088396 - DNA, 22 bp, Homo sapiens
aggctcaggtgcctcattcaca

SEQ ID NO: 8088397 - DNA, 22 bp, Homo sapiens
aggctcagtatagctggcaagt

SEQ ID NO: 8088398 - DNA, 17 bp, Homo sapiens
ccaggagcgtgggtctc

SEQ ID NO: 8088399 - DNA, 22 bp, Homo sapiens
cctcctggagcattggtgagga

SEQ ID NO: 8088400 - DNA, 18 bp, Homo sapiens
cctctgccatagccagca

SEQ ID NO: 8088401 - DNA, 22 bp, Homo sapiens
cctgaggcccctgaggatagca

SEQ ID NO: 8088402 - DNA, 21 bp, Homo sapiens
aggggacagagtagctccagg

SEQ ID NO: 8088403 - DNA, 22 bp, Homo sapiens
aggggagaatttcaactcaggt

SEQ ID NO: 8088404 - DNA, 22 bp, Homo sapiens
cctccccacgggcagccggcgc

SEQ ID NO: 8088405 - DNA, 22 bp, Homo sapiens
agggctcctgaggcccttctgg

SEQ ID NO: 8088406 - DNA, 22 bp, Homo sapiens
agggctcctatgccccatggac

SEQ ID NO: 8088407 - DNA, 22 bp, Homo sapiens
agggctcctccccggcctccac

SEQ ID NO: 8088408 - DNA, 22 bp, Homo sapiens
agggctcctatgatgctctgcc

SEQ ID NO: 8088409 - DNA, 22 bp, Homo sapiens
agggccctccccgctcagggca

SEQ ID NO: 8088410 - DNA, 22 bp, Homo sapiens
agggctcattgacatggaaaag

SEQ ID NO: 8088411 - DNA, 21 bp, Homo sapiens
agggctcaaatgtgcttgctg

SEQ ID NO: 8088412 - DNA, 22 bp, Homo sapiens
agggctcataattcctgacttc

SEQ ID NO: 8088413 - DNA, 22 bp, Homo sapiens
agggctccaggggctgggtgac

SEQ ID NO: 8088414 - DNA, 22 bp, Homo sapiens
agggctcccgtgaggtgactgc

SEQ ID NO: 8088415 - DNA, 22 bp, Homo sapiens
agggccagagtacatcagggct

SEQ ID NO: 8088416 - DNA, 22 bp, Homo sapiens
agggccagagtacatcagggct

SEQ ID NO: 8088417 - DNA, 22 bp, Homo sapiens
agggccagagtctgtgtagata

SEQ ID NO: 8088418 - DNA, 22 bp, Homo sapiens
agggccagaatccctcagtcta

SEQ ID NO: 8088419 - DNA, 22 bp, Homo sapiens
agggccagaggcaccttgcagc

SEQ ID NO: 8088420 - DNA, 23 bp, Homo sapiens
agggccactgggaaggattactg

SEQ ID NO: 8088421 - DNA, 22 bp, Homo sapiens
cccttcccttctgggagatcca

SEQ ID NO: 8088422 - DNA, 22 bp, Homo sapiens
cccaggagttggaggctgcagt

SEQ ID NO: 8088423 - DNA, 23 bp, Homo sapiens
cccaggagtttcactgcaaaggt

SEQ ID NO: 8088424 - DNA, 22 bp, Homo sapiens
cccaggagtttgagttcagcat

SEQ ID NO: 8088425 - DNA, 22 bp, Homo sapiens
cccaggatggggctgcagttat

SEQ ID NO: 8088426 - DNA, 21 bp, Homo sapiens
cccagggaagccgcagtcacc

SEQ ID NO: 8088427 - DNA, 21 bp, Homo sapiens
aggcttggatagatattcata

SEQ ID NO: 8088428 - DNA, 22 bp, Homo sapiens
agggactcggttgagtgcccct

SEQ ID NO: 8088429 - DNA, 22 bp, Homo sapiens
cccaggggtatccatggagaag

SEQ ID NO: 8088430 - DNA, 22 bp, Homo sapiens
agggactcctctgctcggctgc

SEQ ID NO: 8088431 - DNA, 22 bp, Homo sapiens
agggatgatttcagtgtctgcc

SEQ ID NO: 8088432 - DNA, 22 bp, Homo sapiens
agggatggaagctcgtctgcaa

SEQ ID NO: 8088433 - DNA, 22 bp, Homo sapiens
agggatggaagacttgaagacc

SEQ ID NO: 8088434 - DNA, 22 bp, Homo sapiens
agggatgatcagggtagaggct

SEQ ID NO: 8088435 - DNA, 22 bp, Homo sapiens
ccctccccacaaagcttcacac

SEQ ID NO: 8088436 - DNA, 22 bp, Homo sapiens
ccctggaaggagatgggacatg

SEQ ID NO: 8088437 - DNA, 21 bp, Homo sapiens
ccctggaatcctgagtgccag

SEQ ID NO: 8088438 - DNA, 18 bp, Homo sapiens
ccctcttgcacaaagcaa

SEQ ID NO: 8088439 - DNA, 22 bp, Homo sapiens
caggaaggcccacctgtcctgt

SEQ ID NO: 8088440 - DNA, 22 bp, Homo sapiens
caggaaggcgcggctgtgcctg

SEQ ID NO: 8088441 - DNA, 22 bp, Homo sapiens
cagctgaattcttcagactcca

SEQ ID NO: 8088442 - DNA, 22 bp, Homo sapiens
agctgagggcaggatggggtga

SEQ ID NO: 8088443 - DNA, 22 bp, Homo sapiens
agctggcctccgggtgcctggg

SEQ ID NO: 8088444 - DNA, 22 bp, Homo sapiens
caggccagaggctgttgttgcg

SEQ ID NO: 8088445 - DNA, 20 bp, Homo sapiens
caggccagaggtttgatggc

SEQ ID NO: 8088446 - DNA, 18 bp, Homo sapiens
agctggccctggctgccg

SEQ ID NO: 8088447 - DNA, 22 bp, Homo sapiens
agctggccggcctccaggtgga

SEQ ID NO: 8088448 - DNA, 22 bp, Homo sapiens
agctgggctggagctccaagcg

SEQ ID NO: 8088449 - DNA, 19 bp, Homo sapiens
agctgggctgtcacagtga

SEQ ID NO: 8088450 - DNA, 22 bp, Homo sapiens
caggccagcggcccgcgcgttc

SEQ ID NO: 8088451 - DNA, 22 bp, Homo sapiens
caggccagcagggcctccgtgg

SEQ ID NO: 8088452 - DNA, 22 bp, Homo sapiens
caggccagcttcctgacatcct

SEQ ID NO: 8088453 - DNA, 22 bp, Homo sapiens
cagggctccctctggctcccag

SEQ ID NO: 8088454 - DNA, 22 bp, Homo sapiens
cagggctccccagagagcctct

SEQ ID NO: 8088455 - DNA, 22 bp, Homo sapiens
cagggctcgctcttgcccttcg

SEQ ID NO: 8088456 - DNA, 22 bp, Homo sapiens
cagggctcgctcgctcgctcgc

SEQ ID NO: 8088457 - DNA, 22 bp, Homo sapiens
cagggctcgctgccagcttcag

SEQ ID NO: 8088458 - DNA, 22 bp, Homo sapiens
cagggctctgccttgagggatg

SEQ ID NO: 8088459 - DNA, 22 bp, Homo sapiens
cagggatgtctctggaagggag

SEQ ID NO: 8088460 - DNA, 22 bp, Homo sapiens
cagggatggttgagaattggta

SEQ ID NO: 8088461 - DNA, 23 bp, Homo sapiens
cagggccaggcagcagctgtcac

SEQ ID NO: 8088462 - DNA, 22 bp, Homo sapiens
caggggctgtgggcggagcctc

SEQ ID NO: 8088463 - DNA, 22 bp, Homo sapiens
caggtgaggctgaacagatgaa

SEQ ID NO: 8088464 - DNA, 19 bp, Homo sapiens
cagggatgggtagggactc

SEQ ID NO: 8088465 - DNA, 19 bp, Homo sapiens
cagggatgggtagggactc

SEQ ID NO: 8088466 - DNA, 22 bp, Homo sapiens
cagggatggtaaatatgtaaag

SEQ ID NO: 8088467 - DNA, 22 bp, Homo sapiens
cagggatgggatggagtcagtt

SEQ ID NO: 8088468 - DNA, 22 bp, Homo sapiens
cagggagctttcccaggaccct

SEQ ID NO: 8088469 - DNA, 22 bp, Homo sapiens
cagggagctggtgccagccgac

SEQ ID NO: 8088470 - DNA, 22 bp, Homo sapiens
cagggagctctgggccggactc

SEQ ID NO: 8088471 - DNA, 22 bp, Homo sapiens
cagggagcggagtcccatgcct

SEQ ID NO: 8088472 - DNA, 22 bp, Homo sapiens
caggctggagtgcagttgtgca

SEQ ID NO: 8088473 - DNA, 22 bp, Homo sapiens
caggctgcggccgtgtgagcat

SEQ ID NO: 8088474 - DNA, 22 bp, Homo sapiens
caggctgctccagggtaggaaa

SEQ ID NO: 8088475 - DNA, 22 bp, Homo sapiens
caggctgcgtttgtgaaaggta

SEQ ID NO: 8088476 - DNA, 22 bp, Homo sapiens
agctgtggaagactgtcagggt

SEQ ID NO: 8088477 - DNA, 22 bp, Homo sapiens
agctgtgcctattcgtggcaag

SEQ ID NO: 8088478 - DNA, 19 bp, Homo sapiens
agctgtgcagacacttcgc

SEQ ID NO: 8088479 - DNA, 22 bp, Homo sapiens
caggctcagctctggccagtgc

SEQ ID NO: 8088480 - DNA, 22 bp, Homo sapiens
caggctcagcaggagcctgacc

SEQ ID NO: 8088481 - DNA, 22 bp, Homo sapiens
caggctcagatgccctgcgctg

SEQ ID NO: 8088482 - DNA, 22 bp, Homo sapiens
caggctcagaagccagtggagc

SEQ ID NO: 8088483 - DNA, 22 bp, Homo sapiens
cattaaaatatctcatggtgtt

SEQ ID NO: 8088484 - DNA, 22 bp, Homo sapiens
aggcactgtgcagtcccaagca

SEQ ID NO: 8088485 - DNA, 22 bp, Homo sapiens
aggcactgtactaggtacaggg

SEQ ID NO: 8088486 - DNA, 22 bp, Homo sapiens
aggcactgtactaggtacaggg

SEQ ID NO: 8088487 - DNA, 22 bp, Homo sapiens
aggcactggtctaccccttagt

SEQ ID NO: 8088488 - DNA, 22 bp, Homo sapiens
aggcactgtggaagacatggtt

SEQ ID NO: 8088489 - DNA, 22 bp, Homo sapiens
aggcactgtggaagacatggtt

SEQ ID NO: 8088490 - DNA, 15 bp, Homo sapiens
aggcactgtgggacc

SEQ ID NO: 8088491 - DNA, 22 bp, Homo sapiens
aggcactgtgcttcttatatgt

SEQ ID NO: 8088492 - DNA, 22 bp, Homo sapiens
aggcactgtgctgatgtcttat

SEQ ID NO: 8088493 - DNA, 22 bp, Homo sapiens
cattttaaatgatttaagccaa

SEQ ID NO: 8088494 - DNA, 22 bp, Homo sapiens
ccaagtcctgctgccactctac

SEQ ID NO: 8088495 - DNA, 18 bp, Homo sapiens
catgggtgacaggtggat

SEQ ID NO: 8088496 - DNA, 22 bp, Homo sapiens
aggcactgcagattacaggcgc

SEQ ID NO: 8088497 - DNA, 22 bp, Homo sapiens
aggcactgcagattacaggcgc

SEQ ID NO: 8088498 - DNA, 22 bp, Homo sapiens
catgtcaataaatataactgca

SEQ ID NO: 8088499 - DNA, 22 bp, Homo sapiens
catggggcccatgtgctccaag

SEQ ID NO: 8088500 - DNA, 22 bp, Homo sapiens
aggaggggcaatgatagtctgg

SEQ ID NO: 8088501 - DNA, 20 bp, Homo sapiens
aggaggggatagaatcaaag

SEQ ID NO: 8088502 - DNA, 20 bp, Homo sapiens
aggaggggatagaatcaaag

SEQ ID NO: 8088503 - DNA, 16 bp, Homo sapiens
aggaggggaattagga

SEQ ID NO: 8088504 - DNA, 22 bp, Homo sapiens
cagtgcctcttaagtgtcaccc

SEQ ID NO: 8088505 - DNA, 22 bp, Homo sapiens
cagtgctcatagctgttcctcc

SEQ ID NO: 8088506 - DNA, 22 bp, Homo sapiens
cagtgctcctgatgtacccttg

SEQ ID NO: 8088507 - DNA, 22 bp, Homo sapiens
cagtggcatacttggctgatat

SEQ ID NO: 8088508 - DNA, 18 bp, Homo sapiens
cagtggcatagttgagta

SEQ ID NO: 8088509 - DNA, 22 bp, Homo sapiens
caggtgggagcgaggagctact

SEQ ID NO: 8088510 - DNA, 22 bp, Homo sapiens
caggtgggagcgaggagctact

SEQ ID NO: 8088511 - DNA, 22 bp, Homo sapiens
caggtgggaccatgatagggca

SEQ ID NO: 8088512 - DNA, 22 bp, Homo sapiens
caggtgggaccatgatagggca

SEQ ID NO: 8088513 - DNA, 22 bp, Homo sapiens
aggaccagcctccaggtctctt

SEQ ID NO: 8088514 - DNA, 22 bp, Homo sapiens
catataaatacaacatgtgtta

SEQ ID NO: 8088515 - DNA, 22 bp, Homo sapiens
agctgacttcttgatccaatga

SEQ ID NO: 8088516 - DNA, 22 bp, Homo sapiens
agctgactgatgaagaggcctt

SEQ ID NO: 8088517 - DNA, 22 bp, Homo sapiens
agctgactctggcctctggtcc

SEQ ID NO: 8088518 - DNA, 21 bp, Homo sapiens
acagctggtgcagggcgggga

SEQ ID NO: 8088519 - DNA, 22 bp, Homo sapiens
acagctggcaggggggcatgaa

SEQ ID NO: 8088520 - DNA, 22 bp, Homo sapiens
acagctgggaatcagctgggga

SEQ ID NO: 8088521 - DNA, 22 bp, Homo sapiens
acaggatccgctggctttatat

SEQ ID NO: 8088522 - DNA, 22 bp, Homo sapiens
acaggcacctccaggggtatgt

SEQ ID NO: 8088523 - DNA, 17 bp, Homo sapiens
acaggcagatcacctga

SEQ ID NO: 8088524 - DNA, 22 bp, Homo sapiens
agctggcaagttgaaggtggct

SEQ ID NO: 8088525 - DNA, 22 bp, Homo sapiens
acagggagatgggtgaaagcgg

SEQ ID NO: 8088526 - DNA, 22 bp, Homo sapiens
acagggacctgtgagctccata

SEQ ID NO: 8088527 - DNA, 22 bp, Homo sapiens
acaggcagggaccttggctaag

SEQ ID NO: 8088528 - DNA, 22 bp, Homo sapiens
acaggcagcaaaatcagcctca

SEQ ID NO: 8088529 - DNA, 22 bp, Homo sapiens
acaggcagattaagggtaggca

SEQ ID NO: 8088530 - DNA, 22 bp, Homo sapiens
acaggcagatgttttagttgta

SEQ ID NO: 8088531 - DNA, 22 bp, Homo sapiens
acaggcagcgtcattgctgctc

SEQ ID NO: 8088532 - DNA, 22 bp, Homo sapiens
acaggcaggagctccccattcc

SEQ ID NO: 8088533 - DNA, 22 bp, Homo sapiens
aggaagaatgtttacatatcaa

SEQ ID NO: 8088534 - DNA, 22 bp, Homo sapiens
aggaagaacctaagaaagtctc

SEQ ID NO: 8088535 - DNA, 22 bp, Homo sapiens
aggaagaacagataatggacgc

SEQ ID NO: 8088536 - DNA, 22 bp, Homo sapiens
aggaagaaatgtgacttcaaac

SEQ ID NO: 8088537 - DNA, 22 bp, Homo sapiens
aggacacactgcaagagcctgg

SEQ ID NO: 8088538 - DNA, 22 bp, Homo sapiens
acagtaaaaagccttagaattt

SEQ ID NO: 8088539 - DNA, 22 bp, Homo sapiens
aggacacacttctgaggtcttt

SEQ ID NO: 8088540 - DNA, 22 bp, Homo sapiens
acagtctacttgagcttgtata

SEQ ID NO: 8088541 - DNA, 22 bp, Homo sapiens
acagtctctccacactgcaggg

SEQ ID NO: 8088542 - DNA, 22 bp, Homo sapiens
acagtcaatcagaacagcatgt

SEQ ID NO: 8088543 - DNA, 22 bp, Homo sapiens
acagtcattagatacaatgtct

SEQ ID NO: 8088544 - DNA, 20 bp, Homo sapiens
aggcactggggataggtaag

SEQ ID NO: 8088545 - DNA, 20 bp, Homo sapiens
aggcactggggataggtaag

SEQ ID NO: 8088546 - DNA, 22 bp, Homo sapiens
aggcactgggtaattagtagct

SEQ ID NO: 8088547 - DNA, 22 bp, Homo sapiens
aggcactgggggatgagcaagg

SEQ ID NO: 8088548 - DNA, 22 bp, Homo sapiens
aggcactgggaatatgctgagg

SEQ ID NO: 8088549 - DNA, 20 bp, Homo sapiens
aggcactggatttcttatat

SEQ ID NO: 8088550 - DNA, 22 bp, Homo sapiens
aggcactgcttctaagtaggaa

SEQ ID NO: 8088551 - DNA, 22 bp, Homo sapiens
aggcactgcttctaagtaggaa

SEQ ID NO: 8088552 - DNA, 18 bp, Homo sapiens
aggcactggaattaaggg

SEQ ID NO: 8088553 - DNA, 22 bp, Homo sapiens
acatcagagggctcacatgatc

SEQ ID NO: 8088554 - DNA, 22 bp, Homo sapiens
acatccagatctcagcatggct

SEQ ID NO: 8088555 - DNA, 22 bp, Homo sapiens
acatgtttggctctatgctata

SEQ ID NO: 8088556 - DNA, 20 bp, Homo sapiens
aggcctgagagatgactggg

SEQ ID NO: 8088557 - DNA, 22 bp, Homo sapiens
aggccagggtcccacactcgca

SEQ ID NO: 8088558 - DNA, 22 bp, Homo sapiens
aggccagggtagggcccattgt

SEQ ID NO: 8088559 - DNA, 22 bp, Homo sapiens
aggccagggtagggcccattgt

SEQ ID NO: 8088560 - DNA, 22 bp, Homo sapiens
aggccagggccagattagccac

SEQ ID NO: 8088561 - DNA, 22 bp, Homo sapiens
aggccaggggtgagcacttctg

SEQ ID NO: 8088562 - DNA, 22 bp, Homo sapiens
aggccaggcgagacacccggct

SEQ ID NO: 8088563 - DNA, 22 bp, Homo sapiens
aggccaggcctttctccattcc

SEQ ID NO: 8088564 - DNA, 22 bp, Homo sapiens
aggccaggcgagacacccggct

SEQ ID NO: 8088565 - DNA, 22 bp, Homo sapiens
aggccagggcactgctctttag

SEQ ID NO: 8088566 - DNA, 22 bp, Homo sapiens
aggctctgtttgctgtggtacc

SEQ ID NO: 8088567 - DNA, 22 bp, Homo sapiens
acatttgaaaaagttgatggag

SEQ ID NO: 8088568 - DNA, 22 bp, Homo sapiens
acatttgactacatttatatat

SEQ ID NO: 8088569 - DNA, 22 bp, Homo sapiens
acatttgatatggagttgtgta

SEQ ID NO: 8088570 - DNA, 17 bp, Homo sapiens
acatttgcaaaggtctg

SEQ ID NO: 8088571 - DNA, 22 bp, Homo sapiens
agggggcccttgcaggtgagcg

SEQ ID NO: 8088572 - DNA, 22 bp, Homo sapiens
agggggcaggagagacctgctg

SEQ ID NO: 8088573 - DNA, 22 bp, Homo sapiens
agggctgcccagtgtgagagct

SEQ ID NO: 8088574 - DNA, 22 bp, Homo sapiens
agggctgccccagtccagccgg

SEQ ID NO: 8088575 - DNA, 22 bp, Homo sapiens
acccagcctacaaagctcacct

SEQ ID NO: 8088576 - DNA, 19 bp, Homo sapiens
acccagcccaggagtggca

SEQ ID NO: 8088577 - DNA, 22 bp, Homo sapiens
acccagccatgttcagttctct

SEQ ID NO: 8088578 - DNA, 22 bp, Homo sapiens
acccagccacagcattgaggga

SEQ ID NO: 8088579 - DNA, 22 bp, Homo sapiens
agggcagcacaaggcatggact

SEQ ID NO: 8088580 - DNA, 22 bp, Homo sapiens
agggcagcacagctgtgctcct

SEQ ID NO: 8088581 - DNA, 22 bp, Homo sapiens
agggcagcaatttggttcctgg

SEQ ID NO: 8088582 - DNA, 22 bp, Homo sapiens
agggcagcaatgcagctgctgc

SEQ ID NO: 8088583 - DNA, 22 bp, Homo sapiens
accagccccaccgggactgcag

SEQ ID NO: 8088584 - DNA, 22 bp, Homo sapiens
accagcaggccaggggcactgc

SEQ ID NO: 8088585 - DNA, 19 bp, Homo sapiens
accagcccactcccagttt

SEQ ID NO: 8088586 - DNA, 22 bp, Homo sapiens
actgaggaacatatataagatg

SEQ ID NO: 8088587 - DNA, 22 bp, Homo sapiens
agtggcagtggaaagcacacgg

SEQ ID NO: 8088588 - DNA, 22 bp, Homo sapiens
agtggcagggctggctgctgca

SEQ ID NO: 8088589 - DNA, 22 bp, Homo sapiens
agtggcagtagatgagctggtt

SEQ ID NO: 8088590 - DNA, 22 bp, Homo sapiens
actgcactttaggccaactagg

SEQ ID NO: 8088591 - DNA, 22 bp, Homo sapiens
actggaaactacagcctatcct

SEQ ID NO: 8088592 - DNA, 22 bp, Homo sapiens
actggaaagtattctttcactg

SEQ ID NO: 8088593 - DNA, 22 bp, Homo sapiens
actggaaaggctctgaatggga

SEQ ID NO: 8088594 - DNA, 22 bp, Homo sapiens
actggaaagttgattatgtcca

SEQ ID NO: 8088595 - DNA, 22 bp, Homo sapiens
actggaaataaattttgaatgt

SEQ ID NO: 8088596 - DNA, 22 bp, Homo sapiens
actggaaatgagatgatatcag

SEQ ID NO: 8088597 - DNA, 22 bp, Homo sapiens
actggaaaaccactgaaatgag

SEQ ID NO: 8088598 - DNA, 22 bp, Homo sapiens
actggaaaacactactacatgc

SEQ ID NO: 8088599 - DNA, 23 bp, Homo sapiens
agtgttggttgggaagccaagca

SEQ ID NO: 8088600 - DNA, 22 bp, Homo sapiens
agtgttggagtcttggctgcag

SEQ ID NO: 8088601 - DNA, 22 bp, Homo sapiens
agtgttgggtctttagaattta

SEQ ID NO: 8088602 - DNA, 22 bp, Homo sapiens
agtgttggaccgaggtggagcc

SEQ ID NO: 8088603 - DNA, 22 bp, Homo sapiens
agtgtttagtcaagtaagacgc

SEQ ID NO: 8088604 - DNA, 20 bp, Homo sapiens
agtgtttagaatactattat

SEQ ID NO: 8088605 - DNA, 22 bp, Homo sapiens
agtgtttacattgaagcttgta

SEQ ID NO: 8088606 - DNA, 22 bp, Homo sapiens
actaggggctcaggcccaggga

SEQ ID NO: 8088607 - DNA, 22 bp, Homo sapiens
agtatttcttctgagcccaagg

SEQ ID NO: 8088608 - DNA, 22 bp, Homo sapiens
agtatttcttcatatgattact

SEQ ID NO: 8088609 - DNA, 21 bp, Homo sapiens
agtatttcttcatgtccttgc

SEQ ID NO: 8088610 - DNA, 22 bp, Homo sapiens
agtatttgatcagatgatagta

SEQ ID NO: 8088611 - DNA, 22 bp, Homo sapiens
accctccccaagaggtcgtgcc

SEQ ID NO: 8088612 - DNA, 22 bp, Homo sapiens
accctcccatttccatgtagca

SEQ ID NO: 8088613 - DNA, 22 bp, Homo sapiens
actgtgcaggtagatgcctggg

SEQ ID NO: 8088614 - DNA, 22 bp, Homo sapiens
actgtacatgtaaacattgtca

SEQ ID NO: 8088615 - DNA, 22 bp, Homo sapiens
actgtagagaatctgagaaaaa

SEQ ID NO: 8088616 - DNA, 22 bp, Homo sapiens
actgggagaaactgacacctta

SEQ ID NO: 8088617 - DNA, 20 bp, Homo sapiens
actgggagctaacggagatt

SEQ ID NO: 8088618 - DNA, 22 bp, Homo sapiens
actgtcaaatgcaatgaactca

SEQ ID NO: 8088619 - DNA, 22 bp, Homo sapiens
atacagatgttgaatgttatat

SEQ ID NO: 8088620 - DNA, 22 bp, Homo sapiens
acttactactcctttgcaattt

SEQ ID NO: 8088621 - DNA, 20 bp, Homo sapiens
acttaacaccgactaatgat

SEQ ID NO: 8088622 - DNA, 22 bp, Homo sapiens
ataatgcatttagaataattca

SEQ ID NO: 8088623 - DNA, 22 bp, Homo sapiens
atacattagtgaacaaaagaga

SEQ ID NO: 8088624 - DNA, 22 bp, Homo sapiens
acttcttcttcagctgggggat

SEQ ID NO: 8088625 - DNA, 22 bp, Homo sapiens
atacatctatgcctttctgaca

SEQ ID NO: 8088626 - DNA, 22 bp, Homo sapiens
actttatttcctattgcatcca

SEQ ID NO: 8088627 - DNA, 22 bp, Homo sapiens
actttcaagcaagaacactttg

SEQ ID NO: 8088628 - DNA, 22 bp, Homo sapiens
atatttcatggggttccatact

SEQ ID NO: 8088629 - DNA, 21 bp, Homo sapiens
atatttctcataaggttatgg

SEQ ID NO: 8088630 - DNA, 22 bp, Homo sapiens
atattcttccaaaacatcattt

SEQ ID NO: 8088631 - DNA, 22 bp, Homo sapiens
agcaggggtaacagaaggaaag

SEQ ID NO: 8088632 - DNA, 22 bp, Homo sapiens
agcagggctggggcacgagcca

SEQ ID NO: 8088633 - DNA, 23 bp, Homo sapiens
agcaggctgcttctccacagctg

SEQ ID NO: 8088634 - DNA, 22 bp, Homo sapiens
agcaggggctcctccacagcca

SEQ ID NO: 8088635 - DNA, 22 bp, Homo sapiens
cacctagggtttcgcctttctt

SEQ ID NO: 8088636 - DNA, 22 bp, Homo sapiens
cacaatttttcttaggtcctgg

SEQ ID NO: 8088637 - DNA, 22 bp, Homo sapiens
cacaattttcctttaagtgtat

SEQ ID NO: 8088638 - DNA, 22 bp, Homo sapiens
agcaggcaaggtccgtgcctcg

SEQ ID NO: 8088639 - DNA, 22 bp, Homo sapiens
agcaggcacgctccctgcgcga

SEQ ID NO: 8088640 - DNA, 22 bp, Homo sapiens
agcaggagcccttatcaccagg

SEQ ID NO: 8088641 - DNA, 22 bp, Homo sapiens
agcaggctccaggctggccatc

SEQ ID NO: 8088642 - DNA, 22 bp, Homo sapiens
agcagcaggaggccattgtctt

SEQ ID NO: 8088643 - DNA, 22 bp, Homo sapiens
agcagcaggagccgtggggtga

SEQ ID NO: 8088644 - DNA, 22 bp, Homo sapiens
agcagcaggagccgtggggtga

SEQ ID NO: 8088645 - DNA, 23 bp, Homo sapiens
agcagcaggaggtattgataagg

SEQ ID NO: 8088646 - DNA, 22 bp, Homo sapiens
agcagcaggaggctgtccacca

SEQ ID NO: 8088647 - DNA, 20 bp, Homo sapiens
agcagcagatgttggaggtg

SEQ ID NO: 8088648 - DNA, 22 bp, Homo sapiens
agcagcaggctgtgtggactga

SEQ ID NO: 8088649 - DNA, 22 bp, Homo sapiens
agcagcaggctgggatgagtct

SEQ ID NO: 8088650 - DNA, 22 bp, Homo sapiens
agcagcaggctgggatgagtct

SEQ ID NO: 8088651 - DNA, 22 bp, Homo sapiens
caatttttgtacttatagtact

SEQ ID NO: 8088652 - DNA, 22 bp, Homo sapiens
agcagcagggtgatagtgccca

SEQ ID NO: 8088653 - DNA, 22 bp, Homo sapiens
caattttttccatgctcttaca

SEQ ID NO: 8088654 - DNA, 22 bp, Homo sapiens
agcagcagggctctgcccgtgc

SEQ ID NO: 8088655 - DNA, 22 bp, Homo sapiens
agcagcagggcatgtcttactc

SEQ ID NO: 8088656 - DNA, 22 bp, Homo sapiens
agcagcaggcttaaggaaaagt

SEQ ID NO: 8088657 - DNA, 21 bp, Homo sapiens
agcagcagggaagcctcatcc

SEQ ID NO: 8088658 - DNA, 22 bp, Homo sapiens
agcagccacccagctgctcatt

SEQ ID NO: 8088659 - DNA, 22 bp, Homo sapiens
caaatagtttttcatgtattat

SEQ ID NO: 8088660 - DNA, 22 bp, Homo sapiens
caaatagtgtcacattgtgagg

SEQ ID NO: 8088661 - DNA, 22 bp, Homo sapiens
caacagaaggaagcagggtcag

SEQ ID NO: 8088662 - DNA, 22 bp, Homo sapiens
caaatagacttcaatctcttga

SEQ ID NO: 8088663 - DNA, 22 bp, Homo sapiens
caaatagtatgagcaatgattc

SEQ ID NO: 8088664 - DNA, 21 bp, Homo sapiens
agcacagctttaagccatgtg

SEQ ID NO: 8088665 - DNA, 19 bp, Homo sapiens
cagctcagtttgattctct

SEQ ID NO: 8088666 - DNA, 22 bp, Homo sapiens
cagctcagtttcaataccaggt

SEQ ID NO: 8088667 - DNA, 22 bp, Homo sapiens
cagctcaggctctccatgctcc

SEQ ID NO: 8088668 - DNA, 22 bp, Homo sapiens
agctcagccctcctgtgcagct

SEQ ID NO: 8088669 - DNA, 22 bp, Homo sapiens
agctcagcccgttagtaagccc

SEQ ID NO: 8088670 - DNA, 22 bp, Homo sapiens
agctcagcactgtcagcactcc

SEQ ID NO: 8088671 - DNA, 22 bp, Homo sapiens
agctcagagataatcaagagac

SEQ ID NO: 8088672 - DNA, 22 bp, Homo sapiens
cagcatagctgattaaggcaaa

SEQ ID NO: 8088673 - DNA, 22 bp, Homo sapiens
cagcagtgtggaagctgagggg

SEQ ID NO: 8088674 - DNA, 22 bp, Homo sapiens
cagcagctcagtctctcagtag

SEQ ID NO: 8088675 - DNA, 22 bp, Homo sapiens
cagcagctcactcaggtggctc

SEQ ID NO: 8088676 - DNA, 22 bp, Homo sapiens
agcctggcactgccccatccat

SEQ ID NO: 8088677 - DNA, 22 bp, Homo sapiens
cagcaggatatggtggagagag

SEQ ID NO: 8088678 - DNA, 22 bp, Homo sapiens
cagcagctgaggcgctggcgtg

SEQ ID NO: 8088679 - DNA, 22 bp, Homo sapiens
cagagggccccctggccacagt

SEQ ID NO: 8088680 - DNA, 22 bp, Homo sapiens
cagagggcacatggtttcctca

SEQ ID NO: 8088681 - DNA, 22 bp, Homo sapiens
cagagaaaaaatcctgctctca

SEQ ID NO: 8088682 - DNA, 23 bp, Homo sapiens
agcccagcagagaacctaggtcc

SEQ ID NO: 8088683 - DNA, 22 bp, Homo sapiens
agcccagaaatgaaaggatgat

SEQ ID NO: 8088684 - DNA, 22 bp, Homo sapiens
agcccagaggggtttgaggact

SEQ ID NO: 8088685 - DNA, 22 bp, Homo sapiens
agcccagatggtagccctagaa

SEQ ID NO: 8088686 - DNA, 22 bp, Homo sapiens
agcccagataaagtacaaccat

SEQ ID NO: 8088687 - DNA, 20 bp, Homo sapiens
agcccaggcctgtgtgagtc

SEQ ID NO: 8088688 - DNA, 20 bp, Homo sapiens
agcccaggcctgtgtgagtc

SEQ ID NO: 8088689 - DNA, 18 bp, Homo sapiens
agcccaggcatcgtctgc

SEQ ID NO: 8088690 - DNA, 22 bp, Homo sapiens
agcccaggctggagtgcagtgg

SEQ ID NO: 8088691 - DNA, 22 bp, Homo sapiens
agcccaggctggagtgcagtgg

SEQ ID NO: 8088692 - DNA, 22 bp, Homo sapiens
agcccagggaaccaggaagtgg

SEQ ID NO: 8088693 - DNA, 22 bp, Homo sapiens
agcccagggaaccaggaagtgg

SEQ ID NO: 8088694 - DNA, 22 bp, Homo sapiens
cagaggcagtggggttgctcct

SEQ ID NO: 8088695 - DNA, 22 bp, Homo sapiens
agccacaggaaacagagacagc

SEQ ID NO: 8088696 - DNA, 22 bp, Homo sapiens
agccacagtgcaagagagaaaa

SEQ ID NO: 8088697 - DNA, 22 bp, Homo sapiens
agccacagtgggctaccagctc

SEQ ID NO: 8088698 - DNA, 22 bp, Homo sapiens
agccactggtaaactggtagga

SEQ ID NO: 8088699 - DNA, 22 bp, Homo sapiens
agccactggcctgggcagctct

SEQ ID NO: 8088700 - DNA, 22 bp, Homo sapiens
agccactgcccttagccatttg

SEQ ID NO: 8088701 - DNA, 22 bp, Homo sapiens
agccactgtgagaggaccaggg

SEQ ID NO: 8088702 - DNA, 22 bp, Homo sapiens
agccactgtgcaggagcagtgt

SEQ ID NO: 8088703 - DNA, 19 bp, Homo sapiens
agccagaactagtgtttct

SEQ ID NO: 8088704 - DNA, 22 bp, Homo sapiens
agacagcagcagaggggctccc

SEQ ID NO: 8088705 - DNA, 22 bp, Homo sapiens
agacatattggcttgctttaat

SEQ ID NO: 8088706 - DNA, 22 bp, Homo sapiens
agacatttcctagacatcaatg

SEQ ID NO: 8088707 - DNA, 22 bp, Homo sapiens
agacatttggaagatacacata

SEQ ID NO: 8088708 - DNA, 22 bp, Homo sapiens
agacatttggagccaactttcc

SEQ ID NO: 8088709 - DNA, 23 bp, Homo sapiens
agacattttaataaggacttttt

SEQ ID NO: 8088710 - DNA, 22 bp, Homo sapiens
atgacaaaagaagacatgaggt

SEQ ID NO: 8088711 - DNA, 22 bp, Homo sapiens
agaagttgtaggtttgcatatt

SEQ ID NO: 8088712 - DNA, 22 bp, Homo sapiens
agaagtcatttatgttagatga

SEQ ID NO: 8088713 - DNA, 22 bp, Homo sapiens
atgaacaatctggcaagaactt

SEQ ID NO: 8088714 - DNA, 22 bp, Homo sapiens
atgaacaataatcatgtctatg

SEQ ID NO: 8088715 - DNA, 22 bp, Homo sapiens
agacaaatggtaattatgtcta

SEQ ID NO: 8088716 - DNA, 22 bp, Homo sapiens
agacaaatggagtatgagcaac

SEQ ID NO: 8088717 - DNA, 22 bp, Homo sapiens
atgaaagcacgtgggaagataa

SEQ ID NO: 8088718 - DNA, 22 bp, Homo sapiens
agacattttgcattccctgaag

SEQ ID NO: 8088719 - DNA, 22 bp, Homo sapiens
agacattttacattcttccatt

SEQ ID NO: 8088720 - DNA, 22 bp, Homo sapiens
agacattttagacataaaagat

SEQ ID NO: 8088721 - DNA, 22 bp, Homo sapiens
agacccacactttgagtagcaa

SEQ ID NO: 8088722 - DNA, 22 bp, Homo sapiens
atggccagccactcctgatggc

SEQ ID NO: 8088723 - DNA, 22 bp, Homo sapiens
agagacctgagatcctcgacat

SEQ ID NO: 8088724 - DNA, 22 bp, Homo sapiens
atgtgtaaaaggcatgttttat

SEQ ID NO: 8088725 - DNA, 22 bp, Homo sapiens
agagcctgtgattgtcatcacc

SEQ ID NO: 8088726 - DNA, 22 bp, Homo sapiens
agagcctgtaacatctttctta

SEQ ID NO: 8088727 - DNA, 22 bp, Homo sapiens
agagcctgtcaattgtaaagag

SEQ ID NO: 8088728 - DNA, 22 bp, Homo sapiens
agagcctgtctgcctttctacc

SEQ ID NO: 8088729 - DNA, 22 bp, Homo sapiens
agagcctgtacttttctgtgaa

SEQ ID NO: 8088730 - DNA, 22 bp, Homo sapiens
agagccagcaagtgaatagtga

SEQ ID NO: 8088731 - DNA, 22 bp, Homo sapiens
agagccagcaactctagccctg

SEQ ID NO: 8088732 - DNA, 22 bp, Homo sapiens
agagcctgggaatttgcatgtt

SEQ ID NO: 8088733 - DNA, 22 bp, Homo sapiens
agagcctgggcagctcctctgg

SEQ ID NO: 8088734 - DNA, 22 bp, Homo sapiens
atgggggcggctgaagcccagg

SEQ ID NO: 8088735 - DNA, 22 bp, Homo sapiens
atggggtgcatgcagattggga

SEQ ID NO: 8088736 - DNA, 19 bp, Homo sapiens
agagccagacagcatagga

SEQ ID NO: 8088737 - DNA, 22 bp, Homo sapiens
agagccagagacctgggttcac

SEQ ID NO: 8088738 - DNA, 22 bp, Homo sapiens
atgggtggagggtgacacggat

SEQ ID NO: 8088739 - DNA, 18 bp, Homo sapiens
agagcagcggcatcacac

SEQ ID NO: 8088740 - DNA, 22 bp, Homo sapiens
attcatgtggggagccttctgt

SEQ ID NO: 8088741 - DNA, 22 bp, Homo sapiens
attcatgttagcccacatgtag

SEQ ID NO: 8088742 - DNA, 22 bp, Homo sapiens
attcatgtcatagcaggatttc

SEQ ID NO: 8088743 - DNA, 22 bp, Homo sapiens
attcatgtaacattagagaaat

SEQ ID NO: 8088744 - DNA, 22 bp, Homo sapiens
agaggctcctagccactggctt

SEQ ID NO: 8088745 - DNA, 22 bp, Homo sapiens
agaggctccaccttctctgtcc

SEQ ID NO: 8088746 - DNA, 22 bp, Homo sapiens
agaggctcagaggcctggtcct

SEQ ID NO: 8088747 - DNA, 23 bp, Homo sapiens
agaggctcagcgtccacctctac

SEQ ID NO: 8088748 - DNA, 22 bp, Homo sapiens
attccagttgggttctaataca

SEQ ID NO: 8088749 - DNA, 22 bp, Homo sapiens
attattatatagggaaagtccc

SEQ ID NO: 8088750 - DNA, 22 bp, Homo sapiens
attattattgttgatgttaggg

SEQ ID NO: 8088751 - DNA, 22 bp, Homo sapiens
agaggaggctgggtccagataa

SEQ ID NO: 8088752 - DNA, 22 bp, Homo sapiens
atgtttacaattcagtattaca

SEQ ID NO: 8088753 - DNA, 22 bp, Homo sapiens
atgtttatgacctccataagga

SEQ ID NO: 8088754 - DNA, 22 bp, Homo sapiens
atgtttactgaaaagatttcaa

SEQ ID NO: 8088755 - DNA, 22 bp, Homo sapiens
atgtttatgttgggctatattt

SEQ ID NO: 8088756 - DNA, 22 bp, Homo sapiens
atgtttatggagcaggtattag

SEQ ID NO: 8088757 - DNA, 21 bp, Homo sapiens
agagctggtaggtaggtaggt

SEQ ID NO: 8088758 - DNA, 22 bp, Homo sapiens
atttctcattttgcttcaaagg

SEQ ID NO: 8088759 - DNA, 16 bp, Homo sapiens
atttccagattatgca

SEQ ID NO: 8088760 - DNA, 22 bp, Homo sapiens
caaaagtaattgcagtttttgc

SEQ ID NO: 8088761 - DNA, 22 bp, Homo sapiens
caaaagtaattgtggttttcac

SEQ ID NO: 8088762 - DNA, 22 bp, Homo sapiens
caaaagtaatcgtggcttttgc

SEQ ID NO: 8088763 - DNA, 22 bp, Homo sapiens
atttgtgggactataatgcagg

SEQ ID NO: 8088764 - DNA, 22 bp, Homo sapiens
atttcactcattcatgttactt

SEQ ID NO: 8088765 - DNA, 22 bp, Homo sapiens
agatacatatagaaaacatcaa

SEQ ID NO: 8088766 - DNA, 22 bp, Homo sapiens
atttcacttagtgtaatgtctt

SEQ ID NO: 8088767 - DNA, 22 bp, Homo sapiens
aataattagtgggacagagaac

SEQ ID NO: 8088768 - DNA, 22 bp, Homo sapiens
aataattagtgggacagagaac

SEQ ID NO: 8088769 - DNA, 22 bp, Homo sapiens
aagtttatccctctcacagtta

SEQ ID NO: 8088770 - DNA, 22 bp, Homo sapiens
aataagaattgccagatttgaa

SEQ ID NO: 8088771 - DNA, 22 bp, Homo sapiens
aagtgttttgtaaacagaaaag

SEQ ID NO: 8088772 - DNA, 20 bp, Homo sapiens
aagtgttttgacttctgacc

SEQ ID NO: 8088773 - DNA, 22 bp, Homo sapiens
aagtgttttggcttctgtacac

SEQ ID NO: 8088774 - DNA, 22 bp, Homo sapiens
actccaggttttttcactgaag

SEQ ID NO: 8088775 - DNA, 22 bp, Homo sapiens
actccaggttttctctcaagtt

SEQ ID NO: 8088776 - DNA, 20 bp, Homo sapiens
actccaggtggcatgaggac

SEQ ID NO: 8088777 - DNA, 22 bp, Homo sapiens
aagtggactaatacaaggacta

SEQ ID NO: 8088778 - DNA, 22 bp, Homo sapiens
aatatcaacagtgtccttctaa

SEQ ID NO: 8088779 - DNA, 22 bp, Homo sapiens
aatatatttgaatcaggaacaa

SEQ ID NO: 8088780 - DNA, 22 bp, Homo sapiens
aatatatgtggtattgaccagc

SEQ ID NO: 8088781 - DNA, 22 bp, Homo sapiens
aatacactattttgtgctcagt

SEQ ID NO: 8088782 - DNA, 22 bp, Homo sapiens
aatacaatcaaattcactagca

SEQ ID NO: 8088783 - DNA, 22 bp, Homo sapiens
aatcataattgtatacattcat

SEQ ID NO: 8088784 - DNA, 22 bp, Homo sapiens
aatcataattgtatacattcat

SEQ ID NO: 8088785 - DNA, 22 bp, Homo sapiens
actttaaaaagagccttctaac

SEQ ID NO: 8088786 - DNA, 22 bp, Homo sapiens
aatcaacattgttttaagtcaa

SEQ ID NO: 8088787 - DNA, 22 bp, Homo sapiens
aatgaacatggacaagttaata

SEQ ID NO: 8088788 - DNA, 22 bp, Homo sapiens
aatgaaactcgaaataatcaca

SEQ ID NO: 8088789 - DNA, 22 bp, Homo sapiens
acagtacataatcctgagtctg

SEQ ID NO: 8088790 - DNA, 22 bp, Homo sapiens
acagggcttagaaatctgttgc

SEQ ID NO: 8088791 - DNA, 22 bp, Homo sapiens
acagggctccttgggctgacac

SEQ ID NO: 8088792 - DNA, 22 bp, Homo sapiens
acagggctggcgttgggacaga

SEQ ID NO: 8088793 - DNA, 22 bp, Homo sapiens
acagggctgaggctggcttctt

SEQ ID NO: 8088794 - DNA, 22 bp, Homo sapiens
aagctttaaggaattttatgga

SEQ ID NO: 8088795 - DNA, 22 bp, Homo sapiens
aagctttaagtgtcagtcagcc

SEQ ID NO: 8088796 - DNA, 22 bp, Homo sapiens
aaggaaatagatgcagatggta

SEQ ID NO: 8088797 - DNA, 22 bp, Homo sapiens
aaggaaatacttctgcagagca

SEQ ID NO: 8088798 - DNA, 18 bp, Homo sapiens
aagccaggtcaagataag

SEQ ID NO: 8088799 - DNA, 22 bp, Homo sapiens
acaggcagtgatttcctctggt

SEQ ID NO: 8088800 - DNA, 22 bp, Homo sapiens
aaggaaatctttgtaacatctt

SEQ ID NO: 8088801 - DNA, 22 bp, Homo sapiens
aaggcacttttctaaagacctt

SEQ ID NO: 8088802 - DNA, 22 bp, Homo sapiens
aaggcactacgctgctggggcg

SEQ ID NO: 8088803 - DNA, 22 bp, Homo sapiens
aaggcacttttcctgagatgat

SEQ ID NO: 8088804 - DNA, 22 bp, Homo sapiens
aaggcacttgcccagagctgca

SEQ ID NO: 8088805 - DNA, 22 bp, Homo sapiens
aaggcacttaacgtgggaggat

SEQ ID NO: 8088806 - DNA, 22 bp, Homo sapiens
aaggtagatgttgtcatgccca

SEQ ID NO: 8088807 - DNA, 22 bp, Homo sapiens
accatcctgaaaccttcatgct

SEQ ID NO: 8088808 - DNA, 22 bp, Homo sapiens
aaggtggcgctggagctggtcc

SEQ ID NO: 8088809 - DNA, 22 bp, Homo sapiens
accatgggtcagccacctcagc

SEQ ID NO: 8088810 - DNA, 22 bp, Homo sapiens
accccaggcccagggaagaggc

SEQ ID NO: 8088811 - DNA, 22 bp, Homo sapiens
accccaggtcatctgagagtcc

SEQ ID NO: 8088812 - DNA, 22 bp, Homo sapiens
aagtcacaaagtgctgtacatg

SEQ ID NO: 8088813 - DNA, 22 bp, Homo sapiens
aaggctgcctctgccagaggag

SEQ ID NO: 8088814 - DNA, 22 bp, Homo sapiens
aaggctgcctctgccagaggag

SEQ ID NO: 8088815 - DNA, 22 bp, Homo sapiens
aagggccattgctgagagcagt

SEQ ID NO: 8088816 - DNA, 22 bp, Homo sapiens
aagggccatcccagaacagaaa

SEQ ID NO: 8088817 - DNA, 22 bp, Homo sapiens
aagggctctgtgtgcctcccca

SEQ ID NO: 8088818 - DNA, 20 bp, Homo sapiens
agctcctttgtgtccaggat

SEQ ID NO: 8088819 - DNA, 22 bp, Homo sapiens
acagcaggaattaacatataag

SEQ ID NO: 8088820 - DNA, 22 bp, Homo sapiens
acagcagctaaaggtgtctcct

SEQ ID NO: 8088821 - DNA, 22 bp, Homo sapiens
acagcaggatttggcgatgttg

SEQ ID NO: 8088822 - DNA, 22 bp, Homo sapiens
acagcaggagccttcatatgct

SEQ ID NO: 8088823 - DNA, 22 bp, Homo sapiens
acagcaggcatgaatgacactg

SEQ ID NO: 8088824 - DNA, 22 bp, Homo sapiens
acagcaggcatgaagaaatgtt

SEQ ID NO: 8088825 - DNA, 22 bp, Homo sapiens
acagcaggcacacaaggataga

SEQ ID NO: 8088826 - DNA, 17 bp, Homo sapiens
agcctgctgatctcaca

SEQ ID NO: 8088827 - DNA, 22 bp, Homo sapiens
agcctgctggaccaagctcatg

SEQ ID NO: 8088828 - DNA, 17 bp, Homo sapiens
agcctgccccatgctgc

SEQ ID NO: 8088829 - DNA, 20 bp, Homo sapiens
agcctgccagctggcccaga

SEQ ID NO: 8088830 - DNA, 21 bp, Homo sapiens
acagcaagccttcacatgagt

SEQ ID NO: 8088831 - DNA, 21 bp, Homo sapiens
acagcaagccttcacatgagt

SEQ ID NO: 8088832 - DNA, 22 bp, Homo sapiens
agccacagtcaacctgtccata

SEQ ID NO: 8088833 - DNA, 22 bp, Homo sapiens
agccagggtgggtgaatgctat

SEQ ID NO: 8088834 - DNA, 22 bp, Homo sapiens
agccatgggctcccagtccttt

SEQ ID NO: 8088835 - DNA, 22 bp, Homo sapiens
agcccagcggagcgggcccggg

SEQ ID NO: 8088836 - DNA, 22 bp, Homo sapiens
agcccagctgcctgcctgctgt

SEQ ID NO: 8088837 - DNA, 22 bp, Homo sapiens
agcagtgggtgacagagctgag

SEQ ID NO: 8088838 - DNA, 22 bp, Homo sapiens
acactgtgcttagatgctgaac

SEQ ID NO: 8088839 - DNA, 22 bp, Homo sapiens
acactgtgcttagatgctgaac

SEQ ID NO: 8088840 - DNA, 20 bp, Homo sapiens
acactgtgctaaggattttc

SEQ ID NO: 8088841 - DNA, 20 bp, Homo sapiens
acactgtgctaaggattttc

SEQ ID NO: 8088842 - DNA, 21 bp, Homo sapiens
acactgtgtcataatgcttaa

SEQ ID NO: 8088843 - DNA, 22 bp, Homo sapiens
acactgtgtctagcattttaca

SEQ ID NO: 8088844 - DNA, 22 bp, Homo sapiens
acactgtgcatgcatatacaca

SEQ ID NO: 8088845 - DNA, 22 bp, Homo sapiens
acactgtgcatgcatatacaca

SEQ ID NO: 8088846 - DNA, 22 bp, Homo sapiens
acactgtgatttctgggttcca

SEQ ID NO: 8088847 - DNA, 22 bp, Homo sapiens
acactgtgatcttgagaaaggt

SEQ ID NO: 8088848 - DNA, 22 bp, Homo sapiens
acactgtgcagattccctgtga

SEQ ID NO: 8088849 - DNA, 22 bp, Homo sapiens
acagaaattctgggacagaaaa

SEQ ID NO: 8088850 - DNA, 22 bp, Homo sapiens
acagaaattgggcaaatggaag

SEQ ID NO: 8088851 - DNA, 22 bp, Homo sapiens
acagaaattgggcaaatggaag

SEQ ID NO: 8088852 - DNA, 22 bp, Homo sapiens
acagaacaagacctgcttattg

SEQ ID NO: 8088853 - DNA, 22 bp, Homo sapiens
agccacagggggtgagggacaa

SEQ ID NO: 8088854 - DNA, 22 bp, Homo sapiens
agccacaggtgttggccagtgt

SEQ ID NO: 8088855 - DNA, 22 bp, Homo sapiens
acacattatctcattaaatact

SEQ ID NO: 8088856 - DNA, 22 bp, Homo sapiens
acacatttctctttttgtaagt

SEQ ID NO: 8088857 - DNA, 22 bp, Homo sapiens
acactgtgacaaaggctgttct

SEQ ID NO: 8088858 - DNA, 22 bp, Homo sapiens
acactgtgacaagaaagagctg

SEQ ID NO: 8088859 - DNA, 22 bp, Homo sapiens
acactgtgagctgaagggctgc

SEQ ID NO: 8088860 - DNA, 22 bp, Homo sapiens
acactgtgagctgaagggctgc

SEQ ID NO: 8088861 - DNA, 22 bp, Homo sapiens
acactgtgacggaaataaagaa

SEQ ID NO: 8088862 - DNA, 23 bp, Homo sapiens
agcagggccagaatacttgctgt

SEQ ID NO: 8088863 - DNA, 22 bp, Homo sapiens
agcagggcccactaggggagat

SEQ ID NO: 8088864 - DNA, 22 bp, Homo sapiens
agcagggcagttaaagggtcct

SEQ ID NO: 8088865 - DNA, 22 bp, Homo sapiens
agcagcaggtgacctcgatgcc

SEQ ID NO: 8088866 - DNA, 22 bp, Homo sapiens
agcagcagtcatgcctatgctc

SEQ ID NO: 8088867 - DNA, 22 bp, Homo sapiens
acacataagaaactacaaagag

SEQ ID NO: 8088868 - DNA, 23 bp, Homo sapiens
agcagcagtgagaggtgtcttac

SEQ ID NO: 8088869 - DNA, 22 bp, Homo sapiens
agcagcagtgacagccgaaagc

SEQ ID NO: 8088870 - DNA, 22 bp, Homo sapiens
agcagcagtgtgtggtcatgtt

SEQ ID NO: 8088871 - DNA, 22 bp, Homo sapiens
acacaggacggccctgtggctt

SEQ ID NO: 8088872 - DNA, 22 bp, Homo sapiens
acacaggaagtcagcactgatg

SEQ ID NO: 8088873 - DNA, 22 bp, Homo sapiens
acacaggaagtcagcactgatg

SEQ ID NO: 8088874 - DNA, 22 bp, Homo sapiens
acacaggaagagagataataat

SEQ ID NO: 8088875 - DNA, 22 bp, Homo sapiens
acacagatttcactggaataga

SEQ ID NO: 8088876 - DNA, 22 bp, Homo sapiens
acacagatgggtagaaaacaga

SEQ ID NO: 8088877 - DNA, 22 bp, Homo sapiens
acaattctgggtatttatatag

SEQ ID NO: 8088878 - DNA, 20 bp, Homo sapiens
acaatttcctcactatatgc

SEQ ID NO: 8088879 - DNA, 22 bp, Homo sapiens
acaatttatccattgtatagtt

SEQ ID NO: 8088880 - DNA, 22 bp, Homo sapiens
acaagttaccaaaaaagattca

SEQ ID NO: 8088881 - DNA, 22 bp, Homo sapiens
acaaatgtgtctaattgtgcct

SEQ ID NO: 8088882 - DNA, 22 bp, Homo sapiens
acaaatgtctcctcttttgtta

SEQ ID NO: 8088883 - DNA, 22 bp, Homo sapiens
acaaatgtggacatggataatg

SEQ ID NO: 8088884 - DNA, 22 bp, Homo sapiens
acaattctctcatatcttatta

SEQ ID NO: 8088885 - DNA, 22 bp, Homo sapiens
acaatgtttttgttcaaagagt

SEQ ID NO: 8088886 - DNA, 22 bp, Homo sapiens
acaatgttttgaaacatctagg

SEQ ID NO: 8088887 - DNA, 22 bp, Homo sapiens
agcaaggaaactatggagagat

SEQ ID NO: 8088888 - DNA, 22 bp, Homo sapiens
agcaagctcttggaaatgagct

SEQ ID NO: 8088889 - DNA, 21 bp, Homo sapiens
agcaccagttttatgccaggc

SEQ ID NO: 8088890 - DNA, 20 bp, Homo sapiens
acaaaataggtactgggtag

SEQ ID NO: 8088891 - DNA, 22 bp, Homo sapiens
aattttcacagtgctgtgagat

SEQ ID NO: 8088892 - DNA, 22 bp, Homo sapiens
agagctgggtggtggtgactca

SEQ ID NO: 8088893 - DNA, 22 bp, Homo sapiens
acaaactaaaattctttattga

SEQ ID NO: 8088894 - DNA, 22 bp, Homo sapiens
acaaaattgtgttaaactttat

SEQ ID NO: 8088895 - DNA, 22 bp, Homo sapiens
acaaatgactatttggtacagg

SEQ ID NO: 8088896 - DNA, 22 bp, Homo sapiens
acaaatatggtactcggagaaa

SEQ ID NO: 8088897 - DNA, 19 bp, Homo sapiens
acaaatgatgttgcactga

SEQ ID NO: 8088898 - DNA, 22 bp, Homo sapiens
acaaatgattatcacagaggag

SEQ ID NO: 8088899 - DNA, 22 bp, Homo sapiens
acaaatgagaatgtagacagag

SEQ ID NO: 8088900 - DNA, 19 bp, Homo sapiens
acaaatgatgttgcactga

SEQ ID NO: 8088901 - DNA, 19 bp, Homo sapiens
acaaatgatgttgcactga

SEQ ID NO: 8088902 - DNA, 22 bp, Homo sapiens
aatgttgaggatatcagaaaat

SEQ ID NO: 8088903 - DNA, 22 bp, Homo sapiens
agacagggccactcatcctcac

SEQ ID NO: 8088904 - DNA, 22 bp, Homo sapiens
aatgtattctctttataagata

SEQ ID NO: 8088905 - DNA, 22 bp, Homo sapiens
agaagggccagctggacacctg

SEQ ID NO: 8088906 - DNA, 22 bp, Homo sapiens
agacagcagaaactagagcact

SEQ ID NO: 8088907 - DNA, 22 bp, Homo sapiens
agacagcacttttgtatggggg

SEQ ID NO: 8088908 - DNA, 22 bp, Homo sapiens
acaaagatgtttaaagcattta

SEQ ID NO: 8088909 - DNA, 22 bp, Homo sapiens
aagagctggtcacaggtccatt

SEQ ID NO: 8088910 - DNA, 22 bp, Homo sapiens
aagagctggagctgctacagga

SEQ ID NO: 8088911 - DNA, 19 bp, Homo sapiens
aagagcagggaaagaattg

SEQ ID NO: 8088912 - DNA, 20 bp, Homo sapiens
aagagctgactcacagtggt

SEQ ID NO: 8088913 - DNA, 20 bp, Homo sapiens
aagacaccagtggcagcccc

SEQ ID NO: 8088914 - DNA, 22 bp, Homo sapiens
aatttaactgagagtactttta

SEQ ID NO: 8088915 - DNA, 22 bp, Homo sapiens
aagaataacacttaggttttgc

SEQ ID NO: 8088916 - DNA, 22 bp, Homo sapiens
aagaataaattaagatacttag

SEQ ID NO: 8088917 - DNA, 22 bp, Homo sapiens
aatgttttctctgtgaacacat

SEQ ID NO: 8088918 - DNA, 22 bp, Homo sapiens
aagaaatggcttcatctgagta

SEQ ID NO: 8088919 - DNA, 22 bp, Homo sapiens
aagaaagcattagacaggcatt

SEQ ID NO: 8088920 - DNA, 22 bp, Homo sapiens
aacttatacccagggcagaaat

SEQ ID NO: 8088921 - DNA, 22 bp, Homo sapiens
acagcagcttcctgactgtact

SEQ ID NO: 8088922 - DNA, 22 bp, Homo sapiens
acagcagcttcctgactgtact

SEQ ID NO: 8088923 - DNA, 22 bp, Homo sapiens
acagcagcttgtctgttcttta

SEQ ID NO: 8088924 - DNA, 19 bp, Homo sapiens
aagccagctgccagctcgg

SEQ ID NO: 8088925 - DNA, 18 bp, Homo sapiens
acagacaaaatggaaatg

SEQ ID NO: 8088926 - DNA, 22 bp, Homo sapiens
acagaattgaaagtataatctg

SEQ ID NO: 8088927 - DNA, 22 bp, Homo sapiens
acagagtagctcaagaagattg

SEQ ID NO: 8088928 - DNA, 22 bp, Homo sapiens
aagatgttgactcctttgatgt

SEQ ID NO: 8088929 - DNA, 22 bp, Homo sapiens
aagatgttctattttcactttt

SEQ ID NO: 8088930 - DNA, 22 bp, Homo sapiens
acactggattcttgtagtgaag

SEQ ID NO: 8088931 - DNA, 21 bp, Homo sapiens
acactgcaggtgaagtgcact

SEQ ID NO: 8088932 - DNA, 22 bp, Homo sapiens
acactgcatttcaacaaggccc

SEQ ID NO: 8088933 - DNA, 22 bp, Homo sapiens
acactgcatttcaacaaggccc

SEQ ID NO: 8088934 - DNA, 22 bp, Homo sapiens
aagcacagaaaaggagcatgga

SEQ ID NO: 8088935 - DNA, 22 bp, Homo sapiens
aagcacaggatcttgaggagcg

SEQ ID NO: 8088936 - DNA, 22 bp, Homo sapiens
aactacaatatgtatgtatgta

SEQ ID NO: 8088937 - DNA, 22 bp, Homo sapiens
aatataatgctgttttatgcca

SEQ ID NO: 8088938 - DNA, 21 bp, Homo sapiens
aatcatacaaaacatgtcagg

SEQ ID NO: 8088939 - DNA, 22 bp, Homo sapiens
aatcattcttatttcacagcaa

SEQ ID NO: 8088940 - DNA, 22 bp, Homo sapiens
aactgcaagagtaaatgtctag

SEQ ID NO: 8088941 - DNA, 22 bp, Homo sapiens
aactgcaacttcgtaaagtgag

SEQ ID NO: 8088942 - DNA, 22 bp, Homo sapiens
aactgcaacttgtttgattctt

SEQ ID NO: 8088943 - DNA, 22 bp, Homo sapiens
aactgcaagctctttactgcta

SEQ ID NO: 8088944 - DNA, 23 bp, Homo sapiens
aactgcaaggttgctgggaagta

SEQ ID NO: 8088945 - DNA, 22 bp, Homo sapiens
aactgcaagtggggcttgtcat

SEQ ID NO: 8088946 - DNA, 22 bp, Homo sapiens
aactgcaataacttgtgcacca

SEQ ID NO: 8088947 - DNA, 22 bp, Homo sapiens
aactgcaatcacttttgcacca

SEQ ID NO: 8088948 - DNA, 22 bp, Homo sapiens
aactgcaattacttttgcacca

SEQ ID NO: 8088949 - DNA, 22 bp, Homo sapiens
aactgcaattacttttgcacta

SEQ ID NO: 8088950 - DNA, 22 bp, Homo sapiens
aactgcaattacttttgcgcca

SEQ ID NO: 8088951 - DNA, 22 bp, Homo sapiens
aactgtttcagaaatattgttg

SEQ ID NO: 8088952 - DNA, 19 bp, Homo sapiens
aactgtaaagatctgtagc

SEQ ID NO: 8088953 - DNA, 19 bp, Homo sapiens
aactgtaaagatctgtagc

SEQ ID NO: 8088954 - DNA, 22 bp, Homo sapiens
aatataaattcctgggcccagc

SEQ ID NO: 8088955 - DNA, 22 bp, Homo sapiens
aataagaacaactaaggtttat

SEQ ID NO: 8088956 - DNA, 22 bp, Homo sapiens
aataagaactccatttactcgt

SEQ ID NO: 8088957 - DNA, 22 bp, Homo sapiens
aacatgcatgaagaagttatat

SEQ ID NO: 8088958 - DNA, 22 bp, Homo sapiens
aacagtaaagacagaatttatc

SEQ ID NO: 8088959 - DNA, 22 bp, Homo sapiens
aacatgcatataggtaaatgga

SEQ ID NO: 8088960 - DNA, 22 bp, Homo sapiens
aacaggcctatagggaaggcgc

SEQ ID NO: 8088961 - DNA, 22 bp, Homo sapiens
aacaggccctaggaattgggcc

SEQ ID NO: 8088962 - DNA, 22 bp, Homo sapiens
aacaggcaggagaattctgcct

SEQ ID NO: 8088963 - DNA, 22 bp, Homo sapiens
aacagcagggaaattccaagtc

SEQ ID NO: 8088964 - DNA, 22 bp, Homo sapiens
aacagcagggatgacatggcca

SEQ ID NO: 8088965 - DNA, 22 bp, Homo sapiens
aacagcaggtcctggcatgggt

SEQ ID NO: 8088966 - DNA, 22 bp, Homo sapiens
aagtccaaggctgggtgcagtg

SEQ ID NO: 8088967 - DNA, 17 bp, Homo sapiens
aagtccagagttgagca

SEQ ID NO: 8088968 - DNA, 22 bp, Homo sapiens
aacactctacgtgcagctccta

SEQ ID NO: 8088969 - DNA, 22 bp, Homo sapiens
aacaaacagttaagtgtggatg

SEQ ID NO: 8088970 - DNA, 20 bp, Homo sapiens
aacaaactacaaaattatgt

SEQ ID NO: 8088971 - DNA, 22 bp, Homo sapiens
aacaaacattacctggtgctgg

SEQ ID NO: 8088972 - DNA, 22 bp, Homo sapiens
aaatgtttctacttgtgagcat

SEQ ID NO: 8088973 - DNA, 22 bp, Homo sapiens
aaatgttttgctcccatgtggt

SEQ ID NO: 8088974 - DNA, 22 bp, Homo sapiens
aaacaatttccacctctcctga

SEQ ID NO: 8088975 - DNA, 22 bp, Homo sapiens
aaacaatgttcctatattagag

SEQ ID NO: 8088976 - DNA, 22 bp, Homo sapiens
aaacagtgactggtacataata

SEQ ID NO: 8088977 - DNA, 22 bp, Homo sapiens
aaacaatgagcttttacacact

SEQ ID NO: 8088978 - DNA, 22 bp, Homo sapiens
aaacaatgtacatttataatgc

SEQ ID NO: 8088979 - DNA, 22 bp, Homo sapiens
aaaggtcaaaatcgtgacattg

SEQ ID NO: 8088980 - DNA, 22 bp, Homo sapiens
aaatgcagatccctgaatctca

SEQ ID NO: 8088981 - DNA, 22 bp, Homo sapiens
aaatgcagaatgatttcatcta

SEQ ID NO: 8088982 - DNA, 17 bp, Homo sapiens
aaactgaaaaattcact

SEQ ID NO: 8088983 - DNA, 21 bp, Homo sapiens
aaactgaagagacaggaactt

SEQ ID NO: 8088984 - DNA, 22 bp, Homo sapiens
aaactgaaacatcatcatgttg

SEQ ID NO: 8088985 - DNA, 22 bp, Homo sapiens
aaactctggagatgtttatgca

SEQ ID NO: 8088986 - DNA, 22 bp, Homo sapiens
aaactctgttgagataatattt

SEQ ID NO: 8088987 - DNA, 22 bp, Homo sapiens
aaactcttcatatacatatgct

SEQ ID NO: 8088988 - DNA, 22 bp, Homo sapiens
aaaaaattccattctgtgcctt

SEQ ID NO: 8088989 - DNA, 20 bp, Homo sapiens
aaaaacagtaatgctgaaga

SEQ ID NO: 8088990 - DNA, 22 bp, Homo sapiens
aaacagagagatgtatgtggag

SEQ ID NO: 8088991 - DNA, 22 bp, Homo sapiens
aaaaatctatgactgcttctcc

SEQ ID NO: 8088992 - DNA, 22 bp, Homo sapiens
aaaatgaataagttaacccagg

SEQ ID NO: 8088993 - DNA, 22 bp, Homo sapiens
aaacaaacaattagttgtgtgg

SEQ ID NO: 8088994 - DNA, 22 bp, Homo sapiens
aaacaatgaaatatttttatgg

SEQ ID NO: 8088995 - DNA, 22 bp, Homo sapiens
aaacaatccaggaacctgttta

SEQ ID NO: 8088996 - DNA, 22 bp, Homo sapiens
aaacaagtcactttatcttgaa

SEQ ID NO: 8088997 - DNA, 22 bp, Homo sapiens
aaactctactgaggaaataaga

SEQ ID NO: 8088998 - DNA, 22 bp, Homo sapiens
aaaggaaaataagtagttccat

SEQ ID NO: 8088999 - DNA, 22 bp, Homo sapiens
aactaaatctggcatttagagc

SEQ ID NO: 8089000 - DNA, 22 bp, Homo sapiens
aaagataatgtttccttattct

SEQ ID NO: 8089001 - DNA, 22 bp, Homo sapiens
aacaaacaaacattttgtcatc

SEQ ID NO: 8089002 - DNA, 22 bp, Homo sapiens
aaattttagtaaggaagttgag

SEQ ID NO: 8089003 - DNA, 22 bp, Homo sapiens
aaagccacgtggcctggggagc

SEQ ID NO: 8089004 - DNA, 22 bp, Homo sapiens
aaagatcaatagataaagctac

SEQ ID NO: 8089005 - DNA, 22 bp, Homo sapiens
aacagcaatagcactattcatt

SEQ ID NO: 8089006 - DNA, 22 bp, Homo sapiens
aaagctcttatagcagagtgtg

SEQ ID NO: 8089007 - DNA, 22 bp, Homo sapiens
aaagctcttatgtaaacagaaa

SEQ ID NO: 8089008 - DNA, 22 bp, Homo sapiens
aaagctcttggattttagactc

SEQ ID NO: 8089009 - DNA, 22 bp, Homo sapiens
aaagctgtagaatcatcttaat

SEQ ID NO: 8089010 - DNA, 22 bp, Homo sapiens
aaatagcagcctttagttaaca

SEQ ID NO: 8089011 - DNA, 22 bp, Homo sapiens
aaataattgagttggtcaatat

SEQ ID NO: 8089012 - DNA, 22 bp, Homo sapiens
aaatcccactcagaaactgcca

SEQ ID NO: 8089013 - DNA, 22 bp, Homo sapiens
aaataacttggtttcatcagag

SEQ ID NO: 8089014 - DNA, 22 bp, Homo sapiens
aaataactttctgtgtatagtc

SEQ ID NO: 8089015 - DNA, 22 bp, Homo sapiens
aaataagttaaactagaatgat

SEQ ID NO: 8089016 - DNA, 22 bp, Homo sapiens
aaataagtagtttagtgttgtg

SEQ ID NO: 8089017 - DNA, 22 bp, Homo sapiens
aaataattatagcgagtctatc

SEQ ID NO: 8089018 - DNA, 22 bp, Homo sapiens
aaagtgttttgatttagtggta

SEQ ID NO: 8089019 - DNA, 22 bp, Homo sapiens
aaagtgtttttgagctgtagtt

SEQ ID NO: 8089020 - DNA, 22 bp, Homo sapiens
aaataacttatgatcgtctggc

SEQ ID NO: 8089021 - DNA, 22 bp, Homo sapiens
aaagtgttgggattacaggcat

SEQ ID NO: 8089022 - DNA, 22 bp, Homo sapiens
aaatgtattgcataggatattt

SEQ ID NO: 8089023 - DNA, 22 bp, Homo sapiens
aaatctagaagtttaaaaggat

SEQ ID NO: 8089024 - DNA, 22 bp, Homo sapiens
aaatgcaggaaattatgctttt

SEQ ID NO: 8089025 - DNA, 22 bp, Homo sapiens
ggcactgataatgtcctctctc

SEQ ID NO: 8089026 - DNA, 22 bp, Homo sapiens
ggcactgatctgatttccctcc

SEQ ID NO: 8089027 - DNA, 23 bp, Homo sapiens
ggcactgaagctacaatggtgag

SEQ ID NO: 8089028 - DNA, 22 bp, Homo sapiens
ggcactgaaccaggacacaagc

SEQ ID NO: 8089029 - DNA, 22 bp, Homo sapiens
ggcactgaatttcttggcatct

SEQ ID NO: 8089030 - DNA, 22 bp, Homo sapiens
ggcactgaagtgggtgttgggt

SEQ ID NO: 8089031 - DNA, 22 bp, Homo sapiens
ggcactgagaacaggctgactt

SEQ ID NO: 8089032 - DNA, 22 bp, Homo sapiens
ggcactgactgtgcagcgcacc

SEQ ID NO: 8089033 - DNA, 22 bp, Homo sapiens
ggcactgacactagcatggcac

SEQ ID NO: 8089034 - DNA, 22 bp, Homo sapiens
ggcactgagaggctcttcctaa

SEQ ID NO: 8089035 - DNA, 21 bp, Homo sapiens
ggcactgagccagatggactc

SEQ ID NO: 8089036 - DNA, 22 bp, Homo sapiens
ggcactgagctgccttggggca

SEQ ID NO: 8089037 - DNA, 22 bp, Homo sapiens
ggcactgagcgggctctgagcg

SEQ ID NO: 8089038 - DNA, 20 bp, Homo sapiens
ggcagcaattcaccctatcc

SEQ ID NO: 8089039 - DNA, 21 bp, Homo sapiens
ggcagcactacctgaagcata

SEQ ID NO: 8089040 - DNA, 22 bp, Homo sapiens
ggcagcagaactggccctgtat

SEQ ID NO: 8089041 - DNA, 22 bp, Homo sapiens
ggcagcaactcattattcctgt

SEQ ID NO: 8089042 - DNA, 17 bp, Homo sapiens
ggaggcaacagacaggg

SEQ ID NO: 8089043 - DNA, 22 bp, Homo sapiens
ggaggcacacctcagactggga

SEQ ID NO: 8089044 - DNA, 23 bp, Homo sapiens
ggaggcacttaggcagagcagag

SEQ ID NO: 8089045 - DNA, 22 bp, Homo sapiens
ggcacctgctcatctggactca

SEQ ID NO: 8089046 - DNA, 22 bp, Homo sapiens
ggcacctggatgtagcagtgaa

SEQ ID NO: 8089047 - DNA, 22 bp, Homo sapiens
ggcacctggtaagtgctcagta

SEQ ID NO: 8089048 - DNA, 22 bp, Homo sapiens
ggcacctgtgtaagatctggaa

SEQ ID NO: 8089049 - DNA, 22 bp, Homo sapiens
ggcaccagggcaagggtctttc

SEQ ID NO: 8089050 - DNA, 22 bp, Homo sapiens
ggcagctcactgattagcaatt

SEQ ID NO: 8089051 - DNA, 17 bp, Homo sapiens
ggcagtggaggaagaga

SEQ ID NO: 8089052 - DNA, 22 bp, Homo sapiens
ggcagtggcagagcttggtcta

SEQ ID NO: 8089053 - DNA, 22 bp, Homo sapiens
ggcagtggaggaccctgtgtct

SEQ ID NO: 8089054 - DNA, 22 bp, Homo sapiens
ggcagtgcaaggctggcacagt

SEQ ID NO: 8089055 - DNA, 22 bp, Homo sapiens
ggcaggggtcctggtgttgact

SEQ ID NO: 8089056 - DNA, 22 bp, Homo sapiens
ggccacagagggcgggatgctg

SEQ ID NO: 8089057 - DNA, 22 bp, Homo sapiens
ggcagtgggaaataagtgagaa

SEQ ID NO: 8089058 - DNA, 22 bp, Homo sapiens
ggcagtggctcctctctactcc

SEQ ID NO: 8089059 - DNA, 22 bp, Homo sapiens
ggccacagcagatgcttcagat

SEQ ID NO: 8089060 - DNA, 21 bp, Homo sapiens
ggccacagttagggctcagga

SEQ ID NO: 8089061 - DNA, 22 bp, Homo sapiens
ggccagcagacctcagggactc

SEQ ID NO: 8089062 - DNA, 19 bp, Homo sapiens
ggccagcacagggctctgt

SEQ ID NO: 8089063 - DNA, 22 bp, Homo sapiens
ggccagcatggcaagaccaact

SEQ ID NO: 8089064 - DNA, 22 bp, Homo sapiens
ggccagcatatagagtgaagta

SEQ ID NO: 8089065 - DNA, 22 bp, Homo sapiens
ggccagcatatagagtgaagta

SEQ ID NO: 8089066 - DNA, 22 bp, Homo sapiens
ggccagcagtcacagggtcaga

SEQ ID NO: 8089067 - DNA, 22 bp, Homo sapiens
ggccagcagtcacagggtcaga

SEQ ID NO: 8089068 - DNA, 22 bp, Homo sapiens
ggccagcagtatatagctaatt

SEQ ID NO: 8089069 - DNA, 22 bp, Homo sapiens
ggccagcaggccctgtgatcct

SEQ ID NO: 8089070 - DNA, 21 bp, Homo sapiens
ggccagcagcgtccactgtgg

SEQ ID NO: 8089071 - DNA, 22 bp, Homo sapiens
ggccagcatggcaagaccaact

SEQ ID NO: 8089072 - DNA, 22 bp, Homo sapiens
ggcccaggctggagtgcagtgg

SEQ ID NO: 8089073 - DNA, 22 bp, Homo sapiens
ggcccaggctggagtgcagtgg

SEQ ID NO: 8089074 - DNA, 22 bp, Homo sapiens
ggcccaggatgcaagaactgaa

SEQ ID NO: 8089075 - DNA, 22 bp, Homo sapiens
ggcccaggtccagcgagtacct

SEQ ID NO: 8089076 - DNA, 22 bp, Homo sapiens
ggctcactgcaacttccgcctc

SEQ ID NO: 8089077 - DNA, 22 bp, Homo sapiens
ggctcactgcaacttccgcctc

SEQ ID NO: 8089078 - DNA, 22 bp, Homo sapiens
ggctctgaattattcctgagtc

SEQ ID NO: 8089079 - DNA, 22 bp, Homo sapiens
ggctctgaagggtgacaggttt

SEQ ID NO: 8089080 - DNA, 23 bp, Homo sapiens
ggctctgaggatggagctggtgg

SEQ ID NO: 8089081 - DNA, 22 bp, Homo sapiens
ggctctgaaggagacagctgct

SEQ ID NO: 8089082 - DNA, 22 bp, Homo sapiens
ggctcagacctcccagctccag

SEQ ID NO: 8089083 - DNA, 22 bp, Homo sapiens
ggctcagaggccagcaggtaga

SEQ ID NO: 8089084 - DNA, 22 bp, Homo sapiens
ggctggaggagaatgggtgtga

SEQ ID NO: 8089085 - DNA, 22 bp, Homo sapiens
ggctggcagtgtgagagaggga

SEQ ID NO: 8089086 - DNA, 22 bp, Homo sapiens
ggctggcagaagtgtgctggct

SEQ ID NO: 8089087 - DNA, 22 bp, Homo sapiens
ggctgtgcttggtgtccttgga

SEQ ID NO: 8089088 - DNA, 22 bp, Homo sapiens
ggctgtgctttgttaggttgtc

SEQ ID NO: 8089089 - DNA, 18 bp, Homo sapiens
ggctgtgcgtggaggctg

SEQ ID NO: 8089090 - DNA, 22 bp, Homo sapiens
ggctgtgcgtcatccggctgca

SEQ ID NO: 8089091 - DNA, 22 bp, Homo sapiens
ggctgtggcagctggaagtggt

SEQ ID NO: 8089092 - DNA, 22 bp, Homo sapiens
ggctgtggcattaggtgaggcc

SEQ ID NO: 8089093 - DNA, 22 bp, Homo sapiens
ggctgtgggtgtgacaggcctc

SEQ ID NO: 8089094 - DNA, 22 bp, Homo sapiens
ggctgtggtcattaggaggttg

SEQ ID NO: 8089095 - DNA, 22 bp, Homo sapiens
ggctgtggggaccaacaggact

SEQ ID NO: 8089096 - DNA, 22 bp, Homo sapiens
ggctgtgggatgcataggagct

SEQ ID NO: 8089097 - DNA, 22 bp, Homo sapiens
ggctgtggccagcggggctgag

SEQ ID NO: 8089098 - DNA, 22 bp, Homo sapiens
gggagctgaatggcaatggaga

SEQ ID NO: 8089099 - DNA, 22 bp, Homo sapiens
gggagtggattatgtggaccca

SEQ ID NO: 8089100 - DNA, 22 bp, Homo sapiens
gggagctgaagtaggggtaaat

SEQ ID NO: 8089101 - DNA, 22 bp, Homo sapiens
gggagctgaactgctgaagttg

SEQ ID NO: 8089102 - DNA, 22 bp, Homo sapiens
gggagctgaaggagccggcggg

SEQ ID NO: 8089103 - DNA, 22 bp, Homo sapiens
gggagccttgggagtgccagcc

SEQ ID NO: 8089104 - DNA, 22 bp, Homo sapiens
gggagcgggactgcgcaggctt

SEQ ID NO: 8089105 - DNA, 22 bp, Homo sapiens
gggagctctccctgaggcctgg

SEQ ID NO: 8089106 - DNA, 22 bp, Homo sapiens
gggagtgggtttggcctaggcc

SEQ ID NO: 8089107 - DNA, 17 bp, Homo sapiens
gggcagggactcctggg

SEQ ID NO: 8089108 - DNA, 20 bp, Homo sapiens
gggcagagccagccagtccc

SEQ ID NO: 8089109 - DNA, 22 bp, Homo sapiens
gggccccaaaatgccaggctct

SEQ ID NO: 8089110 - DNA, 22 bp, Homo sapiens
gggccccactggggctgcctgc

SEQ ID NO: 8089111 - DNA, 22 bp, Homo sapiens
gggctcagacatccctcctgga

SEQ ID NO: 8089112 - DNA, 22 bp, Homo sapiens
gggctcagctgggcgtgctggt

SEQ ID NO: 8089113 - DNA, 22 bp, Homo sapiens
gggctcagctccttccttccta

SEQ ID NO: 8089114 - DNA, 21 bp, Homo sapiens
gggctcagcgctcggctcctc

SEQ ID NO: 8089115 - DNA, 22 bp, Homo sapiens
gggctcagttctgcttcatgct

SEQ ID NO: 8089116 - DNA, 16 bp, Homo sapiens
gggctcagatctttga

SEQ ID NO: 8089117 - DNA, 23 bp, Homo sapiens
gggctcagatttcattctgtgcc

SEQ ID NO: 8089118 - DNA, 22 bp, Homo sapiens
gggctcagcctcctcacttcga

SEQ ID NO: 8089119 - DNA, 22 bp, Homo sapiens
gggctcagccccattgaaccag

SEQ ID NO: 8089120 - DNA, 22 bp, Homo sapiens
gggctcagaggagtggcctggg

SEQ ID NO: 8089121 - DNA, 22 bp, Homo sapiens
gggctcagagcatttgggttgg

SEQ ID NO: 8089122 - DNA, 22 bp, Homo sapiens
gtaggtcagacataagaggaca

SEQ ID NO: 8089123 - DNA, 22 bp, Homo sapiens
gtattttcaagagcagtagtat

SEQ ID NO: 8089124 - DNA, 22 bp, Homo sapiens
gtattttcatgatttcagacca

SEQ ID NO: 8089125 - DNA, 22 bp, Homo sapiens
gtcaaagaaacgcaccttacat

SEQ ID NO: 8089126 - DNA, 22 bp, Homo sapiens
gtcaaatatactaagaggtaaa

SEQ ID NO: 8089127 - DNA, 22 bp, Homo sapiens
gtcctgggaactggacagctaa

SEQ ID NO: 8089128 - DNA, 22 bp, Homo sapiens
gtcctggcttagttcgctgtaa

SEQ ID NO: 8089129 - DNA, 22 bp, Homo sapiens
gtccaggctgcccagggtcctg

SEQ ID NO: 8089130 - DNA, 22 bp, Homo sapiens
gtccaggctgacccctagagga

SEQ ID NO: 8089131 - DNA, 22 bp, Homo sapiens
gtccaggctaagtcccttctgc

SEQ ID NO: 8089132 - DNA, 22 bp, Homo sapiens
gtccaggctcaaaaggttgtta

SEQ ID NO: 8089133 - DNA, 22 bp, Homo sapiens
gtccaggccccagggattcttg

SEQ ID NO: 8089134 - DNA, 22 bp, Homo sapiens
gtccaggcctgcctctgaggag

SEQ ID NO: 8089135 - DNA, 22 bp, Homo sapiens
gtccaggccatggtggacacag

SEQ ID NO: 8089136 - DNA, 22 bp, Homo sapiens
gtccaggccatggtggacacag

SEQ ID NO: 8089137 - DNA, 19 bp, Homo sapiens
gtccaggcattgggttggt

SEQ ID NO: 8089138 - DNA, 22 bp, Homo sapiens
gtccaggcacctcccttgtgct

SEQ ID NO: 8089139 - DNA, 22 bp, Homo sapiens
gtcactgtatccaggttccagc

SEQ ID NO: 8089140 - DNA, 22 bp, Homo sapiens
gtcaccttgaacaggctactca

SEQ ID NO: 8089141 - DNA, 22 bp, Homo sapiens
gtccagccaggctgcagcaccc

SEQ ID NO: 8089142 - DNA, 22 bp, Homo sapiens
gtgctggccctgtcctcgagct

SEQ ID NO: 8089143 - DNA, 22 bp, Homo sapiens
gtgcccaggcccaaggcaccac

SEQ ID NO: 8089144 - DNA, 22 bp, Homo sapiens
gtgccagcctggtgcgcctggg

SEQ ID NO: 8089145 - DNA, 22 bp, Homo sapiens
gtgagctgttggagtggcagag

SEQ ID NO: 8089146 - DNA, 22 bp, Homo sapiens
gtgaggagctgacactggggtg

SEQ ID NO: 8089147 - DNA, 22 bp, Homo sapiens
gtgaggaatcggttcacggtga

SEQ ID NO: 8089148 - DNA, 22 bp, Homo sapiens
gtgaggaagtgtttgtcaaatt

SEQ ID NO: 8089149 - DNA, 22 bp, Homo sapiens
gtgaggaagtggtcaggcatcc

SEQ ID NO: 8089150 - DNA, 22 bp, Homo sapiens
gtgaaaaatcatcatgacttga

SEQ ID NO: 8089151 - DNA, 22 bp, Homo sapiens
gtgaaaaatgatttgttaactg

SEQ ID NO: 8089152 - DNA, 22 bp, Homo sapiens
gtctcccaatccgggacagcct

SEQ ID NO: 8089153 - DNA, 22 bp, Homo sapiens
gtctatttgggatcatgatatg

SEQ ID NO: 8089154 - DNA, 22 bp, Homo sapiens
gtctatatattgcttgaataat

SEQ ID NO: 8089155 - DNA, 22 bp, Homo sapiens
gtctacaaagcatataaaagag

SEQ ID NO: 8089156 - DNA, 22 bp, Homo sapiens
gtctacagtgaatgggtcctaa

SEQ ID NO: 8089157 - DNA, 22 bp, Homo sapiens
ggggaggctgatgtgggcaaag

SEQ ID NO: 8089158 - DNA, 22 bp, Homo sapiens
gggctgtgttaggtgcggttac

SEQ ID NO: 8089159 - DNA, 16 bp, Homo sapiens
gggctgggggattctg

SEQ ID NO: 8089160 - DNA, 22 bp, Homo sapiens
ggggtgctagagtggggccact

SEQ ID NO: 8089161 - DNA, 22 bp, Homo sapiens
ggggtagggcgattgctgcttt

SEQ ID NO: 8089162 - DNA, 22 bp, Homo sapiens
ggggccagcttcgcgtgctctt

SEQ ID NO: 8089163 - DNA, 22 bp, Homo sapiens
ggggccagcaatgttgaggaat

SEQ ID NO: 8089164 - DNA, 22 bp, Homo sapiens
ggggccagatatcactaaggtt

SEQ ID NO: 8089165 - DNA, 22 bp, Homo sapiens
gggtgggtggtccgcagacata

SEQ ID NO: 8089166 - DNA, 22 bp, Homo sapiens
gggtgggtggcagcaccgaggc

SEQ ID NO: 8089167 - DNA, 22 bp, Homo sapiens
gggtggtggccagcagtgggca

SEQ ID NO: 8089168 - DNA, 22 bp, Homo sapiens
gggtgcaggcagcccaggcagg

SEQ ID NO: 8089169 - DNA, 18 bp, Homo sapiens
ggtgagggagctggaagc

SEQ ID NO: 8089170 - DNA, 22 bp, Homo sapiens
ggtgagggacatcactcagcca

SEQ ID NO: 8089171 - DNA, 22 bp, Homo sapiens
ggtgaggctaagtgacacaggg

SEQ ID NO: 8089172 - DNA, 22 bp, Homo sapiens
ggtgaggcgtccccaccatggg

SEQ ID NO: 8089173 - DNA, 18 bp, Homo sapiens
ggtgaggcggcggccagc

SEQ ID NO: 8089174 - DNA, 22 bp, Homo sapiens
ggtgagagtcttgtggtcccag

SEQ ID NO: 8089175 - DNA, 22 bp, Homo sapiens
ggtccccgtggaggctggagcg

SEQ ID NO: 8089176 - DNA, 19 bp, Homo sapiens
gggttgtgtggaaggtatc

SEQ ID NO: 8089177 - DNA, 22 bp, Homo sapiens
gggttggggcccagcagtctgc

SEQ ID NO: 8089178 - DNA, 22 bp, Homo sapiens
gggttggggcccagcagtctgc

SEQ ID NO: 8089179 - DNA, 22 bp, Homo sapiens
gggttggattacttagggagaa

SEQ ID NO: 8089180 - DNA, 22 bp, Homo sapiens
gggttgaggcggatgtcggcgg

SEQ ID NO: 8089181 - DNA, 22 bp, Homo sapiens
ggttatataattcagtgctttc

SEQ ID NO: 8089182 - DNA, 22 bp, Homo sapiens
ggttggtgagtgcagggtgtta

SEQ ID NO: 8089183 - DNA, 22 bp, Homo sapiens
ggttggggcgagctggaggccc

SEQ ID NO: 8089184 - DNA, 22 bp, Homo sapiens
ggtggagcgcagggtgctggcg

SEQ ID NO: 8089185 - DNA, 22 bp, Homo sapiens
ggtggcaccttaccctgcgcag

SEQ ID NO: 8089186 - DNA, 22 bp, Homo sapiens
ggtggcagagacataggacata

SEQ ID NO: 8089187 - DNA, 22 bp, Homo sapiens
ggtgggcaggcgaggcccaggt

SEQ ID NO: 8089188 - DNA, 22 bp, Homo sapiens
ggtggggcctgctccagcggcc

SEQ ID NO: 8089189 - DNA, 22 bp, Homo sapiens
ggtggggccctggcactggtat

SEQ ID NO: 8089190 - DNA, 22 bp, Homo sapiens
ggtggggcccaggcatctgatg

SEQ ID NO: 8089191 - DNA, 22 bp, Homo sapiens
ggtgggccaggaaggccgccag

SEQ ID NO: 8089192 - DNA, 22 bp, Homo sapiens
gctgcctctgcacagctcactc

SEQ ID NO: 8089193 - DNA, 22 bp, Homo sapiens
gctgcctcccccatggctggaa

SEQ ID NO: 8089194 - DNA, 22 bp, Homo sapiens
gctgctgggtccctctgtgcca

SEQ ID NO: 8089195 - DNA, 18 bp, Homo sapiens
gctgctggtggagggagc

SEQ ID NO: 8089196 - DNA, 22 bp, Homo sapiens
gctggagcttgagaggacaggg

SEQ ID NO: 8089197 - DNA, 22 bp, Homo sapiens
gctcagggaatgagaagatgtt

SEQ ID NO: 8089198 - DNA, 22 bp, Homo sapiens
gctcagggaaggccacgtgaga

SEQ ID NO: 8089199 - DNA, 22 bp, Homo sapiens
gctcagggagagagggcagccg

SEQ ID NO: 8089200 - DNA, 20 bp, Homo sapiens
gctcagggaattcaggaagc

SEQ ID NO: 8089201 - DNA, 22 bp, Homo sapiens
gctcagggccatggaccagcag

SEQ ID NO: 8089202 - DNA, 22 bp, Homo sapiens
gctcagggagtttcacagtgta

SEQ ID NO: 8089203 - DNA, 20 bp, Homo sapiens
gctcagggcctgggtctgga

SEQ ID NO: 8089204 - DNA, 22 bp, Homo sapiens
gctcagggcctggctgcggact

SEQ ID NO: 8089205 - DNA, 22 bp, Homo sapiens
gctcccagcattgctgctgaat

SEQ ID NO: 8089206 - DNA, 22 bp, Homo sapiens
gctcccagatttcagccttgtg

SEQ ID NO: 8089207 - DNA, 22 bp, Homo sapiens
gctcagggcgcgagggacgtgg

SEQ ID NO: 8089208 - DNA, 22 bp, Homo sapiens
gcctggagttcagccaagtccc

SEQ ID NO: 8089209 - DNA, 22 bp, Homo sapiens
gctaggagtggtgggtcaagga

SEQ ID NO: 8089210 - DNA, 22 bp, Homo sapiens
gctaggctcggaagcagcaggg

SEQ ID NO: 8089211 - DNA, 22 bp, Homo sapiens
gctagcagaaagcaggctgctc

SEQ ID NO: 8089212 - DNA, 22 bp, Homo sapiens
gctctcttggtggctgtcctgg

SEQ ID NO: 8089213 - DNA, 22 bp, Homo sapiens
gctcccaggaagagaagggcca

SEQ ID NO: 8089214 - DNA, 22 bp, Homo sapiens
gctcccagctggagcctcaaca

SEQ ID NO: 8089215 - DNA, 22 bp, Homo sapiens
gctcccagcattgcttcccagg

SEQ ID NO: 8089216 - DNA, 20 bp, Homo sapiens
gctcccagcctgcagtcccc

SEQ ID NO: 8089217 - DNA, 22 bp, Homo sapiens
gctccctccatgaggcagaccg

SEQ ID NO: 8089218 - DNA, 22 bp, Homo sapiens
gctccctccatgaggcagaccg

SEQ ID NO: 8089219 - DNA, 21 bp, Homo sapiens
gctctccagggccagcccagg

SEQ ID NO: 8089220 - DNA, 22 bp, Homo sapiens
gctctcccgcagcctggtgggc

SEQ ID NO: 8089221 - DNA, 22 bp, Homo sapiens
gctctcctgtgcagatgctgct

SEQ ID NO: 8089222 - DNA, 22 bp, Homo sapiens
ggactggccggcgctgaggccc

SEQ ID NO: 8089223 - DNA, 22 bp, Homo sapiens
ggactgctccagtgtgatttgt

SEQ ID NO: 8089224 - DNA, 22 bp, Homo sapiens
ggactgtctccttgctggtagg

SEQ ID NO: 8089225 - DNA, 22 bp, Homo sapiens
ggactttaggaagggccaagtg

SEQ ID NO: 8089226 - DNA, 22 bp, Homo sapiens
ggagaaagaaatttttgattgg

SEQ ID NO: 8089227 - DNA, 22 bp, Homo sapiens
ggagaaagaagacgaacattgt

SEQ ID NO: 8089228 - DNA, 22 bp, Homo sapiens
ggagaaagctatgtgggggagt

SEQ ID NO: 8089229 - DNA, 22 bp, Homo sapiens
ggacagggctcttggcactcct

SEQ ID NO: 8089230 - DNA, 22 bp, Homo sapiens
ggacaggccctctggtcagctt

SEQ ID NO: 8089231 - DNA, 22 bp, Homo sapiens
ggaaaaatgacacatatctcaa

SEQ ID NO: 8089232 - DNA, 20 bp, Homo sapiens
ggaaaaatgcatgctcaaga

SEQ ID NO: 8089233 - DNA, 22 bp, Homo sapiens
ggaaaaatagagtatactttaa

SEQ ID NO: 8089234 - DNA, 22 bp, Homo sapiens
ggagaaagtacagcaggcaaca

SEQ ID NO: 8089235 - DNA, 22 bp, Homo sapiens
ggagccaggcaatctgtacttt

SEQ ID NO: 8089236 - DNA, 22 bp, Homo sapiens
ggagccaggcatatcggggcac

SEQ ID NO: 8089237 - DNA, 22 bp, Homo sapiens
ggagcccaagtctgcactcggc

SEQ ID NO: 8089238 - DNA, 22 bp, Homo sapiens
ggagcccaagtctgcactcggc

SEQ ID NO: 8089239 - DNA, 22 bp, Homo sapiens
ggagcctggcaatgctgcgtcc

SEQ ID NO: 8089240 - DNA, 18 bp, Homo sapiens
ggagctgggccccactcc

SEQ ID NO: 8089241 - DNA, 21 bp, Homo sapiens
ggagctggggagctggcccca

SEQ ID NO: 8089242 - DNA, 20 bp, Homo sapiens
ggagctgccctgggctggag

SEQ ID NO: 8089243 - DNA, 22 bp, Homo sapiens
gcttaaaagccacttagtctat

SEQ ID NO: 8089244 - DNA, 22 bp, Homo sapiens
gcttaaatcccaatgctagacc

SEQ ID NO: 8089245 - DNA, 22 bp, Homo sapiens
gctttatagccctattacatga

SEQ ID NO: 8089246 - DNA, 21 bp, Homo sapiens
gctttagatttagtgagccag

SEQ ID NO: 8089247 - DNA, 22 bp, Homo sapiens
gctttagagcccagcttggtgg

SEQ ID NO: 8089248 - DNA, 22 bp, Homo sapiens
gctttagatactcccaatgtcc

SEQ ID NO: 8089249 - DNA, 22 bp, Homo sapiens
gctttagatctgactttctgtg

SEQ ID NO: 8089250 - DNA, 22 bp, Homo sapiens
gctttagatagatttagtcttt

SEQ ID NO: 8089251 - DNA, 22 bp, Homo sapiens
gctttagaagacactctgtttt

SEQ ID NO: 8089252 - DNA, 22 bp, Homo sapiens
gctttagaaatgtaggagatac

SEQ ID NO: 8089253 - DNA, 22 bp, Homo sapiens
gctttagacataaagttcttca

SEQ ID NO: 8089254 - DNA, 22 bp, Homo sapiens
gctttagagaagaaaggttgct

SEQ ID NO: 8089255 - DNA, 22 bp, Homo sapiens
gctttagaaatgagtaaattag

SEQ ID NO: 8089256 - DNA, 22 bp, Homo sapiens
gctttagaaatatcactgtgga

SEQ ID NO: 8089257 - DNA, 22 bp, Homo sapiens
gctttggtcaggtgtccagccc

SEQ ID NO: 8089258 - DNA, 23 bp, Homo sapiens
gctgtcgccagagccccacctac

SEQ ID NO: 8089259 - DNA, 22 bp, Homo sapiens
gctgtcaaggtagaaaacagag

SEQ ID NO: 8089260 - DNA, 22 bp, Homo sapiens
gctggtccactccctggaggct

SEQ ID NO: 8089261 - DNA, 22 bp, Homo sapiens
gctggtccacatcctggtacgt

SEQ ID NO: 8089262 - DNA, 22 bp, Homo sapiens
gcattctttttaggaggttcct

SEQ ID NO: 8089263 - DNA, 22 bp, Homo sapiens
gcagttctacttatccatagac

SEQ ID NO: 8089264 - DNA, 22 bp, Homo sapiens
gcatttcatgccgtggaagtcc

SEQ ID NO: 8089265 - DNA, 22 bp, Homo sapiens
gccacctggactcagagccagg

SEQ ID NO: 8089266 - DNA, 22 bp, Homo sapiens
gccacctgtaagccattaggcc

SEQ ID NO: 8089267 - DNA, 22 bp, Homo sapiens
gccacctgcgggccgtggtgga

SEQ ID NO: 8089268 - DNA, 22 bp, Homo sapiens
gccacctgtttcagatgtggtt

SEQ ID NO: 8089269 - DNA, 22 bp, Homo sapiens
gccacctcccaggacgaggctg

SEQ ID NO: 8089270 - DNA, 23 bp, Homo sapiens
gccacctcctggtcagaaagagg

SEQ ID NO: 8089271 - DNA, 22 bp, Homo sapiens
gccacctcccaggacgaggctg

SEQ ID NO: 8089272 - DNA, 22 bp, Homo sapiens
gccacctccttattccacctgt

SEQ ID NO: 8089273 - DNA, 22 bp, Homo sapiens
gccacctccttattccacctgt

SEQ ID NO: 8089274 - DNA, 21 bp, Homo sapiens
gccacctcaatcttctagcgc

SEQ ID NO: 8089275 - DNA, 22 bp, Homo sapiens
gccacctcggctttctctgctc

SEQ ID NO: 8089276 - DNA, 22 bp, Homo sapiens
gccacctcggctttctctgctc

SEQ ID NO: 8089277 - DNA, 21 bp, Homo sapiens
gccacctcgtctcggagcagc

SEQ ID NO: 8089278 - DNA, 21 bp, Homo sapiens
gccacctcgtctcggagcagc

SEQ ID NO: 8089279 - DNA, 22 bp, Homo sapiens
gccacctctagcaaagctcagc

SEQ ID NO: 8089280 - DNA, 20 bp, Homo sapiens
gccacctctctagcagtaga

SEQ ID NO: 8089281 - DNA, 20 bp, Homo sapiens
gccacctctctagcagtaga

SEQ ID NO: 8089282 - DNA, 22 bp, Homo sapiens
gccacctctctcttgactcgag

SEQ ID NO: 8089283 - DNA, 22 bp, Homo sapiens
gccacctctttgtctctgccgc

SEQ ID NO: 8089284 - DNA, 22 bp, Homo sapiens
gccacctctttgtctctgccgc

SEQ ID NO: 8089285 - DNA, 22 bp, Homo sapiens
gccacctctttgtctctgccgc

SEQ ID NO: 8089286 - DNA, 22 bp, Homo sapiens
gccaggctaagaaaggtgtgat

SEQ ID NO: 8089287 - DNA, 22 bp, Homo sapiens
gccaggctccaggccctcctga

SEQ ID NO: 8089288 - DNA, 23 bp, Homo sapiens
gccaggctccggtctgtggccac

SEQ ID NO: 8089289 - DNA, 22 bp, Homo sapiens
gccaggctctcagtgactgccc

SEQ ID NO: 8089290 - DNA, 22 bp, Homo sapiens
gcccaaggtatatcagagacag

SEQ ID NO: 8089291 - DNA, 22 bp, Homo sapiens
gcccaaggtcacacacaggaag

SEQ ID NO: 8089292 - DNA, 22 bp, Homo sapiens
gcccctcccagtcaggagcact

SEQ ID NO: 8089293 - DNA, 22 bp, Homo sapiens
gcccaagtcagtgcttctggca

SEQ ID NO: 8089294 - DNA, 22 bp, Homo sapiens
gcccaaggtcccatggcagcac

SEQ ID NO: 8089295 - DNA, 22 bp, Homo sapiens
gcccgcagagatctttaacaaa

SEQ ID NO: 8089296 - DNA, 22 bp, Homo sapiens
gcctccctccaccactgcaggt

SEQ ID NO: 8089297 - DNA, 22 bp, Homo sapiens
gcctccctggcccacagcagcg

SEQ ID NO: 8089298 - DNA, 22 bp, Homo sapiens
gcctccctgagtcacccaagca

SEQ ID NO: 8089299 - DNA, 22 bp, Homo sapiens
gcctccctgtagaggccagcct

SEQ ID NO: 8089300 - DNA, 22 bp, Homo sapiens
gcctccctgttcttccacaata

SEQ ID NO: 8089301 - DNA, 18 bp, Homo sapiens
gcctccctggctacactt

SEQ ID NO: 8089302 - DNA, 22 bp, Homo sapiens
gcctccctgtttcctgctccaa

SEQ ID NO: 8089303 - DNA, 22 bp, Homo sapiens
gcctcccttggtgtctcccggg

SEQ ID NO: 8089304 - DNA, 22 bp, Homo sapiens
gcctgcagatatataggatggt

SEQ ID NO: 8089305 - DNA, 22 bp, Homo sapiens
gcctgcagctgcttccacacac

SEQ ID NO: 8089306 - DNA, 22 bp, Homo sapiens
gcctggagaggaagccggtgga

SEQ ID NO: 8089307 - DNA, 22 bp, Homo sapiens
gcctggagagcactgtgcgctt

SEQ ID NO: 8089308 - DNA, 22 bp, Homo sapiens
gcctggagtagcatggcaagcc

SEQ ID NO: 8089309 - DNA, 22 bp, Homo sapiens
gcctggagcccagtgtggggct

SEQ ID NO: 8089310 - DNA, 16 bp, Homo sapiens
gcctggagtggcaggg

SEQ ID NO: 8089311 - DNA, 22 bp, Homo sapiens
gcctggagtggacttggcccct

SEQ ID NO: 8089312 - DNA, 22 bp, Homo sapiens
gcctggagaagatggaactagc

SEQ ID NO: 8089313 - DNA, 22 bp, Homo sapiens
gcagacagatgagggtgctggg

SEQ ID NO: 8089314 - DNA, 22 bp, Homo sapiens
gcacccagatagcaaggattag

SEQ ID NO: 8089315 - DNA, 22 bp, Homo sapiens
gcacccagatattgccttgacc

SEQ ID NO: 8089316 - DNA, 22 bp, Homo sapiens
gcacccagccagcatctcagag

SEQ ID NO: 8089317 - DNA, 22 bp, Homo sapiens
gcacccagcccagggcgtgatg

SEQ ID NO: 8089318 - DNA, 20 bp, Homo sapiens
gcacccagcttcttgttcta

SEQ ID NO: 8089319 - DNA, 22 bp, Homo sapiens
gcaccaccaccatcggcacctc

SEQ ID NO: 8089320 - DNA, 22 bp, Homo sapiens
gcacccagagggcagggtctcc

SEQ ID NO: 8089321 - DNA, 22 bp, Homo sapiens
gcacccagaggtcagcagtgct

SEQ ID NO: 8089322 - DNA, 22 bp, Homo sapiens
gcagacagggctacagaggtac

SEQ ID NO: 8089323 - DNA, 22 bp, Homo sapiens
gcagagtctggtaggtgctggt

SEQ ID NO: 8089324 - DNA, 22 bp, Homo sapiens
gcagagtcccagcaggtggtgg

SEQ ID NO: 8089325 - DNA, 22 bp, Homo sapiens
gcaaggagcctggaggtgagtg

SEQ ID NO: 8089326 - DNA, 22 bp, Homo sapiens
gagtatttatatgtaagtacct

SEQ ID NO: 8089327 - DNA, 22 bp, Homo sapiens
gcacatggacaatggaggtgca

SEQ ID NO: 8089328 - DNA, 22 bp, Homo sapiens
gcacagagtcactagctaagca

SEQ ID NO: 8089329 - DNA, 22 bp, Homo sapiens
gcacagagagtcccgggtgccc

SEQ ID NO: 8089330 - DNA, 22 bp, Homo sapiens
gcacagagacagtcctgagatc

SEQ ID NO: 8089331 - DNA, 22 bp, Homo sapiens
gcacagagaggctgtgagcgcc

SEQ ID NO: 8089332 - DNA, 22 bp, Homo sapiens
gcacagagagcagtgggggaca

SEQ ID NO: 8089333 - DNA, 22 bp, Homo sapiens
gcacagactttgattgcagtca

SEQ ID NO: 8089334 - DNA, 22 bp, Homo sapiens
gcaggccaggctaggggctgtc

SEQ ID NO: 8089335 - DNA, 22 bp, Homo sapiens
gcaggcccagagtcgctggcct

SEQ ID NO: 8089336 - DNA, 22 bp, Homo sapiens
gcagggcagctcactgtggttc

SEQ ID NO: 8089337 - DNA, 22 bp, Homo sapiens
gcagggcagctgaagctaggtg

SEQ ID NO: 8089338 - DNA, 22 bp, Homo sapiens
gcagggcagctgaagctaggtg

SEQ ID NO: 8089339 - DNA, 22 bp, Homo sapiens
gcagggcagcttagtccctgtc

SEQ ID NO: 8089340 - DNA, 22 bp, Homo sapiens
gcaggcccttagccttggtggg

SEQ ID NO: 8089341 - DNA, 19 bp, Homo sapiens
gcaggcccagtcgggctgg

SEQ ID NO: 8089342 - DNA, 22 bp, Homo sapiens
gcaggtctagaagctgcctctg

SEQ ID NO: 8089343 - DNA, 22 bp, Homo sapiens
gcagggcagtaagagctagagt

SEQ ID NO: 8089344 - DNA, 22 bp, Homo sapiens
gcagggcagggcaagaactggg

SEQ ID NO: 8089345 - DNA, 22 bp, Homo sapiens
gcagggcaggatttgaacccag

SEQ ID NO: 8089346 - DNA, 22 bp, Homo sapiens
gcagggcatgggccctgtctgc

SEQ ID NO: 8089347 - DNA, 22 bp, Homo sapiens
gcagcacaaagtccccagggac

SEQ ID NO: 8089348 - DNA, 22 bp, Homo sapiens
gcagcagcagggagtctgactt

SEQ ID NO: 8089349 - DNA, 22 bp, Homo sapiens
gcagccacagaggagggatgca

SEQ ID NO: 8089350 - DNA, 22 bp, Homo sapiens
gcagccacctcccatggcgggg

SEQ ID NO: 8089351 - DNA, 22 bp, Homo sapiens
gcagccagaagactcagaacaa

SEQ ID NO: 8089352 - DNA, 22 bp, Homo sapiens
gcagccaggaaagctggaccct

SEQ ID NO: 8089353 - DNA, 22 bp, Homo sapiens
gcagcccaaaaaagaggtagat

SEQ ID NO: 8089354 - DNA, 22 bp, Homo sapiens
gcagcccaagagactctgttga

SEQ ID NO: 8089355 - DNA, 22 bp, Homo sapiens
gcagcccaagcctgagcatcct

SEQ ID NO: 8089356 - DNA, 17 bp, Homo sapiens
gcagccagtgcagcagg

SEQ ID NO: 8089357 - DNA, 22 bp, Homo sapiens
gcagcccacaccactctgctca

SEQ ID NO: 8089358 - DNA, 22 bp, Homo sapiens
gcagcccaatggactgagacag

SEQ ID NO: 8089359 - DNA, 22 bp, Homo sapiens
gcagcccacagctggaggccta

SEQ ID NO: 8089360 - DNA, 22 bp, Homo sapiens
gcagctgggacactgaggccag

SEQ ID NO: 8089361 - DNA, 22 bp, Homo sapiens
gcagctgggacactgaggccag

SEQ ID NO: 8089362 - DNA, 22 bp, Homo sapiens
gcagctggggccacacttaggc

SEQ ID NO: 8089363 - DNA, 22 bp, Homo sapiens
gcagctgggtctgtgtgggctg

SEQ ID NO: 8089364 - DNA, 23 bp, Homo sapiens
gcagctggttagaagggaaggag

SEQ ID NO: 8089365 - DNA, 22 bp, Homo sapiens
gcagctggtgcaaatgtcactc

SEQ ID NO: 8089366 - DNA, 22 bp, Homo sapiens
gcagctggtctggcctagagta

SEQ ID NO: 8089367 - DNA, 22 bp, Homo sapiens
gcagctggtctggcctagagta

SEQ ID NO: 8089368 - DNA, 22 bp, Homo sapiens
tccagggctgggttggctcagc

SEQ ID NO: 8089369 - DNA, 22 bp, Homo sapiens
tccagggctgacttgggagagg

SEQ ID NO: 8089370 - DNA, 22 bp, Homo sapiens
tccagggcttgacagggtgcct

SEQ ID NO: 8089371 - DNA, 18 bp, Homo sapiens
tccagggcttcctcctct

SEQ ID NO: 8089372 - DNA, 19 bp, Homo sapiens
tccagggctttatggcttt

SEQ ID NO: 8089373 - DNA, 22 bp, Homo sapiens
tccagggcttggctgggacggt

SEQ ID NO: 8089374 - DNA, 21 bp, Homo sapiens
tccagggctttgattctctca

SEQ ID NO: 8089375 - DNA, 22 bp, Homo sapiens
tccatgtgttttcctgtccaca

SEQ ID NO: 8089376 - DNA, 22 bp, Homo sapiens
tcccagagatttcctctccttc

SEQ ID NO: 8089377 - DNA, 22 bp, Homo sapiens
tcccagaggctccagtctctat

SEQ ID NO: 8089378 - DNA, 22 bp, Homo sapiens
tcccagccacaggtgtagccct

SEQ ID NO: 8089379 - DNA, 22 bp, Homo sapiens
tcccagccggtgcctgggtccc

SEQ ID NO: 8089380 - DNA, 22 bp, Homo sapiens
tcccaggccataaaactcagag

SEQ ID NO: 8089381 - DNA, 22 bp, Homo sapiens
tcccagcctggaccctgccagt

SEQ ID NO: 8089382 - DNA, 22 bp, Homo sapiens
tcccagcctggaccctgccagt

SEQ ID NO: 8089383 - DNA, 22 bp, Homo sapiens
tcccagccttatctcccctggc

SEQ ID NO: 8089384 - DNA, 22 bp, Homo sapiens
tcctcagaatcacctggcagct

SEQ ID NO: 8089385 - DNA, 22 bp, Homo sapiens
tcctcacaagcaagcacaggta

SEQ ID NO: 8089386 - DNA, 22 bp, Homo sapiens
tcctcacagcatgaccaggcag

SEQ ID NO: 8089387 - DNA, 22 bp, Homo sapiens
tcctcacactatagatgaggat

SEQ ID NO: 8089388 - DNA, 22 bp, Homo sapiens
tcctcacagagtggcaggcaat

SEQ ID NO: 8089389 - DNA, 22 bp, Homo sapiens
tcctcacaagcatcctgtctca

SEQ ID NO: 8089390 - DNA, 19 bp, Homo sapiens
tcctcaggggctcacagac

SEQ ID NO: 8089391 - DNA, 21 bp, Homo sapiens
tcctcagggccccagagcact

SEQ ID NO: 8089392 - DNA, 22 bp, Homo sapiens
tcctcagggggccaacccagcc

SEQ ID NO: 8089393 - DNA, 22 bp, Homo sapiens
tcctcagacttccctttgtgta

SEQ ID NO: 8089394 - DNA, 22 bp, Homo sapiens
tcctcagcattagcacagacat

SEQ ID NO: 8089395 - DNA, 22 bp, Homo sapiens
tccctctgtgttgggcatgcct

SEQ ID NO: 8089396 - DNA, 22 bp, Homo sapiens
tccctctggtctggacgccata

SEQ ID NO: 8089397 - DNA, 18 bp, Homo sapiens
tccctccctgctgtggcc

SEQ ID NO: 8089398 - DNA, 19 bp, Homo sapiens
tccctccctgtaatctcac

SEQ ID NO: 8089399 - DNA, 20 bp, Homo sapiens
tccctccctccagctctggg

SEQ ID NO: 8089400 - DNA, 22 bp, Homo sapiens
tccctccccacttctgagcttt

SEQ ID NO: 8089401 - DNA, 22 bp, Homo sapiens
tcccaggctaggcctctgcgtt

SEQ ID NO: 8089402 - DNA, 20 bp, Homo sapiens
tcccaggctccaccctagac

SEQ ID NO: 8089403 - DNA, 20 bp, Homo sapiens
tcccaggctgggctccagct

SEQ ID NO: 8089404 - DNA, 22 bp, Homo sapiens
tcccaggctggggccaggtgac

SEQ ID NO: 8089405 - DNA, 22 bp, Homo sapiens
tcccaggctgggggcctgaagt

SEQ ID NO: 8089406 - DNA, 23 bp, Homo sapiens
tcccagggaaggtgagcgaggct

SEQ ID NO: 8089407 - DNA, 22 bp, Homo sapiens
tcctgagataaatctcatgtga

SEQ ID NO: 8089408 - DNA, 19 bp, Homo sapiens
tcctctggtaccacccttg

SEQ ID NO: 8089409 - DNA, 22 bp, Homo sapiens
tcctcttcagagggacctcggg

SEQ ID NO: 8089410 - DNA, 22 bp, Homo sapiens
tcagcaggcaggaggcatgcca

SEQ ID NO: 8089411 - DNA, 22 bp, Homo sapiens
tcagcaggcagtgggtcacaat

SEQ ID NO: 8089412 - DNA, 22 bp, Homo sapiens
tcagcaggcccatcctccaggc

SEQ ID NO: 8089413 - DNA, 22 bp, Homo sapiens
tcagcaggcggttccttgtggg

SEQ ID NO: 8089414 - DNA, 22 bp, Homo sapiens
tcagcaggctctggttgaccat

SEQ ID NO: 8089415 - DNA, 22 bp, Homo sapiens
tcagcaggctgtcagcaggggc

SEQ ID NO: 8089416 - DNA, 22 bp, Homo sapiens
tcagcagggcctccttgtgcag

SEQ ID NO: 8089417 - DNA, 22 bp, Homo sapiens
tcagcagggccatgctctctct

SEQ ID NO: 8089418 - DNA, 22 bp, Homo sapiens
tcagcagggcatactgagccta

SEQ ID NO: 8089419 - DNA, 22 bp, Homo sapiens
tcagcagggagaggagaatgca

SEQ ID NO: 8089420 - DNA, 22 bp, Homo sapiens
tcagcagggaggctctgtgccc

SEQ ID NO: 8089421 - DNA, 22 bp, Homo sapiens
tcagcagggctgtggtgtggct

SEQ ID NO: 8089422 - DNA, 22 bp, Homo sapiens
tcagcagggctgggagctgtga

SEQ ID NO: 8089423 - DNA, 22 bp, Homo sapiens
tcagcaggggccgttgggtgga

SEQ ID NO: 8089424 - DNA, 17 bp, Homo sapiens
tcagcaggggccaagct

SEQ ID NO: 8089425 - DNA, 22 bp, Homo sapiens
tcagccaggcagccccctggtc

SEQ ID NO: 8089426 - DNA, 22 bp, Homo sapiens
tcagccaggcacaatggcagct

SEQ ID NO: 8089427 - DNA, 22 bp, Homo sapiens
tcagccaggcacaatggcagct

SEQ ID NO: 8089428 - DNA, 20 bp, Homo sapiens
tcagccagctaacatgggga

SEQ ID NO: 8089429 - DNA, 22 bp, Homo sapiens
tcagccagagggggcaaaggaa

SEQ ID NO: 8089430 - DNA, 22 bp, Homo sapiens
tcaggacaacaagacttgttta

SEQ ID NO: 8089431 - DNA, 22 bp, Homo sapiens
tcaggacagactagactagcgt

SEQ ID NO: 8089432 - DNA, 22 bp, Homo sapiens
tcaggacagaaggctgccaggg

SEQ ID NO: 8089433 - DNA, 22 bp, Homo sapiens
tcaggacagaaggctgccaggg

SEQ ID NO: 8089434 - DNA, 22 bp, Homo sapiens
tcaggacaatagtgatttttac

SEQ ID NO: 8089435 - DNA, 22 bp, Homo sapiens
tcaggacaacctgttttcagac

SEQ ID NO: 8089436 - DNA, 22 bp, Homo sapiens
tcaggacaacatgttgctaatc

SEQ ID NO: 8089437 - DNA, 22 bp, Homo sapiens
tcaggacaccctgtgcttcctt

SEQ ID NO: 8089438 - DNA, 22 bp, Homo sapiens
tcaggacacttggcacaaggtc

SEQ ID NO: 8089439 - DNA, 22 bp, Homo sapiens
tcaggacagccagggtgcagac

SEQ ID NO: 8089440 - DNA, 22 bp, Homo sapiens
tcaggacagagatcagaacttc

SEQ ID NO: 8089441 - DNA, 22 bp, Homo sapiens
tcaggacatttgtcagcaggag

SEQ ID NO: 8089442 - DNA, 22 bp, Homo sapiens
tcaggacatttgtcagcaggag

SEQ ID NO: 8089443 - DNA, 22 bp, Homo sapiens
tcagaacaggttgtactatgtc

SEQ ID NO: 8089444 - DNA, 22 bp, Homo sapiens
tcagaacaggttgtactatgtc

SEQ ID NO: 8089445 - DNA, 22 bp, Homo sapiens
tcactgcaacctccacctcctg

SEQ ID NO: 8089446 - DNA, 22 bp, Homo sapiens
tcactgcaacctccacctcccg

SEQ ID NO: 8089447 - DNA, 22 bp, Homo sapiens
tcaacagacatttttaagcact

SEQ ID NO: 8089448 - DNA, 22 bp, Homo sapiens
tcaacagattgtattaaggtta

SEQ ID NO: 8089449 - DNA, 21 bp, Homo sapiens
tcacatttctcatgggtaaat

SEQ ID NO: 8089450 - DNA, 22 bp, Homo sapiens
tcatttccctcctacaaagagg

SEQ ID NO: 8089451 - DNA, 21 bp, Homo sapiens
tcatttttattgctaccttgc

SEQ ID NO: 8089452 - DNA, 22 bp, Homo sapiens
tcagggcatctcttaagtggtg

SEQ ID NO: 8089453 - DNA, 22 bp, Homo sapiens
tcagggcatccattgcctgttg

SEQ ID NO: 8089454 - DNA, 22 bp, Homo sapiens
tcagggcatcatcatgaatata

SEQ ID NO: 8089455 - DNA, 22 bp, Homo sapiens
tcagggcatactcttcaaggtc

SEQ ID NO: 8089456 - DNA, 21 bp, Homo sapiens
tcagggcagtgggaggttcct

SEQ ID NO: 8089457 - DNA, 19 bp, Homo sapiens
tcagggcagtccggtcccc

SEQ ID NO: 8089458 - DNA, 22 bp, Homo sapiens
tcagggcaggcgagcagctgct

SEQ ID NO: 8089459 - DNA, 22 bp, Homo sapiens
tcagggcaggttaacttgggtg

SEQ ID NO: 8089460 - DNA, 22 bp, Homo sapiens
tcagggcaggacagtgtaggcc

SEQ ID NO: 8089461 - DNA, 22 bp, Homo sapiens
tcatacatctgtcctggagctc

SEQ ID NO: 8089462 - DNA, 22 bp, Homo sapiens
tcatagaaatggaaagtatatt

SEQ ID NO: 8089463 - DNA, 22 bp, Homo sapiens
tatgctttaaccctcttatatt

SEQ ID NO: 8089464 - DNA, 22 bp, Homo sapiens
tattaagatacgtagttgtaaa

SEQ ID NO: 8089465 - DNA, 22 bp, Homo sapiens
tatgaaacattcatacaaataa

SEQ ID NO: 8089466 - DNA, 22 bp, Homo sapiens
tataaagagtctcaaagaagtt

SEQ ID NO: 8089467 - DNA, 22 bp, Homo sapiens
tataaagctgactcatgaaact

SEQ ID NO: 8089468 - DNA, 22 bp, Homo sapiens
tataaagaaggcacagcaagac

SEQ ID NO: 8089469 - DNA, 22 bp, Homo sapiens
tcaaataatgccattcatcatc

SEQ ID NO: 8089470 - DNA, 22 bp, Homo sapiens
tcaaataatgccattcatcatc

SEQ ID NO: 8089471 - DNA, 22 bp, Homo sapiens
tcaaataccagcaatttcatgt

SEQ ID NO: 8089472 - DNA, 22 bp, Homo sapiens
tcaaatcaccaaactcactggc

SEQ ID NO: 8089473 - DNA, 21 bp, Homo sapiens
tcaaatcctgctgttaccact

SEQ ID NO: 8089474 - DNA, 22 bp, Homo sapiens
tcaaatctcattgcctaaaact

SEQ ID NO: 8089475 - DNA, 22 bp, Homo sapiens
tcaaagatgatgctgaagttat

SEQ ID NO: 8089476 - DNA, 22 bp, Homo sapiens
tatttgctgaatctgattcaga

SEQ ID NO: 8089477 - DNA, 22 bp, Homo sapiens
tatttcttgttattctcgttga

SEQ ID NO: 8089478 - DNA, 22 bp, Homo sapiens
tatttgcaacataaaactctga

SEQ ID NO: 8089479 - DNA, 22 bp, Homo sapiens
tatttgctcaataatagtttta

SEQ ID NO: 8089480 - DNA, 22 bp, Homo sapiens
tattgtccaataggatgttcct

SEQ ID NO: 8089481 - DNA, 19 bp, Homo sapiens
tagatactgatgaactcca

SEQ ID NO: 8089482 - DNA, 22 bp, Homo sapiens
tagagaatggccttgaagtagt

SEQ ID NO: 8089483 - DNA, 22 bp, Homo sapiens
tagagaggtttgaattggctgc

SEQ ID NO: 8089484 - DNA, 22 bp, Homo sapiens
tagaagaaagtgaagctgggga

SEQ ID NO: 8089485 - DNA, 22 bp, Homo sapiens
tagaagaacatgtcaaactata

SEQ ID NO: 8089486 - DNA, 22 bp, Homo sapiens
tagaagaaaagcacttagagat

SEQ ID NO: 8089487 - DNA, 22 bp, Homo sapiens
tagaactaaagaacaactttga

SEQ ID NO: 8089488 - DNA, 22 bp, Homo sapiens
tagaacttagcactagacttgt

SEQ ID NO: 8089489 - DNA, 22 bp, Homo sapiens
tagctgacagatacaatcagat

SEQ ID NO: 8089490 - DNA, 23 bp, Homo sapiens
taggccagggtgacctggggaga

SEQ ID NO: 8089491 - DNA, 22 bp, Homo sapiens
tagtttaatggtcaactaatga

SEQ ID NO: 8089492 - DNA, 22 bp, Homo sapiens
tagtttttactgcgagttataa

SEQ ID NO: 8089493 - DNA, 22 bp, Homo sapiens
tagttttgaggattatatgtga

SEQ ID NO: 8089494 - DNA, 22 bp, Homo sapiens
tactatctcttctaacttcaga

SEQ ID NO: 8089495 - DNA, 22 bp, Homo sapiens
tactgtaatgagattagcttcc

SEQ ID NO: 8089496 - DNA, 22 bp, Homo sapiens
tactgtacattccgtttgttgc

SEQ ID NO: 8089497 - DNA, 22 bp, Homo sapiens
tactgaaacttttcttcaactg

SEQ ID NO: 8089498 - DNA, 22 bp, Homo sapiens
tactgtactgcagttctgcaaa

SEQ ID NO: 8089499 - DNA, 22 bp, Homo sapiens
tactgtactgtcttttttgctg

SEQ ID NO: 8089500 - DNA, 22 bp, Homo sapiens
tactgaaaaagaatccagacct

SEQ ID NO: 8089501 - DNA, 22 bp, Homo sapiens
tactcctgctgatcctgccagc

SEQ ID NO: 8089502 - DNA, 22 bp, Homo sapiens
tactctaacatttgttagatgt

SEQ ID NO: 8089503 - DNA, 22 bp, Homo sapiens
tacttaaaactgatagaatctc

SEQ ID NO: 8089504 - DNA, 22 bp, Homo sapiens
tactgttacagggagtgttcaa

SEQ ID NO: 8089505 - DNA, 18 bp, Homo sapiens
tacatgcataaatgaagc

SEQ ID NO: 8089506 - DNA, 22 bp, Homo sapiens
tacatgaagaaaattaagcagt

SEQ ID NO: 8089507 - DNA, 22 bp, Homo sapiens
tacatgaatgtttcaatattgt

SEQ ID NO: 8089508 - DNA, 22 bp, Homo sapiens
tacatgaagttgtctaaactgg

SEQ ID NO: 8089509 - DNA, 22 bp, Homo sapiens
taatatatttctgctaagctca

SEQ ID NO: 8089510 - DNA, 22 bp, Homo sapiens
taatatctacttcatagagttt

SEQ ID NO: 8089511 - DNA, 22 bp, Homo sapiens
taattattatgacaacaattgc

SEQ ID NO: 8089512 - DNA, 22 bp, Homo sapiens
taattattctagtcacatagca

SEQ ID NO: 8089513 - DNA, 23 bp, Homo sapiens
taattcacatatacattgcttca

SEQ ID NO: 8089514 - DNA, 22 bp, Homo sapiens
taattatttgaagacattagag

SEQ ID NO: 8089515 - DNA, 22 bp, Homo sapiens
taattcttgttcagaggtagta

SEQ ID NO: 8089516 - DNA, 22 bp, Homo sapiens
taattccaagttgagacatgca

SEQ ID NO: 8089517 - DNA, 22 bp, Homo sapiens
taatatatacctttgttaggaa

SEQ ID NO: 8089518 - DNA, 21 bp, Homo sapiens
taagccaccatgtgaaaccag

SEQ ID NO: 8089519 - DNA, 22 bp, Homo sapiens
taagccactagtctgttatgaa

SEQ ID NO: 8089520 - DNA, 22 bp, Homo sapiens
tacacaatctgtttttccattt

SEQ ID NO: 8089521 - DNA, 22 bp, Homo sapiens
tacaagaaggaaaactagcaat

SEQ ID NO: 8089522 - DNA, 22 bp, Homo sapiens
tacaagaaatttctgcatatat

SEQ ID NO: 8089523 - DNA, 22 bp, Homo sapiens
tacaacattgtgttgcttcata

SEQ ID NO: 8089524 - DNA, 17 bp, Homo sapiens
tacaactgttgtttata

SEQ ID NO: 8089525 - DNA, 22 bp, Homo sapiens
tacaactgcacatctgaatcac

SEQ ID NO: 8089526 - DNA, 22 bp, Homo sapiens
tacaactgtgtgaaggaatctg

SEQ ID NO: 8089527 - DNA, 22 bp, Homo sapiens
tacaactgtcagatgttttgag

SEQ ID NO: 8089528 - DNA, 20 bp, Homo sapiens
tacagaatgcaataaaatgg

SEQ ID NO: 8089529 - DNA, 21 bp, Homo sapiens
tacagaatgcgcttcagtctg

SEQ ID NO: 8089530 - DNA, 22 bp, Homo sapiens
tacacacatgcatttgccttat

SEQ ID NO: 8089531 - DNA, 22 bp, Homo sapiens
tacacacagaggccatgggatt

SEQ ID NO: 8089532 - DNA, 21 bp, Homo sapiens
gtgctgggacacagccaggct

SEQ ID NO: 8089533 - DNA, 22 bp, Homo sapiens
gtgctggctggggcatcaggca

SEQ ID NO: 8089534 - DNA, 22 bp, Homo sapiens
gtgtttaataggtagctgaatc

SEQ ID NO: 8089535 - DNA, 22 bp, Homo sapiens
gttcttcagtcacatcacagaa

SEQ ID NO: 8089536 - DNA, 22 bp, Homo sapiens
gttcttcaggctgtgctctaga

SEQ ID NO: 8089537 - DNA, 22 bp, Homo sapiens
gttcttcagtaaaattaaatgt

SEQ ID NO: 8089538 - DNA, 22 bp, Homo sapiens
gttcttcatcattttagatagg

SEQ ID NO: 8089539 - DNA, 22 bp, Homo sapiens
gttcttcatcattaacactctg

SEQ ID NO: 8089540 - DNA, 22 bp, Homo sapiens
gttcttcatcttaaccatctgt

SEQ ID NO: 8089541 - DNA, 22 bp, Homo sapiens
gttatttaactttgtagcatgg

SEQ ID NO: 8089542 - DNA, 22 bp, Homo sapiens
gttatttataaggtgtaactcc

SEQ ID NO: 8089543 - DNA, 22 bp, Homo sapiens
gttatacatatgtgttaacaaa

SEQ ID NO: 8089544 - DNA, 22 bp, Homo sapiens
gttatatatagtatttctctga

SEQ ID NO: 8089545 - DNA, 22 bp, Homo sapiens
gttatcatgcttcatcatcact

SEQ ID NO: 8089546 - DNA, 22 bp, Homo sapiens
gttgagctctccagcttcattt

SEQ ID NO: 8089547 - DNA, 22 bp, Homo sapiens
gtttatctgcactctcttgtag

SEQ ID NO: 8089548 - DNA, 22 bp, Homo sapiens
taagagaatgttgtggctaggt

SEQ ID NO: 8089549 - DNA, 22 bp, Homo sapiens
taagacttaggtcgagtttggc

SEQ ID NO: 8089550 - DNA, 22 bp, Homo sapiens
taaatgttgtaagtacatctaa

SEQ ID NO: 8089551 - DNA, 19 bp, Homo sapiens
taaagcacatagcaaaagt

SEQ ID NO: 8089552 - DNA, 22 bp, Homo sapiens
taaagcaaggcaaattgttggt

SEQ ID NO: 8089553 - DNA, 18 bp, Homo sapiens
taaatgcatgttaataac

SEQ ID NO: 8089554 - DNA, 20 bp, Homo sapiens
taaatgcatgaatgtaaggc

SEQ ID NO: 8089555 - DNA, 22 bp, Homo sapiens
taaagcaccatttgtttatcca

SEQ ID NO: 8089556 - DNA, 22 bp, Homo sapiens
taaagacatgcaaagtctaatt

SEQ ID NO: 8089557 - DNA, 22 bp, Homo sapiens
taaagacatgcaaagtctaatt

SEQ ID NO: 8089558 - DNA, 22 bp, Homo sapiens
taaagacactggttttaatcat

SEQ ID NO: 8089559 - DNA, 22 bp, Homo sapiens
taaaagagaatggataacagag

SEQ ID NO: 8089560 - DNA, 22 bp, Homo sapiens
taaaagaagcttcaaggccggc

SEQ ID NO: 8089561 - DNA, 22 bp, Homo sapiens
taaaacttaactatccagatta

SEQ ID NO: 8089562 - DNA, 22 bp, Homo sapiens
gaatgtttttaggaatgttatg

SEQ ID NO: 8089563 - DNA, 22 bp, Homo sapiens
gaatgtttttataagtgttaca

SEQ ID NO: 8089564 - DNA, 19 bp, Homo sapiens
gaatgtttgtattcagcgc

SEQ ID NO: 8089565 - DNA, 22 bp, Homo sapiens
gaagaaggtgctacacagggca

SEQ ID NO: 8089566 - DNA, 22 bp, Homo sapiens
gacaacagcatatggactgtca

SEQ ID NO: 8089567 - DNA, 21 bp, Homo sapiens
gacaaacatttcatagcttta

SEQ ID NO: 8089568 - DNA, 22 bp, Homo sapiens
gacaaaactgagatcacactgt

SEQ ID NO: 8089569 - DNA, 22 bp, Homo sapiens
gacctgggtaaggggctgacaa

SEQ ID NO: 8089570 - DNA, 22 bp, Homo sapiens
gacctggtccttgtactttgaa

SEQ ID NO: 8089571 - DNA, 22 bp, Homo sapiens
gaccttgggcacagcacagctt

SEQ ID NO: 8089572 - DNA, 22 bp, Homo sapiens
gaccttggttgagcttcctaat

SEQ ID NO: 8089573 - DNA, 22 bp, Homo sapiens
gacctggaggatcctcttcttg

SEQ ID NO: 8089574 - DNA, 17 bp, Homo sapiens
gacagctgggcgcacgc

SEQ ID NO: 8089575 - DNA, 22 bp, Homo sapiens
gacagccaactggggagggcat

SEQ ID NO: 8089576 - DNA, 22 bp, Homo sapiens
gacagctgaacaggtgggataa

SEQ ID NO: 8089577 - DNA, 22 bp, Homo sapiens
gagaagaacttgggcaaagtca

SEQ ID NO: 8089578 - DNA, 22 bp, Homo sapiens
gagaagaaatagaatcacattt

SEQ ID NO: 8089579 - DNA, 22 bp, Homo sapiens
gagaagcaatcgtgacatctcc

SEQ ID NO: 8089580 - DNA, 22 bp, Homo sapiens
gagagccctgcatggctgatga

SEQ ID NO: 8089581 - DNA, 22 bp, Homo sapiens
gagaggagacttatccagattg

SEQ ID NO: 8089582 - DNA, 22 bp, Homo sapiens
gagaggagtccctatcacagtt

SEQ ID NO: 8089583 - DNA, 22 bp, Homo sapiens
gagaggagtccctatcacagtt

SEQ ID NO: 8089584 - DNA, 23 bp, Homo sapiens
gagcagagcgggcgggggtcctg

SEQ ID NO: 8089585 - DNA, 22 bp, Homo sapiens
gagcaggacgtgggaatgggaa

SEQ ID NO: 8089586 - DNA, 22 bp, Homo sapiens
gagcaggaaggccagaagggtc

SEQ ID NO: 8089587 - DNA, 22 bp, Homo sapiens
gagcaggaacagatcccttgga

SEQ ID NO: 8089588 - DNA, 22 bp, Homo sapiens
gagggcctctgtgggtgctcac

SEQ ID NO: 8089589 - DNA, 22 bp, Homo sapiens
gagggccagcagcctcagcatg

SEQ ID NO: 8089590 - DNA, 22 bp, Homo sapiens
gagggccacgttcagggctctc

SEQ ID NO: 8089591 - DNA, 22 bp, Homo sapiens
gaggcctggtttccagcatcct

SEQ ID NO: 8089592 - DNA, 22 bp, Homo sapiens
gaggcctgtcgctaggcctctg

SEQ ID NO: 8089593 - DNA, 22 bp, Homo sapiens
gaggtgctgctgtacttcttgc

SEQ ID NO: 8089594 - DNA, 22 bp, Homo sapiens
gagggtggctcctccctgggcc

SEQ ID NO: 8089595 - DNA, 22 bp, Homo sapiens
gagggtgggtacaccagccctc

SEQ ID NO: 8089596 - DNA, 22 bp, Homo sapiens
gaggcctggaccagccacagag

SEQ ID NO: 8089597 - DNA, 22 bp, Homo sapiens
gaggccagatactctcttctgc

SEQ ID NO: 8089598 - DNA, 22 bp, Homo sapiens
gaggccagagttccccgagtca

SEQ ID NO: 8089599 - DNA, 22 bp, Homo sapiens
gaggccagaatgagtctctggg

SEQ ID NO: 8089600 - DNA, 22 bp, Homo sapiens
gaggccagaagtctgagatcag

SEQ ID NO: 8089601 - DNA, 22 bp, Homo sapiens
gaggccagaagtgcctcgggct

SEQ ID NO: 8089602 - DNA, 22 bp, Homo sapiens
gaggacagtgtgatctgccagc

SEQ ID NO: 8089603 - DNA, 22 bp, Homo sapiens
gaggagtgtattccacaccact

SEQ ID NO: 8089604 - DNA, 22 bp, Homo sapiens
gaggaggtggagtcatgcagag

SEQ ID NO: 8089605 - DNA, 17 bp, Homo sapiens
gaggacagggaagtagg

SEQ ID NO: 8089606 - DNA, 22 bp, Homo sapiens
gaggacaggagactcactgttt

SEQ ID NO: 8089607 - DNA, 22 bp, Homo sapiens
gagctgtgacacgcagcccagg

SEQ ID NO: 8089608 - DNA, 22 bp, Homo sapiens
gagctgggcacacgccacttga

SEQ ID NO: 8089609 - DNA, 22 bp, Homo sapiens
gagcaggatgggagctggggcc

SEQ ID NO: 8089610 - DNA, 22 bp, Homo sapiens
gagctcagcactaaaatcatgt

SEQ ID NO: 8089611 - DNA, 22 bp, Homo sapiens
gaaactgtttctggctttggtg

SEQ ID NO: 8089612 - DNA, 22 bp, Homo sapiens
gaaagaatgctatagtgacttc

SEQ ID NO: 8089613 - DNA, 22 bp, Homo sapiens
gaaaaatgagctgatgtcaggg

SEQ ID NO: 8089614 - DNA, 22 bp, Homo sapiens
gaaaaatgctccaaatctgtgg

SEQ ID NO: 8089615 - DNA, 22 bp, Homo sapiens
gaaattattgctagagactgca

SEQ ID NO: 8089616 - DNA, 22 bp, Homo sapiens
gaactttaaaacaaagtacagt

SEQ ID NO: 8089617 - DNA, 22 bp, Homo sapiens
gaagaacacttcatgattcatt

SEQ ID NO: 8089618 - DNA, 22 bp, Homo sapiens
gaagaaatgtgttcaaggtagg

SEQ ID NO: 8089619 - DNA, 22 bp, Homo sapiens
gaagaaattgaattcatgagct

SEQ ID NO: 8089620 - DNA, 22 bp, Homo sapiens
gaagaaggaagatcatgcttga

SEQ ID NO: 8089621 - DNA, 22 bp, Homo sapiens
cttgcttcattagtgtcttagt

SEQ ID NO: 8089622 - DNA, 18 bp, Homo sapiens
cttggagaactaatgata

SEQ ID NO: 8089623 - DNA, 19 bp, Homo sapiens
cttcttcttggcagccaag

SEQ ID NO: 8089624 - DNA, 22 bp, Homo sapiens
cttcttcccagcttccctcacc

SEQ ID NO: 8089625 - DNA, 20 bp, Homo sapiens
cttcttcattaaccctactg

SEQ ID NO: 8089626 - DNA, 22 bp, Homo sapiens
cttcttcatgtattgatagtct

SEQ ID NO: 8089627 - DNA, 22 bp, Homo sapiens
ctttccaatgcatttccaatgt

SEQ ID NO: 8089628 - DNA, 22 bp, Homo sapiens
ctttccaagaatgcagatacct

SEQ ID NO: 8089629 - DNA, 23 bp, Homo sapiens
ctgttaaattccttaagagcagg

SEQ ID NO: 8089630 - DNA, 22 bp, Homo sapiens
cttcagaaccagccagaagagg

SEQ ID NO: 8089631 - DNA, 22 bp, Homo sapiens
cttcttcaagagaatgggagac

SEQ ID NO: 8089632 - DNA, 22 bp, Homo sapiens
cttcttcaacctgaaagtttca

SEQ ID NO: 8089633 - DNA, 20 bp, Homo sapiens
cttcttcagcctatgcttca

SEQ ID NO: 8089634 - DNA, 20 bp, Homo sapiens
cttcttcagtagtttgttct

SEQ ID NO: 8089635 - DNA, 22 bp, Homo sapiens
cttcttcagttgcatgtattgg

SEQ ID NO: 8089636 - DNA, 22 bp, Homo sapiens
cttcttcataggcagtcctgtt

SEQ ID NO: 8089637 - DNA, 22 bp, Homo sapiens
cttcttcatctgtaaaacttgg

SEQ ID NO: 8089638 - DNA, 22 bp, Homo sapiens
cttcttcatctgtaaaacttgg

SEQ ID NO: 8089639 - DNA, 22 bp, Homo sapiens
cttcttcacactggtctgaagc

SEQ ID NO: 8089640 - DNA, 22 bp, Homo sapiens
cttcttcaatagcaagcgcata

SEQ ID NO: 8089641 - DNA, 22 bp, Homo sapiens
cttcttcagcacaatattgatg

SEQ ID NO: 8089642 - DNA, 22 bp, Homo sapiens
ctggagccttcaccaggggaaa

SEQ ID NO: 8089643 - DNA, 22 bp, Homo sapiens
ctgggccagcaactgcaatgga

SEQ ID NO: 8089644 - DNA, 22 bp, Homo sapiens
ctgggcccacgagggctctggg

SEQ ID NO: 8089645 - DNA, 22 bp, Homo sapiens
ctgggccaggaccagggttgaa

SEQ ID NO: 8089646 - DNA, 22 bp, Homo sapiens
ctgggctccactcccacagtgt

SEQ ID NO: 8089647 - DNA, 22 bp, Homo sapiens
ctgggcctccacgggccatcac

SEQ ID NO: 8089648 - DNA, 22 bp, Homo sapiens
ctgggcctccagctctgccagc

SEQ ID NO: 8089649 - DNA, 22 bp, Homo sapiens
ctgggggcagcaagaagccatg

SEQ ID NO: 8089650 - DNA, 22 bp, Homo sapiens
ctggggggctactgacagagga

SEQ ID NO: 8089651 - DNA, 22 bp, Homo sapiens
ctggtgggtagagggcatcagg

SEQ ID NO: 8089652 - DNA, 22 bp, Homo sapiens
ctggtgtccgcaacgggcagcg

SEQ ID NO: 8089653 - DNA, 22 bp, Homo sapiens
ctgggtgtcaggagacatgatg

SEQ ID NO: 8089654 - DNA, 21 bp, Homo sapiens
ctgtggtacagctgggacgga

SEQ ID NO: 8089655 - DNA, 19 bp, Homo sapiens
ctgtgggtgtgcaagggtg

SEQ ID NO: 8089656 - DNA, 18 bp, Homo sapiens
ctgtgggctggtgcatga

SEQ ID NO: 8089657 - DNA, 22 bp, Homo sapiens
ctgtggtcatctcagagtggcc

SEQ ID NO: 8089658 - DNA, 17 bp, Homo sapiens
ctgtggccacctggatg

SEQ ID NO: 8089659 - DNA, 22 bp, Homo sapiens
ctgtggcatttagaggttgcgt

SEQ ID NO: 8089660 - DNA, 22 bp, Homo sapiens
ctgtgggcatttgagtgtgggt

SEQ ID NO: 8089661 - DNA, 22 bp, Homo sapiens
ctgtgggcctagtctggcctag

SEQ ID NO: 8089662 - DNA, 20 bp, Homo sapiens
ctgtgggcctcacttggggt

SEQ ID NO: 8089663 - DNA, 22 bp, Homo sapiens
ctgtgggcgcctgtcagcctca

SEQ ID NO: 8089664 - DNA, 22 bp, Homo sapiens
ctgtgggctcctgcagctcagg

SEQ ID NO: 8089665 - DNA, 19 bp, Homo sapiens
ctgtgggcggaggaggggc

SEQ ID NO: 8089666 - DNA, 22 bp, Homo sapiens
ctgtggcaaatgatacctccca

SEQ ID NO: 8089667 - DNA, 23 bp, Homo sapiens
ctgtggcaagtcctgcacctgcc

SEQ ID NO: 8089668 - DNA, 22 bp, Homo sapiens
ctgtggcaagtctgcctgtcac

SEQ ID NO: 8089669 - DNA, 22 bp, Homo sapiens
ctgtggcaggaagggactagca

SEQ ID NO: 8089670 - DNA, 22 bp, Homo sapiens
ctgtggcagaggtgacacctct

SEQ ID NO: 8089671 - DNA, 22 bp, Homo sapiens
ctgtggcactcaagaagcctcc

SEQ ID NO: 8089672 - DNA, 22 bp, Homo sapiens
ctgtggcacatgtggcaaggcc

SEQ ID NO: 8089673 - DNA, 22 bp, Homo sapiens
ctgtggcaagtctgcctgtcac

SEQ ID NO: 8089674 - DNA, 20 bp, Homo sapiens
ctgtggcatcttgaaggagg

SEQ ID NO: 8089675 - DNA, 22 bp, Homo sapiens
ctgtggcattgtgaggactgca

SEQ ID NO: 8089676 - DNA, 22 bp, Homo sapiens
ctgtggcagggaagaggccatg

SEQ ID NO: 8089677 - DNA, 20 bp, Homo sapiens
ctgtggcatctgtcatggtg

SEQ ID NO: 8089678 - DNA, 22 bp, Homo sapiens
ctgtccctcagttctgggcaaa

SEQ ID NO: 8089679 - DNA, 22 bp, Homo sapiens
ctggttgggaggttggctttca

SEQ ID NO: 8089680 - DNA, 22 bp, Homo sapiens
ctggttggaggagaagtttgga

SEQ ID NO: 8089681 - DNA, 22 bp, Homo sapiens
ctggttggaagtgcagactctc

SEQ ID NO: 8089682 - DNA, 22 bp, Homo sapiens
ctggttggtgccacatggtggc

SEQ ID NO: 8089683 - DNA, 22 bp, Homo sapiens
ctgtgaatgttatatctcaatg

SEQ ID NO: 8089684 - DNA, 22 bp, Homo sapiens
ctgtgaatctgggtcagttgta

SEQ ID NO: 8089685 - DNA, 20 bp, Homo sapiens
ctgtggaattttaccatgcg

SEQ ID NO: 8089686 - DNA, 22 bp, Homo sapiens
ctgtggaattgatgcttagtgt

SEQ ID NO: 8089687 - DNA, 19 bp, Homo sapiens
ctgctgggtgctgagggag

SEQ ID NO: 8089688 - DNA, 22 bp, Homo sapiens
ctggaagagtgactttgcattt

SEQ ID NO: 8089689 - DNA, 22 bp, Homo sapiens
ctggaagaggggaaatgccatg

SEQ ID NO: 8089690 - DNA, 22 bp, Homo sapiens
ctggaagagtcctaaacagata

SEQ ID NO: 8089691 - DNA, 22 bp, Homo sapiens
ctgctgtgagtggttcttgcct

SEQ ID NO: 8089692 - DNA, 22 bp, Homo sapiens
ctggaaagtgtctccatcctgg

SEQ ID NO: 8089693 - DNA, 22 bp, Homo sapiens
ctggagccggcgagccccagcc

SEQ ID NO: 8089694 - DNA, 17 bp, Homo sapiens
ctggagcctccaactcc

SEQ ID NO: 8089695 - DNA, 22 bp, Homo sapiens
ctggagccgcatggagcaggga

SEQ ID NO: 8089696 - DNA, 22 bp, Homo sapiens
ctggagccctgaatgggcagga

SEQ ID NO: 8089697 - DNA, 22 bp, Homo sapiens
ttttgcttgagtgcacaaaatg

SEQ ID NO: 8089698 - DNA, 22 bp, Homo sapiens
ctcttcctacagtctgctatgc

SEQ ID NO: 8089699 - DNA, 22 bp, Homo sapiens
ctcttcttgaaagaggaattca

SEQ ID NO: 8089700 - DNA, 22 bp, Homo sapiens
ctcttcttatggccgtggctga

SEQ ID NO: 8089701 - DNA, 22 bp, Homo sapiens
ctcttctgtacctcggcctcca

SEQ ID NO: 8089702 - DNA, 22 bp, Homo sapiens
ctcttcctctcatgcggtcata

SEQ ID NO: 8089703 - DNA, 22 bp, Homo sapiens
ctcttcctagtgtgcagcgtgg

SEQ ID NO: 8089704 - DNA, 22 bp, Homo sapiens
ctcttccttaagactataaaga

SEQ ID NO: 8089705 - DNA, 22 bp, Homo sapiens
ctcttcctttcccttgagggtg

SEQ ID NO: 8089706 - DNA, 22 bp, Homo sapiens
ctgaggccgttggtgggcctta

SEQ ID NO: 8089707 - DNA, 22 bp, Homo sapiens
ctgaggcctgtgttggggcagt

SEQ ID NO: 8089708 - DNA, 22 bp, Homo sapiens
ctgaggcctgggggcgtggacg

SEQ ID NO: 8089709 - DNA, 17 bp, Homo sapiens
ctgaggggagtgctgtg

SEQ ID NO: 8089710 - DNA, 22 bp, Homo sapiens
ctgcccccaggctgcatggctg

SEQ ID NO: 8089711 - DNA, 22 bp, Homo sapiens
ctgcccctgccaggcagctgtc

SEQ ID NO: 8089712 - DNA, 22 bp, Homo sapiens
ctgcaggaggatcctgagagtg

SEQ ID NO: 8089713 - DNA, 22 bp, Homo sapiens
ctgcaggaatctgtgctaggtg

SEQ ID NO: 8089714 - DNA, 22 bp, Homo sapiens
ctgaggtgtgagccacttcccc

SEQ ID NO: 8089715 - DNA, 22 bp, Homo sapiens
ctgaggtgtgctttcaatgggt

SEQ ID NO: 8089716 - DNA, 22 bp, Homo sapiens
tttcagtttccagctttgtcat

SEQ ID NO: 8089717 - DNA, 22 bp, Homo sapiens
tttcagtttatgtcttgaatta

SEQ ID NO: 8089718 - DNA, 22 bp, Homo sapiens
ctccttcctggttagcacctta

SEQ ID NO: 8089719 - DNA, 22 bp, Homo sapiens
ctccttcctgccccagtgataa

SEQ ID NO: 8089720 - DNA, 22 bp, Homo sapiens
ctccttcctgcagatctgagat

SEQ ID NO: 8089721 - DNA, 22 bp, Homo sapiens
ctccttcccttcaagtgttcct

SEQ ID NO: 8089722 - DNA, 19 bp, Homo sapiens
ctccttccctggtttctgt

SEQ ID NO: 8089723 - DNA, 22 bp, Homo sapiens
ctccttccctaccatcaatgtt

SEQ ID NO: 8089724 - DNA, 22 bp, Homo sapiens
ctccttcccctactcagcatcc

SEQ ID NO: 8089725 - DNA, 22 bp, Homo sapiens
ctccttccaacaagagaaagag

SEQ ID NO: 8089726 - DNA, 22 bp, Homo sapiens
ctccttcccatgagtgtgggca

SEQ ID NO: 8089727 - DNA, 23 bp, Homo sapiens
tttcagaagtggtcctaggaagc

SEQ ID NO: 8089728 - DNA, 22 bp, Homo sapiens
tttcagaaggggagaaaggtca

SEQ ID NO: 8089729 - DNA, 22 bp, Homo sapiens
tttcagaaccgctaaaataaat

SEQ ID NO: 8089730 - DNA, 22 bp, Homo sapiens
tttattcatcatctgttcatat

SEQ ID NO: 8089731 - DNA, 16 bp, Homo sapiens
ctccaggcaagaatgg

SEQ ID NO: 8089732 - DNA, 22 bp, Homo sapiens
ctccaggccaagattaagtaat

SEQ ID NO: 8089733 - DNA, 22 bp, Homo sapiens
ctccaggccagggaagtggaca

SEQ ID NO: 8089734 - DNA, 22 bp, Homo sapiens
ctccaggccatggctgcggagg

SEQ ID NO: 8089735 - DNA, 22 bp, Homo sapiens
ctccaggcccacggccgcggcc

SEQ ID NO: 8089736 - DNA, 22 bp, Homo sapiens
ctccaggcccacgtcgaggagg

SEQ ID NO: 8089737 - DNA, 22 bp, Homo sapiens
ctccaggcccctggccttctgc

SEQ ID NO: 8089738 - DNA, 22 bp, Homo sapiens
ctctgaaaatgtggtggggaaa

SEQ ID NO: 8089739 - DNA, 22 bp, Homo sapiens
tttctacatgtcaatccaaacc

SEQ ID NO: 8089740 - DNA, 22 bp, Homo sapiens
tttctcaacctcaacactattt

SEQ ID NO: 8089741 - DNA, 22 bp, Homo sapiens
tttctacacttcgtggtgtttt

SEQ ID NO: 8089742 - DNA, 22 bp, Homo sapiens
tttctacaggttgatgggtttg

SEQ ID NO: 8089743 - DNA, 22 bp, Homo sapiens
tttccacagctgtataaaataa

SEQ ID NO: 8089744 - DNA, 22 bp, Homo sapiens
tttccaagagcttatttctgaa

SEQ ID NO: 8089745 - DNA, 22 bp, Homo sapiens
tttccaagagcttatttctgaa

SEQ ID NO: 8089746 - DNA, 22 bp, Homo sapiens
tttccaagactccagttctccc

SEQ ID NO: 8089747 - DNA, 22 bp, Homo sapiens
ctctgtgggccagagaggcccc

SEQ ID NO: 8089748 - DNA, 22 bp, Homo sapiens
tttgcaaagaaattattgctgt

SEQ ID NO: 8089749 - DNA, 18 bp, Homo sapiens
tttgcaaaggaagtatgg

SEQ ID NO: 8089750 - DNA, 22 bp, Homo sapiens
tttgcaaagtgactattatatg

SEQ ID NO: 8089751 - DNA, 22 bp, Homo sapiens
tttgaaaattagacacaggcta

SEQ ID NO: 8089752 - DNA, 22 bp, Homo sapiens
ctctgaatggacactccagtgt

SEQ ID NO: 8089753 - DNA, 21 bp, Homo sapiens
ctctgaatcctgcttctcagt

SEQ ID NO: 8089754 - DNA, 22 bp, Homo sapiens
ctctgaagccccaaatagtccg

SEQ ID NO: 8089755 - DNA, 22 bp, Homo sapiens
ctcagagcaatgaacatgcaaa

SEQ ID NO: 8089756 - DNA, 22 bp, Homo sapiens
ctcagagcccagggtacacccg

SEQ ID NO: 8089757 - DNA, 22 bp, Homo sapiens
ctcagagctgaggccagggaca

SEQ ID NO: 8089758 - DNA, 21 bp, Homo sapiens
ctcagagcagttcagagggat

SEQ ID NO: 8089759 - DNA, 22 bp, Homo sapiens
ctcagagccagttagcaggtgc

SEQ ID NO: 8089760 - DNA, 22 bp, Homo sapiens
ctcacccatatctccatgactc

SEQ ID NO: 8089761 - DNA, 22 bp, Homo sapiens
ctcacccatatctccatgactc

SEQ ID NO: 8089762 - DNA, 21 bp, Homo sapiens
ctcagggcttggtgtcctcat

SEQ ID NO: 8089763 - DNA, 22 bp, Homo sapiens
ctcagggcttgagtgtccagga

SEQ ID NO: 8089764 - DNA, 22 bp, Homo sapiens
ctcaggtacagatttgtggatt

SEQ ID NO: 8089765 - DNA, 22 bp, Homo sapiens
ctcagggcagtatggctgagag

SEQ ID NO: 8089766 - DNA, 22 bp, Homo sapiens
ctcagggctggaaagccaggaa

SEQ ID NO: 8089767 - DNA, 22 bp, Homo sapiens
ctcagggctctgcatgcacacg

SEQ ID NO: 8089768 - DNA, 22 bp, Homo sapiens
ctcagggccaaggatgctgttg

SEQ ID NO: 8089769 - DNA, 22 bp, Homo sapiens
ctcagggcggcgggcagcccag

SEQ ID NO: 8089770 - DNA, 18 bp, Homo sapiens
ctcagggcatcagtctgg

SEQ ID NO: 8089771 - DNA, 18 bp, Homo sapiens
ttgcccctgggtgaggat

SEQ ID NO: 8089772 - DNA, 22 bp, Homo sapiens
ttgcccctggtcagaggaggct

SEQ ID NO: 8089773 - DNA, 22 bp, Homo sapiens
ctccaggacagattcagggcca

SEQ ID NO: 8089774 - DNA, 22 bp, Homo sapiens
ttggctgatgcaagagcttcct

SEQ ID NO: 8089775 - DNA, 22 bp, Homo sapiens
ttggctgaatgaggtcaccttt

SEQ ID NO: 8089776 - DNA, 22 bp, Homo sapiens
ttggctgagagctgctctgcag

SEQ ID NO: 8089777 - DNA, 22 bp, Homo sapiens
ctccagaggttctcatctggga

SEQ ID NO: 8089778 - DNA, 22 bp, Homo sapiens
ctccagagtcacactgcctggg

SEQ ID NO: 8089779 - DNA, 22 bp, Homo sapiens
ctccagaggttctcatctggga

SEQ ID NO: 8089780 - DNA, 22 bp, Homo sapiens
ttggatccatctcaggcatagg

SEQ ID NO: 8089781 - DNA, 22 bp, Homo sapiens
cggcacagggtaaacgttaccc

SEQ ID NO: 8089782 - DNA, 22 bp, Homo sapiens
cggcacagtggctcacgcctgt

SEQ ID NO: 8089783 - DNA, 22 bp, Homo sapiens
cggcacaggccccatcctgact

SEQ ID NO: 8089784 - DNA, 22 bp, Homo sapiens
cggcacagccgggcaaggctgg

SEQ ID NO: 8089785 - DNA, 22 bp, Homo sapiens
ttcaaatacattctttgccact

SEQ ID NO: 8089786 - DNA, 22 bp, Homo sapiens
cgtgggagtggtgggtgctcag

SEQ ID NO: 8089787 - DNA, 22 bp, Homo sapiens
cgtgggaggaaaaatgggcttc

SEQ ID NO: 8089788 - DNA, 22 bp, Homo sapiens
cgggcaaggcgagactaggccc

SEQ ID NO: 8089789 - DNA, 22 bp, Homo sapiens
cggggccctggggctgaaggtc

SEQ ID NO: 8089790 - DNA, 22 bp, Homo sapiens
cggggccctggggctgaaggtc

SEQ ID NO: 8089791 - DNA, 22 bp, Homo sapiens
cgagagttagctaggagtcaca

SEQ ID NO: 8089792 - DNA, 22 bp, Homo sapiens
ttatccaagcagaagctgcaca

SEQ ID NO: 8089793 - DNA, 22 bp, Homo sapiens
ttatttattgtgtacctactgt

SEQ ID NO: 8089794 - DNA, 22 bp, Homo sapiens
ttatttcatgtaaaatttatgt

SEQ ID NO: 8089795 - DNA, 22 bp, Homo sapiens
cgctgggcaggtccacttgtta

SEQ ID NO: 8089796 - DNA, 22 bp, Homo sapiens
ttatattagttagacttgctgt

SEQ ID NO: 8089797 - DNA, 18 bp, Homo sapiens
ccttcagctctgccagta

SEQ ID NO: 8089798 - DNA, 22 bp, Homo sapiens
ttagcaattccaggtaagttat

SEQ ID NO: 8089799 - DNA, 22 bp, Homo sapiens
ccttcagacctagacaggaatc

SEQ ID NO: 8089800 - DNA, 23 bp, Homo sapiens
ccttcagaagaagtaacaggggc

SEQ ID NO: 8089801 - DNA, 22 bp, Homo sapiens
ccttcaaaacactagtttttga

SEQ ID NO: 8089802 - DNA, 22 bp, Homo sapiens
ccttcaaattctcttagctgaa

SEQ ID NO: 8089803 - DNA, 22 bp, Homo sapiens
ttaaattttagaaacagactct

SEQ ID NO: 8089804 - DNA, 22 bp, Homo sapiens
ttaagatagaacccagtagtct

SEQ ID NO: 8089805 - DNA, 22 bp, Homo sapiens
ttaagatagaacccagtagtct

SEQ ID NO: 8089806 - DNA, 22 bp, Homo sapiens
ccttaaaagaactatctcttct

SEQ ID NO: 8089807 - DNA, 22 bp, Homo sapiens
tgggccagcaattgctgctcag

SEQ ID NO: 8089808 - DNA, 22 bp, Homo sapiens
cctgaaaatatcctctcctttg

SEQ ID NO: 8089809 - DNA, 22 bp, Homo sapiens
cctgaaaatcaaggtagtttgg

SEQ ID NO: 8089810 - DNA, 23 bp, Homo sapiens
tgggccactatagaaatctctca

SEQ ID NO: 8089811 - DNA, 22 bp, Homo sapiens
tgggccactgagggtggtcatt

SEQ ID NO: 8089812 - DNA, 22 bp, Homo sapiens
tgggccacttgaaagtggatgt

SEQ ID NO: 8089813 - DNA, 22 bp, Homo sapiens
tgggccactgctccaagtagct

SEQ ID NO: 8089814 - DNA, 22 bp, Homo sapiens
tgggccacgtgacccttaccct

SEQ ID NO: 8089815 - DNA, 22 bp, Homo sapiens
tgggcagggagctggaaccaca

SEQ ID NO: 8089816 - DNA, 22 bp, Homo sapiens
tgggccagaggcatggagctat

SEQ ID NO: 8089817 - DNA, 22 bp, Homo sapiens
tgggccagatccatggcaataa

SEQ ID NO: 8089818 - DNA, 22 bp, Homo sapiens
cctccctgcgctcctgcggcgg

SEQ ID NO: 8089819 - DNA, 22 bp, Homo sapiens
cctccctgcgctcctgcggcgg

SEQ ID NO: 8089820 - DNA, 22 bp, Homo sapiens
tgggagctcacaggcctggctc

SEQ ID NO: 8089821 - DNA, 22 bp, Homo sapiens
tgggagctcagaaagggaggtc

SEQ ID NO: 8089822 - DNA, 22 bp, Homo sapiens
cctctggcaacttcacagccca

SEQ ID NO: 8089823 - DNA, 23 bp, Homo sapiens
tgggagctcaagggaggctgccc

SEQ ID NO: 8089824 - DNA, 22 bp, Homo sapiens
tgggggtgtgccagggacctcc

SEQ ID NO: 8089825 - DNA, 22 bp, Homo sapiens
tgggggtgtcctggtgcacaca

SEQ ID NO: 8089826 - DNA, 22 bp, Homo sapiens
cctgcaccacactcactgctca

SEQ ID NO: 8089827 - DNA, 22 bp, Homo sapiens
cctgcacaatgccagcgggtgg

SEQ ID NO: 8089828 - DNA, 22 bp, Homo sapiens
cctgactagctgggactacaga

SEQ ID NO: 8089829 - DNA, 22 bp, Homo sapiens
cctgagcttgatccttctgtct

SEQ ID NO: 8089830 - DNA, 22 bp, Homo sapiens
tgtcaagagtagtttgaatagt

SEQ ID NO: 8089831 - DNA, 22 bp, Homo sapiens
tgtcaacagatctcaaagctgg

SEQ ID NO: 8089832 - DNA, 22 bp, Homo sapiens
tgtcaacatttatcaagttatt

SEQ ID NO: 8089833 - DNA, 22 bp, Homo sapiens
tgtcaaatagtagaaagatggc

SEQ ID NO: 8089834 - DNA, 22 bp, Homo sapiens
cctggaggctctgggagggcag

SEQ ID NO: 8089835 - DNA, 22 bp, Homo sapiens
tgtaaagacagataaaacagca

SEQ ID NO: 8089836 - DNA, 22 bp, Homo sapiens
tgtaatcatgcatcagttagtt

SEQ ID NO: 8089837 - DNA, 22 bp, Homo sapiens
tgtaatcattacagtacatgga

SEQ ID NO: 8089838 - DNA, 22 bp, Homo sapiens
tgggtcagtttgggggccagcc

SEQ ID NO: 8089839 - DNA, 22 bp, Homo sapiens
cctgcctgtactagagacccag

SEQ ID NO: 8089840 - DNA, 22 bp, Homo sapiens
tgggtcagacagccagtgggcc

SEQ ID NO: 8089841 - DNA, 20 bp, Homo sapiens
tggtctggagccagtgagga

SEQ ID NO: 8089842 - DNA, 22 bp, Homo sapiens
cctgctggacgtggaggagggg

SEQ ID NO: 8089843 - DNA, 22 bp, Homo sapiens
cctgctggccactgctccacct

SEQ ID NO: 8089844 - DNA, 22 bp, Homo sapiens
cctgctgtagggcccctggggc

SEQ ID NO: 8089845 - DNA, 22 bp, Homo sapiens
ccctgcctgtgggcatcaacat

SEQ ID NO: 8089846 - DNA, 22 bp, Homo sapiens
ccctgcctctgaagctgctcag

SEQ ID NO: 8089847 - DNA, 22 bp, Homo sapiens
tggacaggttgagtaggaggag

SEQ ID NO: 8089848 - DNA, 22 bp, Homo sapiens
ccctgccttggggtccacaccg

SEQ ID NO: 8089849 - DNA, 22 bp, Homo sapiens
ccctgctgaatcccatggagtc

SEQ ID NO: 8089850 - DNA, 22 bp, Homo sapiens
tggaggggcaatggagcgcgga

SEQ ID NO: 8089851 - DNA, 19 bp, Homo sapiens
tggaggggtttgaatgtgg

SEQ ID NO: 8089852 - DNA, 22 bp, Homo sapiens
tgctttattttaaatatgccat

SEQ ID NO: 8089853 - DNA, 22 bp, Homo sapiens
tgcctgctccagtcctgtccac

SEQ ID NO: 8089854 - DNA, 22 bp, Homo sapiens
tgctttatttataaaatagcaa

SEQ ID NO: 8089855 - DNA, 22 bp, Homo sapiens
tgctttattgcatcagtgtggg

SEQ ID NO: 8089856 - DNA, 22 bp, Homo sapiens
tgctttattggaacctcatcct

SEQ ID NO: 8089857 - DNA, 22 bp, Homo sapiens
tgcctgctagatatccaggtga

SEQ ID NO: 8089858 - DNA, 22 bp, Homo sapiens
tgcctcagtttcatctgcagaa

SEQ ID NO: 8089859 - DNA, 22 bp, Homo sapiens
tggaagaataggatagaagaac

SEQ ID NO: 8089860 - DNA, 22 bp, Homo sapiens
tggaagggaaagtttggggtcc

SEQ ID NO: 8089861 - DNA, 22 bp, Homo sapiens
tggaagggaacaggtgggtgtt

SEQ ID NO: 8089862 - DNA, 22 bp, Homo sapiens
ccctgtggaggaggagagcagt

SEQ ID NO: 8089863 - DNA, 22 bp, Homo sapiens
ccctgtggcaggaggaggagca

SEQ ID NO: 8089864 - DNA, 22 bp, Homo sapiens
cctcacagaggggcagccatct

SEQ ID NO: 8089865 - DNA, 17 bp, Homo sapiens
cctcacagggaccagac

SEQ ID NO: 8089866 - DNA, 22 bp, Homo sapiens
ccggctcggcgaccaggctgaa

SEQ ID NO: 8089867 - DNA, 22 bp, Homo sapiens
ccggctcggcgaccaggctgaa

SEQ ID NO: 8089868 - DNA, 22 bp, Homo sapiens
cctcagaagctcaaggacattg

SEQ ID NO: 8089869 - DNA, 19 bp, Homo sapiens
cctcaccctgcagaggagg

SEQ ID NO: 8089870 - DNA, 22 bp, Homo sapiens
tggctaacaaggtgaaaccccg

SEQ ID NO: 8089871 - DNA, 22 bp, Homo sapiens
cctcagcccctgaatggagaga

SEQ ID NO: 8089872 - DNA, 19 bp, Homo sapiens
cctccccttggaccagcaa

SEQ ID NO: 8089873 - DNA, 22 bp, Homo sapiens
cctccctctttcagtcccacag

SEQ ID NO: 8089874 - DNA, 23 bp, Homo sapiens
tggctcagctagttttccatttc

SEQ ID NO: 8089875 - DNA, 22 bp, Homo sapiens
tggctcagcggtggcagcagac

SEQ ID NO: 8089876 - DNA, 22 bp, Homo sapiens
tggctcagctgactcggcttct

SEQ ID NO: 8089877 - DNA, 22 bp, Homo sapiens
cctcccaggcattgccattttc

SEQ ID NO: 8089878 - DNA, 22 bp, Homo sapiens
tggctcagcgcggcctggtctt

SEQ ID NO: 8089879 - DNA, 22 bp, Homo sapiens
tggctcagccattcgtgttgcc

SEQ ID NO: 8089880 - DNA, 22 bp, Homo sapiens
tggctcagcctggccctttcat

SEQ ID NO: 8089881 - DNA, 22 bp, Homo sapiens
ccaggctccgcatagaccccac

SEQ ID NO: 8089882 - DNA, 22 bp, Homo sapiens
ccaggctcctcatgatcttgtt

SEQ ID NO: 8089883 - DNA, 21 bp, Homo sapiens
ccaggctcctgaggctggtca

SEQ ID NO: 8089884 - DNA, 22 bp, Homo sapiens
tgaaagcagcaccaataccatt

SEQ ID NO: 8089885 - DNA, 22 bp, Homo sapiens
tgaaggaatggaggatcagagc

SEQ ID NO: 8089886 - DNA, 22 bp, Homo sapiens
tgaacaggtatttattgaacat

SEQ ID NO: 8089887 - DNA, 21 bp, Homo sapiens
ccagcctcagatcagggagct

SEQ ID NO: 8089888 - DNA, 22 bp, Homo sapiens
tctttaaagttggagcttgcaa

SEQ ID NO: 8089889 - DNA, 22 bp, Homo sapiens
ccaggctcaggtgcgagagaca

SEQ ID NO: 8089890 - DNA, 22 bp, Homo sapiens
ccaggctccccaggaggccctt

SEQ ID NO: 8089891 - DNA, 17 bp, Homo sapiens
ccaggctccatcactgt

SEQ ID NO: 8089892 - DNA, 22 bp, Homo sapiens
ccaggctcaggcctgctcgttg

SEQ ID NO: 8089893 - DNA, 22 bp, Homo sapiens
ccaggctcagggcagactttca

SEQ ID NO: 8089894 - DNA, 22 bp, Homo sapiens
ccaggctcagctattaagaaac

SEQ ID NO: 8089895 - DNA, 22 bp, Homo sapiens
ccaggctcagcgcgcacgtctg

SEQ ID NO: 8089896 - DNA, 22 bp, Homo sapiens
ccaggctcacctggagcccctg

SEQ ID NO: 8089897 - DNA, 22 bp, Homo sapiens
ccaggctcactgactaccacat

SEQ ID NO: 8089898 - DNA, 22 bp, Homo sapiens
ccaggctcacagcatcccagga

SEQ ID NO: 8089899 - DNA, 22 bp, Homo sapiens
tctttatttaagtctgttgtaa

SEQ ID NO: 8089900 - DNA, 22 bp, Homo sapiens
tctttatttctgaatcccccat

SEQ ID NO: 8089901 - DNA, 22 bp, Homo sapiens
tctttatttctgaatcccccat

SEQ ID NO: 8089902 - DNA, 22 bp, Homo sapiens
tctttattttatgcttgtgcaa

SEQ ID NO: 8089903 - DNA, 22 bp, Homo sapiens
ccaggtcaagctcccctgtggt

SEQ ID NO: 8089904 - DNA, 22 bp, Homo sapiens
ccagggtgtgggcgtcggcacg

SEQ ID NO: 8089905 - DNA, 22 bp, Homo sapiens
ccagggtggggcaggcccactg

SEQ ID NO: 8089906 - DNA, 22 bp, Homo sapiens
tgagacttcctgatgaggcccg

SEQ ID NO: 8089907 - DNA, 22 bp, Homo sapiens
ccagggcatgtccaagacttag

SEQ ID NO: 8089908 - DNA, 22 bp, Homo sapiens
ccagggcatgtaactaatggtg

SEQ ID NO: 8089909 - DNA, 21 bp, Homo sapiens
tgactttatttgacagcccag

SEQ ID NO: 8089910 - DNA, 22 bp, Homo sapiens
tgactttaataggattttgcat

SEQ ID NO: 8089911 - DNA, 22 bp, Homo sapiens
tgacccatggtctgatcatagg

SEQ ID NO: 8089912 - DNA, 22 bp, Homo sapiens
tgaccacagacccaatgactac

SEQ ID NO: 8089913 - DNA, 22 bp, Homo sapiens
tgaccacacgtctggaattgtg

SEQ ID NO: 8089914 - DNA, 22 bp, Homo sapiens
tgcccaggatctggcgatgctc

SEQ ID NO: 8089915 - DNA, 21 bp, Homo sapiens
cccaggaggctgagaagagca

SEQ ID NO: 8089916 - DNA, 22 bp, Homo sapiens
tgccctcctcctgagcccatgt

SEQ ID NO: 8089917 - DNA, 22 bp, Homo sapiens
cccaggaggcagagatagcagt

SEQ ID NO: 8089918 - DNA, 22 bp, Homo sapiens
cccaggagacatatagaaggac

SEQ ID NO: 8089919 - DNA, 22 bp, Homo sapiens
tgcagcagtttaatgcagggtt

SEQ ID NO: 8089920 - DNA, 17 bp, Homo sapiens
tgcagcagttcccatct

SEQ ID NO: 8089921 - DNA, 22 bp, Homo sapiens
cccagcaggtgccatcactctg

SEQ ID NO: 8089922 - DNA, 22 bp, Homo sapiens
cccagcagtaaccagtggaaat

SEQ ID NO: 8089923 - DNA, 20 bp, Homo sapiens
cccagcccctacctgttgcc

SEQ ID NO: 8089924 - DNA, 22 bp, Homo sapiens
cccagcccccgagtgtctggaa

SEQ ID NO: 8089925 - DNA, 22 bp, Homo sapiens
cccagccctgacctattggaaa

SEQ ID NO: 8089926 - DNA, 20 bp, Homo sapiens
cccagcccgggccgcgctcg

SEQ ID NO: 8089927 - DNA, 18 bp, Homo sapiens
cccagcccaccatttctc

SEQ ID NO: 8089928 - DNA, 22 bp, Homo sapiens
cccagcccacggtcctgggtgg

SEQ ID NO: 8089929 - DNA, 22 bp, Homo sapiens
cccagcccatctcaaaggtcta

SEQ ID NO: 8089930 - DNA, 22 bp, Homo sapiens
cccagcccagcgttcgaggggt

SEQ ID NO: 8089931 - DNA, 21 bp, Homo sapiens
cccaggagaagaaaagatgca

SEQ ID NO: 8089932 - DNA, 22 bp, Homo sapiens
tgcagtggcgccatctcagctc

SEQ ID NO: 8089933 - DNA, 22 bp, Homo sapiens
tgcagtggaggccgtgagacag

SEQ ID NO: 8089934 - DNA, 22 bp, Homo sapiens
tgcagtggaaagactcagactt

SEQ ID NO: 8089935 - DNA, 22 bp, Homo sapiens
cccaagcagggtgcagaggcat

SEQ ID NO: 8089936 - DNA, 22 bp, Homo sapiens
ccatggcaatggtcagtctatt

SEQ ID NO: 8089937 - DNA, 22 bp, Homo sapiens
ccatggagcacctcacagaggc

SEQ ID NO: 8089938 - DNA, 22 bp, Homo sapiens
cccagcagaccgctgtgatggc

SEQ ID NO: 8089939 - DNA, 22 bp, Homo sapiens
cccagcagaatctgatgagggc

SEQ ID NO: 8089940 - DNA, 18 bp, Homo sapiens
cccagcactttgggagcc

SEQ ID NO: 8089941 - DNA, 22 bp, Homo sapiens
tgcagcaggttccaaagggtta

SEQ ID NO: 8089942 - DNA, 22 bp, Homo sapiens
tgcagcaggtgacaacgagtgg

SEQ ID NO: 8089943 - DNA, 22 bp, Homo sapiens
tgcagcagtcagtcaggcctgg

SEQ ID NO: 8089944 - DNA, 22 bp, Homo sapiens
tgcagcagtgttccttggcttg

SEQ ID NO: 8089945 - DNA, 23 bp, Homo sapiens
cccagcagattgtaaagtgtcca

SEQ ID NO: 8089946 - DNA, 22 bp, Homo sapiens
cccagcagccagaatgaggagc

SEQ ID NO: 8089947 - DNA, 22 bp, Homo sapiens
cccacaggtggaagcctcggaa

SEQ ID NO: 8089948 - DNA, 22 bp, Homo sapiens
cccacaggcaggggcagagaca

SEQ ID NO: 8089949 - DNA, 22 bp, Homo sapiens
cccacagaatgccaatgagacc

SEQ ID NO: 8089950 - DNA, 22 bp, Homo sapiens
cccacaggcaggtgcatgggct

SEQ ID NO: 8089951 - DNA, 22 bp, Homo sapiens
cccacccagctgagccgctcac

SEQ ID NO: 8089952 - DNA, 22 bp, Homo sapiens
cccacccagcctggctgagggg

SEQ ID NO: 8089953 - DNA, 22 bp, Homo sapiens
cccacccactctgaccagaagc

SEQ ID NO: 8089954 - DNA, 22 bp, Homo sapiens
cccaccagtacagatggtagat

SEQ ID NO: 8089955 - DNA, 22 bp, Homo sapiens
cccaccagacctgcaccggcac

SEQ ID NO: 8089956 - DNA, 22 bp, Homo sapiens
cccaccagccatctgagagtgt

SEQ ID NO: 8089957 - DNA, 22 bp, Homo sapiens
cccaccagattctcaaatatct

SEQ ID NO: 8089958 - DNA, 22 bp, Homo sapiens
tctccaggaagccctccctgac

SEQ ID NO: 8089959 - DNA, 22 bp, Homo sapiens
tctccaggaaccatcatggtaa

SEQ ID NO: 8089960 - DNA, 22 bp, Homo sapiens
tctccagaggtcccttgtctct

SEQ ID NO: 8089961 - DNA, 22 bp, Homo sapiens
tctccctctttgtctgctttgg

SEQ ID NO: 8089962 - DNA, 22 bp, Homo sapiens
tctcccttggtcacagattcct

SEQ ID NO: 8089963 - DNA, 22 bp, Homo sapiens
tctccctggagccctgaagcat

SEQ ID NO: 8089964 - DNA, 22 bp, Homo sapiens
tctcaaatttgttagataaaat

SEQ ID NO: 8089965 - DNA, 22 bp, Homo sapiens
tctcaaattcccttttcctcct

SEQ ID NO: 8089966 - DNA, 22 bp, Homo sapiens
tctcaaatttgctggaccagta

SEQ ID NO: 8089967 - DNA, 22 bp, Homo sapiens
tctcaaatttatacagagttca

SEQ ID NO: 8089968 - DNA, 22 bp, Homo sapiens
tctcaaatgtaaagcatgattt

SEQ ID NO: 8089969 - DNA, 22 bp, Homo sapiens
ccacctccacctattgccagcc

SEQ ID NO: 8089970 - DNA, 22 bp, Homo sapiens
ccacctccacctattgccagcc

SEQ ID NO: 8089971 - DNA, 22 bp, Homo sapiens
ccacctcctaggcctggagaag

SEQ ID NO: 8089972 - DNA, 22 bp, Homo sapiens
ccacctcctcggccatgtgacg

SEQ ID NO: 8089973 - DNA, 22 bp, Homo sapiens
ccaccacatttgcctagacttt

SEQ ID NO: 8089974 - DNA, 22 bp, Homo sapiens
ccaccagctgcatatgcacgta

SEQ ID NO: 8089975 - DNA, 22 bp, Homo sapiens
tcgcgggttgcacatggccatc

SEQ ID NO: 8089976 - DNA, 22 bp, Homo sapiens
tcgccccgaggcagccctatgc

SEQ ID NO: 8089977 - DNA, 22 bp, Homo sapiens
tcgggctcgctctcctagcgga

SEQ ID NO: 8089978 - DNA, 22 bp, Homo sapiens
tcggggtctttgacacgctctg

SEQ ID NO: 8089979 - DNA, 22 bp, Homo sapiens
ccaccgccatggcgttgtacag

SEQ ID NO: 8089980 - DNA, 22 bp, Homo sapiens
ccaccctggactcgaggcccga

SEQ ID NO: 8089981 - DNA, 22 bp, Homo sapiens
ccaccctgtgcaggcgtgggta

SEQ ID NO: 8089982 - DNA, 22 bp, Homo sapiens
ccacatgatgaggaagctgaac

SEQ ID NO: 8089983 - DNA, 19 bp, Homo sapiens
ccagcaggttcatttcagg

SEQ ID NO: 8089984 - DNA, 22 bp, Homo sapiens
ccagcagggttggtttcttctg

SEQ ID NO: 8089985 - DNA, 22 bp, Homo sapiens
ccagcaggtgtagggctcatgg

SEQ ID NO: 8089986 - DNA, 22 bp, Homo sapiens
ccagcaggggaatatttttagg

SEQ ID NO: 8089987 - DNA, 22 bp, Homo sapiens
ccagcagggcagtgccctggac

SEQ ID NO: 8089988 - DNA, 22 bp, Homo sapiens
tctctcttgtcaccccatctgc

SEQ ID NO: 8089989 - DNA, 22 bp, Homo sapiens
tcccagagctctggaggttgga

SEQ ID NO: 8089990 - DNA, 22 bp, Homo sapiens
tcccagccaggctctaccactt

SEQ ID NO: 8089991 - DNA, 22 bp, Homo sapiens
tcccagccacagtttccacctg

SEQ ID NO: 8089992 - DNA, 22 bp, Homo sapiens
catgttaatgaatttttgcagt

SEQ ID NO: 8089993 - DNA, 22 bp, Homo sapiens
cattcattagaatagatatgta

SEQ ID NO: 8089994 - DNA, 22 bp, Homo sapiens
tcccggcgctgggaggtgggtc

SEQ ID NO: 8089995 - DNA, 22 bp, Homo sapiens
tccctaggagaattgccgcagc

SEQ ID NO: 8089996 - DNA, 22 bp, Homo sapiens
tcccagggtcctcttctggaat

SEQ ID NO: 8089997 - DNA, 22 bp, Homo sapiens
tcccaggatctgagggcagaga

SEQ ID NO: 8089998 - DNA, 21 bp, Homo sapiens
tcctctccatgatctgtttgt

SEQ ID NO: 8089999 - DNA, 22 bp, Homo sapiens
tcctctccatattttctgattt

SEQ ID NO: 8090000 - DNA, 22 bp, Homo sapiens
tccctaggtcctagtcacagta

SEQ ID NO: 8090001 - DNA, 22 bp, Homo sapiens
tccagccctgtggcttccaccc

SEQ ID NO: 8090002 - DNA, 22 bp, Homo sapiens
catgttaaattgagtttgcaat

SEQ ID NO: 8090003 - DNA, 22 bp, Homo sapiens
catgtgtgtccatgtgactaag

SEQ ID NO: 8090004 - DNA, 22 bp, Homo sapiens
tccaggcccatggagcagagct

SEQ ID NO: 8090005 - DNA, 20 bp, Homo sapiens
tccaggcagctcagagtgtc

SEQ ID NO: 8090006 - DNA, 22 bp, Homo sapiens
tcatgcaagaataataggaagg

SEQ ID NO: 8090007 - DNA, 22 bp, Homo sapiens
catgaaaaatttactgttaaca

SEQ ID NO: 8090008 - DNA, 22 bp, Homo sapiens
tcattcttgatcactagttagt

SEQ ID NO: 8090009 - DNA, 22 bp, Homo sapiens
tcattctttaccaagttgtcac

SEQ ID NO: 8090010 - DNA, 20 bp, Homo sapiens
tccaagccctccttccattc

SEQ ID NO: 8090011 - DNA, 17 bp, Homo sapiens
tccaagccagcttgcct

SEQ ID NO: 8090012 - DNA, 22 bp, Homo sapiens
tatttcagtcacttcttctctg

SEQ ID NO: 8090013 - DNA, 22 bp, Homo sapiens
tatttcatctggaacaaggtaa

SEQ ID NO: 8090014 - DNA, 22 bp, Homo sapiens
tatttcattctttatcaggagc

SEQ ID NO: 8090015 - DNA, 22 bp, Homo sapiens
caggttacaatgaaaccattaa

SEQ ID NO: 8090016 - DNA, 22 bp, Homo sapiens
cagtccagagcccaccagagga

SEQ ID NO: 8090017 - DNA, 21 bp, Homo sapiens
tatttctttgactctctccct

SEQ ID NO: 8090018 - DNA, 22 bp, Homo sapiens
tatttctttcaggtatgtgttg

SEQ ID NO: 8090019 - DNA, 22 bp, Homo sapiens
tatttcttgttccctccaagtt

SEQ ID NO: 8090020 - DNA, 22 bp, Homo sapiens
tatttccaaaagcctattatga

SEQ ID NO: 8090021 - DNA, 22 bp, Homo sapiens
tatttccaagctgaatccaatg

SEQ ID NO: 8090022 - DNA, 22 bp, Homo sapiens
tatttccacctattattttctg

SEQ ID NO: 8090023 - DNA, 22 bp, Homo sapiens
cagtagccttatttggatcatt

SEQ ID NO: 8090024 - DNA, 22 bp, Homo sapiens
cagtagccactagacacatgta

SEQ ID NO: 8090025 - DNA, 22 bp, Homo sapiens
cagtgagcacggccagagggga

SEQ ID NO: 8090026 - DNA, 22 bp, Homo sapiens
tcacaaatattttaacagtagg

SEQ ID NO: 8090027 - DNA, 22 bp, Homo sapiens
tatttcttttcgtgacttattg

SEQ ID NO: 8090028 - DNA, 22 bp, Homo sapiens
tatttgaaagtgtacaaaaact

SEQ ID NO: 8090029 - DNA, 22 bp, Homo sapiens
tcacaaatcattttatctgtgt

SEQ ID NO: 8090030 - DNA, 22 bp, Homo sapiens
tcacaaatgaggaaatcgagca

SEQ ID NO: 8090031 - DNA, 21 bp, Homo sapiens
tcacaactttgaatttcaata

SEQ ID NO: 8090032 - DNA, 22 bp, Homo sapiens
tcacaactctttccatttaata

SEQ ID NO: 8090033 - DNA, 21 bp, Homo sapiens
tcagcagcatctgcctagagt

SEQ ID NO: 8090034 - DNA, 22 bp, Homo sapiens
cagtttatagttgttatgtgtg

SEQ ID NO: 8090035 - DNA, 21 bp, Homo sapiens
cagtttaataacaaagaagga

SEQ ID NO: 8090036 - DNA, 22 bp, Homo sapiens
cagtgccatgatgcagagcaat

SEQ ID NO: 8090037 - DNA, 21 bp, Homo sapiens
cagtgccagccacaggacgcc

SEQ ID NO: 8090038 - DNA, 22 bp, Homo sapiens
cagtgccaaggatggcctggga

SEQ ID NO: 8090039 - DNA, 22 bp, Homo sapiens
cagtgccacaggaatggccaat

SEQ ID NO: 8090040 - DNA, 21 bp, Homo sapiens
cagtggcagttcttgcctctg

SEQ ID NO: 8090041 - DNA, 22 bp, Homo sapiens
cagtgggattgggattggaacc

SEQ ID NO: 8090042 - DNA, 22 bp, Homo sapiens
cagtgggagcaaatacactcat

SEQ ID NO: 8090043 - DNA, 23 bp, Homo sapiens
cagtgggaggactgagataaaac

SEQ ID NO: 8090044 - DNA, 22 bp, Homo sapiens
cagtgggaagggcagaggcttt

SEQ ID NO: 8090045 - DNA, 22 bp, Homo sapiens
cagtgggaagaatgcagcctcc

SEQ ID NO: 8090046 - DNA, 22 bp, Homo sapiens
cagtgggaatgaagtggaggcc

SEQ ID NO: 8090047 - DNA, 22 bp, Homo sapiens
cagtgggacatgggcactgggc

SEQ ID NO: 8090048 - DNA, 22 bp, Homo sapiens
caggctgggctccggagataaa

SEQ ID NO: 8090049 - DNA, 22 bp, Homo sapiens
tagagctggaaaactgcaggta

SEQ ID NO: 8090050 - DNA, 19 bp, Homo sapiens
tagagctgcttcctggcag

SEQ ID NO: 8090051 - DNA, 22 bp, Homo sapiens
tagagctggccgggacagctgg

SEQ ID NO: 8090052 - DNA, 22 bp, Homo sapiens
tagagctgggcagtgctctgag

SEQ ID NO: 8090053 - DNA, 22 bp, Homo sapiens
tagagctggaatttgcagcaag

SEQ ID NO: 8090054 - DNA, 17 bp, Homo sapiens
tagagctggttcaggag

SEQ ID NO: 8090055 - DNA, 20 bp, Homo sapiens
cagggcacactgcagcctcg

SEQ ID NO: 8090056 - DNA, 22 bp, Homo sapiens
cagggcacggagaagtcacccc

SEQ ID NO: 8090057 - DNA, 22 bp, Homo sapiens
cagggcaaggcagagcgtcccc

SEQ ID NO: 8090058 - DNA, 22 bp, Homo sapiens
cagggatggcgctggctgcccg

SEQ ID NO: 8090059 - DNA, 22 bp, Homo sapiens
gtgaggggccaagagtagggca

SEQ ID NO: 8090060 - DNA, 22 bp, Homo sapiens
caggctggagtgcagtggggcg

SEQ ID NO: 8090061 - DNA, 22 bp, Homo sapiens
caggctggagtgcagtggggcg

SEQ ID NO: 8090062 - DNA, 22 bp, Homo sapiens
caggctggagtgcaatggtgct

SEQ ID NO: 8090063 - DNA, 16 bp, Homo sapiens
tactgtggagcaaggc

SEQ ID NO: 8090064 - DNA, 22 bp, Homo sapiens
caggctggagtgagtgtagtgg

SEQ ID NO: 8090065 - DNA, 22 bp, Homo sapiens
caggggacattaaagctccata

SEQ ID NO: 8090066 - DNA, 22 bp, Homo sapiens
tagtctggacttcttagtgtca

SEQ ID NO: 8090067 - DNA, 22 bp, Homo sapiens
caggggcaagaatgctgtcagc

SEQ ID NO: 8090068 - DNA, 22 bp, Homo sapiens
tatcatcttgttgtcatgcagc

SEQ ID NO: 8090069 - DNA, 22 bp, Homo sapiens
cagggtggcaggcaccatggcc

SEQ ID NO: 8090070 - DNA, 22 bp, Homo sapiens
cagggcagccaggccccgtggg

SEQ ID NO: 8090071 - DNA, 22 bp, Homo sapiens
cagggcagagggaaactccttt

SEQ ID NO: 8090072 - DNA, 22 bp, Homo sapiens
tagctcaaaggttaagtgtgga

SEQ ID NO: 8090073 - DNA, 22 bp, Homo sapiens
tagctttaagatgagatgtgga

SEQ ID NO: 8090074 - DNA, 22 bp, Homo sapiens
tagctttaagacatggtgaatg

SEQ ID NO: 8090075 - DNA, 22 bp, Homo sapiens
tagctttaataagctgctgaat

SEQ ID NO: 8090076 - DNA, 22 bp, Homo sapiens
cagggccttcgtaagtgtccgg

SEQ ID NO: 8090077 - DNA, 22 bp, Homo sapiens
cagggcctgtacaagtcccacc

SEQ ID NO: 8090078 - DNA, 22 bp, Homo sapiens
cagggccttgttcaggagtgaa

SEQ ID NO: 8090079 - DNA, 22 bp, Homo sapiens
cagggctcagggactgcagaaa

SEQ ID NO: 8090080 - DNA, 22 bp, Homo sapiens
cagggctcaggctctgggattc

SEQ ID NO: 8090081 - DNA, 22 bp, Homo sapiens
taggagcctgctctgcagggac

SEQ ID NO: 8090082 - DNA, 22 bp, Homo sapiens
taggaccaggggctgccaggaa

SEQ ID NO: 8090083 - DNA, 22 bp, Homo sapiens
taggaccagcagggtcagggtc

SEQ ID NO: 8090084 - DNA, 22 bp, Homo sapiens
tttcacagcatataggtgtact

SEQ ID NO: 8090085 - DNA, 22 bp, Homo sapiens
tttcacagctgggaagagatat

SEQ ID NO: 8090086 - DNA, 22 bp, Homo sapiens
tttcactagaacgttcttgttt

SEQ ID NO: 8090087 - DNA, 22 bp, Homo sapiens
tttcagaaaacttatcatcagt

SEQ ID NO: 8090088 - DNA, 22 bp, Homo sapiens
tttcagaaacgattatgaacac

SEQ ID NO: 8090089 - DNA, 22 bp, Homo sapiens
tttcagaaagcatcatcaaagt

SEQ ID NO: 8090090 - DNA, 22 bp, Homo sapiens
tttcagaaagctgaacatatga

SEQ ID NO: 8090091 - DNA, 22 bp, Homo sapiens
tttcagaaatggcactgaaatc

SEQ ID NO: 8090092 - DNA, 22 bp, Homo sapiens
tttcagaaagctgaacatatga

SEQ ID NO: 8090093 - DNA, 22 bp, Homo sapiens
tttcatgtcattccatttcaga

SEQ ID NO: 8090094 - DNA, 22 bp, Homo sapiens
tttcatgaggggcaaaatctca

SEQ ID NO: 8090095 - DNA, 22 bp, Homo sapiens
tttcatgagattcctccacatc

SEQ ID NO: 8090096 - DNA, 22 bp, Homo sapiens
tttcatggctaggactagagtg

SEQ ID NO: 8090097 - DNA, 22 bp, Homo sapiens
tttcccagttccctgctctata

SEQ ID NO: 8090098 - DNA, 23 bp, Homo sapiens
tttcaactcctgccattatttct

SEQ ID NO: 8090099 - DNA, 22 bp, Homo sapiens
tttcaacatacctcagtgtatg

SEQ ID NO: 8090100 - DNA, 22 bp, Homo sapiens
tttcaacaggatgataataggc

SEQ ID NO: 8090101 - DNA, 23 bp, Homo sapiens
tttcaacaggcagagaagactta

SEQ ID NO: 8090102 - DNA, 22 bp, Homo sapiens
tttcacagagaaatataacagg

SEQ ID NO: 8090103 - DNA, 22 bp, Homo sapiens
tttcacagagaaatataacagg

SEQ ID NO: 8090104 - DNA, 22 bp, Homo sapiens
tttcacagaaaggataacatta

SEQ ID NO: 8090105 - DNA, 22 bp, Homo sapiens
tttcacagaaaggataacatta

SEQ ID NO: 8090106 - DNA, 23 bp, Homo sapiens
tttcaaattactctgcagatgac

SEQ ID NO: 8090107 - DNA, 23 bp, Homo sapiens
tttcaacaatgcttagagaaaac

SEQ ID NO: 8090108 - DNA, 22 bp, Homo sapiens
tttcaacaccagagaccatgcg

SEQ ID NO: 8090109 - DNA, 22 bp, Homo sapiens
tttattcttgagagtgagaaga

SEQ ID NO: 8090110 - DNA, 22 bp, Homo sapiens
tttattctgtgctacatgaaga

SEQ ID NO: 8090111 - DNA, 20 bp, Homo sapiens
tttattcacagagaagagtt

SEQ ID NO: 8090112 - DNA, 22 bp, Homo sapiens
tttattctagctcagaatagtt

SEQ ID NO: 8090113 - DNA, 22 bp, Homo sapiens
tttattctataggcattaagca

SEQ ID NO: 8090114 - DNA, 22 bp, Homo sapiens
tttacagtctatgttgaattaa

SEQ ID NO: 8090115 - DNA, 22 bp, Homo sapiens
tttacagtcaccaaactttgct

SEQ ID NO: 8090116 - DNA, 22 bp, Homo sapiens
tttaatgtgacatcttttagag

SEQ ID NO: 8090117 - DNA, 22 bp, Homo sapiens
tttaatgtattctttggaacca

SEQ ID NO: 8090118 - DNA, 22 bp, Homo sapiens
tttaatgatagtcttacgaaaa

SEQ ID NO: 8090119 - DNA, 22 bp, Homo sapiens
tttagaagttcacacatttaaa

SEQ ID NO: 8090120 - DNA, 23 bp, Homo sapiens
tttatccaactctgtaatctctc

SEQ ID NO: 8090121 - DNA, 22 bp, Homo sapiens
tttatcatcttgtttttaaagc

SEQ ID NO: 8090122 - DNA, 22 bp, Homo sapiens
tttatctattgtattgttgatg

SEQ ID NO: 8090123 - DNA, 22 bp, Homo sapiens
tttatattgtaaaaatggttct

SEQ ID NO: 8090124 - DNA, 22 bp, Homo sapiens
tttatatagagatttgtgcatg

SEQ ID NO: 8090125 - DNA, 22 bp, Homo sapiens
ttgcagggaaatagaaataaac

SEQ ID NO: 8090126 - DNA, 22 bp, Homo sapiens
ttgcaggggaaggagcagagct

SEQ ID NO: 8090127 - DNA, 22 bp, Homo sapiens
ttgcaggggagaggaacaaaca

SEQ ID NO: 8090128 - DNA, 22 bp, Homo sapiens
ttgacacagttttctcattaag

SEQ ID NO: 8090129 - DNA, 22 bp, Homo sapiens
ttgacacagatcaatattcaac

SEQ ID NO: 8090130 - DNA, 22 bp, Homo sapiens
ttgacaatgtcctttgaatttc

SEQ ID NO: 8090131 - DNA, 19 bp, Homo sapiens
ttgctcccaccccagtttt

SEQ ID NO: 8090132 - DNA, 22 bp, Homo sapiens
ttgtaaagctttgagactacat

SEQ ID NO: 8090133 - DNA, 22 bp, Homo sapiens
ttgtgtccaaggctatggtgat

SEQ ID NO: 8090134 - DNA, 22 bp, Homo sapiens
ttgtgtcctgatttgacacaat

SEQ ID NO: 8090135 - DNA, 22 bp, Homo sapiens
ttgggcagggaaaggacaggca

SEQ ID NO: 8090136 - DNA, 22 bp, Homo sapiens
ttgggccaaggcagatctccaa

SEQ ID NO: 8090137 - DNA, 22 bp, Homo sapiens
ttgggccaaatagctatttact

SEQ ID NO: 8090138 - DNA, 22 bp, Homo sapiens
ttgggccaaagatgtccttgtt

SEQ ID NO: 8090139 - DNA, 22 bp, Homo sapiens
ttgggccactttagtttcctta

SEQ ID NO: 8090140 - DNA, 20 bp, Homo sapiens
ttgggccacactgattcagc

SEQ ID NO: 8090141 - DNA, 22 bp, Homo sapiens
ttgggagcaaataggaaagagg

SEQ ID NO: 8090142 - DNA, 22 bp, Homo sapiens
ttggccatctaagcccagccac

SEQ ID NO: 8090143 - DNA, 22 bp, Homo sapiens
ttggactggtttacatttcaag

SEQ ID NO: 8090144 - DNA, 22 bp, Homo sapiens
ttggactgagagttccaccatt

SEQ ID NO: 8090145 - DNA, 22 bp, Homo sapiens
ttggactgaatctttctcacac

SEQ ID NO: 8090146 - DNA, 22 bp, Homo sapiens
ttggcagtagtctcggctaccc

SEQ ID NO: 8090147 - DNA, 22 bp, Homo sapiens
ttctccaacacaagcatgatgt

SEQ ID NO: 8090148 - DNA, 22 bp, Homo sapiens
ttcctgacttgccaggtgtgac

SEQ ID NO: 8090149 - DNA, 22 bp, Homo sapiens
ttcctgcagcaaggagaagctg

SEQ ID NO: 8090150 - DNA, 22 bp, Homo sapiens
ttcctgcaaaactactagtagc

SEQ ID NO: 8090151 - DNA, 22 bp, Homo sapiens
ttcttatagaagcaaccattgt

SEQ ID NO: 8090152 - DNA, 22 bp, Homo sapiens
ttctgtgaatcttttttcccac

SEQ ID NO: 8090153 - DNA, 22 bp, Homo sapiens
ttctgtgattgacatgtggctt

SEQ ID NO: 8090154 - DNA, 21 bp, Homo sapiens
ttcttcaaagaagaaggcaca

SEQ ID NO: 8090155 - DNA, 22 bp, Homo sapiens
ttcttcaaacaaaagtggcatg

SEQ ID NO: 8090156 - DNA, 22 bp, Homo sapiens
ttcttcaaaacaacactggcct

SEQ ID NO: 8090157 - DNA, 22 bp, Homo sapiens
ttcttcaaatagcagggagtca

SEQ ID NO: 8090158 - DNA, 22 bp, Homo sapiens
ttcttcaacaaggacactgtta

SEQ ID NO: 8090159 - DNA, 22 bp, Homo sapiens
ttcttcaaccatctacataaac

SEQ ID NO: 8090160 - DNA, 22 bp, Homo sapiens
ttcttcaatgtgccctgttttc

SEQ ID NO: 8090161 - DNA, 22 bp, Homo sapiens
ttcttcaattttccatatactg

SEQ ID NO: 8090162 - DNA, 22 bp, Homo sapiens
ttgaacattggcaatttcatat

SEQ ID NO: 8090163 - DNA, 22 bp, Homo sapiens
ttgaacagctgttacattgtta

SEQ ID NO: 8090164 - DNA, 22 bp, Homo sapiens
ttcttttctttaggcattgtgt

SEQ ID NO: 8090165 - DNA, 21 bp, Homo sapiens
ttcacagatgggaaaactgag

SEQ ID NO: 8090166 - DNA, 22 bp, Homo sapiens
ttcacagcttaataaggctcag

SEQ ID NO: 8090167 - DNA, 22 bp, Homo sapiens
ttcacagactttccatagattg

SEQ ID NO: 8090168 - DNA, 22 bp, Homo sapiens
ttcagagcatctctaaagccag

SEQ ID NO: 8090169 - DNA, 22 bp, Homo sapiens
ttcagcaaccagaaaggctggg

SEQ ID NO: 8090170 - DNA, 22 bp, Homo sapiens
ttcagcaagaccaccatgtacc

SEQ ID NO: 8090171 - DNA, 22 bp, Homo sapiens
ttcagagctggtgtctacagct

SEQ ID NO: 8090172 - DNA, 16 bp, Homo sapiens
ttcagagcggctcata

SEQ ID NO: 8090173 - DNA, 22 bp, Homo sapiens
ttcagtgtttgtagagataact

SEQ ID NO: 8090174 - DNA, 22 bp, Homo sapiens
ttcagtgtggtgcacagttttg

SEQ ID NO: 8090175 - DNA, 22 bp, Homo sapiens
ttccaggcatgtcagacatagg

SEQ ID NO: 8090176 - DNA, 23 bp, Homo sapiens
ttccaggcagagcagggattaga

SEQ ID NO: 8090177 - DNA, 22 bp, Homo sapiens
ttccaggcagaacaatcatgct

SEQ ID NO: 8090178 - DNA, 22 bp, Homo sapiens
ttccaggctgcacagttgggac

SEQ ID NO: 8090179 - DNA, 22 bp, Homo sapiens
ttccaggctgcagttgtagtta

SEQ ID NO: 8090180 - DNA, 22 bp, Homo sapiens
ttccaggcttctctggggcgtc

SEQ ID NO: 8090181 - DNA, 22 bp, Homo sapiens
ttccaggctgcagttttctagt

SEQ ID NO: 8090182 - DNA, 22 bp, Homo sapiens
ttccaggcattaaagtttctcc

SEQ ID NO: 8090183 - DNA, 22 bp, Homo sapiens
ttccaggccagaatggtcacat

SEQ ID NO: 8090184 - DNA, 22 bp, Homo sapiens
ttccaggcattacagggtttgc

SEQ ID NO: 8090185 - DNA, 22 bp, Homo sapiens
ttccaggctatccggtgaaggg

SEQ ID NO: 8090186 - DNA, 22 bp, Homo sapiens
ttccaggcgcacgtcggcctta

SEQ ID NO: 8090187 - DNA, 22 bp, Homo sapiens
ttccaggctcccttggaggtgt

SEQ ID NO: 8090188 - DNA, 22 bp, Homo sapiens
ttccaggctattccctttggag

SEQ ID NO: 8090189 - DNA, 22 bp, Homo sapiens
ttccaggctcctgcagtttcta

SEQ ID NO: 8090190 - DNA, 22 bp, Homo sapiens
ttccaggctcttccaggctgtc

SEQ ID NO: 8090191 - DNA, 22 bp, Homo sapiens
ttccaggctgatgggccacagg

SEQ ID NO: 8090192 - DNA, 22 bp, Homo sapiens
ttccagtgaccatagagtatgg

SEQ ID NO: 8090193 - DNA, 22 bp, Homo sapiens
ttatacatgtgttttgagatga

SEQ ID NO: 8090194 - DNA, 22 bp, Homo sapiens
ttatagaaggagcattcactta

SEQ ID NO: 8090195 - DNA, 22 bp, Homo sapiens
ttatactaaaacgcattgaatt

SEQ ID NO: 8090196 - DNA, 22 bp, Homo sapiens
ttattcttttctccagaatccc

SEQ ID NO: 8090197 - DNA, 22 bp, Homo sapiens
ttattgaaggaactgaaataaa

SEQ ID NO: 8090198 - DNA, 22 bp, Homo sapiens
ttattgactgaaatgagagtga

SEQ ID NO: 8090199 - DNA, 22 bp, Homo sapiens
ttcaaacagtgtagaatatatg

SEQ ID NO: 8090200 - DNA, 22 bp, Homo sapiens
ttattatagattatgcaagatt

SEQ ID NO: 8090201 - DNA, 22 bp, Homo sapiens
ttattatagattatgcaagatt

SEQ ID NO: 8090202 - DNA, 22 bp, Homo sapiens
ttattctttaaacatatatgtt

SEQ ID NO: 8090203 - DNA, 22 bp, Homo sapiens
ttattacaatgcagaaaataga

SEQ ID NO: 8090204 - DNA, 22 bp, Homo sapiens
ttatatgattgaagtgcataag

SEQ ID NO: 8090205 - DNA, 22 bp, Homo sapiens
tttttataactcttttgtgaca

SEQ ID NO: 8090206 - DNA, 22 bp, Homo sapiens
tttttcagccatgaattacact

SEQ ID NO: 8090207 - DNA, 22 bp, Homo sapiens
tttgatagggaagtaagaatga

SEQ ID NO: 8090208 - DNA, 22 bp, Homo sapiens
tttggtccaagttttactcttt

SEQ ID NO: 8090209 - DNA, 22 bp, Homo sapiens
tttggtcctaagctgctctcta

SEQ ID NO: 8090210 - DNA, 22 bp, Homo sapiens
tttggtccctccctgcagctca

SEQ ID NO: 8090211 - DNA, 21 bp, Homo sapiens
tttggtcccctcacctcctgg

SEQ ID NO: 8090212 - DNA, 22 bp, Homo sapiens
tttggtcccagttctgtcatgg

SEQ ID NO: 8090213 - DNA, 22 bp, Homo sapiens
tttggtccagcagtcccacttc

SEQ ID NO: 8090214 - DNA, 22 bp, Homo sapiens
tttggtccatttgctcttacat

SEQ ID NO: 8090215 - DNA, 22 bp, Homo sapiens
tttggtccattatatgctgtca

SEQ ID NO: 8090216 - DNA, 18 bp, Homo sapiens
tttggtcctttataaaca

SEQ ID NO: 8090217 - DNA, 22 bp, Homo sapiens
tttggtccttcatacttccttt

SEQ ID NO: 8090218 - DNA, 22 bp, Homo sapiens
tttggtcctgagcaaaactatg

SEQ ID NO: 8090219 - DNA, 22 bp, Homo sapiens
tttggtcctctctctgtgtgtg

SEQ ID NO: 8090220 - DNA, 22 bp, Homo sapiens
tttggtcctatgagcaagtttc

SEQ ID NO: 8090221 - DNA, 22 bp, Homo sapiens
tttgaatgcaggacatacagaa

SEQ ID NO: 8090222 - DNA, 22 bp, Homo sapiens
tttgacaacagcaaatgtcaca

SEQ ID NO: 8090223 - DNA, 22 bp, Homo sapiens
ttttattgcaataaagtgtgta

SEQ ID NO: 8090224 - DNA, 22 bp, Homo sapiens
ttttattggagtgataccaagc

SEQ ID NO: 8090225 - DNA, 22 bp, Homo sapiens
ttttcagttttccaggtagccg

SEQ ID NO: 8090226 - DNA, 22 bp, Homo sapiens
ttttaagaaatgtatgactgtc

SEQ ID NO: 8090227 - DNA, 22 bp, Homo sapiens
ttttaaaggctgtatgaccaag

SEQ ID NO: 8090228 - DNA, 22 bp, Homo sapiens
tttgtaacattatggactgctt

SEQ ID NO: 8090229 - DNA, 22 bp, Homo sapiens
cacagcataatgaaatatactt

SEQ ID NO: 8090230 - DNA, 22 bp, Homo sapiens
cacagcagtctttcactaaata

SEQ ID NO: 8090231 - DNA, 21 bp, Homo sapiens
cacagcagggttcctgggctc

SEQ ID NO: 8090232 - DNA, 22 bp, Homo sapiens
cacagcctcctctggctcacgg

SEQ ID NO: 8090233 - DNA, 18 bp, Homo sapiens
cacaggagatgacctgac

SEQ ID NO: 8090234 - DNA, 22 bp, Homo sapiens
cacaggagaggttaatgggggc

SEQ ID NO: 8090235 - DNA, 19 bp, Homo sapiens
cacagctctgctcagggaa

SEQ ID NO: 8090236 - DNA, 22 bp, Homo sapiens
ggaggggatttagtagatgcta

SEQ ID NO: 8090237 - DNA, 22 bp, Homo sapiens
ggaggggatggtttgaccctgg

SEQ ID NO: 8090238 - DNA, 22 bp, Homo sapiens
cacagagaatgatgagtcactg

SEQ ID NO: 8090239 - DNA, 22 bp, Homo sapiens
ggacagcatatcagcagggcag

SEQ ID NO: 8090240 - DNA, 22 bp, Homo sapiens
ggacagcattctactgtaggca

SEQ ID NO: 8090241 - DNA, 19 bp, Homo sapiens
ggacacagaaagctgcatt

SEQ ID NO: 8090242 - DNA, 22 bp, Homo sapiens
ggacagcacagctcttgacaac

SEQ ID NO: 8090243 - DNA, 18 bp, Homo sapiens
caaattctcattgatttc

SEQ ID NO: 8090244 - DNA, 22 bp, Homo sapiens
caaattctcaccctgtttgatt

SEQ ID NO: 8090245 - DNA, 22 bp, Homo sapiens
caaattctcttactgtttgaca

SEQ ID NO: 8090246 - DNA, 22 bp, Homo sapiens
gctggccagtgtggtgaccacc

SEQ ID NO: 8090247 - DNA, 22 bp, Homo sapiens
gctgggccgacctgggctgcag

SEQ ID NO: 8090248 - DNA, 22 bp, Homo sapiens
gctgggccctgggtgccctagc

SEQ ID NO: 8090249 - DNA, 21 bp, Homo sapiens
gctgggcctgtacttgccctg

SEQ ID NO: 8090250 - DNA, 22 bp, Homo sapiens
gctgggcccagatcccaggatc

SEQ ID NO: 8090251 - DNA, 22 bp, Homo sapiens
gctgggccccatccctcgagca

SEQ ID NO: 8090252 - DNA, 22 bp, Homo sapiens
gctgggccagccagacatgtga

SEQ ID NO: 8090253 - DNA, 22 bp, Homo sapiens
gctgggagccgtacctgtcacg

SEQ ID NO: 8090254 - DNA, 22 bp, Homo sapiens
gctgggaggaatttggggaata

SEQ ID NO: 8090255 - DNA, 22 bp, Homo sapiens
gctggcccagcgcccagggcag

SEQ ID NO: 8090256 - DNA, 22 bp, Homo sapiens
gctggccatggcctgcgccatc

SEQ ID NO: 8090257 - DNA, 22 bp, Homo sapiens
gctgggagcaagtactcatctt

SEQ ID NO: 8090258 - DNA, 22 bp, Homo sapiens
gctgggagccccgagccagcgc

SEQ ID NO: 8090259 - DNA, 19 bp, Homo sapiens
caagttctggagattaggg

SEQ ID NO: 8090260 - DNA, 22 bp, Homo sapiens
gctgggctcaccaggccactag

SEQ ID NO: 8090261 - DNA, 20 bp, Homo sapiens
caagtgttattgtgcattta

SEQ ID NO: 8090262 - DNA, 22 bp, Homo sapiens
caatgcaatgcaatgcaatgca

SEQ ID NO: 8090263 - DNA, 22 bp, Homo sapiens
caatggaagaatctgacctgca

SEQ ID NO: 8090264 - DNA, 22 bp, Homo sapiens
caatgtactacaaagattgtca

SEQ ID NO: 8090265 - DNA, 22 bp, Homo sapiens
gcttccagatcccatgctctta

SEQ ID NO: 8090266 - DNA, 17 bp, Homo sapiens
ggaacaaatactatgca

SEQ ID NO: 8090267 - DNA, 22 bp, Homo sapiens
ggcaggtgtggtgaccagagat

SEQ ID NO: 8090268 - DNA, 22 bp, Homo sapiens
ggcaggactgatcagtgggatg

SEQ ID NO: 8090269 - DNA, 22 bp, Homo sapiens
ggcaggactcttctgtgggccg

SEQ ID NO: 8090270 - DNA, 20 bp, Homo sapiens
ggcaggacccggtagggagc

SEQ ID NO: 8090271 - DNA, 22 bp, Homo sapiens
ggaggtggaggttgcagtgagc

SEQ ID NO: 8090272 - DNA, 22 bp, Homo sapiens
ggccccaggcctttggtctggc

SEQ ID NO: 8090273 - DNA, 22 bp, Homo sapiens
ggccccaggacctccacggtcc

SEQ ID NO: 8090274 - DNA, 22 bp, Homo sapiens
ggccccagctgtggtgaataga

SEQ ID NO: 8090275 - DNA, 22 bp, Homo sapiens
ggccccagcttcaaccccgtgg

SEQ ID NO: 8090276 - DNA, 22 bp, Homo sapiens
ggccccagggaagaaggtggtc

SEQ ID NO: 8090277 - DNA, 22 bp, Homo sapiens
ggccccagggattaggccaacc

SEQ ID NO: 8090278 - DNA, 22 bp, Homo sapiens
ggcgcaggccttggatcctggt

SEQ ID NO: 8090279 - DNA, 21 bp, Homo sapiens
ggccccagcccatgggttctc

SEQ ID NO: 8090280 - DNA, 21 bp, Homo sapiens
ggccccagcccatgggttctc

SEQ ID NO: 8090281 - DNA, 22 bp, Homo sapiens
ggccccagcctcagtcccctga

SEQ ID NO: 8090282 - DNA, 22 bp, Homo sapiens
ggccccagcagtgcttgtttat

SEQ ID NO: 8090283 - DNA, 19 bp, Homo sapiens
ggccccagccagggtatca

SEQ ID NO: 8090284 - DNA, 18 bp, Homo sapiens
ggccagccccaggccagc

SEQ ID NO: 8090285 - DNA, 22 bp, Homo sapiens
ggccagcctggggctcccagac

SEQ ID NO: 8090286 - DNA, 20 bp, Homo sapiens
caccacagaattggggacag

SEQ ID NO: 8090287 - DNA, 21 bp, Homo sapiens
cacatttgaacctcacagcaa

SEQ ID NO: 8090288 - DNA, 22 bp, Homo sapiens
ggccagctcagggtccttgggc

SEQ ID NO: 8090289 - DNA, 22 bp, Homo sapiens
cacccagccttcacacaggagt

SEQ ID NO: 8090290 - DNA, 22 bp, Homo sapiens
cagaacattcactcatatgtgg

SEQ ID NO: 8090291 - DNA, 22 bp, Homo sapiens
cagaacatgatataaacagaag

SEQ ID NO: 8090292 - DNA, 20 bp, Homo sapiens
cagaacatgagcatcgagcc

SEQ ID NO: 8090293 - DNA, 22 bp, Homo sapiens
cagaacattcttgccagtacat

SEQ ID NO: 8090294 - DNA, 22 bp, Homo sapiens
cagaacagtacctagcacatag

SEQ ID NO: 8090295 - DNA, 22 bp, Homo sapiens
ggcttggaccagtcacagtggt

SEQ ID NO: 8090296 - DNA, 22 bp, Homo sapiens
ggcttggaaattgcaggacaca

SEQ ID NO: 8090297 - DNA, 22 bp, Homo sapiens
ggcttggaaatggtaatgagct

SEQ ID NO: 8090298 - DNA, 23 bp, Homo sapiens
ggctgggagctccgggtgcacgt

SEQ ID NO: 8090299 - DNA, 22 bp, Homo sapiens
ggctgcggatctaaggctggga

SEQ ID NO: 8090300 - DNA, 22 bp, Homo sapiens
ggctgaggctcatgccatcttg

SEQ ID NO: 8090301 - DNA, 22 bp, Homo sapiens
cactgcaacctcagactcctgg

SEQ ID NO: 8090302 - DNA, 22 bp, Homo sapiens
cactgcaaaggggaaagaagca

SEQ ID NO: 8090303 - DNA, 22 bp, Homo sapiens
ggcgctcagtgttgccccagag

SEQ ID NO: 8090304 - DNA, 22 bp, Homo sapiens
gtgcctgggacacagcagatac

SEQ ID NO: 8090305 - DNA, 20 bp, Homo sapiens
cagcctccactcactcagct

SEQ ID NO: 8090306 - DNA, 22 bp, Homo sapiens
cagctcagcttcctgggtgtgt

SEQ ID NO: 8090307 - DNA, 22 bp, Homo sapiens
cagctcccagaactgaccatgt

SEQ ID NO: 8090308 - DNA, 22 bp, Homo sapiens
cagctccagcctgacaccaaga

SEQ ID NO: 8090309 - DNA, 22 bp, Homo sapiens
gtctcagggctgagggcagtgg

SEQ ID NO: 8090310 - DNA, 22 bp, Homo sapiens
gtcctgagtcaagtgtgggcag

SEQ ID NO: 8090311 - DNA, 22 bp, Homo sapiens
gtcctgagtcaagtgtgggcag

SEQ ID NO: 8090312 - DNA, 22 bp, Homo sapiens
gtcctgagggcccaggcattct

SEQ ID NO: 8090313 - DNA, 22 bp, Homo sapiens
gtcctgagagaggctccttgcc

SEQ ID NO: 8090314 - DNA, 22 bp, Homo sapiens
cagcagagctgggctttgaatt

SEQ ID NO: 8090315 - DNA, 22 bp, Homo sapiens
cagcagggaagctgtgctgttt

SEQ ID NO: 8090316 - DNA, 22 bp, Homo sapiens
cagcagagctgtgtgggaaggg

SEQ ID NO: 8090317 - DNA, 22 bp, Homo sapiens
gggcgctgggtgtcgagactca

SEQ ID NO: 8090318 - DNA, 22 bp, Homo sapiens
gggggaggtgaatgcaataagg

SEQ ID NO: 8090319 - DNA, 22 bp, Homo sapiens
cagaggaagctgggtgtggagt

SEQ ID NO: 8090320 - DNA, 22 bp, Homo sapiens
gggggatgctcaggaggctgct

SEQ ID NO: 8090321 - DNA, 22 bp, Homo sapiens
cagaggaaatgggaaggagata

SEQ ID NO: 8090322 - DNA, 22 bp, Homo sapiens
cagaggaacgtttggattgatt

SEQ ID NO: 8090323 - DNA, 21 bp, Homo sapiens
gggctcagtggaaaagagtgt

SEQ ID NO: 8090324 - DNA, 22 bp, Homo sapiens
gggctcagtctggcgtggaatg

SEQ ID NO: 8090325 - DNA, 22 bp, Homo sapiens
gggctcagtctgcggcgcgcgg

SEQ ID NO: 8090326 - DNA, 22 bp, Homo sapiens
gggctcagtcggcaagcccctt

SEQ ID NO: 8090327 - DNA, 22 bp, Homo sapiens
gggctcagtcctggttctaccc

SEQ ID NO: 8090328 - DNA, 22 bp, Homo sapiens
gggctcagggacacatgtgtgt

SEQ ID NO: 8090329 - DNA, 22 bp, Homo sapiens
gggctcaggtcagggcatcagc

SEQ ID NO: 8090330 - DNA, 22 bp, Homo sapiens
gggctcaggagtttgaggctgc

SEQ ID NO: 8090331 - DNA, 22 bp, Homo sapiens
gggctcaggcctggcctctcac

SEQ ID NO: 8090332 - DNA, 22 bp, Homo sapiens
ggggtcctggaggccagctgga

SEQ ID NO: 8090333 - DNA, 22 bp, Homo sapiens
cagatacagctagctccgtggc

SEQ ID NO: 8090334 - DNA, 22 bp, Homo sapiens
cagatacattaaaatgatgatt

SEQ ID NO: 8090335 - DNA, 22 bp, Homo sapiens
cagcagagacggtaagcagaac

SEQ ID NO: 8090336 - DNA, 20 bp, Homo sapiens
cagcagagacccatggggag

SEQ ID NO: 8090337 - DNA, 22 bp, Homo sapiens
ggtgtcctttgggggctccgag

SEQ ID NO: 8090338 - DNA, 18 bp, Homo sapiens
ggtggcaggtcagatgcc

SEQ ID NO: 8090339 - DNA, 22 bp, Homo sapiens
ggtggcagtcttaagagatctt

SEQ ID NO: 8090340 - DNA, 22 bp, Homo sapiens
ggtggcagtagcactgggcctg

SEQ ID NO: 8090341 - DNA, 22 bp, Homo sapiens
ggtggcagtggtctctgacaga

SEQ ID NO: 8090342 - DNA, 23 bp, Homo sapiens
cttgagctcaggaagagctgagt

SEQ ID NO: 8090343 - DNA, 22 bp, Homo sapiens
cttgagctctcagccactagct

SEQ ID NO: 8090344 - DNA, 22 bp, Homo sapiens
cttgagcttaggttcaggattg

SEQ ID NO: 8090345 - DNA, 22 bp, Homo sapiens
cttgagctgaagccagttgaaa

SEQ ID NO: 8090346 - DNA, 22 bp, Homo sapiens
cttgaggtatgaaacctgcatt

SEQ ID NO: 8090347 - DNA, 22 bp, Homo sapiens
cttgagctaggaaggctgaggc

SEQ ID NO: 8090348 - DNA, 18 bp, Homo sapiens
cttgagctaagggacccc

SEQ ID NO: 8090349 - DNA, 22 bp, Homo sapiens
atcttccttcactttctcccac

SEQ ID NO: 8090350 - DNA, 22 bp, Homo sapiens
atcttcccaggctggggagagg

SEQ ID NO: 8090351 - DNA, 22 bp, Homo sapiens
cttgagaatcttctctgaagag

SEQ ID NO: 8090352 - DNA, 22 bp, Homo sapiens
gaaaacatccagagatagacct

SEQ ID NO: 8090353 - DNA, 22 bp, Homo sapiens
gaaaatagttcatcacaatgat

SEQ ID NO: 8090354 - DNA, 22 bp, Homo sapiens
gaaaatgagcctcagctacatt

SEQ ID NO: 8090355 - DNA, 22 bp, Homo sapiens
gaaaactattggcctagaacaa

SEQ ID NO: 8090356 - DNA, 22 bp, Homo sapiens
gaaaagaactgcatgggattaa

SEQ ID NO: 8090357 - DNA, 22 bp, Homo sapiens
gaaaatgtgtcatccctactgt

SEQ ID NO: 8090358 - DNA, 22 bp, Homo sapiens
gaaaatgtgcctttgggtattg

SEQ ID NO: 8090359 - DNA, 22 bp, Homo sapiens
gaactttaatcccttgggctta

SEQ ID NO: 8090360 - DNA, 22 bp, Homo sapiens
gaactttattccagaagaaagc

SEQ ID NO: 8090361 - DNA, 22 bp, Homo sapiens
atgcctcctcaaatctgccaca

SEQ ID NO: 8090362 - DNA, 22 bp, Homo sapiens
gaagcacatggctatagctatt

SEQ ID NO: 8090363 - DNA, 22 bp, Homo sapiens
gaatgtttgactaaaggtagct

SEQ ID NO: 8090364 - DNA, 22 bp, Homo sapiens
gactgggggcagccgcaccagt

SEQ ID NO: 8090365 - DNA, 22 bp, Homo sapiens
gactggggtaaggtgaggaggt

SEQ ID NO: 8090366 - DNA, 22 bp, Homo sapiens
atgctttattggagacagtcat

SEQ ID NO: 8090367 - DNA, 22 bp, Homo sapiens
atgctttagttcaaaggactta

SEQ ID NO: 8090368 - DNA, 22 bp, Homo sapiens
gacagggaggagcagagcttct

SEQ ID NO: 8090369 - DNA, 22 bp, Homo sapiens
gacagtggttccaaggcagctt

SEQ ID NO: 8090370 - DNA, 22 bp, Homo sapiens
gagcagggagacaactctggtg

SEQ ID NO: 8090371 - DNA, 21 bp, Homo sapiens
atgtcaaatgctttattttat

SEQ ID NO: 8090372 - DNA, 22 bp, Homo sapiens
gagctttaggagaaggaggtca

SEQ ID NO: 8090373 - DNA, 22 bp, Homo sapiens
gagctttagctgagacctgctt

SEQ ID NO: 8090374 - DNA, 22 bp, Homo sapiens
gagctttaccttaggttctgtt

SEQ ID NO: 8090375 - DNA, 22 bp, Homo sapiens
gagctttacttctgactggtgc

SEQ ID NO: 8090376 - DNA, 22 bp, Homo sapiens
gagctttaagggcactggtctt

SEQ ID NO: 8090377 - DNA, 22 bp, Homo sapiens
gagctttaagggataaaatgat

SEQ ID NO: 8090378 - DNA, 22 bp, Homo sapiens
gagggatggtgtgagaggctca

SEQ ID NO: 8090379 - DNA, 22 bp, Homo sapiens
gagggatgtcaggggaccttgg

SEQ ID NO: 8090380 - DNA, 22 bp, Homo sapiens
gagggcaaaacagagaagatgt

SEQ ID NO: 8090381 - DNA, 22 bp, Homo sapiens
gagggatgtgcctgaaggcagg

SEQ ID NO: 8090382 - DNA, 22 bp, Homo sapiens
gaggctttggttataaaagatc

SEQ ID NO: 8090383 - DNA, 22 bp, Homo sapiens
gaggggtcacatgggctggctt

SEQ ID NO: 8090384 - DNA, 22 bp, Homo sapiens
gagggcaccagaagagccagat

SEQ ID NO: 8090385 - DNA, 22 bp, Homo sapiens
gagggcacgaaacaaccacttc

SEQ ID NO: 8090386 - DNA, 19 bp, Homo sapiens
gaggggaggaattgacaag

SEQ ID NO: 8090387 - DNA, 22 bp, Homo sapiens
gagggggctagcgcagtgccca

SEQ ID NO: 8090388 - DNA, 22 bp, Homo sapiens
gagggggctccctgaagccagt

SEQ ID NO: 8090389 - DNA, 22 bp, Homo sapiens
atgtttcaggcgaactaacatg

SEQ ID NO: 8090390 - DNA, 22 bp, Homo sapiens
atgtttcaggaaatcagctaga

SEQ ID NO: 8090391 - DNA, 22 bp, Homo sapiens
atgtttcagatacagatcaaat

SEQ ID NO: 8090392 - DNA, 22 bp, Homo sapiens
atgtttcagatacagatcaaat

SEQ ID NO: 8090393 - DNA, 22 bp, Homo sapiens
atgtttcatgactgagcaaaat

SEQ ID NO: 8090394 - DNA, 22 bp, Homo sapiens
atgtttaattatctgggttttg

SEQ ID NO: 8090395 - DNA, 22 bp, Homo sapiens
atgtttattttgcagagtaggg

SEQ ID NO: 8090396 - DNA, 22 bp, Homo sapiens
atgtttcaccagcaaattacct

SEQ ID NO: 8090397 - DNA, 17 bp, Homo sapiens
gagtgcagacacaagca

SEQ ID NO: 8090398 - DNA, 23 bp, Homo sapiens
gagtgcagaatagacatgcagtg

SEQ ID NO: 8090399 - DNA, 22 bp, Homo sapiens
gagtgcagatgaacagaagatt

SEQ ID NO: 8090400 - DNA, 22 bp, Homo sapiens
gagtgcaggcctgagcaccatc

SEQ ID NO: 8090401 - DNA, 22 bp, Homo sapiens
gagttataacctagtttaactg

SEQ ID NO: 8090402 - DNA, 22 bp, Homo sapiens
gagttaattcgaatattctagc

SEQ ID NO: 8090403 - DNA, 18 bp, Homo sapiens
gatcgggggcgccccaag

SEQ ID NO: 8090404 - DNA, 22 bp, Homo sapiens
gctccttctggctcccttttgg

SEQ ID NO: 8090405 - DNA, 22 bp, Homo sapiens
gctcagggtcccttggtgctgg

SEQ ID NO: 8090406 - DNA, 22 bp, Homo sapiens
gctcaggtgttacctcctctag

SEQ ID NO: 8090407 - DNA, 22 bp, Homo sapiens
gcgcaggagccgcggagggccg

SEQ ID NO: 8090408 - DNA, 22 bp, Homo sapiens
gctcagggctaaggctgagggg

SEQ ID NO: 8090409 - DNA, 22 bp, Homo sapiens
caaatgaatagggagtgtgatg

SEQ ID NO: 8090410 - DNA, 22 bp, Homo sapiens
caaatgaagggagctgaagtct

SEQ ID NO: 8090411 - DNA, 22 bp, Homo sapiens
caaatgaagagggcaacttctg

SEQ ID NO: 8090412 - DNA, 22 bp, Homo sapiens
caaatgaatttccctgcaaatg

SEQ ID NO: 8090413 - DNA, 22 bp, Homo sapiens
caaatgaatttccctgcaaatg

SEQ ID NO: 8090414 - DNA, 22 bp, Homo sapiens
gctctgagacagtagagatggc

SEQ ID NO: 8090415 - DNA, 22 bp, Homo sapiens
caaatgaagaaccttctcacct

SEQ ID NO: 8090416 - DNA, 22 bp, Homo sapiens
caaatctatatgttgatattct

SEQ ID NO: 8090417 - DNA, 22 bp, Homo sapiens
atttaccagtgctgacatttga

SEQ ID NO: 8090418 - DNA, 22 bp, Homo sapiens
atttacagtttagcatttcaag

SEQ ID NO: 8090419 - DNA, 22 bp, Homo sapiens
atttacataatagactttaggt

SEQ ID NO: 8090420 - DNA, 22 bp, Homo sapiens
gcccagccagagctgtgtgatg

SEQ ID NO: 8090421 - DNA, 22 bp, Homo sapiens
gcccagccacagtcactttcat

SEQ ID NO: 8090422 - DNA, 22 bp, Homo sapiens
gcccagcaggggatggcagctc

SEQ ID NO: 8090423 - DNA, 22 bp, Homo sapiens
gcccagcccctgggtggacgtg

SEQ ID NO: 8090424 - DNA, 22 bp, Homo sapiens
gcccaggaggtggaggtgcagt

SEQ ID NO: 8090425 - DNA, 22 bp, Homo sapiens
gcccaggaggttgggctgtgca

SEQ ID NO: 8090426 - DNA, 22 bp, Homo sapiens
gcccaggagttcaagtctagtg

SEQ ID NO: 8090427 - DNA, 22 bp, Homo sapiens
gcccaggagttcaagtctagtg

SEQ ID NO: 8090428 - DNA, 22 bp, Homo sapiens
gcccctccatccatcaccgggg

SEQ ID NO: 8090429 - DNA, 22 bp, Homo sapiens
gccctcccctctgggtggtgag

SEQ ID NO: 8090430 - DNA, 23 bp, Homo sapiens
gccctccctcccaggtgggtgtt

SEQ ID NO: 8090431 - DNA, 22 bp, Homo sapiens
gccctccctacagcctatttct

SEQ ID NO: 8090432 - DNA, 22 bp, Homo sapiens
gccctcctgcaggggcttctgg

SEQ ID NO: 8090433 - DNA, 22 bp, Homo sapiens
gccctcctttgcttctcctagt

SEQ ID NO: 8090434 - DNA, 22 bp, Homo sapiens
atttgcaaagtcgtatctgtga

SEQ ID NO: 8090435 - DNA, 22 bp, Homo sapiens
atttgattagctgtgtaatttt

SEQ ID NO: 8090436 - DNA, 22 bp, Homo sapiens
atttgatttgtagatagtgtag

SEQ ID NO: 8090437 - DNA, 18 bp, Homo sapiens
attttgaacaatgctgta

SEQ ID NO: 8090438 - DNA, 22 bp, Homo sapiens
gcaggagagtctgtgccaggtt

SEQ ID NO: 8090439 - DNA, 22 bp, Homo sapiens
gcagcctgggcaacagagtgag

SEQ ID NO: 8090440 - DNA, 22 bp, Homo sapiens
gcagcaggtccgcatcatcatc

SEQ ID NO: 8090441 - DNA, 22 bp, Homo sapiens
gcagccagggctaagctgggga

SEQ ID NO: 8090442 - DNA, 22 bp, Homo sapiens
gcactgtgatcaaggctaagca

SEQ ID NO: 8090443 - DNA, 22 bp, Homo sapiens
gcactgtgacccagagcaggtg

SEQ ID NO: 8090444 - DNA, 22 bp, Homo sapiens
gcagaagtcagaccatctgaat

SEQ ID NO: 8090445 - DNA, 20 bp, Homo sapiens
gcaaaataggctctgttggt

SEQ ID NO: 8090446 - DNA, 22 bp, Homo sapiens
atgtttctagagctttgtccca

SEQ ID NO: 8090447 - DNA, 22 bp, Homo sapiens
gcaaacaagctgcctgaagatt

SEQ ID NO: 8090448 - DNA, 21 bp, Homo sapiens
gcaaatgttcaggaaaaaaga

SEQ ID NO: 8090449 - DNA, 22 bp, Homo sapiens
gcactgtgacagcaagagtgag

SEQ ID NO: 8090450 - DNA, 22 bp, Homo sapiens
gcactgtgaatatactagcaaa

SEQ ID NO: 8090451 - DNA, 22 bp, Homo sapiens
gcactgtgacagcaagagtgag

SEQ ID NO: 8090452 - DNA, 22 bp, Homo sapiens
gcactgtgaatatactagcaaa

SEQ ID NO: 8090453 - DNA, 22 bp, Homo sapiens
gcacagggccctgtgcgtaggt

SEQ ID NO: 8090454 - DNA, 22 bp, Homo sapiens
gcacaggctctcttggggacac

SEQ ID NO: 8090455 - DNA, 22 bp, Homo sapiens
gcacagaggatgaggcagctct

SEQ ID NO: 8090456 - DNA, 22 bp, Homo sapiens
gcacagagcctggtaccgagaa

SEQ ID NO: 8090457 - DNA, 22 bp, Homo sapiens
gcagggaggaagagatgcttcc

SEQ ID NO: 8090458 - DNA, 22 bp, Homo sapiens
gcaggctgtggtatgttgggca

SEQ ID NO: 8090459 - DNA, 22 bp, Homo sapiens
gcaggctagggagctgcagtcc

SEQ ID NO: 8090460 - DNA, 22 bp, Homo sapiens
gcaggcggatcactggaagtca

SEQ ID NO: 8090461 - DNA, 22 bp, Homo sapiens
gcaggagcagtcaggggcagct

SEQ ID NO: 8090462 - DNA, 22 bp, Homo sapiens
gcaggagcaatggcctatcaga

SEQ ID NO: 8090463 - DNA, 22 bp, Homo sapiens
gcaggagcaaactgcagtgtgg

SEQ ID NO: 8090464 - DNA, 22 bp, Homo sapiens
gcaggagccacttcagggatgc

SEQ ID NO: 8090465 - DNA, 22 bp, Homo sapiens
gcagggaggtttgctgacctgg

SEQ ID NO: 8090466 - DNA, 22 bp, Homo sapiens
gcaggtggatcacctgaggtca

SEQ ID NO: 8090467 - DNA, 20 bp, Homo sapiens
gcagtgctggtgcctctgct

SEQ ID NO: 8090468 - DNA, 22 bp, Homo sapiens
attgttatgaaaataagatgtt

SEQ ID NO: 8090469 - DNA, 22 bp, Homo sapiens
attgttgggtagtttgttcagc

SEQ ID NO: 8090470 - DNA, 22 bp, Homo sapiens
attgtttacactaacttcataa

SEQ ID NO: 8090471 - DNA, 22 bp, Homo sapiens
gccactgagcccggccattgtt

SEQ ID NO: 8090472 - DNA, 22 bp, Homo sapiens
gccactgattattcagcagaca

SEQ ID NO: 8090473 - DNA, 22 bp, Homo sapiens
gccactggacccagaaagggaa

SEQ ID NO: 8090474 - DNA, 22 bp, Homo sapiens
cccatgaggtggaggttgcagt

SEQ ID NO: 8090475 - DNA, 22 bp, Homo sapiens
cccatgagacctggtttaaggc

SEQ ID NO: 8090476 - DNA, 17 bp, Homo sapiens
cccatgagcccactccc

SEQ ID NO: 8090477 - DNA, 22 bp, Homo sapiens
cccatgagattctgaatttggc

SEQ ID NO: 8090478 - DNA, 22 bp, Homo sapiens
ccctaggggcaatgatggtgct

SEQ ID NO: 8090479 - DNA, 22 bp, Homo sapiens
ccctgctgtgtcccacctggaa

SEQ ID NO: 8090480 - DNA, 22 bp, Homo sapiens
ccctgctgtcaggtgctgggag

SEQ ID NO: 8090481 - DNA, 22 bp, Homo sapiens
ccctgctgcatggcctccacga

SEQ ID NO: 8090482 - DNA, 22 bp, Homo sapiens
ccctgccccaggcggcttcact

SEQ ID NO: 8090483 - DNA, 22 bp, Homo sapiens
ccctcccaagcactctgacata

SEQ ID NO: 8090484 - DNA, 22 bp, Homo sapiens
ccctccattaaaacagacctat

SEQ ID NO: 8090485 - DNA, 22 bp, Homo sapiens
ccctcccaggagtggccagaga

SEQ ID NO: 8090486 - DNA, 22 bp, Homo sapiens
cccaggaggtcaaggctgcagt

SEQ ID NO: 8090487 - DNA, 22 bp, Homo sapiens
cccaggctgtgcaaacttcaaa

SEQ ID NO: 8090488 - DNA, 22 bp, Homo sapiens
agggctgcttacctggaatggc

SEQ ID NO: 8090489 - DNA, 22 bp, Homo sapiens
agggctggagccacagctggga

SEQ ID NO: 8090490 - DNA, 22 bp, Homo sapiens
agggcgggctcatcacatgctc

SEQ ID NO: 8090491 - DNA, 19 bp, Homo sapiens
agggcggggcccaggcaca

SEQ ID NO: 8090492 - DNA, 20 bp, Homo sapiens
agggcctggagtacagcagg

SEQ ID NO: 8090493 - DNA, 22 bp, Homo sapiens
agggcctgagctggctgacctc

SEQ ID NO: 8090494 - DNA, 22 bp, Homo sapiens
agggcctgaggctgacggggag

SEQ ID NO: 8090495 - DNA, 22 bp, Homo sapiens
ccctggaactcctaggcaagca

SEQ ID NO: 8090496 - DNA, 22 bp, Homo sapiens
ccctggaacccatggccagtgt

SEQ ID NO: 8090497 - DNA, 22 bp, Homo sapiens
ccctggaaatgaggcatgtgcg

SEQ ID NO: 8090498 - DNA, 22 bp, Homo sapiens
agggtatgttttaggctgagtt

SEQ ID NO: 8090499 - DNA, 22 bp, Homo sapiens
cctgaagaaaattccacgagaa

SEQ ID NO: 8090500 - DNA, 22 bp, Homo sapiens
agggctggctaggtgcgttccc

SEQ ID NO: 8090501 - DNA, 22 bp, Homo sapiens
aggggatgatcctcccgcagcg

SEQ ID NO: 8090502 - DNA, 22 bp, Homo sapiens
cctcttccactgggccccatcc

SEQ ID NO: 8090503 - DNA, 22 bp, Homo sapiens
cctcttccactgggccccatcc

SEQ ID NO: 8090504 - DNA, 22 bp, Homo sapiens
cctcttccactgggccccatcc

SEQ ID NO: 8090505 - DNA, 22 bp, Homo sapiens
aggggcactagaatgggagact

SEQ ID NO: 8090506 - DNA, 20 bp, Homo sapiens
ccagctctgtggttagatac

SEQ ID NO: 8090507 - DNA, 22 bp, Homo sapiens
ccagcaggagatgcctgtgtct

SEQ ID NO: 8090508 - DNA, 22 bp, Homo sapiens
ccagcaggagagaacatttccc

SEQ ID NO: 8090509 - DNA, 22 bp, Homo sapiens
ccagcaggagactagcaacata

SEQ ID NO: 8090510 - DNA, 22 bp, Homo sapiens
ccagcaggcagtcatatccttt

SEQ ID NO: 8090511 - DNA, 22 bp, Homo sapiens
ccagctggcccagctgtgctcc

SEQ ID NO: 8090512 - DNA, 22 bp, Homo sapiens
ccagctggcactgtggctgccc

SEQ ID NO: 8090513 - DNA, 22 bp, Homo sapiens
ccagctggcccagctgtgctcc

SEQ ID NO: 8090514 - DNA, 22 bp, Homo sapiens
ccagctggagccaaggtggact

SEQ ID NO: 8090515 - DNA, 22 bp, Homo sapiens
ccaggacaagccagagggacag

SEQ ID NO: 8090516 - DNA, 22 bp, Homo sapiens
aggcggtgctgtggacagtgac

SEQ ID NO: 8090517 - DNA, 20 bp, Homo sapiens
aggccactgaatgccaatca

SEQ ID NO: 8090518 - DNA, 21 bp, Homo sapiens
ccagagcctgctgagccccct

SEQ ID NO: 8090519 - DNA, 22 bp, Homo sapiens
ccagagctaaacacacaggctg

SEQ ID NO: 8090520 - DNA, 22 bp, Homo sapiens
ccagagctccagggctacagaa

SEQ ID NO: 8090521 - DNA, 22 bp, Homo sapiens
ccagcaggactttggaaatatg

SEQ ID NO: 8090522 - DNA, 22 bp, Homo sapiens
ccagcaggaaagtgacgtttga

SEQ ID NO: 8090523 - DNA, 22 bp, Homo sapiens
aggccaggcaacattctgaagt

SEQ ID NO: 8090524 - DNA, 22 bp, Homo sapiens
aggccaggtggtcatgcttgct

SEQ ID NO: 8090525 - DNA, 22 bp, Homo sapiens
aggccaggttcctcaatcttga

SEQ ID NO: 8090526 - DNA, 22 bp, Homo sapiens
ccactgggggctgcaggcactc

SEQ ID NO: 8090527 - DNA, 22 bp, Homo sapiens
ccagaaatcctctctttcttgc

SEQ ID NO: 8090528 - DNA, 22 bp, Homo sapiens
aggccacagttgaggccagcaa

SEQ ID NO: 8090529 - DNA, 22 bp, Homo sapiens
aggctgcttcttgtccttggca

SEQ ID NO: 8090530 - DNA, 22 bp, Homo sapiens
aggctggcgacatctggcgggc

SEQ ID NO: 8090531 - DNA, 22 bp, Homo sapiens
aggctgggaaggtaaagttgta

SEQ ID NO: 8090532 - DNA, 22 bp, Homo sapiens
aggctggggaattgaatttgct

SEQ ID NO: 8090533 - DNA, 20 bp, Homo sapiens
aggctggggtgttttgccca

SEQ ID NO: 8090534 - DNA, 22 bp, Homo sapiens
aggctgggtacctgtcatatgc

SEQ ID NO: 8090535 - DNA, 22 bp, Homo sapiens
aggctgggcaccgttttgatcc

SEQ ID NO: 8090536 - DNA, 22 bp, Homo sapiens
aggctgggctccgcccaactcc

SEQ ID NO: 8090537 - DNA, 20 bp, Homo sapiens
ccagggctggctcctgggat

SEQ ID NO: 8090538 - DNA, 22 bp, Homo sapiens
ccagggcaggagaaagactcac

SEQ ID NO: 8090539 - DNA, 22 bp, Homo sapiens
ccaggctgggcggggaacctgg

SEQ ID NO: 8090540 - DNA, 22 bp, Homo sapiens
ccaggctgggctacaagttgag

SEQ ID NO: 8090541 - DNA, 22 bp, Homo sapiens
ccaggctggagtatagtggcgc

SEQ ID NO: 8090542 - DNA, 22 bp, Homo sapiens
ccaaaataacagcccaattcac

SEQ ID NO: 8090543 - DNA, 22 bp, Homo sapiens
aggcagcgtagcaaggctagta

SEQ ID NO: 8090544 - DNA, 22 bp, Homo sapiens
ccaaaatattagtgcttaagta

SEQ ID NO: 8090545 - DNA, 19 bp, Homo sapiens
aggcacaggttgtctggac

SEQ ID NO: 8090546 - DNA, 19 bp, Homo sapiens
aggcacaggttgtctggac

SEQ ID NO: 8090547 - DNA, 22 bp, Homo sapiens
aggcacagtgcctggaatcaaa

SEQ ID NO: 8090548 - DNA, 22 bp, Homo sapiens
aggcacagtggctcacacctgt

SEQ ID NO: 8090549 - DNA, 22 bp, Homo sapiens
aggcacagtggctcacacctgt

SEQ ID NO: 8090550 - DNA, 22 bp, Homo sapiens
aggcacagtggccctgtttggg

SEQ ID NO: 8090551 - DNA, 20 bp, Homo sapiens
aggcacagttcctagttggg

SEQ ID NO: 8090552 - DNA, 22 bp, Homo sapiens
aggcactgaatatccagtaaaa

SEQ ID NO: 8090553 - DNA, 22 bp, Homo sapiens
aggcactgaagtggtaaatgta

SEQ ID NO: 8090554 - DNA, 22 bp, Homo sapiens
aggcactgaaggaagcttgcgc

SEQ ID NO: 8090555 - DNA, 22 bp, Homo sapiens
aggcactgaaaggtggccagag

SEQ ID NO: 8090556 - DNA, 22 bp, Homo sapiens
aggcacagtttcatccccgggc

SEQ ID NO: 8090557 - DNA, 22 bp, Homo sapiens
aggcactgaagaactctttttg

SEQ ID NO: 8090558 - DNA, 22 bp, Homo sapiens
aggcactgattctgttttccat

SEQ ID NO: 8090559 - DNA, 22 bp, Homo sapiens
aggcactgattctcagagttac

SEQ ID NO: 8090560 - DNA, 22 bp, Homo sapiens
aggcactgacaattctggactg

SEQ ID NO: 8090561 - DNA, 23 bp, Homo sapiens
aggcactgaatgtgtcagtgagt

SEQ ID NO: 8090562 - DNA, 22 bp, Homo sapiens
aggcactgacagattctgtgtc

SEQ ID NO: 8090563 - DNA, 22 bp, Homo sapiens
aggcactgacctgcttccttga

SEQ ID NO: 8090564 - DNA, 22 bp, Homo sapiens
aggcactgactcaagggagcca

SEQ ID NO: 8090565 - DNA, 22 bp, Homo sapiens
aggcactgactcaagggagcca

SEQ ID NO: 8090566 - DNA, 22 bp, Homo sapiens
aggcactgagaggctgtgttgc

SEQ ID NO: 8090567 - DNA, 22 bp, Homo sapiens
aggcacagggatgcggagccag

SEQ ID NO: 8090568 - DNA, 22 bp, Homo sapiens
aggcacagggatgcggagccag

SEQ ID NO: 8090569 - DNA, 22 bp, Homo sapiens
aggcacaggtggacttcacagt

SEQ ID NO: 8090570 - DNA, 23 bp, Homo sapiens
catgtgtgacagtatcactgttt

SEQ ID NO: 8090571 - DNA, 22 bp, Homo sapiens
catgtgtgaatcttgtgatcat

SEQ ID NO: 8090572 - DNA, 22 bp, Homo sapiens
aggagttatggcagaatcaaat

SEQ ID NO: 8090573 - DNA, 22 bp, Homo sapiens
aggagtttggggattagtcagg

SEQ ID NO: 8090574 - DNA, 22 bp, Homo sapiens
aggagggttctctggacagagg

SEQ ID NO: 8090575 - DNA, 22 bp, Homo sapiens
aggagccaaacatattgagaga

SEQ ID NO: 8090576 - DNA, 22 bp, Homo sapiens
aggagccaaaagctgaacaaga

SEQ ID NO: 8090577 - DNA, 22 bp, Homo sapiens
aggagccaatctgataaagcca

SEQ ID NO: 8090578 - DNA, 22 bp, Homo sapiens
aggagccacctaggagctgttt

SEQ ID NO: 8090579 - DNA, 22 bp, Homo sapiens
cagtggaaatcagagtgagagt

SEQ ID NO: 8090580 - DNA, 22 bp, Homo sapiens
aggagctgggagaaggactaaa

SEQ ID NO: 8090581 - DNA, 17 bp, Homo sapiens
aggagctgggggtggtg

SEQ ID NO: 8090582 - DNA, 22 bp, Homo sapiens
aggagctgggctgctgctggga

SEQ ID NO: 8090583 - DNA, 22 bp, Homo sapiens
agctgggtttctggcaggctta

SEQ ID NO: 8090584 - DNA, 22 bp, Homo sapiens
agctgggttcagaggcacatgg

SEQ ID NO: 8090585 - DNA, 22 bp, Homo sapiens
agctgggtgttcttgggcctaa

SEQ ID NO: 8090586 - DNA, 22 bp, Homo sapiens
agctgggtggagggcccacggt

SEQ ID NO: 8090587 - DNA, 22 bp, Homo sapiens
agctgggtgtagggctggacaa

SEQ ID NO: 8090588 - DNA, 22 bp, Homo sapiens
agctgggtgcggtggctcatgc

SEQ ID NO: 8090589 - DNA, 22 bp, Homo sapiens
agctgggtgcccgaagccacgt

SEQ ID NO: 8090590 - DNA, 22 bp, Homo sapiens
agctgggcctgatttgcagggg

SEQ ID NO: 8090591 - DNA, 22 bp, Homo sapiens
agctgggcctgagctggaagct

SEQ ID NO: 8090592 - DNA, 22 bp, Homo sapiens
agctgggcctgagctggaagct

SEQ ID NO: 8090593 - DNA, 22 bp, Homo sapiens
agctgggctgatgactcatgtt

SEQ ID NO: 8090594 - DNA, 22 bp, Homo sapiens
agctgggcgcagtggctggtga

SEQ ID NO: 8090595 - DNA, 22 bp, Homo sapiens
agctgggctccaagagggatct

SEQ ID NO: 8090596 - DNA, 22 bp, Homo sapiens
agctgggctccaagagggatct

SEQ ID NO: 8090597 - DNA, 21 bp, Homo sapiens
agctgggcctcagcctgcagt

SEQ ID NO: 8090598 - DNA, 23 bp, Homo sapiens
agctgggccaggtggtcagacct

SEQ ID NO: 8090599 - DNA, 22 bp, Homo sapiens
agctgggcagactgcagtggtt

SEQ ID NO: 8090600 - DNA, 22 bp, Homo sapiens
agctggagccagtgtgaggctt

SEQ ID NO: 8090601 - DNA, 19 bp, Homo sapiens
agctggagattggagggca

SEQ ID NO: 8090602 - DNA, 22 bp, Homo sapiens
caggaagaccagggctgtggct

SEQ ID NO: 8090603 - DNA, 22 bp, Homo sapiens
caggaaatataggaaaaggaac

SEQ ID NO: 8090604 - DNA, 22 bp, Homo sapiens
caggaaaaggagactttagcac

SEQ ID NO: 8090605 - DNA, 22 bp, Homo sapiens
agctgcctcagcaacacagacc

SEQ ID NO: 8090606 - DNA, 22 bp, Homo sapiens
agctgcctggagtcatttcctg

SEQ ID NO: 8090607 - DNA, 22 bp, Homo sapiens
agctgcctccatggtcaaagat

SEQ ID NO: 8090608 - DNA, 22 bp, Homo sapiens
cagggaccctactagctcacac

SEQ ID NO: 8090609 - DNA, 22 bp, Homo sapiens
cagggactgagatccagactgt

SEQ ID NO: 8090610 - DNA, 22 bp, Homo sapiens
cagggacattggtggccaggtt

SEQ ID NO: 8090611 - DNA, 22 bp, Homo sapiens
agctttatttgtcattcacggc

SEQ ID NO: 8090612 - DNA, 22 bp, Homo sapiens
agctttattaactctccaggtg

SEQ ID NO: 8090613 - DNA, 22 bp, Homo sapiens
agctttattcatgatttcaggg

SEQ ID NO: 8090614 - DNA, 22 bp, Homo sapiens
caggtccctgcgccccggcctc

SEQ ID NO: 8090615 - DNA, 22 bp, Homo sapiens
cagggtggtaccagcatctagt

SEQ ID NO: 8090616 - DNA, 22 bp, Homo sapiens
cagggtttcaccatgttagcag

SEQ ID NO: 8090617 - DNA, 22 bp, Homo sapiens
cagggttgggctccaaggatgg

SEQ ID NO: 8090618 - DNA, 22 bp, Homo sapiens
cttcaagtcgccaaatgctgaa

SEQ ID NO: 8090619 - DNA, 22 bp, Homo sapiens
cttccttctgaagcatagaagc

SEQ ID NO: 8090620 - DNA, 22 bp, Homo sapiens
atccatgattagtaggataaag

SEQ ID NO: 8090621 - DNA, 22 bp, Homo sapiens
cttaatctcacctgcaaagtcc

SEQ ID NO: 8090622 - DNA, 22 bp, Homo sapiens
atccatgaaggtacttctcagg

SEQ ID NO: 8090623 - DNA, 20 bp, Homo sapiens
atccatgagagtctggattc

SEQ ID NO: 8090624 - DNA, 22 bp, Homo sapiens
atccatgatcaatttattacta

SEQ ID NO: 8090625 - DNA, 22 bp, Homo sapiens
cttaacatcctgcatttttctt

SEQ ID NO: 8090626 - DNA, 22 bp, Homo sapiens
atctgtggctggtgagaggcag

SEQ ID NO: 8090627 - DNA, 22 bp, Homo sapiens
atctggttcttcttaggcatca

SEQ ID NO: 8090628 - DNA, 22 bp, Homo sapiens
cttctgtgcttcacagttgcca

SEQ ID NO: 8090629 - DNA, 22 bp, Homo sapiens
atctccttggatcacgtttagt

SEQ ID NO: 8090630 - DNA, 19 bp, Homo sapiens
atctcctttcttcaagctt

SEQ ID NO: 8090631 - DNA, 22 bp, Homo sapiens
atctccttggtctcgttccagg

SEQ ID NO: 8090632 - DNA, 22 bp, Homo sapiens
cttctccttatatgtcccgttc

SEQ ID NO: 8090633 - DNA, 20 bp, Homo sapiens
ctgggtggcaagcaaggggg

SEQ ID NO: 8090634 - DNA, 22 bp, Homo sapiens
ctgggtggctgtccagccagcc

SEQ ID NO: 8090635 - DNA, 22 bp, Homo sapiens
ctgggtggcgtctggggccagt

SEQ ID NO: 8090636 - DNA, 22 bp, Homo sapiens
atattattctagtaacagtgat

SEQ ID NO: 8090637 - DNA, 22 bp, Homo sapiens
ctgggagcttttagaaatgcag

SEQ ID NO: 8090638 - DNA, 22 bp, Homo sapiens
ctgggagcttgttaggaatgca

SEQ ID NO: 8090639 - DNA, 22 bp, Homo sapiens
ctgtcgcctggtcctctctgga

SEQ ID NO: 8090640 - DNA, 22 bp, Homo sapiens
atcacagattgtgaataactat

SEQ ID NO: 8090641 - DNA, 22 bp, Homo sapiens
agttcttcataaccttactgtg

SEQ ID NO: 8090642 - DNA, 22 bp, Homo sapiens
agttctcaagacaattacctgt

SEQ ID NO: 8090643 - DNA, 22 bp, Homo sapiens
ataaaatctttatgtgctctgc

SEQ ID NO: 8090644 - DNA, 22 bp, Homo sapiens
ataaagaccagtatcttatgtt

SEQ ID NO: 8090645 - DNA, 22 bp, Homo sapiens
ataaagatttctttttctctac

SEQ ID NO: 8090646 - DNA, 21 bp, Homo sapiens
ataaagacaaacactatttgg

SEQ ID NO: 8090647 - DNA, 22 bp, Homo sapiens
ataaacttgagtctcagagtat

SEQ ID NO: 8090648 - DNA, 22 bp, Homo sapiens
ataaactttagcggaaggagga

SEQ ID NO: 8090649 - DNA, 22 bp, Homo sapiens
ataaagcatactttgtatgact

SEQ ID NO: 8090650 - DNA, 22 bp, Homo sapiens
atacacaggtgctaggtcaata

SEQ ID NO: 8090651 - DNA, 21 bp, Homo sapiens
atacacatacacataaatgtg

SEQ ID NO: 8090652 - DNA, 22 bp, Homo sapiens
atacacatatgtgtgtatatgt

SEQ ID NO: 8090653 - DNA, 22 bp, Homo sapiens
ctgctggggtcagagcactggg

SEQ ID NO: 8090654 - DNA, 22 bp, Homo sapiens
ctgctgtgcagacagactctct

SEQ ID NO: 8090655 - DNA, 22 bp, Homo sapiens
ctgctgtgggcagggtagctgg

SEQ ID NO: 8090656 - DNA, 22 bp, Homo sapiens
ctgctgggctcctcatgtgact

SEQ ID NO: 8090657 - DNA, 22 bp, Homo sapiens
ctgctactgaaattagatagtc

SEQ ID NO: 8090658 - DNA, 22 bp, Homo sapiens
ctgctacacgattctgattcca

SEQ ID NO: 8090659 - DNA, 22 bp, Homo sapiens
ctggccagactacacatgtgtg

SEQ ID NO: 8090660 - DNA, 20 bp, Homo sapiens
ctggccagaacgcctacaca

SEQ ID NO: 8090661 - DNA, 22 bp, Homo sapiens
ctggcacagccactgcaggcag

SEQ ID NO: 8090662 - DNA, 22 bp, Homo sapiens
ctggcacaaaagaaaactgcca

SEQ ID NO: 8090663 - DNA, 22 bp, Homo sapiens
atacacatgtgtatgtgcatgc

SEQ ID NO: 8090664 - DNA, 22 bp, Homo sapiens
ctgggagctggaatgggagaag

SEQ ID NO: 8090665 - DNA, 22 bp, Homo sapiens
ctgggagctgtcaggagcgtgt

SEQ ID NO: 8090666 - DNA, 22 bp, Homo sapiens
ctgggagaggctgctccgctct

SEQ ID NO: 8090667 - DNA, 22 bp, Homo sapiens
atagtttgaaggctgttctact

SEQ ID NO: 8090668 - DNA, 22 bp, Homo sapiens
atagtttgtgaaacacagcagt

SEQ ID NO: 8090669 - DNA, 22 bp, Homo sapiens
atagttttatagatattgtgta

SEQ ID NO: 8090670 - DNA, 22 bp, Homo sapiens
ctagcctgggatttgaacttat

SEQ ID NO: 8090671 - DNA, 22 bp, Homo sapiens
agtcaggatatgccttgtgggc

SEQ ID NO: 8090672 - DNA, 22 bp, Homo sapiens
ctatcattttacatggttggtg

SEQ ID NO: 8090673 - DNA, 22 bp, Homo sapiens
agtcaggaacctcagcaagtct

SEQ ID NO: 8090674 - DNA, 22 bp, Homo sapiens
agtcaggaagctggagctgggg

SEQ ID NO: 8090675 - DNA, 22 bp, Homo sapiens
ctatttacgctgctggggatca

SEQ ID NO: 8090676 - DNA, 22 bp, Homo sapiens
agtaggaggcgggagcatgaag

SEQ ID NO: 8090677 - DNA, 22 bp, Homo sapiens
agtatttctagttggttctact

SEQ ID NO: 8090678 - DNA, 22 bp, Homo sapiens
agtatttctgaatattatcata

SEQ ID NO: 8090679 - DNA, 22 bp, Homo sapiens
agtatttctgctcatgaaagag

SEQ ID NO: 8090680 - DNA, 18 bp, Homo sapiens
agtatttctgcatgtctt

SEQ ID NO: 8090681 - DNA, 22 bp, Homo sapiens
agtcaagattctggcactagca

SEQ ID NO: 8090682 - DNA, 22 bp, Homo sapiens
agtaaatgtttatcacacagat

SEQ ID NO: 8090683 - DNA, 22 bp, Homo sapiens
agtaaactgtgggtacagatgt

SEQ ID NO: 8090684 - DNA, 22 bp, Homo sapiens
ccttctcctgccttgggttcat

SEQ ID NO: 8090685 - DNA, 22 bp, Homo sapiens
agtaaaaattgaggtgcaaaat

SEQ ID NO: 8090686 - DNA, 21 bp, Homo sapiens
ccttctccattacagtaagct

SEQ ID NO: 8090687 - DNA, 22 bp, Homo sapiens
ccttctcccctctgcagggtgt

SEQ ID NO: 8090688 - DNA, 22 bp, Homo sapiens
aggtgcagctggtggagtctgg

SEQ ID NO: 8090689 - DNA, 22 bp, Homo sapiens
aggtggcagcagcctggtgaaa

SEQ ID NO: 8090690 - DNA, 22 bp, Homo sapiens
aggtggcagagtgacaggctga

SEQ ID NO: 8090691 - DNA, 22 bp, Homo sapiens
cctgtgggaggggcctggcgcg

SEQ ID NO: 8090692 - DNA, 22 bp, Homo sapiens
cctgtgggaggttctgtgagtc

SEQ ID NO: 8090693 - DNA, 22 bp, Homo sapiens
cctgtgggcgcagctggagtca

SEQ ID NO: 8090694 - DNA, 21 bp, Homo sapiens
cctgggagaattgggtgtggc

SEQ ID NO: 8090695 - DNA, 22 bp, Homo sapiens
cctgggaggctgaggctgcagt

SEQ ID NO: 8090696 - DNA, 22 bp, Homo sapiens
cctgggaggctgtgggtctgct

SEQ ID NO: 8090697 - DNA, 22 bp, Homo sapiens
cctgggagggcaagtgctgatg

SEQ ID NO: 8090698 - DNA, 22 bp, Homo sapiens
aggtcaccatggcatgctccac

SEQ ID NO: 8090699 - DNA, 22 bp, Homo sapiens
aggtaaattcagcagtgacatt

SEQ ID NO: 8090700 - DNA, 22 bp, Homo sapiens
agtgagttgaacattgataatg

SEQ ID NO: 8090701 - DNA, 18 bp, Homo sapiens
agtgagttgttgaaagaa

SEQ ID NO: 8090702 - DNA, 22 bp, Homo sapiens
agtgagggactagtgctgggga

SEQ ID NO: 8090703 - DNA, 22 bp, Homo sapiens
agtgaaaggaaaaactgatatt

SEQ ID NO: 8090704 - DNA, 22 bp, Homo sapiens
agtctttatgattgtcaaagta

SEQ ID NO: 8090705 - DNA, 22 bp, Homo sapiens
agtggaggttacagctgtacat

SEQ ID NO: 8090706 - DNA, 22 bp, Homo sapiens
agtggaatggtgtcctgagctc

SEQ ID NO: 8090707 - DNA, 22 bp, Homo sapiens
agtgcttttattatatacagga

SEQ ID NO: 8090708 - DNA, 22 bp, Homo sapiens
agtggcagtggggcagggccct

SEQ ID NO: 8090709 - DNA, 22 bp, Homo sapiens
agtgccagctccacacagcagc

SEQ ID NO: 8090710 - DNA, 23 bp, Homo sapiens
agtgccagggagatcaggacgga

SEQ ID NO: 8090711 - DNA, 22 bp, Homo sapiens
agtgcctggaccccatgacata

SEQ ID NO: 8090712 - DNA, 22 bp, Homo sapiens
ctgagcagccccaccagccatt

SEQ ID NO: 8090713 - DNA, 19 bp, Homo sapiens
ctgagcagcggcagcactt

SEQ ID NO: 8090714 - DNA, 22 bp, Homo sapiens
ctgagccagagggagtcgggtc

SEQ ID NO: 8090715 - DNA, 22 bp, Homo sapiens
ctgagccaccggcagggacatc

SEQ ID NO: 8090716 - DNA, 22 bp, Homo sapiens
ctgagccagctggcatgtgcta

SEQ ID NO: 8090717 - DNA, 22 bp, Homo sapiens
ctgagccagctggcatgtgcta

SEQ ID NO: 8090718 - DNA, 23 bp, Homo sapiens
agtgtttatgttcagtgaccctc

SEQ ID NO: 8090719 - DNA, 22 bp, Homo sapiens
agtgtggccaatgaggatgggc

SEQ ID NO: 8090720 - DNA, 22 bp, Homo sapiens
agtgtttgggggccttgtaaca

SEQ ID NO: 8090721 - DNA, 22 bp, Homo sapiens
agtgtttggggtgattgtaacc

SEQ ID NO: 8090722 - DNA, 22 bp, Homo sapiens
agtggcctggagccccgcctgg

SEQ ID NO: 8090723 - DNA, 22 bp, Homo sapiens
agtggcggggattagcagtgtt

SEQ ID NO: 8090724 - DNA, 22 bp, Homo sapiens
agtgtgaagagcagcacaaatg

SEQ ID NO: 8090725 - DNA, 22 bp, Homo sapiens
agtgtcaagtacatggtagtga

SEQ ID NO: 8090726 - DNA, 22 bp, Homo sapiens
agtgtcaatgccaacagtatat

SEQ ID NO: 8090727 - DNA, 22 bp, Homo sapiens
actgagcctgtgccctcatcag

SEQ ID NO: 8090728 - DNA, 21 bp, Homo sapiens
agtgaagagtgaaacacatgg

SEQ ID NO: 8090729 - DNA, 22 bp, Homo sapiens
actgcactgatttatcatccca

SEQ ID NO: 8090730 - DNA, 22 bp, Homo sapiens
agtgctcactctccacagtgcc

SEQ ID NO: 8090731 - DNA, 22 bp, Homo sapiens
actgcagcaggtaagagcattt

SEQ ID NO: 8090732 - DNA, 22 bp, Homo sapiens
agtgctcctttcattgctgccc

SEQ ID NO: 8090733 - DNA, 22 bp, Homo sapiens
actgggcatgatgagtcaccta

SEQ ID NO: 8090734 - DNA, 22 bp, Homo sapiens
actgggccagacactgattccc

SEQ ID NO: 8090735 - DNA, 18 bp, Homo sapiens
actgggccagcaggcagg

SEQ ID NO: 8090736 - DNA, 23 bp, Homo sapiens
actgggccagctacttagcactg

SEQ ID NO: 8090737 - DNA, 22 bp, Homo sapiens
actgggccaggtgtgggtgagt

SEQ ID NO: 8090738 - DNA, 22 bp, Homo sapiens
actgggcccagtggtgtggctg

SEQ ID NO: 8090739 - DNA, 22 bp, Homo sapiens
actgggccttgccatggcagcc

SEQ ID NO: 8090740 - DNA, 20 bp, Homo sapiens
actgggcctaggggaggcat

SEQ ID NO: 8090741 - DNA, 22 bp, Homo sapiens
actgggcctgattgggtcggag

SEQ ID NO: 8090742 - DNA, 22 bp, Homo sapiens
actgggcctggattggcgtgtc

SEQ ID NO: 8090743 - DNA, 22 bp, Homo sapiens
actgggcccatatactcagtct

SEQ ID NO: 8090744 - DNA, 22 bp, Homo sapiens
actgggccgcgctgcagagggc

SEQ ID NO: 8090745 - DNA, 22 bp, Homo sapiens
actgggccgaaatggacagaat

SEQ ID NO: 8090746 - DNA, 22 bp, Homo sapiens
actgggccggtgcagagtagtt

SEQ ID NO: 8090747 - DNA, 22 bp, Homo sapiens
actgggcctacccagattggca

SEQ ID NO: 8090748 - DNA, 22 bp, Homo sapiens
actgggcagggaaggagaccga

SEQ ID NO: 8090749 - DNA, 22 bp, Homo sapiens
actgccaatggtagtttgatgg

SEQ ID NO: 8090750 - DNA, 21 bp, Homo sapiens
actggccaccactggcagggg

SEQ ID NO: 8090751 - DNA, 22 bp, Homo sapiens
agtactttagcataaagcagtt

SEQ ID NO: 8090752 - DNA, 22 bp, Homo sapiens
agtactttacttcttacagttt

SEQ ID NO: 8090753 - DNA, 22 bp, Homo sapiens
agtagtttttaagaggtataaa

SEQ ID NO: 8090754 - DNA, 22 bp, Homo sapiens
agtacatttattaatggtaaaa

SEQ ID NO: 8090755 - DNA, 22 bp, Homo sapiens
agtacatatagtaatttagcca

SEQ ID NO: 8090756 - DNA, 22 bp, Homo sapiens
agtaccatgcttcctgactggt

SEQ ID NO: 8090757 - DNA, 22 bp, Homo sapiens
aggtgggcccagtgggctccag

SEQ ID NO: 8090758 - DNA, 21 bp, Homo sapiens
aggtgggcaggtggagtggcc

SEQ ID NO: 8090759 - DNA, 22 bp, Homo sapiens
actctcccttggagcctcaggc

SEQ ID NO: 8090760 - DNA, 22 bp, Homo sapiens
actctccttttgatcttcagaa

SEQ ID NO: 8090761 - DNA, 22 bp, Homo sapiens
agtcactgtcaaagccacacac

SEQ ID NO: 8090762 - DNA, 22 bp, Homo sapiens
actctaaaccccactctgctgg

SEQ ID NO: 8090763 - DNA, 22 bp, Homo sapiens
actcctgggtgctgaccagcgt

SEQ ID NO: 8090764 - DNA, 22 bp, Homo sapiens
aggtgacttaggctgtggctcg

SEQ ID NO: 8090765 - DNA, 22 bp, Homo sapiens
aggtgggcaccaggcttgtggt

SEQ ID NO: 8090766 - DNA, 22 bp, Homo sapiens
aggtgggcactccgctcgaggt

SEQ ID NO: 8090767 - DNA, 22 bp, Homo sapiens
acgaaggaatgtgcttgagcat

SEQ ID NO: 8090768 - DNA, 22 bp, Homo sapiens
acgaataaatctatttcacaca

SEQ ID NO: 8090769 - DNA, 22 bp, Homo sapiens
acgaataagagataaagcaagg

SEQ ID NO: 8090770 - DNA, 22 bp, Homo sapiens
aggtagctatccagacgctgaa

SEQ ID NO: 8090771 - DNA, 22 bp, Homo sapiens
actttacacatcttttctcatt

SEQ ID NO: 8090772 - DNA, 22 bp, Homo sapiens
actttaaagcagaatggctatg

SEQ ID NO: 8090773 - DNA, 21 bp, Homo sapiens
actttaatatacatgaggagg

SEQ ID NO: 8090774 - DNA, 22 bp, Homo sapiens
atacaaagacaaatctcaatct

SEQ ID NO: 8090775 - DNA, 22 bp, Homo sapiens
atacatcatttcccatcaatcg

SEQ ID NO: 8090776 - DNA, 22 bp, Homo sapiens
actttctgcagtgttggaaatg

SEQ ID NO: 8090777 - DNA, 22 bp, Homo sapiens
actttctgtcatctagacaagt

SEQ ID NO: 8090778 - DNA, 22 bp, Homo sapiens
actgtttagtaaattgaaatgg

SEQ ID NO: 8090779 - DNA, 22 bp, Homo sapiens
actgtttatagttttgagctga

SEQ ID NO: 8090780 - DNA, 22 bp, Homo sapiens
actgggccttgtgtgtctcatc

SEQ ID NO: 8090781 - DNA, 22 bp, Homo sapiens
atcccaggggttgtatcttccc

SEQ ID NO: 8090782 - DNA, 22 bp, Homo sapiens
atcccaggcggcacaggttgca

SEQ ID NO: 8090783 - DNA, 22 bp, Homo sapiens
atcccaggaggctgcgcagtta

SEQ ID NO: 8090784 - DNA, 22 bp, Homo sapiens
atccaggcattctgacttcaag

SEQ ID NO: 8090785 - DNA, 22 bp, Homo sapiens
atccaggaaggatggcattgag

SEQ ID NO: 8090786 - DNA, 16 bp, Homo sapiens
atccaggcaggaaaga

SEQ ID NO: 8090787 - DNA, 22 bp, Homo sapiens
agaagccaatccttgtctctct

SEQ ID NO: 8090788 - DNA, 22 bp, Homo sapiens
atctctggcccctggggtccga

SEQ ID NO: 8090789 - DNA, 22 bp, Homo sapiens
atatttctccaaatgttttcaa

SEQ ID NO: 8090790 - DNA, 22 bp, Homo sapiens
actttttacagggtgtatacca

SEQ ID NO: 8090791 - DNA, 22 bp, Homo sapiens
actttttagtttcctcaaacat

SEQ ID NO: 8090792 - DNA, 22 bp, Homo sapiens
acccaggtctctcgacttctgg

SEQ ID NO: 8090793 - DNA, 18 bp, Homo sapiens
acccaggttttgaagctt

SEQ ID NO: 8090794 - DNA, 22 bp, Homo sapiens
acccagggtttgagctctgcag

SEQ ID NO: 8090795 - DNA, 22 bp, Homo sapiens
acccagggttcctgggtcccag

SEQ ID NO: 8090796 - DNA, 22 bp, Homo sapiens
acccagggaccccgctgacgcc

SEQ ID NO: 8090797 - DNA, 22 bp, Homo sapiens
acccactgtagccactctgggt

SEQ ID NO: 8090798 - DNA, 22 bp, Homo sapiens
accagggttgagtcagctgcgt

SEQ ID NO: 8090799 - DNA, 22 bp, Homo sapiens
accaggggatggttggcactgt

SEQ ID NO: 8090800 - DNA, 22 bp, Homo sapiens
accaggggtgtcaacagcattt

SEQ ID NO: 8090801 - DNA, 22 bp, Homo sapiens
accacagaggaatttgaagagg

SEQ ID NO: 8090802 - DNA, 20 bp, Homo sapiens
accaggagatggaggcaggg

SEQ ID NO: 8090803 - DNA, 22 bp, Homo sapiens
acattgaacagtacaaatgatc

SEQ ID NO: 8090804 - DNA, 22 bp, Homo sapiens
aggccacaggattgcacagcat

SEQ ID NO: 8090805 - DNA, 22 bp, Homo sapiens
aggccacaggcaccctgtgttc

SEQ ID NO: 8090806 - DNA, 22 bp, Homo sapiens
aggccacaggtggaagccagag

SEQ ID NO: 8090807 - DNA, 22 bp, Homo sapiens
aggccagcacgacagccgcagg

SEQ ID NO: 8090808 - DNA, 22 bp, Homo sapiens
acatgaaaagactatctgatta

SEQ ID NO: 8090809 - DNA, 22 bp, Homo sapiens
acatgaaaactggttccttcag

SEQ ID NO: 8090810 - DNA, 22 bp, Homo sapiens
acatgaaaaatgtttgcagttt

SEQ ID NO: 8090811 - DNA, 22 bp, Homo sapiens
aggccagcattctctctccagg

SEQ ID NO: 8090812 - DNA, 22 bp, Homo sapiens
aggccagcattctctctccagg

SEQ ID NO: 8090813 - DNA, 22 bp, Homo sapiens
aggcccagcttgaagtgggaag

SEQ ID NO: 8090814 - DNA, 22 bp, Homo sapiens
aggccaggtggtcatgcttgct

SEQ ID NO: 8090815 - DNA, 22 bp, Homo sapiens
acagcccaagtcacctgcagga

SEQ ID NO: 8090816 - DNA, 22 bp, Homo sapiens
acagccaggtaaaggcatggca

SEQ ID NO: 8090817 - DNA, 22 bp, Homo sapiens
acagccagtaatctacccctgt

SEQ ID NO: 8090818 - DNA, 20 bp, Homo sapiens
agctccagtgctgacgcttc

SEQ ID NO: 8090819 - DNA, 22 bp, Homo sapiens
agctccaggtgcaagtcatggt

SEQ ID NO: 8090820 - DNA, 23 bp, Homo sapiens
acagccccatgcaggtgtgtttg

SEQ ID NO: 8090821 - DNA, 22 bp, Homo sapiens
acagccccagcgcggcggggtc

SEQ ID NO: 8090822 - DNA, 22 bp, Homo sapiens
acagcccaggactccagtgggc

SEQ ID NO: 8090823 - DNA, 22 bp, Homo sapiens
acagcccaggactccagtgggc

SEQ ID NO: 8090824 - DNA, 22 bp, Homo sapiens
acagcccagctctttctctgca

SEQ ID NO: 8090825 - DNA, 22 bp, Homo sapiens
acagcccagaaagcctaagggg

SEQ ID NO: 8090826 - DNA, 20 bp, Homo sapiens
agctggcctgtcctaggcct

SEQ ID NO: 8090827 - DNA, 22 bp, Homo sapiens
agctggcctgttagagctgagt

SEQ ID NO: 8090828 - DNA, 22 bp, Homo sapiens
agctggccttcggtgtcactgg

SEQ ID NO: 8090829 - DNA, 22 bp, Homo sapiens
agctttatggtgcctcacttga

SEQ ID NO: 8090830 - DNA, 19 bp, Homo sapiens
agctgtggggcctagcacc

SEQ ID NO: 8090831 - DNA, 22 bp, Homo sapiens
agctgtggggcaggcagcgagg

SEQ ID NO: 8090832 - DNA, 22 bp, Homo sapiens
agctgtggggaggaggctagca

SEQ ID NO: 8090833 - DNA, 22 bp, Homo sapiens
agctgtggtcttcaagttgcct

SEQ ID NO: 8090834 - DNA, 22 bp, Homo sapiens
agctgtggtgttttcaagccct

SEQ ID NO: 8090835 - DNA, 22 bp, Homo sapiens
agctgtggttctgggcagcgac

SEQ ID NO: 8090836 - DNA, 21 bp, Homo sapiens
agctgtggttttacatctttt

SEQ ID NO: 8090837 - DNA, 22 bp, Homo sapiens
agctgtgtaagtcatgtaggtg

SEQ ID NO: 8090838 - DNA, 22 bp, Homo sapiens
agctgggatgataacctcagtc

SEQ ID NO: 8090839 - DNA, 22 bp, Homo sapiens
agctgggcaaaatgtgaggttg

SEQ ID NO: 8090840 - DNA, 22 bp, Homo sapiens
agctgtgggcctgggagagctg

SEQ ID NO: 8090841 - DNA, 22 bp, Homo sapiens
agctgtgggatttgggtgtgcc

SEQ ID NO: 8090842 - DNA, 21 bp, Homo sapiens
agctgtggcgaggggaacatg

SEQ ID NO: 8090843 - DNA, 22 bp, Homo sapiens
agctgggagctgaaggctgatt

SEQ ID NO: 8090844 - DNA, 22 bp, Homo sapiens
agctgggaggtgggcagtgaga

SEQ ID NO: 8090845 - DNA, 22 bp, Homo sapiens
aggagctgcagattctgccttg

SEQ ID NO: 8090846 - DNA, 22 bp, Homo sapiens
aggagctgctttggtgcggttt

SEQ ID NO: 8090847 - DNA, 22 bp, Homo sapiens
aggagctgcaaaaccggccgct

SEQ ID NO: 8090848 - DNA, 23 bp, Homo sapiens
aggagccatgagttggatatgtt

SEQ ID NO: 8090849 - DNA, 20 bp, Homo sapiens
aggagccattgactgcagca

SEQ ID NO: 8090850 - DNA, 22 bp, Homo sapiens
aggagccattttccaagggcga

SEQ ID NO: 8090851 - DNA, 22 bp, Homo sapiens
aggagccattgcaggatggcag

SEQ ID NO: 8090852 - DNA, 22 bp, Homo sapiens
aggcacagagaatgccctccat

SEQ ID NO: 8090853 - DNA, 22 bp, Homo sapiens
aggcacagagaatgccctccat

SEQ ID NO: 8090854 - DNA, 22 bp, Homo sapiens
aggcacagagaagtaaagtatc

SEQ ID NO: 8090855 - DNA, 22 bp, Homo sapiens
aggcacagaatggcattcagtg

SEQ ID NO: 8090856 - DNA, 22 bp, Homo sapiens
aggcacagaatggcattcagtg

SEQ ID NO: 8090857 - DNA, 18 bp, Homo sapiens
aggcacagagcatacata

SEQ ID NO: 8090858 - DNA, 18 bp, Homo sapiens
aggcacagagcatacata

SEQ ID NO: 8090859 - DNA, 22 bp, Homo sapiens
aggcacagagaggttaaatgca

SEQ ID NO: 8090860 - DNA, 22 bp, Homo sapiens
aggcacagatttggggaaagca

SEQ ID NO: 8090861 - DNA, 22 bp, Homo sapiens
acatacatatgtttaaatgcat

SEQ ID NO: 8090862 - DNA, 23 bp, Homo sapiens
acatacatggagataaagtgatg

SEQ ID NO: 8090863 - DNA, 22 bp, Homo sapiens
aggaggggcatagaaatgtaat

SEQ ID NO: 8090864 - DNA, 21 bp, Homo sapiens
aggaggggtctttcccactga

SEQ ID NO: 8090865 - DNA, 22 bp, Homo sapiens
aggagggagatgcccatcctgg

SEQ ID NO: 8090866 - DNA, 22 bp, Homo sapiens
aggaggggttctcgggtgctga

SEQ ID NO: 8090867 - DNA, 22 bp, Homo sapiens
agaggctccttcactctggcac

SEQ ID NO: 8090868 - DNA, 22 bp, Homo sapiens
attacacaggatttgccttact

SEQ ID NO: 8090869 - DNA, 22 bp, Homo sapiens
attacacatagacattcgttca

SEQ ID NO: 8090870 - DNA, 21 bp, Homo sapiens
attacagcagtggccaaatgc

SEQ ID NO: 8090871 - DNA, 22 bp, Homo sapiens
agagctggctgtgggtgacttt

SEQ ID NO: 8090872 - DNA, 18 bp, Homo sapiens
agagtccagggtgaggtg

SEQ ID NO: 8090873 - DNA, 22 bp, Homo sapiens
agagtccatgaagacagctgag

SEQ ID NO: 8090874 - DNA, 22 bp, Homo sapiens
agagtccatatgtgggaggagt

SEQ ID NO: 8090875 - DNA, 22 bp, Homo sapiens
agagtccaccctggggtcaggc

SEQ ID NO: 8090876 - DNA, 22 bp, Homo sapiens
agaggggctcaagcagtggtct

SEQ ID NO: 8090877 - DNA, 22 bp, Homo sapiens
agaggggctcaagcagtggtct

SEQ ID NO: 8090878 - DNA, 22 bp, Homo sapiens
agaggggagtcctaatctgatt

SEQ ID NO: 8090879 - DNA, 18 bp, Homo sapiens
agaggggaggtaagtctg

SEQ ID NO: 8090880 - DNA, 22 bp, Homo sapiens
agaggggagtcctaatctgatt

SEQ ID NO: 8090881 - DNA, 22 bp, Homo sapiens
agaggggaggcgaaccagagtc

SEQ ID NO: 8090882 - DNA, 22 bp, Homo sapiens
agaggggaggcgaaccagagtc

SEQ ID NO: 8090883 - DNA, 23 bp, Homo sapiens
agaggggagcatctgctggctga

SEQ ID NO: 8090884 - DNA, 23 bp, Homo sapiens
agaggggagcatctgctggctga

SEQ ID NO: 8090885 - DNA, 22 bp, Homo sapiens
agaggggagagctaagcaattc

SEQ ID NO: 8090886 - DNA, 22 bp, Homo sapiens
agaggggacagccacctgcccg

SEQ ID NO: 8090887 - DNA, 22 bp, Homo sapiens
agaggggaagtaatgaatgata

SEQ ID NO: 8090888 - DNA, 22 bp, Homo sapiens
agaggggaagtaatgaatgata

SEQ ID NO: 8090889 - DNA, 22 bp, Homo sapiens
agaggggaaggatgtgatgtga

SEQ ID NO: 8090890 - DNA, 22 bp, Homo sapiens
agaggggaaggatgtgatgtga

SEQ ID NO: 8090891 - DNA, 22 bp, Homo sapiens
agagggctggacgcaggttgga

SEQ ID NO: 8090892 - DNA, 22 bp, Homo sapiens
agagggctgggatgtgctgtgt

SEQ ID NO: 8090893 - DNA, 22 bp, Homo sapiens
agcaaatattttgttgaagtgc

SEQ ID NO: 8090894 - DNA, 22 bp, Homo sapiens
attttcagagacatctggactt

SEQ ID NO: 8090895 - DNA, 22 bp, Homo sapiens
caaaggcaggtgctgaatattc

SEQ ID NO: 8090896 - DNA, 20 bp, Homo sapiens
agcaagagtaaggacagcga

SEQ ID NO: 8090897 - DNA, 21 bp, Homo sapiens
agatgctgtgctccaggagca

SEQ ID NO: 8090898 - DNA, 22 bp, Homo sapiens
attggtcagagtaaatttattt

SEQ ID NO: 8090899 - DNA, 18 bp, Homo sapiens
attggtcctgtccaccca

SEQ ID NO: 8090900 - DNA, 22 bp, Homo sapiens
attggtcccctcctatgtgcca

SEQ ID NO: 8090901 - DNA, 22 bp, Homo sapiens
attggtccatttaccctctctt

SEQ ID NO: 8090902 - DNA, 22 bp, Homo sapiens
atgaaggacaacaggggagcag

SEQ ID NO: 8090903 - DNA, 22 bp, Homo sapiens
atgaagggtgtccctgtgagca

SEQ ID NO: 8090904 - DNA, 22 bp, Homo sapiens
atctgcttgaatgagcaacagg

SEQ ID NO: 8090905 - DNA, 22 bp, Homo sapiens
atgaagccatctcctccccttc

SEQ ID NO: 8090906 - DNA, 19 bp, Homo sapiens
atctgccttagtgctgctg

SEQ ID NO: 8090907 - DNA, 19 bp, Homo sapiens
atctgcctgttatcacata

SEQ ID NO: 8090908 - DNA, 22 bp, Homo sapiens
atctgcctggtctttgatgcag

SEQ ID NO: 8090909 - DNA, 22 bp, Homo sapiens
atctgcctgtatttaccatcat

SEQ ID NO: 8090910 - DNA, 19 bp, Homo sapiens
atctgcctgttatcacata

SEQ ID NO: 8090911 - DNA, 22 bp, Homo sapiens
atctgcctggctccaggtgagc

SEQ ID NO: 8090912 - DNA, 22 bp, Homo sapiens
atctgcctgcttatgatgcctg

SEQ ID NO: 8090913 - DNA, 22 bp, Homo sapiens
atctgcctcttcttcattgcga

SEQ ID NO: 8090914 - DNA, 22 bp, Homo sapiens
atctgcctccaagtccatgtgt

SEQ ID NO: 8090915 - DNA, 22 bp, Homo sapiens
atctgcctgagtctaggttttc

SEQ ID NO: 8090916 - DNA, 22 bp, Homo sapiens
atctgcctgcagtggaggtggg

SEQ ID NO: 8090917 - DNA, 22 bp, Homo sapiens
agacacattttacattaactgt

SEQ ID NO: 8090918 - DNA, 22 bp, Homo sapiens
agacactgttctcacatgcttg

SEQ ID NO: 8090919 - DNA, 22 bp, Homo sapiens
agacactgtgtacagaaaaaga

SEQ ID NO: 8090920 - DNA, 22 bp, Homo sapiens
agacctggattccaatcctacc

SEQ ID NO: 8090921 - DNA, 22 bp, Homo sapiens
agacctggtgatagctgtccta

SEQ ID NO: 8090922 - DNA, 22 bp, Homo sapiens
agactgtgagaagatggctgcg

SEQ ID NO: 8090923 - DNA, 22 bp, Homo sapiens
agactttaacaatgggtatgaa

SEQ ID NO: 8090924 - DNA, 22 bp, Homo sapiens
agactttagaatcagatagcct

SEQ ID NO: 8090925 - DNA, 22 bp, Homo sapiens
agactttaatgtgcaaatgaaa

SEQ ID NO: 8090926 - DNA, 22 bp, Homo sapiens
agactttatccctgtttttctc

SEQ ID NO: 8090927 - DNA, 22 bp, Homo sapiens
agactttatagtttttggctat

SEQ ID NO: 8090928 - DNA, 22 bp, Homo sapiens
agactttataaatcttaatttc

SEQ ID NO: 8090929 - DNA, 22 bp, Homo sapiens
agactttagggccatggtaggt

SEQ ID NO: 8090930 - DNA, 22 bp, Homo sapiens
agactttagatacgtcttcttc

SEQ ID NO: 8090931 - DNA, 22 bp, Homo sapiens
agagaatacaaagaagatatgt

SEQ ID NO: 8090932 - DNA, 22 bp, Homo sapiens
agagctgaaaaagctgacccgg

SEQ ID NO: 8090933 - DNA, 22 bp, Homo sapiens
agagctggaatcagacctcagg

SEQ ID NO: 8090934 - DNA, 22 bp, Homo sapiens
agagctggcagcagcttctcct

SEQ ID NO: 8090935 - DNA, 23 bp, Homo sapiens
agagcctgaaagacttctggcac

SEQ ID NO: 8090936 - DNA, 22 bp, Homo sapiens
agagcctgaggatgtcccagct

SEQ ID NO: 8090937 - DNA, 21 bp, Homo sapiens
agagcctgagatcttccagca

SEQ ID NO: 8090938 - DNA, 22 bp, Homo sapiens
agagccaggccaggccggggca

SEQ ID NO: 8090939 - DNA, 22 bp, Homo sapiens
agagcccaggtcctggagaggg

SEQ ID NO: 8090940 - DNA, 22 bp, Homo sapiens
agagcccatcagtggcagtgga

SEQ ID NO: 8090941 - DNA, 22 bp, Homo sapiens
agctccagggaaagagtggatc

SEQ ID NO: 8090942 - DNA, 22 bp, Homo sapiens
agctccagcctcttctggaggt

SEQ ID NO: 8090943 - DNA, 22 bp, Homo sapiens
agctccaggataagacaggtgc

SEQ ID NO: 8090944 - DNA, 20 bp, Homo sapiens
agctaggagaaagcatggag

SEQ ID NO: 8090945 - DNA, 22 bp, Homo sapiens
agctccagattaattgtaggag

SEQ ID NO: 8090946 - DNA, 22 bp, Homo sapiens
agctccagaagcctgcaaggta

SEQ ID NO: 8090947 - DNA, 22 bp, Homo sapiens
agctccagagtctgaactattc

SEQ ID NO: 8090948 - DNA, 22 bp, Homo sapiens
cagcaagaaaattcacatgctc

SEQ ID NO: 8090949 - DNA, 20 bp, Homo sapiens
cagatgggacgtggaggagt

SEQ ID NO: 8090950 - DNA, 22 bp, Homo sapiens
agctacagatgagcccagtatc

SEQ ID NO: 8090951 - DNA, 21 bp, Homo sapiens
agccagcaacacagcatctcc

SEQ ID NO: 8090952 - DNA, 22 bp, Homo sapiens
agccagcacggatttcccagga

SEQ ID NO: 8090953 - DNA, 22 bp, Homo sapiens
agccagcactttttctctgggc

SEQ ID NO: 8090954 - DNA, 22 bp, Homo sapiens
agccagcacggcgccatggagt

SEQ ID NO: 8090955 - DNA, 22 bp, Homo sapiens
agccagcaggtgcagaattcca

SEQ ID NO: 8090956 - DNA, 17 bp, Homo sapiens
agccagcagtagctggt

SEQ ID NO: 8090957 - DNA, 22 bp, Homo sapiens
agccagcaggtgggaaactgga

SEQ ID NO: 8090958 - DNA, 22 bp, Homo sapiens
agccagcatatatatagttgaa

SEQ ID NO: 8090959 - DNA, 22 bp, Homo sapiens
agccagcaggaacgtctaggtt

SEQ ID NO: 8090960 - DNA, 19 bp, Homo sapiens
agccagcagcgtagcatct

SEQ ID NO: 8090961 - DNA, 19 bp, Homo sapiens
agccagcaggcctctgagc

SEQ ID NO: 8090962 - DNA, 22 bp, Homo sapiens
agccagcagggcttagaggaca

SEQ ID NO: 8090963 - DNA, 22 bp, Homo sapiens
agccagcaggtgagtgcagcct

SEQ ID NO: 8090964 - DNA, 22 bp, Homo sapiens
agccagcatgaagacagaggcc

SEQ ID NO: 8090965 - DNA, 22 bp, Homo sapiens
agccagcatcccttcagtctcc

SEQ ID NO: 8090966 - DNA, 22 bp, Homo sapiens
agccagcatcttgcttcttgag

SEQ ID NO: 8090967 - DNA, 19 bp, Homo sapiens
agccagccagcaggtatgc

SEQ ID NO: 8090968 - DNA, 20 bp, Homo sapiens
cagagaccaggccaggtgtc

SEQ ID NO: 8090969 - DNA, 22 bp, Homo sapiens
cagagacatccattttatatgc

SEQ ID NO: 8090970 - DNA, 22 bp, Homo sapiens
agccaggccagactcacaccct

SEQ ID NO: 8090971 - DNA, 21 bp, Homo sapiens
cagagcctgtgttgacagttg

SEQ ID NO: 8090972 - DNA, 22 bp, Homo sapiens
agccaggccttagggagaggca

SEQ ID NO: 8090973 - DNA, 22 bp, Homo sapiens
cagagccttagttctcctagaa

SEQ ID NO: 8090974 - DNA, 22 bp, Homo sapiens
cagagctcagagctgccaggca

SEQ ID NO: 8090975 - DNA, 22 bp, Homo sapiens
agccagtggaattcccaggggt

SEQ ID NO: 8090976 - DNA, 22 bp, Homo sapiens
agccagtgggattagagcctct

SEQ ID NO: 8090977 - DNA, 22 bp, Homo sapiens
agcccaggttctaaagccaaac

SEQ ID NO: 8090978 - DNA, 22 bp, Homo sapiens
agcccagggagttgattagcat

SEQ ID NO: 8090979 - DNA, 22 bp, Homo sapiens
agcccagggacagggcggatgt

SEQ ID NO: 8090980 - DNA, 22 bp, Homo sapiens
agcccaggttgaggctgcagtg

SEQ ID NO: 8090981 - DNA, 22 bp, Homo sapiens
agccccagcccctctctcacaa

SEQ ID NO: 8090982 - DNA, 22 bp, Homo sapiens
agccccaggatgggccgcagga

SEQ ID NO: 8090983 - DNA, 22 bp, Homo sapiens
agccccagttccctggaagtct

SEQ ID NO: 8090984 - DNA, 22 bp, Homo sapiens
agccctggcccggctgtgcttt

SEQ ID NO: 8090985 - DNA, 22 bp, Homo sapiens
cagatggccagaggcagctgca

SEQ ID NO: 8090986 - DNA, 22 bp, Homo sapiens
agcaggaccaagaaggggaaaa

SEQ ID NO: 8090987 - DNA, 18 bp, Homo sapiens
agcaggactgtggggtgg

SEQ ID NO: 8090988 - DNA, 22 bp, Homo sapiens
agcaggacacgatgcggcagga

SEQ ID NO: 8090989 - DNA, 22 bp, Homo sapiens
agcaggaaggggatgatgggca

SEQ ID NO: 8090990 - DNA, 22 bp, Homo sapiens
agcagggaggcggtgtgctggc

SEQ ID NO: 8090991 - DNA, 22 bp, Homo sapiens
agcagggaggcccagggcactg

SEQ ID NO: 8090992 - DNA, 22 bp, Homo sapiens
agcaggcttggtccccagcctc

SEQ ID NO: 8090993 - DNA, 22 bp, Homo sapiens
cacagcagagggagccattgaa

SEQ ID NO: 8090994 - DNA, 22 bp, Homo sapiens
agcagggcaaagtcaggctaac

SEQ ID NO: 8090995 - DNA, 19 bp, Homo sapiens
agcagggagtggttgtggg

SEQ ID NO: 8090996 - DNA, 22 bp, Homo sapiens
agcagggcaggtaaggatcaga

SEQ ID NO: 8090997 - DNA, 22 bp, Homo sapiens
caccactgtatccctagcactt

SEQ ID NO: 8090998 - DNA, 22 bp, Homo sapiens
cactgttattactactatacat

SEQ ID NO: 8090999 - DNA, 22 bp, Homo sapiens
cactgtggtgtgagggctgatg

SEQ ID NO: 8091000 - DNA, 22 bp, Homo sapiens
cactgtggttattatcactgtt

SEQ ID NO: 8091001 - DNA, 22 bp, Homo sapiens
cactgtggggtttggctggaac

SEQ ID NO: 8091002 - DNA, 22 bp, Homo sapiens
cactgtgggtcccagactggag

SEQ ID NO: 8091003 - DNA, 19 bp, Homo sapiens
cactgtggtccttcactgc

SEQ ID NO: 8091004 - DNA, 22 bp, Homo sapiens
cactgtggtgccaaacctggag

SEQ ID NO: 8091005 - DNA, 17 bp, Homo sapiens
cactgtgggggcattta

SEQ ID NO: 8091006 - DNA, 22 bp, Homo sapiens
cactgtgggcctgtcgtgggtg

SEQ ID NO: 8091007 - DNA, 22 bp, Homo sapiens
agcatggggctccgcaatgaac

SEQ ID NO: 8091008 - DNA, 22 bp, Homo sapiens
agcatggggctccgcaatgaac

SEQ ID NO: 8091009 - DNA, 22 bp, Homo sapiens
agcagtgagtgggaggaccatg

SEQ ID NO: 8091010 - DNA, 22 bp, Homo sapiens
agcatgaaagcataggacagtc

SEQ ID NO: 8091011 - DNA, 22 bp, Homo sapiens
agcatgaaaggcgtgccaactt

SEQ ID NO: 8091012 - DNA, 19 bp, Homo sapiens
agcagtggagccatgcctg

SEQ ID NO: 8091013 - DNA, 22 bp, Homo sapiens
agcacctgtggctcatgctcgt

SEQ ID NO: 8091014 - DNA, 22 bp, Homo sapiens
agcactctaagtgcaagacact

SEQ ID NO: 8091015 - DNA, 22 bp, Homo sapiens
caaaggcatgtgagtatatgtg

SEQ ID NO: 8091016 - DNA, 22 bp, Homo sapiens
caaaggcagttactgaatgaag

SEQ ID NO: 8091017 - DNA, 22 bp, Homo sapiens
cacagagcaggtgctgggaaga

SEQ ID NO: 8091018 - DNA, 22 bp, Homo sapiens
cacagaacatttttagatgcag

SEQ ID NO: 8091019 - DNA, 22 bp, Homo sapiens
agcagctcagaggcaccagggc

SEQ ID NO: 8091020 - DNA, 22 bp, Homo sapiens
agcagccttgtgactccggggt

SEQ ID NO: 8091021 - DNA, 22 bp, Homo sapiens
agcagcctggtctctcgccaat

SEQ ID NO: 8091022 - DNA, 19 bp, Homo sapiens
agcagcagaagtgtgcctt

SEQ ID NO: 8091023 - DNA, 22 bp, Homo sapiens
agcagcagatccaaaaaatgtg

SEQ ID NO: 8091024 - DNA, 21 bp, Homo sapiens
agcagcagatctggtgagggc

SEQ ID NO: 8091025 - DNA, 21 bp, Homo sapiens
agcagcagatctggtgagggc

SEQ ID NO: 8091026 - DNA, 22 bp, Homo sapiens
agcagcagagctctggtctgca

SEQ ID NO: 8091027 - DNA, 22 bp, Homo sapiens
agcagcagaggtcagaaaggta

SEQ ID NO: 8091028 - DNA, 22 bp, Homo sapiens
agcagcagatcaaacaggcttg

SEQ ID NO: 8091029 - DNA, 22 bp, Homo sapiens
aatcttctacttgacagttctc

SEQ ID NO: 8091030 - DNA, 22 bp, Homo sapiens
aatcttctttcttaacagtaca

SEQ ID NO: 8091031 - DNA, 22 bp, Homo sapiens
aatctttccctattaaatgtgg

SEQ ID NO: 8091032 - DNA, 22 bp, Homo sapiens
aatctgtttccaatacttgcta

SEQ ID NO: 8091033 - DNA, 22 bp, Homo sapiens
aatctgtttttgaaactttgta

SEQ ID NO: 8091034 - DNA, 22 bp, Homo sapiens
agaaaattactccagagacaag

SEQ ID NO: 8091035 - DNA, 20 bp, Homo sapiens
agaaaatgttttcagctgga

SEQ ID NO: 8091036 - DNA, 22 bp, Homo sapiens
aatatcagtatattgtatcagt

SEQ ID NO: 8091037 - DNA, 22 bp, Homo sapiens
aatatcagcacttttgtggtat

SEQ ID NO: 8091038 - DNA, 21 bp, Homo sapiens
actgtggggttcaactggcag

SEQ ID NO: 8091039 - DNA, 22 bp, Homo sapiens
actgtggggtgcgaggcagtga

SEQ ID NO: 8091040 - DNA, 22 bp, Homo sapiens
actgtggggggctttgctcagt

SEQ ID NO: 8091041 - DNA, 22 bp, Homo sapiens
actgtggggtgaggcccaagaa

SEQ ID NO: 8091042 - DNA, 22 bp, Homo sapiens
actgtgggggagccagtcccat

SEQ ID NO: 8091043 - DNA, 22 bp, Homo sapiens
actgtgggcctttcctttgacc

SEQ ID NO: 8091044 - DNA, 22 bp, Homo sapiens
actgtgggcagcttctgggaac

SEQ ID NO: 8091045 - DNA, 23 bp, Homo sapiens
actgtgggcaccacagagagtgt

SEQ ID NO: 8091046 - DNA, 22 bp, Homo sapiens
actgtggcaaagaagcaggctc

SEQ ID NO: 8091047 - DNA, 22 bp, Homo sapiens
actgtggctcatcaggctggtg

SEQ ID NO: 8091048 - DNA, 22 bp, Homo sapiens
actgtgggagcgcagtggcagc

SEQ ID NO: 8091049 - DNA, 22 bp, Homo sapiens
actgtgggacatccctccctat

SEQ ID NO: 8091050 - DNA, 21 bp, Homo sapiens
acctttaattcaagcatcagg

SEQ ID NO: 8091051 - DNA, 22 bp, Homo sapiens
aagtgcaaatctgtggctgaaa

SEQ ID NO: 8091052 - DNA, 22 bp, Homo sapiens
aagtgcaatgaatagctgcaat

SEQ ID NO: 8091053 - DNA, 22 bp, Homo sapiens
aagtgcaagcaggacttagttt

SEQ ID NO: 8091054 - DNA, 22 bp, Homo sapiens
aagtgcaatttgaaattctgca

SEQ ID NO: 8091055 - DNA, 22 bp, Homo sapiens
acctgggagtcacacctgagaa

SEQ ID NO: 8091056 - DNA, 22 bp, Homo sapiens
acctgggaaaaggagtggccat

SEQ ID NO: 8091057 - DNA, 22 bp, Homo sapiens
acctgggagagaggagccggcg

SEQ ID NO: 8091058 - DNA, 22 bp, Homo sapiens
accttgatgcctttccaagatg

SEQ ID NO: 8091059 - DNA, 22 bp, Homo sapiens
accttggcagtttctacctttt

SEQ ID NO: 8091060 - DNA, 22 bp, Homo sapiens
aagtggcagaatagtggcagga

SEQ ID NO: 8091061 - DNA, 18 bp, Homo sapiens
aagtggcacaggagtgca

SEQ ID NO: 8091062 - DNA, 20 bp, Homo sapiens
actgacagggaactaaggct

SEQ ID NO: 8091063 - DNA, 22 bp, Homo sapiens
aataaaatggtcagttttctca

SEQ ID NO: 8091064 - DNA, 19 bp, Homo sapiens
actgagaccacagacaagt

SEQ ID NO: 8091065 - DNA, 22 bp, Homo sapiens
aagtaaaacacacagtccaccg

SEQ ID NO: 8091066 - DNA, 22 bp, Homo sapiens
aagtaaaattcaatcttcactg

SEQ ID NO: 8091067 - DNA, 22 bp, Homo sapiens
aagtaaaagctttaccatgcgc

SEQ ID NO: 8091068 - DNA, 17 bp, Homo sapiens
accacctctcaccagca

SEQ ID NO: 8091069 - DNA, 22 bp, Homo sapiens
accacctcatcaagctggattg

SEQ ID NO: 8091070 - DNA, 22 bp, Homo sapiens
accaccaggggattttcagaac

SEQ ID NO: 8091071 - DNA, 22 bp, Homo sapiens
acattcttaacagttaaaaact

SEQ ID NO: 8091072 - DNA, 22 bp, Homo sapiens
acattatgagcccactggtgaa

SEQ ID NO: 8091073 - DNA, 22 bp, Homo sapiens
aaggccaggccagatgacagtc

SEQ ID NO: 8091074 - DNA, 22 bp, Homo sapiens
acatgtaaaagataaattaaca

SEQ ID NO: 8091075 - DNA, 22 bp, Homo sapiens
acatgtaaaaattaaggtaaga

SEQ ID NO: 8091076 - DNA, 22 bp, Homo sapiens
acataacatagttgacattttt

SEQ ID NO: 8091077 - DNA, 22 bp, Homo sapiens
acataatggacaataatgcatc

SEQ ID NO: 8091078 - DNA, 22 bp, Homo sapiens
acatgggatcaatgaggcaggc

SEQ ID NO: 8091079 - DNA, 22 bp, Homo sapiens
acatgggatgacctccgatggt

SEQ ID NO: 8091080 - DNA, 22 bp, Homo sapiens
acatggggcccaaagagaggtc

SEQ ID NO: 8091081 - DNA, 22 bp, Homo sapiens
acagatttttggtaaataattt

SEQ ID NO: 8091082 - DNA, 22 bp, Homo sapiens
acagctggagtgttggtgaggt

SEQ ID NO: 8091083 - DNA, 22 bp, Homo sapiens
acagattttaaatttgtagttg

SEQ ID NO: 8091084 - DNA, 20 bp, Homo sapiens
acagatgaggaaaatgaagt

SEQ ID NO: 8091085 - DNA, 22 bp, Homo sapiens
acaggaaattggcatatcagtt

SEQ ID NO: 8091086 - DNA, 22 bp, Homo sapiens
acaggcagagtcaggttgggtt

SEQ ID NO: 8091087 - DNA, 22 bp, Homo sapiens
acaggagccaaacacatgccag

SEQ ID NO: 8091088 - DNA, 22 bp, Homo sapiens
acaggagcccaggatgggcgga

SEQ ID NO: 8091089 - DNA, 22 bp, Homo sapiens
acaggagctctagggacagcac

SEQ ID NO: 8091090 - DNA, 19 bp, Homo sapiens
acaggcagaattgggtgtg

SEQ ID NO: 8091091 - DNA, 23 bp, Homo sapiens
acaggctcttaatcagtgctcct

SEQ ID NO: 8091092 - DNA, 22 bp, Homo sapiens
agctcaggctctgcagggacta

SEQ ID NO: 8091093 - DNA, 22 bp, Homo sapiens
agctcaggtctcaggaggtgtc

SEQ ID NO: 8091094 - DNA, 22 bp, Homo sapiens
agctcaggtcattccagggatg

SEQ ID NO: 8091095 - DNA, 22 bp, Homo sapiens
agcctgcttccctttgtgcccc

SEQ ID NO: 8091096 - DNA, 22 bp, Homo sapiens
agcctggccaggcctgcccagg

SEQ ID NO: 8091097 - DNA, 21 bp, Homo sapiens
acagaactgtatagtgataaa

SEQ ID NO: 8091098 - DNA, 22 bp, Homo sapiens
acagaacatggatttttgaagt

SEQ ID NO: 8091099 - DNA, 22 bp, Homo sapiens
acagaacatattgcttctctca

SEQ ID NO: 8091100 - DNA, 22 bp, Homo sapiens
acagaacaggctgagaaaaaca

SEQ ID NO: 8091101 - DNA, 22 bp, Homo sapiens
agcccaggtgactcatacaccc

SEQ ID NO: 8091102 - DNA, 22 bp, Homo sapiens
agcccaggtggagtgtgtgggg

SEQ ID NO: 8091103 - DNA, 22 bp, Homo sapiens
agcccaggtctggcccagcctg

SEQ ID NO: 8091104 - DNA, 22 bp, Homo sapiens
acagaacagagggttttagaat

SEQ ID NO: 8091105 - DNA, 20 bp, Homo sapiens
agccaggctcaagctccccc

SEQ ID NO: 8091106 - DNA, 22 bp, Homo sapiens
agcattctcagaatgtcatttt

SEQ ID NO: 8091107 - DNA, 23 bp, Homo sapiens
agcattctctccaacatttaaca

SEQ ID NO: 8091108 - DNA, 22 bp, Homo sapiens
agcagcagattatggtctacat

SEQ ID NO: 8091109 - DNA, 22 bp, Homo sapiens
agcagcagattcagcaggaatg

SEQ ID NO: 8091110 - DNA, 22 bp, Homo sapiens
agcagcagcattgagcgcttgt

SEQ ID NO: 8091111 - DNA, 22 bp, Homo sapiens
agcagcagccgtagccttatta

SEQ ID NO: 8091112 - DNA, 22 bp, Homo sapiens
agcagcagctcagttctcagct

SEQ ID NO: 8091113 - DNA, 23 bp, Homo sapiens
agcagcagcaattaagtggatat

SEQ ID NO: 8091114 - DNA, 21 bp, Homo sapiens
agcagcagcagtggggcttct

SEQ ID NO: 8091115 - DNA, 22 bp, Homo sapiens
agcagcagttgctgacgttcta

SEQ ID NO: 8091116 - DNA, 22 bp, Homo sapiens
acacactggcaggagctataaa

SEQ ID NO: 8091117 - DNA, 22 bp, Homo sapiens
acacactgtaaggactatcact

SEQ ID NO: 8091118 - DNA, 22 bp, Homo sapiens
agcagaaaattggaaatgacaa

SEQ ID NO: 8091119 - DNA, 22 bp, Homo sapiens
agcagaaatagaagtcaatgat

SEQ ID NO: 8091120 - DNA, 22 bp, Homo sapiens
agattttatagataatttccca

SEQ ID NO: 8091121 - DNA, 22 bp, Homo sapiens
agatttctgggcttcaccacct

SEQ ID NO: 8091122 - DNA, 22 bp, Homo sapiens
agcaggagggttttgtagagtc

SEQ ID NO: 8091123 - DNA, 21 bp, Homo sapiens
agcaggaggcagtcacagctc

SEQ ID NO: 8091124 - DNA, 22 bp, Homo sapiens
agcaggcatagagtagcactca

SEQ ID NO: 8091125 - DNA, 22 bp, Homo sapiens
agcagggctttgcagacttggg

SEQ ID NO: 8091126 - DNA, 22 bp, Homo sapiens
agcagggcttctgtgcctgtgc

SEQ ID NO: 8091127 - DNA, 22 bp, Homo sapiens
agcagggctgtgctccttccga

SEQ ID NO: 8091128 - DNA, 22 bp, Homo sapiens
agcaggtgacagggctgtggtg

SEQ ID NO: 8091129 - DNA, 22 bp, Homo sapiens
agcaggtgacccaagcaggctg

SEQ ID NO: 8091130 - DNA, 22 bp, Homo sapiens
agcagggctttggctggctttc

SEQ ID NO: 8091131 - DNA, 22 bp, Homo sapiens
agactggggttctggcaaggag

SEQ ID NO: 8091132 - DNA, 22 bp, Homo sapiens
agactgcatattgtcctttaga

SEQ ID NO: 8091133 - DNA, 22 bp, Homo sapiens
agacactgaatgtttggtggtc

SEQ ID NO: 8091134 - DNA, 22 bp, Homo sapiens
agacacctgccacccagagctc

SEQ ID NO: 8091135 - DNA, 22 bp, Homo sapiens
agagaaatatttaggaaaggag

SEQ ID NO: 8091136 - DNA, 21 bp, Homo sapiens
aatggaagtttaaaggtatcc

SEQ ID NO: 8091137 - DNA, 22 bp, Homo sapiens
aatggaatgcctcacatgtatt

SEQ ID NO: 8091138 - DNA, 22 bp, Homo sapiens
aatgaaaattggaccctagaac

SEQ ID NO: 8091139 - DNA, 22 bp, Homo sapiens
agaatttttgattatctactcg

SEQ ID NO: 8091140 - DNA, 22 bp, Homo sapiens
aatgtataaagtgttaataact

SEQ ID NO: 8091141 - DNA, 22 bp, Homo sapiens
aatttatttcctgccagtacac

SEQ ID NO: 8091142 - DNA, 22 bp, Homo sapiens
agagggctaactgggaagcagg

SEQ ID NO: 8091143 - DNA, 22 bp, Homo sapiens
agagggctgcctcagtcagcta

SEQ ID NO: 8091144 - DNA, 17 bp, Homo sapiens
agagggctcaaggcatc

SEQ ID NO: 8091145 - DNA, 22 bp, Homo sapiens
acaaaaaccgtggattcagcat

SEQ ID NO: 8091146 - DNA, 22 bp, Homo sapiens
acaaaaaccgtggattcagcat

SEQ ID NO: 8091147 - DNA, 20 bp, Homo sapiens
agaggttcagtctggagaag

SEQ ID NO: 8091148 - DNA, 20 bp, Homo sapiens
agatcctgtctccaccttgg

SEQ ID NO: 8091149 - DNA, 23 bp, Homo sapiens
agatccatgtgggctggaaactg

SEQ ID NO: 8091150 - DNA, 22 bp, Homo sapiens
agatatatttaaggtaataagt

SEQ ID NO: 8091151 - DNA, 20 bp, Homo sapiens
agattattcctaagatttct

SEQ ID NO: 8091152 - DNA, 22 bp, Homo sapiens
agatgttttggagacactaacc

SEQ ID NO: 8091153 - DNA, 22 bp, Homo sapiens
agatgttttctaattctatatt

SEQ ID NO: 8091154 - DNA, 22 bp, Homo sapiens
agatgttttgtgtatttcatca

SEQ ID NO: 8091155 - DNA, 22 bp, Homo sapiens
aagaaagccaaagttcatacct

SEQ ID NO: 8091156 - DNA, 22 bp, Homo sapiens
aagaatgtggcatttatttata

SEQ ID NO: 8091157 - DNA, 22 bp, Homo sapiens
aagccagatagaagaactcatt

SEQ ID NO: 8091158 - DNA, 22 bp, Homo sapiens
aagccagatcaaagtgtccagg

SEQ ID NO: 8091159 - DNA, 22 bp, Homo sapiens
aagcactttagtgagaataagg

SEQ ID NO: 8091160 - DNA, 19 bp, Homo sapiens
aaatatcagagagatgata

SEQ ID NO: 8091161 - DNA, 22 bp, Homo sapiens
aacagcagctgaggagctgggc

SEQ ID NO: 8091162 - DNA, 22 bp, Homo sapiens
aaatgggtttgattctcagcca

SEQ ID NO: 8091163 - DNA, 22 bp, Homo sapiens
aacaactgcttattgagtgact

SEQ ID NO: 8091164 - DNA, 22 bp, Homo sapiens
aacaactgctaaggtgtgtcct

SEQ ID NO: 8091165 - DNA, 22 bp, Homo sapiens
aacaactgaaaagctttttctg

SEQ ID NO: 8091166 - DNA, 22 bp, Homo sapiens
aacaactgagcaggagtgacag

SEQ ID NO: 8091167 - DNA, 22 bp, Homo sapiens
aactcaaagatgcatgacgctt

SEQ ID NO: 8091168 - DNA, 22 bp, Homo sapiens
aacatttgaaaatcaagaatct

SEQ ID NO: 8091169 - DNA, 22 bp, Homo sapiens
aacatttgagaaaaatactctt

SEQ ID NO: 8091170 - DNA, 22 bp, Homo sapiens
aacatttgcatgctttattaga

SEQ ID NO: 8091171 - DNA, 23 bp, Homo sapiens
aacatttgtaaggtgattttgtt

SEQ ID NO: 8091172 - DNA, 22 bp, Homo sapiens
aactgataatggacacataaaa

SEQ ID NO: 8091173 - DNA, 22 bp, Homo sapiens
aactgaacagaactcagagatt

SEQ ID NO: 8091174 - DNA, 22 bp, Homo sapiens
aacatgcaatgtctgaaaatcc

SEQ ID NO: 8091175 - DNA, 22 bp, Homo sapiens
aacatgcaaagctatgatgtat

SEQ ID NO: 8091176 - DNA, 22 bp, Homo sapiens
aacattctattttgctaaaaca

SEQ ID NO: 8091177 - DNA, 22 bp, Homo sapiens
aaagatgtgtaagaaataaaca

SEQ ID NO: 8091178 - DNA, 22 bp, Homo sapiens
aaacactggcaatttcatgcac

SEQ ID NO: 8091179 - DNA, 22 bp, Homo sapiens
aaactaaacctggcttagtaag

SEQ ID NO: 8091180 - DNA, 22 bp, Homo sapiens
aaatacagattctgactcagag

SEQ ID NO: 8091181 - DNA, 22 bp, Homo sapiens
aaatagaaaccaacaaggtcag

SEQ ID NO: 8091182 - DNA, 22 bp, Homo sapiens
aaatataatttctgcctcaata

SEQ ID NO: 8091183 - DNA, 22 bp, Homo sapiens
aaacttgaacccagctcaggct

SEQ ID NO: 8091184 - DNA, 22 bp, Homo sapiens
aaagaagggacagactgcctct

SEQ ID NO: 8091185 - DNA, 22 bp, Homo sapiens
aaacatgagttaaaagtaactg

SEQ ID NO: 8091186 - DNA, 22 bp, Homo sapiens
aaacatgaatagatattaaaca

SEQ ID NO: 8091187 - DNA, 22 bp, Homo sapiens
aaacaactcggcaactgctttt

SEQ ID NO: 8091188 - DNA, 22 bp, Homo sapiens
aaacaactcggcaactgctttt

SEQ ID NO: 8091189 - DNA, 22 bp, Homo sapiens
aaacaaacataggtttgaaagt

SEQ ID NO: 8091190 - DNA, 19 bp, Homo sapiens
aaaaacttagtccagaaag

SEQ ID NO: 8091191 - DNA, 22 bp, Homo sapiens
aaaagtctgctctcatttcaga

SEQ ID NO: 8091192 - DNA, 22 bp, Homo sapiens
aaaaatgtgaccacagggtgtt

SEQ ID NO: 8091193 - DNA, 22 bp, Homo sapiens
aaaaatgcttggacttaataaa

SEQ ID NO: 8091194 - DNA, 22 bp, Homo sapiens
aaaaatgtcattatggaactga

SEQ ID NO: 8091195 - DNA, 22 bp, Homo sapiens
acagaagacagagtgttcatct

SEQ ID NO: 8091196 - DNA, 22 bp, Homo sapiens
aagatacatcattcaggagtga

SEQ ID NO: 8091197 - DNA, 22 bp, Homo sapiens
aagatacattatgtctctctga

SEQ ID NO: 8091198 - DNA, 22 bp, Homo sapiens
aagatacattttcttcagagaa

SEQ ID NO: 8091199 - DNA, 22 bp, Homo sapiens
aagattttcagctaatggtgca

SEQ ID NO: 8091200 - DNA, 22 bp, Homo sapiens
aagattttctcaactgtatttg

SEQ ID NO: 8091201 - DNA, 22 bp, Homo sapiens
acagagcttaggatgactccca

SEQ ID NO: 8091202 - DNA, 22 bp, Homo sapiens
acagagctgtactacttactga

SEQ ID NO: 8091203 - DNA, 22 bp, Homo sapiens
aagatacatcaaagcaaattgg

SEQ ID NO: 8091204 - DNA, 22 bp, Homo sapiens
acactaatgagaaaggaattaa

SEQ ID NO: 8091205 - DNA, 22 bp, Homo sapiens
acaccccaccagtaactgaggg

SEQ ID NO: 8091206 - DNA, 22 bp, Homo sapiens
acaccttctgagaactgagcag

SEQ ID NO: 8091207 - DNA, 22 bp, Homo sapiens
aagaggttgtctgtgatgagtt

SEQ ID NO: 8091208 - DNA, 22 bp, Homo sapiens
aatgtattctgggaaaatgtta

SEQ ID NO: 8091209 - DNA, 22 bp, Homo sapiens
aatgtattcttcaaccttgcta

SEQ ID NO: 8091210 - DNA, 22 bp, Homo sapiens
aactttcagaatcctatgcatt

SEQ ID NO: 8091211 - DNA, 22 bp, Homo sapiens
aatgttatgtggttcaacttaa

SEQ ID NO: 8091212 - DNA, 22 bp, Homo sapiens
aatgtgaaaccgcacagaataa

SEQ ID NO: 8091213 - DNA, 22 bp, Homo sapiens
aatgtgaactttgtcatgtaac

SEQ ID NO: 8091214 - DNA, 22 bp, Homo sapiens
aatgttacaggacctaagatga

SEQ ID NO: 8091215 - DNA, 22 bp, Homo sapiens
aatgttaattcacagccaaata

SEQ ID NO: 8091216 - DNA, 22 bp, Homo sapiens
aatgttaagtttagattataac

SEQ ID NO: 8091217 - DNA, 22 bp, Homo sapiens
aatgttaatgtgtttgcttatg

SEQ ID NO: 8091218 - DNA, 22 bp, Homo sapiens
aagacaatttgatactagttgc

SEQ ID NO: 8091219 - DNA, 22 bp, Homo sapiens
acaactggctttttagcttgtt

SEQ ID NO: 8091220 - DNA, 22 bp, Homo sapiens
acaactgggggcattactggca

SEQ ID NO: 8091221 - DNA, 22 bp, Homo sapiens
acaactgttagacacttctaag

SEQ ID NO: 8091222 - DNA, 22 bp, Homo sapiens
acaactgttggaggaacacagg

SEQ ID NO: 8091223 - DNA, 22 bp, Homo sapiens
acaactttctgggttatctgat

SEQ ID NO: 8091224 - DNA, 22 bp, Homo sapiens
acaactttgtagcaattccacg

SEQ ID NO: 8091225 - DNA, 22 bp, Homo sapiens
acaagaataaggataagagatt

SEQ ID NO: 8091226 - DNA, 22 bp, Homo sapiens
aattagcatttcccatataaat

SEQ ID NO: 8091227 - DNA, 22 bp, Homo sapiens
aattagaagctgttagcaaaat

SEQ ID NO: 8091228 - DNA, 22 bp, Homo sapiens
aattcaacagtcagttatctca

SEQ ID NO: 8091229 - DNA, 22 bp, Homo sapiens
aagaatttaaactaaccatatg

SEQ ID NO: 8091230 - DNA, 22 bp, Homo sapiens
aagacaatcctggacagtcagc

SEQ ID NO: 8091231 - DNA, 22 bp, Homo sapiens
aaattataggtgccaccttgga

SEQ ID NO: 8091232 - DNA, 22 bp, Homo sapiens
aaattaactatcacttttgtga

SEQ ID NO: 8091233 - DNA, 22 bp, Homo sapiens
aaattattacaagctagttggc

SEQ ID NO: 8091234 - DNA, 22 bp, Homo sapiens
aaattgttgatctacagtaagg

SEQ ID NO: 8091235 - DNA, 22 bp, Homo sapiens
aagctttatgatctctcagcta

SEQ ID NO: 8091236 - DNA, 22 bp, Homo sapiens
aagctttagagatgagttcctt

SEQ ID NO: 8091237 - DNA, 22 bp, Homo sapiens
aagctttatgacttggagacag

SEQ ID NO: 8091238 - DNA, 22 bp, Homo sapiens
aagctgtgaaatagattacaca

SEQ ID NO: 8091239 - DNA, 20 bp, Homo sapiens
aagctgggtaggagaggagc

SEQ ID NO: 8091240 - DNA, 22 bp, Homo sapiens
aagctgggacttagcgcagata

SEQ ID NO: 8091241 - DNA, 22 bp, Homo sapiens
aagctgggagggagcccagagt

SEQ ID NO: 8091242 - DNA, 18 bp, Homo sapiens
aagctgggaaggagacag

SEQ ID NO: 8091243 - DNA, 22 bp, Homo sapiens
aagcccagaatcaagtctactg

SEQ ID NO: 8091244 - DNA, 22 bp, Homo sapiens
aagcccagatgagatccctgga

SEQ ID NO: 8091245 - DNA, 22 bp, Homo sapiens
aagccagatttcactcttaatt

SEQ ID NO: 8091246 - DNA, 22 bp, Homo sapiens
aaatttcaagcaaagtagctat

SEQ ID NO: 8091247 - DNA, 22 bp, Homo sapiens
aaggccagactctggaatgaca

SEQ ID NO: 8091248 - DNA, 22 bp, Homo sapiens
aacaataattgcggttctctat

SEQ ID NO: 8091249 - DNA, 22 bp, Homo sapiens
aaggggagatgtcatgggccct

SEQ ID NO: 8091250 - DNA, 22 bp, Homo sapiens
aaggggcctcacagatgggctt

SEQ ID NO: 8091251 - DNA, 21 bp, Homo sapiens
aaggggcaaacccaggacacc

SEQ ID NO: 8091252 - DNA, 22 bp, Homo sapiens
aagttacattttggtctaattg

SEQ ID NO: 8091253 - DNA, 22 bp, Homo sapiens
aagtatttcgttctgaaaaagt

SEQ ID NO: 8091254 - DNA, 22 bp, Homo sapiens
aagtatttcgttctgaaaaagt

SEQ ID NO: 8091255 - DNA, 22 bp, Homo sapiens
aagtttgcatagattaagcatt

SEQ ID NO: 8091256 - DNA, 22 bp, Homo sapiens
aacatttcagcaaataagaaca

SEQ ID NO: 8091257 - DNA, 22 bp, Homo sapiens
aacattctggttctaaaaacct

SEQ ID NO: 8091258 - DNA, 20 bp, Homo sapiens
tccagggcaaactcatcacc

SEQ ID NO: 8091259 - DNA, 20 bp, Homo sapiens
tccagggcaactagagtgtg

SEQ ID NO: 8091260 - DNA, 21 bp, Homo sapiens
tccaggcctcaggaagggatg

SEQ ID NO: 8091261 - DNA, 22 bp, Homo sapiens
tcccacagtggtacagccctga

SEQ ID NO: 8091262 - DNA, 22 bp, Homo sapiens
tcccagagtcttctcctgtaat

SEQ ID NO: 8091263 - DNA, 22 bp, Homo sapiens
tcccagattcctgctcttatat

SEQ ID NO: 8091264 - DNA, 22 bp, Homo sapiens
tcccagattcctgctcttatat

SEQ ID NO: 8091265 - DNA, 22 bp, Homo sapiens
tcccagagtttcctgtgtccca

SEQ ID NO: 8091266 - DNA, 22 bp, Homo sapiens
tcccaggaaaacactcgaggac

SEQ ID NO: 8091267 - DNA, 22 bp, Homo sapiens
tcccaggaagatcccagggacc

SEQ ID NO: 8091268 - DNA, 22 bp, Homo sapiens
tccagcccctcctgagccaagc

SEQ ID NO: 8091269 - DNA, 22 bp, Homo sapiens
tccagcccatccctagcctggg

SEQ ID NO: 8091270 - DNA, 17 bp, Homo sapiens
tccagccctgcccgacg

SEQ ID NO: 8091271 - DNA, 22 bp, Homo sapiens
tccagccctctggcccgcggtg

SEQ ID NO: 8091272 - DNA, 20 bp, Homo sapiens
tccaggagaactgggagccg

SEQ ID NO: 8091273 - DNA, 22 bp, Homo sapiens
tccaggacagcggcaggcagat

SEQ ID NO: 8091274 - DNA, 22 bp, Homo sapiens
tccaggaatgtgtgtgggctag

SEQ ID NO: 8091275 - DNA, 22 bp, Homo sapiens
tccaggaacgagaggctgggca

SEQ ID NO: 8091276 - DNA, 22 bp, Homo sapiens
tccaggaactcttgatggtgat

SEQ ID NO: 8091277 - DNA, 22 bp, Homo sapiens
tccacctccatgctgggcagag

SEQ ID NO: 8091278 - DNA, 18 bp, Homo sapiens
tccaccagtcaatctgtc

SEQ ID NO: 8091279 - DNA, 22 bp, Homo sapiens
tccaccagttcaccttgtagca

SEQ ID NO: 8091280 - DNA, 22 bp, Homo sapiens
tccaccagggtttcatctccct

SEQ ID NO: 8091281 - DNA, 22 bp, Homo sapiens
tccaccagcttcttcaccagct

SEQ ID NO: 8091282 - DNA, 21 bp, Homo sapiens
tccaccagctcttcctcttca

SEQ ID NO: 8091283 - DNA, 22 bp, Homo sapiens
tccaccagccaggcccaggctg

SEQ ID NO: 8091284 - DNA, 20 bp, Homo sapiens
tccaccaggaagggtaggga

SEQ ID NO: 8091285 - DNA, 22 bp, Homo sapiens
tccaccaggctccatgttcagt

SEQ ID NO: 8091286 - DNA, 22 bp, Homo sapiens
tccaccagagccttcccatgct

SEQ ID NO: 8091287 - DNA, 22 bp, Homo sapiens
tccaccagagccctctttgcgg

SEQ ID NO: 8091288 - DNA, 22 bp, Homo sapiens
tccaccagcagcctgtcagcct

SEQ ID NO: 8091289 - DNA, 22 bp, Homo sapiens
tccgcccgcacgtatggagtgg

SEQ ID NO: 8091290 - DNA, 22 bp, Homo sapiens
tccgggaggcagaggttgcagt

SEQ ID NO: 8091291 - DNA, 22 bp, Homo sapiens
tcctccagaaactgaggcagaa

SEQ ID NO: 8091292 - DNA, 20 bp, Homo sapiens
tcctccagaagggcagggtg

SEQ ID NO: 8091293 - DNA, 22 bp, Homo sapiens
tcctccagaaactgaggcagaa

SEQ ID NO: 8091294 - DNA, 22 bp, Homo sapiens
tcctccagctgtatcctgcctg

SEQ ID NO: 8091295 - DNA, 21 bp, Homo sapiens
tcctcctccactaggctagcc

SEQ ID NO: 8091296 - DNA, 22 bp, Homo sapiens
tcctcccttgactcctgctttt

SEQ ID NO: 8091297 - DNA, 22 bp, Homo sapiens
tcctcccttggggtttcgttat

SEQ ID NO: 8091298 - DNA, 19 bp, Homo sapiens
tcctccctttggtgtcctg

SEQ ID NO: 8091299 - DNA, 23 bp, Homo sapiens
tcctcccaaatttcagcctcatt

SEQ ID NO: 8091300 - DNA, 22 bp, Homo sapiens
tcctccagtgtctggggccttg

SEQ ID NO: 8091301 - DNA, 22 bp, Homo sapiens
tcctccagtggcccagtccttc

SEQ ID NO: 8091302 - DNA, 22 bp, Homo sapiens
tcctccaggtctagggtggctt

SEQ ID NO: 8091303 - DNA, 22 bp, Homo sapiens
tcctccctgggagcttctgagt

SEQ ID NO: 8091304 - DNA, 22 bp, Homo sapiens
tcctccctgtaccattcctctg

SEQ ID NO: 8091305 - DNA, 22 bp, Homo sapiens
tcctcccttctcactgggaagg

SEQ ID NO: 8091306 - DNA, 22 bp, Homo sapiens
tcctccctgcactcagtgaagt

SEQ ID NO: 8091307 - DNA, 21 bp, Homo sapiens
tcctccctgagctgtggggga

SEQ ID NO: 8091308 - DNA, 22 bp, Homo sapiens
tcctccctgagtggggacagct

SEQ ID NO: 8091309 - DNA, 23 bp, Homo sapiens
tcctccctgacttctacagcaca

SEQ ID NO: 8091310 - DNA, 22 bp, Homo sapiens
tcctccctaactcatgatgagt

SEQ ID NO: 8091311 - DNA, 22 bp, Homo sapiens
tcctccctaaatcctagactgt

SEQ ID NO: 8091312 - DNA, 22 bp, Homo sapiens
tccctgtgggcagaggctgcct

SEQ ID NO: 8091313 - DNA, 22 bp, Homo sapiens
tccctgtgtccatgccaggagg

SEQ ID NO: 8091314 - DNA, 22 bp, Homo sapiens
tccctggggcagtggctcggag

SEQ ID NO: 8091315 - DNA, 22 bp, Homo sapiens
tcccaggcaaaggcagctcatt

SEQ ID NO: 8091316 - DNA, 22 bp, Homo sapiens
tcccaggattttaggctctcag

SEQ ID NO: 8091317 - DNA, 22 bp, Homo sapiens
tccctgccaatgattggagcaa

SEQ ID NO: 8091318 - DNA, 22 bp, Homo sapiens
tccctgcagcccctgagccttc

SEQ ID NO: 8091319 - DNA, 22 bp, Homo sapiens
tcagaacattctcattgactgc

SEQ ID NO: 8091320 - DNA, 22 bp, Homo sapiens
tcagaagcaggagtgtgcacaa

SEQ ID NO: 8091321 - DNA, 22 bp, Homo sapiens
tcactggggcctttggtcagga

SEQ ID NO: 8091322 - DNA, 22 bp, Homo sapiens
tcactgtgcacatatgataggt

SEQ ID NO: 8091323 - DNA, 22 bp, Homo sapiens
tcactgtgaatgttatcatctt

SEQ ID NO: 8091324 - DNA, 21 bp, Homo sapiens
tcactgtgcaaatgttgatgg

SEQ ID NO: 8091325 - DNA, 21 bp, Homo sapiens
tcactgtgcaaatgttgatgg

SEQ ID NO: 8091326 - DNA, 22 bp, Homo sapiens
tcactgtgcacatatgataggt

SEQ ID NO: 8091327 - DNA, 22 bp, Homo sapiens
tcactgtgattctgtatggatt

SEQ ID NO: 8091328 - DNA, 22 bp, Homo sapiens
tcactacaacctccgcctcctg

SEQ ID NO: 8091329 - DNA, 22 bp, Homo sapiens
tcactgggagatgtgggaaggg

SEQ ID NO: 8091330 - DNA, 22 bp, Homo sapiens
tcacctgggagggctgtggtag

SEQ ID NO: 8091331 - DNA, 22 bp, Homo sapiens
tcacctctactcagcctagttc

SEQ ID NO: 8091332 - DNA, 22 bp, Homo sapiens
tcacccaggtaatagcagtttg

SEQ ID NO: 8091333 - DNA, 22 bp, Homo sapiens
tcacatgagtattattttccaa

SEQ ID NO: 8091334 - DNA, 22 bp, Homo sapiens
tcacatgaggttatgacaaagc

SEQ ID NO: 8091335 - DNA, 22 bp, Homo sapiens
tcacatgaaatgctgtaaagaa

SEQ ID NO: 8091336 - DNA, 18 bp, Homo sapiens
tcaaaatatttctgtgga

SEQ ID NO: 8091337 - DNA, 22 bp, Homo sapiens
tcaaaagtttcacatagagata

SEQ ID NO: 8091338 - DNA, 20 bp, Homo sapiens
tcaaaataggtgtgggcgga

SEQ ID NO: 8091339 - DNA, 22 bp, Homo sapiens
tcaatacatacaatgtatagtg

SEQ ID NO: 8091340 - DNA, 22 bp, Homo sapiens
tcacacagctgacagagccttt

SEQ ID NO: 8091341 - DNA, 22 bp, Homo sapiens
tcacacagctgacagagccttt

SEQ ID NO: 8091342 - DNA, 23 bp, Homo sapiens
tcacacagctggtcaggtacaga

SEQ ID NO: 8091343 - DNA, 23 bp, Homo sapiens
tcacacagctggtcaggtacaga

SEQ ID NO: 8091344 - DNA, 22 bp, Homo sapiens
tcacaatttggatacagctatg

SEQ ID NO: 8091345 - DNA, 22 bp, Homo sapiens
tcacacagattggtagagctga

SEQ ID NO: 8091346 - DNA, 22 bp, Homo sapiens
tcaattctgcctctaaatattt

SEQ ID NO: 8091347 - DNA, 22 bp, Homo sapiens
tcaatgtttggaaatcctttgt

SEQ ID NO: 8091348 - DNA, 18 bp, Homo sapiens
tcagcccagagcccagtt

SEQ ID NO: 8091349 - DNA, 22 bp, Homo sapiens
tcagcccagcccagcaagtgca

SEQ ID NO: 8091350 - DNA, 22 bp, Homo sapiens
tcagccagttgccccagttagt

SEQ ID NO: 8091351 - DNA, 23 bp, Homo sapiens
tcagcccacatctagtcattagc

SEQ ID NO: 8091352 - DNA, 22 bp, Homo sapiens
tcagcccaaccctgcacaagga

SEQ ID NO: 8091353 - DNA, 22 bp, Homo sapiens
tcagcccacctggtgtggggct

SEQ ID NO: 8091354 - DNA, 22 bp, Homo sapiens
tcagcccaccttcaggggagtt

SEQ ID NO: 8091355 - DNA, 22 bp, Homo sapiens
tcagcccagaccacctcattgc

SEQ ID NO: 8091356 - DNA, 22 bp, Homo sapiens
tcagaggcttctgctcacctca

SEQ ID NO: 8091357 - DNA, 22 bp, Homo sapiens
tcagccaggccctaagagattg

SEQ ID NO: 8091358 - DNA, 22 bp, Homo sapiens
tcagccagggcagagcaggtga

SEQ ID NO: 8091359 - DNA, 22 bp, Homo sapiens
tcaggagctcttccctggtgtg

SEQ ID NO: 8091360 - DNA, 22 bp, Homo sapiens
tcaggagctcaggctgatggaa

SEQ ID NO: 8091361 - DNA, 22 bp, Homo sapiens
tcaggagctgcactgggcccac

SEQ ID NO: 8091362 - DNA, 22 bp, Homo sapiens
tcaggagcctgaaagaggtcta

SEQ ID NO: 8091363 - DNA, 21 bp, Homo sapiens
tcaggcaggcgcagagggaag

SEQ ID NO: 8091364 - DNA, 22 bp, Homo sapiens
tcaggcagctccaggaatggta

SEQ ID NO: 8091365 - DNA, 22 bp, Homo sapiens
tcaggcagatgcagggatggat

SEQ ID NO: 8091366 - DNA, 22 bp, Homo sapiens
tcagggcaaaagggaaaccatt

SEQ ID NO: 8091367 - DNA, 22 bp, Homo sapiens
tcagggacttacaaaccagaag

SEQ ID NO: 8091368 - DNA, 22 bp, Homo sapiens
tcagggactgttactgcctttg

SEQ ID NO: 8091369 - DNA, 22 bp, Homo sapiens
tcagggactaggtgctgcctga

SEQ ID NO: 8091370 - DNA, 22 bp, Homo sapiens
tcagggcaaagggcagagtttg

SEQ ID NO: 8091371 - DNA, 22 bp, Homo sapiens
tcagggcaagattggttaataa

SEQ ID NO: 8091372 - DNA, 22 bp, Homo sapiens
tcagggcaagtctcagaaggtt

SEQ ID NO: 8091373 - DNA, 22 bp, Homo sapiens
tcagggcaatgtccctcagaag

SEQ ID NO: 8091374 - DNA, 22 bp, Homo sapiens
tcagggcaccaaaaaagatgcc

SEQ ID NO: 8091375 - DNA, 22 bp, Homo sapiens
tcagggcacattctgcagtggc

SEQ ID NO: 8091376 - DNA, 22 bp, Homo sapiens
tcagggcacaggcctgtgggtt

SEQ ID NO: 8091377 - DNA, 22 bp, Homo sapiens
tcaggctcaaagggccggatga

SEQ ID NO: 8091378 - DNA, 22 bp, Homo sapiens
tcaggctcaggaatgtgtttat

SEQ ID NO: 8091379 - DNA, 18 bp, Homo sapiens
tcaggctctctggctaga

SEQ ID NO: 8091380 - DNA, 20 bp, Homo sapiens
tcaggctccgcattaactta

SEQ ID NO: 8091381 - DNA, 22 bp, Homo sapiens
tcaggctctcagaccaacagca

SEQ ID NO: 8091382 - DNA, 22 bp, Homo sapiens
tcaggctctacacttgacacac

SEQ ID NO: 8091383 - DNA, 22 bp, Homo sapiens
tcaggctcaggttaggggccaa

SEQ ID NO: 8091384 - DNA, 22 bp, Homo sapiens
tcaggctccctgctgggctctg

SEQ ID NO: 8091385 - DNA, 22 bp, Homo sapiens
tcaggctctgggtacacctgac

SEQ ID NO: 8091386 - DNA, 22 bp, Homo sapiens
tcaggctctgagctgatgctaa

SEQ ID NO: 8091387 - DNA, 22 bp, Homo sapiens
tcaggctctgccacctagatta

SEQ ID NO: 8091388 - DNA, 22 bp, Homo sapiens
tcaggtcccactgctagtaagt

SEQ ID NO: 8091389 - DNA, 22 bp, Homo sapiens
tcagtgcattaataatatcagt

SEQ ID NO: 8091390 - DNA, 22 bp, Homo sapiens
tcagggcactgtcacctgatat

SEQ ID NO: 8091391 - DNA, 22 bp, Homo sapiens
tcagggcacgtttctgcaatgc

SEQ ID NO: 8091392 - DNA, 22 bp, Homo sapiens
tcagggcagaatccaaagaatt

SEQ ID NO: 8091393 - DNA, 16 bp, Homo sapiens
tcagggcagaatggca

SEQ ID NO: 8091394 - DNA, 22 bp, Homo sapiens
tcagggcagcctaaggcacctc

SEQ ID NO: 8091395 - DNA, 21 bp, Homo sapiens
tcagggcagctgctcttcaga

SEQ ID NO: 8091396 - DNA, 19 bp, Homo sapiens
tcagtggatgaacatgttt

SEQ ID NO: 8091397 - DNA, 22 bp, Homo sapiens
tattcagtgacagggtattatg

SEQ ID NO: 8091398 - DNA, 21 bp, Homo sapiens
tattcagtccattgatgttta

SEQ ID NO: 8091399 - DNA, 22 bp, Homo sapiens
tatgtttaaatgtatgtgtatg

SEQ ID NO: 8091400 - DNA, 22 bp, Homo sapiens
tatgtttagtatccattttcag

SEQ ID NO: 8091401 - DNA, 22 bp, Homo sapiens
tatgtttagtatccattttcag

SEQ ID NO: 8091402 - DNA, 22 bp, Homo sapiens
tatgttcatgtcaaacaaatgc

SEQ ID NO: 8091403 - DNA, 22 bp, Homo sapiens
tatgttattttcatacaacaga

SEQ ID NO: 8091404 - DNA, 22 bp, Homo sapiens
tatgttactcacatgttcttgc

SEQ ID NO: 8091405 - DNA, 22 bp, Homo sapiens
tatgttacaaagtttttctaaa

SEQ ID NO: 8091406 - DNA, 22 bp, Homo sapiens
tatttcacatctatgaagtgag

SEQ ID NO: 8091407 - DNA, 22 bp, Homo sapiens
tatttcacaagatgctgatgct

SEQ ID NO: 8091408 - DNA, 20 bp, Homo sapiens
tatttcactctccagatggc

SEQ ID NO: 8091409 - DNA, 22 bp, Homo sapiens
tatttcactattctctgtaact

SEQ ID NO: 8091410 - DNA, 22 bp, Homo sapiens
tatttcaccttactaagctgtg

SEQ ID NO: 8091411 - DNA, 22 bp, Homo sapiens
tatttcagggagaataaatttg

SEQ ID NO: 8091412 - DNA, 22 bp, Homo sapiens
tatttcagcaagaagaatgtgg

SEQ ID NO: 8091413 - DNA, 22 bp, Homo sapiens
tatttcagccctactacttggc

SEQ ID NO: 8091414 - DNA, 22 bp, Homo sapiens
tattttcaccttctctggatat

SEQ ID NO: 8091415 - DNA, 22 bp, Homo sapiens
tattttcattctgtgtgactgt

SEQ ID NO: 8091416 - DNA, 22 bp, Homo sapiens
tattttcatcttgtccttggat

SEQ ID NO: 8091417 - DNA, 22 bp, Homo sapiens
tatttccagcagtaagaagaca

SEQ ID NO: 8091418 - DNA, 22 bp, Homo sapiens
tatttccatgttagaactaagt

SEQ ID NO: 8091419 - DNA, 22 bp, Homo sapiens
tatttccaggccccactctaga

SEQ ID NO: 8091420 - DNA, 22 bp, Homo sapiens
tatttctaagagatatctgtac

SEQ ID NO: 8091421 - DNA, 22 bp, Homo sapiens
tatcaatacatgttatcagtgt

SEQ ID NO: 8091422 - DNA, 21 bp, Homo sapiens
tatcaaggcactttttaaaga

SEQ ID NO: 8091423 - DNA, 22 bp, Homo sapiens
tatcacactagcctatagtgga

SEQ ID NO: 8091424 - DNA, 18 bp, Homo sapiens
tatatttcacacatattc

SEQ ID NO: 8091425 - DNA, 18 bp, Homo sapiens
tatatttcacacatattc

SEQ ID NO: 8091426 - DNA, 19 bp, Homo sapiens
tagtgtttttctggagcag

SEQ ID NO: 8091427 - DNA, 21 bp, Homo sapiens
tatacagaggggaacaggaga

SEQ ID NO: 8091428 - DNA, 22 bp, Homo sapiens
tataccttccacaaaacagctt

SEQ ID NO: 8091429 - DNA, 22 bp, Homo sapiens
tatattataagccctttcagaa

SEQ ID NO: 8091430 - DNA, 22 bp, Homo sapiens
tagatgttaagcttctagaagg

SEQ ID NO: 8091431 - DNA, 20 bp, Homo sapiens
tagatgtttcctgtcataaa

SEQ ID NO: 8091432 - DNA, 23 bp, Homo sapiens
tagatgtttggggaactttgccc

SEQ ID NO: 8091433 - DNA, 22 bp, Homo sapiens
tagatgttttgatatttgctga

SEQ ID NO: 8091434 - DNA, 21 bp, Homo sapiens
tagcacagctgtagacagttt

SEQ ID NO: 8091435 - DNA, 22 bp, Homo sapiens
tagcacccatggaatctgctgg

SEQ ID NO: 8091436 - DNA, 23 bp, Homo sapiens
tagcacctctcacatagtgggtt

SEQ ID NO: 8091437 - DNA, 22 bp, Homo sapiens
tagaagcagtaatagaaatagg

SEQ ID NO: 8091438 - DNA, 22 bp, Homo sapiens
tagagctgctggactgtaacag

SEQ ID NO: 8091439 - DNA, 22 bp, Homo sapiens
tagagctgataatgaggccaag

SEQ ID NO: 8091440 - DNA, 22 bp, Homo sapiens
tagagctgagttgactccattt

SEQ ID NO: 8091441 - DNA, 22 bp, Homo sapiens
taggtttactgaattagtggaa

SEQ ID NO: 8091442 - DNA, 22 bp, Homo sapiens
taggctgctcaccaggctcaga

SEQ ID NO: 8091443 - DNA, 22 bp, Homo sapiens
tagtgtaatgacatttagacga

SEQ ID NO: 8091444 - DNA, 22 bp, Homo sapiens
tagtcctgaccagctggatgtt

SEQ ID NO: 8091445 - DNA, 22 bp, Homo sapiens
tagtcctgaccttgccaccagc

SEQ ID NO: 8091446 - DNA, 22 bp, Homo sapiens
tagtcctggcagccctcctggc

SEQ ID NO: 8091447 - DNA, 22 bp, Homo sapiens
tagtcctggattggtggaggca

SEQ ID NO: 8091448 - DNA, 22 bp, Homo sapiens
tagtcaatcagtatgtattgga

SEQ ID NO: 8091449 - DNA, 22 bp, Homo sapiens
tagtcaggagtaggagttttgg

SEQ ID NO: 8091450 - DNA, 22 bp, Homo sapiens
tagcccagaaagcaaatgtctc

SEQ ID NO: 8091451 - DNA, 22 bp, Homo sapiens
tagcccagaagagggaagcaac

SEQ ID NO: 8091452 - DNA, 22 bp, Homo sapiens
tagcccagagagccaggggctt

SEQ ID NO: 8091453 - DNA, 19 bp, Homo sapiens
tagcccagagcctggctac

SEQ ID NO: 8091454 - DNA, 22 bp, Homo sapiens
tagcccagagtcccaattccag

SEQ ID NO: 8091455 - DNA, 22 bp, Homo sapiens
tagcccagatgattgaaccatg

SEQ ID NO: 8091456 - DNA, 22 bp, Homo sapiens
tagcccagatgattgaaccatg

SEQ ID NO: 8091457 - DNA, 22 bp, Homo sapiens
tagcccagagtcccaattccag

SEQ ID NO: 8091458 - DNA, 22 bp, Homo sapiens
tagcccagatacaaatcatgat

SEQ ID NO: 8091459 - DNA, 21 bp, Homo sapiens
taggacagcccccctgccctc

SEQ ID NO: 8091460 - DNA, 20 bp, Homo sapiens
taggacaggcagccgagggg

SEQ ID NO: 8091461 - DNA, 22 bp, Homo sapiens
taggacaggtgaggggctgtgg

SEQ ID NO: 8091462 - DNA, 22 bp, Homo sapiens
taacaatagtgtttgctagtca

SEQ ID NO: 8091463 - DNA, 22 bp, Homo sapiens
taactgtatagcttggactaaa

SEQ ID NO: 8091464 - DNA, 22 bp, Homo sapiens
taactgtgtgaacgtgatcatt

SEQ ID NO: 8091465 - DNA, 22 bp, Homo sapiens
taactgtgaagtaattgtggat

SEQ ID NO: 8091466 - DNA, 22 bp, Homo sapiens
taagaaacccaggaatttctta

SEQ ID NO: 8091467 - DNA, 22 bp, Homo sapiens
taagaaactaatgcaataagag

SEQ ID NO: 8091468 - DNA, 22 bp, Homo sapiens
taagaaactatggagaagaact

SEQ ID NO: 8091469 - DNA, 22 bp, Homo sapiens
taagaaactgtcacagtactat

SEQ ID NO: 8091470 - DNA, 22 bp, Homo sapiens
taagaaactgtcacagtactat

SEQ ID NO: 8091471 - DNA, 22 bp, Homo sapiens
taagaaactattgtctctgaac

SEQ ID NO: 8091472 - DNA, 22 bp, Homo sapiens
taaactgtgtaatatgatgtct

SEQ ID NO: 8091473 - DNA, 22 bp, Homo sapiens
taaagaacacagggaatagcac

SEQ ID NO: 8091474 - DNA, 21 bp, Homo sapiens
taaataataagttgctgagat

SEQ ID NO: 8091475 - DNA, 22 bp, Homo sapiens
taaataagttcttcattgtttg

SEQ ID NO: 8091476 - DNA, 17 bp, Homo sapiens
taaatacacaagggtat

SEQ ID NO: 8091477 - DNA, 22 bp, Homo sapiens
gttttataggtgaaatattact

SEQ ID NO: 8091478 - DNA, 22 bp, Homo sapiens
gttttataattgcttcataaga

SEQ ID NO: 8091479 - DNA, 22 bp, Homo sapiens
gttttataggctgttgctatat

SEQ ID NO: 8091480 - DNA, 22 bp, Homo sapiens
taaacatctgtcatgtgtttat

SEQ ID NO: 8091481 - DNA, 22 bp, Homo sapiens
gttataaaatgcacagttgttt

SEQ ID NO: 8091482 - DNA, 22 bp, Homo sapiens
gtgttaaatgcaatcacatgca

SEQ ID NO: 8091483 - DNA, 22 bp, Homo sapiens
gtgttaaaatgctttatagtag

SEQ ID NO: 8091484 - DNA, 22 bp, Homo sapiens
gtgttaaacatgttcacagcat

SEQ ID NO: 8091485 - DNA, 22 bp, Homo sapiens
gtgttaaaaatcccatgatatg

SEQ ID NO: 8091486 - DNA, 22 bp, Homo sapiens
gtgctttagttcttgcaactgg

SEQ ID NO: 8091487 - DNA, 22 bp, Homo sapiens
gtgctttaataagatttcactt

SEQ ID NO: 8091488 - DNA, 22 bp, Homo sapiens
gttccaggaccctggcctctga

SEQ ID NO: 8091489 - DNA, 22 bp, Homo sapiens
gtttataaggcccaatatttct

SEQ ID NO: 8091490 - DNA, 22 bp, Homo sapiens
gtttatatgtgtgccactctta

SEQ ID NO: 8091491 - DNA, 22 bp, Homo sapiens
tacaatttagtggtgtgtggtt

SEQ ID NO: 8091492 - DNA, 22 bp, Homo sapiens
tacaatgaccatattatgtaag

SEQ ID NO: 8091493 - DNA, 22 bp, Homo sapiens
tacaatgatgatactttactgg

SEQ ID NO: 8091494 - DNA, 19 bp, Homo sapiens
tacaatgatgttacctttg

SEQ ID NO: 8091495 - DNA, 19 bp, Homo sapiens
tacaagcttaaagtaatgt

SEQ ID NO: 8091496 - DNA, 22 bp, Homo sapiens
taatggaagttaaatatggtat

SEQ ID NO: 8091497 - DNA, 22 bp, Homo sapiens
taagttcataagcttattctta

SEQ ID NO: 8091498 - DNA, 22 bp, Homo sapiens
taagtgttggtaattacaatga

SEQ ID NO: 8091499 - DNA, 22 bp, Homo sapiens
tacattatttcatcagtcatct

SEQ ID NO: 8091500 - DNA, 22 bp, Homo sapiens
tacattatcttgttatctttca

SEQ ID NO: 8091501 - DNA, 22 bp, Homo sapiens
tacatgtatgtttatcttgaga

SEQ ID NO: 8091502 - DNA, 22 bp, Homo sapiens
tacagtttgttacattgttagt

SEQ ID NO: 8091503 - DNA, 22 bp, Homo sapiens
tactaaatagtttaattcctca

SEQ ID NO: 8091504 - DNA, 22 bp, Homo sapiens
taccttgggagacgccaggccc

SEQ ID NO: 8091505 - DNA, 22 bp, Homo sapiens
tacctgggcccaccagtgcctg

SEQ ID NO: 8091506 - DNA, 22 bp, Homo sapiens
tactgcatggtggagtggagct

SEQ ID NO: 8091507 - DNA, 22 bp, Homo sapiens
tactgcctgggggagacagctg

SEQ ID NO: 8091508 - DNA, 22 bp, Homo sapiens
tactgcataactggcatgtggg

SEQ ID NO: 8091509 - DNA, 22 bp, Homo sapiens
tactgcaaaccatttacagtag

SEQ ID NO: 8091510 - DNA, 22 bp, Homo sapiens
tactgcaaaccatttacagtag

SEQ ID NO: 8091511 - DNA, 22 bp, Homo sapiens
gctcaaatttcagactcatgaa

SEQ ID NO: 8091512 - DNA, 22 bp, Homo sapiens
gcggggggaggaacatcttgca

SEQ ID NO: 8091513 - DNA, 22 bp, Homo sapiens
gcggggcacagtgatggagcac

SEQ ID NO: 8091514 - DNA, 18 bp, Homo sapiens
gcgggcggtgcagtgggc

SEQ ID NO: 8091515 - DNA, 22 bp, Homo sapiens
gcgggccaccttggagagcgct

SEQ ID NO: 8091516 - DNA, 22 bp, Homo sapiens
gcgggccaccttggagagcgct

SEQ ID NO: 8091517 - DNA, 22 bp, Homo sapiens
gcctggtgaaaggcagagagcg

SEQ ID NO: 8091518 - DNA, 22 bp, Homo sapiens
gccttcaggtgctgccaggcta

SEQ ID NO: 8091519 - DNA, 22 bp, Homo sapiens
gcctggggaacttgatcctgtc

SEQ ID NO: 8091520 - DNA, 22 bp, Homo sapiens
gctcagggaaagagctcctgtc

SEQ ID NO: 8091521 - DNA, 19 bp, Homo sapiens
gctcaggctgtgtgtgggg

SEQ ID NO: 8091522 - DNA, 22 bp, Homo sapiens
gctcaggctctcccaggggaat

SEQ ID NO: 8091523 - DNA, 22 bp, Homo sapiens
gctgatgggagctggctcaccc

SEQ ID NO: 8091524 - DNA, 22 bp, Homo sapiens
ggactctggctcagtgttgctt

SEQ ID NO: 8091525 - DNA, 22 bp, Homo sapiens
ggactctgctggttttgttcac

SEQ ID NO: 8091526 - DNA, 22 bp, Homo sapiens
ggacggggagctggaaagggga

SEQ ID NO: 8091527 - DNA, 22 bp, Homo sapiens
ggacggggagctggaaagggga

SEQ ID NO: 8091528 - DNA, 22 bp, Homo sapiens
ggacctggcaatttgcatctct

SEQ ID NO: 8091529 - DNA, 22 bp, Homo sapiens
ggacctggcaatttgcatctct

SEQ ID NO: 8091530 - DNA, 19 bp, Homo sapiens
ggacctggcaatctgcatt

SEQ ID NO: 8091531 - DNA, 22 bp, Homo sapiens
ggactctgttttcctgatcact

SEQ ID NO: 8091532 - DNA, 22 bp, Homo sapiens
ggactctggtatttcactcttg

SEQ ID NO: 8091533 - DNA, 22 bp, Homo sapiens
ggactctgtagaggttctcatt

SEQ ID NO: 8091534 - DNA, 22 bp, Homo sapiens
ggagagctggtatatgaagaca

SEQ ID NO: 8091535 - DNA, 22 bp, Homo sapiens
ggaccggtggcttcctcgggtc

SEQ ID NO: 8091536 - DNA, 21 bp, Homo sapiens
ggacagaggagaaggcaccct

SEQ ID NO: 8091537 - DNA, 22 bp, Homo sapiens
ggacagagggcaggagcccaga

SEQ ID NO: 8091538 - DNA, 22 bp, Homo sapiens
ggacagagccctggtggcctaa

SEQ ID NO: 8091539 - DNA, 22 bp, Homo sapiens
ggacactgttcatggggagggg

SEQ ID NO: 8091540 - DNA, 18 bp, Homo sapiens
ggaaggaagaatgcattt

SEQ ID NO: 8091541 - DNA, 22 bp, Homo sapiens
ggaaatcaaggggacaaattgt

SEQ ID NO: 8091542 - DNA, 22 bp, Homo sapiens
gctgtgcccagctccagctctg

SEQ ID NO: 8091543 - DNA, 22 bp, Homo sapiens
gctgggtttccagcaggcagga

SEQ ID NO: 8091544 - DNA, 22 bp, Homo sapiens
gctgggtctggctgtgagccgg

SEQ ID NO: 8091545 - DNA, 22 bp, Homo sapiens
gctgggtcctatgctggtagag

SEQ ID NO: 8091546 - DNA, 22 bp, Homo sapiens
gctgggtctggatgctcaggtg

SEQ ID NO: 8091547 - DNA, 19 bp, Homo sapiens
gctgggtggggtccacagc

SEQ ID NO: 8091548 - DNA, 22 bp, Homo sapiens
gctgggagtcgcgtctgtggcc

SEQ ID NO: 8091549 - DNA, 16 bp, Homo sapiens
gctgggagggagaggt

SEQ ID NO: 8091550 - DNA, 16 bp, Homo sapiens
gctgggagggagaggt

SEQ ID NO: 8091551 - DNA, 22 bp, Homo sapiens
gctgggagcaaagccatgcata

SEQ ID NO: 8091552 - DNA, 22 bp, Homo sapiens
gctgggagacagacttggaacc

SEQ ID NO: 8091553 - DNA, 22 bp, Homo sapiens
gctgggaagtgcaagatcaagg

SEQ ID NO: 8091554 - DNA, 22 bp, Homo sapiens
gctgggactgagacagtgacct

SEQ ID NO: 8091555 - DNA, 22 bp, Homo sapiens
gctggcacctatttggacctgg

SEQ ID NO: 8091556 - DNA, 22 bp, Homo sapiens
gctggcacaggtggatgctggc

SEQ ID NO: 8091557 - DNA, 22 bp, Homo sapiens
gctggcacatggctcagggcct

SEQ ID NO: 8091558 - DNA, 22 bp, Homo sapiens
gcccactggctggagtgctggt

SEQ ID NO: 8091559 - DNA, 23 bp, Homo sapiens
gcccagagaggctcaccaggaat

SEQ ID NO: 8091560 - DNA, 22 bp, Homo sapiens
gccaggagccctgggcaagttc

SEQ ID NO: 8091561 - DNA, 22 bp, Homo sapiens
gccaggacctcagatgcagggc

SEQ ID NO: 8091562 - DNA, 22 bp, Homo sapiens
gccaggaccctggagggcatct

SEQ ID NO: 8091563 - DNA, 22 bp, Homo sapiens
gccaggactgagaatgggagca

SEQ ID NO: 8091564 - DNA, 22 bp, Homo sapiens
gccaggactagagggaggtgag

SEQ ID NO: 8091565 - DNA, 22 bp, Homo sapiens
gccaggacggtgaatgggctac

SEQ ID NO: 8091566 - DNA, 22 bp, Homo sapiens
gccaggtgtagtggccacacct

SEQ ID NO: 8091567 - DNA, 22 bp, Homo sapiens
gccaggtgtagtggccacacct

SEQ ID NO: 8091568 - DNA, 22 bp, Homo sapiens
gcctcagaatcatttatcatct

SEQ ID NO: 8091569 - DNA, 22 bp, Homo sapiens
gcccagggcagggcaagagtga

SEQ ID NO: 8091570 - DNA, 22 bp, Homo sapiens
gcccagggcgatggtcggggcc

SEQ ID NO: 8091571 - DNA, 22 bp, Homo sapiens
gcccagggctgcaagtggacgc

SEQ ID NO: 8091572 - DNA, 22 bp, Homo sapiens
gcccaggctggagtgcagtggt

SEQ ID NO: 8091573 - DNA, 23 bp, Homo sapiens
gcccatggagtctggatctggcc

SEQ ID NO: 8091574 - DNA, 22 bp, Homo sapiens
gccagccccttagggctctccc

SEQ ID NO: 8091575 - DNA, 22 bp, Homo sapiens
gccagcagtcctgctgtgtgcc

SEQ ID NO: 8091576 - DNA, 22 bp, Homo sapiens
gccagccataggccagcactgg

SEQ ID NO: 8091577 - DNA, 22 bp, Homo sapiens
gccagcagtggccaccaccagg

SEQ ID NO: 8091578 - DNA, 22 bp, Homo sapiens
gccagcagggcggagccatcta

SEQ ID NO: 8091579 - DNA, 22 bp, Homo sapiens
gccagcaggtggagagatcaag

SEQ ID NO: 8091580 - DNA, 22 bp, Homo sapiens
gccagaggcccaaggacagctg

SEQ ID NO: 8091581 - DNA, 17 bp, Homo sapiens
gcagtatgatcctctgg

SEQ ID NO: 8091582 - DNA, 18 bp, Homo sapiens
gcagtctctctggtcttc

SEQ ID NO: 8091583 - DNA, 22 bp, Homo sapiens
gcatgaaatgagcgaatataat

SEQ ID NO: 8091584 - DNA, 22 bp, Homo sapiens
gcatccagtcttggctcctgga

SEQ ID NO: 8091585 - DNA, 22 bp, Homo sapiens
gcatccaggactatatgatgat

SEQ ID NO: 8091586 - DNA, 22 bp, Homo sapiens
gcatccagaggtagccactgtg

SEQ ID NO: 8091587 - DNA, 20 bp, Homo sapiens
gcatccagacacccagctgc

SEQ ID NO: 8091588 - DNA, 22 bp, Homo sapiens
gcatctaaacttgcatcattgt

SEQ ID NO: 8091589 - DNA, 22 bp, Homo sapiens
gcatctaaataaacgtgggagt

SEQ ID NO: 8091590 - DNA, 22 bp, Homo sapiens
gcatctaatccagtccagcatc

SEQ ID NO: 8091591 - DNA, 22 bp, Homo sapiens
gcaggagctggaaagtgatgtt

SEQ ID NO: 8091592 - DNA, 22 bp, Homo sapiens
gcagctggccctgacacgcaga

SEQ ID NO: 8091593 - DNA, 22 bp, Homo sapiens
gcaggagctttgcttactgctg

SEQ ID NO: 8091594 - DNA, 22 bp, Homo sapiens
gcagctggagccagccagacac

SEQ ID NO: 8091595 - DNA, 22 bp, Homo sapiens
gcagctggagccagccagacac

SEQ ID NO: 8091596 - DNA, 22 bp, Homo sapiens
gcaggaggttgagccaggactg

SEQ ID NO: 8091597 - DNA, 22 bp, Homo sapiens
gcagggcggcccagagcaggcc

SEQ ID NO: 8091598 - DNA, 22 bp, Homo sapiens
gcagggccttagcagcggctgc

SEQ ID NO: 8091599 - DNA, 22 bp, Homo sapiens
gcaggctccaggccggcccctt

SEQ ID NO: 8091600 - DNA, 22 bp, Homo sapiens
gcaggctccaaggcctgggaga

SEQ ID NO: 8091601 - DNA, 20 bp, Homo sapiens
gcaggctccgggcttgggag

SEQ ID NO: 8091602 - DNA, 22 bp, Homo sapiens
gcaggctcccttgcagagcagg

SEQ ID NO: 8091603 - DNA, 22 bp, Homo sapiens
gcaggctcgttggaagtcccct

SEQ ID NO: 8091604 - DNA, 22 bp, Homo sapiens
gcaggctccaactggaggagtt

SEQ ID NO: 8091605 - DNA, 22 bp, Homo sapiens
gcaggctcactctgtttggctc

SEQ ID NO: 8091606 - DNA, 22 bp, Homo sapiens
gcaggctcagagcagattagca

SEQ ID NO: 8091607 - DNA, 22 bp, Homo sapiens
gcaggctcaaaagctggtagga

SEQ ID NO: 8091608 - DNA, 22 bp, Homo sapiens
gcaggctcttctttctgcccag

SEQ ID NO: 8091609 - DNA, 22 bp, Homo sapiens
gcagcatccccaggcagcaggg

SEQ ID NO: 8091610 - DNA, 22 bp, Homo sapiens
gcagcatcaggttcactgcgtg

SEQ ID NO: 8091611 - DNA, 22 bp, Homo sapiens
gcagcaggtgtgcttttaatga

SEQ ID NO: 8091612 - DNA, 22 bp, Homo sapiens
gcagcagctctgaatgggcccc

SEQ ID NO: 8091613 - DNA, 22 bp, Homo sapiens
gcagcagctcagccgggcactg

SEQ ID NO: 8091614 - DNA, 22 bp, Homo sapiens
gcagcaggaatttaaatttata

SEQ ID NO: 8091615 - DNA, 22 bp, Homo sapiens
gcagcaggaataggataagcaa

SEQ ID NO: 8091616 - DNA, 22 bp, Homo sapiens
gcagcaggagagtttgtcctgc

SEQ ID NO: 8091617 - DNA, 22 bp, Homo sapiens
gcagcaggactgccgttaaagt

SEQ ID NO: 8091618 - DNA, 22 bp, Homo sapiens
gcagcaggagagtaatagcggt

SEQ ID NO: 8091619 - DNA, 22 bp, Homo sapiens
gcagcaggtctgtcaatgtcat

SEQ ID NO: 8091620 - DNA, 22 bp, Homo sapiens
gcagcaggcacttaccgttgct

SEQ ID NO: 8091621 - DNA, 22 bp, Homo sapiens
gcagcaggcacggtctcgacat

SEQ ID NO: 8091622 - DNA, 22 bp, Homo sapiens
gcagcaggatggccaattgcca

SEQ ID NO: 8091623 - DNA, 19 bp, Homo sapiens
gcacaggacatctgatgga

SEQ ID NO: 8091624 - DNA, 22 bp, Homo sapiens
gcacaggatgatgggttgaggg

SEQ ID NO: 8091625 - DNA, 22 bp, Homo sapiens
gcacaggcacagagggccactg

SEQ ID NO: 8091626 - DNA, 22 bp, Homo sapiens
gcaagcagatctccggagggaa

SEQ ID NO: 8091627 - DNA, 22 bp, Homo sapiens
gcaaatgacagactcaccttgg

SEQ ID NO: 8091628 - DNA, 22 bp, Homo sapiens
gaggggctggggttgactccaa

SEQ ID NO: 8091629 - DNA, 22 bp, Homo sapiens
gaggggctgggtagggcaaccc

SEQ ID NO: 8091630 - DNA, 22 bp, Homo sapiens
gaggggctgtggagctctctgg

SEQ ID NO: 8091631 - DNA, 22 bp, Homo sapiens
gagggggaaagtccctggagtc

SEQ ID NO: 8091632 - DNA, 22 bp, Homo sapiens
gaggggtgtggagccatcagtt

SEQ ID NO: 8091633 - DNA, 22 bp, Homo sapiens
gcactgagcaccagccacagat

SEQ ID NO: 8091634 - DNA, 22 bp, Homo sapiens
gcactgagctttggaggagcag

SEQ ID NO: 8091635 - DNA, 22 bp, Homo sapiens
gcactggagatacagagatgaa

SEQ ID NO: 8091636 - DNA, 22 bp, Homo sapiens
gcactggaaatacctagatgaa

SEQ ID NO: 8091637 - DNA, 22 bp, Homo sapiens
gcagaggacacaggagggcaag

SEQ ID NO: 8091638 - DNA, 22 bp, Homo sapiens
gcactgtgctaaacatgtatca

SEQ ID NO: 8091639 - DNA, 22 bp, Homo sapiens
gcactgtgctaaacatgtatca

SEQ ID NO: 8091640 - DNA, 22 bp, Homo sapiens
gcactgtgctagaagccagggg

SEQ ID NO: 8091641 - DNA, 22 bp, Homo sapiens
gcactgtgcttagttcactatt

SEQ ID NO: 8091642 - DNA, 22 bp, Homo sapiens
gcactgtgcttagttcactatt

SEQ ID NO: 8091643 - DNA, 22 bp, Homo sapiens
gcactgtgctaggtatcaggga

SEQ ID NO: 8091644 - DNA, 22 bp, Homo sapiens
gggcatgcaggactgtggcaga

SEQ ID NO: 8091645 - DNA, 22 bp, Homo sapiens
gggcctgcaggttctgagaggc

SEQ ID NO: 8091646 - DNA, 22 bp, Homo sapiens
gggctggctcccaggtgttgaa

SEQ ID NO: 8091647 - DNA, 22 bp, Homo sapiens
ggggcagctcccgagggcagga

SEQ ID NO: 8091648 - DNA, 22 bp, Homo sapiens
ggggcacacttttggtagatat

SEQ ID NO: 8091649 - DNA, 22 bp, Homo sapiens
ggggatggtagaccggtgacgt

SEQ ID NO: 8091650 - DNA, 22 bp, Homo sapiens
ggggatggaatgtagtagtgat

SEQ ID NO: 8091651 - DNA, 22 bp, Homo sapiens
gggctgggatggcttgaagatt

SEQ ID NO: 8091652 - DNA, 22 bp, Homo sapiens
gggctgggaatggctaagtatg

SEQ ID NO: 8091653 - DNA, 22 bp, Homo sapiens
gggctgggattgcttgctgtga

SEQ ID NO: 8091654 - DNA, 22 bp, Homo sapiens
gggctgggcatggtgttccctc

SEQ ID NO: 8091655 - DNA, 22 bp, Homo sapiens
gggctggggctcaataatttgt

SEQ ID NO: 8091656 - DNA, 22 bp, Homo sapiens
gggggcgcacagtcaccacaaa

SEQ ID NO: 8091657 - DNA, 22 bp, Homo sapiens
gggggcggagcacgtgaccacg

SEQ ID NO: 8091658 - DNA, 22 bp, Homo sapiens
ggtgcagggagaggcaggcccc

SEQ ID NO: 8091659 - DNA, 22 bp, Homo sapiens
ggtgccaggctgtagtcagggt

SEQ ID NO: 8091660 - DNA, 22 bp, Homo sapiens
ggtgccagtgggtctcaggata

SEQ ID NO: 8091661 - DNA, 22 bp, Homo sapiens
ggtgggagagcttgctttgatg

SEQ ID NO: 8091662 - DNA, 23 bp, Homo sapiens
ggtgggagattatccagaattat

SEQ ID NO: 8091663 - DNA, 22 bp, Homo sapiens
ggtgggagccaacacccttctg

SEQ ID NO: 8091664 - DNA, 22 bp, Homo sapiens
ggtgggaggcaggctgctccca

SEQ ID NO: 8091665 - DNA, 22 bp, Homo sapiens
ggtgggaggactgtttgaggca

SEQ ID NO: 8091666 - DNA, 22 bp, Homo sapiens
ggtgggagggctgcgttcctct

SEQ ID NO: 8091667 - DNA, 16 bp, Homo sapiens
ggtgggaggtgaggtg

SEQ ID NO: 8091668 - DNA, 22 bp, Homo sapiens
ggtgggagtggaacgtggaaga

SEQ ID NO: 8091669 - DNA, 22 bp, Homo sapiens
ggtgggagtgggcacagttacg

SEQ ID NO: 8091670 - DNA, 22 bp, Homo sapiens
gggtcaggctcagcagggcagc

SEQ ID NO: 8091671 - DNA, 22 bp, Homo sapiens
gggtcaggcctcaaggtgggct

SEQ ID NO: 8091672 - DNA, 22 bp, Homo sapiens
gggtcattctgaaaatgtaaac

SEQ ID NO: 8091673 - DNA, 22 bp, Homo sapiens
ggtagctgcagcaggctggcaa

SEQ ID NO: 8091674 - DNA, 22 bp, Homo sapiens
ggtccaggatcaaggcatcacc

SEQ ID NO: 8091675 - DNA, 16 bp, Homo sapiens
gtagccgtggccgctg

SEQ ID NO: 8091676 - DNA, 22 bp, Homo sapiens
gtagcccacctggggagggcga

SEQ ID NO: 8091677 - DNA, 22 bp, Homo sapiens
ggtgggcagctcttggcaggca

SEQ ID NO: 8091678 - DNA, 22 bp, Homo sapiens
ggtgggcacccgagactggatc

SEQ ID NO: 8091679 - DNA, 23 bp, Homo sapiens
gtcagggcagctcccagcccaac

SEQ ID NO: 8091680 - DNA, 23 bp, Homo sapiens
gtcagggctggggtcagagtgac

SEQ ID NO: 8091681 - DNA, 22 bp, Homo sapiens
gtcattcttaacaactcagtag

SEQ ID NO: 8091682 - DNA, 19 bp, Homo sapiens
gtcctctcaacaacccggg

SEQ ID NO: 8091683 - DNA, 22 bp, Homo sapiens
gtctcctccctttcattcacct

SEQ ID NO: 8091684 - DNA, 22 bp, Homo sapiens
gtctcctcttcatatacctgtt

SEQ ID NO: 8091685 - DNA, 23 bp, Homo sapiens
gtctcccatagcgctcccaggct

SEQ ID NO: 8091686 - DNA, 22 bp, Homo sapiens
gtctcccatctctgtccttgtg

SEQ ID NO: 8091687 - DNA, 22 bp, Homo sapiens
gtctccttgtggatctcaagga

SEQ ID NO: 8091688 - DNA, 22 bp, Homo sapiens
gtcttcaatagagcctcaattt

SEQ ID NO: 8091689 - DNA, 22 bp, Homo sapiens
gtcttcaacaataactaccact

SEQ ID NO: 8091690 - DNA, 22 bp, Homo sapiens
gtcttcctaatttgctattagg

SEQ ID NO: 8091691 - DNA, 22 bp, Homo sapiens
gtcttcttgttttgaaggaaat

SEQ ID NO: 8091692 - DNA, 22 bp, Homo sapiens
gtcttctttaacctactaaagc

SEQ ID NO: 8091693 - DNA, 22 bp, Homo sapiens
gtcttcttttcagtctgcttgt

SEQ ID NO: 8091694 - DNA, 22 bp, Homo sapiens
gtcttcttgtgttgcctgtctt

SEQ ID NO: 8091695 - DNA, 22 bp, Homo sapiens
gtgagggaggtagatttcatca

SEQ ID NO: 8091696 - DNA, 22 bp, Homo sapiens
gtgctgggtgctgcagacaggt

SEQ ID NO: 8091697 - DNA, 22 bp, Homo sapiens
gtgctgggattacaggtgtgag

SEQ ID NO: 8091698 - DNA, 22 bp, Homo sapiens
gtgctggggagataggaagaga

SEQ ID NO: 8091699 - DNA, 22 bp, Homo sapiens
gtgctgggggtttctgtaggtc

SEQ ID NO: 8091700 - DNA, 22 bp, Homo sapiens
gtgcaattcactgttatgtctg

SEQ ID NO: 8091701 - DNA, 20 bp, Homo sapiens
gtgcaatggcgcaatctcgg

SEQ ID NO: 8091702 - DNA, 22 bp, Homo sapiens
ggagcaagtcccaggcactagt

SEQ ID NO: 8091703 - DNA, 22 bp, Homo sapiens
ggagttggtgagcaccaggctt

SEQ ID NO: 8091704 - DNA, 22 bp, Homo sapiens
ggagttggaggctccagggaac

SEQ ID NO: 8091705 - DNA, 22 bp, Homo sapiens
ggatgggaacttggtagggcat

SEQ ID NO: 8091706 - DNA, 22 bp, Homo sapiens
ggatgggaacttggtagggcat

SEQ ID NO: 8091707 - DNA, 22 bp, Homo sapiens
ggatgctcagtgcctgtgtcca

SEQ ID NO: 8091708 - DNA, 22 bp, Homo sapiens
ggcagccatgctccaggtgcag

SEQ ID NO: 8091709 - DNA, 22 bp, Homo sapiens
ggcagccagtagggccagcctg

SEQ ID NO: 8091710 - DNA, 22 bp, Homo sapiens
ggcagccagcaatgagaagttt

SEQ ID NO: 8091711 - DNA, 22 bp, Homo sapiens
ggcagcagtaggagctaatctt

SEQ ID NO: 8091712 - DNA, 22 bp, Homo sapiens
ggcagcagtccatggcccaagg

SEQ ID NO: 8091713 - DNA, 22 bp, Homo sapiens
ggcagcagggctgtctccctac

SEQ ID NO: 8091714 - DNA, 22 bp, Homo sapiens
ggcagcagggctgtctccctac

SEQ ID NO: 8091715 - DNA, 19 bp, Homo sapiens
ggcagaaggtgtaggggga

SEQ ID NO: 8091716 - DNA, 22 bp, Homo sapiens
ggcagcagcaaggttggagctg

SEQ ID NO: 8091717 - DNA, 16 bp, Homo sapiens
ggcagcagctccgtgc

SEQ ID NO: 8091718 - DNA, 22 bp, Homo sapiens
ggcagcaggagccatctggtag

SEQ ID NO: 8091719 - DNA, 20 bp, Homo sapiens
ggcagcaggagtttcctctt

SEQ ID NO: 8091720 - DNA, 22 bp, Homo sapiens
ggcactgtttttgtattcagtt

SEQ ID NO: 8091721 - DNA, 22 bp, Homo sapiens
ggcactgattccattcatgaag

SEQ ID NO: 8091722 - DNA, 22 bp, Homo sapiens
ggcctaggaaggggatgtaact

SEQ ID NO: 8091723 - DNA, 22 bp, Homo sapiens
ggccaggagaggagggcactga

SEQ ID NO: 8091724 - DNA, 22 bp, Homo sapiens
ggccaggagctgcacagggctc

SEQ ID NO: 8091725 - DNA, 22 bp, Homo sapiens
ggccaggaggcaggggctcaat

SEQ ID NO: 8091726 - DNA, 22 bp, Homo sapiens
ggccaggcactgtgtgagatat

SEQ ID NO: 8091727 - DNA, 22 bp, Homo sapiens
ggccaggccaagagggttggaa

SEQ ID NO: 8091728 - DNA, 19 bp, Homo sapiens
ggcgggtggactggagccc

SEQ ID NO: 8091729 - DNA, 22 bp, Homo sapiens
ggcagtggtgggaggctcgctc

SEQ ID NO: 8091730 - DNA, 20 bp, Homo sapiens
ggcatgagatgtgagggagg

SEQ ID NO: 8091731 - DNA, 22 bp, Homo sapiens
ggcaggaggaagagttagcacc

SEQ ID NO: 8091732 - DNA, 18 bp, Homo sapiens
ggcaggggtgaaccacag

SEQ ID NO: 8091733 - DNA, 22 bp, Homo sapiens
ggcagtgggttccccaaggcac

SEQ ID NO: 8091734 - DNA, 22 bp, Homo sapiens
ggcaggtgacctggcctcccag

SEQ ID NO: 8091735 - DNA, 18 bp, Homo sapiens
ggctgcttaaggagatcc

SEQ ID NO: 8091736 - DNA, 18 bp, Homo sapiens
ggctgaggttgactagaa

SEQ ID NO: 8091737 - DNA, 22 bp, Homo sapiens
ggctgaggtgtggggaactata

SEQ ID NO: 8091738 - DNA, 22 bp, Homo sapiens
ggctgagggccagggctagtct

SEQ ID NO: 8091739 - DNA, 22 bp, Homo sapiens
ggctgaggggcccagaggaaca

SEQ ID NO: 8091740 - DNA, 22 bp, Homo sapiens
ggctgtgccctcacatggggca

SEQ ID NO: 8091741 - DNA, 20 bp, Homo sapiens
ggctgtgcccttccgtggcc

SEQ ID NO: 8091742 - DNA, 22 bp, Homo sapiens
ggctgtgcaccatccacctccc

SEQ ID NO: 8091743 - DNA, 17 bp, Homo sapiens
ggctgtgccaggtgaga

SEQ ID NO: 8091744 - DNA, 22 bp, Homo sapiens
ggctgggtcccagctgggagga

SEQ ID NO: 8091745 - DNA, 21 bp, Homo sapiens
ggctgggtcatgcagctggcc

SEQ ID NO: 8091746 - DNA, 22 bp, Homo sapiens
ggctcctctctggccgctcccg

SEQ ID NO: 8091747 - DNA, 22 bp, Homo sapiens
ggcgtgggaagtggggcttctg

SEQ ID NO: 8091748 - DNA, 22 bp, Homo sapiens
ggcggtggttgagaggacggcg

SEQ ID NO: 8091749 - DNA, 22 bp, Homo sapiens
ggcggtggcgtgaaggtggctg

SEQ ID NO: 8091750 - DNA, 22 bp, Homo sapiens
ggctcccaggagggcctggagg

SEQ ID NO: 8091751 - DNA, 22 bp, Homo sapiens
ggctccccaggtccaggagctg

SEQ ID NO: 8091752 - DNA, 22 bp, Homo sapiens
ggctccctgcaacctccgcctc

SEQ ID NO: 8091753 - DNA, 22 bp, Homo sapiens
ggctccctgcctgtcctcagtc

SEQ ID NO: 8091754 - DNA, 22 bp, Homo sapiens
ggctccctgggtgctcctgctc

SEQ ID NO: 8091755 - DNA, 22 bp, Homo sapiens
ggctccctggaaatcccgaggc

SEQ ID NO: 8091756 - DNA, 22 bp, Homo sapiens
gggcagtgacaaaggggatgaa

SEQ ID NO: 8091757 - DNA, 19 bp, Homo sapiens
gggcagtggcactagggag

SEQ ID NO: 8091758 - DNA, 22 bp, Homo sapiens
gggcagtgaatattggtgggaa

SEQ ID NO: 8091759 - DNA, 22 bp, Homo sapiens
gggcactgagtggatgatgcag

SEQ ID NO: 8091760 - DNA, 22 bp, Homo sapiens
gggcacctggctagtgacagtg

SEQ ID NO: 8091761 - DNA, 21 bp, Homo sapiens
gggcacccttagcctcctctg

SEQ ID NO: 8091762 - DNA, 22 bp, Homo sapiens
gggcaccttgggtctcaggcaa

SEQ ID NO: 8091763 - DNA, 22 bp, Homo sapiens
gggcacagtctaaagttgggcc

SEQ ID NO: 8091764 - DNA, 22 bp, Homo sapiens
gggcacagtctgcagcccccca

SEQ ID NO: 8091765 - DNA, 22 bp, Homo sapiens
gggcacagtctaaagttgggcc

SEQ ID NO: 8091766 - DNA, 22 bp, Homo sapiens
gggaggtgattaggaccatgta

SEQ ID NO: 8091767 - DNA, 22 bp, Homo sapiens
gggagggccaggctcacccagg

SEQ ID NO: 8091768 - DNA, 22 bp, Homo sapiens
gggaggtgttctgccaacgcgg

SEQ ID NO: 8091769 - DNA, 22 bp, Homo sapiens
gggcacagtactccaatcaact

SEQ ID NO: 8091770 - DNA, 22 bp, Homo sapiens
gggagctggatcgcgcgcccgg

SEQ ID NO: 8091771 - DNA, 22 bp, Homo sapiens
gggagctggatgattgaggcaa

SEQ ID NO: 8091772 - DNA, 22 bp, Homo sapiens
gggagctgagctctgagccacg

SEQ ID NO: 8091773 - DNA, 22 bp, Homo sapiens
gggagctgagggacctctgtgg

SEQ ID NO: 8091774 - DNA, 22 bp, Homo sapiens
gggagctgaggagccccgtcgg

SEQ ID NO: 8091775 - DNA, 22 bp, Homo sapiens
gggagctggagctggaagactc

SEQ ID NO: 8091776 - DNA, 21 bp, Homo sapiens
gggagctgacagcagcacggc

SEQ ID NO: 8091777 - DNA, 22 bp, Homo sapiens
ggctttattttgcatgaatgct

SEQ ID NO: 8091778 - DNA, 22 bp, Homo sapiens
gggaagggagggacctcagtct

SEQ ID NO: 8091779 - DNA, 22 bp, Homo sapiens
gggaagggacttgtttaaggtc

SEQ ID NO: 8091780 - DNA, 22 bp, Homo sapiens
ggctgtgcctcaaggctactca

SEQ ID NO: 8091781 - DNA, 22 bp, Homo sapiens
ggctgtgcgggcagccgtggga

SEQ ID NO: 8091782 - DNA, 22 bp, Homo sapiens
ggctttatagggtagaggatca

SEQ ID NO: 8091783 - DNA, 22 bp, Homo sapiens
ggctttatgcagggatagaaat

SEQ ID NO: 8091784 - DNA, 22 bp, Homo sapiens
ggctttatgcacagcagatggt

SEQ ID NO: 8091785 - DNA, 22 bp, Homo sapiens
ggctttatcaaatgagaccctg

SEQ ID NO: 8091786 - DNA, 22 bp, Homo sapiens
ggctttatattgtttgagcaga

SEQ ID NO: 8091787 - DNA, 22 bp, Homo sapiens
ggctttattatgtggccatgtg

SEQ ID NO: 8091788 - DNA, 22 bp, Homo sapiens
ggctttatttgcagccattgtt

SEQ ID NO: 8091789 - DNA, 22 bp, Homo sapiens
ggctttatttcactgtaccata

SEQ ID NO: 8091790 - DNA, 21 bp, Homo sapiens
ggctttatgctcacccagcct

SEQ ID NO: 8091791 - DNA, 22 bp, Homo sapiens
ggctttatgtttttcatgtggt

SEQ ID NO: 8091792 - DNA, 22 bp, Homo sapiens
ggctttattaactcatccgtaa

SEQ ID NO: 8091793 - DNA, 22 bp, Homo sapiens
ggctttattaagcagggtaagt

SEQ ID NO: 8091794 - DNA, 23 bp, Homo sapiens
ttcagggcctcagaggtgaagct

SEQ ID NO: 8091795 - DNA, 20 bp, Homo sapiens
cgcagcagtggaagtggaat

SEQ ID NO: 8091796 - DNA, 22 bp, Homo sapiens
cggctgggttcggctgcaggcc

SEQ ID NO: 8091797 - DNA, 22 bp, Homo sapiens
ctaaatgatggatttaaacttt

SEQ ID NO: 8091798 - DNA, 22 bp, Homo sapiens
ttcctctcctcccaccaggtga

SEQ ID NO: 8091799 - DNA, 22 bp, Homo sapiens
cgtcccgggttcacgccattct

SEQ ID NO: 8091800 - DNA, 22 bp, Homo sapiens
cgtcctgggtctgggaaggcat

SEQ ID NO: 8091801 - DNA, 21 bp, Homo sapiens
ttctccttcttgatccaagca

SEQ ID NO: 8091802 - DNA, 22 bp, Homo sapiens
ttctccttgaaaagctgcatct

SEQ ID NO: 8091803 - DNA, 22 bp, Homo sapiens
ttctccttcctggttttcaggc

SEQ ID NO: 8091804 - DNA, 22 bp, Homo sapiens
ttctccttattcatagttgtct

SEQ ID NO: 8091805 - DNA, 22 bp, Homo sapiens
ttctcctttgtaattctcatcc

SEQ ID NO: 8091806 - DNA, 22 bp, Homo sapiens
ttctcctttcattccctgtaga

SEQ ID NO: 8091807 - DNA, 22 bp, Homo sapiens
ttctccttggtttatgggacat

SEQ ID NO: 8091808 - DNA, 22 bp, Homo sapiens
ttctccttgttcccttcaattg

SEQ ID NO: 8091809 - DNA, 22 bp, Homo sapiens
ctacatttacacagttaggctt

SEQ ID NO: 8091810 - DNA, 22 bp, Homo sapiens
ttctaccattgggaaaacagcc

SEQ ID NO: 8091811 - DNA, 22 bp, Homo sapiens
ttctgaaagccaattcattgaa

SEQ ID NO: 8091812 - DNA, 22 bp, Homo sapiens
ttctcttttgtgatgtgagatg

SEQ ID NO: 8091813 - DNA, 22 bp, Homo sapiens
ttcttaactcaaatatatatcc

SEQ ID NO: 8091814 - DNA, 22 bp, Homo sapiens
ttcttaactggaaaatgtcaga

SEQ ID NO: 8091815 - DNA, 22 bp, Homo sapiens
ttcttcaggaagagcctggact

SEQ ID NO: 8091816 - DNA, 22 bp, Homo sapiens
ttcttcagtcccactagccaca

SEQ ID NO: 8091817 - DNA, 22 bp, Homo sapiens
ttcttcatgctgttgctgcttg

SEQ ID NO: 8091818 - DNA, 21 bp, Homo sapiens
ttcttcagtttaatataaaat

SEQ ID NO: 8091819 - DNA, 22 bp, Homo sapiens
ttcttcagtttggtaaatgtaa

SEQ ID NO: 8091820 - DNA, 22 bp, Homo sapiens
ttcttcagtgtagcaactgtat

SEQ ID NO: 8091821 - DNA, 22 bp, Homo sapiens
ttgaaatatcaagttattagtg

SEQ ID NO: 8091822 - DNA, 22 bp, Homo sapiens
ttgaagttgtagttcagtgaag

SEQ ID NO: 8091823 - DNA, 22 bp, Homo sapiens
ttgcctattgttcttacatgtt

SEQ ID NO: 8091824 - DNA, 22 bp, Homo sapiens
ttgcactaggaaaaggcagcca

SEQ ID NO: 8091825 - DNA, 23 bp, Homo sapiens
ttgcacattggagctggtcttct

SEQ ID NO: 8091826 - DNA, 22 bp, Homo sapiens
ttgctgggtcagaagccaggag

SEQ ID NO: 8091827 - DNA, 22 bp, Homo sapiens
ctcaggctaagaaggccaagtg

SEQ ID NO: 8091828 - DNA, 22 bp, Homo sapiens
ttgctgtagctcatttcactct

SEQ ID NO: 8091829 - DNA, 22 bp, Homo sapiens
ctcagccagacatgacccagtc

SEQ ID NO: 8091830 - DNA, 22 bp, Homo sapiens
ctcaggccattcctaccaaggg

SEQ ID NO: 8091831 - DNA, 20 bp, Homo sapiens
ccttctccagcttgttcttg

SEQ ID NO: 8091832 - DNA, 22 bp, Homo sapiens
ccttcttctgtgtggcccaaga

SEQ ID NO: 8091833 - DNA, 22 bp, Homo sapiens
ccttctgctggtcatcccagtg

SEQ ID NO: 8091834 - DNA, 22 bp, Homo sapiens
ttacctaaaatagctcaattta

SEQ ID NO: 8091835 - DNA, 22 bp, Homo sapiens
ttaccaggaggcattctctgaa

SEQ ID NO: 8091836 - DNA, 22 bp, Homo sapiens
ccttgggaggctcccagggaga

SEQ ID NO: 8091837 - DNA, 22 bp, Homo sapiens
ttaccttgtaaaacatattcct

SEQ ID NO: 8091838 - DNA, 22 bp, Homo sapiens
ttatcctggattatatatgtga

SEQ ID NO: 8091839 - DNA, 22 bp, Homo sapiens
ttatctacgtatttaaactctt

SEQ ID NO: 8091840 - DNA, 22 bp, Homo sapiens
cgcagcagccccgtggtaggtg

SEQ ID NO: 8091841 - DNA, 22 bp, Homo sapiens
ttatttcattgatttctaagac

SEQ ID NO: 8091842 - DNA, 22 bp, Homo sapiens
ttattcacctctattagactca

SEQ ID NO: 8091843 - DNA, 22 bp, Homo sapiens
ttattcactcatttaacattat

SEQ ID NO: 8091844 - DNA, 22 bp, Homo sapiens
ttattcaccagtgtaaaacact

SEQ ID NO: 8091845 - DNA, 22 bp, Homo sapiens
cctttctgatggcctcccagcc

SEQ ID NO: 8091846 - DNA, 22 bp, Homo sapiens
ttatgtacctgaattagtaaag

SEQ ID NO: 8091847 - DNA, 22 bp, Homo sapiens
ttatgtactctgcaatgtttga

SEQ ID NO: 8091848 - DNA, 17 bp, Homo sapiens
cgagggcttgctggctc

SEQ ID NO: 8091849 - DNA, 22 bp, Homo sapiens
cgcaccactgaattccagcctg

SEQ ID NO: 8091850 - DNA, 22 bp, Homo sapiens
cgagtccagggttaggagtccg

SEQ ID NO: 8091851 - DNA, 22 bp, Homo sapiens
tggttcctacgcacattgaatt

SEQ ID NO: 8091852 - DNA, 22 bp, Homo sapiens
tgtttctaggtcaataattttt

SEQ ID NO: 8091853 - DNA, 22 bp, Homo sapiens
tgtttctagagaaaatatttac

SEQ ID NO: 8091854 - DNA, 22 bp, Homo sapiens
cctgtcacgatgactgcactct

SEQ ID NO: 8091855 - DNA, 22 bp, Homo sapiens
ttaaaagagcagcccagcatat

SEQ ID NO: 8091856 - DNA, 22 bp, Homo sapiens
ttaaaatagccagtgcccctct

SEQ ID NO: 8091857 - DNA, 22 bp, Homo sapiens
ctgaaactccatgagaaattgc

SEQ ID NO: 8091858 - DNA, 22 bp, Homo sapiens
ctgaaaaatatgttttggagaa

SEQ ID NO: 8091859 - DNA, 22 bp, Homo sapiens
ctgaaaaacgggatttggctgg

SEQ ID NO: 8091860 - DNA, 22 bp, Homo sapiens
ctgaagttattgtacaaatttg

SEQ ID NO: 8091861 - DNA, 22 bp, Homo sapiens
ttttctctatattgtctgtgaa

SEQ ID NO: 8091862 - DNA, 22 bp, Homo sapiens
ttttcagttccatctctgctct

SEQ ID NO: 8091863 - DNA, 22 bp, Homo sapiens
ctgaagttctacaagcctcagg

SEQ ID NO: 8091864 - DNA, 22 bp, Homo sapiens
ctgaagttcatacaatggccat

SEQ ID NO: 8091865 - DNA, 22 bp, Homo sapiens
ctgagcttggcttatctccagc

SEQ ID NO: 8091866 - DNA, 22 bp, Homo sapiens
ctgagcttccagttcctccagg

SEQ ID NO: 8091867 - DNA, 22 bp, Homo sapiens
ctgaggaagacagcagctgtgt

SEQ ID NO: 8091868 - DNA, 22 bp, Homo sapiens
ctgaggaatgagtgaggagcca

SEQ ID NO: 8091869 - DNA, 22 bp, Homo sapiens
ctgagggagagaatggggcaaa

SEQ ID NO: 8091870 - DNA, 22 bp, Homo sapiens
ctgagggagacagtgcggacta

SEQ ID NO: 8091871 - DNA, 18 bp, Homo sapiens
ctgagggcaacagaggct

SEQ ID NO: 8091872 - DNA, 22 bp, Homo sapiens
ctgagggccctgaagcttggca

SEQ ID NO: 8091873 - DNA, 22 bp, Homo sapiens
ctgctcctgtccagcagggcca

SEQ ID NO: 8091874 - DNA, 22 bp, Homo sapiens
ctgctccccagcctgcgccttt

SEQ ID NO: 8091875 - DNA, 19 bp, Homo sapiens
ctgctccctccttctggca

SEQ ID NO: 8091876 - DNA, 22 bp, Homo sapiens
ctgcctgcgccaccaccacgtc

SEQ ID NO: 8091877 - DNA, 22 bp, Homo sapiens
ctgcctgcatgctgccatagct

SEQ ID NO: 8091878 - DNA, 19 bp, Homo sapiens
ctgctctccttgacttgga

SEQ ID NO: 8091879 - DNA, 22 bp, Homo sapiens
ctgcagtaacgatcatggtgcc

SEQ ID NO: 8091880 - DNA, 21 bp, Homo sapiens
ctgagggccgcagctgggctc

SEQ ID NO: 8091881 - DNA, 22 bp, Homo sapiens
ctgcagtgcctgccactgagcc

SEQ ID NO: 8091882 - DNA, 22 bp, Homo sapiens
ctgcccctgctcatggctgtcc

SEQ ID NO: 8091883 - DNA, 22 bp, Homo sapiens
ctgcatcacagcaggaggcaca

SEQ ID NO: 8091884 - DNA, 22 bp, Homo sapiens
ctgccctgcttgatgacagcga

SEQ ID NO: 8091885 - DNA, 22 bp, Homo sapiens
ctgccctgagtcatgccagatg

SEQ ID NO: 8091886 - DNA, 22 bp, Homo sapiens
ctgccctgcagctccacggact

SEQ ID NO: 8091887 - DNA, 22 bp, Homo sapiens
ctgcccctggtgatggacgcca

SEQ ID NO: 8091888 - DNA, 22 bp, Homo sapiens
ctgcccctggctggtgaagcag

SEQ ID NO: 8091889 - DNA, 22 bp, Homo sapiens
ctgcctctattcactgaggcag

SEQ ID NO: 8091890 - DNA, 22 bp, Homo sapiens
ctgccctgggccaggaagcggc

SEQ ID NO: 8091891 - DNA, 22 bp, Homo sapiens
ctgccctgggagtacctgtcct

SEQ ID NO: 8091892 - DNA, 22 bp, Homo sapiens
ctccctggcagccgcactcctg

SEQ ID NO: 8091893 - DNA, 22 bp, Homo sapiens
ctccctggcacagcgagaggtt

SEQ ID NO: 8091894 - DNA, 22 bp, Homo sapiens
ctccctcacacccttgcccaga

SEQ ID NO: 8091895 - DNA, 22 bp, Homo sapiens
ctccctggaggtgagctggcac

SEQ ID NO: 8091896 - DNA, 22 bp, Homo sapiens
ctccgcagcgggccaatccgga

SEQ ID NO: 8091897 - DNA, 22 bp, Homo sapiens
ctccctggtgtcccctccagga

SEQ ID NO: 8091898 - DNA, 19 bp, Homo sapiens
ctcctcagtcccagaggtc

SEQ ID NO: 8091899 - DNA, 21 bp, Homo sapiens
ctcctcaggaccagccacagg

SEQ ID NO: 8091900 - DNA, 22 bp, Homo sapiens
ctcctcagggctggttacatgg

SEQ ID NO: 8091901 - DNA, 22 bp, Homo sapiens
ctcctcagtcaggtctagggtc

SEQ ID NO: 8091902 - DNA, 22 bp, Homo sapiens
ctcccaggggaactatcaagta

SEQ ID NO: 8091903 - DNA, 22 bp, Homo sapiens
ctcaggcttgggaggaggccca

SEQ ID NO: 8091904 - DNA, 22 bp, Homo sapiens
ctcctgagctgcagccttgtgt

SEQ ID NO: 8091905 - DNA, 22 bp, Homo sapiens
ctcctcagttgtcccatggaga

SEQ ID NO: 8091906 - DNA, 22 bp, Homo sapiens
tttacaattctctaccagtgtt

SEQ ID NO: 8091907 - DNA, 22 bp, Homo sapiens
tttacaatagggtctgaatgaa

SEQ ID NO: 8091908 - DNA, 21 bp, Homo sapiens
ctcgtacctgctttccttcta

SEQ ID NO: 8091909 - DNA, 22 bp, Homo sapiens
tttcaaagttgggaattgtaat

SEQ ID NO: 8091910 - DNA, 22 bp, Homo sapiens
tttcaaagtcaatatcattacc

SEQ ID NO: 8091911 - DNA, 20 bp, Homo sapiens
ctctcacagctccctcagcc

SEQ ID NO: 8091912 - DNA, 22 bp, Homo sapiens
ctctcaaatgtcattcctctat

SEQ ID NO: 8091913 - DNA, 22 bp, Homo sapiens
tttctctgctgtgttggcagct

SEQ ID NO: 8091914 - DNA, 22 bp, Homo sapiens
ctctgagctgaaacatgagcat

SEQ ID NO: 8091915 - DNA, 19 bp, Homo sapiens
ctctggagcagacactgga

SEQ ID NO: 8091916 - DNA, 23 bp, Homo sapiens
tttgaagttgactgccttccaga

SEQ ID NO: 8091917 - DNA, 22 bp, Homo sapiens
tttcttagtcctagagtgattt

SEQ ID NO: 8091918 - DNA, 22 bp, Homo sapiens
ctctgcctgccactgttcaggc

SEQ ID NO: 8091919 - DNA, 22 bp, Homo sapiens
gagagaaatgtgcagtttgggc

SEQ ID NO: 8091920 - DNA, 22 bp, Homo sapiens
gagagggcaaacttgtagctaa

SEQ ID NO: 8091921 - DNA, 22 bp, Homo sapiens
gagagggccgggggccagctcc

SEQ ID NO: 8091922 - DNA, 22 bp, Homo sapiens
gagagggctctgtgtgggtact

SEQ ID NO: 8091923 - DNA, 22 bp, Homo sapiens
gagagggcaaggtagatgctac

SEQ ID NO: 8091924 - DNA, 21 bp, Homo sapiens
gagagggcattataggaagtg

SEQ ID NO: 8091925 - DNA, 22 bp, Homo sapiens
gagactttttaatcactaggaa

SEQ ID NO: 8091926 - DNA, 22 bp, Homo sapiens
gagactttctgatctcactcat

SEQ ID NO: 8091927 - DNA, 22 bp, Homo sapiens
gagactttaaaaaacattaaga

SEQ ID NO: 8091928 - DNA, 22 bp, Homo sapiens
gactgcaaccttagactagaaa

SEQ ID NO: 8091929 - DNA, 21 bp, Homo sapiens
gactgcaagcgaggctgtgaa

SEQ ID NO: 8091930 - DNA, 22 bp, Homo sapiens
gagaccaggaagtacagcagcc

SEQ ID NO: 8091931 - DNA, 22 bp, Homo sapiens
gactcctcagtcaccctcagct

SEQ ID NO: 8091932 - DNA, 22 bp, Homo sapiens
gactcccctgggccccatccag

SEQ ID NO: 8091933 - DNA, 22 bp, Homo sapiens
gactctggttgcgggttctgct

SEQ ID NO: 8091934 - DNA, 22 bp, Homo sapiens
gactctggtgacttgacctgta

SEQ ID NO: 8091935 - DNA, 22 bp, Homo sapiens
gactctgggaggtggactgagg

SEQ ID NO: 8091936 - DNA, 22 bp, Homo sapiens
gactctggcctcatccctgagg

SEQ ID NO: 8091937 - DNA, 22 bp, Homo sapiens
gacagacatttcctgatccaat

SEQ ID NO: 8091938 - DNA, 22 bp, Homo sapiens
gacagcagataagacctcatca

SEQ ID NO: 8091939 - DNA, 22 bp, Homo sapiens
gacagcagatgaagcctgcaga

SEQ ID NO: 8091940 - DNA, 22 bp, Homo sapiens
gaagggagaaggttgggtgacg

SEQ ID NO: 8091941 - DNA, 22 bp, Homo sapiens
gaaagctgggaaataaatatta

SEQ ID NO: 8091942 - DNA, 22 bp, Homo sapiens
gaaggggaaagttgagcaaata

SEQ ID NO: 8091943 - DNA, 19 bp, Homo sapiens
gaaggggaaggtgggtacc

SEQ ID NO: 8091944 - DNA, 22 bp, Homo sapiens
gaaggggactggcagctgcaga

SEQ ID NO: 8091945 - DNA, 22 bp, Homo sapiens
gacagacaggaggcattcaggg

SEQ ID NO: 8091946 - DNA, 22 bp, Homo sapiens
gacagacacaattgatccatga

SEQ ID NO: 8091947 - DNA, 22 bp, Homo sapiens
gacagaactcaaacatgagaag

SEQ ID NO: 8091948 - DNA, 22 bp, Homo sapiens
gagggctgtggggcatgaccag

SEQ ID NO: 8091949 - DNA, 22 bp, Homo sapiens
gagggctgtgaaggagcgggtt

SEQ ID NO: 8091950 - DNA, 22 bp, Homo sapiens
gaggggctgggcagtccctgga

SEQ ID NO: 8091951 - DNA, 22 bp, Homo sapiens
gaggggctggctgtggtcccat

SEQ ID NO: 8091952 - DNA, 22 bp, Homo sapiens
gagggctgatgttgccacctca

SEQ ID NO: 8091953 - DNA, 22 bp, Homo sapiens
gagggctgccacgttgggcgag

SEQ ID NO: 8091954 - DNA, 22 bp, Homo sapiens
gaggctgcactggctaaaggct

SEQ ID NO: 8091955 - DNA, 22 bp, Homo sapiens
gaggctgcagctatcagacatt

SEQ ID NO: 8091956 - DNA, 22 bp, Homo sapiens
gaggctgcaggcaatgctgccc

SEQ ID NO: 8091957 - DNA, 22 bp, Homo sapiens
gagggaggggagctccaccctc

SEQ ID NO: 8091958 - DNA, 22 bp, Homo sapiens
gagggaggggagctccaccctc

SEQ ID NO: 8091959 - DNA, 22 bp, Homo sapiens
gagggaggcatcatgaatccag

SEQ ID NO: 8091960 - DNA, 22 bp, Homo sapiens
gaggcagcttggggctgtgggt

SEQ ID NO: 8091961 - DNA, 22 bp, Homo sapiens
gaggcagttcctgagtgacaag

SEQ ID NO: 8091962 - DNA, 22 bp, Homo sapiens
gaggctccagcgacacctaggc

SEQ ID NO: 8091963 - DNA, 22 bp, Homo sapiens
gagctgctggctcctcaggtta

SEQ ID NO: 8091964 - DNA, 22 bp, Homo sapiens
gagctgagggtctaggagggtt

SEQ ID NO: 8091965 - DNA, 22 bp, Homo sapiens
gagctgaggctgaggcctcact

SEQ ID NO: 8091966 - DNA, 22 bp, Homo sapiens
gagctgagcctgggtggaccgc

SEQ ID NO: 8091967 - DNA, 22 bp, Homo sapiens
gagctgagatcatgtacactag

SEQ ID NO: 8091968 - DNA, 22 bp, Homo sapiens
gagaggggcccaagccacatag

SEQ ID NO: 8091969 - DNA, 22 bp, Homo sapiens
gagagggctggaaacttcctgg

SEQ ID NO: 8091970 - DNA, 22 bp, Homo sapiens
gagagggctgcctggtgtgagg

SEQ ID NO: 8091971 - DNA, 21 bp, Homo sapiens
gagcatggcttacatcagcag

SEQ ID NO: 8091972 - DNA, 22 bp, Homo sapiens
gagcatggatcatgtgctgggt

SEQ ID NO: 8091973 - DNA, 22 bp, Homo sapiens
gagcccaggaagtggaggctga

SEQ ID NO: 8091974 - DNA, 22 bp, Homo sapiens
gagcccagcttgcacatggagc

SEQ ID NO: 8091975 - DNA, 22 bp, Homo sapiens
gagcccagcttgcacatggagc

SEQ ID NO: 8091976 - DNA, 22 bp, Homo sapiens
gagcccagctgtccttggcaaa

SEQ ID NO: 8091977 - DNA, 22 bp, Homo sapiens
gagcccagctgtccttggcaaa

SEQ ID NO: 8091978 - DNA, 22 bp, Homo sapiens
gagcccaggaagtggaggctga

SEQ ID NO: 8091979 - DNA, 22 bp, Homo sapiens
gagcccaggagtttgatgctgc

SEQ ID NO: 8091980 - DNA, 22 bp, Homo sapiens
gagcccaggatggtgtatggct

SEQ ID NO: 8091981 - DNA, 22 bp, Homo sapiens
gagcccagattggaatttccca

SEQ ID NO: 8091982 - DNA, 22 bp, Homo sapiens
gagcccagcccagagccatatg

SEQ ID NO: 8091983 - DNA, 22 bp, Homo sapiens
gagcccagctctacctcagact

SEQ ID NO: 8091984 - DNA, 22 bp, Homo sapiens
gagcccagctctacctcagact

SEQ ID NO: 8091985 - DNA, 22 bp, Homo sapiens
gagcccagcccagagccatatg

SEQ ID NO: 8091986 - DNA, 22 bp, Homo sapiens
gagcccagctaaatttatataa

SEQ ID NO: 8091987 - DNA, 22 bp, Homo sapiens
gagcccagctgcggccctcagc

SEQ ID NO: 8091988 - DNA, 22 bp, Homo sapiens
gagcccagctgcggccctcagc

SEQ ID NO: 8091989 - DNA, 22 bp, Homo sapiens
gagcccaggctggggttcagag

SEQ ID NO: 8091990 - DNA, 21 bp, Homo sapiens
gagcccaggcatctcattaat

SEQ ID NO: 8091991 - DNA, 22 bp, Homo sapiens
gagcccaggcagaggttgcagt

SEQ ID NO: 8091992 - DNA, 22 bp, Homo sapiens
gagcccagggtgaaatagcagc

SEQ ID NO: 8091993 - DNA, 22 bp, Homo sapiens
gagcccagggtgaaatagcagc

SEQ ID NO: 8091994 - DNA, 22 bp, Homo sapiens
gagcccagggcaggcaaggcag

SEQ ID NO: 8091995 - DNA, 22 bp, Homo sapiens
gagcccagggcaggcaaggcag

SEQ ID NO: 8091996 - DNA, 22 bp, Homo sapiens
gagcccaggttctgcttccagc

SEQ ID NO: 8091997 - DNA, 22 bp, Homo sapiens
gagcccaggttctgcttccagc

SEQ ID NO: 8091998 - DNA, 22 bp, Homo sapiens
gagcccagtaggcaaagctgca

SEQ ID NO: 8091999 - DNA, 22 bp, Homo sapiens
gagcccagtaggcaaagctgca

SEQ ID NO: 8092000 - DNA, 22 bp, Homo sapiens
gagcccagtctgctcctgcgcc

SEQ ID NO: 8092001 - DNA, 22 bp, Homo sapiens
ctgggccttatgagtacctgga

SEQ ID NO: 8092002 - DNA, 22 bp, Homo sapiens
ctgggccttcattgctctccca

SEQ ID NO: 8092003 - DNA, 22 bp, Homo sapiens
ctgggccttgccttgcccacag

SEQ ID NO: 8092004 - DNA, 22 bp, Homo sapiens
ctgggcctgtgactcccatcct

SEQ ID NO: 8092005 - DNA, 22 bp, Homo sapiens
ctgggccttagggcactccctt

SEQ ID NO: 8092006 - DNA, 22 bp, Homo sapiens
ctgggcctggtgtggcacctgc

SEQ ID NO: 8092007 - DNA, 22 bp, Homo sapiens
ctgggccttggattgacactgt

SEQ ID NO: 8092008 - DNA, 22 bp, Homo sapiens
ctgggcgcgtcccctgaggcgg

SEQ ID NO: 8092009 - DNA, 22 bp, Homo sapiens
ctgggagcgcagcaggcacaac

SEQ ID NO: 8092010 - DNA, 22 bp, Homo sapiens
ctgggagcaagtcaggaaaggt

SEQ ID NO: 8092011 - DNA, 22 bp, Homo sapiens
ctgggcacttgctcacagctct

SEQ ID NO: 8092012 - DNA, 22 bp, Homo sapiens
ctgggcactgcagcaggcatca

SEQ ID NO: 8092013 - DNA, 22 bp, Homo sapiens
ctgggcagctgtatcagggagt

SEQ ID NO: 8092014 - DNA, 22 bp, Homo sapiens
ctgggcagctaccaccactgct

SEQ ID NO: 8092015 - DNA, 22 bp, Homo sapiens
ctgggcagaattttaggatggc

SEQ ID NO: 8092016 - DNA, 22 bp, Homo sapiens
ctgggcactttggggagcctac

SEQ ID NO: 8092017 - DNA, 22 bp, Homo sapiens
ctgggcagcctcacacaatgtt

SEQ ID NO: 8092018 - DNA, 22 bp, Homo sapiens
ctgggcagagctaacacctgag

SEQ ID NO: 8092019 - DNA, 22 bp, Homo sapiens
ctgggcagagtccggaagatgg

SEQ ID NO: 8092020 - DNA, 22 bp, Homo sapiens
ctgggacttgcagagcaggagg

SEQ ID NO: 8092021 - DNA, 22 bp, Homo sapiens
ctgggacagttcaggtagggca

SEQ ID NO: 8092022 - DNA, 23 bp, Homo sapiens
ctgggacatggtaggggcacaac

SEQ ID NO: 8092023 - DNA, 23 bp, Homo sapiens
ctgggacatggtaggggcacaac

SEQ ID NO: 8092024 - DNA, 22 bp, Homo sapiens
ctgggacccacacctggaatct

SEQ ID NO: 8092025 - DNA, 22 bp, Homo sapiens
ctgggacacccagagctgcaga

SEQ ID NO: 8092026 - DNA, 22 bp, Homo sapiens
ctgggacagagcagcagtgggg

SEQ ID NO: 8092027 - DNA, 22 bp, Homo sapiens
ctgcttcatatttcatagtgat

SEQ ID NO: 8092028 - DNA, 22 bp, Homo sapiens
ctgcttcagcaaagctatttgc

SEQ ID NO: 8092029 - DNA, 22 bp, Homo sapiens
ctgcttcacttcggttgcatag

SEQ ID NO: 8092030 - DNA, 22 bp, Homo sapiens
ctgcttcaaggaaatgaatcgg

SEQ ID NO: 8092031 - DNA, 22 bp, Homo sapiens
ctgtcaacacgggtgtgcgtgc

SEQ ID NO: 8092032 - DNA, 22 bp, Homo sapiens
ctgtcaaattcataacacttat

SEQ ID NO: 8092033 - DNA, 19 bp, Homo sapiens
ctgtcaaccccatgggagt

SEQ ID NO: 8092034 - DNA, 22 bp, Homo sapiens
ctgtgcttacctgcccaggtga

SEQ ID NO: 8092035 - DNA, 22 bp, Homo sapiens
ctgtaaaacactgtagtatctg

SEQ ID NO: 8092036 - DNA, 22 bp, Homo sapiens
ctgtacaaaagaaagttcctat

SEQ ID NO: 8092037 - DNA, 22 bp, Homo sapiens
ctggtgccattctgtggcctag

SEQ ID NO: 8092038 - DNA, 22 bp, Homo sapiens
cttctagagctggagcaaatgt

SEQ ID NO: 8092039 - DNA, 23 bp, Homo sapiens
cttctagagtcagctccaagttt

SEQ ID NO: 8092040 - DNA, 17 bp, Homo sapiens
cttctagaaggcaaact

SEQ ID NO: 8092041 - DNA, 22 bp, Homo sapiens
cttctacaaggttgtcctctat

SEQ ID NO: 8092042 - DNA, 22 bp, Homo sapiens
cttctcaaagttgtgaatcagg

SEQ ID NO: 8092043 - DNA, 22 bp, Homo sapiens
cttagtgaggaatgaatttgtt

SEQ ID NO: 8092044 - DNA, 22 bp, Homo sapiens
cttccaaagcactttatggacc

SEQ ID NO: 8092045 - DNA, 22 bp, Homo sapiens
cttccaaaatttatatgttgaa

SEQ ID NO: 8092046 - DNA, 22 bp, Homo sapiens
cttcagtgttggttcattacga

SEQ ID NO: 8092047 - DNA, 22 bp, Homo sapiens
cttaattacccaatgtggtagg

SEQ ID NO: 8092048 - DNA, 22 bp, Homo sapiens
ctgtttaatgaggtgtaacaac

SEQ ID NO: 8092049 - DNA, 22 bp, Homo sapiens
ctgtggaaggacttagcgatac

SEQ ID NO: 8092050 - DNA, 22 bp, Homo sapiens
ctgtggaaggcctgtcctgaaa

SEQ ID NO: 8092051 - DNA, 21 bp, Homo sapiens
ctgtggaagggaactagaggg

SEQ ID NO: 8092052 - DNA, 22 bp, Homo sapiens
ctgtttatcatgtacatttcca

SEQ ID NO: 8092053 - DNA, 22 bp, Homo sapiens
ctgtggaaaatttgtatgtaat

SEQ ID NO: 8092054 - DNA, 22 bp, Homo sapiens
ctgtggaaataaacaatgctaa

SEQ ID NO: 8092055 - DNA, 22 bp, Homo sapiens
cttaaaatctggcagttagcta

SEQ ID NO: 8092056 - DNA, 22 bp, Homo sapiens
ctttaagactaaattagagttt

SEQ ID NO: 8092057 - DNA, 22 bp, Homo sapiens
ctttgcaatagaggcacacatg

SEQ ID NO: 8092058 - DNA, 22 bp, Homo sapiens
ctttgcaaactgtcacactttc

SEQ ID NO: 8092059 - DNA, 22 bp, Homo sapiens
ctttgcaaacgattaccacatg

SEQ ID NO: 8092060 - DNA, 22 bp, Homo sapiens
cttttccactgagcctcacaaa

SEQ ID NO: 8092061 - DNA, 22 bp, Homo sapiens
cttttacagtggacctgccatt

SEQ ID NO: 8092062 - DNA, 22 bp, Homo sapiens
gaaagccatctggctgctggga

SEQ ID NO: 8092063 - DNA, 22 bp, Homo sapiens
gaaaatgtttgtccggagctga

SEQ ID NO: 8092064 - DNA, 22 bp, Homo sapiens
gaaaatgtttcctgttatttgc

SEQ ID NO: 8092065 - DNA, 22 bp, Homo sapiens
tgcactttaaaaaatggtgatg

SEQ ID NO: 8092066 - DNA, 22 bp, Homo sapiens
tgcaaatattgggacagtctag

SEQ ID NO: 8092067 - DNA, 22 bp, Homo sapiens
tgcaatatcagattcaacacat

SEQ ID NO: 8092068 - DNA, 22 bp, Homo sapiens
tgcaatattttatatccaacaa

SEQ ID NO: 8092069 - DNA, 22 bp, Homo sapiens
tgcaatatgttgcattgtatgg

SEQ ID NO: 8092070 - DNA, 22 bp, Homo sapiens
cccaagggatgcttgagtagtt

SEQ ID NO: 8092071 - DNA, 22 bp, Homo sapiens
cccaagggtgcccagcagagga

SEQ ID NO: 8092072 - DNA, 22 bp, Homo sapiens
cccaaggggtgttgatggagga

SEQ ID NO: 8092073 - DNA, 22 bp, Homo sapiens
cccaaggaataggatcccagga

SEQ ID NO: 8092074 - DNA, 16 bp, Homo sapiens
cccaaggagctccagg

SEQ ID NO: 8092075 - DNA, 22 bp, Homo sapiens
tgcagggccttgttgatgtgct

SEQ ID NO: 8092076 - DNA, 22 bp, Homo sapiens
cccagcagggtctctgtgtcta

SEQ ID NO: 8092077 - DNA, 22 bp, Homo sapiens
cccagcaggcatgttgggagga

SEQ ID NO: 8092078 - DNA, 22 bp, Homo sapiens
cccagcaggcatgttgggagga

SEQ ID NO: 8092079 - DNA, 22 bp, Homo sapiens
cccagcagcttgcacagtgctg

SEQ ID NO: 8092080 - DNA, 22 bp, Homo sapiens
ccatccagaaacttccatcccc

SEQ ID NO: 8092081 - DNA, 22 bp, Homo sapiens
tgaggccagggattccatcatt

SEQ ID NO: 8092082 - DNA, 22 bp, Homo sapiens
tgaggccatgcccgtgccggcc

SEQ ID NO: 8092083 - DNA, 17 bp, Homo sapiens
tgaggccatggcaccat

SEQ ID NO: 8092084 - DNA, 22 bp, Homo sapiens
tgagttttttcaacatatgaag

SEQ ID NO: 8092085 - DNA, 21 bp, Homo sapiens
tgagtctcccttagcccacgc

SEQ ID NO: 8092086 - DNA, 22 bp, Homo sapiens
tgagtcctggctttgggatgta

SEQ ID NO: 8092087 - DNA, 22 bp, Homo sapiens
tgagtcctaaagctgtgccctt

SEQ ID NO: 8092088 - DNA, 22 bp, Homo sapiens
ccatccaggctgtgggtgagct

SEQ ID NO: 8092089 - DNA, 22 bp, Homo sapiens
ccagggctgctcattggctggt

SEQ ID NO: 8092090 - DNA, 22 bp, Homo sapiens
ccagggctgctgtgggactcca

SEQ ID NO: 8092091 - DNA, 23 bp, Homo sapiens
tgagcccaggaggtcaaggctgc

SEQ ID NO: 8092092 - DNA, 22 bp, Homo sapiens
ccaggagcattaagagaacata

SEQ ID NO: 8092093 - DNA, 22 bp, Homo sapiens
ccaggagcaacttgaaggcaag

SEQ ID NO: 8092094 - DNA, 22 bp, Homo sapiens
tctgggccggagccgacggcag

SEQ ID NO: 8092095 - DNA, 22 bp, Homo sapiens
tctgggcctgtctcagagctgg

SEQ ID NO: 8092096 - DNA, 22 bp, Homo sapiens
ccaggaggctctgactggaccc

SEQ ID NO: 8092097 - DNA, 22 bp, Homo sapiens
ccaggcacactgccctgccctt

SEQ ID NO: 8092098 - DNA, 22 bp, Homo sapiens
tcttacccggcaacgtgtgtcg

SEQ ID NO: 8092099 - DNA, 22 bp, Homo sapiens
ccaggcagagggatccccatcc

SEQ ID NO: 8092100 - DNA, 22 bp, Homo sapiens
ccaggcccccgagcagaagaca

SEQ ID NO: 8092101 - DNA, 22 bp, Homo sapiens
ccagggcatcctcacatcgcag

SEQ ID NO: 8092102 - DNA, 22 bp, Homo sapiens
ccagggcatgggaagaactgaa

SEQ ID NO: 8092103 - DNA, 22 bp, Homo sapiens
ccagggcatcacatccagtgtt

SEQ ID NO: 8092104 - DNA, 22 bp, Homo sapiens
ccagggcagtgggagaaggtgc

SEQ ID NO: 8092105 - DNA, 22 bp, Homo sapiens
ccagggctctgcttctgccatg

SEQ ID NO: 8092106 - DNA, 22 bp, Homo sapiens
ccagggctgagactgtattggg

SEQ ID NO: 8092107 - DNA, 22 bp, Homo sapiens
ccagggcaacgctgtctcagag

SEQ ID NO: 8092108 - DNA, 22 bp, Homo sapiens
ccagggcaacgctgtctcagag

SEQ ID NO: 8092109 - DNA, 22 bp, Homo sapiens
ccagggcaaatgagatcatagc

SEQ ID NO: 8092110 - DNA, 22 bp, Homo sapiens
ccagggcaataggaacactttt

SEQ ID NO: 8092111 - DNA, 22 bp, Homo sapiens
ccagggcaattatttggagggt

SEQ ID NO: 8092112 - DNA, 22 bp, Homo sapiens
ccagggcaggggctggagttca

SEQ ID NO: 8092113 - DNA, 22 bp, Homo sapiens
ccagggcaggggctggagttca

SEQ ID NO: 8092114 - DNA, 22 bp, Homo sapiens
ccagggcagggaccacgtgtct

SEQ ID NO: 8092115 - DNA, 22 bp, Homo sapiens
ccagggcacgttgggacagtac

SEQ ID NO: 8092116 - DNA, 17 bp, Homo sapiens
ccagggaggggccgcgc

SEQ ID NO: 8092117 - DNA, 22 bp, Homo sapiens
ccagggagggtcctgtggcttc

SEQ ID NO: 8092118 - DNA, 23 bp, Homo sapiens
ccagggagtgctactatcaagcc

SEQ ID NO: 8092119 - DNA, 22 bp, Homo sapiens
tgaaacagagtggatacagtga

SEQ ID NO: 8092120 - DNA, 21 bp, Homo sapiens
ccaggctgggagggcagttcc

SEQ ID NO: 8092121 - DNA, 23 bp, Homo sapiens
tgaaacagatgccaatgatcaag

SEQ ID NO: 8092122 - DNA, 22 bp, Homo sapiens
ccaggctgtaagagtgatgttg

SEQ ID NO: 8092123 - DNA, 22 bp, Homo sapiens
ccaggctgttttcaaacttggg

SEQ ID NO: 8092124 - DNA, 22 bp, Homo sapiens
tgggacaggaggcctctggaga

SEQ ID NO: 8092125 - DNA, 22 bp, Homo sapiens
tgggacaggaggcctctggaga

SEQ ID NO: 8092126 - DNA, 22 bp, Homo sapiens
tgggacaggatgaccagaaggt

SEQ ID NO: 8092127 - DNA, 22 bp, Homo sapiens
tgggcagaaggaagagccacct

SEQ ID NO: 8092128 - DNA, 19 bp, Homo sapiens
cctctcccatgcttacctc

SEQ ID NO: 8092129 - DNA, 22 bp, Homo sapiens
tgggacagagtgagctttggcc

SEQ ID NO: 8092130 - DNA, 22 bp, Homo sapiens
cctctcccagggagagcctgag

SEQ ID NO: 8092131 - DNA, 22 bp, Homo sapiens
cctctcccacgtggcagaggct

SEQ ID NO: 8092132 - DNA, 22 bp, Homo sapiens
cctcctggggtgaaggatggga

SEQ ID NO: 8092133 - DNA, 22 bp, Homo sapiens
cctcctggcctgtgcagagccc

SEQ ID NO: 8092134 - DNA, 22 bp, Homo sapiens
cctcctctgtgcagctgtgggt

SEQ ID NO: 8092135 - DNA, 22 bp, Homo sapiens
cctcctctgtgcagctgtgggt

SEQ ID NO: 8092136 - DNA, 22 bp, Homo sapiens
tggggagagattgaggagtttt

SEQ ID NO: 8092137 - DNA, 22 bp, Homo sapiens
tggggagagaccggaatgtttc

SEQ ID NO: 8092138 - DNA, 22 bp, Homo sapiens
tgggccgtggagcactctgaga

SEQ ID NO: 8092139 - DNA, 22 bp, Homo sapiens
tgggccgggcactgtactgggc

SEQ ID NO: 8092140 - DNA, 22 bp, Homo sapiens
tgggcctggagccctggagagt

SEQ ID NO: 8092141 - DNA, 22 bp, Homo sapiens
tgggcctggccctgtggaggag

SEQ ID NO: 8092142 - DNA, 22 bp, Homo sapiens
tgggctcagtgggagaaagggc

SEQ ID NO: 8092143 - DNA, 22 bp, Homo sapiens
cctgcagggtgctgccacagat

SEQ ID NO: 8092144 - DNA, 22 bp, Homo sapiens
cctgcctcccagaggtcctcta

SEQ ID NO: 8092145 - DNA, 22 bp, Homo sapiens
cctgcctcatcaacttgtcgtg

SEQ ID NO: 8092146 - DNA, 22 bp, Homo sapiens
cctgcctcaggactctgcatat

SEQ ID NO: 8092147 - DNA, 22 bp, Homo sapiens
tggtacacatgtccaaggtcag

SEQ ID NO: 8092148 - DNA, 22 bp, Homo sapiens
cccaggtctcctgcttcccagg

SEQ ID NO: 8092149 - DNA, 22 bp, Homo sapiens
cccagttgttgccggctctgga

SEQ ID NO: 8092150 - DNA, 22 bp, Homo sapiens
tgctgggcaccagtgcctgcag

SEQ ID NO: 8092151 - DNA, 22 bp, Homo sapiens
tgctgggcactgtctaggtact

SEQ ID NO: 8092152 - DNA, 22 bp, Homo sapiens
cccagtggggaaatagctagct

SEQ ID NO: 8092153 - DNA, 22 bp, Homo sapiens
cccagtggtgctggcatctgtg

SEQ ID NO: 8092154 - DNA, 23 bp, Homo sapiens
tgctggggtagtttgtggcacag

SEQ ID NO: 8092155 - DNA, 22 bp, Homo sapiens
ccccaggacacatggaccaagt

SEQ ID NO: 8092156 - DNA, 22 bp, Homo sapiens
tgctgggggtgtctcaccaggc

SEQ ID NO: 8092157 - DNA, 22 bp, Homo sapiens
tgcttccctgctctgcacacct

SEQ ID NO: 8092158 - DNA, 22 bp, Homo sapiens
ccccaggagaaatcttaaacta

SEQ ID NO: 8092159 - DNA, 22 bp, Homo sapiens
ccccaggacgtggccctcatag

SEQ ID NO: 8092160 - DNA, 21 bp, Homo sapiens
tgcttccctgggccacactga

SEQ ID NO: 8092161 - DNA, 22 bp, Homo sapiens
ccctccctctgctgggtgtaga

SEQ ID NO: 8092162 - DNA, 22 bp, Homo sapiens
ccctccctatgtagatgatgtt

SEQ ID NO: 8092163 - DNA, 18 bp, Homo sapiens
tgcttggagcatttacca

SEQ ID NO: 8092164 - DNA, 22 bp, Homo sapiens
tggcaggaaaaacattggagat

SEQ ID NO: 8092165 - DNA, 22 bp, Homo sapiens
tggcacagtgctggatggtgct

SEQ ID NO: 8092166 - DNA, 22 bp, Homo sapiens
tggcacagtgctggatggtgct

SEQ ID NO: 8092167 - DNA, 22 bp, Homo sapiens
tggcagagaacacacatgattc

SEQ ID NO: 8092168 - DNA, 22 bp, Homo sapiens
ccctccctttgtctttatgaac

SEQ ID NO: 8092169 - DNA, 22 bp, Homo sapiens
ccctcctcaactctggcttcca

SEQ ID NO: 8092170 - DNA, 22 bp, Homo sapiens
ccctccctgtgtgcctcatttg

SEQ ID NO: 8092171 - DNA, 22 bp, Homo sapiens
ccctccctgaagaagttactct

SEQ ID NO: 8092172 - DNA, 22 bp, Homo sapiens
ccctcccttccaagttgaggac

SEQ ID NO: 8092173 - DNA, 22 bp, Homo sapiens
ccctccctttgcagcagtgcat

SEQ ID NO: 8092174 - DNA, 22 bp, Homo sapiens
ccacagctgaccgcaggtgagc

SEQ ID NO: 8092175 - DNA, 22 bp, Homo sapiens
ccaccaggacagccctgagggg

SEQ ID NO: 8092176 - DNA, 21 bp, Homo sapiens
ccacaggggctcccctgtcag

SEQ ID NO: 8092177 - DNA, 22 bp, Homo sapiens
ccacagggctctaggcgcttcc

SEQ ID NO: 8092178 - DNA, 22 bp, Homo sapiens
catttccagctcctgcatcatg

SEQ ID NO: 8092179 - DNA, 22 bp, Homo sapiens
catttccacttctgaaaactgg

SEQ ID NO: 8092180 - DNA, 22 bp, Homo sapiens
tccatacacattgaattttagt

SEQ ID NO: 8092181 - DNA, 22 bp, Homo sapiens
catttcacgcacactcattact

SEQ ID NO: 8092182 - DNA, 22 bp, Homo sapiens
cattttcagcacccatctgaaa

SEQ ID NO: 8092183 - DNA, 22 bp, Homo sapiens
cattttcatgagtttctgttca

SEQ ID NO: 8092184 - DNA, 22 bp, Homo sapiens
catttctagggatcataaagta

SEQ ID NO: 8092185 - DNA, 22 bp, Homo sapiens
ccagagccagagaggtgcctgc

SEQ ID NO: 8092186 - DNA, 22 bp, Homo sapiens
ccagagcccagcacacggtgct

SEQ ID NO: 8092187 - DNA, 22 bp, Homo sapiens
ccagagccggctccctcagctt

SEQ ID NO: 8092188 - DNA, 22 bp, Homo sapiens
ccagagcccgggacctggactt

SEQ ID NO: 8092189 - DNA, 22 bp, Homo sapiens
ccagagcctcaacacaggtcct

SEQ ID NO: 8092190 - DNA, 22 bp, Homo sapiens
ccagagcctcgcccggagcctc

SEQ ID NO: 8092191 - DNA, 22 bp, Homo sapiens
ccagagcctgctgagccccatt

SEQ ID NO: 8092192 - DNA, 22 bp, Homo sapiens
ccagatgtccctctcaggtttg

SEQ ID NO: 8092193 - DNA, 22 bp, Homo sapiens
tctataaattatgcagtctcag

SEQ ID NO: 8092194 - DNA, 22 bp, Homo sapiens
tctcagagacctgaactccctg

SEQ ID NO: 8092195 - DNA, 22 bp, Homo sapiens
tctcagtgtgttttctctcaga

SEQ ID NO: 8092196 - DNA, 22 bp, Homo sapiens
ccaccctgaggaatggtccggc

SEQ ID NO: 8092197 - DNA, 22 bp, Homo sapiens
ccaccctgagccgcaagagcag

SEQ ID NO: 8092198 - DNA, 22 bp, Homo sapiens
ccaccctgccttgggccagtga

SEQ ID NO: 8092199 - DNA, 22 bp, Homo sapiens
ccaccccaaatgaagacctctc

SEQ ID NO: 8092200 - DNA, 22 bp, Homo sapiens
ccaccaggcactcacagggaag

SEQ ID NO: 8092201 - DNA, 22 bp, Homo sapiens
ccaccaggcactcacagggaag

SEQ ID NO: 8092202 - DNA, 22 bp, Homo sapiens
tctagaaagccaaattaggaat

SEQ ID NO: 8092203 - DNA, 19 bp, Homo sapiens
tccaggggctccacctcct

SEQ ID NO: 8092204 - DNA, 22 bp, Homo sapiens
tccagggttgtgggcttcagca

SEQ ID NO: 8092205 - DNA, 22 bp, Homo sapiens
tccaggtactcattggctgtta

SEQ ID NO: 8092206 - DNA, 22 bp, Homo sapiens
tccaggtatgacatggctgttt

SEQ ID NO: 8092207 - DNA, 22 bp, Homo sapiens
tccagggcatgctcagactcag

SEQ ID NO: 8092208 - DNA, 22 bp, Homo sapiens
tccagggcatggggagagagtg

SEQ ID NO: 8092209 - DNA, 22 bp, Homo sapiens
tccagggcagtgactacagcgg

SEQ ID NO: 8092210 - DNA, 23 bp, Homo sapiens
tccagggcagtggctgggtctgc

SEQ ID NO: 8092211 - DNA, 22 bp, Homo sapiens
catgtggttcaagtactccaca

SEQ ID NO: 8092212 - DNA, 22 bp, Homo sapiens
tccaggctttggggcaggagcg

SEQ ID NO: 8092213 - DNA, 22 bp, Homo sapiens
tccaagatctacagcagtttag

SEQ ID NO: 8092214 - DNA, 22 bp, Homo sapiens
tccaagcatgtggtcaggagcc

SEQ ID NO: 8092215 - DNA, 18 bp, Homo sapiens
tccagagagggagaagtg

SEQ ID NO: 8092216 - DNA, 20 bp, Homo sapiens
catgccagaatgtgaggtag

SEQ ID NO: 8092217 - DNA, 22 bp, Homo sapiens
tcatcagggatattggcctgaa

SEQ ID NO: 8092218 - DNA, 22 bp, Homo sapiens
catgtaaagcatccttctaggg

SEQ ID NO: 8092219 - DNA, 22 bp, Homo sapiens
catgtaaaacactcagaacagt

SEQ ID NO: 8092220 - DNA, 22 bp, Homo sapiens
catgtaaaaagaagaatctgga

SEQ ID NO: 8092221 - DNA, 23 bp, Homo sapiens
catggaaaactgaaagctgacct

SEQ ID NO: 8092222 - DNA, 22 bp, Homo sapiens
catcaggaggagatgaagaaaa

SEQ ID NO: 8092223 - DNA, 22 bp, Homo sapiens
tcagtgtgaggtcttccacccg

SEQ ID NO: 8092224 - DNA, 22 bp, Homo sapiens
tcagtgtgagtaccatgctcag

SEQ ID NO: 8092225 - DNA, 22 bp, Homo sapiens
catcctagaaaaccctatggaa

SEQ ID NO: 8092226 - DNA, 22 bp, Homo sapiens
cagtgtcctcagccagcagcta

SEQ ID NO: 8092227 - DNA, 22 bp, Homo sapiens
cagtgtcaggatcagtatattt

SEQ ID NO: 8092228 - DNA, 22 bp, Homo sapiens
cagtgtaagctctagactagaa

SEQ ID NO: 8092229 - DNA, 22 bp, Homo sapiens
tagacagggtggcttagaaaca

SEQ ID NO: 8092230 - DNA, 22 bp, Homo sapiens
caggctgcagcagcagtggccc

SEQ ID NO: 8092231 - DNA, 22 bp, Homo sapiens
tagaaacaagtttctctttggg

SEQ ID NO: 8092232 - DNA, 22 bp, Homo sapiens
cagggcagtttgtgcctatgag

SEQ ID NO: 8092233 - DNA, 22 bp, Homo sapiens
cagggcagtaccgccctctggc

SEQ ID NO: 8092234 - DNA, 22 bp, Homo sapiens
cagggcagttttacttctctct

SEQ ID NO: 8092235 - DNA, 22 bp, Homo sapiens
cagggccaagcccctttggctg

SEQ ID NO: 8092236 - DNA, 22 bp, Homo sapiens
cagggcattacttcaggtcctt

SEQ ID NO: 8092237 - DNA, 22 bp, Homo sapiens
cagggccaagctgcagcatctg

SEQ ID NO: 8092238 - DNA, 22 bp, Homo sapiens
cagggcatctggagtcgggcgg

SEQ ID NO: 8092239 - DNA, 22 bp, Homo sapiens
cagggcatccgtgctccatgct

SEQ ID NO: 8092240 - DNA, 22 bp, Homo sapiens
cagggatgctgcttaggcagtt

SEQ ID NO: 8092241 - DNA, 22 bp, Homo sapiens
cagggatggagagactactggc

SEQ ID NO: 8092242 - DNA, 22 bp, Homo sapiens
cagggatgctgttaaacatcct

SEQ ID NO: 8092243 - DNA, 22 bp, Homo sapiens
cagggatgagcagatggagcaa

SEQ ID NO: 8092244 - DNA, 22 bp, Homo sapiens
cagggatgagaaagctctctaa

SEQ ID NO: 8092245 - DNA, 22 bp, Homo sapiens
cagggatgagagatggcacaga

SEQ ID NO: 8092246 - DNA, 22 bp, Homo sapiens
cagggatggcctggcgggccac

SEQ ID NO: 8092247 - DNA, 22 bp, Homo sapiens
cagggatgaccagagggatgtg

SEQ ID NO: 8092248 - DNA, 22 bp, Homo sapiens
cagggaggctgtcttatgcctg

SEQ ID NO: 8092249 - DNA, 23 bp, Homo sapiens
cagggaggagatactgtgtatct

SEQ ID NO: 8092250 - DNA, 22 bp, Homo sapiens
tacagcctggcactaccctggg

SEQ ID NO: 8092251 - DNA, 22 bp, Homo sapiens
tacagctaggcaaaaatgacat

SEQ ID NO: 8092252 - DNA, 22 bp, Homo sapiens
caggcctggagtgcaatggcac

SEQ ID NO: 8092253 - DNA, 22 bp, Homo sapiens
tacagtttctcattatgctctc

SEQ ID NO: 8092254 - DNA, 22 bp, Homo sapiens
caggctccagcttcctgctcag

SEQ ID NO: 8092255 - DNA, 22 bp, Homo sapiens
caggctcccaccctcctgcagc

SEQ ID NO: 8092256 - DNA, 20 bp, Homo sapiens
caggctccgcaggactaggg

SEQ ID NO: 8092257 - DNA, 21 bp, Homo sapiens
caggctctgctagaggagcct

SEQ ID NO: 8092258 - DNA, 22 bp, Homo sapiens
caggctccttcccagggatggt

SEQ ID NO: 8092259 - DNA, 22 bp, Homo sapiens
tacagacatttactccactcct

SEQ ID NO: 8092260 - DNA, 22 bp, Homo sapiens
tacacttttcaatgtagtctgt

SEQ ID NO: 8092261 - DNA, 22 bp, Homo sapiens
tacactttatggatcctacttt

SEQ ID NO: 8092262 - DNA, 22 bp, Homo sapiens
caggccccattcctcttgggac

SEQ ID NO: 8092263 - DNA, 22 bp, Homo sapiens
gtggagcataacacactagcct

SEQ ID NO: 8092264 - DNA, 22 bp, Homo sapiens
gtggagcaatcagagggtcagt

SEQ ID NO: 8092265 - DNA, 22 bp, Homo sapiens
gtggagcaggactagctgagaa

SEQ ID NO: 8092266 - DNA, 22 bp, Homo sapiens
tcacatgcttgaggaaagaaaa

SEQ ID NO: 8092267 - DNA, 22 bp, Homo sapiens
cagtggaggccttgggaccttt

SEQ ID NO: 8092268 - DNA, 22 bp, Homo sapiens
cagtggaggctcaagtgtgctt

SEQ ID NO: 8092269 - DNA, 22 bp, Homo sapiens
cagtggcacccacgggctgggc

SEQ ID NO: 8092270 - DNA, 22 bp, Homo sapiens
cagtggcagagaacagagacct

SEQ ID NO: 8092271 - DNA, 22 bp, Homo sapiens
cagtctggcacagcacactgaa

SEQ ID NO: 8092272 - DNA, 22 bp, Homo sapiens
tcaaattctattctatactcag

SEQ ID NO: 8092273 - DNA, 22 bp, Homo sapiens
tcaaattagtggaataataatg

SEQ ID NO: 8092274 - DNA, 17 bp, Homo sapiens
cagtgaagagacattaa

SEQ ID NO: 8092275 - DNA, 22 bp, Homo sapiens
tagttttacttgcgatgataat

SEQ ID NO: 8092276 - DNA, 22 bp, Homo sapiens
tagtgtctgacatttaagagca

SEQ ID NO: 8092277 - DNA, 22 bp, Homo sapiens
cagggctggatcctccagactc

SEQ ID NO: 8092278 - DNA, 22 bp, Homo sapiens
caggtggggcagctgtgggagc

SEQ ID NO: 8092279 - DNA, 22 bp, Homo sapiens
caggtgggcttgggagaacact

SEQ ID NO: 8092280 - DNA, 22 bp, Homo sapiens
caggtggggagagtgtggagca

SEQ ID NO: 8092281 - DNA, 22 bp, Homo sapiens
tatgaagacaatgatagcatga

SEQ ID NO: 8092282 - DNA, 22 bp, Homo sapiens
tatgaagaagacaaatgacact

SEQ ID NO: 8092283 - DNA, 22 bp, Homo sapiens
tatgaacatgctgtggttataa

SEQ ID NO: 8092284 - DNA, 22 bp, Homo sapiens
ttgaaagacttctcctgtgaaa

SEQ ID NO: 8092285 - DNA, 22 bp, Homo sapiens
ttgacattttgtcatattgaca

SEQ ID NO: 8092286 - DNA, 22 bp, Homo sapiens
ttgaaaaaattggtagaggatg

SEQ ID NO: 8092287 - DNA, 23 bp, Homo sapiens
ttgaaaaatatagtcccattgtc

SEQ ID NO: 8092288 - DNA, 22 bp, Homo sapiens
ttgagacacagtttcactctgt

SEQ ID NO: 8092289 - DNA, 22 bp, Homo sapiens
ttgagacactttgggcatcact

SEQ ID NO: 8092290 - DNA, 22 bp, Homo sapiens
ttcttcttgaaactttaggttg

SEQ ID NO: 8092291 - DNA, 22 bp, Homo sapiens
ttcttcttctggctgcacctgg

SEQ ID NO: 8092292 - DNA, 22 bp, Homo sapiens
ttcttcttcatttctgacgatg

SEQ ID NO: 8092293 - DNA, 22 bp, Homo sapiens
ttcttcttcaagtgctgcattc

SEQ ID NO: 8092294 - DNA, 22 bp, Homo sapiens
ttcttcttaatgtcctgggaac

SEQ ID NO: 8092295 - DNA, 22 bp, Homo sapiens
ttcttcctctgtaaaaggtgac

SEQ ID NO: 8092296 - DNA, 22 bp, Homo sapiens
ttcttcctcagcagggctgcct

SEQ ID NO: 8092297 - DNA, 22 bp, Homo sapiens
ttcttccttggtttcctggata

SEQ ID NO: 8092298 - DNA, 22 bp, Homo sapiens
ttcttcagcctaccttgacctc

SEQ ID NO: 8092299 - DNA, 22 bp, Homo sapiens
ttctgggagagaaagggccttg

SEQ ID NO: 8092300 - DNA, 22 bp, Homo sapiens
ttctgggacatctggacagttt

SEQ ID NO: 8092301 - DNA, 21 bp, Homo sapiens
ttctgggaaatgagctggggc

SEQ ID NO: 8092302 - DNA, 22 bp, Homo sapiens
ttccctctcacttaaagcttgg

SEQ ID NO: 8092303 - DNA, 22 bp, Homo sapiens
ttctatcatacttgaatacatt

SEQ ID NO: 8092304 - DNA, 22 bp, Homo sapiens
ttctcacaggatttcttttagt

SEQ ID NO: 8092305 - DNA, 22 bp, Homo sapiens
ttctcacagtacctaacatgta

SEQ ID NO: 8092306 - DNA, 20 bp, Homo sapiens
ttctgcctagggttagcctg

SEQ ID NO: 8092307 - DNA, 22 bp, Homo sapiens
ttctgcctgatgtagtcatacc

SEQ ID NO: 8092308 - DNA, 22 bp, Homo sapiens
ttctctttgacattattcaggt

SEQ ID NO: 8092309 - DNA, 22 bp, Homo sapiens
ttctgattgctgatgaggccca

SEQ ID NO: 8092310 - DNA, 22 bp, Homo sapiens
ttctcctacttaaggccttcca

SEQ ID NO: 8092311 - DNA, 22 bp, Homo sapiens
ttctcctctgttaccttgcaaa

SEQ ID NO: 8092312 - DNA, 22 bp, Homo sapiens
ttccaaggctgctatttgtttc

SEQ ID NO: 8092313 - DNA, 19 bp, Homo sapiens
ttccaaaatcaggatttga

SEQ ID NO: 8092314 - DNA, 22 bp, Homo sapiens
ttccaagagctttaattgttga

SEQ ID NO: 8092315 - DNA, 22 bp, Homo sapiens
ttccaagagtaaattcaaattg

SEQ ID NO: 8092316 - DNA, 22 bp, Homo sapiens
ttcccaggctgtgctaccagag

SEQ ID NO: 8092317 - DNA, 22 bp, Homo sapiens
ttcccaggtaattctgaggcag

SEQ ID NO: 8092318 - DNA, 22 bp, Homo sapiens
ttcccaggaagcctctccaagc

SEQ ID NO: 8092319 - DNA, 22 bp, Homo sapiens
ttcccaggactctgggtgtctt

SEQ ID NO: 8092320 - DNA, 19 bp, Homo sapiens
ttcccaggaaaggggtgca

SEQ ID NO: 8092321 - DNA, 22 bp, Homo sapiens
ttcccctctcagatctggccta

SEQ ID NO: 8092322 - DNA, 19 bp, Homo sapiens
ttcccctccccagggatag

SEQ ID NO: 8092323 - DNA, 22 bp, Homo sapiens
ttccatgacaccgagggaagtc

SEQ ID NO: 8092324 - DNA, 22 bp, Homo sapiens
ttccatgaagggcagcctctca

SEQ ID NO: 8092325 - DNA, 22 bp, Homo sapiens
ttccatgaaatgtgttatgctt

SEQ ID NO: 8092326 - DNA, 22 bp, Homo sapiens
ttccatgaaggagactgagaag

SEQ ID NO: 8092327 - DNA, 18 bp, Homo sapiens
ttccatgattcctttcac

SEQ ID NO: 8092328 - DNA, 22 bp, Homo sapiens
ttccatgagctctgagttcaca

SEQ ID NO: 8092329 - DNA, 22 bp, Homo sapiens
ttccatgaaagtgaaatggagc

SEQ ID NO: 8092330 - DNA, 22 bp, Homo sapiens
ttcagaagtagctaagcagtca

SEQ ID NO: 8092331 - DNA, 22 bp, Homo sapiens
ttcagaatatttgttttacatg

SEQ ID NO: 8092332 - DNA, 22 bp, Homo sapiens
ttcatagagcagctcactgaat

SEQ ID NO: 8092333 - DNA, 22 bp, Homo sapiens
ttcagaatgtgaccttatttgg

SEQ ID NO: 8092334 - DNA, 22 bp, Homo sapiens
ttcagacagttttcagattcat

SEQ ID NO: 8092335 - DNA, 22 bp, Homo sapiens
ttcatcaatgtgtttaataatg

SEQ ID NO: 8092336 - DNA, 22 bp, Homo sapiens
ttatttactggatggccttggg

SEQ ID NO: 8092337 - DNA, 22 bp, Homo sapiens
ttatttacaactcttctcttcc

SEQ ID NO: 8092338 - DNA, 22 bp, Homo sapiens
ttatttaaaagtggtaagattc

SEQ ID NO: 8092339 - DNA, 22 bp, Homo sapiens
ttatttaatgtgatctgaagag

SEQ ID NO: 8092340 - DNA, 22 bp, Homo sapiens
ttatgttatgctatttcagata

SEQ ID NO: 8092341 - DNA, 21 bp, Homo sapiens
ttcaaaatggtgtgtttgtct

SEQ ID NO: 8092342 - DNA, 22 bp, Homo sapiens
ttattttctcctcagaaagtgg

SEQ ID NO: 8092343 - DNA, 22 bp, Homo sapiens
ttattttcagctaggaaagcca

SEQ ID NO: 8092344 - DNA, 22 bp, Homo sapiens
tcctctggaacctcacccttgc

SEQ ID NO: 8092345 - DNA, 22 bp, Homo sapiens
tcctctggcccagctgcctctg

SEQ ID NO: 8092346 - DNA, 22 bp, Homo sapiens
tcctctccagcaaactggctat

SEQ ID NO: 8092347 - DNA, 21 bp, Homo sapiens
tcctctactgagccatgcaga

SEQ ID NO: 8092348 - DNA, 22 bp, Homo sapiens
tcctctgctccaggctggactt

SEQ ID NO: 8092349 - DNA, 22 bp, Homo sapiens
tcctctgctccatctttactgt

SEQ ID NO: 8092350 - DNA, 22 bp, Homo sapiens
ttatgctaacctcatcttctcc

SEQ ID NO: 8092351 - DNA, 22 bp, Homo sapiens
ttatacagtttatacttagaat

SEQ ID NO: 8092352 - DNA, 22 bp, Homo sapiens
tttacacttgaggaaactgagg

SEQ ID NO: 8092353 - DNA, 22 bp, Homo sapiens
tttacagaatgttgaatttggg

SEQ ID NO: 8092354 - DNA, 22 bp, Homo sapiens
tttaagacagtgcaagctgaat

SEQ ID NO: 8092355 - DNA, 22 bp, Homo sapiens
tttacactgcttgaacaatctc

SEQ ID NO: 8092356 - DNA, 22 bp, Homo sapiens
tttaaattatagttaatgtctg

SEQ ID NO: 8092357 - DNA, 22 bp, Homo sapiens
ttgttgaatggataaataaatt

SEQ ID NO: 8092358 - DNA, 22 bp, Homo sapiens
tttacagctgctggcaagcttg

SEQ ID NO: 8092359 - DNA, 22 bp, Homo sapiens
tttacagctgctggcaagcttg

SEQ ID NO: 8092360 - DNA, 22 bp, Homo sapiens
tttagtgtagcattcagagtca

SEQ ID NO: 8092361 - DNA, 22 bp, Homo sapiens
tttagtgtaattctgccttttg

SEQ ID NO: 8092362 - DNA, 16 bp, Homo sapiens
tttatttactagtgtt

SEQ ID NO: 8092363 - DNA, 22 bp, Homo sapiens
tttattgggtgcagtgcccaca

SEQ ID NO: 8092364 - DNA, 22 bp, Homo sapiens
tttattgggcctggaggatcta

SEQ ID NO: 8092365 - DNA, 22 bp, Homo sapiens
tttattggaacacagccatgac

SEQ ID NO: 8092366 - DNA, 20 bp, Homo sapiens
tttattggcctttcaggaac

SEQ ID NO: 8092367 - DNA, 22 bp, Homo sapiens
tttattggatggatggatggat

SEQ ID NO: 8092368 - DNA, 22 bp, Homo sapiens
tttattggatgggtcagctcta

SEQ ID NO: 8092369 - DNA, 22 bp, Homo sapiens
tttattggatatttacaagata

SEQ ID NO: 8092370 - DNA, 22 bp, Homo sapiens
tttatgtttgcattttcaaaga

SEQ ID NO: 8092371 - DNA, 23 bp, Homo sapiens
tttatttatttaggctgagggat

SEQ ID NO: 8092372 - DNA, 20 bp, Homo sapiens
tttcaagtcagcaattctca

SEQ ID NO: 8092373 - DNA, 22 bp, Homo sapiens
tttatttatccttctggattgc

SEQ ID NO: 8092374 - DNA, 21 bp, Homo sapiens
tttatttatataggacacatg

SEQ ID NO: 8092375 - DNA, 22 bp, Homo sapiens
tttatttataagccacttgctg

SEQ ID NO: 8092376 - DNA, 22 bp, Homo sapiens
tttcacaactgcttatttgaga

SEQ ID NO: 8092377 - DNA, 22 bp, Homo sapiens
tttcacaggatgctgttttata

SEQ ID NO: 8092378 - DNA, 22 bp, Homo sapiens
tttcacattagatatgtcattt

SEQ ID NO: 8092379 - DNA, 22 bp, Homo sapiens
tttcagtgtatcttccaaaagc

SEQ ID NO: 8092380 - DNA, 21 bp, Homo sapiens
tttcagtgtatgacagtgaaa

SEQ ID NO: 8092381 - DNA, 22 bp, Homo sapiens
tttcagtgtgagtgtcttattt

SEQ ID NO: 8092382 - DNA, 22 bp, Homo sapiens
tttcagtgtcagtaatgcagca

SEQ ID NO: 8092383 - DNA, 22 bp, Homo sapiens
tttcagtttttgctcgatgtat

SEQ ID NO: 8092384 - DNA, 22 bp, Homo sapiens
tttcagtgggtttatttcatgt

SEQ ID NO: 8092385 - DNA, 20 bp, Homo sapiens
tttcagtggtttgtgcctag

SEQ ID NO: 8092386 - DNA, 22 bp, Homo sapiens
tttcagtggcatcgattaccct

SEQ ID NO: 8092387 - DNA, 22 bp, Homo sapiens
tttcagtgtaaggtttccagga

SEQ ID NO: 8092388 - DNA, 22 bp, Homo sapiens
tttcagtgtatcttccaaaagc

SEQ ID NO: 8092389 - DNA, 22 bp, Homo sapiens
tttccatgttggtgaaatgagg

SEQ ID NO: 8092390 - DNA, 22 bp, Homo sapiens
tttcccagaggtatgaataagt

SEQ ID NO: 8092391 - DNA, 22 bp, Homo sapiens
tttccaaataaggtcacattct

SEQ ID NO: 8092392 - DNA, 22 bp, Homo sapiens
tttccaggtattaatactgtat

SEQ ID NO: 8092393 - DNA, 22 bp, Homo sapiens
ttgcttcattaagttctcacag

SEQ ID NO: 8092394 - DNA, 22 bp, Homo sapiens
ttgcttcagtagctctttaaag

SEQ ID NO: 8092395 - DNA, 22 bp, Homo sapiens
ttggcacctccctaggaagaag

SEQ ID NO: 8092396 - DNA, 22 bp, Homo sapiens
ttggaattcaagttgtagctta

SEQ ID NO: 8092397 - DNA, 22 bp, Homo sapiens
ttgtagaacatgcagcacaatg

SEQ ID NO: 8092398 - DNA, 21 bp, Homo sapiens
ttggccgtgcagatgaacagc

SEQ ID NO: 8092399 - DNA, 22 bp, Homo sapiens
ttttccagagctgtctcttgca

SEQ ID NO: 8092400 - DNA, 22 bp, Homo sapiens
ttttccagattggacttagtcc

SEQ ID NO: 8092401 - DNA, 22 bp, Homo sapiens
ttttagaagtgcctatcctatg

SEQ ID NO: 8092402 - DNA, 22 bp, Homo sapiens
ttttagaagtgcctatcctatg

SEQ ID NO: 8092403 - DNA, 22 bp, Homo sapiens
ttttattgggagtcctctactg

SEQ ID NO: 8092404 - DNA, 22 bp, Homo sapiens
ttttattggtaatgataaaagt

SEQ ID NO: 8092405 - DNA, 22 bp, Homo sapiens
ttttattgtctcccagttctgg

SEQ ID NO: 8092406 - DNA, 22 bp, Homo sapiens
ttttattgtctgtattgcctat

SEQ ID NO: 8092407 - DNA, 22 bp, Homo sapiens
ttttattgtcaatgaagacaga

SEQ ID NO: 8092408 - DNA, 20 bp, Homo sapiens
ttttccagaaagtatcattg

SEQ ID NO: 8092409 - DNA, 23 bp, Homo sapiens
ttttccagaatcgactctgtaga

SEQ ID NO: 8092410 - DNA, 16 bp, Homo sapiens
ttttattgtgacagcc

SEQ ID NO: 8092411 - DNA, 22 bp, Homo sapiens
ttttacagttccatgcaaagcg

SEQ ID NO: 8092412 - DNA, 22 bp, Homo sapiens
ttttaattttagcccttctggt

SEQ ID NO: 8092413 - DNA, 20 bp, Homo sapiens
tttgagaccagtctgcccaa

SEQ ID NO: 8092414 - DNA, 22 bp, Homo sapiens
tttgcagtgtcagcttctgtgt

SEQ ID NO: 8092415 - DNA, 19 bp, Homo sapiens
tttgcagtggttcctttgt

SEQ ID NO: 8092416 - DNA, 22 bp, Homo sapiens
tttctagggctcttgtcttctg

SEQ ID NO: 8092417 - DNA, 22 bp, Homo sapiens
tttctaggcacagtgtcttccc

SEQ ID NO: 8092418 - DNA, 22 bp, Homo sapiens
tttctagtaaaagctaattacc

SEQ ID NO: 8092419 - DNA, 22 bp, Homo sapiens
tttctaggtcttccatactgcc

SEQ ID NO: 8092420 - DNA, 22 bp, Homo sapiens
tttctagtctcgatctcttaat

SEQ ID NO: 8092421 - DNA, 22 bp, Homo sapiens
tttctatctgagaagatatcta

SEQ ID NO: 8092422 - DNA, 22 bp, Homo sapiens
tttgaaatatgaggcattatga

SEQ ID NO: 8092423 - DNA, 22 bp, Homo sapiens
tttgaaattaagatattgtcca

SEQ ID NO: 8092424 - DNA, 22 bp, Homo sapiens
tttgacatggaataactcattt

SEQ ID NO: 8092425 - DNA, 22 bp, Homo sapiens
tttgacagcagataaaataaaa

SEQ ID NO: 8092426 - DNA, 22 bp, Homo sapiens
tttgaagacagatcaatataag

SEQ ID NO: 8092427 - DNA, 22 bp, Homo sapiens
attctacacaaagcaagaagac

SEQ ID NO: 8092428 - DNA, 22 bp, Homo sapiens
gcagcagggtgccagctttgca

SEQ ID NO: 8092429 - DNA, 22 bp, Homo sapiens
gcagcagggagcaggggtgtca

SEQ ID NO: 8092430 - DNA, 22 bp, Homo sapiens
gcagcaggcttttcataccttg

SEQ ID NO: 8092431 - DNA, 22 bp, Homo sapiens
gcagcaggcatggccgccctgg

SEQ ID NO: 8092432 - DNA, 22 bp, Homo sapiens
attcagtgtttgcagcaacttt

SEQ ID NO: 8092433 - DNA, 22 bp, Homo sapiens
attcagtgtgaggttttcaagt

SEQ ID NO: 8092434 - DNA, 22 bp, Homo sapiens
attcagtgtcttgatctgggaa

SEQ ID NO: 8092435 - DNA, 22 bp, Homo sapiens
attcagtgtggacccatttaaa

SEQ ID NO: 8092436 - DNA, 19 bp, Homo sapiens
attcagtgtctctgacttc

SEQ ID NO: 8092437 - DNA, 22 bp, Homo sapiens
attcagtgtctactccattgcc

SEQ ID NO: 8092438 - DNA, 22 bp, Homo sapiens
attcagtgtatcaatgaatgct

SEQ ID NO: 8092439 - DNA, 22 bp, Homo sapiens
attcagtgtagttattatcttt

SEQ ID NO: 8092440 - DNA, 22 bp, Homo sapiens
attatttatcctcttggtctat

SEQ ID NO: 8092441 - DNA, 22 bp, Homo sapiens
attatttagaaatcgattgaaa

SEQ ID NO: 8092442 - DNA, 22 bp, Homo sapiens
attcagtgggtgctcagcacaa

SEQ ID NO: 8092443 - DNA, 22 bp, Homo sapiens
attcagtggatatcttcacttt

SEQ ID NO: 8092444 - DNA, 22 bp, Homo sapiens
attcagtgctgtaatacgctaa

SEQ ID NO: 8092445 - DNA, 22 bp, Homo sapiens
attcagtgccaaggagaacttg

SEQ ID NO: 8092446 - DNA, 22 bp, Homo sapiens
attcagtgattcatttgtacaa

SEQ ID NO: 8092447 - DNA, 22 bp, Homo sapiens
attcagtgagtgtttaccggaa

SEQ ID NO: 8092448 - DNA, 22 bp, Homo sapiens
attcagtgacctaattacttac

SEQ ID NO: 8092449 - DNA, 22 bp, Homo sapiens
attatttacagtgtgctcgaag

SEQ ID NO: 8092450 - DNA, 22 bp, Homo sapiens
attcttattatagtaaaacagt

SEQ ID NO: 8092451 - DNA, 22 bp, Homo sapiens
attcttaattgccatgctgtat

SEQ ID NO: 8092452 - DNA, 22 bp, Homo sapiens
attcttaattgccatgctgtat

SEQ ID NO: 8092453 - DNA, 22 bp, Homo sapiens
attcttaattccaaagactgag

SEQ ID NO: 8092454 - DNA, 22 bp, Homo sapiens
attcttcacaaatatatagaag

SEQ ID NO: 8092455 - DNA, 22 bp, Homo sapiens
attcttcacacctgttcctgtt

SEQ ID NO: 8092456 - DNA, 22 bp, Homo sapiens
attcttatttaaatagagtctg

SEQ ID NO: 8092457 - DNA, 22 bp, Homo sapiens
attcttcaaagagtgtcaaagt

SEQ ID NO: 8092458 - DNA, 22 bp, Homo sapiens
attcttcaccatggataatttg

SEQ ID NO: 8092459 - DNA, 22 bp, Homo sapiens
attcttcacataagtgctgtac

SEQ ID NO: 8092460 - DNA, 22 bp, Homo sapiens
attcttcacatggataggatct

SEQ ID NO: 8092461 - DNA, 22 bp, Homo sapiens
attcttcactgtttcagaatga

SEQ ID NO: 8092462 - DNA, 22 bp, Homo sapiens
attcttcacctgagtcagtcta

SEQ ID NO: 8092463 - DNA, 22 bp, Homo sapiens
attctcaaaacataacttcact

SEQ ID NO: 8092464 - DNA, 22 bp, Homo sapiens
attcttcagcaggggacactat

SEQ ID NO: 8092465 - DNA, 22 bp, Homo sapiens
attcttcagaatatctggcact

SEQ ID NO: 8092466 - DNA, 23 bp, Homo sapiens
attgaacagagagaaaaacatcc

SEQ ID NO: 8092467 - DNA, 17 bp, Homo sapiens
gcaagggatgggagatt

SEQ ID NO: 8092468 - DNA, 22 bp, Homo sapiens
gcaagtgagaggcatcattaga

SEQ ID NO: 8092469 - DNA, 22 bp, Homo sapiens
attattcttatgtcatcatggc

SEQ ID NO: 8092470 - DNA, 22 bp, Homo sapiens
gcaagaaaaaggcttcatgaac

SEQ ID NO: 8092471 - DNA, 22 bp, Homo sapiens
attaaaattccaaggtatgcca

SEQ ID NO: 8092472 - DNA, 23 bp, Homo sapiens
atgttttatgtctctagctgcca

SEQ ID NO: 8092473 - DNA, 22 bp, Homo sapiens
atgttaaaaaccagtacagttg

SEQ ID NO: 8092474 - DNA, 22 bp, Homo sapiens
attggagaagaacatgaattag

SEQ ID NO: 8092475 - DNA, 22 bp, Homo sapiens
atttacagaaacttaatcatag

SEQ ID NO: 8092476 - DNA, 22 bp, Homo sapiens
gccaggagggaaaggacaattt

SEQ ID NO: 8092477 - DNA, 22 bp, Homo sapiens
gccaggaggcttaactggacag

SEQ ID NO: 8092478 - DNA, 22 bp, Homo sapiens
atttacagaagcatgtaatagc

SEQ ID NO: 8092479 - DNA, 21 bp, Homo sapiens
atttcagagcacacaagtaaa

SEQ ID NO: 8092480 - DNA, 22 bp, Homo sapiens
atttcagatgaccaaatggaaa

SEQ ID NO: 8092481 - DNA, 22 bp, Homo sapiens
atttcagattcagaaatgtagg

SEQ ID NO: 8092482 - DNA, 22 bp, Homo sapiens
gccaggccactcccgggtcctg

SEQ ID NO: 8092483 - DNA, 22 bp, Homo sapiens
gccaggcctgcaagtgctggtg

SEQ ID NO: 8092484 - DNA, 18 bp, Homo sapiens
atttctactactataaag

SEQ ID NO: 8092485 - DNA, 22 bp, Homo sapiens
atttcctttgcaaagactgtgc

SEQ ID NO: 8092486 - DNA, 23 bp, Homo sapiens
atttctaggggattttctggtgc

SEQ ID NO: 8092487 - DNA, 22 bp, Homo sapiens
atttcagtgttttaagagttca

SEQ ID NO: 8092488 - DNA, 22 bp, Homo sapiens
atttcagtgagaaagcaatcaa

SEQ ID NO: 8092489 - DNA, 22 bp, Homo sapiens
gcctgctgaagccagagtgtgt

SEQ ID NO: 8092490 - DNA, 22 bp, Homo sapiens
gcctctctgggctgccgaggct

SEQ ID NO: 8092491 - DNA, 18 bp, Homo sapiens
gcctgcctagagcttgcc

SEQ ID NO: 8092492 - DNA, 22 bp, Homo sapiens
gcctgctggatgtggccaggcc

SEQ ID NO: 8092493 - DNA, 22 bp, Homo sapiens
gcctgctggaggagcctcaggg

SEQ ID NO: 8092494 - DNA, 21 bp, Homo sapiens
gcctccagccagatggcctcc

SEQ ID NO: 8092495 - DNA, 22 bp, Homo sapiens
gcctcactgcagccccaggaag

SEQ ID NO: 8092496 - DNA, 21 bp, Homo sapiens
gcctcaccatgtcaagccagg

SEQ ID NO: 8092497 - DNA, 22 bp, Homo sapiens
atttctcagtgtacattatgtt

SEQ ID NO: 8092498 - DNA, 22 bp, Homo sapiens
gcctcgaggctgagaaggcaca

SEQ ID NO: 8092499 - DNA, 22 bp, Homo sapiens
gcctctccgagccactgcctct

SEQ ID NO: 8092500 - DNA, 22 bp, Homo sapiens
caaaggcaggccccctgtgcag

SEQ ID NO: 8092501 - DNA, 22 bp, Homo sapiens
atggggctgggattctcctcgg

SEQ ID NO: 8092502 - DNA, 22 bp, Homo sapiens
atggctggcactggcctgggtt

SEQ ID NO: 8092503 - DNA, 22 bp, Homo sapiens
gagctgggcctcagaacacagt

SEQ ID NO: 8092504 - DNA, 22 bp, Homo sapiens
gagctgggcctgcgagtgctgc

SEQ ID NO: 8092505 - DNA, 21 bp, Homo sapiens
gagctgggcgaggctccgggg

SEQ ID NO: 8092506 - DNA, 22 bp, Homo sapiens
gagctgggcgagccggggaagt

SEQ ID NO: 8092507 - DNA, 22 bp, Homo sapiens
gagctggggcagcttaggagtg

SEQ ID NO: 8092508 - DNA, 19 bp, Homo sapiens
atgtacccagtgtcaatcc

SEQ ID NO: 8092509 - DNA, 22 bp, Homo sapiens
gaggccaggggcctggagatga

SEQ ID NO: 8092510 - DNA, 22 bp, Homo sapiens
gaggccaggggcctggagatga

SEQ ID NO: 8092511 - DNA, 22 bp, Homo sapiens
gaggccagggtaccatcaacat

SEQ ID NO: 8092512 - DNA, 22 bp, Homo sapiens
gaggccagggatgcaatgagag

SEQ ID NO: 8092513 - DNA, 22 bp, Homo sapiens
gaggctgctttcctcctatcct

SEQ ID NO: 8092514 - DNA, 22 bp, Homo sapiens
gaggctgctttgatgacaggag

SEQ ID NO: 8092515 - DNA, 22 bp, Homo sapiens
gaggggagaaggcactaaccag

SEQ ID NO: 8092516 - DNA, 22 bp, Homo sapiens
gaggggagacagggaaatcagt

SEQ ID NO: 8092517 - DNA, 22 bp, Homo sapiens
gaggggagacagggaaatcagt

SEQ ID NO: 8092518 - DNA, 22 bp, Homo sapiens
gaggggagacagggaaatcagt

SEQ ID NO: 8092519 - DNA, 16 bp, Homo sapiens
gaggggagcagtaggc

SEQ ID NO: 8092520 - DNA, 22 bp, Homo sapiens
atgtctttcgcatcagtagcta

SEQ ID NO: 8092521 - DNA, 23 bp, Homo sapiens
gaggcctggccctgccacatctc

SEQ ID NO: 8092522 - DNA, 23 bp, Homo sapiens
gaggcctggccctgccacatctc

SEQ ID NO: 8092523 - DNA, 20 bp, Homo sapiens
gaggctgcggactgctggac

SEQ ID NO: 8092524 - DNA, 22 bp, Homo sapiens
gaggctgcggggaggagcctgc

SEQ ID NO: 8092525 - DNA, 22 bp, Homo sapiens
gagagctgtggtttgaccaggc

SEQ ID NO: 8092526 - DNA, 22 bp, Homo sapiens
gagagctgtgttcattctacca

SEQ ID NO: 8092527 - DNA, 22 bp, Homo sapiens
atggcagtgataggctagtgat

SEQ ID NO: 8092528 - DNA, 22 bp, Homo sapiens
atggccagtgttgagatcaggc

SEQ ID NO: 8092529 - DNA, 22 bp, Homo sapiens
atggcccaggcctcctgtggct

SEQ ID NO: 8092530 - DNA, 22 bp, Homo sapiens
gagccagctacatggtctgcaa

SEQ ID NO: 8092531 - DNA, 22 bp, Homo sapiens
gagccagctatgtagcaagagg

SEQ ID NO: 8092532 - DNA, 22 bp, Homo sapiens
gacagaggctggagcacctcct

SEQ ID NO: 8092533 - DNA, 23 bp, Homo sapiens
gacagagtgagaccttgtcttac

SEQ ID NO: 8092534 - DNA, 22 bp, Homo sapiens
atggaacatgaattaatatggt

SEQ ID NO: 8092535 - DNA, 22 bp, Homo sapiens
atggaacaagaactcagattta

SEQ ID NO: 8092536 - DNA, 22 bp, Homo sapiens
atggaagagtccccatggatga

SEQ ID NO: 8092537 - DNA, 22 bp, Homo sapiens
atcttcctttgccatgggatag

SEQ ID NO: 8092538 - DNA, 20 bp, Homo sapiens
atcttcttggccagcttgct

SEQ ID NO: 8092539 - DNA, 22 bp, Homo sapiens
cttggtccgagggcgcctaggc

SEQ ID NO: 8092540 - DNA, 22 bp, Homo sapiens
cttggtcctgcagggtctcttg

SEQ ID NO: 8092541 - DNA, 22 bp, Homo sapiens
cttggcatgcagcaggcactca

SEQ ID NO: 8092542 - DNA, 22 bp, Homo sapiens
atctacccactgaacacaatat

SEQ ID NO: 8092543 - DNA, 22 bp, Homo sapiens
atgcaaaagtaattgcaatttt

SEQ ID NO: 8092544 - DNA, 22 bp, Homo sapiens
atgcaaaataaggcagaaacat

SEQ ID NO: 8092545 - DNA, 22 bp, Homo sapiens
atgcacttcaagcatctctctg

SEQ ID NO: 8092546 - DNA, 22 bp, Homo sapiens
gacactgaagtcactaagcagg

SEQ ID NO: 8092547 - DNA, 22 bp, Homo sapiens
atgagttgaagctacaagaggc

SEQ ID NO: 8092548 - DNA, 22 bp, Homo sapiens
caaagtatgaaccagtttctct

SEQ ID NO: 8092549 - DNA, 22 bp, Homo sapiens
gctcctcttctcccactgaatg

SEQ ID NO: 8092550 - DNA, 22 bp, Homo sapiens
caaagtaactgcctttccaatt

SEQ ID NO: 8092551 - DNA, 22 bp, Homo sapiens
gctgcagtgagccaagatcgtg

SEQ ID NO: 8092552 - DNA, 22 bp, Homo sapiens
caactaatcctttgaaaagaag

SEQ ID NO: 8092553 - DNA, 22 bp, Homo sapiens
caagataagatcatttacacta

SEQ ID NO: 8092554 - DNA, 22 bp, Homo sapiens
caagatgggtgttgtgatggtt

SEQ ID NO: 8092555 - DNA, 22 bp, Homo sapiens
caagatgtgcctaatcagacct

SEQ ID NO: 8092556 - DNA, 22 bp, Homo sapiens
caaggaggaagatgcaggggac

SEQ ID NO: 8092557 - DNA, 21 bp, Homo sapiens
caaggacaggttgcagggcaa

SEQ ID NO: 8092558 - DNA, 18 bp, Homo sapiens
cacaatttacagatgaca

SEQ ID NO: 8092559 - DNA, 22 bp, Homo sapiens
cacaatttccaagtcatgttat

SEQ ID NO: 8092560 - DNA, 22 bp, Homo sapiens
cacaatttccattgagcagcag

SEQ ID NO: 8092561 - DNA, 22 bp, Homo sapiens
cacaatttcagttgcatgcaac

SEQ ID NO: 8092562 - DNA, 22 bp, Homo sapiens
cacaatttgtattttgcatcca

SEQ ID NO: 8092563 - DNA, 22 bp, Homo sapiens
cacaatttgtttgctcttagtc

SEQ ID NO: 8092564 - DNA, 22 bp, Homo sapiens
cacaatttggtgctaaagaaag

SEQ ID NO: 8092565 - DNA, 22 bp, Homo sapiens
cacaatttggacttcactggtt

SEQ ID NO: 8092566 - DNA, 22 bp, Homo sapiens
cacaatttggggtgcccactgt

SEQ ID NO: 8092567 - DNA, 22 bp, Homo sapiens
cacaatttccttgcttcacttt

SEQ ID NO: 8092568 - DNA, 22 bp, Homo sapiens
cacaatttccttgcttcacttt

SEQ ID NO: 8092569 - DNA, 22 bp, Homo sapiens
cacaatttgttttatcagtatt

SEQ ID NO: 8092570 - DNA, 22 bp, Homo sapiens
cacaatttgttttatcagtatt

SEQ ID NO: 8092571 - DNA, 22 bp, Homo sapiens
cacacattgagcagctgtttgt

SEQ ID NO: 8092572 - DNA, 22 bp, Homo sapiens
cacaccagcatggtctcagtgt

SEQ ID NO: 8092573 - DNA, 22 bp, Homo sapiens
cacaccagaggttacctgcaaa

SEQ ID NO: 8092574 - DNA, 22 bp, Homo sapiens
ggaaaactgaggctctcagcag

SEQ ID NO: 8092575 - DNA, 22 bp, Homo sapiens
cacaaaatctttctcgattatt

SEQ ID NO: 8092576 - DNA, 22 bp, Homo sapiens
cacaaaatatcaagcactttta

SEQ ID NO: 8092577 - DNA, 22 bp, Homo sapiens
cacaaaatatcaagcactttta

SEQ ID NO: 8092578 - DNA, 22 bp, Homo sapiens
cacaaacatcaatcctgttttc

SEQ ID NO: 8092579 - DNA, 22 bp, Homo sapiens
cacaaacatcaatcctgttttc

SEQ ID NO: 8092580 - DNA, 22 bp, Homo sapiens
cacaatgtggtttgtcatcttt

SEQ ID NO: 8092581 - DNA, 22 bp, Homo sapiens
cacaatgtatatgtatatcaaa

SEQ ID NO: 8092582 - DNA, 22 bp, Homo sapiens
gctgtggccaacaaaccacttt

SEQ ID NO: 8092583 - DNA, 22 bp, Homo sapiens
gctgtggcccttggcatctgcg

SEQ ID NO: 8092584 - DNA, 20 bp, Homo sapiens
gctgtggcaagtgctcactg

SEQ ID NO: 8092585 - DNA, 22 bp, Homo sapiens
caaggcagctattgtctccata

SEQ ID NO: 8092586 - DNA, 22 bp, Homo sapiens
caatttctcgaactctaatcca

SEQ ID NO: 8092587 - DNA, 22 bp, Homo sapiens
gcttggccctgccgcctgggtc

SEQ ID NO: 8092588 - DNA, 22 bp, Homo sapiens
gcttctcgggcctgatgtcgtc

SEQ ID NO: 8092589 - DNA, 22 bp, Homo sapiens
gcttctcctcccgctcccaggc

SEQ ID NO: 8092590 - DNA, 22 bp, Homo sapiens
gcttctccagaccttcatcccc

SEQ ID NO: 8092591 - DNA, 22 bp, Homo sapiens
gctgtggcctggcgcagagctg

SEQ ID NO: 8092592 - DNA, 22 bp, Homo sapiens
gctgtggccgtcagggaaatgg

SEQ ID NO: 8092593 - DNA, 22 bp, Homo sapiens
gctgtggccgggcccaggccgc

SEQ ID NO: 8092594 - DNA, 20 bp, Homo sapiens
gctgtggccgtgccagactc

SEQ ID NO: 8092595 - DNA, 22 bp, Homo sapiens
gctgtggcctccagcactcccc

SEQ ID NO: 8092596 - DNA, 22 bp, Homo sapiens
cacccactgagctcatgtccca

SEQ ID NO: 8092597 - DNA, 22 bp, Homo sapiens
cacccagcacagagggaggcga

SEQ ID NO: 8092598 - DNA, 22 bp, Homo sapiens
cacccagcagcacttaagacta

SEQ ID NO: 8092599 - DNA, 22 bp, Homo sapiens
ggcagccagagggcagctggat

SEQ ID NO: 8092600 - DNA, 21 bp, Homo sapiens
ggcagctgaccgcgcggtgca

SEQ ID NO: 8092601 - DNA, 23 bp, Homo sapiens
caccagttaaaatataaatcagc

SEQ ID NO: 8092602 - DNA, 18 bp, Homo sapiens
caccctccgcggctgccc

SEQ ID NO: 8092603 - DNA, 22 bp, Homo sapiens
caccctccagctcccgggggct

SEQ ID NO: 8092604 - DNA, 18 bp, Homo sapiens
caccctccgcggctgccc

SEQ ID NO: 8092605 - DNA, 22 bp, Homo sapiens
cactgagcatgagtgggctgtg

SEQ ID NO: 8092606 - DNA, 22 bp, Homo sapiens
cactgagctgatagaattccag

SEQ ID NO: 8092607 - DNA, 22 bp, Homo sapiens
ggcctcgcggcttctggtggct

SEQ ID NO: 8092608 - DNA, 22 bp, Homo sapiens
ggctagggatctagaccaggac

SEQ ID NO: 8092609 - DNA, 22 bp, Homo sapiens
cactggcagatttgggatctgg

SEQ ID NO: 8092610 - DNA, 22 bp, Homo sapiens
cactggcattagtcacgaggca

SEQ ID NO: 8092611 - DNA, 22 bp, Homo sapiens
cactggcatctagtgggttgag

SEQ ID NO: 8092612 - DNA, 22 bp, Homo sapiens
ggcagcagttacaaatgtgcag

SEQ ID NO: 8092613 - DNA, 22 bp, Homo sapiens
ggcagcagtggctgctattgtc

SEQ ID NO: 8092614 - DNA, 22 bp, Homo sapiens
ggcagccaccctgggaggcaga

SEQ ID NO: 8092615 - DNA, 22 bp, Homo sapiens
cacagtggattgggtgatgccc

SEQ ID NO: 8092616 - DNA, 22 bp, Homo sapiens
cacagtgctcaaacacaagtgc

SEQ ID NO: 8092617 - DNA, 22 bp, Homo sapiens
ggcacagggggctgaggactag

SEQ ID NO: 8092618 - DNA, 22 bp, Homo sapiens
ggcacagggtgatgttgcagtt

SEQ ID NO: 8092619 - DNA, 22 bp, Homo sapiens
cacagggcaggccccaggcctc

SEQ ID NO: 8092620 - DNA, 22 bp, Homo sapiens
ggcactgggaatgcagtgatga

SEQ ID NO: 8092621 - DNA, 22 bp, Homo sapiens
ggcactgggaatgcagtgatga

SEQ ID NO: 8092622 - DNA, 22 bp, Homo sapiens
cacagctgtatccaggagatcc

SEQ ID NO: 8092623 - DNA, 22 bp, Homo sapiens
cacactgataggcttgacaggc

SEQ ID NO: 8092624 - DNA, 22 bp, Homo sapiens
cacactgactggaatcaaggat

SEQ ID NO: 8092625 - DNA, 22 bp, Homo sapiens
cacactcattagtcatttctct

SEQ ID NO: 8092626 - DNA, 22 bp, Homo sapiens
ggaggcggaagttgcagtgagc

SEQ ID NO: 8092627 - DNA, 22 bp, Homo sapiens
ggaggcggacacaggtagtgtt

SEQ ID NO: 8092628 - DNA, 22 bp, Homo sapiens
ggaggcggagcttgcagtgagc

SEQ ID NO: 8092629 - DNA, 22 bp, Homo sapiens
cacagggaggcggtcactggct

SEQ ID NO: 8092630 - DNA, 22 bp, Homo sapiens
cacagggcaccagttggccatc

SEQ ID NO: 8092631 - DNA, 22 bp, Homo sapiens
ggatgttgattgaatggccatt

SEQ ID NO: 8092632 - DNA, 22 bp, Homo sapiens
cacagggaggcagccatgctcc

SEQ ID NO: 8092633 - DNA, 22 bp, Homo sapiens
ggatgggcagacaggacggcac

SEQ ID NO: 8092634 - DNA, 22 bp, Homo sapiens
ggatgggcccgggacggcgctg

SEQ ID NO: 8092635 - DNA, 22 bp, Homo sapiens
ggatgggctgaaaggtagcccc

SEQ ID NO: 8092636 - DNA, 22 bp, Homo sapiens
ggatgtagtgcaaggagtgaat

SEQ ID NO: 8092637 - DNA, 22 bp, Homo sapiens
ggatgttctggggttctcttgt

SEQ ID NO: 8092638 - DNA, 22 bp, Homo sapiens
ggatgtgaatctgggctgagac

SEQ ID NO: 8092639 - DNA, 22 bp, Homo sapiens
ggaggcggaggctgcagtgagc

SEQ ID NO: 8092640 - DNA, 23 bp, Homo sapiens
ggatgggcaagcctagtgcctac

SEQ ID NO: 8092641 - DNA, 22 bp, Homo sapiens
ggatgggagcagaggacgacca

SEQ ID NO: 8092642 - DNA, 22 bp, Homo sapiens
gggactggcacagggctgggag

SEQ ID NO: 8092643 - DNA, 22 bp, Homo sapiens
gggactggaactactggtgcag

SEQ ID NO: 8092644 - DNA, 22 bp, Homo sapiens
gggactggagtagaggccggtg

SEQ ID NO: 8092645 - DNA, 19 bp, Homo sapiens
gggactggaggatgtggag

SEQ ID NO: 8092646 - DNA, 21 bp, Homo sapiens
gggacaccaactccagggctt

SEQ ID NO: 8092647 - DNA, 22 bp, Homo sapiens
cactgggaatctgggaaagaga

SEQ ID NO: 8092648 - DNA, 22 bp, Homo sapiens
cactgggacctaggactgagct

SEQ ID NO: 8092649 - DNA, 22 bp, Homo sapiens
cactgggacctaggactgagct

SEQ ID NO: 8092650 - DNA, 22 bp, Homo sapiens
cagacaggcaggtgagagctcc

SEQ ID NO: 8092651 - DNA, 22 bp, Homo sapiens
cagaagttttgctctcttgggt

SEQ ID NO: 8092652 - DNA, 22 bp, Homo sapiens
cagacaggggtaaccttcctca

SEQ ID NO: 8092653 - DNA, 22 bp, Homo sapiens
gggcaagcagtgaggacagcac

SEQ ID NO: 8092654 - DNA, 22 bp, Homo sapiens
gggcacaccttgtctgagcaca

SEQ ID NO: 8092655 - DNA, 18 bp, Homo sapiens
gggcaagcggctgtcacc

SEQ ID NO: 8092656 - DNA, 22 bp, Homo sapiens
gggcaagctcttcagaagctct

SEQ ID NO: 8092657 - DNA, 20 bp, Homo sapiens
gggcaaggaaacagccccca

SEQ ID NO: 8092658 - DNA, 22 bp, Homo sapiens
gggcaagctttgaacatcagca

SEQ ID NO: 8092659 - DNA, 22 bp, Homo sapiens
gggaggggttgcatgtttgagt

SEQ ID NO: 8092660 - DNA, 22 bp, Homo sapiens
gggagggcttggacccagatgt

SEQ ID NO: 8092661 - DNA, 22 bp, Homo sapiens
gggtgcaggggaccctagggac

SEQ ID NO: 8092662 - DNA, 22 bp, Homo sapiens
gggtgcagggtctccagcagct

SEQ ID NO: 8092663 - DNA, 22 bp, Homo sapiens
gggtgctgactggggcctgaaa

SEQ ID NO: 8092664 - DNA, 23 bp, Homo sapiens
gggtgctgcctgtagtcatgctg

SEQ ID NO: 8092665 - DNA, 22 bp, Homo sapiens
gggtgcggtccccacagcccgt

SEQ ID NO: 8092666 - DNA, 22 bp, Homo sapiens
cagaggtgtacagagggaggcc

SEQ ID NO: 8092667 - DNA, 22 bp, Homo sapiens
cagagctggtgtgtcctggcat

SEQ ID NO: 8092668 - DNA, 22 bp, Homo sapiens
cagagctggtaagtggtagagg

SEQ ID NO: 8092669 - DNA, 22 bp, Homo sapiens
cagagctggtgtgtcctggcat

SEQ ID NO: 8092670 - DNA, 22 bp, Homo sapiens
cagagctggtgttacaagtcca

SEQ ID NO: 8092671 - DNA, 22 bp, Homo sapiens
cagagctgtatttatctttcca

SEQ ID NO: 8092672 - DNA, 22 bp, Homo sapiens
cagagctgtcatttgccagtga

SEQ ID NO: 8092673 - DNA, 22 bp, Homo sapiens
cagagctgcgctttttcctggt

SEQ ID NO: 8092674 - DNA, 22 bp, Homo sapiens
cagagctgcagattgaaggcat

SEQ ID NO: 8092675 - DNA, 22 bp, Homo sapiens
cagagctgctcatggtggccag

SEQ ID NO: 8092676 - DNA, 19 bp, Homo sapiens
cagagctgctggcctcgtc

SEQ ID NO: 8092677 - DNA, 22 bp, Homo sapiens
gggctgtgtactatgaggaggg

SEQ ID NO: 8092678 - DNA, 22 bp, Homo sapiens
gggctgtgtgcagtacgggtcc

SEQ ID NO: 8092679 - DNA, 20 bp, Homo sapiens
ggggaagaaaaggatgtgat

SEQ ID NO: 8092680 - DNA, 23 bp, Homo sapiens
cagagctgattaaacttaatctc

SEQ ID NO: 8092681 - DNA, 22 bp, Homo sapiens
cagagctgagaatgttgatgct

SEQ ID NO: 8092682 - DNA, 22 bp, Homo sapiens
cagagctgagtcttcaaggttg

SEQ ID NO: 8092683 - DNA, 22 bp, Homo sapiens
cagagctgcacattctatgatg

SEQ ID NO: 8092684 - DNA, 22 bp, Homo sapiens
cagagctgcaaatgcccctccg

SEQ ID NO: 8092685 - DNA, 22 bp, Homo sapiens
cagagctgattggatccagaga

SEQ ID NO: 8092686 - DNA, 22 bp, Homo sapiens
cagagctgacccaaggattgaa

SEQ ID NO: 8092687 - DNA, 21 bp, Homo sapiens
cagagctgaagggtgtagtgt

SEQ ID NO: 8092688 - DNA, 22 bp, Homo sapiens
gggcacagcccagtggggtccc

SEQ ID NO: 8092689 - DNA, 22 bp, Homo sapiens
gggcacagagggtcttgaagaa

SEQ ID NO: 8092690 - DNA, 22 bp, Homo sapiens
gggcacagagaaggttttagtg

SEQ ID NO: 8092691 - DNA, 22 bp, Homo sapiens
gggcacagagggtcttgaagaa

SEQ ID NO: 8092692 - DNA, 22 bp, Homo sapiens
gggcacagaagtctaagacatc

SEQ ID NO: 8092693 - DNA, 22 bp, Homo sapiens
cagagcccctcgtctccaccac

SEQ ID NO: 8092694 - DNA, 22 bp, Homo sapiens
cagagccctgcatgctccatct

SEQ ID NO: 8092695 - DNA, 21 bp, Homo sapiens
gggcgaggcctgatgtggctc

SEQ ID NO: 8092696 - DNA, 22 bp, Homo sapiens
gggcgagggcgaaagcgagagc

SEQ ID NO: 8092697 - DNA, 22 bp, Homo sapiens
cagagcccttcctcccacgggg

SEQ ID NO: 8092698 - DNA, 22 bp, Homo sapiens
gggcgaggactgactctgggca

SEQ ID NO: 8092699 - DNA, 22 bp, Homo sapiens
cagccaagaaagcagtgctcca

SEQ ID NO: 8092700 - DNA, 22 bp, Homo sapiens
cagcccagcagactgttaccac

SEQ ID NO: 8092701 - DNA, 22 bp, Homo sapiens
cagcccagcagactgttaccac

SEQ ID NO: 8092702 - DNA, 22 bp, Homo sapiens
cagcccagagccagttcccgct

SEQ ID NO: 8092703 - DNA, 22 bp, Homo sapiens
cagcccagagccagttcccgct

SEQ ID NO: 8092704 - DNA, 22 bp, Homo sapiens
cagcccagcactaagtagattt

SEQ ID NO: 8092705 - DNA, 21 bp, Homo sapiens
cagcccagcccattgacagtg

SEQ ID NO: 8092706 - DNA, 22 bp, Homo sapiens
cagcccagcagtcttagcctgc

SEQ ID NO: 8092707 - DNA, 22 bp, Homo sapiens
cagcccagcagtcttagcctgc

SEQ ID NO: 8092708 - DNA, 22 bp, Homo sapiens
cagcccagcagggtctggccct

SEQ ID NO: 8092709 - DNA, 22 bp, Homo sapiens
cagcccagcagggtctggccct

SEQ ID NO: 8092710 - DNA, 22 bp, Homo sapiens
cagcccagcagggtctggccct

SEQ ID NO: 8092711 - DNA, 21 bp, Homo sapiens
cagcccagcccattgacagtg

SEQ ID NO: 8092712 - DNA, 21 bp, Homo sapiens
cagcccagcccattgacagtg

SEQ ID NO: 8092713 - DNA, 22 bp, Homo sapiens
cagcaaggccattggatgcagt

SEQ ID NO: 8092714 - DNA, 22 bp, Homo sapiens
ggtgggggagacttggtcaaga

SEQ ID NO: 8092715 - DNA, 22 bp, Homo sapiens
ggtgggagagctctgtctccag

SEQ ID NO: 8092716 - DNA, 22 bp, Homo sapiens
ggttcccggatctccgagtccc

SEQ ID NO: 8092717 - DNA, 22 bp, Homo sapiens
ggttccccaggcggcccttgga

SEQ ID NO: 8092718 - DNA, 20 bp, Homo sapiens
gtaaaatatggtctttgggt

SEQ ID NO: 8092719 - DNA, 20 bp, Homo sapiens
gtaaaatatggtctttgggt

SEQ ID NO: 8092720 - DNA, 22 bp, Homo sapiens
cagcagagtttggcttctaatg

SEQ ID NO: 8092721 - DNA, 22 bp, Homo sapiens
cagcagagtaattctcacctct

SEQ ID NO: 8092722 - DNA, 22 bp, Homo sapiens
cagcagcaaatctagaagagga

SEQ ID NO: 8092723 - DNA, 22 bp, Homo sapiens
cagcagcaacaacggaagcctt

SEQ ID NO: 8092724 - DNA, 22 bp, Homo sapiens
gtatttctagaaccaaaagcca

SEQ ID NO: 8092725 - DNA, 22 bp, Homo sapiens
gtatttctagaaaatgcagatt

SEQ ID NO: 8092726 - DNA, 22 bp, Homo sapiens
gtatttctagaatggtagcact

SEQ ID NO: 8092727 - DNA, 22 bp, Homo sapiens
gtatttctagtttcttccacag

SEQ ID NO: 8092728 - DNA, 22 bp, Homo sapiens
gtatttctgcaaagtgtgtgac

SEQ ID NO: 8092729 - DNA, 22 bp, Homo sapiens
gtatttctggtaactgctgcta

SEQ ID NO: 8092730 - DNA, 22 bp, Homo sapiens
gtatttctggttaaatgtgcta

SEQ ID NO: 8092731 - DNA, 16 bp, Homo sapiens
gtatttcttagacttt

SEQ ID NO: 8092732 - DNA, 22 bp, Homo sapiens
gtatttcttccacggtggattt

SEQ ID NO: 8092733 - DNA, 22 bp, Homo sapiens
gtatttcttggaaatcctttta

SEQ ID NO: 8092734 - DNA, 22 bp, Homo sapiens
gtatttcttgtacttccttgtc

SEQ ID NO: 8092735 - DNA, 22 bp, Homo sapiens
gtatttctttacatatgctcat

SEQ ID NO: 8092736 - DNA, 22 bp, Homo sapiens
gtatttctttatctggtcagaa

SEQ ID NO: 8092737 - DNA, 15 bp, Homo sapiens
gtatttcttttatat

SEQ ID NO: 8092738 - DNA, 22 bp, Homo sapiens
gtatttctttccattatagtca

SEQ ID NO: 8092739 - DNA, 22 bp, Homo sapiens
cagcaggattggatacatctca

SEQ ID NO: 8092740 - DNA, 22 bp, Homo sapiens
cagcaggatttgaaaggaagag

SEQ ID NO: 8092741 - DNA, 22 bp, Homo sapiens
cagcaggcaggtgggccaagtc

SEQ ID NO: 8092742 - DNA, 22 bp, Homo sapiens
cagcagctacttggagcagcag

SEQ ID NO: 8092743 - DNA, 22 bp, Homo sapiens
cagcaggaccattgaggcatca

SEQ ID NO: 8092744 - DNA, 22 bp, Homo sapiens
ctcagtgtgaatgctcagtaaa

SEQ ID NO: 8092745 - DNA, 22 bp, Homo sapiens
agtgacaggaccaggtctggaa

SEQ ID NO: 8092746 - DNA, 22 bp, Homo sapiens
agtgacaggggaggcaggtgtg

SEQ ID NO: 8092747 - DNA, 22 bp, Homo sapiens
ctcaggccaataagctccagcc

SEQ ID NO: 8092748 - DNA, 22 bp, Homo sapiens
ctcagggaattgaatctccttg

SEQ ID NO: 8092749 - DNA, 18 bp, Homo sapiens
agtctcagcggaggagta

SEQ ID NO: 8092750 - DNA, 22 bp, Homo sapiens
agtctcagagtacctgagggac

SEQ ID NO: 8092751 - DNA, 22 bp, Homo sapiens
ctcagctagtaacgtacatgtc

SEQ ID NO: 8092752 - DNA, 22 bp, Homo sapiens
ctcagctccagccctcagcagc

SEQ ID NO: 8092753 - DNA, 22 bp, Homo sapiens
ctcagcacatctttacatttcc

SEQ ID NO: 8092754 - DNA, 22 bp, Homo sapiens
cggggttcatccatgctgtggc

SEQ ID NO: 8092755 - DNA, 23 bp, Homo sapiens
ctcaaccctagtaagggagtagg

SEQ ID NO: 8092756 - DNA, 23 bp, Homo sapiens
ctcaacatccattcttgcccttc

SEQ ID NO: 8092757 - DNA, 22 bp, Homo sapiens
ctcaaatccccgttcctcattc

SEQ ID NO: 8092758 - DNA, 22 bp, Homo sapiens
agtcccagctactcaagaggct

SEQ ID NO: 8092759 - DNA, 21 bp, Homo sapiens
ctcagaccacagctcacaccc

SEQ ID NO: 8092760 - DNA, 22 bp, Homo sapiens
ctcctgagtagtagcattgtca

SEQ ID NO: 8092761 - DNA, 22 bp, Homo sapiens
ctcctgagtctccacgccccgt

SEQ ID NO: 8092762 - DNA, 22 bp, Homo sapiens
ctcctgcatgctcacatatgcc

SEQ ID NO: 8092763 - DNA, 22 bp, Homo sapiens
ctcctgagggatgcttaggctt

SEQ ID NO: 8092764 - DNA, 22 bp, Homo sapiens
ctcctgaggaaaagcttggtca

SEQ ID NO: 8092765 - DNA, 20 bp, Homo sapiens
ctctcccagcacagcttcct

SEQ ID NO: 8092766 - DNA, 22 bp, Homo sapiens
ctctcccagtcaggctcaggat

SEQ ID NO: 8092767 - DNA, 22 bp, Homo sapiens
ctctccttgaggcttggacttc

SEQ ID NO: 8092768 - DNA, 17 bp, Homo sapiens
ctctccttcctctgagg

SEQ ID NO: 8092769 - DNA, 22 bp, Homo sapiens
ctctccttgcagatggctgcct

SEQ ID NO: 8092770 - DNA, 20 bp, Homo sapiens
ctctccttgccgacttggca

SEQ ID NO: 8092771 - DNA, 22 bp, Homo sapiens
ctctcctttcactaaatattct

SEQ ID NO: 8092772 - DNA, 22 bp, Homo sapiens
ctctcctttactgcagagagcg

SEQ ID NO: 8092773 - DNA, 22 bp, Homo sapiens
ctctcctttgaagcaactgtat

SEQ ID NO: 8092774 - DNA, 22 bp, Homo sapiens
ctctcctttgaagcaactgtat

SEQ ID NO: 8092775 - DNA, 22 bp, Homo sapiens
ctctctatggatgcagtttttc

SEQ ID NO: 8092776 - DNA, 22 bp, Homo sapiens
ctcttcttgtctctggttagaa

SEQ ID NO: 8092777 - DNA, 22 bp, Homo sapiens
ctcttctttagtccagaccatc

SEQ ID NO: 8092778 - DNA, 22 bp, Homo sapiens
ctcttagtaatgccatgaagca

SEQ ID NO: 8092779 - DNA, 22 bp, Homo sapiens
ctcttcttggcccccatgaggg

SEQ ID NO: 8092780 - DNA, 22 bp, Homo sapiens
ctcttgggatacactgccatag

SEQ ID NO: 8092781 - DNA, 22 bp, Homo sapiens
agtgtaaacttaagagaatatc

SEQ ID NO: 8092782 - DNA, 19 bp, Homo sapiens
ctctggagaacaatagtgc

SEQ ID NO: 8092783 - DNA, 22 bp, Homo sapiens
agtgggagaatgaataagggcc

SEQ ID NO: 8092784 - DNA, 22 bp, Homo sapiens
agtgggagagaagcaagtagta

SEQ ID NO: 8092785 - DNA, 22 bp, Homo sapiens
agtatattgctcttaatcatag

SEQ ID NO: 8092786 - DNA, 22 bp, Homo sapiens
cggctcagacttcccaagaaca

SEQ ID NO: 8092787 - DNA, 20 bp, Homo sapiens
cggctcagcctctccctccc

SEQ ID NO: 8092788 - DNA, 22 bp, Homo sapiens
cggctcactgcagctccgcctc

SEQ ID NO: 8092789 - DNA, 22 bp, Homo sapiens
cggccaggcacagtggcccacg

SEQ ID NO: 8092790 - DNA, 22 bp, Homo sapiens
cggaggggtttgaacagaggag

SEQ ID NO: 8092791 - DNA, 22 bp, Homo sapiens
cggaggggatacattttctgaa

SEQ ID NO: 8092792 - DNA, 22 bp, Homo sapiens
cctttattcaattagtcctaat

SEQ ID NO: 8092793 - DNA, 22 bp, Homo sapiens
cctttattcaattagtcctaat

SEQ ID NO: 8092794 - DNA, 22 bp, Homo sapiens
cgaggaaatatttacaactgat

SEQ ID NO: 8092795 - DNA, 22 bp, Homo sapiens
aggtggcatgagactgtaccag

SEQ ID NO: 8092796 - DNA, 22 bp, Homo sapiens
aggtgcaggagctgtgcaggga

SEQ ID NO: 8092797 - DNA, 22 bp, Homo sapiens
cctgggagaactgctgggttgg

SEQ ID NO: 8092798 - DNA, 22 bp, Homo sapiens
ccttggaggactgctgcttctt

SEQ ID NO: 8092799 - DNA, 21 bp, Homo sapiens
aggtgggagaccatgtaggtc

SEQ ID NO: 8092800 - DNA, 22 bp, Homo sapiens
aggtgggaacccagcagggccc

SEQ ID NO: 8092801 - DNA, 22 bp, Homo sapiens
cctggacagggccaggccatgc

SEQ ID NO: 8092802 - DNA, 22 bp, Homo sapiens
cctggacagagggcagcggcca

SEQ ID NO: 8092803 - DNA, 22 bp, Homo sapiens
cctggccagaggcgtgcctgtg

SEQ ID NO: 8092804 - DNA, 22 bp, Homo sapiens
cctgcccatactgacctctaat

SEQ ID NO: 8092805 - DNA, 22 bp, Homo sapiens
cctgccctaatccagagactag

SEQ ID NO: 8092806 - DNA, 22 bp, Homo sapiens
cctctgagtgacagcctcctct

SEQ ID NO: 8092807 - DNA, 22 bp, Homo sapiens
cctctctcttgtagtccctgcc

SEQ ID NO: 8092808 - DNA, 22 bp, Homo sapiens
agggtctgtggatgcatctggg

SEQ ID NO: 8092809 - DNA, 22 bp, Homo sapiens
agggtcaggttaagggagtcat

SEQ ID NO: 8092810 - DNA, 22 bp, Homo sapiens
ctggagggctgcagcgaggctg

SEQ ID NO: 8092811 - DNA, 22 bp, Homo sapiens
ctggcagcggtttgcagcctgg

SEQ ID NO: 8092812 - DNA, 22 bp, Homo sapiens
atactttctgaccaattaattg

SEQ ID NO: 8092813 - DNA, 22 bp, Homo sapiens
ctggcagcgcagcatgaagtcg

SEQ ID NO: 8092814 - DNA, 22 bp, Homo sapiens
ctggagcccaggcctggtgtct

SEQ ID NO: 8092815 - DNA, 22 bp, Homo sapiens
ctggagccagccagggccctct

SEQ ID NO: 8092816 - DNA, 22 bp, Homo sapiens
ctggagagaccgaaagaggctg

SEQ ID NO: 8092817 - DNA, 22 bp, Homo sapiens
ctgcccaccgtgtgcacgtgcg

SEQ ID NO: 8092818 - DNA, 22 bp, Homo sapiens
ctgctctgctgatcagtgtctc

SEQ ID NO: 8092819 - DNA, 22 bp, Homo sapiens
ctgctctggcgtactcggcatc

SEQ ID NO: 8092820 - DNA, 22 bp, Homo sapiens
atacaactttatctgtaatgag

SEQ ID NO: 8092821 - DNA, 22 bp, Homo sapiens
atacaactttatctgtaatgag

SEQ ID NO: 8092822 - DNA, 20 bp, Homo sapiens
ctgaggggtctgacttggac

SEQ ID NO: 8092823 - DNA, 22 bp, Homo sapiens
ctgaggggataaaggtttgggt

SEQ ID NO: 8092824 - DNA, 22 bp, Homo sapiens
agttggttcactccttcatgcc

SEQ ID NO: 8092825 - DNA, 22 bp, Homo sapiens
ctgaggcctcgttggctggaac

SEQ ID NO: 8092826 - DNA, 22 bp, Homo sapiens
ctgcagctaaggaatgtggttg

SEQ ID NO: 8092827 - DNA, 22 bp, Homo sapiens
agtttgaaagtattgacagaag

SEQ ID NO: 8092828 - DNA, 22 bp, Homo sapiens
agtttgaaatgttggcaatatt

SEQ ID NO: 8092829 - DNA, 22 bp, Homo sapiens
agtttgaattgaaatgcagatg

SEQ ID NO: 8092830 - DNA, 22 bp, Homo sapiens
ataaatatcactgttgtccctc

SEQ ID NO: 8092831 - DNA, 20 bp, Homo sapiens
ataaaataactgccacaaga

SEQ ID NO: 8092832 - DNA, 20 bp, Homo sapiens
ataaaataactgccacaaga

SEQ ID NO: 8092833 - DNA, 22 bp, Homo sapiens
atcatgttccagaaacagtgat

SEQ ID NO: 8092834 - DNA, 22 bp, Homo sapiens
ctgtggagcagggcagggtcac

SEQ ID NO: 8092835 - DNA, 22 bp, Homo sapiens
atcattctagtccttatggtct

SEQ ID NO: 8092836 - DNA, 22 bp, Homo sapiens
atcattctattgttgagctgcc

SEQ ID NO: 8092837 - DNA, 22 bp, Homo sapiens
atccccctgtatctggaagaat

SEQ ID NO: 8092838 - DNA, 22 bp, Homo sapiens
atcacagttactcaaataatga

SEQ ID NO: 8092839 - DNA, 22 bp, Homo sapiens
atcacagtctttttcttaagta

SEQ ID NO: 8092840 - DNA, 22 bp, Homo sapiens
ctgggtcccctcagtgacactg

SEQ ID NO: 8092841 - DNA, 22 bp, Homo sapiens
ctgggtagggcaaggaactggc

SEQ ID NO: 8092842 - DNA, 22 bp, Homo sapiens
ctgggtaagttcctaaggctca

SEQ ID NO: 8092843 - DNA, 22 bp, Homo sapiens
atatatatcgagttcatgtctc

SEQ ID NO: 8092844 - DNA, 22 bp, Homo sapiens
ctgggcacaagtggccctggat

SEQ ID NO: 8092845 - DNA, 22 bp, Homo sapiens
ctgggcacagaccccctgggcc

SEQ ID NO: 8092846 - DNA, 22 bp, Homo sapiens
ctgggcacagcgttgggctctt

SEQ ID NO: 8092847 - DNA, 22 bp, Homo sapiens
ctgggcacctttgcagcaggct

SEQ ID NO: 8092848 - DNA, 22 bp, Homo sapiens
ctgggcacagtggctcacgcct

SEQ ID NO: 8092849 - DNA, 22 bp, Homo sapiens
ctgggacacccaaggaaagagc

SEQ ID NO: 8092850 - DNA, 22 bp, Homo sapiens
atataatacaacctgctaagtg

SEQ ID NO: 8092851 - DNA, 22 bp, Homo sapiens
ctggcagctgcccgagatgccc

SEQ ID NO: 8092852 - DNA, 22 bp, Homo sapiens
ctggcagctggaggctagaggc

SEQ ID NO: 8092853 - DNA, 22 bp, Homo sapiens
ctggcagcttagcactctggtt

SEQ ID NO: 8092854 - DNA, 22 bp, Homo sapiens
atatttactgctgtggtgaagg

SEQ ID NO: 8092855 - DNA, 22 bp, Homo sapiens
atatttctctcagacatggaag

SEQ ID NO: 8092856 - DNA, 22 bp, Homo sapiens
atatttcttgagcacctggtat

SEQ ID NO: 8092857 - DNA, 22 bp, Homo sapiens
atatttctctcagacatggaag

SEQ ID NO: 8092858 - DNA, 22 bp, Homo sapiens
atatttctgggggtgtgtttct

SEQ ID NO: 8092859 - DNA, 20 bp, Homo sapiens
atatttcttaagaactttca

SEQ ID NO: 8092860 - DNA, 22 bp, Homo sapiens
ctgggcaggatacttcatggga

SEQ ID NO: 8092861 - DNA, 22 bp, Homo sapiens
atatatcatgagtaaaacttga

SEQ ID NO: 8092862 - DNA, 22 bp, Homo sapiens
atatgaagtcagacaaactggg

SEQ ID NO: 8092863 - DNA, 22 bp, Homo sapiens
aggcatggcatggggcagatgt

SEQ ID NO: 8092864 - DNA, 22 bp, Homo sapiens
aggcagtgctcaagacagcagc

SEQ ID NO: 8092865 - DNA, 22 bp, Homo sapiens
aggccaagattttggatcagct

SEQ ID NO: 8092866 - DNA, 22 bp, Homo sapiens
aggccagctcaccctggctcct

SEQ ID NO: 8092867 - DNA, 22 bp, Homo sapiens
aggccagctcaccctggctcct

SEQ ID NO: 8092868 - DNA, 22 bp, Homo sapiens
aggccagcgctgctagctcccg

SEQ ID NO: 8092869 - DNA, 22 bp, Homo sapiens
aggccagctatgactctgctcc

SEQ ID NO: 8092870 - DNA, 22 bp, Homo sapiens
aggcccagttatcctacttgtt

SEQ ID NO: 8092871 - DNA, 22 bp, Homo sapiens
aggccccatcaggaaggaggcc

SEQ ID NO: 8092872 - DNA, 22 bp, Homo sapiens
aggccagcttctaccctctgtt

SEQ ID NO: 8092873 - DNA, 22 bp, Homo sapiens
aggccaggaatccttgtcccag

SEQ ID NO: 8092874 - DNA, 20 bp, Homo sapiens
aggccaggaaatgtagttct

SEQ ID NO: 8092875 - DNA, 22 bp, Homo sapiens
aggccaggaccattagcccaga

SEQ ID NO: 8092876 - DNA, 22 bp, Homo sapiens
aggccaggaccattagcccaga

SEQ ID NO: 8092877 - DNA, 22 bp, Homo sapiens
aggccaggaatccttgtcccag

SEQ ID NO: 8092878 - DNA, 22 bp, Homo sapiens
aggccaggacacttaagtaaga

SEQ ID NO: 8092879 - DNA, 22 bp, Homo sapiens
aggccaggatagcatggatcag

SEQ ID NO: 8092880 - DNA, 22 bp, Homo sapiens
aggccaggatagcatggatcag

SEQ ID NO: 8092881 - DNA, 23 bp, Homo sapiens
ccagtgattgcctggaaggaggt

SEQ ID NO: 8092882 - DNA, 22 bp, Homo sapiens
ccagtttaggtactaggctcta

SEQ ID NO: 8092883 - DNA, 22 bp, Homo sapiens
aggctctgcatccaggctttat

SEQ ID NO: 8092884 - DNA, 22 bp, Homo sapiens
aggctctgaggcagattttcgt

SEQ ID NO: 8092885 - DNA, 22 bp, Homo sapiens
aggctctgatcaggtggctgtg

SEQ ID NO: 8092886 - DNA, 22 bp, Homo sapiens
aggcctagaggaatggccaggg

SEQ ID NO: 8092887 - DNA, 21 bp, Homo sapiens
ccaggcatgactgcagagagc

SEQ ID NO: 8092888 - DNA, 22 bp, Homo sapiens
ccaggcatccattgcttcctct

SEQ ID NO: 8092889 - DNA, 22 bp, Homo sapiens
ccaggccaaattcagtcagcag

SEQ ID NO: 8092890 - DNA, 22 bp, Homo sapiens
aggcctcctggctccaggcctt

SEQ ID NO: 8092891 - DNA, 22 bp, Homo sapiens
ccaggctctatccctccttctt

SEQ ID NO: 8092892 - DNA, 22 bp, Homo sapiens
ccaggctctgcgctggacatgg

SEQ ID NO: 8092893 - DNA, 15 bp, Homo sapiens
ccaggctctgcactc

SEQ ID NO: 8092894 - DNA, 22 bp, Homo sapiens
ccaggctctgccaggcccttga

SEQ ID NO: 8092895 - DNA, 22 bp, Homo sapiens
ccaggctctgcaaaatcaggct

SEQ ID NO: 8092896 - DNA, 22 bp, Homo sapiens
ccaggctctgagcctcactctt

SEQ ID NO: 8092897 - DNA, 22 bp, Homo sapiens
ccaggctctgacatagatggga

SEQ ID NO: 8092898 - DNA, 22 bp, Homo sapiens
ccaggctctgagaggaatgtga

SEQ ID NO: 8092899 - DNA, 22 bp, Homo sapiens
ccaggcctagcccctgagggta

SEQ ID NO: 8092900 - DNA, 22 bp, Homo sapiens
agggcagctgtgagccactgtg

SEQ ID NO: 8092901 - DNA, 22 bp, Homo sapiens
agggcagctggaaggtggcttc

SEQ ID NO: 8092902 - DNA, 22 bp, Homo sapiens
agggcagctaaggtgctgactg

SEQ ID NO: 8092903 - DNA, 22 bp, Homo sapiens
agggcagcctgagtgctggccc

SEQ ID NO: 8092904 - DNA, 22 bp, Homo sapiens
agggcagcctctcagcctaggt

SEQ ID NO: 8092905 - DNA, 22 bp, Homo sapiens
agggcagccatgagccttcagg

SEQ ID NO: 8092906 - DNA, 22 bp, Homo sapiens
agggaggagtcctcaaagtcat

SEQ ID NO: 8092907 - DNA, 22 bp, Homo sapiens
agggccaggaacacctgaaggg

SEQ ID NO: 8092908 - DNA, 18 bp, Homo sapiens
agggccagctgtgagtag

SEQ ID NO: 8092909 - DNA, 22 bp, Homo sapiens
agggccaggatcacagccaaga

SEQ ID NO: 8092910 - DNA, 22 bp, Homo sapiens
agggccaggatcacagccaaga

SEQ ID NO: 8092911 - DNA, 22 bp, Homo sapiens
agggccagctagagccctcgcc

SEQ ID NO: 8092912 - DNA, 22 bp, Homo sapiens
agggccagccgacttccagcct

SEQ ID NO: 8092913 - DNA, 22 bp, Homo sapiens
agggccagccgacttccagcct

SEQ ID NO: 8092914 - DNA, 22 bp, Homo sapiens
agggccagggaagctgtatttt

SEQ ID NO: 8092915 - DNA, 22 bp, Homo sapiens
agggccagggaaacgatcagca

SEQ ID NO: 8092916 - DNA, 22 bp, Homo sapiens
agggccagggaaacgatcagca

SEQ ID NO: 8092917 - DNA, 22 bp, Homo sapiens
agggccaggctcccatgtcagg

SEQ ID NO: 8092918 - DNA, 22 bp, Homo sapiens
ccctggggctgagggatggccg

SEQ ID NO: 8092919 - DNA, 22 bp, Homo sapiens
ccctggggagcaggcgaaggag

SEQ ID NO: 8092920 - DNA, 20 bp, Homo sapiens
cctccaggcacacccatgtg

SEQ ID NO: 8092921 - DNA, 22 bp, Homo sapiens
cctccaggccttgcaggttaac

SEQ ID NO: 8092922 - DNA, 23 bp, Homo sapiens
cctcccaggctgcgagtcccgag

SEQ ID NO: 8092923 - DNA, 22 bp, Homo sapiens
cctccaggctggttatcagctg

SEQ ID NO: 8092924 - DNA, 22 bp, Homo sapiens
cctccaggataagtcagggcct

SEQ ID NO: 8092925 - DNA, 22 bp, Homo sapiens
cctcgcggcactcgggccggat

SEQ ID NO: 8092926 - DNA, 22 bp, Homo sapiens
cctcgcggcactcgggccggat

SEQ ID NO: 8092927 - DNA, 22 bp, Homo sapiens
cctctccttgcacccgtcccgc

SEQ ID NO: 8092928 - DNA, 22 bp, Homo sapiens
cctctctccaattttcacctca

SEQ ID NO: 8092929 - DNA, 22 bp, Homo sapiens
cctcccagtgcctccagagcag

SEQ ID NO: 8092930 - DNA, 22 bp, Homo sapiens
cctcaagtcaattctgtctcgc

SEQ ID NO: 8092931 - DNA, 21 bp, Homo sapiens
cctcaagtgcctcctgctgct

SEQ ID NO: 8092932 - DNA, 22 bp, Homo sapiens
cctcaaattgctcagcgtctag

SEQ ID NO: 8092933 - DNA, 23 bp, Homo sapiens
cctcaaatgtagcctttttccca

SEQ ID NO: 8092934 - DNA, 22 bp, Homo sapiens
cctcaaatagcccccagtctag

SEQ ID NO: 8092935 - DNA, 22 bp, Homo sapiens
cctcaaatctttagagttattt

SEQ ID NO: 8092936 - DNA, 22 bp, Homo sapiens
cctcaaattggcattaattaag

SEQ ID NO: 8092937 - DNA, 22 bp, Homo sapiens
cctcaaattgtcaaataagaat

SEQ ID NO: 8092938 - DNA, 22 bp, Homo sapiens
cctcagagccatgcctgagttc

SEQ ID NO: 8092939 - DNA, 22 bp, Homo sapiens
cctcagagccatgcctgagttc

SEQ ID NO: 8092940 - DNA, 22 bp, Homo sapiens
cctcagagcagcacccagatga

SEQ ID NO: 8092941 - DNA, 22 bp, Homo sapiens
cctcaaataagttttatttatc

SEQ ID NO: 8092942 - DNA, 20 bp, Homo sapiens
cctcaaataagtgccagcat

SEQ ID NO: 8092943 - DNA, 22 bp, Homo sapiens
ccctgtggttgctagggcacag

SEQ ID NO: 8092944 - DNA, 22 bp, Homo sapiens
ccatgagcttcctatatagggt

SEQ ID NO: 8092945 - DNA, 22 bp, Homo sapiens
ccatgagcttcaactgacacag

SEQ ID NO: 8092946 - DNA, 22 bp, Homo sapiens
ccatgagccaggctgaggaagc

SEQ ID NO: 8092947 - DNA, 22 bp, Homo sapiens
cccagcagtttgcttagagtga

SEQ ID NO: 8092948 - DNA, 22 bp, Homo sapiens
cccagcagttgttggtgcacat

SEQ ID NO: 8092949 - DNA, 22 bp, Homo sapiens
cccagcagtgacccagtgatac

SEQ ID NO: 8092950 - DNA, 22 bp, Homo sapiens
cccagcacaggcaattccatac

SEQ ID NO: 8092951 - DNA, 22 bp, Homo sapiens
cccagcaaggccagctcagggc

SEQ ID NO: 8092952 - DNA, 22 bp, Homo sapiens
cccagcctggtgcactgtgggg

SEQ ID NO: 8092953 - DNA, 22 bp, Homo sapiens
cccagcctggtgcactgtgggg

SEQ ID NO: 8092954 - DNA, 22 bp, Homo sapiens
cccagcctctgggctcacccaa

SEQ ID NO: 8092955 - DNA, 22 bp, Homo sapiens
cccagcctctgtttgctcctct

SEQ ID NO: 8092956 - DNA, 22 bp, Homo sapiens
ccccaggtggatggctcgcata

SEQ ID NO: 8092957 - DNA, 22 bp, Homo sapiens
ccccagggtcagtgtgtggagg

SEQ ID NO: 8092958 - DNA, 22 bp, Homo sapiens
agggagccagagttgggagctc

SEQ ID NO: 8092959 - DNA, 22 bp, Homo sapiens
agggaagggcagggtctatgca

SEQ ID NO: 8092960 - DNA, 19 bp, Homo sapiens
aggagccttgagcagtgag

SEQ ID NO: 8092961 - DNA, 22 bp, Homo sapiens
aggagccatgagcaggaggcaa

SEQ ID NO: 8092962 - DNA, 20 bp, Homo sapiens
aggagctgaattagagggtt

SEQ ID NO: 8092963 - DNA, 22 bp, Homo sapiens
aggagctgaagtctctgcactc

SEQ ID NO: 8092964 - DNA, 22 bp, Homo sapiens
aggagctgagtcagcccgacag

SEQ ID NO: 8092965 - DNA, 22 bp, Homo sapiens
aggagctgataaaagggggtca

SEQ ID NO: 8092966 - DNA, 21 bp, Homo sapiens
aggagctgtgtgcttcctttc

SEQ ID NO: 8092967 - DNA, 22 bp, Homo sapiens
aggaggaatacaatccagcagc

SEQ ID NO: 8092968 - DNA, 22 bp, Homo sapiens
aggaggaggtgggacacagtga

SEQ ID NO: 8092969 - DNA, 22 bp, Homo sapiens
aggaggcaactgagatttagaa

SEQ ID NO: 8092970 - DNA, 20 bp, Homo sapiens
aggaggcaatgtagataagc

SEQ ID NO: 8092971 - DNA, 20 bp, Homo sapiens
aggacagcagctgccacttg

SEQ ID NO: 8092972 - DNA, 22 bp, Homo sapiens
aggaaggaagagacaccatttg

SEQ ID NO: 8092973 - DNA, 21 bp, Homo sapiens
aggagaaacacaggtcagccc

SEQ ID NO: 8092974 - DNA, 22 bp, Homo sapiens
aggacagcccttgagagcacat

SEQ ID NO: 8092975 - DNA, 22 bp, Homo sapiens
aggacagcatatgggaaccagt

SEQ ID NO: 8092976 - DNA, 22 bp, Homo sapiens
aggacagcatatgggaaccagt

SEQ ID NO: 8092977 - DNA, 22 bp, Homo sapiens
aggacagcagtgctggcacttg

SEQ ID NO: 8092978 - DNA, 22 bp, Homo sapiens
aggacagcattttcagcatctc

SEQ ID NO: 8092979 - DNA, 22 bp, Homo sapiens
aggacagcattttcagcatctc

SEQ ID NO: 8092980 - DNA, 22 bp, Homo sapiens
aggacagcccccaacagcaaca

SEQ ID NO: 8092981 - DNA, 22 bp, Homo sapiens
aggacagcccttgagagcacat

SEQ ID NO: 8092982 - DNA, 22 bp, Homo sapiens
catgcagcctgtgaacagtgtc

SEQ ID NO: 8092983 - DNA, 22 bp, Homo sapiens
catgcaggaggaaaaagcagct

SEQ ID NO: 8092984 - DNA, 22 bp, Homo sapiens
catgcaggcctatggagcagtg

SEQ ID NO: 8092985 - DNA, 23 bp, Homo sapiens
catgccagtttgtgcaggcagat

SEQ ID NO: 8092986 - DNA, 22 bp, Homo sapiens
aggcacaggaatgtcatccagt

SEQ ID NO: 8092987 - DNA, 22 bp, Homo sapiens
aggcacaggaatgtcatccagt

SEQ ID NO: 8092988 - DNA, 22 bp, Homo sapiens
aggcacaggaggtggtaagaag

SEQ ID NO: 8092989 - DNA, 22 bp, Homo sapiens
aggcacaggcctcagcacccag

SEQ ID NO: 8092990 - DNA, 22 bp, Homo sapiens
aggcacaggcctcagcacccag

SEQ ID NO: 8092991 - DNA, 22 bp, Homo sapiens
aggcacagcctcccttcacatg

SEQ ID NO: 8092992 - DNA, 22 bp, Homo sapiens
aggcacaggaacaggaaaagag

SEQ ID NO: 8092993 - DNA, 22 bp, Homo sapiens
aggcacagcctcccccaactcc

SEQ ID NO: 8092994 - DNA, 22 bp, Homo sapiens
aggcacagcctcccccaactcc

SEQ ID NO: 8092995 - DNA, 22 bp, Homo sapiens
aggcagcagaaaacaaatggtt

SEQ ID NO: 8092996 - DNA, 19 bp, Homo sapiens
aggcagcattctggggctt

SEQ ID NO: 8092997 - DNA, 22 bp, Homo sapiens
aggcagcatttgaatccaggtc

SEQ ID NO: 8092998 - DNA, 22 bp, Homo sapiens
cattatgtgagtgattaattca

SEQ ID NO: 8092999 - DNA, 22 bp, Homo sapiens
cattatgtgggaaaatgttctt

SEQ ID NO: 8093000 - DNA, 18 bp, Homo sapiens
cattatgtggttatagaa

SEQ ID NO: 8093001 - DNA, 22 bp, Homo sapiens
cattatgttcagtagcttaaaa

SEQ ID NO: 8093002 - DNA, 23 bp, Homo sapiens
agctctgaaatagggaaagagga

SEQ ID NO: 8093003 - DNA, 18 bp, Homo sapiens
agctctcccccacatgcc

SEQ ID NO: 8093004 - DNA, 22 bp, Homo sapiens
cagcttctgtctgattagcaag

SEQ ID NO: 8093005 - DNA, 21 bp, Homo sapiens
caggaaaagcggaagtctagc

SEQ ID NO: 8093006 - DNA, 22 bp, Homo sapiens
caggacagagcccagactgtgt

SEQ ID NO: 8093007 - DNA, 22 bp, Homo sapiens
caggacagaccaagatcgtgct

SEQ ID NO: 8093008 - DNA, 19 bp, Homo sapiens
caggacagacttcaaagcc

SEQ ID NO: 8093009 - DNA, 22 bp, Homo sapiens
caggacagaaataaggaatata

SEQ ID NO: 8093010 - DNA, 22 bp, Homo sapiens
caggacagacagaatgcctaac

SEQ ID NO: 8093011 - DNA, 22 bp, Homo sapiens
agctggccagcacctccaggtc

SEQ ID NO: 8093012 - DNA, 22 bp, Homo sapiens
agctggcattgcagggagctgc

SEQ ID NO: 8093013 - DNA, 22 bp, Homo sapiens
agctggcatctgaagtcagggc

SEQ ID NO: 8093014 - DNA, 22 bp, Homo sapiens
agctggcatactttgctaggaa

SEQ ID NO: 8093015 - DNA, 22 bp, Homo sapiens
caggaggtgccctctagtggca

SEQ ID NO: 8093016 - DNA, 22 bp, Homo sapiens
agcttcttaagttcctgcagca

SEQ ID NO: 8093017 - DNA, 22 bp, Homo sapiens
agctgtgtttccagatggtagc

SEQ ID NO: 8093018 - DNA, 22 bp, Homo sapiens
agctgtgtgcccatggtggagg

SEQ ID NO: 8093019 - DNA, 22 bp, Homo sapiens
agctgtgtgtgcttgggattat

SEQ ID NO: 8093020 - DNA, 22 bp, Homo sapiens
agctgtggcagcagccgtggca

SEQ ID NO: 8093021 - DNA, 22 bp, Homo sapiens
agctgtggccagatgtgagcgg

SEQ ID NO: 8093022 - DNA, 22 bp, Homo sapiens
caggcctggcccccggcacacc

SEQ ID NO: 8093023 - DNA, 22 bp, Homo sapiens
caggcctcaggggctcaggctg

SEQ ID NO: 8093024 - DNA, 21 bp, Homo sapiens
caggccccaggcctggggtgc

SEQ ID NO: 8093025 - DNA, 21 bp, Homo sapiens
caggccgggtgagcaggcagc

SEQ ID NO: 8093026 - DNA, 22 bp, Homo sapiens
aggaacccggtctgtcactgtg

SEQ ID NO: 8093027 - DNA, 22 bp, Homo sapiens
aggaacctaagagcctgcagtc

SEQ ID NO: 8093028 - DNA, 22 bp, Homo sapiens
aggaaatgtacaaatgaagatg

SEQ ID NO: 8093029 - DNA, 22 bp, Homo sapiens
cagggccagcgtctcgggctat

SEQ ID NO: 8093030 - DNA, 22 bp, Homo sapiens
cagggccagagagggctggctg

SEQ ID NO: 8093031 - DNA, 22 bp, Homo sapiens
cagggccagagagggctggctg

SEQ ID NO: 8093032 - DNA, 22 bp, Homo sapiens
cagggccagccgcagcatccac

SEQ ID NO: 8093033 - DNA, 22 bp, Homo sapiens
cagggccactgtagatgaggag

SEQ ID NO: 8093034 - DNA, 22 bp, Homo sapiens
agctttatataaaagagtacat

SEQ ID NO: 8093035 - DNA, 22 bp, Homo sapiens
agctttatagaaaggatcagtg

SEQ ID NO: 8093036 - DNA, 22 bp, Homo sapiens
agctttatatgttgtttctcca

SEQ ID NO: 8093037 - DNA, 22 bp, Homo sapiens
agccaggtgcagtggcacacac

SEQ ID NO: 8093038 - DNA, 22 bp, Homo sapiens
cagacagcaggcctggatgtgt

SEQ ID NO: 8093039 - DNA, 22 bp, Homo sapiens
agccagtgcaacagcagtgaag

SEQ ID NO: 8093040 - DNA, 19 bp, Homo sapiens
agccagtgagcctctgggt

SEQ ID NO: 8093041 - DNA, 22 bp, Homo sapiens
agccagtgacatacgattggga

SEQ ID NO: 8093042 - DNA, 22 bp, Homo sapiens
cagagctggcctgtgatttttg

SEQ ID NO: 8093043 - DNA, 22 bp, Homo sapiens
cagagctggagggaaccctggc

SEQ ID NO: 8093044 - DNA, 22 bp, Homo sapiens
cagagctggcggtgagaagaca

SEQ ID NO: 8093045 - DNA, 22 bp, Homo sapiens
cagagctggagcttgaatggag

SEQ ID NO: 8093046 - DNA, 22 bp, Homo sapiens
cagagctggagaagtggattta

SEQ ID NO: 8093047 - DNA, 22 bp, Homo sapiens
cagagctggacttaaatatatt

SEQ ID NO: 8093048 - DNA, 22 bp, Homo sapiens
agcccaggagtttgaggctgtg

SEQ ID NO: 8093049 - DNA, 22 bp, Homo sapiens
agcccaggaggtggaggttgca

SEQ ID NO: 8093050 - DNA, 22 bp, Homo sapiens
agcccaggaggtggaggttgca

SEQ ID NO: 8093051 - DNA, 22 bp, Homo sapiens
agcccaggagcctttggagggt

SEQ ID NO: 8093052 - DNA, 22 bp, Homo sapiens
agcccaggagcctttggagggt

SEQ ID NO: 8093053 - DNA, 22 bp, Homo sapiens
agcccaggaatctgcatcttga

SEQ ID NO: 8093054 - DNA, 22 bp, Homo sapiens
agcccaggaagttgaggcttgc

SEQ ID NO: 8093055 - DNA, 22 bp, Homo sapiens
agcccaggaagttgaggcttgc

SEQ ID NO: 8093056 - DNA, 22 bp, Homo sapiens
agccaggcagggctctcgctct

SEQ ID NO: 8093057 - DNA, 22 bp, Homo sapiens
agccaggacatctctagctgct

SEQ ID NO: 8093058 - DNA, 22 bp, Homo sapiens
agccacagcccacaggactctt

SEQ ID NO: 8093059 - DNA, 22 bp, Homo sapiens
agccacagcaacaagtgcaatt

SEQ ID NO: 8093060 - DNA, 22 bp, Homo sapiens
agccacagcacattgtaagaaa

SEQ ID NO: 8093061 - DNA, 22 bp, Homo sapiens
cagaactgacctctgattctag

SEQ ID NO: 8093062 - DNA, 22 bp, Homo sapiens
agccacagagcaggagaccttt

SEQ ID NO: 8093063 - DNA, 19 bp, Homo sapiens
agccacagaacttgcagga

SEQ ID NO: 8093064 - DNA, 22 bp, Homo sapiens
agccacagagagggagctgcaa

SEQ ID NO: 8093065 - DNA, 22 bp, Homo sapiens
agccaagctgatctcctgctga

SEQ ID NO: 8093066 - DNA, 22 bp, Homo sapiens
agccttgttggtctgagtttgg

SEQ ID NO: 8093067 - DNA, 22 bp, Homo sapiens
cagcaggaggcatggcttccct

SEQ ID NO: 8093068 - DNA, 23 bp, Homo sapiens
cagcaggagggtgcctgggctgc

SEQ ID NO: 8093069 - DNA, 22 bp, Homo sapiens
cagcaggacccaggaatcctgc

SEQ ID NO: 8093070 - DNA, 22 bp, Homo sapiens
agctcagaacctcctcatccca

SEQ ID NO: 8093071 - DNA, 22 bp, Homo sapiens
agctcagaactgcagacatgtg

SEQ ID NO: 8093072 - DNA, 22 bp, Homo sapiens
agctcagaagcctatgcatagt

SEQ ID NO: 8093073 - DNA, 22 bp, Homo sapiens
agctaggagattttgtgaggct

SEQ ID NO: 8093074 - DNA, 22 bp, Homo sapiens
cagcaggaggtgagtagcaggt

SEQ ID NO: 8093075 - DNA, 22 bp, Homo sapiens
agctcctcctgtgccaggccag

SEQ ID NO: 8093076 - DNA, 22 bp, Homo sapiens
cagccagatcagggcaggggtt

SEQ ID NO: 8093077 - DNA, 22 bp, Homo sapiens
cagccagatcagggcaggggtt

SEQ ID NO: 8093078 - DNA, 22 bp, Homo sapiens
cagccagatcaaactcagatgt

SEQ ID NO: 8093079 - DNA, 22 bp, Homo sapiens
cagccagagaggaaggaatgca

SEQ ID NO: 8093080 - DNA, 22 bp, Homo sapiens
cagccagagaaagggcactgcc

SEQ ID NO: 8093081 - DNA, 22 bp, Homo sapiens
cagccagaggctgcgaggggcc

SEQ ID NO: 8093082 - DNA, 22 bp, Homo sapiens
agctccctgagatgccacagca

SEQ ID NO: 8093083 - DNA, 21 bp, Homo sapiens
agcctcaggttgttggttctt

SEQ ID NO: 8093084 - DNA, 22 bp, Homo sapiens
cagcacagggcttgagaggtgt

SEQ ID NO: 8093085 - DNA, 22 bp, Homo sapiens
cagcacagtacaaggcacggat

SEQ ID NO: 8093086 - DNA, 22 bp, Homo sapiens
cagcacagctgaggggctgtct

SEQ ID NO: 8093087 - DNA, 22 bp, Homo sapiens
cagcacagctgaggggctgtct

SEQ ID NO: 8093088 - DNA, 22 bp, Homo sapiens
cagcagaggcacgtctgtgaat

SEQ ID NO: 8093089 - DNA, 22 bp, Homo sapiens
agcctccatcccatgcacaaag

SEQ ID NO: 8093090 - DNA, 22 bp, Homo sapiens
cagcagcagccccaggaaggtt

SEQ ID NO: 8093091 - DNA, 21 bp, Homo sapiens
cagcagagtaatgcattcgta

SEQ ID NO: 8093092 - DNA, 22 bp, Homo sapiens
cagcagaggttttgctccatga

SEQ ID NO: 8093093 - DNA, 22 bp, Homo sapiens
cagcagcagtggctgcagaaca

SEQ ID NO: 8093094 - DNA, 22 bp, Homo sapiens
cagcagcatgaattcgagccac

SEQ ID NO: 8093095 - DNA, 22 bp, Homo sapiens
agccttccacccagatcccctt

SEQ ID NO: 8093096 - DNA, 22 bp, Homo sapiens
agcagggcagtgcttcagctct

SEQ ID NO: 8093097 - DNA, 22 bp, Homo sapiens
agcagggcctggcactcctggg

SEQ ID NO: 8093098 - DNA, 22 bp, Homo sapiens
agcagggctccatttcactgcc

SEQ ID NO: 8093099 - DNA, 22 bp, Homo sapiens
agcagggctctgccatgggccc

SEQ ID NO: 8093100 - DNA, 22 bp, Homo sapiens
cacatgaacatgctggaaaagc

SEQ ID NO: 8093101 - DNA, 22 bp, Homo sapiens
caccagggacaatgctaggggt

SEQ ID NO: 8093102 - DNA, 22 bp, Homo sapiens
caccagggctctgagctctgaa

SEQ ID NO: 8093103 - DNA, 22 bp, Homo sapiens
caccagggccccaggctgtgcc

SEQ ID NO: 8093104 - DNA, 22 bp, Homo sapiens
caccagggcagcagcctagtct

SEQ ID NO: 8093105 - DNA, 22 bp, Homo sapiens
agcagtggcctggggctctgtg

SEQ ID NO: 8093106 - DNA, 22 bp, Homo sapiens
caccagggtacaatttcgcaga

SEQ ID NO: 8093107 - DNA, 22 bp, Homo sapiens
cacagggccactttcccagtaa

SEQ ID NO: 8093108 - DNA, 22 bp, Homo sapiens
cacaggaggaggtgcccgggcc

SEQ ID NO: 8093109 - DNA, 22 bp, Homo sapiens
cacaggaggcaatggtaagatt

SEQ ID NO: 8093110 - DNA, 22 bp, Homo sapiens
cacaggaggaggccagagcgta

SEQ ID NO: 8093111 - DNA, 22 bp, Homo sapiens
cacaggaggttaggaagtggtc

SEQ ID NO: 8093112 - DNA, 22 bp, Homo sapiens
cacaggagggagcgggcagcca

SEQ ID NO: 8093113 - DNA, 22 bp, Homo sapiens
agcaggagcatttccatgattc

SEQ ID NO: 8093114 - DNA, 22 bp, Homo sapiens
caatgaacacagcaatttcata

SEQ ID NO: 8093115 - DNA, 18 bp, Homo sapiens
agcagctgtgccacactg

SEQ ID NO: 8093116 - DNA, 22 bp, Homo sapiens
agcagctgtttgttgaattggt

SEQ ID NO: 8093117 - DNA, 22 bp, Homo sapiens
caaatgatactgtttttagtct

SEQ ID NO: 8093118 - DNA, 22 bp, Homo sapiens
agcacagcttagcacctggcac

SEQ ID NO: 8093119 - DNA, 22 bp, Homo sapiens
caaatgatagagccgattatca

SEQ ID NO: 8093120 - DNA, 22 bp, Homo sapiens
caaatgcagtccctttgttgct

SEQ ID NO: 8093121 - DNA, 22 bp, Homo sapiens
caaatgcaggtcataacctgag

SEQ ID NO: 8093122 - DNA, 22 bp, Homo sapiens
agcaatttttgattttcagtgt

SEQ ID NO: 8093123 - DNA, 22 bp, Homo sapiens
agcacagatttgtcaacataga

SEQ ID NO: 8093124 - DNA, 22 bp, Homo sapiens
agcagcagggtgtaattgggca

SEQ ID NO: 8093125 - DNA, 22 bp, Homo sapiens
caatcttagagagattctttta

SEQ ID NO: 8093126 - DNA, 22 bp, Homo sapiens
agcagcattatgatatatctta

SEQ ID NO: 8093127 - DNA, 22 bp, Homo sapiens
agcagcatgttcattacattat

SEQ ID NO: 8093128 - DNA, 22 bp, Homo sapiens
agcagcagaaggtttgcaccca

SEQ ID NO: 8093129 - DNA, 22 bp, Homo sapiens
agcagcagaagggagacccagg

SEQ ID NO: 8093130 - DNA, 22 bp, Homo sapiens
agcagcacacgggagaaagaca

SEQ ID NO: 8093131 - DNA, 22 bp, Homo sapiens
agcagcagaaagttgatggcag

SEQ ID NO: 8093132 - DNA, 22 bp, Homo sapiens
caactgaactgatatcaactat

SEQ ID NO: 8093133 - DNA, 22 bp, Homo sapiens
caactgaactgatatcaactat

SEQ ID NO: 8093134 - DNA, 22 bp, Homo sapiens
caactgcacaccaagcttgtgt

SEQ ID NO: 8093135 - DNA, 22 bp, Homo sapiens
caactgaaaagattctacgcag

SEQ ID NO: 8093136 - DNA, 22 bp, Homo sapiens
attcttcattgttgattcatgt

SEQ ID NO: 8093137 - DNA, 23 bp, Homo sapiens
attcttcattatcttctagaaaa

SEQ ID NO: 8093138 - DNA, 22 bp, Homo sapiens
attcttcatcagagatgcacta

SEQ ID NO: 8093139 - DNA, 22 bp, Homo sapiens
attcttcatttactgttacttg

SEQ ID NO: 8093140 - DNA, 22 bp, Homo sapiens
attcttcatcactaccttgtga

SEQ ID NO: 8093141 - DNA, 22 bp, Homo sapiens
attcttcatacctactgaggtt

SEQ ID NO: 8093142 - DNA, 22 bp, Homo sapiens
attcttcatacagacaagtcct

SEQ ID NO: 8093143 - DNA, 22 bp, Homo sapiens
agagtggcctggcctggggcat

SEQ ID NO: 8093144 - DNA, 22 bp, Homo sapiens
atttaagaggctgctagagtat

SEQ ID NO: 8093145 - DNA, 22 bp, Homo sapiens
atttagtgacctgaactgaaac

SEQ ID NO: 8093146 - DNA, 22 bp, Homo sapiens
atttattattgtggttacttct

SEQ ID NO: 8093147 - DNA, 23 bp, Homo sapiens
atttacaggttaaatgaaatcag

SEQ ID NO: 8093148 - DNA, 22 bp, Homo sapiens
atttcattgaagttaattcttc

SEQ ID NO: 8093149 - DNA, 22 bp, Homo sapiens
atttcattgaagttaattcttc

SEQ ID NO: 8093150 - DNA, 23 bp, Homo sapiens
agatgaaagcttcccatcacagt

SEQ ID NO: 8093151 - DNA, 22 bp, Homo sapiens
agatgggcgcgctgctctgatg

SEQ ID NO: 8093152 - DNA, 22 bp, Homo sapiens
agatgggcgccctggactgagg

SEQ ID NO: 8093153 - DNA, 20 bp, Homo sapiens
agcaaaatgcaagattttca

SEQ ID NO: 8093154 - DNA, 22 bp, Homo sapiens
agcaaacagtttctggggatct

SEQ ID NO: 8093155 - DNA, 22 bp, Homo sapiens
atttgctttcaggtataaaagg

SEQ ID NO: 8093156 - DNA, 22 bp, Homo sapiens
atttgctttaaggtataaaagg

SEQ ID NO: 8093157 - DNA, 22 bp, Homo sapiens
atttgcttgtgctatgaaagtt

SEQ ID NO: 8093158 - DNA, 22 bp, Homo sapiens
atttgcttatctccacagttgt

SEQ ID NO: 8093159 - DNA, 22 bp, Homo sapiens
atttgcttctgtgaaatcaagt

SEQ ID NO: 8093160 - DNA, 22 bp, Homo sapiens
attataaacctttgagggtggg

SEQ ID NO: 8093161 - DNA, 22 bp, Homo sapiens
attctgtatttctaataagatc

SEQ ID NO: 8093162 - DNA, 22 bp, Homo sapiens
agagggtgggcacgtgatggat

SEQ ID NO: 8093163 - DNA, 22 bp, Homo sapiens
atgttttaaatatgtgtgtaaa

SEQ ID NO: 8093164 - DNA, 22 bp, Homo sapiens
atgttaaatagccatttgtttg

SEQ ID NO: 8093165 - DNA, 22 bp, Homo sapiens
atgttaaatggtttattattaa

SEQ ID NO: 8093166 - DNA, 22 bp, Homo sapiens
atgttaactgaagccattctcg

SEQ ID NO: 8093167 - DNA, 22 bp, Homo sapiens
atgttacaatccaacaaaatta

SEQ ID NO: 8093168 - DNA, 22 bp, Homo sapiens
atgttacaattcaaaatgctgc

SEQ ID NO: 8093169 - DNA, 22 bp, Homo sapiens
atgttaaagatggtgggaaatt

SEQ ID NO: 8093170 - DNA, 22 bp, Homo sapiens
atgtgtctttgagactctgcta

SEQ ID NO: 8093171 - DNA, 22 bp, Homo sapiens
agaatacagtatgcaaaaagat

SEQ ID NO: 8093172 - DNA, 22 bp, Homo sapiens
agaagaaatgtgaaggccactg

SEQ ID NO: 8093173 - DNA, 22 bp, Homo sapiens
agaagacagagtctacattcta

SEQ ID NO: 8093174 - DNA, 17 bp, Homo sapiens
agacagtgagtgccttg

SEQ ID NO: 8093175 - DNA, 22 bp, Homo sapiens
agacagtgatgtaagcaggagt

SEQ ID NO: 8093176 - DNA, 22 bp, Homo sapiens
agacagtgatggacaggcagac

SEQ ID NO: 8093177 - DNA, 22 bp, Homo sapiens
agacagtgcaagaagagcaggc

SEQ ID NO: 8093178 - DNA, 22 bp, Homo sapiens
agacacataggaccacactgtg

SEQ ID NO: 8093179 - DNA, 22 bp, Homo sapiens
agacacaggattctgcatttct

SEQ ID NO: 8093180 - DNA, 22 bp, Homo sapiens
atgggaggcagcagagcccagc

SEQ ID NO: 8093181 - DNA, 22 bp, Homo sapiens
atgggaggatgctcgggtgctc

SEQ ID NO: 8093182 - DNA, 19 bp, Homo sapiens
atggaaaattgtactcaat

SEQ ID NO: 8093183 - DNA, 22 bp, Homo sapiens
atggacagtactgagtggacta

SEQ ID NO: 8093184 - DNA, 22 bp, Homo sapiens
agactacaggagaaactcactc

SEQ ID NO: 8093185 - DNA, 22 bp, Homo sapiens
atggagttctttaaattcacag

SEQ ID NO: 8093186 - DNA, 22 bp, Homo sapiens
atggctgggaggagagtatgat

SEQ ID NO: 8093187 - DNA, 21 bp, Homo sapiens
actcaagtggagatgccaggt

SEQ ID NO: 8093188 - DNA, 22 bp, Homo sapiens
actcatttaaacatttactgaa

SEQ ID NO: 8093189 - DNA, 22 bp, Homo sapiens
actcaagtcataggcttctttc

SEQ ID NO: 8093190 - DNA, 22 bp, Homo sapiens
actcaaatttgtcaactgaagc

SEQ ID NO: 8093191 - DNA, 20 bp, Homo sapiens
actcaaatcacctgcctcaa

SEQ ID NO: 8093192 - DNA, 23 bp, Homo sapiens
actcaaatttcgcttggagttca

SEQ ID NO: 8093193 - DNA, 22 bp, Homo sapiens
actcaaatagcaacggtgagaa

SEQ ID NO: 8093194 - DNA, 22 bp, Homo sapiens
actcaaatagctgcccctagtg

SEQ ID NO: 8093195 - DNA, 22 bp, Homo sapiens
actatacattgaatgttaaggt

SEQ ID NO: 8093196 - DNA, 22 bp, Homo sapiens
acctcccttgctaaagactgtg

SEQ ID NO: 8093197 - DNA, 22 bp, Homo sapiens
acctccctgcctcttggcgtca

SEQ ID NO: 8093198 - DNA, 22 bp, Homo sapiens
acctccctgggttatcggggca

SEQ ID NO: 8093199 - DNA, 22 bp, Homo sapiens
acctccctggccttctgattcc

SEQ ID NO: 8093200 - DNA, 22 bp, Homo sapiens
acctgctcaactggcttctcgc

SEQ ID NO: 8093201 - DNA, 21 bp, Homo sapiens
acctccctcgagcaaccagca

SEQ ID NO: 8093202 - DNA, 20 bp, Homo sapiens
acctccctctgtgggtggga

SEQ ID NO: 8093203 - DNA, 22 bp, Homo sapiens
acctccctcgccgtccactctg

SEQ ID NO: 8093204 - DNA, 22 bp, Homo sapiens
acctccctccatctggacacta

SEQ ID NO: 8093205 - DNA, 22 bp, Homo sapiens
acctccctaagggtccagctta

SEQ ID NO: 8093206 - DNA, 22 bp, Homo sapiens
acctccctaacccttttggctc

SEQ ID NO: 8093207 - DNA, 22 bp, Homo sapiens
agggctgtttttcagtgtgtga

SEQ ID NO: 8093208 - DNA, 22 bp, Homo sapiens
agggctgtcagactgaggaggc

SEQ ID NO: 8093209 - DNA, 22 bp, Homo sapiens
agggctgtttttggcacctggg

SEQ ID NO: 8093210 - DNA, 22 bp, Homo sapiens
actcatttgacactttaaactg

SEQ ID NO: 8093211 - DNA, 22 bp, Homo sapiens
actccagggaggtgagtgtgcg

SEQ ID NO: 8093212 - DNA, 19 bp, Homo sapiens
actccagggatgacagaag

SEQ ID NO: 8093213 - DNA, 22 bp, Homo sapiens
actccaggaaacttaggggaaa

SEQ ID NO: 8093214 - DNA, 22 bp, Homo sapiens
actccaggatgtagaatcagag

SEQ ID NO: 8093215 - DNA, 22 bp, Homo sapiens
actccaggcatctgcttctgct

SEQ ID NO: 8093216 - DNA, 22 bp, Homo sapiens
actgaacacttttgaaagatta

SEQ ID NO: 8093217 - DNA, 22 bp, Homo sapiens
actgaagcttgggtggaactta

SEQ ID NO: 8093218 - DNA, 22 bp, Homo sapiens
actgaagccagagggaggacat

SEQ ID NO: 8093219 - DNA, 22 bp, Homo sapiens
actgaagcacatttgccatgaa

SEQ ID NO: 8093220 - DNA, 21 bp, Homo sapiens
actgcaaacagcagagactga

SEQ ID NO: 8093221 - DNA, 20 bp, Homo sapiens
actgcaaagtactctttcag

SEQ ID NO: 8093222 - DNA, 22 bp, Homo sapiens
actgcaacacctcctgggttca

SEQ ID NO: 8093223 - DNA, 22 bp, Homo sapiens
actgcaacctccacctcctggg

SEQ ID NO: 8093224 - DNA, 22 bp, Homo sapiens
actgcaagtcacttggctatgt

SEQ ID NO: 8093225 - DNA, 22 bp, Homo sapiens
actgcaagaatggtaatatttg

SEQ ID NO: 8093226 - DNA, 22 bp, Homo sapiens
actgcttagtattattaatgtc

SEQ ID NO: 8093227 - DNA, 20 bp, Homo sapiens
actggacactgaggtgagct

SEQ ID NO: 8093228 - DNA, 22 bp, Homo sapiens
actggcagaacgtgatgcgggt

SEQ ID NO: 8093229 - DNA, 22 bp, Homo sapiens
actggcaaaatagtatattcct

SEQ ID NO: 8093230 - DNA, 22 bp, Homo sapiens
acttcatagaatgagcttggaa

SEQ ID NO: 8093231 - DNA, 22 bp, Homo sapiens
acttcatgcagaagagagctgt

SEQ ID NO: 8093232 - DNA, 22 bp, Homo sapiens
acttgccccagaattgctgctg

SEQ ID NO: 8093233 - DNA, 22 bp, Homo sapiens
acttcaaaaataagtgagaggt

SEQ ID NO: 8093234 - DNA, 19 bp, Homo sapiens
acttcaaatcttagagaaa

SEQ ID NO: 8093235 - DNA, 22 bp, Homo sapiens
acttcaaattctgggggaagag

SEQ ID NO: 8093236 - DNA, 22 bp, Homo sapiens
acttcaaatgtgacaatgtgaa

SEQ ID NO: 8093237 - DNA, 22 bp, Homo sapiens
acttcaaaatgagtttcctggt

SEQ ID NO: 8093238 - DNA, 22 bp, Homo sapiens
acttcaaacaattaacagagaa

SEQ ID NO: 8093239 - DNA, 22 bp, Homo sapiens
acttcaaatctcttgaaagcaa

SEQ ID NO: 8093240 - DNA, 22 bp, Homo sapiens
acttcaaattttcagaagaaat

SEQ ID NO: 8093241 - DNA, 22 bp, Homo sapiens
acttcagagactttatggtcca

SEQ ID NO: 8093242 - DNA, 22 bp, Homo sapiens
actgtgtggaccactctgaggc

SEQ ID NO: 8093243 - DNA, 22 bp, Homo sapiens
actgttacagggcactgaacat

SEQ ID NO: 8093244 - DNA, 22 bp, Homo sapiens
actgttacagagcaggaaattg

SEQ ID NO: 8093245 - DNA, 22 bp, Homo sapiens
agtttccactggagacactgtg

SEQ ID NO: 8093246 - DNA, 22 bp, Homo sapiens
actgtgagagtttttctaggag

SEQ ID NO: 8093247 - DNA, 20 bp, Homo sapiens
actgtgaatgctgaattagc

SEQ ID NO: 8093248 - DNA, 22 bp, Homo sapiens
actgtggtgcacggcctgctcc

SEQ ID NO: 8093249 - DNA, 21 bp, Homo sapiens
actgtgggtctgaccacctgg

SEQ ID NO: 8093250 - DNA, 22 bp, Homo sapiens
actgtgggtcccagctgtgtct

SEQ ID NO: 8093251 - DNA, 22 bp, Homo sapiens
actgtaaattacataagaacag

SEQ ID NO: 8093252 - DNA, 22 bp, Homo sapiens
actgtaaattacataagaacag

SEQ ID NO: 8093253 - DNA, 22 bp, Homo sapiens
actgtgaaagctaacatcttag

SEQ ID NO: 8093254 - DNA, 22 bp, Homo sapiens
agtttatgtaaaattagtaatg

SEQ ID NO: 8093255 - DNA, 22 bp, Homo sapiens
actgtaaagaagtaagtatggg

SEQ ID NO: 8093256 - DNA, 22 bp, Homo sapiens
actgtaaaatgagatatgtata

SEQ ID NO: 8093257 - DNA, 22 bp, Homo sapiens
actgtaaaagaaggtctttgca

SEQ ID NO: 8093258 - DNA, 22 bp, Homo sapiens
actgtaaaatacataagtattg

SEQ ID NO: 8093259 - DNA, 22 bp, Homo sapiens
actggcagtagagggagcgcat

SEQ ID NO: 8093260 - DNA, 22 bp, Homo sapiens
actggcagctgtaggatgcatg

SEQ ID NO: 8093261 - DNA, 20 bp, Homo sapiens
actggcagcctgcctgctgt

SEQ ID NO: 8093262 - DNA, 22 bp, Homo sapiens
atcattctgatggtcaatgcta

SEQ ID NO: 8093263 - DNA, 21 bp, Homo sapiens
atcattctggaaaattcaagc

SEQ ID NO: 8093264 - DNA, 23 bp, Homo sapiens
atcattctccaatctggagcagg

SEQ ID NO: 8093265 - DNA, 22 bp, Homo sapiens
atcatttccctttagatcacaa

SEQ ID NO: 8093266 - DNA, 22 bp, Homo sapiens
atccagagaggttaggtgacat

SEQ ID NO: 8093267 - DNA, 22 bp, Homo sapiens
atccagagactggggctgggat

SEQ ID NO: 8093268 - DNA, 22 bp, Homo sapiens
agaagaaatgaggccgttctgc

SEQ ID NO: 8093269 - DNA, 22 bp, Homo sapiens
atcagagctgtgattcccactc

SEQ ID NO: 8093270 - DNA, 22 bp, Homo sapiens
agaaacatcgcttagtcctcat

SEQ ID NO: 8093271 - DNA, 21 bp, Homo sapiens
agaaacatgatcaaaggaacc

SEQ ID NO: 8093272 - DNA, 22 bp, Homo sapiens
atcacaaaggctgcttcatgat

SEQ ID NO: 8093273 - DNA, 22 bp, Homo sapiens
agaaacagcattagcatcaatt

SEQ ID NO: 8093274 - DNA, 22 bp, Homo sapiens
agaaacatcctgctttccattt

SEQ ID NO: 8093275 - DNA, 22 bp, Homo sapiens
agaaacatattcagtgagtaat

SEQ ID NO: 8093276 - DNA, 22 bp, Homo sapiens
agaaacatcattggaacacaag

SEQ ID NO: 8093277 - DNA, 22 bp, Homo sapiens
acttggtgtattagctctcact

SEQ ID NO: 8093278 - DNA, 22 bp, Homo sapiens
atatatttgagaatattcatga

SEQ ID NO: 8093279 - DNA, 22 bp, Homo sapiens
atatatttgagaatattcatga

SEQ ID NO: 8093280 - DNA, 22 bp, Homo sapiens
agaaaatttaaagagacacaca

SEQ ID NO: 8093281 - DNA, 22 bp, Homo sapiens
agaaacagaagggaaagctttt

SEQ ID NO: 8093282 - DNA, 22 bp, Homo sapiens
acagctcactcacagggctagt

SEQ ID NO: 8093283 - DNA, 22 bp, Homo sapiens
acagctactctgcagataaatc

SEQ ID NO: 8093284 - DNA, 22 bp, Homo sapiens
acagctgattggatcaaggaca

SEQ ID NO: 8093285 - DNA, 22 bp, Homo sapiens
agctggggctgtggttgtgatt

SEQ ID NO: 8093286 - DNA, 22 bp, Homo sapiens
agctgggggttggataagggta

SEQ ID NO: 8093287 - DNA, 22 bp, Homo sapiens
agctgggtacagcctgtgccta

SEQ ID NO: 8093288 - DNA, 22 bp, Homo sapiens
acagcagacagtcggcttcctg

SEQ ID NO: 8093289 - DNA, 22 bp, Homo sapiens
acagcagacacaggcacgctgt

SEQ ID NO: 8093290 - DNA, 22 bp, Homo sapiens
acaggctctggggcaggatggc

SEQ ID NO: 8093291 - DNA, 22 bp, Homo sapiens
agctttatgcttcctacaagct

SEQ ID NO: 8093292 - DNA, 22 bp, Homo sapiens
agctttatgggagcttagataa

SEQ ID NO: 8093293 - DNA, 22 bp, Homo sapiens
agctttatcttcacctgggaat

SEQ ID NO: 8093294 - DNA, 22 bp, Homo sapiens
agctttatcccttgcccatcga

SEQ ID NO: 8093295 - DNA, 22 bp, Homo sapiens
agctttatgaggagaccttagt

SEQ ID NO: 8093296 - DNA, 22 bp, Homo sapiens
agctttatcacaatattggcta

SEQ ID NO: 8093297 - DNA, 22 bp, Homo sapiens
agctttatcagaggagtctcta

SEQ ID NO: 8093298 - DNA, 22 bp, Homo sapiens
agctttatatttaatgaattct

SEQ ID NO: 8093299 - DNA, 22 bp, Homo sapiens
agctgggtcttgggccaggaga

SEQ ID NO: 8093300 - DNA, 22 bp, Homo sapiens
agctgggtgaaggcagatggct

SEQ ID NO: 8093301 - DNA, 22 bp, Homo sapiens
acagttatctttgaaatagaga

SEQ ID NO: 8093302 - DNA, 20 bp, Homo sapiens
aggagtccctgtgctctctc

SEQ ID NO: 8093303 - DNA, 22 bp, Homo sapiens
aggagctggagtccaggcaagt

SEQ ID NO: 8093304 - DNA, 20 bp, Homo sapiens
aggaggaaaaaatgacgagc

SEQ ID NO: 8093305 - DNA, 22 bp, Homo sapiens
aggagctgttttgttcagcaaa

SEQ ID NO: 8093306 - DNA, 21 bp, Homo sapiens
aggagctgtgttagctggtcg

SEQ ID NO: 8093307 - DNA, 18 bp, Homo sapiens
acagggagggcgctgggg

SEQ ID NO: 8093308 - DNA, 22 bp, Homo sapiens
acagggattatgactgacagcc

SEQ ID NO: 8093309 - DNA, 22 bp, Homo sapiens
acagggattttccaggctaccc

SEQ ID NO: 8093310 - DNA, 22 bp, Homo sapiens
acagggcaacctctgggagact

SEQ ID NO: 8093311 - DNA, 22 bp, Homo sapiens
acagggcacctgaggtaggaag

SEQ ID NO: 8093312 - DNA, 20 bp, Homo sapiens
aggctgagttctatgcactt

SEQ ID NO: 8093313 - DNA, 23 bp, Homo sapiens
aggcgagctcttctccagcacgt

SEQ ID NO: 8093314 - DNA, 22 bp, Homo sapiens
acatggaagataaaaatactca

SEQ ID NO: 8093315 - DNA, 22 bp, Homo sapiens
acatgattttagtatcataata

SEQ ID NO: 8093316 - DNA, 22 bp, Homo sapiens
acatgcaaatgtgcatgcatgt

SEQ ID NO: 8093317 - DNA, 22 bp, Homo sapiens
acatgcaaatgtgcatgcatgt

SEQ ID NO: 8093318 - DNA, 22 bp, Homo sapiens
agggcagtgtggtgggactgac

SEQ ID NO: 8093319 - DNA, 22 bp, Homo sapiens
agggcatctagttccctctctt

SEQ ID NO: 8093320 - DNA, 22 bp, Homo sapiens
agggcatctctaacagtctcct

SEQ ID NO: 8093321 - DNA, 23 bp, Homo sapiens
agggcatgaagcagaggacgtgg

SEQ ID NO: 8093322 - DNA, 23 bp, Homo sapiens
agggcatgaagcagaggacgtgg

SEQ ID NO: 8093323 - DNA, 22 bp, Homo sapiens
acccaggcctgagagacaggag

SEQ ID NO: 8093324 - DNA, 20 bp, Homo sapiens
agggcagcttgaggagccgg

SEQ ID NO: 8093325 - DNA, 18 bp, Homo sapiens
acccaggctcatggtcct

SEQ ID NO: 8093326 - DNA, 22 bp, Homo sapiens
agggcctgggccagcacccttt

SEQ ID NO: 8093327 - DNA, 22 bp, Homo sapiens
acccaggctgcttctcagtggc

SEQ ID NO: 8093328 - DNA, 22 bp, Homo sapiens
accctcaagatggaagcagttt

SEQ ID NO: 8093329 - DNA, 22 bp, Homo sapiens
accccaggaagtggaggtcatg

SEQ ID NO: 8093330 - DNA, 22 bp, Homo sapiens
agggcctggtgacctgggtcct

SEQ ID NO: 8093331 - DNA, 22 bp, Homo sapiens
agggacacgaggtcctgctggg

SEQ ID NO: 8093332 - DNA, 22 bp, Homo sapiens
aagaaacaaccactgctctcct

SEQ ID NO: 8093333 - DNA, 22 bp, Homo sapiens
aactgcttgtagtgacttgcct

SEQ ID NO: 8093334 - DNA, 22 bp, Homo sapiens
aactggaagagtgaatataact

SEQ ID NO: 8093335 - DNA, 22 bp, Homo sapiens
aactttcttggatgtctcaaca

SEQ ID NO: 8093336 - DNA, 20 bp, Homo sapiens
aagaaacttgaaagtacaag

SEQ ID NO: 8093337 - DNA, 22 bp, Homo sapiens
aattctataggcaagctatttt

SEQ ID NO: 8093338 - DNA, 22 bp, Homo sapiens
aattctacattggttcacattt

SEQ ID NO: 8093339 - DNA, 22 bp, Homo sapiens
aagaacaactgctttaaaagca

SEQ ID NO: 8093340 - DNA, 22 bp, Homo sapiens
aagaacaactgctttaaaagca

SEQ ID NO: 8093341 - DNA, 22 bp, Homo sapiens
aagaaattaaggaatgcaacga

SEQ ID NO: 8093342 - DNA, 22 bp, Homo sapiens
aagagacttctagatttgttga

SEQ ID NO: 8093343 - DNA, 22 bp, Homo sapiens
aagagaatgacaaggagaacct

SEQ ID NO: 8093344 - DNA, 22 bp, Homo sapiens
acacaaactgctagaaaattgg

SEQ ID NO: 8093345 - DNA, 22 bp, Homo sapiens
acacaaacagtctatagcacca

SEQ ID NO: 8093346 - DNA, 22 bp, Homo sapiens
aagactttctcccaaatcctca

SEQ ID NO: 8093347 - DNA, 22 bp, Homo sapiens
aattttaatcagtggtgctgag

SEQ ID NO: 8093348 - DNA, 22 bp, Homo sapiens
aattttaagcatatgactggtt

SEQ ID NO: 8093349 - DNA, 22 bp, Homo sapiens
aatttccagatcagatgactca

SEQ ID NO: 8093350 - DNA, 22 bp, Homo sapiens
aatttccagaccccatccacag

SEQ ID NO: 8093351 - DNA, 22 bp, Homo sapiens
aatttccaaatttctgtcacac

SEQ ID NO: 8093352 - DNA, 22 bp, Homo sapiens
acacatatatacatatttgtgc

SEQ ID NO: 8093353 - DNA, 22 bp, Homo sapiens
acacatttaaaaaggaacatat

SEQ ID NO: 8093354 - DNA, 22 bp, Homo sapiens
aagatgaaaatttactgtgatg

SEQ ID NO: 8093355 - DNA, 22 bp, Homo sapiens
aagatgcggttgaccatggtgt

SEQ ID NO: 8093356 - DNA, 22 bp, Homo sapiens
aagatgttactcaaccaggata

SEQ ID NO: 8093357 - DNA, 22 bp, Homo sapiens
aagatgttagaggtcatgcaga

SEQ ID NO: 8093358 - DNA, 22 bp, Homo sapiens
aagatgttaaatctgtagaatt

SEQ ID NO: 8093359 - DNA, 22 bp, Homo sapiens
aagatgttattgtcttccttgc

SEQ ID NO: 8093360 - DNA, 22 bp, Homo sapiens
aagcaatagcaacaactttaca

SEQ ID NO: 8093361 - DNA, 22 bp, Homo sapiens
aagcagagggtatggccaggtt

SEQ ID NO: 8093362 - DNA, 22 bp, Homo sapiens
aagcagaggtagggtgtgcagt

SEQ ID NO: 8093363 - DNA, 22 bp, Homo sapiens
acagcagagccagtggctctag

SEQ ID NO: 8093364 - DNA, 22 bp, Homo sapiens
acagcagagcaccagggccact

SEQ ID NO: 8093365 - DNA, 22 bp, Homo sapiens
aagcaatatactgatatgatta

SEQ ID NO: 8093366 - DNA, 22 bp, Homo sapiens
aagcagagcctgagacagggat

SEQ ID NO: 8093367 - DNA, 22 bp, Homo sapiens
aagcagaatagaggcccttccc

SEQ ID NO: 8093368 - DNA, 22 bp, Homo sapiens
aaattttaaggctggaacttaa

SEQ ID NO: 8093369 - DNA, 22 bp, Homo sapiens
aacacagctaatttctgtcaat

SEQ ID NO: 8093370 - DNA, 22 bp, Homo sapiens
aacacagaagtgccaagagcca

SEQ ID NO: 8093371 - DNA, 22 bp, Homo sapiens
aacacagagtatttgaagcatt

SEQ ID NO: 8093372 - DNA, 20 bp, Homo sapiens
aacacagataccaaaggttg

SEQ ID NO: 8093373 - DNA, 22 bp, Homo sapiens
aacacagacatagtgattacag

SEQ ID NO: 8093374 - DNA, 22 bp, Homo sapiens
aaatgtcagaagctttacttct

SEQ ID NO: 8093375 - DNA, 22 bp, Homo sapiens
aaggaagatgaggtgctgctta

SEQ ID NO: 8093376 - DNA, 22 bp, Homo sapiens
aaggcactgtactagttagtta

SEQ ID NO: 8093377 - DNA, 22 bp, Homo sapiens
aaattattctcatgtgtttctt

SEQ ID NO: 8093378 - DNA, 21 bp, Homo sapiens
aaattcacctagtaaaacttc

SEQ ID NO: 8093379 - DNA, 22 bp, Homo sapiens
aacatctacagtgagatgttag

SEQ ID NO: 8093380 - DNA, 22 bp, Homo sapiens
aacatctactaagtgccaggca

SEQ ID NO: 8093381 - DNA, 22 bp, Homo sapiens
aagtgtcctcattcaacatgca

SEQ ID NO: 8093382 - DNA, 22 bp, Homo sapiens
aagtgtatatatgacttataaa

SEQ ID NO: 8093383 - DNA, 19 bp, Homo sapiens
aacatctgtaactattttc

SEQ ID NO: 8093384 - DNA, 22 bp, Homo sapiens
aacatctccaacctacatccac

SEQ ID NO: 8093385 - DNA, 22 bp, Homo sapiens
aacatgaaaagcccagagaggt

SEQ ID NO: 8093386 - DNA, 22 bp, Homo sapiens
aatagactttctttttagaaca

SEQ ID NO: 8093387 - DNA, 22 bp, Homo sapiens
aatgacagccagattcttctct

SEQ ID NO: 8093388 - DNA, 22 bp, Homo sapiens
aatgacagtggcacagtcactt

SEQ ID NO: 8093389 - DNA, 22 bp, Homo sapiens
aactagaaagaacatatttcca

SEQ ID NO: 8093390 - DNA, 22 bp, Homo sapiens
aactagaaccacttgtatttcc

SEQ ID NO: 8093391 - DNA, 22 bp, Homo sapiens
aactagaacgtctagttgctgg

SEQ ID NO: 8093392 - DNA, 22 bp, Homo sapiens
aatgaacaacactgaaggaaga

SEQ ID NO: 8093393 - DNA, 22 bp, Homo sapiens
aagagggaggtgcgggtgcaga

SEQ ID NO: 8093394 - DNA, 22 bp, Homo sapiens
aagagggcagcacaggtgggtc

SEQ ID NO: 8093395 - DNA, 22 bp, Homo sapiens
aagaggggtggtctgtgaggat

SEQ ID NO: 8093396 - DNA, 17 bp, Homo sapiens
aagaggtaactgtacta

SEQ ID NO: 8093397 - DNA, 22 bp, Homo sapiens
aaatacattagacggagagtta

SEQ ID NO: 8093398 - DNA, 22 bp, Homo sapiens
aaatactagaattcagagttga

SEQ ID NO: 8093399 - DNA, 22 bp, Homo sapiens
aagataaactcttgatttctga

SEQ ID NO: 8093400 - DNA, 22 bp, Homo sapiens
aagacgggagtcaggtgagctc

SEQ ID NO: 8093401 - DNA, 22 bp, Homo sapiens
aagaacatggtaggataacaaa

SEQ ID NO: 8093402 - DNA, 22 bp, Homo sapiens
aagcctccttattaaaggatat

SEQ ID NO: 8093403 - DNA, 22 bp, Homo sapiens
aagcccagatgtgagaactgag

SEQ ID NO: 8093404 - DNA, 22 bp, Homo sapiens
aagcccagatgggagcatttca

SEQ ID NO: 8093405 - DNA, 22 bp, Homo sapiens
aaatctctggcagaaataaact

SEQ ID NO: 8093406 - DNA, 22 bp, Homo sapiens
aaatctctggtcacagaactta

SEQ ID NO: 8093407 - DNA, 22 bp, Homo sapiens
aaatctctgaacttaataatgc

SEQ ID NO: 8093408 - DNA, 22 bp, Homo sapiens
aaatctctgcaggcaaatgtga

SEQ ID NO: 8093409 - DNA, 22 bp, Homo sapiens
aagattatttaagacaggaacc

SEQ ID NO: 8093410 - DNA, 22 bp, Homo sapiens
aagattatggcagataacaatt

SEQ ID NO: 8093411 - DNA, 22 bp, Homo sapiens
aagcaggagagcctgggtgagc

SEQ ID NO: 8093412 - DNA, 22 bp, Homo sapiens
aagatgttttaatatttcgagg

SEQ ID NO: 8093413 - DNA, 22 bp, Homo sapiens
aagatgtttaggtaaaaagttt

SEQ ID NO: 8093414 - DNA, 22 bp, Homo sapiens
aagatgtttagatttatacaat

SEQ ID NO: 8093415 - DNA, 22 bp, Homo sapiens
aagatccatgagggcagagatt

SEQ ID NO: 8093416 - DNA, 22 bp, Homo sapiens
aagatgttgcattagaatacct

SEQ ID NO: 8093417 - DNA, 22 bp, Homo sapiens
aacatacatatttcagtgtcca

SEQ ID NO: 8093418 - DNA, 22 bp, Homo sapiens
aacatataaactcttaagttca

SEQ ID NO: 8093419 - DNA, 22 bp, Homo sapiens
aaagattatggcattgaaatac

SEQ ID NO: 8093420 - DNA, 22 bp, Homo sapiens
aaagatttgagttctgcttata

SEQ ID NO: 8093421 - DNA, 22 bp, Homo sapiens
aactgtaatgaattgttcatga

SEQ ID NO: 8093422 - DNA, 22 bp, Homo sapiens
aactgtaatttttacatagtaa

SEQ ID NO: 8093423 - DNA, 22 bp, Homo sapiens
aactgtagaagggacacaaaag

SEQ ID NO: 8093424 - DNA, 22 bp, Homo sapiens
aactgtaagaaataaaattctg

SEQ ID NO: 8093425 - DNA, 21 bp, Homo sapiens
aactgcaaatgatgctggaga

SEQ ID NO: 8093426 - DNA, 22 bp, Homo sapiens
aactgtaaggcttagaacagca

SEQ ID NO: 8093427 - DNA, 22 bp, Homo sapiens
aactgtggacttgagactgatg

SEQ ID NO: 8093428 - DNA, 22 bp, Homo sapiens
aactgtgaggatgtgcaaattc

SEQ ID NO: 8093429 - DNA, 22 bp, Homo sapiens
aactgtgggagaaggcgatgtg

SEQ ID NO: 8093430 - DNA, 22 bp, Homo sapiens
aactgtgggatgcattaattca

SEQ ID NO: 8093431 - DNA, 22 bp, Homo sapiens
aactgtggccagggactggagt

SEQ ID NO: 8093432 - DNA, 22 bp, Homo sapiens
aactgtggcatgttgaatttgt

SEQ ID NO: 8093433 - DNA, 22 bp, Homo sapiens
aactgtggagattcggaaggta

SEQ ID NO: 8093434 - DNA, 22 bp, Homo sapiens
aactgtggacttgagactgatg

SEQ ID NO: 8093435 - DNA, 22 bp, Homo sapiens
aactgtgggatgcattaattca

SEQ ID NO: 8093436 - DNA, 22 bp, Homo sapiens
aagaacatgaagtcacaaatgc

SEQ ID NO: 8093437 - DNA, 22 bp, Homo sapiens
aaagcctcccaggttatgagta

SEQ ID NO: 8093438 - DNA, 22 bp, Homo sapiens
aacatttgtttggcttcaatta

SEQ ID NO: 8093439 - DNA, 22 bp, Homo sapiens
aacatttgtttcgttatgtgaa

SEQ ID NO: 8093440 - DNA, 22 bp, Homo sapiens
aactgcaaaataatcaagttgt

SEQ ID NO: 8093441 - DNA, 22 bp, Homo sapiens
aactgcaaagccaatctcagga

SEQ ID NO: 8093442 - DNA, 21 bp, Homo sapiens
aactgcaaatcttagactgca

SEQ ID NO: 8093443 - DNA, 22 bp, Homo sapiens
aactgcaaaaatggtagtctta

SEQ ID NO: 8093444 - DNA, 22 bp, Homo sapiens
aacccgagggccccaggctcgg

SEQ ID NO: 8093445 - DNA, 22 bp, Homo sapiens
aaactgcagccttgagttcagg

SEQ ID NO: 8093446 - DNA, 22 bp, Homo sapiens
aaactgcaggtcatgacccatt

SEQ ID NO: 8093447 - DNA, 22 bp, Homo sapiens
aaactgcatgaagctgatttta

SEQ ID NO: 8093448 - DNA, 23 bp, Homo sapiens
aaactgcatctctgagcctcagc

SEQ ID NO: 8093449 - DNA, 22 bp, Homo sapiens
aaaatattttagggccaggaga

SEQ ID NO: 8093450 - DNA, 22 bp, Homo sapiens
aaactgcacatgaggctggtgc

SEQ ID NO: 8093451 - DNA, 22 bp, Homo sapiens
aaactgcactttattttgtcaa

SEQ ID NO: 8093452 - DNA, 22 bp, Homo sapiens
aaactgcagagccatggttcaa

SEQ ID NO: 8093453 - DNA, 22 bp, Homo sapiens
aaactgcacaagggtgcatagc

SEQ ID NO: 8093454 - DNA, 22 bp, Homo sapiens
aaactgcacacgatgtgcctga

SEQ ID NO: 8093455 - DNA, 22 bp, Homo sapiens
aaactgcaattatttttgcaat

SEQ ID NO: 8093456 - DNA, 22 bp, Homo sapiens
aaaattctgtcattaaattgtg

SEQ ID NO: 8093457 - DNA, 21 bp, Homo sapiens
aaagagcccgctgagaggttc

SEQ ID NO: 8093458 - DNA, 22 bp, Homo sapiens
aaacacaagaggcagggtacag

SEQ ID NO: 8093459 - DNA, 22 bp, Homo sapiens
aaagagctcacagtccactgga

SEQ ID NO: 8093460 - DNA, 22 bp, Homo sapiens
aaaactaaatacgctttgcctc

SEQ ID NO: 8093461 - DNA, 22 bp, Homo sapiens
aaaattattcatggcttttgga

SEQ ID NO: 8093462 - DNA, 22 bp, Homo sapiens
aaaattatagatctagtgcctg

SEQ ID NO: 8093463 - DNA, 22 bp, Homo sapiens
aaaattatggagtatcccaaag

SEQ ID NO: 8093464 - DNA, 22 bp, Homo sapiens
aaacattagacaccatatgctc

SEQ ID NO: 8093465 - DNA, 20 bp, Homo sapiens
aaacattcatgtacaagtga

SEQ ID NO: 8093466 - DNA, 22 bp, Homo sapiens
aaactgtattccatcctcatca

SEQ ID NO: 8093467 - DNA, 22 bp, Homo sapiens
aaactgtaagtgcctcaaggtc

SEQ ID NO: 8093468 - DNA, 22 bp, Homo sapiens
aaactgcaatgacaggtaggag

SEQ ID NO: 8093469 - DNA, 22 bp, Homo sapiens
aaactgcaattacttttgcagc

SEQ ID NO: 8093470 - DNA, 22 bp, Homo sapiens
aaactgcaattacttttgcacc

SEQ ID NO: 8093471 - DNA, 22 bp, Homo sapiens
aaactgcaattatgtttgcaga

SEQ ID NO: 8093472 - DNA, 22 bp, Homo sapiens
aaacagataatgctataaatgg

SEQ ID NO: 8093473 - DNA, 22 bp, Homo sapiens
aaacagataagggacaatttca

SEQ ID NO: 8093474 - DNA, 20 bp, Homo sapiens
aaagccactggcaagagact

SEQ ID NO: 8093475 - DNA, 22 bp, Homo sapiens
aaacactgaagacctatctggt

SEQ ID NO: 8093476 - DNA, 22 bp, Homo sapiens
aaagaaatacctttctcagctt

SEQ ID NO: 8093477 - DNA, 22 bp, Homo sapiens
aaagaaacctatcagccacatg

SEQ ID NO: 8093478 - DNA, 16 bp, Homo sapiens
aaagaaacaggtgtcc

SEQ ID NO: 8093479 - DNA, 22 bp, Homo sapiens
aaactgtgagctagtaaatagg

SEQ ID NO: 8093480 - DNA, 22 bp, Homo sapiens
aaactgtgaagcaagtacaagg

SEQ ID NO: 8093481 - DNA, 22 bp, Homo sapiens
acactgaatgtttaagaacttg

SEQ ID NO: 8093482 - DNA, 22 bp, Homo sapiens
acactgaatgtttaagaacttg

SEQ ID NO: 8093483 - DNA, 22 bp, Homo sapiens
acactgacacctgccctcaggt

SEQ ID NO: 8093484 - DNA, 17 bp, Homo sapiens
acactgacatgccacac

SEQ ID NO: 8093485 - DNA, 21 bp, Homo sapiens
acactgacaaccatccacgag

SEQ ID NO: 8093486 - DNA, 22 bp, Homo sapiens
acactgagattttcctgacacc

SEQ ID NO: 8093487 - DNA, 22 bp, Homo sapiens
acactgagattttcctgacacc

SEQ ID NO: 8093488 - DNA, 22 bp, Homo sapiens
acactgacgcttgacagtcacc

SEQ ID NO: 8093489 - DNA, 22 bp, Homo sapiens
acactgactgggcagtatagtc

SEQ ID NO: 8093490 - DNA, 22 bp, Homo sapiens
acactgactgggacagaagacc

SEQ ID NO: 8093491 - DNA, 22 bp, Homo sapiens
acacttcagcagtatgcttggg

SEQ ID NO: 8093492 - DNA, 22 bp, Homo sapiens
acactgagttttaccaggcaca

SEQ ID NO: 8093493 - DNA, 22 bp, Homo sapiens
acactgcagatgaaagcataag

SEQ ID NO: 8093494 - DNA, 22 bp, Homo sapiens
acacttcacccctgctcccagt

SEQ ID NO: 8093495 - DNA, 22 bp, Homo sapiens
acacattaggcagtgcttaaat

SEQ ID NO: 8093496 - DNA, 22 bp, Homo sapiens
acactagtagaatagtgtttgc

SEQ ID NO: 8093497 - DNA, 22 bp, Homo sapiens
acactctagagggaagcgcttt

SEQ ID NO: 8093498 - DNA, 22 bp, Homo sapiens
acactgaatatacaatgaatat

SEQ ID NO: 8093499 - DNA, 22 bp, Homo sapiens
acactgaagagcactttcaaag

SEQ ID NO: 8093500 - DNA, 22 bp, Homo sapiens
acactgaagagcactttcaaag

SEQ ID NO: 8093501 - DNA, 22 bp, Homo sapiens
acaatgcacctattttaaaact

SEQ ID NO: 8093502 - DNA, 22 bp, Homo sapiens
agcagagccaggtctctctgta

SEQ ID NO: 8093503 - DNA, 22 bp, Homo sapiens
agcagagcagaatgtgaaggtg

SEQ ID NO: 8093504 - DNA, 22 bp, Homo sapiens
acacagagtatcttttgcctag

SEQ ID NO: 8093505 - DNA, 22 bp, Homo sapiens
agcagctggtaggagtggccac

SEQ ID NO: 8093506 - DNA, 22 bp, Homo sapiens
acacagatattgtacttgatcc

SEQ ID NO: 8093507 - DNA, 22 bp, Homo sapiens
acacagatattttgaatacata

SEQ ID NO: 8093508 - DNA, 22 bp, Homo sapiens
agctcctgccaacactgatggg

SEQ ID NO: 8093509 - DNA, 22 bp, Homo sapiens
acagcacaatctgagtcccaga

SEQ ID NO: 8093510 - DNA, 22 bp, Homo sapiens
acagatgtacactcatatataa

SEQ ID NO: 8093511 - DNA, 22 bp, Homo sapiens
acagattcactgcactggccat

SEQ ID NO: 8093512 - DNA, 22 bp, Homo sapiens
acagatgatttttatgaaaaca

SEQ ID NO: 8093513 - DNA, 20 bp, Homo sapiens
acagatgaggatgcggaggc

SEQ ID NO: 8093514 - DNA, 22 bp, Homo sapiens
acagagctgggatctgaaccca

SEQ ID NO: 8093515 - DNA, 19 bp, Homo sapiens
acagagctctctgcttctg

SEQ ID NO: 8093516 - DNA, 22 bp, Homo sapiens
acagagctaaatttcaatccca

SEQ ID NO: 8093517 - DNA, 22 bp, Homo sapiens
acagagctaatgttgcataggc

SEQ ID NO: 8093518 - DNA, 22 bp, Homo sapiens
agcctctctgatgtgacagcta

SEQ ID NO: 8093519 - DNA, 22 bp, Homo sapiens
agcctcctgtagccctcaccca

SEQ ID NO: 8093520 - DNA, 22 bp, Homo sapiens
agcctctcactgtcaccctccc

SEQ ID NO: 8093521 - DNA, 22 bp, Homo sapiens
agcctctctttattcccagcta

SEQ ID NO: 8093522 - DNA, 22 bp, Homo sapiens
acactttgttgtggcatatacg

SEQ ID NO: 8093523 - DNA, 22 bp, Homo sapiens
acagagactaagcttttcatca

SEQ ID NO: 8093524 - DNA, 23 bp, Homo sapiens
acagagacaatggtttcatcttg

SEQ ID NO: 8093525 - DNA, 22 bp, Homo sapiens
acagagacaaatgttagtagtt

SEQ ID NO: 8093526 - DNA, 22 bp, Homo sapiens
agccagggtgagagggctttgt

SEQ ID NO: 8093527 - DNA, 19 bp, Homo sapiens
agccagggtccagacatgt

SEQ ID NO: 8093528 - DNA, 22 bp, Homo sapiens
acagactgttggcctactgagc

SEQ ID NO: 8093529 - DNA, 22 bp, Homo sapiens
acagactgtttggttcatgtct

SEQ ID NO: 8093530 - DNA, 22 bp, Homo sapiens
acagactgtcccaccacatgga

SEQ ID NO: 8093531 - DNA, 22 bp, Homo sapiens
agaggctgttacactcccagat

SEQ ID NO: 8093532 - DNA, 22 bp, Homo sapiens
agaggctgaatgatgtcatcat

SEQ ID NO: 8093533 - DNA, 22 bp, Homo sapiens
agaggctctaataccagcatgg

SEQ ID NO: 8093534 - DNA, 22 bp, Homo sapiens
acaatcttattagtagtataga

SEQ ID NO: 8093535 - DNA, 22 bp, Homo sapiens
acaagcctaacataacataagt

SEQ ID NO: 8093536 - DNA, 22 bp, Homo sapiens
acaagcatgggctttgacatca

SEQ ID NO: 8093537 - DNA, 22 bp, Homo sapiens
acaagatagcttagaagattca

SEQ ID NO: 8093538 - DNA, 22 bp, Homo sapiens
acaagcacttcactgtcctctg

SEQ ID NO: 8093539 - DNA, 22 bp, Homo sapiens
acaacaaagacacttgaaatga

SEQ ID NO: 8093540 - DNA, 17 bp, Homo sapiens
acaacagaaatgtattc

SEQ ID NO: 8093541 - DNA, 22 bp, Homo sapiens
acaactagcaggtattaatttt

SEQ ID NO: 8093542 - DNA, 22 bp, Homo sapiens
aatgggttgctttccacagcct

SEQ ID NO: 8093543 - DNA, 22 bp, Homo sapiens
aatgggtttctgtcccagctct

SEQ ID NO: 8093544 - DNA, 22 bp, Homo sapiens
aatggtaatggagagaactact

SEQ ID NO: 8093545 - DNA, 23 bp, Homo sapiens
aatggtcttcctccacccctctg

SEQ ID NO: 8093546 - DNA, 18 bp, Homo sapiens
aatgtgaatatttacttc

SEQ ID NO: 8093547 - DNA, 22 bp, Homo sapiens
agacaattaaaaaattatgctt

SEQ ID NO: 8093548 - DNA, 22 bp, Homo sapiens
aatgggaggtagtatgggaggt

SEQ ID NO: 8093549 - DNA, 22 bp, Homo sapiens
aatgggagtggcttggaaatca

SEQ ID NO: 8093550 - DNA, 22 bp, Homo sapiens
agagccagttgttaagcactta

SEQ ID NO: 8093551 - DNA, 20 bp, Homo sapiens
agagcctggaaaaagacatc

SEQ ID NO: 8093552 - DNA, 22 bp, Homo sapiens
agagcctgctacctcattccag

SEQ ID NO: 8093553 - DNA, 22 bp, Homo sapiens
agagcctggacttttctgagcc

SEQ ID NO: 8093554 - DNA, 22 bp, Homo sapiens
agagcctggaggttctgctgaa

SEQ ID NO: 8093555 - DNA, 22 bp, Homo sapiens
agagccaggcggctgggcacct

SEQ ID NO: 8093556 - DNA, 22 bp, Homo sapiens
agagccaggctcccatggggca

SEQ ID NO: 8093557 - DNA, 22 bp, Homo sapiens
agagccaggctctacctgggtt

SEQ ID NO: 8093558 - DNA, 22 bp, Homo sapiens
agagccagttaagcacttacag

SEQ ID NO: 8093559 - DNA, 22 bp, Homo sapiens
agagccaggtgtagtctcggag

SEQ ID NO: 8093560 - DNA, 22 bp, Homo sapiens
agagccagttacaactgtggag

SEQ ID NO: 8093561 - DNA, 22 bp, Homo sapiens
aattaaaagataacccatgagt

SEQ ID NO: 8093562 - DNA, 22 bp, Homo sapiens
aattaacagagggcttattact

SEQ ID NO: 8093563 - DNA, 17 bp, Homo sapiens
acagggcagaaacagct

SEQ ID NO: 8093564 - DNA, 22 bp, Homo sapiens
aagctcagagtctcggagggaa

SEQ ID NO: 8093565 - DNA, 22 bp, Homo sapiens
acagggcagaaatgttgcatct

SEQ ID NO: 8093566 - DNA, 22 bp, Homo sapiens
acagggcagagaggcaggcttg

SEQ ID NO: 8093567 - DNA, 22 bp, Homo sapiens
acagggcagcaactttgtgcct

SEQ ID NO: 8093568 - DNA, 22 bp, Homo sapiens
acagggcagagggcagttggta

SEQ ID NO: 8093569 - DNA, 22 bp, Homo sapiens
acagggcagagtgaaatgctat

SEQ ID NO: 8093570 - DNA, 19 bp, Homo sapiens
acagggcagcaataggata

SEQ ID NO: 8093571 - DNA, 22 bp, Homo sapiens
aagccttttccacctaatagag

SEQ ID NO: 8093572 - DNA, 22 bp, Homo sapiens
aaggacaggctaacctgacatt

SEQ ID NO: 8093573 - DNA, 22 bp, Homo sapiens
accatgttggccaagctggtct

SEQ ID NO: 8093574 - DNA, 22 bp, Homo sapiens
accctgccctctccagctcagg

SEQ ID NO: 8093575 - DNA, 22 bp, Homo sapiens
aaggctcggcaatgtgcggctc

SEQ ID NO: 8093576 - DNA, 22 bp, Homo sapiens
aaggctgcttttaacatgcata

SEQ ID NO: 8093577 - DNA, 22 bp, Homo sapiens
acattgtttgagaatacagatg

SEQ ID NO: 8093578 - DNA, 22 bp, Homo sapiens
acatttcatgttttccagagca

SEQ ID NO: 8093579 - DNA, 23 bp, Homo sapiens
actttattgaccccaggtcagtt

SEQ ID NO: 8093580 - DNA, 23 bp, Homo sapiens
actttattgaccccaggtcagtt

SEQ ID NO: 8093581 - DNA, 22 bp, Homo sapiens
actttaaaactgatcatcagag

SEQ ID NO: 8093582 - DNA, 22 bp, Homo sapiens
actttatttcctattgcatcca

SEQ ID NO: 8093583 - DNA, 22 bp, Homo sapiens
aatcagaaagaggtcatgttgc

SEQ ID NO: 8093584 - DNA, 22 bp, Homo sapiens
actttgaaactaaaattcatta

SEQ ID NO: 8093585 - DNA, 22 bp, Homo sapiens
aatactatgtagccaaaataat

SEQ ID NO: 8093586 - DNA, 22 bp, Homo sapiens
aatatagtgttagctcatttga

SEQ ID NO: 8093587 - DNA, 22 bp, Homo sapiens
aatatagttctggtattgttaa

SEQ ID NO: 8093588 - DNA, 22 bp, Homo sapiens
agaaatgaaaccaaagcctaga

SEQ ID NO: 8093589 - DNA, 23 bp, Homo sapiens
aatgatttcatgatgatagcagc

SEQ ID NO: 8093590 - DNA, 22 bp, Homo sapiens
aatgatttcccctacacagaag

SEQ ID NO: 8093591 - DNA, 22 bp, Homo sapiens
aatgatttcccctacacagaag

SEQ ID NO: 8093592 - DNA, 23 bp, Homo sapiens
actggacagagtggacgaggctg

SEQ ID NO: 8093593 - DNA, 22 bp, Homo sapiens
actggccaggcagcagtagctt

SEQ ID NO: 8093594 - DNA, 22 bp, Homo sapiens
actgcactccagcccgagcaac

SEQ ID NO: 8093595 - DNA, 22 bp, Homo sapiens
actatacaccaaaatattaagg

SEQ ID NO: 8093596 - DNA, 23 bp, Homo sapiens
actataaagttgttctgatttac

SEQ ID NO: 8093597 - DNA, 22 bp, Homo sapiens
actatacagtatgtacgtgcac

SEQ ID NO: 8093598 - DNA, 22 bp, Homo sapiens
actctaaatagcctcttaaaca

SEQ ID NO: 8093599 - DNA, 22 bp, Homo sapiens
aagtctctggcaaatgatcttg

SEQ ID NO: 8093600 - DNA, 20 bp, Homo sapiens
acgtggccaccagtggctta

SEQ ID NO: 8093601 - DNA, 22 bp, Homo sapiens
acggggctagagaaggtttctt

SEQ ID NO: 8093602 - DNA, 22 bp, Homo sapiens
accgggaagtcctgcactgggc

SEQ ID NO: 8093603 - DNA, 23 bp, Homo sapiens
acctaaatagctgtgttgaagta

SEQ ID NO: 8093604 - DNA, 22 bp, Homo sapiens
acctacagatctttgaatgtgt

SEQ ID NO: 8093605 - DNA, 22 bp, Homo sapiens
acctacagagatctgcattttt

SEQ ID NO: 8093606 - DNA, 22 bp, Homo sapiens
gtggcacagtgggagagcccca

SEQ ID NO: 8093607 - DNA, 22 bp, Homo sapiens
gtggcacacaggagagagctca

SEQ ID NO: 8093608 - DNA, 22 bp, Homo sapiens
gtggcacaaggcttacacagca

SEQ ID NO: 8093609 - DNA, 22 bp, Homo sapiens
gtggcacagagatggggcatga

SEQ ID NO: 8093610 - DNA, 22 bp, Homo sapiens
gtggcagcaaaatcctgcattc

SEQ ID NO: 8093611 - DNA, 22 bp, Homo sapiens
gtggcagagttgctgactagaa

SEQ ID NO: 8093612 - DNA, 22 bp, Homo sapiens
gtggcagagggtgagctggact

SEQ ID NO: 8093613 - DNA, 22 bp, Homo sapiens
gtggcagaggctctgggaccag

SEQ ID NO: 8093614 - DNA, 22 bp, Homo sapiens
gtggcagccgcaggccctgtgt

SEQ ID NO: 8093615 - DNA, 22 bp, Homo sapiens
gtggcagcggtgtgcaaggagg

SEQ ID NO: 8093616 - DNA, 22 bp, Homo sapiens
gtggcagcagaggggtggtatg

SEQ ID NO: 8093617 - DNA, 22 bp, Homo sapiens
gtggagggtttgcaatgtgcag

SEQ ID NO: 8093618 - DNA, 18 bp, Homo sapiens
gtggagggttctcagaat

SEQ ID NO: 8093619 - DNA, 22 bp, Homo sapiens
gtggacagcttctaggtgccag

SEQ ID NO: 8093620 - DNA, 22 bp, Homo sapiens
gtgcctggaactgggtaggctg

SEQ ID NO: 8093621 - DNA, 22 bp, Homo sapiens
gtgacattttttaagcccttgt

SEQ ID NO: 8093622 - DNA, 22 bp, Homo sapiens
gtgacattgctaggaacagatt

SEQ ID NO: 8093623 - DNA, 22 bp, Homo sapiens
gtgacattcaggatatcaatgg

SEQ ID NO: 8093624 - DNA, 22 bp, Homo sapiens
gtgacatttacgaatcttatcc

SEQ ID NO: 8093625 - DNA, 22 bp, Homo sapiens
gtgcctggcatgcgccggtgct

SEQ ID NO: 8093626 - DNA, 22 bp, Homo sapiens
gtgcctggcagggtcagctgct

SEQ ID NO: 8093627 - DNA, 22 bp, Homo sapiens
gtggaatgtccttgatcataag

SEQ ID NO: 8093628 - DNA, 22 bp, Homo sapiens
gtggaatgaatagatttgcatt

SEQ ID NO: 8093629 - DNA, 22 bp, Homo sapiens
gtggaagaggcaagatagctct

SEQ ID NO: 8093630 - DNA, 22 bp, Homo sapiens
gtggctgagcagcagagagctg

SEQ ID NO: 8093631 - DNA, 19 bp, Homo sapiens
gtggcctgcgctgggtgcg

SEQ ID NO: 8093632 - DNA, 22 bp, Homo sapiens
gtggcctggaaaggctggtctg

SEQ ID NO: 8093633 - DNA, 22 bp, Homo sapiens
gtggctgggctccgagcggctt

SEQ ID NO: 8093634 - DNA, 22 bp, Homo sapiens
gtgggagctttggcatcaggct

SEQ ID NO: 8093635 - DNA, 22 bp, Homo sapiens
gtgggagcttcatcaagcagtt

SEQ ID NO: 8093636 - DNA, 22 bp, Homo sapiens
gtgggagctgcggaggcctggg

SEQ ID NO: 8093637 - DNA, 22 bp, Homo sapiens
gtgggagcatggtcccagtgcc

SEQ ID NO: 8093638 - DNA, 22 bp, Homo sapiens
gtgggagccatttccagtatgc

SEQ ID NO: 8093639 - DNA, 22 bp, Homo sapiens
gtgggagaaattagctctagtt

SEQ ID NO: 8093640 - DNA, 22 bp, Homo sapiens
gtggccagaatcttgaggcctt

SEQ ID NO: 8093641 - DNA, 22 bp, Homo sapiens
gtggccaggagaccttgggcat

SEQ ID NO: 8093642 - DNA, 22 bp, Homo sapiens
gtggcaggatcacggctcactg

SEQ ID NO: 8093643 - DNA, 20 bp, Homo sapiens
gtggcaggcagtgaaggagc

SEQ ID NO: 8093644 - DNA, 22 bp, Homo sapiens
gtggcagggctttgctgttctt

SEQ ID NO: 8093645 - DNA, 22 bp, Homo sapiens
gtggcagggagaagccattggg

SEQ ID NO: 8093646 - DNA, 22 bp, Homo sapiens
gtggcagctggtatgcagacag

SEQ ID NO: 8093647 - DNA, 22 bp, Homo sapiens
gtggcagctgtgggacactggt

SEQ ID NO: 8093648 - DNA, 22 bp, Homo sapiens
gtggcagctgtgttgcagtttt

SEQ ID NO: 8093649 - DNA, 22 bp, Homo sapiens
gtggcaggagagacacagccat

SEQ ID NO: 8093650 - DNA, 22 bp, Homo sapiens
gtggcaggagtgggccttgaag

SEQ ID NO: 8093651 - DNA, 22 bp, Homo sapiens
gtggcaggggcgggctgttccg

SEQ ID NO: 8093652 - DNA, 22 bp, Homo sapiens
gtggcagggtgctcatcatgca

SEQ ID NO: 8093653 - DNA, 22 bp, Homo sapiens
gtggcatcgtctgaggtggggt

SEQ ID NO: 8093654 - DNA, 22 bp, Homo sapiens
gtggcagttttgacatcacaaa

SEQ ID NO: 8093655 - DNA, 22 bp, Homo sapiens
gtggcagtgggatgctatcagg

SEQ ID NO: 8093656 - DNA, 23 bp, Homo sapiens
gtaaaatacgcagtgcagtgtga

SEQ ID NO: 8093657 - DNA, 22 bp, Homo sapiens
gtaaaatagaataacgtggcta

SEQ ID NO: 8093658 - DNA, 21 bp, Homo sapiens
ggtgtcctgagggataggtag

SEQ ID NO: 8093659 - DNA, 22 bp, Homo sapiens
ggtgtcctgtcagctagagtga

SEQ ID NO: 8093660 - DNA, 23 bp, Homo sapiens
gtaaaatacgcagtgcagtgtga

SEQ ID NO: 8093661 - DNA, 22 bp, Homo sapiens
gtacatttaggattcattgaaa

SEQ ID NO: 8093662 - DNA, 22 bp, Homo sapiens
gtacatttactgatgaaaagta

SEQ ID NO: 8093663 - DNA, 22 bp, Homo sapiens
ggtgaggggctcctctgcccgg

SEQ ID NO: 8093664 - DNA, 22 bp, Homo sapiens
ggtgaggggcacctctgcccgg

SEQ ID NO: 8093665 - DNA, 22 bp, Homo sapiens
ggtgaggggcgcctctgcccgg

SEQ ID NO: 8093666 - DNA, 22 bp, Homo sapiens
ggtgaggggcgcctctgcccag

SEQ ID NO: 8093667 - DNA, 22 bp, Homo sapiens
ggtggcagaggtgcatcagccc

SEQ ID NO: 8093668 - DNA, 22 bp, Homo sapiens
ggtggcagagaggaggtagttt

SEQ ID NO: 8093669 - DNA, 22 bp, Homo sapiens
ggtgcaggagcggggtgctcgg

SEQ ID NO: 8093670 - DNA, 22 bp, Homo sapiens
ggtgcaggcggtggggcaagta

SEQ ID NO: 8093671 - DNA, 22 bp, Homo sapiens
ggtgtcctacagggccgcaggc

SEQ ID NO: 8093672 - DNA, 21 bp, Homo sapiens
ggtgtccagaggagtccccag

SEQ ID NO: 8093673 - DNA, 22 bp, Homo sapiens
ggtgtccattggcctaacctag

SEQ ID NO: 8093674 - DNA, 22 bp, Homo sapiens
ggtggcagttacaggggcaaat

SEQ ID NO: 8093675 - DNA, 22 bp, Homo sapiens
ggtggccaggccagctctggcc

SEQ ID NO: 8093676 - DNA, 22 bp, Homo sapiens
ggtggcaggccctgagcatccc

SEQ ID NO: 8093677 - DNA, 22 bp, Homo sapiens
ggtggcaggctggcattggcaa

SEQ ID NO: 8093678 - DNA, 23 bp, Homo sapiens
ggtggcaggagtggatgctgagc

SEQ ID NO: 8093679 - DNA, 22 bp, Homo sapiens
gtctgggcatcagactgcgggc

SEQ ID NO: 8093680 - DNA, 22 bp, Homo sapiens
gtccttccacatggccaacttc

SEQ ID NO: 8093681 - DNA, 22 bp, Homo sapiens
gtccttccccagccagctctgg

SEQ ID NO: 8093682 - DNA, 22 bp, Homo sapiens
gtccttcctgcagggatggatg

SEQ ID NO: 8093683 - DNA, 22 bp, Homo sapiens
gtcccagggatgcagacatgag

SEQ ID NO: 8093684 - DNA, 22 bp, Homo sapiens
gtcccagggcaaggctgtttct

SEQ ID NO: 8093685 - DNA, 22 bp, Homo sapiens
gtcccagggccaccatatatag

SEQ ID NO: 8093686 - DNA, 22 bp, Homo sapiens
gtcccaggtgcccagtgggcag

SEQ ID NO: 8093687 - DNA, 22 bp, Homo sapiens
gtcccaggtcccagcacatctg

SEQ ID NO: 8093688 - DNA, 22 bp, Homo sapiens
gtcccaggtgggctccacctct

SEQ ID NO: 8093689 - DNA, 22 bp, Homo sapiens
gtcccaggtgggctccacctct

SEQ ID NO: 8093690 - DNA, 22 bp, Homo sapiens
gtcccataagtagtgcaacttg

SEQ ID NO: 8093691 - DNA, 22 bp, Homo sapiens
gtcccagggaggttcagggctt

SEQ ID NO: 8093692 - DNA, 22 bp, Homo sapiens
gtccatcttattacagagcttt

SEQ ID NO: 8093693 - DNA, 19 bp, Homo sapiens
gtccatgcttagaggggcc

SEQ ID NO: 8093694 - DNA, 22 bp, Homo sapiens
gtccatgactgtgactcacatg

SEQ ID NO: 8093695 - DNA, 22 bp, Homo sapiens
gtccatgattctgtgacaccct

SEQ ID NO: 8093696 - DNA, 22 bp, Homo sapiens
gtccatgattctgtgtagtaga

SEQ ID NO: 8093697 - DNA, 22 bp, Homo sapiens
gtccagggccccgagcaccagg

SEQ ID NO: 8093698 - DNA, 22 bp, Homo sapiens
gtggggtagatctttctcagga

SEQ ID NO: 8093699 - DNA, 22 bp, Homo sapiens
gtggggtgtccagcagcgagct

SEQ ID NO: 8093700 - DNA, 22 bp, Homo sapiens
gtgggtgcggggagccgaggcg

SEQ ID NO: 8093701 - DNA, 22 bp, Homo sapiens
gtggtgtaggtcacagttagga

SEQ ID NO: 8093702 - DNA, 22 bp, Homo sapiens
gtgggcatctccttggaagcca

SEQ ID NO: 8093703 - DNA, 22 bp, Homo sapiens
gtgggccacatcccagggctct

SEQ ID NO: 8093704 - DNA, 22 bp, Homo sapiens
gtgggccactgggaggcaaggg

SEQ ID NO: 8093705 - DNA, 22 bp, Homo sapiens
gtgggccagcttttctcctggg

SEQ ID NO: 8093706 - DNA, 22 bp, Homo sapiens
gtgggccagcattttgaagagt

SEQ ID NO: 8093707 - DNA, 22 bp, Homo sapiens
gtgggccaggacccgctgtccg

SEQ ID NO: 8093708 - DNA, 22 bp, Homo sapiens
gtgggccaggcgtctaggccct

SEQ ID NO: 8093709 - DNA, 19 bp, Homo sapiens
gtgggccaggcagaaggct

SEQ ID NO: 8093710 - DNA, 22 bp, Homo sapiens
gtgggccaggccggagtgcaga

SEQ ID NO: 8093711 - DNA, 22 bp, Homo sapiens
gtgggcagtggtttgcgcggtc

SEQ ID NO: 8093712 - DNA, 22 bp, Homo sapiens
gtgggcagttcaattctgggag

SEQ ID NO: 8093713 - DNA, 22 bp, Homo sapiens
gtgggcaggaggccctgccctg

SEQ ID NO: 8093714 - DNA, 22 bp, Homo sapiens
gtgggcagcctgtccggagacc

SEQ ID NO: 8093715 - DNA, 22 bp, Homo sapiens
gtgggcagccccttcaaggcca

SEQ ID NO: 8093716 - DNA, 20 bp, Homo sapiens
gtgggcagcaggcatactgg

SEQ ID NO: 8093717 - DNA, 22 bp, Homo sapiens
gtgggcagacagtgctttgcag

SEQ ID NO: 8093718 - DNA, 22 bp, Homo sapiens
gtgggcagaacatttgtaggct

SEQ ID NO: 8093719 - DNA, 22 bp, Homo sapiens
gtgggcagagcaagggaactca

SEQ ID NO: 8093720 - DNA, 22 bp, Homo sapiens
gtgggggcaggcagtgctagga

SEQ ID NO: 8093721 - DNA, 22 bp, Homo sapiens
gtgggctggatttgcttgcaga

SEQ ID NO: 8093722 - DNA, 22 bp, Homo sapiens
gtgggctgcttcctccttccac

SEQ ID NO: 8093723 - DNA, 22 bp, Homo sapiens
gtgggctgcccttgaggtcagc

SEQ ID NO: 8093724 - DNA, 22 bp, Homo sapiens
gtgggccagttcctcacaggta

SEQ ID NO: 8093725 - DNA, 22 bp, Homo sapiens
gtgtgggctatgtgcgtgggca

SEQ ID NO: 8093726 - DNA, 22 bp, Homo sapiens
gtgtgggctgcagaggcacagc

SEQ ID NO: 8093727 - DNA, 22 bp, Homo sapiens
gtgtgcaggtgtcagtgcagct

SEQ ID NO: 8093728 - DNA, 22 bp, Homo sapiens
gtgtgcagggatgagtgcaggt

SEQ ID NO: 8093729 - DNA, 22 bp, Homo sapiens
gtgtgcagaacagggagtgggt

SEQ ID NO: 8093730 - DNA, 22 bp, Homo sapiens
gtgtcccaggcctctggaatta

SEQ ID NO: 8093731 - DNA, 22 bp, Homo sapiens
gtgtccactccatgcccatcct

SEQ ID NO: 8093732 - DNA, 22 bp, Homo sapiens
gtgtccactcgtggtctgtcag

SEQ ID NO: 8093733 - DNA, 19 bp, Homo sapiens
gtgtccatggagcatggag

SEQ ID NO: 8093734 - DNA, 22 bp, Homo sapiens
gttctctctgcttccaagatgg

SEQ ID NO: 8093735 - DNA, 22 bp, Homo sapiens
gtttaataatgttgaattacta

SEQ ID NO: 8093736 - DNA, 22 bp, Homo sapiens
gtttaataatgttgaattacta

SEQ ID NO: 8093737 - DNA, 22 bp, Homo sapiens
taaaacacataaactctctatt

SEQ ID NO: 8093738 - DNA, 22 bp, Homo sapiens
taacactgatttgttctcaggg

SEQ ID NO: 8093739 - DNA, 22 bp, Homo sapiens
taacactgatttgttctcaggg

SEQ ID NO: 8093740 - DNA, 22 bp, Homo sapiens
taacactgccatgctggagtca

SEQ ID NO: 8093741 - DNA, 22 bp, Homo sapiens
taacactatccagatatgataa

SEQ ID NO: 8093742 - DNA, 22 bp, Homo sapiens
taacactgtggtgttctttgtc

SEQ ID NO: 8093743 - DNA, 22 bp, Homo sapiens
taacactgtccaaagaattcca

SEQ ID NO: 8093744 - DNA, 22 bp, Homo sapiens
ggagcgtgcactccaggccctt

SEQ ID NO: 8093745 - DNA, 22 bp, Homo sapiens
ggagagggtaggggtcctgccc

SEQ ID NO: 8093746 - DNA, 22 bp, Homo sapiens
ggaggccaccatggagtcactt

SEQ ID NO: 8093747 - DNA, 22 bp, Homo sapiens
ggaggagctgctgtgggggccc

SEQ ID NO: 8093748 - DNA, 22 bp, Homo sapiens
ggaggacactggctctgccttc

SEQ ID NO: 8093749 - DNA, 22 bp, Homo sapiens
ggaggagcatgagagggtagtg

SEQ ID NO: 8093750 - DNA, 22 bp, Homo sapiens
ggagctgaggctgaggcctcac

SEQ ID NO: 8093751 - DNA, 22 bp, Homo sapiens
gcttcggggtccaagcgcgtgt

SEQ ID NO: 8093752 - DNA, 22 bp, Homo sapiens
gctgggctcgttcccacacgcg

SEQ ID NO: 8093753 - DNA, 22 bp, Homo sapiens
gctgggccagagcagcagcact

SEQ ID NO: 8093754 - DNA, 22 bp, Homo sapiens
ggaaaacaagagaatgatgttt

SEQ ID NO: 8093755 - DNA, 22 bp, Homo sapiens
ggaagaaaggtggacaacaggt

SEQ ID NO: 8093756 - DNA, 22 bp, Homo sapiens
ggaagaaagtagaaaaccgtgg

SEQ ID NO: 8093757 - DNA, 22 bp, Homo sapiens
ggaagaaagcacacaaacttga

SEQ ID NO: 8093758 - DNA, 22 bp, Homo sapiens
ggaagaaagacatttattttga

SEQ ID NO: 8093759 - DNA, 22 bp, Homo sapiens
ggaagaaaatgggcaacaggtg

SEQ ID NO: 8093760 - DNA, 17 bp, Homo sapiens
ggaagaaaaggatcatc

SEQ ID NO: 8093761 - DNA, 18 bp, Homo sapiens
ggaagaaaaggaactcag

SEQ ID NO: 8093762 - DNA, 22 bp, Homo sapiens
ggaagaaaagcttccagcgcct

SEQ ID NO: 8093763 - DNA, 22 bp, Homo sapiens
ggaagaaatgctcttctatgcg

SEQ ID NO: 8093764 - DNA, 22 bp, Homo sapiens
ggaagaaatctggttaagagat

SEQ ID NO: 8093765 - DNA, 22 bp, Homo sapiens
ggaagaaatctggttaagagat

SEQ ID NO: 8093766 - DNA, 22 bp, Homo sapiens
ggaaggggtgtcgcccatggat

SEQ ID NO: 8093767 - DNA, 22 bp, Homo sapiens
ggaagggtttaagcaggagagt

SEQ ID NO: 8093768 - DNA, 22 bp, Homo sapiens
ggaagggtttggaaagccgaga

SEQ ID NO: 8093769 - DNA, 22 bp, Homo sapiens
ggcaggtgaggcatgtgcctgg

SEQ ID NO: 8093770 - DNA, 22 bp, Homo sapiens
ggcaggtgaggcatgtgcctgg

SEQ ID NO: 8093771 - DNA, 22 bp, Homo sapiens
ggcaggcctgagaggcagggct

SEQ ID NO: 8093772 - DNA, 22 bp, Homo sapiens
ggcagaggaagctggaagtggg

SEQ ID NO: 8093773 - DNA, 20 bp, Homo sapiens
ggcagacctgctgagagccc

SEQ ID NO: 8093774 - DNA, 22 bp, Homo sapiens
ggcacagcactgtaggcctggg

SEQ ID NO: 8093775 - DNA, 22 bp, Homo sapiens
ggcacagcacagagcacatgta

SEQ ID NO: 8093776 - DNA, 22 bp, Homo sapiens
ggcacagcacagtggacccagg

SEQ ID NO: 8093777 - DNA, 23 bp, Homo sapiens
ggcacagatgctgagcatgtgca

SEQ ID NO: 8093778 - DNA, 22 bp, Homo sapiens
ggagtgggaacaatgacatggt

SEQ ID NO: 8093779 - DNA, 22 bp, Homo sapiens
ggagtgggcagcactgccctgt

SEQ ID NO: 8093780 - DNA, 22 bp, Homo sapiens
ggagtggcaggccacagtgctg

SEQ ID NO: 8093781 - DNA, 22 bp, Homo sapiens
ggagtgtgggatggagctcagg

SEQ ID NO: 8093782 - DNA, 22 bp, Homo sapiens
ggagttgattttggatatatta

SEQ ID NO: 8093783 - DNA, 22 bp, Homo sapiens
ggaggccttgaggccaggagct

SEQ ID NO: 8093784 - DNA, 22 bp, Homo sapiens
ggaggcggaggttgcagtgagc

SEQ ID NO: 8093785 - DNA, 22 bp, Homo sapiens
ggaggcggaggttgcagtgagt

SEQ ID NO: 8093786 - DNA, 22 bp, Homo sapiens
ggagggcagagtcccctgctga

SEQ ID NO: 8093787 - DNA, 18 bp, Homo sapiens
ggagggctttggggactg

SEQ ID NO: 8093788 - DNA, 22 bp, Homo sapiens
ggaggggaactaatcccgtgac

SEQ ID NO: 8093789 - DNA, 22 bp, Homo sapiens
ggagggctgtagaggagacctg

SEQ ID NO: 8093790 - DNA, 22 bp, Homo sapiens
ggagggctgccaggtggagcgg

SEQ ID NO: 8093791 - DNA, 22 bp, Homo sapiens
ggagggctccctgggagtggat

SEQ ID NO: 8093792 - DNA, 22 bp, Homo sapiens
ggagggccctgggtgcagctct

SEQ ID NO: 8093793 - DNA, 22 bp, Homo sapiens
ggagggctcgtcatccaccact

SEQ ID NO: 8093794 - DNA, 22 bp, Homo sapiens
ggaggggtgagaatggctgcct

SEQ ID NO: 8093795 - DNA, 22 bp, Homo sapiens
ggaggggtgctcagctgtcacg

SEQ ID NO: 8093796 - DNA, 22 bp, Homo sapiens
ggagggggactgacactgattt

SEQ ID NO: 8093797 - DNA, 22 bp, Homo sapiens
ggagggggaattcagccccagc

SEQ ID NO: 8093798 - DNA, 22 bp, Homo sapiens
ggagggggaattcagccccagc

SEQ ID NO: 8093799 - DNA, 22 bp, Homo sapiens
ggagggggaagaagctaaagac

SEQ ID NO: 8093800 - DNA, 22 bp, Homo sapiens
ggagggggaaactttggctgcc

SEQ ID NO: 8093801 - DNA, 22 bp, Homo sapiens
ggaggggaggtccagctgatct

SEQ ID NO: 8093802 - DNA, 22 bp, Homo sapiens
ggaggggagtctcccaaagccg

SEQ ID NO: 8093803 - DNA, 22 bp, Homo sapiens
ggaggggagtctcccaaagccg

SEQ ID NO: 8093804 - DNA, 22 bp, Homo sapiens
ggaggggaggattaatgacaaa

SEQ ID NO: 8093805 - DNA, 22 bp, Homo sapiens
ggaggggagatgtttgggctca

SEQ ID NO: 8093806 - DNA, 22 bp, Homo sapiens
ggagggttagcaaaggcacaga

SEQ ID NO: 8093807 - DNA, 22 bp, Homo sapiens
gggctaggcttggccagcactg

SEQ ID NO: 8093808 - DNA, 22 bp, Homo sapiens
gggctggcaggacctgggctga

SEQ ID NO: 8093809 - DNA, 22 bp, Homo sapiens
gggctggagccagctgtggctg

SEQ ID NO: 8093810 - DNA, 20 bp, Homo sapiens
ggggggcttcagggcctgtg

SEQ ID NO: 8093811 - DNA, 22 bp, Homo sapiens
ggggggctgttctggacaggaa

SEQ ID NO: 8093812 - DNA, 22 bp, Homo sapiens
ggggggtgctgatcagtggagc

SEQ ID NO: 8093813 - DNA, 22 bp, Homo sapiens
gggggtcccaagctgggctgct

SEQ ID NO: 8093814 - DNA, 22 bp, Homo sapiens
gggggctggaatatccatcaac

SEQ ID NO: 8093815 - DNA, 22 bp, Homo sapiens
gggggctggactttcccacaca

SEQ ID NO: 8093816 - DNA, 22 bp, Homo sapiens
gggtgggcctgtctggccatgt

SEQ ID NO: 8093817 - DNA, 22 bp, Homo sapiens
gggtgggccactgagcagcgtg

SEQ ID NO: 8093818 - DNA, 17 bp, Homo sapiens
gggtgggcactgctggc

SEQ ID NO: 8093819 - DNA, 22 bp, Homo sapiens
gggtgaggagctgccagtcatg

SEQ ID NO: 8093820 - DNA, 22 bp, Homo sapiens
gggatggagggtagagcaagtg

SEQ ID NO: 8093821 - DNA, 22 bp, Homo sapiens
gggatggatcttggctgaggct

SEQ ID NO: 8093822 - DNA, 19 bp, Homo sapiens
gggatgggccctcaccctc

SEQ ID NO: 8093823 - DNA, 22 bp, Homo sapiens
gggatggggagctggaaagggg

SEQ ID NO: 8093824 - DNA, 22 bp, Homo sapiens
gggatggggagctggaaagggg

SEQ ID NO: 8093825 - DNA, 22 bp, Homo sapiens
gggatggggagctggaaagggg

SEQ ID NO: 8093826 - DNA, 22 bp, Homo sapiens
gggaggctctgctcagcccccg

SEQ ID NO: 8093827 - DNA, 22 bp, Homo sapiens
gggaggcgccgagggtagctaa

SEQ ID NO: 8093828 - DNA, 20 bp, Homo sapiens
gggaggcgagggctgagcag

SEQ ID NO: 8093829 - DNA, 22 bp, Homo sapiens
gggacctgcgccactcactgtc

SEQ ID NO: 8093830 - DNA, 22 bp, Homo sapiens
gggacctggcacctttgctctg

SEQ ID NO: 8093831 - DNA, 22 bp, Homo sapiens
gggacgacaggctctgtggtag

SEQ ID NO: 8093832 - DNA, 22 bp, Homo sapiens
gggccaggagtggagatatggg

SEQ ID NO: 8093833 - DNA, 22 bp, Homo sapiens
gggccaggagtggagatatggg

SEQ ID NO: 8093834 - DNA, 22 bp, Homo sapiens
gggccacaggccttgcccgcag

SEQ ID NO: 8093835 - DNA, 22 bp, Homo sapiens
gggccaggtatcgtctttagta

SEQ ID NO: 8093836 - DNA, 22 bp, Homo sapiens
gggccaggtggaccccagcctc

SEQ ID NO: 8093837 - DNA, 22 bp, Homo sapiens
gggccaggtggaccccagcctc

SEQ ID NO: 8093838 - DNA, 22 bp, Homo sapiens
gggccaggtcggtgaatggtca

SEQ ID NO: 8093839 - DNA, 22 bp, Homo sapiens
gggccaggtcggtgaatggtca

SEQ ID NO: 8093840 - DNA, 22 bp, Homo sapiens
gggcagcacgtttcaggaggat

SEQ ID NO: 8093841 - DNA, 18 bp, Homo sapiens
gggcagcacagcagcctc

SEQ ID NO: 8093842 - DNA, 22 bp, Homo sapiens
gggcagcaaatctgagtctggt

SEQ ID NO: 8093843 - DNA, 22 bp, Homo sapiens
gggccagtgggacctgggtctc

SEQ ID NO: 8093844 - DNA, 22 bp, Homo sapiens
gggcccagcactggctgggatc

SEQ ID NO: 8093845 - DNA, 22 bp, Homo sapiens
gggcctgtctcactccctggtt

SEQ ID NO: 8093846 - DNA, 22 bp, Homo sapiens
gggcccagccctctgctcactg

SEQ ID NO: 8093847 - DNA, 22 bp, Homo sapiens
gggctactgagctggaactggg

SEQ ID NO: 8093848 - DNA, 22 bp, Homo sapiens
gggcgtggatggtcagtgcagg

SEQ ID NO: 8093849 - DNA, 22 bp, Homo sapiens
gggcgtggatggtcagtgcagg

SEQ ID NO: 8093850 - DNA, 22 bp, Homo sapiens
ggccccagcagaccctcctctg

SEQ ID NO: 8093851 - DNA, 22 bp, Homo sapiens
ggccccagattctgggctgggt

SEQ ID NO: 8093852 - DNA, 22 bp, Homo sapiens
ggccccaggtctgaacacgctg

SEQ ID NO: 8093853 - DNA, 22 bp, Homo sapiens
ggccccagttcactcctggccg

SEQ ID NO: 8093854 - DNA, 22 bp, Homo sapiens
ggccatggtcatgggtgagctt

SEQ ID NO: 8093855 - DNA, 22 bp, Homo sapiens
ggccagagctcaaacagtcgca

SEQ ID NO: 8093856 - DNA, 22 bp, Homo sapiens
ggccagaggccacagctgtgtc

SEQ ID NO: 8093857 - DNA, 22 bp, Homo sapiens
ggccagaggtggtacatagctt

SEQ ID NO: 8093858 - DNA, 18 bp, Homo sapiens
ggccagagggagggtccc

SEQ ID NO: 8093859 - DNA, 22 bp, Homo sapiens
ggccagagggagggcacaaatc

SEQ ID NO: 8093860 - DNA, 22 bp, Homo sapiens
ggccagaaagttaagctgtggc

SEQ ID NO: 8093861 - DNA, 22 bp, Homo sapiens
ggccacctggctgtgggggcag

SEQ ID NO: 8093862 - DNA, 22 bp, Homo sapiens
ggccacctgggttcgactgggc

SEQ ID NO: 8093863 - DNA, 22 bp, Homo sapiens
ggcaggtgctctgtgggcctgg

SEQ ID NO: 8093864 - DNA, 22 bp, Homo sapiens
ggctcaggactgcagcgtagag

SEQ ID NO: 8093865 - DNA, 22 bp, Homo sapiens
ggctcaggccagaccacgactc

SEQ ID NO: 8093866 - DNA, 22 bp, Homo sapiens
ggctccaagtctcagagtgaag

SEQ ID NO: 8093867 - DNA, 22 bp, Homo sapiens
ggcttcccaaggagccaggatg

SEQ ID NO: 8093868 - DNA, 22 bp, Homo sapiens
ggcttcccagcagagggcgcac

SEQ ID NO: 8093869 - DNA, 22 bp, Homo sapiens
ggcttcccaggcggtccccaca

SEQ ID NO: 8093870 - DNA, 22 bp, Homo sapiens
ggcttcccagtccctgctctca

SEQ ID NO: 8093871 - DNA, 22 bp, Homo sapiens
ggcttccctgcctcacttattc

SEQ ID NO: 8093872 - DNA, 22 bp, Homo sapiens
ggcttccctgtttgctgtgcct

SEQ ID NO: 8093873 - DNA, 22 bp, Homo sapiens
ggcttccctttccgagaggaga

SEQ ID NO: 8093874 - DNA, 22 bp, Homo sapiens
ggcttccctaaacctttccact

SEQ ID NO: 8093875 - DNA, 18 bp, Homo sapiens
ggcttccctactcacttc

SEQ ID NO: 8093876 - DNA, 22 bp, Homo sapiens
ggcttccccacagtcctgagct

SEQ ID NO: 8093877 - DNA, 22 bp, Homo sapiens
ggcttccccacaaagcacacaa

SEQ ID NO: 8093878 - DNA, 20 bp, Homo sapiens
ggcttccccgccatcttccg

SEQ ID NO: 8093879 - DNA, 22 bp, Homo sapiens
ggcttcccctccagtgctctgt

SEQ ID NO: 8093880 - DNA, 23 bp, Homo sapiens
ggcttcagtgagagtccctgctg

SEQ ID NO: 8093881 - DNA, 22 bp, Homo sapiens
ggcttcattttatcttatcatg

SEQ ID NO: 8093882 - DNA, 22 bp, Homo sapiens
ggctggcctcagggtcctcgct

SEQ ID NO: 8093883 - DNA, 23 bp, Homo sapiens
ggctggcccggggctgctcctga

SEQ ID NO: 8093884 - DNA, 22 bp, Homo sapiens
ggctggcgggtgggtgaaagac

SEQ ID NO: 8093885 - DNA, 22 bp, Homo sapiens
ggctgatcaggtgcaaatgcat

SEQ ID NO: 8093886 - DNA, 22 bp, Homo sapiens
gagctggctccgccatgctgct

SEQ ID NO: 8093887 - DNA, 22 bp, Homo sapiens
gagctgggaagatagcttgagc

SEQ ID NO: 8093888 - DNA, 22 bp, Homo sapiens
gaggacagagccgcctggcaag

SEQ ID NO: 8093889 - DNA, 22 bp, Homo sapiens
gaggacagagccgcctggcaag

SEQ ID NO: 8093890 - DNA, 22 bp, Homo sapiens
gaggacagctctaactaaagtc

SEQ ID NO: 8093891 - DNA, 22 bp, Homo sapiens
gaggacagcttagggcttcctg

SEQ ID NO: 8093892 - DNA, 22 bp, Homo sapiens
gaggaagatggttgagtggtcc

SEQ ID NO: 8093893 - DNA, 22 bp, Homo sapiens
gagctgggagttatagcatgtt

SEQ ID NO: 8093894 - DNA, 22 bp, Homo sapiens
gagctgggaggactgggaactt

SEQ ID NO: 8093895 - DNA, 22 bp, Homo sapiens
gagctgggacttggaatccaca

SEQ ID NO: 8093896 - DNA, 18 bp, Homo sapiens
gagctgggagaaggaagg

SEQ ID NO: 8093897 - DNA, 22 bp, Homo sapiens
gaggcagaggttgcagtgagct

SEQ ID NO: 8093898 - DNA, 22 bp, Homo sapiens
gaggcagagtcacaaagagtct

SEQ ID NO: 8093899 - DNA, 22 bp, Homo sapiens
gaggagggagctggaagctctt

SEQ ID NO: 8093900 - DNA, 22 bp, Homo sapiens
gagggatggtagttgacactga

SEQ ID NO: 8093901 - DNA, 22 bp, Homo sapiens
gagggatgcagaaacagaggcc

SEQ ID NO: 8093902 - DNA, 22 bp, Homo sapiens
gaggctgcccaactggagtgga

SEQ ID NO: 8093903 - DNA, 22 bp, Homo sapiens
gaggctgcccacacctgcgccg

SEQ ID NO: 8093904 - DNA, 22 bp, Homo sapiens
gaggggatgcagagaggcttat

SEQ ID NO: 8093905 - DNA, 22 bp, Homo sapiens
gaggggagtgtcctccgggccc

SEQ ID NO: 8093906 - DNA, 22 bp, Homo sapiens
gaggggcacagtaaagggtccc

SEQ ID NO: 8093907 - DNA, 22 bp, Homo sapiens
gagtccagagattaagcacctc

SEQ ID NO: 8093908 - DNA, 22 bp, Homo sapiens
gagtcaggtttctgcctataga

SEQ ID NO: 8093909 - DNA, 22 bp, Homo sapiens
gaggtatttttgcatgcctgat

SEQ ID NO: 8093910 - DNA, 22 bp, Homo sapiens
gaggtaacactgttcagtgggc

SEQ ID NO: 8093911 - DNA, 22 bp, Homo sapiens
gaggggcgtcctgagtgggcct

SEQ ID NO: 8093912 - DNA, 22 bp, Homo sapiens
gaggtcaggcttgcagcagggt

SEQ ID NO: 8093913 - DNA, 22 bp, Homo sapiens
gagtcctgatccttagctctcc

SEQ ID NO: 8093914 - DNA, 22 bp, Homo sapiens
gagtcgagcagaaagccgtcgg

SEQ ID NO: 8093915 - DNA, 22 bp, Homo sapiens
gagtctggtgatggtcattgtc

SEQ ID NO: 8093916 - DNA, 22 bp, Homo sapiens
gagtgctggggtgcagagaggt

SEQ ID NO: 8093917 - DNA, 22 bp, Homo sapiens
gagtggcatatgtgcctgtgaa

SEQ ID NO: 8093918 - DNA, 22 bp, Homo sapiens
gagtggcaggcactgtgacgga

SEQ ID NO: 8093919 - DNA, 22 bp, Homo sapiens
gagtgctttgtcttgtaattct

SEQ ID NO: 8093920 - DNA, 21 bp, Homo sapiens
gagtgggacatgggagtggtt

SEQ ID NO: 8093921 - DNA, 18 bp, Homo sapiens
gagtgtggcactgggccc

SEQ ID NO: 8093922 - DNA, 22 bp, Homo sapiens
gagtgtccgtgcagccccagac

SEQ ID NO: 8093923 - DNA, 22 bp, Homo sapiens
gatacattttatctcctaacag

SEQ ID NO: 8093924 - DNA, 22 bp, Homo sapiens
gatgagcattgtttcatgtgtt

SEQ ID NO: 8093925 - DNA, 22 bp, Homo sapiens
gatgaagaggcactgacatatt

SEQ ID NO: 8093926 - DNA, 22 bp, Homo sapiens
gatctgggagcctcatggagac

SEQ ID NO: 8093927 - DNA, 22 bp, Homo sapiens
gatcttctctttagtagaaaca

SEQ ID NO: 8093928 - DNA, 22 bp, Homo sapiens
gatcttctatgtaatgaagtgt

SEQ ID NO: 8093929 - DNA, 22 bp, Homo sapiens
gatcttctagcagaagtaattt

SEQ ID NO: 8093930 - DNA, 22 bp, Homo sapiens
gatccctgccctcagcctggac

SEQ ID NO: 8093931 - DNA, 20 bp, Homo sapiens
gatgaaatcactgggcagcc

SEQ ID NO: 8093932 - DNA, 17 bp, Homo sapiens
gatgaaatgatgcacac

SEQ ID NO: 8093933 - DNA, 22 bp, Homo sapiens
gaaaggcagtacagctgagcct

SEQ ID NO: 8093934 - DNA, 22 bp, Homo sapiens
gaaaaggcctccccataggaat

SEQ ID NO: 8093935 - DNA, 22 bp, Homo sapiens
gaaaaggccactcctaggagct

SEQ ID NO: 8093936 - DNA, 22 bp, Homo sapiens
gaactgaagacttttactgtac

SEQ ID NO: 8093937 - DNA, 22 bp, Homo sapiens
gaactgcatcttaaataatact

SEQ ID NO: 8093938 - DNA, 22 bp, Homo sapiens
gaactgcattgtggtatatgtt

SEQ ID NO: 8093939 - DNA, 22 bp, Homo sapiens
gaacgcaacggaaaagatttca

SEQ ID NO: 8093940 - DNA, 22 bp, Homo sapiens
gaactaaatttgacagacaaca

SEQ ID NO: 8093941 - DNA, 22 bp, Homo sapiens
gaacacagtcaagggctgctgt

SEQ ID NO: 8093942 - DNA, 22 bp, Homo sapiens
gaacacagaagaatttctaaga

SEQ ID NO: 8093943 - DNA, 22 bp, Homo sapiens
gaaataacagctctggaagagt

SEQ ID NO: 8093944 - DNA, 22 bp, Homo sapiens
gaaataacctcatgcaccatga

SEQ ID NO: 8093945 - DNA, 22 bp, Homo sapiens
ctggctggtcctcggggacagc

SEQ ID NO: 8093946 - DNA, 22 bp, Homo sapiens
ctttagatttctatgtatcact

SEQ ID NO: 8093947 - DNA, 19 bp, Homo sapiens
ctttagacacacctggaca

SEQ ID NO: 8093948 - DNA, 22 bp, Homo sapiens
ctttagatgttgctttaactat

SEQ ID NO: 8093949 - DNA, 22 bp, Homo sapiens
ctttagacatacagaatttcca

SEQ ID NO: 8093950 - DNA, 22 bp, Homo sapiens
cttgggagtagaggcaggagca

SEQ ID NO: 8093951 - DNA, 22 bp, Homo sapiens
cttggctgtcataaggtcctgg

SEQ ID NO: 8093952 - DNA, 22 bp, Homo sapiens
cttgggaatgctaacagatgac

SEQ ID NO: 8093953 - DNA, 22 bp, Homo sapiens
cttgaagttgcaaaacattaat

SEQ ID NO: 8093954 - DNA, 19 bp, Homo sapiens
gacaggacgaagggaagtt

SEQ ID NO: 8093955 - DNA, 23 bp, Homo sapiens
gaactgttgatgaatagaatata

SEQ ID NO: 8093956 - DNA, 22 bp, Homo sapiens
gaactgtgtacattgtagataa

SEQ ID NO: 8093957 - DNA, 22 bp, Homo sapiens
gaactgtgggtaatatattaga

SEQ ID NO: 8093958 - DNA, 18 bp, Homo sapiens
gagagctgctacctagct

SEQ ID NO: 8093959 - DNA, 22 bp, Homo sapiens
gagagctgcagccgagaggggg

SEQ ID NO: 8093960 - DNA, 22 bp, Homo sapiens
gagagctgcaaggtagggcggg

SEQ ID NO: 8093961 - DNA, 22 bp, Homo sapiens
gagagctgggggactgtggatg

SEQ ID NO: 8093962 - DNA, 22 bp, Homo sapiens
gagagctggccagcttcagtat

SEQ ID NO: 8093963 - DNA, 22 bp, Homo sapiens
gagagctggattctggataggt

SEQ ID NO: 8093964 - DNA, 22 bp, Homo sapiens
gagagctgggctttgggtgaag

SEQ ID NO: 8093965 - DNA, 22 bp, Homo sapiens
gactttatcctgcctgaccacg

SEQ ID NO: 8093966 - DNA, 22 bp, Homo sapiens
gactttataaatgagaggcgga

SEQ ID NO: 8093967 - DNA, 22 bp, Homo sapiens
gactttatgaagagatgaccaa

SEQ ID NO: 8093968 - DNA, 22 bp, Homo sapiens
gactttatcttgtccttcctgc

SEQ ID NO: 8093969 - DNA, 22 bp, Homo sapiens
gactttattactaaccctgtga

SEQ ID NO: 8093970 - DNA, 22 bp, Homo sapiens
gactttattcgttaactgttaa

SEQ ID NO: 8093971 - DNA, 22 bp, Homo sapiens
gactttattatagtggcaatag

SEQ ID NO: 8093972 - DNA, 22 bp, Homo sapiens
gactttattttaacggagattc

SEQ ID NO: 8093973 - DNA, 22 bp, Homo sapiens
gactttatttccttatttgtga

SEQ ID NO: 8093974 - DNA, 22 bp, Homo sapiens
gactgctttggtttgtaaatgt

SEQ ID NO: 8093975 - DNA, 22 bp, Homo sapiens
gactgtggggaagcagatgcca

SEQ ID NO: 8093976 - DNA, 22 bp, Homo sapiens
gactgtggggaagcagatgcca

SEQ ID NO: 8093977 - DNA, 22 bp, Homo sapiens
gactgtggggggcggacacaag

SEQ ID NO: 8093978 - DNA, 22 bp, Homo sapiens
gactgtggtctgttctccaggt

SEQ ID NO: 8093979 - DNA, 22 bp, Homo sapiens
gactgtgggctccttgagggca

SEQ ID NO: 8093980 - DNA, 22 bp, Homo sapiens
gactgtgggctctgtttgtctt

SEQ ID NO: 8093981 - DNA, 22 bp, Homo sapiens
gactgtgggctctgtttgtctt

SEQ ID NO: 8093982 - DNA, 22 bp, Homo sapiens
gactgtgggctccttgagggca

SEQ ID NO: 8093983 - DNA, 22 bp, Homo sapiens
gactgtgggaagactgtaggtt

SEQ ID NO: 8093984 - DNA, 22 bp, Homo sapiens
gactgtggcgtagatgctggga

SEQ ID NO: 8093985 - DNA, 22 bp, Homo sapiens
gactgtggcgtagatgctggga

SEQ ID NO: 8093986 - DNA, 22 bp, Homo sapiens
gactgtggctaatggtgttagg

SEQ ID NO: 8093987 - DNA, 22 bp, Homo sapiens
gactgtggctaatggtgttagg

SEQ ID NO: 8093988 - DNA, 22 bp, Homo sapiens
gactgtggctgcgtgtaaggaa

SEQ ID NO: 8093989 - DNA, 22 bp, Homo sapiens
gactgtggcagaaatgttgttg

SEQ ID NO: 8093990 - DNA, 22 bp, Homo sapiens
gactgtggcagaaatgttgttg

SEQ ID NO: 8093991 - DNA, 22 bp, Homo sapiens
gactgtggatagaacactgcag

SEQ ID NO: 8093992 - DNA, 22 bp, Homo sapiens
gactgtggcaggctcagcactg

SEQ ID NO: 8093993 - DNA, 22 bp, Homo sapiens
gactgtggccttggaccatggg

SEQ ID NO: 8093994 - DNA, 22 bp, Homo sapiens
gactgtggactctcatgataga

SEQ ID NO: 8093995 - DNA, 22 bp, Homo sapiens
gacaggcaggccagggctgtgg

SEQ ID NO: 8093996 - DNA, 22 bp, Homo sapiens
gacaggaggcagagctcaggtg

SEQ ID NO: 8093997 - DNA, 22 bp, Homo sapiens
gacccagcttaagtcacatgtt

SEQ ID NO: 8093998 - DNA, 22 bp, Homo sapiens
gacccagcctggtttttatagg

SEQ ID NO: 8093999 - DNA, 22 bp, Homo sapiens
gacccagctaaccaggtgggga

SEQ ID NO: 8094000 - DNA, 18 bp, Homo sapiens
gacccagcagatgggctt

SEQ ID NO: 8094001 - DNA, 22 bp, Homo sapiens
gatgcattacaaaagtgattat

SEQ ID NO: 8094002 - DNA, 22 bp, Homo sapiens
gatgggcagcacagctggccaa

SEQ ID NO: 8094003 - DNA, 22 bp, Homo sapiens
gatgggctgtctgagcgctgtg

SEQ ID NO: 8094004 - DNA, 22 bp, Homo sapiens
gatgggctgtctgagcgctgtg

SEQ ID NO: 8094005 - DNA, 22 bp, Homo sapiens
gatgggaggaacctgggtccct

SEQ ID NO: 8094006 - DNA, 22 bp, Homo sapiens
gatggtctttgtctctgataag

SEQ ID NO: 8094007 - DNA, 22 bp, Homo sapiens
gatgtccatttcaaacctcatt

SEQ ID NO: 8094008 - DNA, 22 bp, Homo sapiens
gatgtagacacttggaggctta

SEQ ID NO: 8094009 - DNA, 22 bp, Homo sapiens
gatttacagatctaagggtcac

SEQ ID NO: 8094010 - DNA, 22 bp, Homo sapiens
gatgttttttaggatctcagca

SEQ ID NO: 8094011 - DNA, 22 bp, Homo sapiens
gatgttaagaaggaattgaagt

SEQ ID NO: 8094012 - DNA, 22 bp, Homo sapiens
gatgttaaatgtaaatagctgc

SEQ ID NO: 8094013 - DNA, 22 bp, Homo sapiens
gatgttaacttgttctgcctct

SEQ ID NO: 8094014 - DNA, 22 bp, Homo sapiens
gatgttaaaggttggtaagtca

SEQ ID NO: 8094015 - DNA, 22 bp, Homo sapiens
gattcacagaacttagtcaagc

SEQ ID NO: 8094016 - DNA, 22 bp, Homo sapiens
gcacccaggcttgggcagcaac

SEQ ID NO: 8094017 - DNA, 22 bp, Homo sapiens
gcacccagggacttggctggcc

SEQ ID NO: 8094018 - DNA, 22 bp, Homo sapiens
gcacccagtttgtctcagggtt

SEQ ID NO: 8094019 - DNA, 22 bp, Homo sapiens
gcacccagggcaggaagtgagg

SEQ ID NO: 8094020 - DNA, 22 bp, Homo sapiens
gcacccagtgggatgcttagca

SEQ ID NO: 8094021 - DNA, 22 bp, Homo sapiens
gcacccaggccggcgactgcag

SEQ ID NO: 8094022 - DNA, 22 bp, Homo sapiens
gcacccaggcactttcctttct

SEQ ID NO: 8094023 - DNA, 22 bp, Homo sapiens
gcacaattatttatgcagtatg

SEQ ID NO: 8094024 - DNA, 22 bp, Homo sapiens
gcacctccaggggccgcccacc

SEQ ID NO: 8094025 - DNA, 22 bp, Homo sapiens
gcacttgtgacagttcctggca

SEQ ID NO: 8094026 - DNA, 22 bp, Homo sapiens
gcacttgttttatgttcctgag

SEQ ID NO: 8094027 - DNA, 22 bp, Homo sapiens
gcaccctgtcaaaatggaccaa

SEQ ID NO: 8094028 - DNA, 22 bp, Homo sapiens
gcagagccaggagcccaggatc

SEQ ID NO: 8094029 - DNA, 22 bp, Homo sapiens
gcagagccaggctggggcaggt

SEQ ID NO: 8094030 - DNA, 22 bp, Homo sapiens
gcagagccaggctggggcaggt

SEQ ID NO: 8094031 - DNA, 22 bp, Homo sapiens
gcagagccccattgctggcggg

SEQ ID NO: 8094032 - DNA, 22 bp, Homo sapiens
gcaattacagtggcatgtattt

SEQ ID NO: 8094033 - DNA, 22 bp, Homo sapiens
gattttcatgataaacttgtga

SEQ ID NO: 8094034 - DNA, 22 bp, Homo sapiens
gattttcattatagctagtttc

SEQ ID NO: 8094035 - DNA, 22 bp, Homo sapiens
gattttcatttgcactctagaa

SEQ ID NO: 8094036 - DNA, 22 bp, Homo sapiens
gattttattagcccaaactttg

SEQ ID NO: 8094037 - DNA, 22 bp, Homo sapiens
gattttatatggcatactgtgg

SEQ ID NO: 8094038 - DNA, 21 bp, Homo sapiens
gattttaaagagactgccaca

SEQ ID NO: 8094039 - DNA, 21 bp, Homo sapiens
gatttgcagaaactagacagg

SEQ ID NO: 8094040 - DNA, 22 bp, Homo sapiens
gatttctttgaattagagaggt

SEQ ID NO: 8094041 - DNA, 22 bp, Homo sapiens
gatttctttgtacccacaatcc

SEQ ID NO: 8094042 - DNA, 22 bp, Homo sapiens
gatttctttatgaagtacagaa

SEQ ID NO: 8094043 - DNA, 22 bp, Homo sapiens
gatttctttagctcatcagatc

SEQ ID NO: 8094044 - DNA, 22 bp, Homo sapiens
gatttcttggcccactctcaga

SEQ ID NO: 8094045 - DNA, 22 bp, Homo sapiens
gatttcttcaggagcagaggag

SEQ ID NO: 8094046 - DNA, 22 bp, Homo sapiens
gatttcttctctcccaagagga

SEQ ID NO: 8094047 - DNA, 22 bp, Homo sapiens
gcagtgggcaacaagagctgga

SEQ ID NO: 8094048 - DNA, 22 bp, Homo sapiens
gcaggtggttaaggtcccatgt

SEQ ID NO: 8094049 - DNA, 22 bp, Homo sapiens
gcaggtgggggtcggtgcatct

SEQ ID NO: 8094050 - DNA, 19 bp, Homo sapiens
gcaggtggatgtggtcagc

SEQ ID NO: 8094051 - DNA, 22 bp, Homo sapiens
gcagggtggatggcagggccag

SEQ ID NO: 8094052 - DNA, 22 bp, Homo sapiens
gcatgtgttggtttatgcatgt

SEQ ID NO: 8094053 - DNA, 22 bp, Homo sapiens
gcatgtgttattttatgtatga

SEQ ID NO: 8094054 - DNA, 22 bp, Homo sapiens
gccacagcccgagcaccatgag

SEQ ID NO: 8094055 - DNA, 22 bp, Homo sapiens
gcatgggaggacagtctgggct

SEQ ID NO: 8094056 - DNA, 22 bp, Homo sapiens
gcatgggcaagaggactggggg

SEQ ID NO: 8094057 - DNA, 22 bp, Homo sapiens
gcatgggctttctcagagttct

SEQ ID NO: 8094058 - DNA, 22 bp, Homo sapiens
gcatgtggtgctgaggctgtcg

SEQ ID NO: 8094059 - DNA, 22 bp, Homo sapiens
gcatgtgtggaggagatgtgct

SEQ ID NO: 8094060 - DNA, 22 bp, Homo sapiens
gccacaggctccagcatcagta

SEQ ID NO: 8094061 - DNA, 20 bp, Homo sapiens
gccagaggccggcaggggct

SEQ ID NO: 8094062 - DNA, 22 bp, Homo sapiens
gccagcagcccagaaggacttt

SEQ ID NO: 8094063 - DNA, 22 bp, Homo sapiens
gccagcaccagctactagtcac

SEQ ID NO: 8094064 - DNA, 22 bp, Homo sapiens
gccagcagccacagaagtcact

SEQ ID NO: 8094065 - DNA, 22 bp, Homo sapiens
gcaggagccagggattccagga

SEQ ID NO: 8094066 - DNA, 22 bp, Homo sapiens
gcaggagccaggccgagctggt

SEQ ID NO: 8094067 - DNA, 22 bp, Homo sapiens
gcaggagctgctctcctgacga

SEQ ID NO: 8094068 - DNA, 22 bp, Homo sapiens
gcaggagctcgtttccaggctg

SEQ ID NO: 8094069 - DNA, 22 bp, Homo sapiens
gcaggcaccgcggcggcaggtt

SEQ ID NO: 8094070 - DNA, 22 bp, Homo sapiens
gcaggagactggctgtggtagt

SEQ ID NO: 8094071 - DNA, 22 bp, Homo sapiens
gcaggagaacaaagcaagctgc

SEQ ID NO: 8094072 - DNA, 22 bp, Homo sapiens
gcaggaccaggcacgagggcca

SEQ ID NO: 8094073 - DNA, 22 bp, Homo sapiens
gcaggacctctggatgcaatgc

SEQ ID NO: 8094074 - DNA, 22 bp, Homo sapiens
gcagagccctgggggtatggtg

SEQ ID NO: 8094075 - DNA, 22 bp, Homo sapiens
gcagggcagccacaggccccct

SEQ ID NO: 8094076 - DNA, 22 bp, Homo sapiens
gcagggtgacgttgcccacctc

SEQ ID NO: 8094077 - DNA, 22 bp, Homo sapiens
gcagggggtcattcacgctggc

SEQ ID NO: 8094078 - DNA, 22 bp, Homo sapiens
gcagggcaaatgtggaaaggag

SEQ ID NO: 8094079 - DNA, 20 bp, Homo sapiens
gcagggcaagggatatgaaa

SEQ ID NO: 8094080 - DNA, 22 bp, Homo sapiens
gcagggcacacaagaatgataa

SEQ ID NO: 8094081 - DNA, 22 bp, Homo sapiens
gcagggcacaaggacgcacagg

SEQ ID NO: 8094082 - DNA, 22 bp, Homo sapiens
gcagggcaatgatcccgagagg

SEQ ID NO: 8094083 - DNA, 22 bp, Homo sapiens
gcagggcagagggagaatctct

SEQ ID NO: 8094084 - DNA, 22 bp, Homo sapiens
gcagggcagacctccagcctat

SEQ ID NO: 8094085 - DNA, 22 bp, Homo sapiens
gcagggcagaaggtgctgagga

SEQ ID NO: 8094086 - DNA, 22 bp, Homo sapiens
gcagggcacagacagtgccaag

SEQ ID NO: 8094087 - DNA, 22 bp, Homo sapiens
gcaggctgccctcttgtgttga

SEQ ID NO: 8094088 - DNA, 22 bp, Homo sapiens
gcaggcagaggtggaggagaca

SEQ ID NO: 8094089 - DNA, 17 bp, Homo sapiens
gcaggcactgctgcctg

SEQ ID NO: 8094090 - DNA, 21 bp, Homo sapiens
gcaggcactctagaggagctg

SEQ ID NO: 8094091 - DNA, 22 bp, Homo sapiens
gctcctctgtcaaatgagagtg

SEQ ID NO: 8094092 - DNA, 22 bp, Homo sapiens
gctcctcttatttcatcagggc

SEQ ID NO: 8094093 - DNA, 22 bp, Homo sapiens
gctccaagatcattttcccatt

SEQ ID NO: 8094094 - DNA, 22 bp, Homo sapiens
gctccagatgaatgcacttgtt

SEQ ID NO: 8094095 - DNA, 22 bp, Homo sapiens
gctccaggagagggaagcagat

SEQ ID NO: 8094096 - DNA, 22 bp, Homo sapiens
gctcagagataaaactgatcag

SEQ ID NO: 8094097 - DNA, 22 bp, Homo sapiens
gctcagagatgtctgctgcctt

SEQ ID NO: 8094098 - DNA, 22 bp, Homo sapiens
gctcagaaatggcagatggaga

SEQ ID NO: 8094099 - DNA, 22 bp, Homo sapiens
gctcagagcactcagactcagc

SEQ ID NO: 8094100 - DNA, 22 bp, Homo sapiens
gctcagagcccgaggcttgcat

SEQ ID NO: 8094101 - DNA, 22 bp, Homo sapiens
gctctctttttccagtggtggt

SEQ ID NO: 8094102 - DNA, 22 bp, Homo sapiens
gctctgagtgatcagctgggaa

SEQ ID NO: 8094103 - DNA, 22 bp, Homo sapiens
gctctgaggagccaagaatgtg

SEQ ID NO: 8094104 - DNA, 22 bp, Homo sapiens
gctcttccatttctcttgaact

SEQ ID NO: 8094105 - DNA, 22 bp, Homo sapiens
gctggagctgcagcctgggcct

SEQ ID NO: 8094106 - DNA, 22 bp, Homo sapiens
gctggagccattggcttggcct

SEQ ID NO: 8094107 - DNA, 22 bp, Homo sapiens
gctggagcgggttcgggccgct

SEQ ID NO: 8094108 - DNA, 22 bp, Homo sapiens
gctgggagtgggcaagatgaga

SEQ ID NO: 8094109 - DNA, 22 bp, Homo sapiens
gctgggagtttgatttgactgg

SEQ ID NO: 8094110 - DNA, 22 bp, Homo sapiens
gctgggcaacggaagagagaaa

SEQ ID NO: 8094111 - DNA, 22 bp, Homo sapiens
gctgggcagcctggccgctgcc

SEQ ID NO: 8094112 - DNA, 22 bp, Homo sapiens
gctgggcagcccctacagagag

SEQ ID NO: 8094113 - DNA, 22 bp, Homo sapiens
gctgggcagctgaggcctctca

SEQ ID NO: 8094114 - DNA, 22 bp, Homo sapiens
gctgggcaggcctcgtgagggc

SEQ ID NO: 8094115 - DNA, 22 bp, Homo sapiens
gctgggcaggcctcgtgagggc

SEQ ID NO: 8094116 - DNA, 22 bp, Homo sapiens
gctgggcagtgagtgagtcctt

SEQ ID NO: 8094117 - DNA, 22 bp, Homo sapiens
gctgggcactgtcccataggct

SEQ ID NO: 8094118 - DNA, 22 bp, Homo sapiens
gctgggcaagtgccttgggttt

SEQ ID NO: 8094119 - DNA, 22 bp, Homo sapiens
gctgggcaatgccagagaggag

SEQ ID NO: 8094120 - DNA, 22 bp, Homo sapiens
gctgggcaatgccagagaggag

SEQ ID NO: 8094121 - DNA, 22 bp, Homo sapiens
gctgctctcatagatggcttca

SEQ ID NO: 8094122 - DNA, 22 bp, Homo sapiens
gctgctctcagagctcatgctg

SEQ ID NO: 8094123 - DNA, 22 bp, Homo sapiens
gctgcctggagctcagcctgcc

SEQ ID NO: 8094124 - DNA, 22 bp, Homo sapiens
gctgagcccccctgcgtgggtc

SEQ ID NO: 8094125 - DNA, 22 bp, Homo sapiens
gcctgcctcaaaatcccagttc

SEQ ID NO: 8094126 - DNA, 22 bp, Homo sapiens
gcctgcctgctgtgtgcaagtt

SEQ ID NO: 8094127 - DNA, 22 bp, Homo sapiens
gcctgccttcggtgcgcagcgg

SEQ ID NO: 8094128 - DNA, 22 bp, Homo sapiens
gcctgccttttggaggcacatt

SEQ ID NO: 8094129 - DNA, 22 bp, Homo sapiens
gcctgcctttgtgaggaagcgg

SEQ ID NO: 8094130 - DNA, 22 bp, Homo sapiens
gcctggagggctctagagaggc

SEQ ID NO: 8094131 - DNA, 22 bp, Homo sapiens
gcctggagcctcagcaaggagg

SEQ ID NO: 8094132 - DNA, 22 bp, Homo sapiens
gcctggagtactccttgaagtg

SEQ ID NO: 8094133 - DNA, 22 bp, Homo sapiens
gcctggagggttgaggttttgt

SEQ ID NO: 8094134 - DNA, 22 bp, Homo sapiens
gcccaggaggtcaagtagctat

SEQ ID NO: 8094135 - DNA, 22 bp, Homo sapiens
gcccaggaggtcaagtagctat

SEQ ID NO: 8094136 - DNA, 22 bp, Homo sapiens
gcccaggctggagtgcagtggc

SEQ ID NO: 8094137 - DNA, 22 bp, Homo sapiens
gcccaggatggagaatagtggt

SEQ ID NO: 8094138 - DNA, 22 bp, Homo sapiens
gcccaggatggctggaggtgct

SEQ ID NO: 8094139 - DNA, 20 bp, Homo sapiens
gcccaggatctctgaggcat

SEQ ID NO: 8094140 - DNA, 22 bp, Homo sapiens
gcccaggatctgctcagatcat

SEQ ID NO: 8094141 - DNA, 22 bp, Homo sapiens
gccaggctgtttttattactgt

SEQ ID NO: 8094142 - DNA, 22 bp, Homo sapiens
gccaggctggtgtcacaactct

SEQ ID NO: 8094143 - DNA, 22 bp, Homo sapiens
gccaggctgctccagggaggcc

SEQ ID NO: 8094144 - DNA, 22 bp, Homo sapiens
gccaggctgctggctgctgtcc

SEQ ID NO: 8094145 - DNA, 19 bp, Homo sapiens
gccgggcccgggttggccg

SEQ ID NO: 8094146 - DNA, 22 bp, Homo sapiens
ttgttaaaggcaaaacaagcac

SEQ ID NO: 8094147 - DNA, 22 bp, Homo sapiens
ttgttaaagatgcagattccat

SEQ ID NO: 8094148 - DNA, 21 bp, Homo sapiens
ttgttacaatgcaagagtatg

SEQ ID NO: 8094149 - DNA, 22 bp, Homo sapiens
ttgttacagcagcaatagaaaa

SEQ ID NO: 8094150 - DNA, 22 bp, Homo sapiens
ttgttaaaatgcatattctggt

SEQ ID NO: 8094151 - DNA, 22 bp, Homo sapiens
tttaaaaaactagtctgagtct

SEQ ID NO: 8094152 - DNA, 22 bp, Homo sapiens
tttaaaaaactagtctgagtct

SEQ ID NO: 8094153 - DNA, 22 bp, Homo sapiens
ctccagggcagcatggcagtgg

SEQ ID NO: 8094154 - DNA, 20 bp, Homo sapiens
ctccaggggaagagccttcc

SEQ ID NO: 8094155 - DNA, 22 bp, Homo sapiens
ctccagggggcatccacacagc

SEQ ID NO: 8094156 - DNA, 22 bp, Homo sapiens
ctccaggggccagaagcctggc

SEQ ID NO: 8094157 - DNA, 22 bp, Homo sapiens
ctccagggttccccgatccact

SEQ ID NO: 8094158 - DNA, 22 bp, Homo sapiens
ttgggtagcagcagggctcgat

SEQ ID NO: 8094159 - DNA, 22 bp, Homo sapiens
ttgggtaggattcagcagtgtg

SEQ ID NO: 8094160 - DNA, 22 bp, Homo sapiens
ttgggtctacgtagaaagaaca

SEQ ID NO: 8094161 - DNA, 22 bp, Homo sapiens
ctccaggcgcttaccaagcgct

SEQ ID NO: 8094162 - DNA, 22 bp, Homo sapiens
ctccagggaggagcacgggttc

SEQ ID NO: 8094163 - DNA, 22 bp, Homo sapiens
ctccagggagctgtggaggttt

SEQ ID NO: 8094164 - DNA, 22 bp, Homo sapiens
ctccaggcgccgcttttgcagt

SEQ ID NO: 8094165 - DNA, 22 bp, Homo sapiens
ttgatacatttttaggataaac

SEQ ID NO: 8094166 - DNA, 22 bp, Homo sapiens
ttgatacaggctctatttcatc

SEQ ID NO: 8094167 - DNA, 22 bp, Homo sapiens
ttggatgaggttgagaatcatt

SEQ ID NO: 8094168 - DNA, 22 bp, Homo sapiens
tttacagttaagaaatgttacc

SEQ ID NO: 8094169 - DNA, 22 bp, Homo sapiens
tttacatgtaatgttatacaaa

SEQ ID NO: 8094170 - DNA, 17 bp, Homo sapiens
tttagaatacaatgttt

SEQ ID NO: 8094171 - DNA, 22 bp, Homo sapiens
tttagacatagctgaaatcatt

SEQ ID NO: 8094172 - DNA, 17 bp, Homo sapiens
ctcctctctgggttact

SEQ ID NO: 8094173 - DNA, 22 bp, Homo sapiens
ctcctctggaaattcctctgcc

SEQ ID NO: 8094174 - DNA, 22 bp, Homo sapiens
ctcctctggcttcctggaggca

SEQ ID NO: 8094175 - DNA, 22 bp, Homo sapiens
ctcctctggcttcctggaggca

SEQ ID NO: 8094176 - DNA, 22 bp, Homo sapiens
ctcctcttctgagtaccaggga

SEQ ID NO: 8094177 - DNA, 22 bp, Homo sapiens
ctcctctgtctaccacgagggt

SEQ ID NO: 8094178 - DNA, 22 bp, Homo sapiens
ctcctctgtctggccctgagcc

SEQ ID NO: 8094179 - DNA, 22 bp, Homo sapiens
ctcctctgtattgattgggact

SEQ ID NO: 8094180 - DNA, 22 bp, Homo sapiens
ctcctctgtctaccacgagggt

SEQ ID NO: 8094181 - DNA, 22 bp, Homo sapiens
ctcctctgggtcctggtggcca

SEQ ID NO: 8094182 - DNA, 22 bp, Homo sapiens
ctcctctttagccccagctgga

SEQ ID NO: 8094183 - DNA, 20 bp, Homo sapiens
tttcagttggttaatggcat

SEQ ID NO: 8094184 - DNA, 22 bp, Homo sapiens
tttcagttgtcctgttaatagc

SEQ ID NO: 8094185 - DNA, 22 bp, Homo sapiens
tttcagtgttatgactttcatt

SEQ ID NO: 8094186 - DNA, 22 bp, Homo sapiens
tttcagttactgctatatcatt

SEQ ID NO: 8094187 - DNA, 22 bp, Homo sapiens
tttcagttcagtttattatatc

SEQ ID NO: 8094188 - DNA, 20 bp, Homo sapiens
tttcagttatcttgaccttc

SEQ ID NO: 8094189 - DNA, 22 bp, Homo sapiens
tttcagtgtgtaaattgaaata

SEQ ID NO: 8094190 - DNA, 22 bp, Homo sapiens
tttcagtgtgctcctgagggct

SEQ ID NO: 8094191 - DNA, 22 bp, Homo sapiens
ctctccctggccagctgtgcag

SEQ ID NO: 8094192 - DNA, 22 bp, Homo sapiens
ctctcctacatttcattcacaa

SEQ ID NO: 8094193 - DNA, 20 bp, Homo sapiens
ctctcctcacccgtgtcagg

SEQ ID NO: 8094194 - DNA, 22 bp, Homo sapiens
ctctcctccaacagccctgccg

SEQ ID NO: 8094195 - DNA, 22 bp, Homo sapiens
ctctcctccaggaactcacagt

SEQ ID NO: 8094196 - DNA, 22 bp, Homo sapiens
ctctccctatgcctcccaggag

SEQ ID NO: 8094197 - DNA, 22 bp, Homo sapiens
ctctccctaggttagcggtcag

SEQ ID NO: 8094198 - DNA, 22 bp, Homo sapiens
ctctccactgtcctttgctggt

SEQ ID NO: 8094199 - DNA, 22 bp, Homo sapiens
ctcctgggctgtcggcgctctg

SEQ ID NO: 8094200 - DNA, 22 bp, Homo sapiens
ctcctgggctcatatcattcag

SEQ ID NO: 8094201 - DNA, 22 bp, Homo sapiens
ctcctgggctatgtctgcttgg

SEQ ID NO: 8094202 - DNA, 22 bp, Homo sapiens
ctcctgggatgactctttcttt

SEQ ID NO: 8094203 - DNA, 22 bp, Homo sapiens
ctcctgggagtcttcctggatg

SEQ ID NO: 8094204 - DNA, 22 bp, Homo sapiens
ctcctgggagcagggatggatg

SEQ ID NO: 8094205 - DNA, 22 bp, Homo sapiens
ctaatcatctttctcttaaagc

SEQ ID NO: 8094206 - DNA, 22 bp, Homo sapiens
ctaatacaccctattgcttgtt

SEQ ID NO: 8094207 - DNA, 22 bp, Homo sapiens
ctacaaaagtaattgtggtttt

SEQ ID NO: 8094208 - DNA, 22 bp, Homo sapiens
ttccttccacttcaggattttg

SEQ ID NO: 8094209 - DNA, 22 bp, Homo sapiens
ttccttccatagcaaaacatgc

SEQ ID NO: 8094210 - DNA, 22 bp, Homo sapiens
ttccttccagcttgtgacagtc

SEQ ID NO: 8094211 - DNA, 22 bp, Homo sapiens
ttccttcccctagctgagaaac

SEQ ID NO: 8094212 - DNA, 22 bp, Homo sapiens
ttccttccctcagtggctgaag

SEQ ID NO: 8094213 - DNA, 22 bp, Homo sapiens
ttccttccgggcaccaggcact

SEQ ID NO: 8094214 - DNA, 22 bp, Homo sapiens
ttccttcctcctccagttctgg

SEQ ID NO: 8094215 - DNA, 22 bp, Homo sapiens
ttccttcctctttcacaacagc

SEQ ID NO: 8094216 - DNA, 22 bp, Homo sapiens
ttccttcctggggatttatcat

SEQ ID NO: 8094217 - DNA, 22 bp, Homo sapiens
ttccttcctgtcttccttactg

SEQ ID NO: 8094218 - DNA, 22 bp, Homo sapiens
ttccaggcaaaggaagcagctt

SEQ ID NO: 8094219 - DNA, 22 bp, Homo sapiens
ttccaggcacatcccaactcca

SEQ ID NO: 8094220 - DNA, 21 bp, Homo sapiens
cggctcagtgcctgctccttc

SEQ ID NO: 8094221 - DNA, 22 bp, Homo sapiens
cggctggggctgtccccatgac

SEQ ID NO: 8094222 - DNA, 22 bp, Homo sapiens
cggctgggtagaggtgccgggt

SEQ ID NO: 8094223 - DNA, 22 bp, Homo sapiens
ttcattctgcagttctcagctc

SEQ ID NO: 8094224 - DNA, 22 bp, Homo sapiens
ttcattctgggctctaaggaac

SEQ ID NO: 8094225 - DNA, 19 bp, Homo sapiens
ttcattctcttattgttgt

SEQ ID NO: 8094226 - DNA, 22 bp, Homo sapiens
ttcattcttgtctttgtatagt

SEQ ID NO: 8094227 - DNA, 22 bp, Homo sapiens
ttccaaaatgccttgatatgat

SEQ ID NO: 8094228 - DNA, 22 bp, Homo sapiens
ttcattcttatttgtgatctgg

SEQ ID NO: 8094229 - DNA, 22 bp, Homo sapiens
ttcattcttgggatcagagagt

SEQ ID NO: 8094230 - DNA, 22 bp, Homo sapiens
cgctgggcgccgacctgctggc

SEQ ID NO: 8094231 - DNA, 22 bp, Homo sapiens
ttcacatggcaatagagaggga

SEQ ID NO: 8094232 - DNA, 22 bp, Homo sapiens
cgctgggcgcgctccgaacccg

SEQ ID NO: 8094233 - DNA, 22 bp, Homo sapiens
cggctcaggccacaggacggca

SEQ ID NO: 8094234 - DNA, 22 bp, Homo sapiens
cgctggtgaaggctaggctagc

SEQ ID NO: 8094235 - DNA, 22 bp, Homo sapiens
ttcacatgaaagtaggaaagga

SEQ ID NO: 8094236 - DNA, 20 bp, Homo sapiens
ttgagcttttagtacagaca

SEQ ID NO: 8094237 - DNA, 20 bp, Homo sapiens
ttgagcttttagtacagaca

SEQ ID NO: 8094238 - DNA, 22 bp, Homo sapiens
ctattttctgtctctatagagt

SEQ ID NO: 8094239 - DNA, 22 bp, Homo sapiens
ctattttcattcttacattgtc

SEQ ID NO: 8094240 - DNA, 22 bp, Homo sapiens
ctattttcccatatggttgaca

SEQ ID NO: 8094241 - DNA, 22 bp, Homo sapiens
ctattttccgcagcaggaagta

SEQ ID NO: 8094242 - DNA, 22 bp, Homo sapiens
ctatttcaaggcccagatatga

SEQ ID NO: 8094243 - DNA, 22 bp, Homo sapiens
ctatttctgcctaatgacctgt

SEQ ID NO: 8094244 - DNA, 22 bp, Homo sapiens
ctatttctacacagggtcggcg

SEQ ID NO: 8094245 - DNA, 23 bp, Homo sapiens
ctatttctcatagttcaggtctt

SEQ ID NO: 8094246 - DNA, 22 bp, Homo sapiens
ctatttctaaacctataagtga

SEQ ID NO: 8094247 - DNA, 22 bp, Homo sapiens
ttcttcctcacactctcaccca

SEQ ID NO: 8094248 - DNA, 21 bp, Homo sapiens
ttcttcctaaatacagatctc

SEQ ID NO: 8094249 - DNA, 22 bp, Homo sapiens
ttctgtcacttttttggaatct

SEQ ID NO: 8094250 - DNA, 21 bp, Homo sapiens
ctagcccctactccaagttga

SEQ ID NO: 8094251 - DNA, 22 bp, Homo sapiens
ctagggagcactagctgccttg

SEQ ID NO: 8094252 - DNA, 22 bp, Homo sapiens
ctgattgagaaggaaggggatc

SEQ ID NO: 8094253 - DNA, 22 bp, Homo sapiens
ctgaggagtgggtgggcagtga

SEQ ID NO: 8094254 - DNA, 22 bp, Homo sapiens
ctgaggcactggtaatgggcat

SEQ ID NO: 8094255 - DNA, 22 bp, Homo sapiens
ctgccaggcctccgctgtcccc

SEQ ID NO: 8094256 - DNA, 22 bp, Homo sapiens
ctgccagggcatcctgtggtgg

SEQ ID NO: 8094257 - DNA, 22 bp, Homo sapiens
ctgcagatgtctcaattttatt

SEQ ID NO: 8094258 - DNA, 22 bp, Homo sapiens
ctgcagagcttgtctggatgtg

SEQ ID NO: 8094259 - DNA, 22 bp, Homo sapiens
ctgccatctgagggtccagcct

SEQ ID NO: 8094260 - DNA, 22 bp, Homo sapiens
ctgcctcatgctgcctgcagcc

SEQ ID NO: 8094261 - DNA, 22 bp, Homo sapiens
ctgcctcctcacgtccacagtg

SEQ ID NO: 8094262 - DNA, 22 bp, Homo sapiens
ctgaagagcaaaccaactggac

SEQ ID NO: 8094263 - DNA, 21 bp, Homo sapiens
ttttattgatgaatggccact

SEQ ID NO: 8094264 - DNA, 19 bp, Homo sapiens
ctgaaaaacattctcagga

SEQ ID NO: 8094265 - DNA, 22 bp, Homo sapiens
ctctgggcaagtttcttcatga

SEQ ID NO: 8094266 - DNA, 22 bp, Homo sapiens
ctctgggccatgctactgctct

SEQ ID NO: 8094267 - DNA, 23 bp, Homo sapiens
ttttattgatatgtagctgttgt

SEQ ID NO: 8094268 - DNA, 22 bp, Homo sapiens
ctctcctctgaagtggtgaccc

SEQ ID NO: 8094269 - DNA, 22 bp, Homo sapiens
ctctcctgggctgaccgtccga

SEQ ID NO: 8094270 - DNA, 22 bp, Homo sapiens
ctctggctgtttgcagctcaag

SEQ ID NO: 8094271 - DNA, 22 bp, Homo sapiens
ctgcctgctcaccagggctctg

SEQ ID NO: 8094272 - DNA, 22 bp, Homo sapiens
ctggaaagacagagggcatggg

SEQ ID NO: 8094273 - DNA, 16 bp, Homo sapiens
ctggaaaggctagctc

SEQ ID NO: 8094274 - DNA, 22 bp, Homo sapiens
ctggaaagctgcaggacccaga

SEQ ID NO: 8094275 - DNA, 22 bp, Homo sapiens
ctggaaagatttctttggagtc

SEQ ID NO: 8094276 - DNA, 22 bp, Homo sapiens
ctggaaagtagatgtactaagg

SEQ ID NO: 8094277 - DNA, 22 bp, Homo sapiens
ctggaaagtacagtgtgtcaca

SEQ ID NO: 8094278 - DNA, 22 bp, Homo sapiens
ctggaaagtagacaatctaaaa

SEQ ID NO: 8094279 - DNA, 22 bp, Homo sapiens
ctggacagaagtggctgggcag

SEQ ID NO: 8094280 - DNA, 22 bp, Homo sapiens
ctggacagaaaccagtcctggg

SEQ ID NO: 8094281 - DNA, 22 bp, Homo sapiens
ctggacagaaagggctgctgtg

SEQ ID NO: 8094282 - DNA, 22 bp, Homo sapiens
ctggacaggctggggactgcaa

SEQ ID NO: 8094283 - DNA, 21 bp, Homo sapiens
ctggagggtagagttgggctg

SEQ ID NO: 8094284 - DNA, 22 bp, Homo sapiens
ctggagttagagtagacactga

SEQ ID NO: 8094285 - DNA, 22 bp, Homo sapiens
ctggagctctgtgtgttcctga

SEQ ID NO: 8094286 - DNA, 22 bp, Homo sapiens
ctggaggagaacttgaggaagg

SEQ ID NO: 8094287 - DNA, 22 bp, Homo sapiens
ctggcccagagctctggccttt

SEQ ID NO: 8094288 - DNA, 20 bp, Homo sapiens
ctggcccaggatgatggcgc

SEQ ID NO: 8094289 - DNA, 22 bp, Homo sapiens
ctggcccaggctcctggggcac

SEQ ID NO: 8094290 - DNA, 21 bp, Homo sapiens
ctggcccagggatctgcattt

SEQ ID NO: 8094291 - DNA, 22 bp, Homo sapiens
ctggctccactccctgcctgac

SEQ ID NO: 8094292 - DNA, 22 bp, Homo sapiens
ctggcagcattaacagagagca

SEQ ID NO: 8094293 - DNA, 22 bp, Homo sapiens
ctggcagcatggagcctgtgct

SEQ ID NO: 8094294 - DNA, 19 bp, Homo sapiens
ctggccacacctgctggtt

SEQ ID NO: 8094295 - DNA, 22 bp, Homo sapiens
ctggccaggctctcacgtggtc

SEQ ID NO: 8094296 - DNA, 22 bp, Homo sapiens
ctggcacatgctccctgagtgg

SEQ ID NO: 8094297 - DNA, 22 bp, Homo sapiens
ctggcagcagcttctggatcga

SEQ ID NO: 8094298 - DNA, 22 bp, Homo sapiens
ctggcacatagtaggtgcacag

SEQ ID NO: 8094299 - DNA, 22 bp, Homo sapiens
cctcctagaggaaccccagggc

SEQ ID NO: 8094300 - DNA, 22 bp, Homo sapiens
cctcctctgggaagattcagag

SEQ ID NO: 8094301 - DNA, 22 bp, Homo sapiens
cctccctggccagagcagcagc

SEQ ID NO: 8094302 - DNA, 22 bp, Homo sapiens
tggcccctgaggagcgtcagcc

SEQ ID NO: 8094303 - DNA, 22 bp, Homo sapiens
tggctcagctgtcacagcctgg

SEQ ID NO: 8094304 - DNA, 22 bp, Homo sapiens
tggctcagtttagcagctcagt

SEQ ID NO: 8094305 - DNA, 22 bp, Homo sapiens
tggctcagtttctgcccagctg

SEQ ID NO: 8094306 - DNA, 22 bp, Homo sapiens
tggctcagtttcagtcctggtt

SEQ ID NO: 8094307 - DNA, 22 bp, Homo sapiens
tggctcagtttgggggattgaa

SEQ ID NO: 8094308 - DNA, 22 bp, Homo sapiens
cctctgtgacaaacagtcctgg

SEQ ID NO: 8094309 - DNA, 22 bp, Homo sapiens
cctctgagaggccatctctcct

SEQ ID NO: 8094310 - DNA, 22 bp, Homo sapiens
cctctcctggctgtaggacctc

SEQ ID NO: 8094311 - DNA, 22 bp, Homo sapiens
cctctcctggctgtaggacctc

SEQ ID NO: 8094312 - DNA, 22 bp, Homo sapiens
cctctctgtgtggcctctccat

SEQ ID NO: 8094313 - DNA, 23 bp, Homo sapiens
tggccaggcataaaggtgggtgg

SEQ ID NO: 8094314 - DNA, 23 bp, Homo sapiens
tggccaggcataaaggtgggtgg

SEQ ID NO: 8094315 - DNA, 22 bp, Homo sapiens
tggccaggcaggtagaacggcc

SEQ ID NO: 8094316 - DNA, 22 bp, Homo sapiens
tggccaggcaggtagaacggcc

SEQ ID NO: 8094317 - DNA, 22 bp, Homo sapiens
tggccaggcattcagataagac

SEQ ID NO: 8094318 - DNA, 22 bp, Homo sapiens
tggccaggaggctgcttctgac

SEQ ID NO: 8094319 - DNA, 22 bp, Homo sapiens
tggcacagtcctgggtgcctgc

SEQ ID NO: 8094320 - DNA, 22 bp, Homo sapiens
tggcacagtatgggattaaaga

SEQ ID NO: 8094321 - DNA, 22 bp, Homo sapiens
tggcacagggcttggtcgctca

SEQ ID NO: 8094322 - DNA, 22 bp, Homo sapiens
tggcacaggatctcagcggcca

SEQ ID NO: 8094323 - DNA, 22 bp, Homo sapiens
tggcacaggatctcagcggcca

SEQ ID NO: 8094324 - DNA, 22 bp, Homo sapiens
tggcacaggagcactgccctgg

SEQ ID NO: 8094325 - DNA, 22 bp, Homo sapiens
tggcacaggcggtaagggtgtg

SEQ ID NO: 8094326 - DNA, 22 bp, Homo sapiens
tggcacaggcggtaagggtgtg

SEQ ID NO: 8094327 - DNA, 22 bp, Homo sapiens
tggcacaggaatttagatgcag

SEQ ID NO: 8094328 - DNA, 22 bp, Homo sapiens
tggcacaggaatttagatgcag

SEQ ID NO: 8094329 - DNA, 18 bp, Homo sapiens
tggagctgagggcaatgc

SEQ ID NO: 8094330 - DNA, 22 bp, Homo sapiens
tggcaagctcgtttgggtcaga

SEQ ID NO: 8094331 - DNA, 22 bp, Homo sapiens
tggcaagcagagtctggtgggg

SEQ ID NO: 8094332 - DNA, 22 bp, Homo sapiens
tggcaagctgggttgggtagcc

SEQ ID NO: 8094333 - DNA, 22 bp, Homo sapiens
tggcaagaaactgaggcctgct

SEQ ID NO: 8094334 - DNA, 22 bp, Homo sapiens
tggagctgagaagtggagctct

SEQ ID NO: 8094335 - DNA, 22 bp, Homo sapiens
tggagctgagagccaggctggc

SEQ ID NO: 8094336 - DNA, 22 bp, Homo sapiens
ccctcaggatgcagtggaagtg

SEQ ID NO: 8094337 - DNA, 22 bp, Homo sapiens
cccctccctgacctggttgggc

SEQ ID NO: 8094338 - DNA, 22 bp, Homo sapiens
ccctaggaattctatggccaag

SEQ ID NO: 8094339 - DNA, 22 bp, Homo sapiens
ccccagcccacaagcatattaa

SEQ ID NO: 8094340 - DNA, 22 bp, Homo sapiens
ccccagccttccatgggaattg

SEQ ID NO: 8094341 - DNA, 22 bp, Homo sapiens
ccccacctgtgcgtctgccgca

SEQ ID NO: 8094342 - DNA, 22 bp, Homo sapiens
ccccagccagcaggacctctga

SEQ ID NO: 8094343 - DNA, 22 bp, Homo sapiens
ccccagccagcttgtagtagaa

SEQ ID NO: 8094344 - DNA, 22 bp, Homo sapiens
cccagggaggcccaggctctgc

SEQ ID NO: 8094345 - DNA, 22 bp, Homo sapiens
cccagggagagcgcggaggcgg

SEQ ID NO: 8094346 - DNA, 20 bp, Homo sapiens
cccagggacctgagctccat

SEQ ID NO: 8094347 - DNA, 22 bp, Homo sapiens
cccagggaggtagcaggagaaa

SEQ ID NO: 8094348 - DNA, 22 bp, Homo sapiens
tgctccaggtgtgcctctcatg

SEQ ID NO: 8094349 - DNA, 23 bp, Homo sapiens
tgctccaggtacagaactccagg

SEQ ID NO: 8094350 - DNA, 22 bp, Homo sapiens
tgctccagtgagctggccatcc

SEQ ID NO: 8094351 - DNA, 22 bp, Homo sapiens
cccaggctgagttagaggtgtc

SEQ ID NO: 8094352 - DNA, 22 bp, Homo sapiens
tgcctgggcctctgaggaaggc

SEQ ID NO: 8094353 - DNA, 22 bp, Homo sapiens
tgcctgggagtgaccaagactc

SEQ ID NO: 8094354 - DNA, 22 bp, Homo sapiens
cccaggaggtggaggctgcagt

SEQ ID NO: 8094355 - DNA, 22 bp, Homo sapiens
cccaggaggttgaggctgcagt

SEQ ID NO: 8094356 - DNA, 22 bp, Homo sapiens
cccaggaggtggagttcacagt

SEQ ID NO: 8094357 - DNA, 22 bp, Homo sapiens
cccaggcagagagctggtgagc

SEQ ID NO: 8094358 - DNA, 22 bp, Homo sapiens
cccaggcagggacgtgctctgg

SEQ ID NO: 8094359 - DNA, 22 bp, Homo sapiens
tgcctgctctgtgccacagttg

SEQ ID NO: 8094360 - DNA, 22 bp, Homo sapiens
cccaggcagtgctgatccctca

SEQ ID NO: 8094361 - DNA, 22 bp, Homo sapiens
cccaggcagtgctgatccctca

SEQ ID NO: 8094362 - DNA, 22 bp, Homo sapiens
cccaggcagcggggtctccttg

SEQ ID NO: 8094363 - DNA, 20 bp, Homo sapiens
cccaggcagagctagcggca

SEQ ID NO: 8094364 - DNA, 20 bp, Homo sapiens
cccaggcagagctagcggca

SEQ ID NO: 8094365 - DNA, 22 bp, Homo sapiens
tgcagggaatgcttgcagcatg

SEQ ID NO: 8094366 - DNA, 22 bp, Homo sapiens
cccagcctttgcttcctggttc

SEQ ID NO: 8094367 - DNA, 23 bp, Homo sapiens
cccagctgagacttcctgaactc

SEQ ID NO: 8094368 - DNA, 22 bp, Homo sapiens
cctgggcaatatagtgaggccc

SEQ ID NO: 8094369 - DNA, 21 bp, Homo sapiens
cctgggccaaattccctggac

SEQ ID NO: 8094370 - DNA, 22 bp, Homo sapiens
cctgggccaggcttgggaatgc

SEQ ID NO: 8094371 - DNA, 22 bp, Homo sapiens
cctgggccctcaccgccggtgg

SEQ ID NO: 8094372 - DNA, 22 bp, Homo sapiens
tgtggggctccctggcagcctg

SEQ ID NO: 8094373 - DNA, 22 bp, Homo sapiens
tgtggggcagctagccggcctg

SEQ ID NO: 8094374 - DNA, 22 bp, Homo sapiens
cctgggcctatcctagaaccaa

SEQ ID NO: 8094375 - DNA, 22 bp, Homo sapiens
tgtggggcttacaaaggcagat

SEQ ID NO: 8094376 - DNA, 20 bp, Homo sapiens
tgtggcaggatgagggcgga

SEQ ID NO: 8094377 - DNA, 22 bp, Homo sapiens
tgtggcagctggaggtggagaa

SEQ ID NO: 8094378 - DNA, 22 bp, Homo sapiens
tgtggcaggatgcggaagatgc

SEQ ID NO: 8094379 - DNA, 22 bp, Homo sapiens
cctgggagctgtggaaaggctg

SEQ ID NO: 8094380 - DNA, 22 bp, Homo sapiens
tgtggctgtggatgctttccag

SEQ ID NO: 8094381 - DNA, 19 bp, Homo sapiens
cctgggcctccatcacccc

SEQ ID NO: 8094382 - DNA, 22 bp, Homo sapiens
cctgggcctctcaaagtgctgg

SEQ ID NO: 8094383 - DNA, 22 bp, Homo sapiens
cctgggcctggcgggtcggctc

SEQ ID NO: 8094384 - DNA, 22 bp, Homo sapiens
tgtgtgtcagagtctccatggt

SEQ ID NO: 8094385 - DNA, 22 bp, Homo sapiens
cctgggctttgctggcaaggcc

SEQ ID NO: 8094386 - DNA, 22 bp, Homo sapiens
cctgggccttgacctcgtgggc

SEQ ID NO: 8094387 - DNA, 22 bp, Homo sapiens
cctgggtcctggcagcctcctg

SEQ ID NO: 8094388 - DNA, 22 bp, Homo sapiens
tgtgcccatctcccagcttgac

SEQ ID NO: 8094389 - DNA, 22 bp, Homo sapiens
cctgggagagctgcccgggtga

SEQ ID NO: 8094390 - DNA, 22 bp, Homo sapiens
cctgggagagccatctgtggcc

SEQ ID NO: 8094391 - DNA, 23 bp, Homo sapiens
cctggcttcattctcttagggtg

SEQ ID NO: 8094392 - DNA, 22 bp, Homo sapiens
cctggcttctgggtctgtgaga

SEQ ID NO: 8094393 - DNA, 22 bp, Homo sapiens
tgtgaagatttggcatgcagaa

SEQ ID NO: 8094394 - DNA, 22 bp, Homo sapiens
tgtgaggattaaatgcatagtg

SEQ ID NO: 8094395 - DNA, 22 bp, Homo sapiens
tgtgaggaacaggactagagca

SEQ ID NO: 8094396 - DNA, 22 bp, Homo sapiens
tgtgaggaacaggactagagca

SEQ ID NO: 8094397 - DNA, 21 bp, Homo sapiens
tgtctttaggacctgttaaat

SEQ ID NO: 8094398 - DNA, 22 bp, Homo sapiens
tgtcctcttccagtgctccttc

SEQ ID NO: 8094399 - DNA, 22 bp, Homo sapiens
tgtcctctaattggcctcttgc

SEQ ID NO: 8094400 - DNA, 22 bp, Homo sapiens
tgtccatggggaaggggaagtg

SEQ ID NO: 8094401 - DNA, 22 bp, Homo sapiens
tgtccatggatagagctgctcg

SEQ ID NO: 8094402 - DNA, 22 bp, Homo sapiens
tgtattatcaagtaaatacatg

SEQ ID NO: 8094403 - DNA, 22 bp, Homo sapiens
tggtgctgataatggcaggatt

SEQ ID NO: 8094404 - DNA, 22 bp, Homo sapiens
cctgcccactgcccggtcagcc

SEQ ID NO: 8094405 - DNA, 19 bp, Homo sapiens
tggtcccatactgctggcc

SEQ ID NO: 8094406 - DNA, 22 bp, Homo sapiens
tggtgctgcctcagatgcctta

SEQ ID NO: 8094407 - DNA, 21 bp, Homo sapiens
cctggactgggagcagcactg

SEQ ID NO: 8094408 - DNA, 22 bp, Homo sapiens
cctggactcaggctgtgggcac

SEQ ID NO: 8094409 - DNA, 22 bp, Homo sapiens
gttcttcaaagtgacaactaaa

SEQ ID NO: 8094410 - DNA, 22 bp, Homo sapiens
gttcttcacatttcattgagga

SEQ ID NO: 8094411 - DNA, 22 bp, Homo sapiens
gttcttcaggccatcctcccag

SEQ ID NO: 8094412 - DNA, 22 bp, Homo sapiens
gttcttcagcattagaagtcat

SEQ ID NO: 8094413 - DNA, 22 bp, Homo sapiens
gttcttcagattccatttcagt

SEQ ID NO: 8094414 - DNA, 22 bp, Homo sapiens
gttcttcagaggggaaagaacc

SEQ ID NO: 8094415 - DNA, 22 bp, Homo sapiens
caggaaagggatgggctgccac

SEQ ID NO: 8094416 - DNA, 22 bp, Homo sapiens
caggaagcacagtgaggagacc

SEQ ID NO: 8094417 - DNA, 19 bp, Homo sapiens
caggaacatggagggaggg

SEQ ID NO: 8094418 - DNA, 22 bp, Homo sapiens
caggaagaggtatcaccgagca

SEQ ID NO: 8094419 - DNA, 22 bp, Homo sapiens
caggaagaggacaggcttcccc

SEQ ID NO: 8094420 - DNA, 22 bp, Homo sapiens
caggaacagcaccaggagctag

SEQ ID NO: 8094421 - DNA, 22 bp, Homo sapiens
cagcttctgctatcgaacatct

SEQ ID NO: 8094422 - DNA, 22 bp, Homo sapiens
cagctttacctttaggagtaac

SEQ ID NO: 8094423 - DNA, 22 bp, Homo sapiens
cagctttagagaaaacatattt

SEQ ID NO: 8094424 - DNA, 22 bp, Homo sapiens
cagctttaccaatatttggaaa

SEQ ID NO: 8094425 - DNA, 16 bp, Homo sapiens
cagctttatgtcagtg

SEQ ID NO: 8094426 - DNA, 17 bp, Homo sapiens
cagctttatgctactgt

SEQ ID NO: 8094427 - DNA, 22 bp, Homo sapiens
cagctttattaatgattgtctt

SEQ ID NO: 8094428 - DNA, 22 bp, Homo sapiens
cagctttagtaacccactgctc

SEQ ID NO: 8094429 - DNA, 22 bp, Homo sapiens
cagctttaggactcataataaa

SEQ ID NO: 8094430 - DNA, 20 bp, Homo sapiens
cagctttagatctttgatta

SEQ ID NO: 8094431 - DNA, 22 bp, Homo sapiens
cagctttattgaggtataattg

SEQ ID NO: 8094432 - DNA, 22 bp, Homo sapiens
cagctttatttcacgtgtttgt

SEQ ID NO: 8094433 - DNA, 22 bp, Homo sapiens
caggaaaatggaatcacctgta

SEQ ID NO: 8094434 - DNA, 22 bp, Homo sapiens
gttaaacagttacatgtgctgg

SEQ ID NO: 8094435 - DNA, 22 bp, Homo sapiens
gttacaatgtccttacatgaaa

SEQ ID NO: 8094436 - DNA, 22 bp, Homo sapiens
gtgtttggtcagacgtccgggg

SEQ ID NO: 8094437 - DNA, 22 bp, Homo sapiens
cagcttccacagacttggctcg

SEQ ID NO: 8094438 - DNA, 22 bp, Homo sapiens
cagcttccatctccactgccct

SEQ ID NO: 8094439 - DNA, 22 bp, Homo sapiens
cagcttcccttggctgagcaga

SEQ ID NO: 8094440 - DNA, 22 bp, Homo sapiens
cagctgtggctgccactgctcc

SEQ ID NO: 8094441 - DNA, 22 bp, Homo sapiens
cagctgtgggcctgacgtggca

SEQ ID NO: 8094442 - DNA, 22 bp, Homo sapiens
cagctgtgtagatgcagggtca

SEQ ID NO: 8094443 - DNA, 22 bp, Homo sapiens
cagctgtgtaaacacatgtgta

SEQ ID NO: 8094444 - DNA, 22 bp, Homo sapiens
cagctgtggggagcttgggcca

SEQ ID NO: 8094445 - DNA, 22 bp, Homo sapiens
cagctgtgtaaacacatgtgta

SEQ ID NO: 8094446 - DNA, 22 bp, Homo sapiens
cagctgggagctccattagata

SEQ ID NO: 8094447 - DNA, 22 bp, Homo sapiens
gtgtgctgcccaactcgcagat

SEQ ID NO: 8094448 - DNA, 22 bp, Homo sapiens
cagctgtgagcagccagttgcc

SEQ ID NO: 8094449 - DNA, 22 bp, Homo sapiens
cagctgtgagagtgcattgaag

SEQ ID NO: 8094450 - DNA, 17 bp, Homo sapiens
cagctgtgagagcctta

SEQ ID NO: 8094451 - DNA, 22 bp, Homo sapiens
cagctgtgacagccagttgatg

SEQ ID NO: 8094452 - DNA, 22 bp, Homo sapiens
cagctgggcctcctgagccctg

SEQ ID NO: 8094453 - DNA, 22 bp, Homo sapiens
cagctggggagagacatggcag

SEQ ID NO: 8094454 - DNA, 22 bp, Homo sapiens
cagctggggagagacatggcag

SEQ ID NO: 8094455 - DNA, 22 bp, Homo sapiens
cagctggggcagccacgtgcgg

SEQ ID NO: 8094456 - DNA, 22 bp, Homo sapiens
gtggtaccagtaggtcagccat

SEQ ID NO: 8094457 - DNA, 22 bp, Homo sapiens
cagctgctgttcagttttgttt

SEQ ID NO: 8094458 - DNA, 22 bp, Homo sapiens
cagctggctgcggtgaggggac

SEQ ID NO: 8094459 - DNA, 22 bp, Homo sapiens
cagctggccccacagtagaggc

SEQ ID NO: 8094460 - DNA, 22 bp, Homo sapiens
gtggggcagtggcctgggagca

SEQ ID NO: 8094461 - DNA, 22 bp, Homo sapiens
gtgggcaggtaggcaccagcta

SEQ ID NO: 8094462 - DNA, 22 bp, Homo sapiens
gtgggcaggccccaaagcaggg

SEQ ID NO: 8094463 - DNA, 22 bp, Homo sapiens
gtgggaagaacttcaagtggct

SEQ ID NO: 8094464 - DNA, 22 bp, Homo sapiens
gtgggaagtctctcggaggaag

SEQ ID NO: 8094465 - DNA, 22 bp, Homo sapiens
cagctctttactctgcaatgat

SEQ ID NO: 8094466 - DNA, 22 bp, Homo sapiens
cagctcttcctcccaccggaca

SEQ ID NO: 8094467 - DNA, 22 bp, Homo sapiens
cagctcttcagtgcctgagata

SEQ ID NO: 8094468 - DNA, 22 bp, Homo sapiens
cagctcttagagggagacagac

SEQ ID NO: 8094469 - DNA, 22 bp, Homo sapiens
cagctctgttcatagatggtgc

SEQ ID NO: 8094470 - DNA, 19 bp, Homo sapiens
gtggccagggcaggggctg

SEQ ID NO: 8094471 - DNA, 22 bp, Homo sapiens
gtggcagtcgctgacagataca

SEQ ID NO: 8094472 - DNA, 22 bp, Homo sapiens
gtggccagtggtgggcgccctg

SEQ ID NO: 8094473 - DNA, 22 bp, Homo sapiens
gtggccagtgggaatgggctca

SEQ ID NO: 8094474 - DNA, 22 bp, Homo sapiens
gtggcagaaactggcagaggag

SEQ ID NO: 8094475 - DNA, 22 bp, Homo sapiens
cagcccaggccgacagttcctc

SEQ ID NO: 8094476 - DNA, 22 bp, Homo sapiens
cagcccaggactgcaggtgttt

SEQ ID NO: 8094477 - DNA, 22 bp, Homo sapiens
cagcccaggccgacagttcctc

SEQ ID NO: 8094478 - DNA, 22 bp, Homo sapiens
cagcccaggccgacagttcctc

SEQ ID NO: 8094479 - DNA, 22 bp, Homo sapiens
cagcccagccgagggcctggct

SEQ ID NO: 8094480 - DNA, 22 bp, Homo sapiens
cagcccagccgagggcctggct

SEQ ID NO: 8094481 - DNA, 22 bp, Homo sapiens
cagcccagcgcaaacaactggc

SEQ ID NO: 8094482 - DNA, 22 bp, Homo sapiens
cagcccagccttgtctctttat

SEQ ID NO: 8094483 - DNA, 21 bp, Homo sapiens
cagcccagcttcttccccagt

SEQ ID NO: 8094484 - DNA, 21 bp, Homo sapiens
cagcccagcttcttccccagt

SEQ ID NO: 8094485 - DNA, 22 bp, Homo sapiens
cagcccaggactgcaggtgttt

SEQ ID NO: 8094486 - DNA, 22 bp, Homo sapiens
cagcccagctgggatcacactc

SEQ ID NO: 8094487 - DNA, 22 bp, Homo sapiens
cagcccagctgggatcacactc

SEQ ID NO: 8094488 - DNA, 22 bp, Homo sapiens
cagcccagcgcaaacaactggc

SEQ ID NO: 8094489 - DNA, 22 bp, Homo sapiens
cagcccagctctgactaaccct

SEQ ID NO: 8094490 - DNA, 22 bp, Homo sapiens
gtggcaggttataagcatctca

SEQ ID NO: 8094491 - DNA, 22 bp, Homo sapiens
gtggcagagccaaggctggagc

SEQ ID NO: 8094492 - DNA, 22 bp, Homo sapiens
gtggcaggtcccattggagcag

SEQ ID NO: 8094493 - DNA, 22 bp, Homo sapiens
gtggcagaccttcccttctcct

SEQ ID NO: 8094494 - DNA, 20 bp, Homo sapiens
tacaatacacatgcatatga

SEQ ID NO: 8094495 - DNA, 22 bp, Homo sapiens
tacaagttgcagaaagttgttt

SEQ ID NO: 8094496 - DNA, 22 bp, Homo sapiens
tacaaatgggttaaaatatagt

SEQ ID NO: 8094497 - DNA, 20 bp, Homo sapiens
tacatattatatcagctgca

SEQ ID NO: 8094498 - DNA, 22 bp, Homo sapiens
tacatcataataatacttagaa

SEQ ID NO: 8094499 - DNA, 22 bp, Homo sapiens
tacagtaaccagtctacttaga

SEQ ID NO: 8094500 - DNA, 22 bp, Homo sapiens
caggcagctgggtcaccgtccc

SEQ ID NO: 8094501 - DNA, 22 bp, Homo sapiens
caggcagctgaggactttgcta

SEQ ID NO: 8094502 - DNA, 22 bp, Homo sapiens
caggcagctgactgtcagatat

SEQ ID NO: 8094503 - DNA, 22 bp, Homo sapiens
caggcagctctaatggaaagtg

SEQ ID NO: 8094504 - DNA, 22 bp, Homo sapiens
caggcagcatttactctgatga

SEQ ID NO: 8094505 - DNA, 22 bp, Homo sapiens
caggcagccaggggacctgtcc

SEQ ID NO: 8094506 - DNA, 22 bp, Homo sapiens
caggcagcatcagtctgctgta

SEQ ID NO: 8094507 - DNA, 22 bp, Homo sapiens
caggcagcagccactctggtat

SEQ ID NO: 8094508 - DNA, 22 bp, Homo sapiens
caggcagcaggagccctgctcg

SEQ ID NO: 8094509 - DNA, 22 bp, Homo sapiens
caggcaaggaggcactgaggga

SEQ ID NO: 8094510 - DNA, 22 bp, Homo sapiens
caggcaaggagctggctcaagt

SEQ ID NO: 8094511 - DNA, 22 bp, Homo sapiens
caggcaagattagagatgagca

SEQ ID NO: 8094512 - DNA, 22 bp, Homo sapiens
taagaaacatgatacttttcct

SEQ ID NO: 8094513 - DNA, 22 bp, Homo sapiens
taagaaacatgatacttttcct

SEQ ID NO: 8094514 - DNA, 22 bp, Homo sapiens
caggatccccaggtcgccgtcc

SEQ ID NO: 8094515 - DNA, 22 bp, Homo sapiens
caggatccctggcctccgccca

SEQ ID NO: 8094516 - DNA, 22 bp, Homo sapiens
taacattaggtagacataagcc

SEQ ID NO: 8094517 - DNA, 22 bp, Homo sapiens
taacactttggattaaaattct

SEQ ID NO: 8094518 - DNA, 22 bp, Homo sapiens
taacaacatgcaatttaacctt

SEQ ID NO: 8094519 - DNA, 22 bp, Homo sapiens
taacaacttgcttttatcttag

SEQ ID NO: 8094520 - DNA, 22 bp, Homo sapiens
caggagagatatgagtccccac

SEQ ID NO: 8094521 - DNA, 22 bp, Homo sapiens
caggagagatatgagtccccac

SEQ ID NO: 8094522 - DNA, 22 bp, Homo sapiens
taaatgtctgttaacatgaatg

SEQ ID NO: 8094523 - DNA, 22 bp, Homo sapiens
caggagggtgtggaaaactggg

SEQ ID NO: 8094524 - DNA, 22 bp, Homo sapiens
caggagtgtctccacacagcaa

SEQ ID NO: 8094525 - DNA, 22 bp, Homo sapiens
caggagtgtcgggtcactaggt

SEQ ID NO: 8094526 - DNA, 22 bp, Homo sapiens
caggagttttaaatctagcatg

SEQ ID NO: 8094527 - DNA, 22 bp, Homo sapiens
caggacagtgcaggtccatcct

SEQ ID NO: 8094528 - DNA, 22 bp, Homo sapiens
caggacagttggcatctgctgc

SEQ ID NO: 8094529 - DNA, 22 bp, Homo sapiens
taaacatttgttattcttgttt

SEQ ID NO: 8094530 - DNA, 22 bp, Homo sapiens
caggacccatcagccaggcact

SEQ ID NO: 8094531 - DNA, 22 bp, Homo sapiens
caggacagttggcatctgctgc

SEQ ID NO: 8094532 - DNA, 19 bp, Homo sapiens
caggacagtttgccaagaa

SEQ ID NO: 8094533 - DNA, 22 bp, Homo sapiens
caggacagtttgctttgccctg

SEQ ID NO: 8094534 - DNA, 22 bp, Homo sapiens
caggagacaatggctgtggggc

SEQ ID NO: 8094535 - DNA, 22 bp, Homo sapiens
taaaaagcagctgagattttct

SEQ ID NO: 8094536 - DNA, 22 bp, Homo sapiens
gttttctgattagcaaatctga

SEQ ID NO: 8094537 - DNA, 22 bp, Homo sapiens
taaaatagcatgtgcagtgaaa

SEQ ID NO: 8094538 - DNA, 22 bp, Homo sapiens
taaaatagcatgtgcagtgaaa

SEQ ID NO: 8094539 - DNA, 22 bp, Homo sapiens
caggaattcatagcattgttct

SEQ ID NO: 8094540 - DNA, 22 bp, Homo sapiens
caggacaggtgttctagatcag

SEQ ID NO: 8094541 - DNA, 22 bp, Homo sapiens
caggacagtataggctttagga

SEQ ID NO: 8094542 - DNA, 22 bp, Homo sapiens
caggacagctcaacacctcctc

SEQ ID NO: 8094543 - DNA, 22 bp, Homo sapiens
caggacagctgggccaccacca

SEQ ID NO: 8094544 - DNA, 22 bp, Homo sapiens
caggacaggagtggggtcaaag

SEQ ID NO: 8094545 - DNA, 22 bp, Homo sapiens
caggacaggccctgtggggtct

SEQ ID NO: 8094546 - DNA, 22 bp, Homo sapiens
caggaagctgagctgcactgca

SEQ ID NO: 8094547 - DNA, 22 bp, Homo sapiens
caggaaggaaagggtgtggaga

SEQ ID NO: 8094548 - DNA, 22 bp, Homo sapiens
caggaagggggatccttggaag

SEQ ID NO: 8094549 - DNA, 22 bp, Homo sapiens
ccagcgactgtgacctcagcta

SEQ ID NO: 8094550 - DNA, 22 bp, Homo sapiens
ccagcctggagggcagtggtgg

SEQ ID NO: 8094551 - DNA, 22 bp, Homo sapiens
ccagctcctcttgtctctagca

SEQ ID NO: 8094552 - DNA, 22 bp, Homo sapiens
tctctcttgaagtattagctag

SEQ ID NO: 8094553 - DNA, 22 bp, Homo sapiens
tctctcttctttgttaagaatg

SEQ ID NO: 8094554 - DNA, 22 bp, Homo sapiens
tctctcttcaacccttaactag

SEQ ID NO: 8094555 - DNA, 20 bp, Homo sapiens
tctcttggcttgggggacac

SEQ ID NO: 8094556 - DNA, 22 bp, Homo sapiens
ccagccccgggaacctggccgt

SEQ ID NO: 8094557 - DNA, 22 bp, Homo sapiens
ccagcccatgcccttatagcat

SEQ ID NO: 8094558 - DNA, 19 bp, Homo sapiens
ccagcccatagtccatcac

SEQ ID NO: 8094559 - DNA, 19 bp, Homo sapiens
ccagcccatagtccatcac

SEQ ID NO: 8094560 - DNA, 22 bp, Homo sapiens
ccagcccctatcctcgctccac

SEQ ID NO: 8094561 - DNA, 22 bp, Homo sapiens
ccagccccgggccttaccgtgc

SEQ ID NO: 8094562 - DNA, 21 bp, Homo sapiens
ccagcccagcctccttctctt

SEQ ID NO: 8094563 - DNA, 19 bp, Homo sapiens
ccagcccacagtgactttc

SEQ ID NO: 8094564 - DNA, 21 bp, Homo sapiens
ccagcccagctgtgtcccagc

SEQ ID NO: 8094565 - DNA, 22 bp, Homo sapiens
ccagcccaaacaagccgccttc

SEQ ID NO: 8094566 - DNA, 22 bp, Homo sapiens
ccagcccaaagtcaccccggga

SEQ ID NO: 8094567 - DNA, 22 bp, Homo sapiens
tctgagtcctaaacccccaggg

SEQ ID NO: 8094568 - DNA, 22 bp, Homo sapiens
tctgtcttcatcagcatgtgat

SEQ ID NO: 8094569 - DNA, 22 bp, Homo sapiens
ccaggaggcagaggttgtagtg

SEQ ID NO: 8094570 - DNA, 22 bp, Homo sapiens
ccaggaagctgtctgatatgaa

SEQ ID NO: 8094571 - DNA, 22 bp, Homo sapiens
ccaggaagcctcagatgctgag

SEQ ID NO: 8094572 - DNA, 22 bp, Homo sapiens
ccagctgggtccctgctggggc

SEQ ID NO: 8094573 - DNA, 22 bp, Homo sapiens
ccagctgggtccctgctggggc

SEQ ID NO: 8094574 - DNA, 22 bp, Homo sapiens
ccagctggtaagtgatggagcc

SEQ ID NO: 8094575 - DNA, 22 bp, Homo sapiens
ccagctggtaagtgatggagcc

SEQ ID NO: 8094576 - DNA, 22 bp, Homo sapiens
ccagctgggattaagggaaaat

SEQ ID NO: 8094577 - DNA, 22 bp, Homo sapiens
ccagctggggaagtggggcata

SEQ ID NO: 8094578 - DNA, 22 bp, Homo sapiens
ccagctggtctgtgctcatgtt

SEQ ID NO: 8094579 - DNA, 18 bp, Homo sapiens
ccagctgtgcagcatctg

SEQ ID NO: 8094580 - DNA, 22 bp, Homo sapiens
tctggagctggcagggccctgg

SEQ ID NO: 8094581 - DNA, 22 bp, Homo sapiens
tctggagctggagggcaaggca

SEQ ID NO: 8094582 - DNA, 22 bp, Homo sapiens
ccacagagtcttccttctcttc

SEQ ID NO: 8094583 - DNA, 22 bp, Homo sapiens
ccacagattatttctaaacagg

SEQ ID NO: 8094584 - DNA, 22 bp, Homo sapiens
ccacagagttgatgcaataaga

SEQ ID NO: 8094585 - DNA, 22 bp, Homo sapiens
ccacagcatgcaggcctgacac

SEQ ID NO: 8094586 - DNA, 22 bp, Homo sapiens
ccacagctgaaagcagaggctc

SEQ ID NO: 8094587 - DNA, 22 bp, Homo sapiens
ccacaaggcctgtggggctgct

SEQ ID NO: 8094588 - DNA, 22 bp, Homo sapiens
ccaaataatatttcagaaccat

SEQ ID NO: 8094589 - DNA, 22 bp, Homo sapiens
ccaaatgtgcctgtttcaacaa

SEQ ID NO: 8094590 - DNA, 22 bp, Homo sapiens
tcccagggcagctgtccagaag

SEQ ID NO: 8094591 - DNA, 22 bp, Homo sapiens
tcccagggtcagtggtgaggcc

SEQ ID NO: 8094592 - DNA, 22 bp, Homo sapiens
tcccagggtcagtggtgaggcc

SEQ ID NO: 8094593 - DNA, 17 bp, Homo sapiens
tccaggcagcaactgag

SEQ ID NO: 8094594 - DNA, 20 bp, Homo sapiens
tccaggcagacagctatggg

SEQ ID NO: 8094595 - DNA, 22 bp, Homo sapiens
catttgacagtgagtcacagca

SEQ ID NO: 8094596 - DNA, 22 bp, Homo sapiens
tcctggtgaggctagaagtgtc

SEQ ID NO: 8094597 - DNA, 18 bp, Homo sapiens
tcctggtggagaagtggt

SEQ ID NO: 8094598 - DNA, 22 bp, Homo sapiens
ccacagggtgtcatcagcttga

SEQ ID NO: 8094599 - DNA, 22 bp, Homo sapiens
ccactgaaggtcaacatagagc

SEQ ID NO: 8094600 - DNA, 22 bp, Homo sapiens
ccagaagccctttgtttgttgt

SEQ ID NO: 8094601 - DNA, 22 bp, Homo sapiens
ccagaagctatgttttagataa

SEQ ID NO: 8094602 - DNA, 22 bp, Homo sapiens
ccagaagcacctccttttgtgc

SEQ ID NO: 8094603 - DNA, 22 bp, Homo sapiens
ccactgagtacccgatggctgc

SEQ ID NO: 8094604 - DNA, 22 bp, Homo sapiens
ccactgaggcaggcagtatcta

SEQ ID NO: 8094605 - DNA, 22 bp, Homo sapiens
ccagagctgatgggcccagggt

SEQ ID NO: 8094606 - DNA, 18 bp, Homo sapiens
ccagagctggctcctcgc

SEQ ID NO: 8094607 - DNA, 22 bp, Homo sapiens
tctccagtctcaagacattgag

SEQ ID NO: 8094608 - DNA, 22 bp, Homo sapiens
tcactccatctttgctactggt

SEQ ID NO: 8094609 - DNA, 22 bp, Homo sapiens
tcactcaatggtatcaggaggt

SEQ ID NO: 8094610 - DNA, 22 bp, Homo sapiens
tcactcaagcatctacagggat

SEQ ID NO: 8094611 - DNA, 22 bp, Homo sapiens
tcactcaatatcccagtggggc

SEQ ID NO: 8094612 - DNA, 22 bp, Homo sapiens
tcacccagaaaagacagcagat

SEQ ID NO: 8094613 - DNA, 22 bp, Homo sapiens
tcacccagattacatcctgtca

SEQ ID NO: 8094614 - DNA, 22 bp, Homo sapiens
cagtgctgagagcctggccagg

SEQ ID NO: 8094615 - DNA, 22 bp, Homo sapiens
cagtgctggaggggtgcttgca

SEQ ID NO: 8094616 - DNA, 22 bp, Homo sapiens
cagtgctggtgtaggctgacca

SEQ ID NO: 8094617 - DNA, 22 bp, Homo sapiens
tcaccattggcaattataaaac

SEQ ID NO: 8094618 - DNA, 20 bp, Homo sapiens
cagtcctgtccctgctgccc

SEQ ID NO: 8094619 - DNA, 22 bp, Homo sapiens
cagtctccgccagctcctcaca

SEQ ID NO: 8094620 - DNA, 22 bp, Homo sapiens
cagtctccgccagctcctcaca

SEQ ID NO: 8094621 - DNA, 22 bp, Homo sapiens
cagggtggcactcagcgcatct

SEQ ID NO: 8094622 - DNA, 22 bp, Homo sapiens
cagggtggcacatcacagcatt

SEQ ID NO: 8094623 - DNA, 22 bp, Homo sapiens
cagggtggcacatcacagcatt

SEQ ID NO: 8094624 - DNA, 22 bp, Homo sapiens
caggtctccagctcagggtcca

SEQ ID NO: 8094625 - DNA, 22 bp, Homo sapiens
caggtccagaaaccaaaggatt

SEQ ID NO: 8094626 - DNA, 22 bp, Homo sapiens
cagggtggaacaggcaatactt

SEQ ID NO: 8094627 - DNA, 22 bp, Homo sapiens
caggggccaggctgtctgctgt

SEQ ID NO: 8094628 - DNA, 22 bp, Homo sapiens
tatctctaggctgccacttaaa

SEQ ID NO: 8094629 - DNA, 22 bp, Homo sapiens
tatctctagcgcacagaagaaa

SEQ ID NO: 8094630 - DNA, 22 bp, Homo sapiens
tcagccccacggggtcagccaa

SEQ ID NO: 8094631 - DNA, 19 bp, Homo sapiens
tcagcccatcagactcaca

SEQ ID NO: 8094632 - DNA, 22 bp, Homo sapiens
tcagcccatcactcacgtatta

SEQ ID NO: 8094633 - DNA, 22 bp, Homo sapiens
tcagcccagttaagaacctgtt

SEQ ID NO: 8094634 - DNA, 21 bp, Homo sapiens
tcagcccaggtgtctttgccc

SEQ ID NO: 8094635 - DNA, 22 bp, Homo sapiens
tcagcccaggtcacgtaatcaa

SEQ ID NO: 8094636 - DNA, 22 bp, Homo sapiens
tcagcccagttttatcatctgt

SEQ ID NO: 8094637 - DNA, 20 bp, Homo sapiens
tcagctctgtgcctgggatg

SEQ ID NO: 8094638 - DNA, 19 bp, Homo sapiens
tcagcccaggctgggaagc

SEQ ID NO: 8094639 - DNA, 22 bp, Homo sapiens
tcagcccagggacagaggcccc

SEQ ID NO: 8094640 - DNA, 20 bp, Homo sapiens
tcagcccagggtgagcatct

SEQ ID NO: 8094641 - DNA, 22 bp, Homo sapiens
tcagcccaggaatgagccttct

SEQ ID NO: 8094642 - DNA, 22 bp, Homo sapiens
tcagcccaggaggttgagacta

SEQ ID NO: 8094643 - DNA, 22 bp, Homo sapiens
tcagggcatggctgcacttggc

SEQ ID NO: 8094644 - DNA, 20 bp, Homo sapiens
tcagggcatgggacagcccc

SEQ ID NO: 8094645 - DNA, 22 bp, Homo sapiens
tcagggattgcaaaattcatcc

SEQ ID NO: 8094646 - DNA, 22 bp, Homo sapiens
tcagggcatgtatgtttcttta

SEQ ID NO: 8094647 - DNA, 22 bp, Homo sapiens
tcagggcattcaagaggcctgg

SEQ ID NO: 8094648 - DNA, 21 bp, Homo sapiens
catcacaggatgattttttca

SEQ ID NO: 8094649 - DNA, 22 bp, Homo sapiens
catccagagtccaaggctgggc

SEQ ID NO: 8094650 - DNA, 22 bp, Homo sapiens
catccaggcaccacaaccagct

SEQ ID NO: 8094651 - DNA, 22 bp, Homo sapiens
catccaggcaccacaaccagct

SEQ ID NO: 8094652 - DNA, 23 bp, Homo sapiens
catccaggagctgagtctgactg

SEQ ID NO: 8094653 - DNA, 22 bp, Homo sapiens
catccagggcagccatggcctg

SEQ ID NO: 8094654 - DNA, 22 bp, Homo sapiens
catatattatggactgcagaat

SEQ ID NO: 8094655 - DNA, 22 bp, Homo sapiens
catatattctggttttcactgg

SEQ ID NO: 8094656 - DNA, 22 bp, Homo sapiens
catagaatgtaataaagagtag

SEQ ID NO: 8094657 - DNA, 22 bp, Homo sapiens
catgcaaacacgtaaacattca

SEQ ID NO: 8094658 - DNA, 22 bp, Homo sapiens
catgcaaaggtcaagatcagga

SEQ ID NO: 8094659 - DNA, 20 bp, Homo sapiens
tccagcccagcagcctgaca

SEQ ID NO: 8094660 - DNA, 22 bp, Homo sapiens
tccagcccagctcctctcagaa

SEQ ID NO: 8094661 - DNA, 22 bp, Homo sapiens
tcatttcaatgatactactaag

SEQ ID NO: 8094662 - DNA, 22 bp, Homo sapiens
tcatgggaacaccagtattctc

SEQ ID NO: 8094663 - DNA, 22 bp, Homo sapiens
tcagttctgctagaaaaacagt

SEQ ID NO: 8094664 - DNA, 22 bp, Homo sapiens
tcagttctttatttcacagtga

SEQ ID NO: 8094665 - DNA, 22 bp, Homo sapiens
catccctgctggtggaaggggt

SEQ ID NO: 8094666 - DNA, 22 bp, Homo sapiens
tgtgtcaatttatgtcattcat

SEQ ID NO: 8094667 - DNA, 22 bp, Homo sapiens
tgtgtcaagtggaatttcaggg

SEQ ID NO: 8094668 - DNA, 22 bp, Homo sapiens
tgtgtcaagacatttagtcatt

SEQ ID NO: 8094669 - DNA, 22 bp, Homo sapiens
tgtgtcaattttcattcctact

SEQ ID NO: 8094670 - DNA, 22 bp, Homo sapiens
tgtgggcactaatgacatgcag

SEQ ID NO: 8094671 - DNA, 19 bp, Homo sapiens
tgtgggcaagggatggcag

SEQ ID NO: 8094672 - DNA, 22 bp, Homo sapiens
tgtgggaggattcagaattggg

SEQ ID NO: 8094673 - DNA, 22 bp, Homo sapiens
tgtgggaggtctggaaggctcc

SEQ ID NO: 8094674 - DNA, 20 bp, Homo sapiens
tgtgggcccttggctggcaa

SEQ ID NO: 8094675 - DNA, 22 bp, Homo sapiens
tgtgtacatatacacaaataca

SEQ ID NO: 8094676 - DNA, 21 bp, Homo sapiens
tgtggctgacaccctttggga

SEQ ID NO: 8094677 - DNA, 19 bp, Homo sapiens
tgtggctgagcactcctta

SEQ ID NO: 8094678 - DNA, 22 bp, Homo sapiens
tgtggccttgcagcctggaggt

SEQ ID NO: 8094679 - DNA, 22 bp, Homo sapiens
tgtggcctttcaaggatggaat

SEQ ID NO: 8094680 - DNA, 22 bp, Homo sapiens
tgtgggagaaggaagcaagctg

SEQ ID NO: 8094681 - DNA, 22 bp, Homo sapiens
tgtgggaggaacacagccagaa

SEQ ID NO: 8094682 - DNA, 22 bp, Homo sapiens
tgtgggaggaattagaatggga

SEQ ID NO: 8094683 - DNA, 22 bp, Homo sapiens
tgttacattggagttgtttaga

SEQ ID NO: 8094684 - DNA, 22 bp, Homo sapiens
tgttacatcgttggctaggaga

SEQ ID NO: 8094685 - DNA, 22 bp, Homo sapiens
tgttacatttctctttcttgga

SEQ ID NO: 8094686 - DNA, 18 bp, Homo sapiens
tgttaaatgaagatttgc

SEQ ID NO: 8094687 - DNA, 22 bp, Homo sapiens
tgttaacatactgctttctaat

SEQ ID NO: 8094688 - DNA, 22 bp, Homo sapiens
tgttcttctagattgcctttta

SEQ ID NO: 8094689 - DNA, 22 bp, Homo sapiens
tgtttaaatagaacatactgca

SEQ ID NO: 8094690 - DNA, 22 bp, Homo sapiens
tgtttactcctgatatattttt

SEQ ID NO: 8094691 - DNA, 22 bp, Homo sapiens
ttaaaagaatcctgttatcctc

SEQ ID NO: 8094692 - DNA, 22 bp, Homo sapiens
ttaaaatgcagattctgattca

SEQ ID NO: 8094693 - DNA, 22 bp, Homo sapiens
ttaaaaaccatcttcctttcct

SEQ ID NO: 8094694 - DNA, 20 bp, Homo sapiens
ttaaaaagagtcacaggaga

SEQ ID NO: 8094695 - DNA, 22 bp, Homo sapiens
ttaaacactgggggttaatgca

SEQ ID NO: 8094696 - DNA, 22 bp, Homo sapiens
ttaaacacctgtctagtgtagc

SEQ ID NO: 8094697 - DNA, 22 bp, Homo sapiens
tgttttatgagccatataacct

SEQ ID NO: 8094698 - DNA, 22 bp, Homo sapiens
tgttttaagagcgcactttata

SEQ ID NO: 8094699 - DNA, 22 bp, Homo sapiens
tgttttaaagccattgcctttc

SEQ ID NO: 8094700 - DNA, 22 bp, Homo sapiens
tgtctcctcaactcatgctcga

SEQ ID NO: 8094701 - DNA, 22 bp, Homo sapiens
tgtctcctcggctgtccagcca

SEQ ID NO: 8094702 - DNA, 22 bp, Homo sapiens
tgtctcctctgtcctgtcagga

SEQ ID NO: 8094703 - DNA, 22 bp, Homo sapiens
tgtctcctgggtcccttccacc

SEQ ID NO: 8094704 - DNA, 22 bp, Homo sapiens
tgtcttcagtaaaatacactat

SEQ ID NO: 8094705 - DNA, 22 bp, Homo sapiens
tgtcttcagcaaatgcctttct

SEQ ID NO: 8094706 - DNA, 22 bp, Homo sapiens
tgtgaccactagcacagctgcc

SEQ ID NO: 8094707 - DNA, 22 bp, Homo sapiens
tgtgatatttgagtattgtcaa

SEQ ID NO: 8094708 - DNA, 22 bp, Homo sapiens
tgtgaacattcagatcaagctc

SEQ ID NO: 8094709 - DNA, 22 bp, Homo sapiens
tgtgaatatacttaatgccact

SEQ ID NO: 8094710 - DNA, 22 bp, Homo sapiens
tgtgaaaggagccatagacagt

SEQ ID NO: 8094711 - DNA, 22 bp, Homo sapiens
tgtgaaatattggcaatttcat

SEQ ID NO: 8094712 - DNA, 22 bp, Homo sapiens
ttatatgtttctgtttggaggc

SEQ ID NO: 8094713 - DNA, 22 bp, Homo sapiens
ttatgatttgccacagattggt

SEQ ID NO: 8094714 - DNA, 22 bp, Homo sapiens
ttatgatttagaaagattcact

SEQ ID NO: 8094715 - DNA, 22 bp, Homo sapiens
ttacattttggggtaaggataa

SEQ ID NO: 8094716 - DNA, 22 bp, Homo sapiens
ttagataacagtagaatatcaa

SEQ ID NO: 8094717 - DNA, 22 bp, Homo sapiens
ttagaacatctgtgtctttatg

SEQ ID NO: 8094718 - DNA, 22 bp, Homo sapiens
ttagatgtgtatatacatgtca

SEQ ID NO: 8094719 - DNA, 22 bp, Homo sapiens
ttagatgtgcaggacttttatc

SEQ ID NO: 8094720 - DNA, 22 bp, Homo sapiens
ttagatgtttatatacagattt

SEQ ID NO: 8094721 - DNA, 22 bp, Homo sapiens
ttaggtaagtaggatcaaaaaa

SEQ ID NO: 8094722 - DNA, 22 bp, Homo sapiens
ttacagatcatcaaggtataat

SEQ ID NO: 8094723 - DNA, 19 bp, Homo sapiens
ttacatgacatatgaagga

SEQ ID NO: 8094724 - DNA, 22 bp, Homo sapiens
ttacattttgcacagatgtccc

SEQ ID NO: 8094725 - DNA, 22 bp, Homo sapiens
ttacattttagttaacctgtga

SEQ ID NO: 8094726 - DNA, 22 bp, Homo sapiens
ttacatttggctatgtcctcta

SEQ ID NO: 8094727 - DNA, 22 bp, Homo sapiens
ttacatttcccccttggaggct

SEQ ID NO: 8094728 - DNA, 22 bp, Homo sapiens
ttacatgtactggtttgactta

SEQ ID NO: 8094729 - DNA, 22 bp, Homo sapiens
ttacatgtacaaacaattctta

SEQ ID NO: 8094730 - DNA, 22 bp, Homo sapiens
ttacattagacccactttcatg

SEQ ID NO: 8094731 - DNA, 23 bp, Homo sapiens
ttacatgtgtgcacacattctgg

SEQ ID NO: 8094732 - DNA, 22 bp, Homo sapiens
ttacacaaaaataagatatggc

SEQ ID NO: 8094733 - DNA, 22 bp, Homo sapiens
ttacacaaaaataagatatggc

SEQ ID NO: 8094734 - DNA, 22 bp, Homo sapiens
ttacaactgaagctaatgtgct

SEQ ID NO: 8094735 - DNA, 22 bp, Homo sapiens
ttacaactggtgaattttatgg

SEQ ID NO: 8094736 - DNA, 22 bp, Homo sapiens
ttacaaagttctgagttcaaac

SEQ ID NO: 8094737 - DNA, 23 bp, Homo sapiens
ttccagagtccacatctgccacc

SEQ ID NO: 8094738 - DNA, 17 bp, Homo sapiens
ttccagcatgttactaa

SEQ ID NO: 8094739 - DNA, 22 bp, Homo sapiens
ttcattctttgaatctgaggta

SEQ ID NO: 8094740 - DNA, 19 bp, Homo sapiens
ttcattctttctacttacc

SEQ ID NO: 8094741 - DNA, 19 bp, Homo sapiens
ttcattctttctacttacc

SEQ ID NO: 8094742 - DNA, 22 bp, Homo sapiens
ttcattcttgtctttgtatagt

SEQ ID NO: 8094743 - DNA, 22 bp, Homo sapiens
ttcatgtttgcctatttgactt

SEQ ID NO: 8094744 - DNA, 20 bp, Homo sapiens
ttatttctcattctcctact

SEQ ID NO: 8094745 - DNA, 22 bp, Homo sapiens
ttatttcttgtctatgtagcca

SEQ ID NO: 8094746 - DNA, 22 bp, Homo sapiens
ttatttctactattttgcctga

SEQ ID NO: 8094747 - DNA, 22 bp, Homo sapiens
tgggcatggactgtggagccgc

SEQ ID NO: 8094748 - DNA, 22 bp, Homo sapiens
tgggcagtcatcagcacaccgg

SEQ ID NO: 8094749 - DNA, 22 bp, Homo sapiens
tgggcagtgagaaaggtcaggt

SEQ ID NO: 8094750 - DNA, 22 bp, Homo sapiens
tgggcagtggctgggcctctct

SEQ ID NO: 8094751 - DNA, 22 bp, Homo sapiens
tgggccagcactgggtgctcat

SEQ ID NO: 8094752 - DNA, 22 bp, Homo sapiens
tgggccagctccctgcccctgg

SEQ ID NO: 8094753 - DNA, 22 bp, Homo sapiens
tgggccagctgaagtgccgccc

SEQ ID NO: 8094754 - DNA, 22 bp, Homo sapiens
tgggccaggatttcaagaccct

SEQ ID NO: 8094755 - DNA, 22 bp, Homo sapiens
tgggccacgggggtggagagct

SEQ ID NO: 8094756 - DNA, 22 bp, Homo sapiens
tgggccacgtcatctcccacaa

SEQ ID NO: 8094757 - DNA, 22 bp, Homo sapiens
tgggccacagagtgagaaatgt

SEQ ID NO: 8094758 - DNA, 22 bp, Homo sapiens
tgggccacacacagaagaatca

SEQ ID NO: 8094759 - DNA, 22 bp, Homo sapiens
tgggccacaagccatgggacca

SEQ ID NO: 8094760 - DNA, 22 bp, Homo sapiens
tgggccacattccaaaccagct

SEQ ID NO: 8094761 - DNA, 22 bp, Homo sapiens
tgggccacagttcaccaatccc

SEQ ID NO: 8094762 - DNA, 22 bp, Homo sapiens
tgggccacagctcacacatcca

SEQ ID NO: 8094763 - DNA, 22 bp, Homo sapiens
tgggcagggagctggaaccaca

SEQ ID NO: 8094764 - DNA, 22 bp, Homo sapiens
tgggcagcatcctccacagtca

SEQ ID NO: 8094765 - DNA, 22 bp, Homo sapiens
tgggcagcagcaaagccagact

SEQ ID NO: 8094766 - DNA, 22 bp, Homo sapiens
tgggcagatctttggtggctag

SEQ ID NO: 8094767 - DNA, 21 bp, Homo sapiens
tgggcagatggcagtgtggct

SEQ ID NO: 8094768 - DNA, 22 bp, Homo sapiens
tgggcagattaatgcagtggct

SEQ ID NO: 8094769 - DNA, 22 bp, Homo sapiens
tgggcaagggacaggcctggct

SEQ ID NO: 8094770 - DNA, 22 bp, Homo sapiens
tgggcaagtatcggactctgag

SEQ ID NO: 8094771 - DNA, 22 bp, Homo sapiens
tgggcaaggctggagcctgcag

SEQ ID NO: 8094772 - DNA, 21 bp, Homo sapiens
tgggcaagtttgggggtcctc

SEQ ID NO: 8094773 - DNA, 22 bp, Homo sapiens
tgggcacagaatagatggccca

SEQ ID NO: 8094774 - DNA, 22 bp, Homo sapiens
tgggcacaaacatctgcctgtt

SEQ ID NO: 8094775 - DNA, 22 bp, Homo sapiens
tgggcacagagtcccatctgcc

SEQ ID NO: 8094776 - DNA, 21 bp, Homo sapiens
tgggatgggtctgggaccagc

SEQ ID NO: 8094777 - DNA, 22 bp, Homo sapiens
tgggcaagcaggagggcctcag

SEQ ID NO: 8094778 - DNA, 22 bp, Homo sapiens
tgggcaagctctgggtggacac

SEQ ID NO: 8094779 - DNA, 22 bp, Homo sapiens
tgggcagactgagccctgtccc

SEQ ID NO: 8094780 - DNA, 20 bp, Homo sapiens
tgggcacagctttggagggc

SEQ ID NO: 8094781 - DNA, 22 bp, Homo sapiens
tgggcacaggggaatggatgaa

SEQ ID NO: 8094782 - DNA, 22 bp, Homo sapiens
tgggagtgatacagtatggaat

SEQ ID NO: 8094783 - DNA, 22 bp, Homo sapiens
tgggagtcagacagcctgagat

SEQ ID NO: 8094784 - DNA, 22 bp, Homo sapiens
tgggagtgcacctgggacacga

SEQ ID NO: 8094785 - DNA, 23 bp, Homo sapiens
tgggatggattcaccagtgtgct

SEQ ID NO: 8094786 - DNA, 22 bp, Homo sapiens
tgggaggccgaggcaggtggat

SEQ ID NO: 8094787 - DNA, 22 bp, Homo sapiens
tgggagtccattgtcccaggca

SEQ ID NO: 8094788 - DNA, 22 bp, Homo sapiens
tgggagtcagtcgttctcagag

SEQ ID NO: 8094789 - DNA, 22 bp, Homo sapiens
tgggcgaggcccagggctgcgt

SEQ ID NO: 8094790 - DNA, 22 bp, Homo sapiens
tgggcgggcaggagcgcacctg

SEQ ID NO: 8094791 - DNA, 23 bp, Homo sapiens
tgggcggggcttttcactctgcc

SEQ ID NO: 8094792 - DNA, 21 bp, Homo sapiens
tgggctcagccccagccctgc

SEQ ID NO: 8094793 - DNA, 22 bp, Homo sapiens
tgggctcagccttcatgtggcc

SEQ ID NO: 8094794 - DNA, 23 bp, Homo sapiens
tgggctcagcttccagtggggag

SEQ ID NO: 8094795 - DNA, 22 bp, Homo sapiens
tgggctcagctcccaagggaag

SEQ ID NO: 8094796 - DNA, 22 bp, Homo sapiens
tgggctcaggaccccagaggcc

SEQ ID NO: 8094797 - DNA, 22 bp, Homo sapiens
tgggcctgttgcctgagtccat

SEQ ID NO: 8094798 - DNA, 23 bp, Homo sapiens
tgggcgaggcaggagtggagcac

SEQ ID NO: 8094799 - DNA, 22 bp, Homo sapiens
tgggcctgtgatgctgggctat

SEQ ID NO: 8094800 - DNA, 22 bp, Homo sapiens
tgggcctgtggcttggctctag

SEQ ID NO: 8094801 - DNA, 21 bp, Homo sapiens
tgggcctgtccctcttggagg

SEQ ID NO: 8094802 - DNA, 22 bp, Homo sapiens
tgggcctgtgatgctgggctat

SEQ ID NO: 8094803 - DNA, 17 bp, Homo sapiens
tgggccagtagaaggga

SEQ ID NO: 8094804 - DNA, 22 bp, Homo sapiens
tgggccagtagctactcgcaag

SEQ ID NO: 8094805 - DNA, 22 bp, Homo sapiens
tgggccagtccagccccaggga

SEQ ID NO: 8094806 - DNA, 22 bp, Homo sapiens
tgggccaggtctgtgtcagctg

SEQ ID NO: 8094807 - DNA, 22 bp, Homo sapiens
tgggccaggtctgcggtcattt

SEQ ID NO: 8094808 - DNA, 22 bp, Homo sapiens
tgggccaggcatgtgatcagca

SEQ ID NO: 8094809 - DNA, 22 bp, Homo sapiens
tgggccagggcacccagtccag

SEQ ID NO: 8094810 - DNA, 22 bp, Homo sapiens
tgggccagtcctgcctaaggtg

SEQ ID NO: 8094811 - DNA, 22 bp, Homo sapiens
tgggccagttatttcacctctg

SEQ ID NO: 8094812 - DNA, 23 bp, Homo sapiens
tgggccagttctgttgaaagcca

SEQ ID NO: 8094813 - DNA, 22 bp, Homo sapiens
tgggccagttggtgactacaaa

SEQ ID NO: 8094814 - DNA, 22 bp, Homo sapiens
tgggcctgaaggagctgcgccc

SEQ ID NO: 8094815 - DNA, 20 bp, Homo sapiens
tgggcctgagcctgtgggct

SEQ ID NO: 8094816 - DNA, 20 bp, Homo sapiens
tgggcctgagcctgtgggct

SEQ ID NO: 8094817 - DNA, 19 bp, Homo sapiens
tgggcctgcatctgggtct

SEQ ID NO: 8094818 - DNA, 19 bp, Homo sapiens
tgggcctgcatctgggtct

SEQ ID NO: 8094819 - DNA, 22 bp, Homo sapiens
tgggcctgccccaggcttcagc

SEQ ID NO: 8094820 - DNA, 22 bp, Homo sapiens
tgggcctgattcttgaatcctg

SEQ ID NO: 8094821 - DNA, 22 bp, Homo sapiens
tgggggcatggaccagcctggc

SEQ ID NO: 8094822 - DNA, 22 bp, Homo sapiens
tgggggcagaggattcaggaat

SEQ ID NO: 8094823 - DNA, 22 bp, Homo sapiens
tgggggcagccaggctgtcaag

SEQ ID NO: 8094824 - DNA, 22 bp, Homo sapiens
tgggggcacttcgaggtcgcct

SEQ ID NO: 8094825 - DNA, 22 bp, Homo sapiens
tggggccagcggggaggactca

SEQ ID NO: 8094826 - DNA, 22 bp, Homo sapiens
tggggccagggaggaccagaca

SEQ ID NO: 8094827 - DNA, 22 bp, Homo sapiens
tggggccaggtggctgcaggtc

SEQ ID NO: 8094828 - DNA, 22 bp, Homo sapiens
tggggccagagatggggcgcag

SEQ ID NO: 8094829 - DNA, 22 bp, Homo sapiens
tggggccagagctgcagggagc

SEQ ID NO: 8094830 - DNA, 21 bp, Homo sapiens
tggggaggggacctgattatg

SEQ ID NO: 8094831 - DNA, 22 bp, Homo sapiens
tgggggtgactatctcgggaat

SEQ ID NO: 8094832 - DNA, 22 bp, Homo sapiens
tgggtcctcgtcttccaaggca

SEQ ID NO: 8094833 - DNA, 20 bp, Homo sapiens
tgggtcctgcttcttcctga

SEQ ID NO: 8094834 - DNA, 22 bp, Homo sapiens
tgggtccttcaaagctgggtct

SEQ ID NO: 8094835 - DNA, 22 bp, Homo sapiens
tgggtccttgccatcttggagt

SEQ ID NO: 8094836 - DNA, 22 bp, Homo sapiens
tgggtagaaacaaggctggact

SEQ ID NO: 8094837 - DNA, 22 bp, Homo sapiens
tgggtactcctattagttcagt

SEQ ID NO: 8094838 - DNA, 22 bp, Homo sapiens
tgggtagggacttagctggctg

SEQ ID NO: 8094839 - DNA, 22 bp, Homo sapiens
tggtcaaaccagttatctgtaa

SEQ ID NO: 8094840 - DNA, 22 bp, Homo sapiens
tggtatggctaacgaggtcaag

SEQ ID NO: 8094841 - DNA, 22 bp, Homo sapiens
tgggtgtgagcccgggagccgc

SEQ ID NO: 8094842 - DNA, 22 bp, Homo sapiens
tgtatcaagggtttatgtaagc

SEQ ID NO: 8094843 - DNA, 22 bp, Homo sapiens
tgtatcaaaccaaattaattct

SEQ ID NO: 8094844 - DNA, 22 bp, Homo sapiens
tgtacttgaacttgactgtaga

SEQ ID NO: 8094845 - DNA, 22 bp, Homo sapiens
tgtatttcctggtttagatcaa

SEQ ID NO: 8094846 - DNA, 22 bp, Homo sapiens
tgtatttcgctaggtactccct

SEQ ID NO: 8094847 - DNA, 18 bp, Homo sapiens
tgtatttctaacagctaa

SEQ ID NO: 8094848 - DNA, 22 bp, Homo sapiens
tgtatttctgctttctctagta

SEQ ID NO: 8094849 - DNA, 22 bp, Homo sapiens
tgtatttcaattttagcaccaa

SEQ ID NO: 8094850 - DNA, 20 bp, Homo sapiens
tgtatttcatgcattcctgg

SEQ ID NO: 8094851 - DNA, 22 bp, Homo sapiens
tgtattgaattgtgttatatct

SEQ ID NO: 8094852 - DNA, 22 bp, Homo sapiens
tgtcaattatgtgacacatctt

SEQ ID NO: 8094853 - DNA, 22 bp, Homo sapiens
tgtcaaacaccaacatttctcc

SEQ ID NO: 8094854 - DNA, 22 bp, Homo sapiens
tgtcacatgaagccaacatagc

SEQ ID NO: 8094855 - DNA, 22 bp, Homo sapiens
tgtcctcagatatgtctactct

SEQ ID NO: 8094856 - DNA, 22 bp, Homo sapiens
tgtcctgtgtctaggggtcttc

SEQ ID NO: 8094857 - DNA, 22 bp, Homo sapiens
tgtccccaaggttcagcccaca

SEQ ID NO: 8094858 - DNA, 22 bp, Homo sapiens
tgtcccctgcccagggatggga

SEQ ID NO: 8094859 - DNA, 22 bp, Homo sapiens
tgtccctctgaggcttccctgg

SEQ ID NO: 8094860 - DNA, 22 bp, Homo sapiens
tgtccaccgttcagcaccagag

SEQ ID NO: 8094861 - DNA, 22 bp, Homo sapiens
tggtgggctgagtctcatcgga

SEQ ID NO: 8094862 - DNA, 22 bp, Homo sapiens
tggtggggattccctccctggc

SEQ ID NO: 8094863 - DNA, 22 bp, Homo sapiens
tggtgggggaggctgtctagca

SEQ ID NO: 8094864 - DNA, 22 bp, Homo sapiens
tggtggcacaagggagagaatc

SEQ ID NO: 8094865 - DNA, 22 bp, Homo sapiens
tggtggcaattcaaagacagca

SEQ ID NO: 8094866 - DNA, 22 bp, Homo sapiens
tggtggcaatgtcctggagaag

SEQ ID NO: 8094867 - DNA, 19 bp, Homo sapiens
tggtggcaatgtcagctaa

SEQ ID NO: 8094868 - DNA, 23 bp, Homo sapiens
tggtggcagaagtagcagatgac

SEQ ID NO: 8094869 - DNA, 22 bp, Homo sapiens
tggtggcactgacatcagacac

SEQ ID NO: 8094870 - DNA, 22 bp, Homo sapiens
tggtggcagagcaagagctgga

SEQ ID NO: 8094871 - DNA, 22 bp, Homo sapiens
tggtggcatcaattgacttctc

SEQ ID NO: 8094872 - DNA, 22 bp, Homo sapiens
tggtggcagctgggacagaggt

SEQ ID NO: 8094873 - DNA, 22 bp, Homo sapiens
tggtggcagcaggagggcccct

SEQ ID NO: 8094874 - DNA, 22 bp, Homo sapiens
tggtggcagctgagtgtcaggt

SEQ ID NO: 8094875 - DNA, 22 bp, Homo sapiens
tggtggcagtgagaaggagagg

SEQ ID NO: 8094876 - DNA, 22 bp, Homo sapiens
tggtgcaggtgttgatgcagga

SEQ ID NO: 8094877 - DNA, 22 bp, Homo sapiens
tggtgcagtcattggcccaggg

SEQ ID NO: 8094878 - DNA, 22 bp, Homo sapiens
tggtgcagatagtggtgtagta

SEQ ID NO: 8094879 - DNA, 22 bp, Homo sapiens
tggtgcaggccaagctgcgagc

SEQ ID NO: 8094880 - DNA, 22 bp, Homo sapiens
tggtgcagttcccagggccggg

SEQ ID NO: 8094881 - DNA, 22 bp, Homo sapiens
tggtgcagtccaaagggagcag

SEQ ID NO: 8094882 - DNA, 22 bp, Homo sapiens
tggtggcaaaagaggcaaagtg

SEQ ID NO: 8094883 - DNA, 22 bp, Homo sapiens
tggtggcaaatcaggacacttc

SEQ ID NO: 8094884 - DNA, 22 bp, Homo sapiens
tggtggcaacattgctggagtg

SEQ ID NO: 8094885 - DNA, 21 bp, Homo sapiens
tggtgacccctgtctgttccc

SEQ ID NO: 8094886 - DNA, 22 bp, Homo sapiens
tggtgaccaatgctatggccag

SEQ ID NO: 8094887 - DNA, 22 bp, Homo sapiens
tggtgaggccaaagccatgaca

SEQ ID NO: 8094888 - DNA, 22 bp, Homo sapiens
tggtgaggtcatagagaactgt

SEQ ID NO: 8094889 - DNA, 22 bp, Homo sapiens
tgtacacaattcttaacataca

SEQ ID NO: 8094890 - DNA, 22 bp, Homo sapiens
tgtaattttacgtgacacagtt

SEQ ID NO: 8094891 - DNA, 22 bp, Homo sapiens
tgtaacaatgaatatagtgact

SEQ ID NO: 8094892 - DNA, 23 bp, Homo sapiens
tgtaacaatttcatatacatgca

SEQ ID NO: 8094893 - DNA, 22 bp, Homo sapiens
tgtaacctgactgctttgctct

SEQ ID NO: 8094894 - DNA, 22 bp, Homo sapiens
tgtaaatgaagtatgctttact

SEQ ID NO: 8094895 - DNA, 22 bp, Homo sapiens
tgtaaagatccttagcaacatc

SEQ ID NO: 8094896 - DNA, 22 bp, Homo sapiens
tgtaaaaagcccagccgctgag

SEQ ID NO: 8094897 - DNA, 22 bp, Homo sapiens
tggttggctgagcagagtcact

SEQ ID NO: 8094898 - DNA, 22 bp, Homo sapiens
tggttggggtctgcagccatcc

SEQ ID NO: 8094899 - DNA, 18 bp, Homo sapiens
tggttccttgaaggggca

SEQ ID NO: 8094900 - DNA, 22 bp, Homo sapiens
tggttcctcagggcagctgtac

SEQ ID NO: 8094901 - DNA, 22 bp, Homo sapiens
tggttcctggttcacttggcag

SEQ ID NO: 8094902 - DNA, 22 bp, Homo sapiens
tggtgtgggcgtggcaggcaag

SEQ ID NO: 8094903 - DNA, 22 bp, Homo sapiens
tggtgttgaacctcagcagggg

SEQ ID NO: 8094904 - DNA, 22 bp, Homo sapiens
tggacagcaaacatggagagaa

SEQ ID NO: 8094905 - DNA, 22 bp, Homo sapiens
tggacagcttgcagagccaccc

SEQ ID NO: 8094906 - DNA, 23 bp, Homo sapiens
tggacagcagcagcagtgtcacc

SEQ ID NO: 8094907 - DNA, 22 bp, Homo sapiens
tggacagccatgcaaatgagct

SEQ ID NO: 8094908 - DNA, 22 bp, Homo sapiens
tggacagcgaaagtgcctggga

SEQ ID NO: 8094909 - DNA, 22 bp, Homo sapiens
tggaatggaaacaaactgagga

SEQ ID NO: 8094910 - DNA, 21 bp, Homo sapiens
tggaccaggaaggtggtggtg

SEQ ID NO: 8094911 - DNA, 22 bp, Homo sapiens
tggactgctttgtaatttaaaa

SEQ ID NO: 8094912 - DNA, 17 bp, Homo sapiens
tggaagtgaggacactg

SEQ ID NO: 8094913 - DNA, 22 bp, Homo sapiens
tggaaggggttacgcagcagga

SEQ ID NO: 8094914 - DNA, 22 bp, Homo sapiens
tgctttataaccatttctgtgg

SEQ ID NO: 8094915 - DNA, 22 bp, Homo sapiens
tgcttgattagggaagtcacat

SEQ ID NO: 8094916 - DNA, 22 bp, Homo sapiens
tgctttattcccttctgatgtg

SEQ ID NO: 8094917 - DNA, 22 bp, Homo sapiens
tgctttattcgacatctggtag

SEQ ID NO: 8094918 - DNA, 22 bp, Homo sapiens
tgctttattcagtctctgccat

SEQ ID NO: 8094919 - DNA, 22 bp, Homo sapiens
tgctttattcagggtttacccc

SEQ ID NO: 8094920 - DNA, 22 bp, Homo sapiens
tgctttatgttatcagaagggt

SEQ ID NO: 8094921 - DNA, 22 bp, Homo sapiens
tgctttattaagagagaaattt

SEQ ID NO: 8094922 - DNA, 22 bp, Homo sapiens
tgctttataacttagtttatgg

SEQ ID NO: 8094923 - DNA, 22 bp, Homo sapiens
tgctttataacttagtttatgg

SEQ ID NO: 8094924 - DNA, 22 bp, Homo sapiens
tgctttatagacaaggaagtag

SEQ ID NO: 8094925 - DNA, 22 bp, Homo sapiens
tgctttataggggattgcaggc

SEQ ID NO: 8094926 - DNA, 22 bp, Homo sapiens
tgctttataggggattgcaggc

SEQ ID NO: 8094927 - DNA, 22 bp, Homo sapiens
tgctttatatctctcttcttag

SEQ ID NO: 8094928 - DNA, 22 bp, Homo sapiens
tgctttatcaaagctatagtga

SEQ ID NO: 8094929 - DNA, 22 bp, Homo sapiens
tgctttatctgacttggcgctg

SEQ ID NO: 8094930 - DNA, 22 bp, Homo sapiens
tgctttatctgtgagaacctga

SEQ ID NO: 8094931 - DNA, 18 bp, Homo sapiens
tgctttatgcttatataa

SEQ ID NO: 8094932 - DNA, 22 bp, Homo sapiens
tgctttatggagcccatctcat

SEQ ID NO: 8094933 - DNA, 22 bp, Homo sapiens
tgctttatggagcccatctcat

SEQ ID NO: 8094934 - DNA, 22 bp, Homo sapiens
tgctttatggatttgtgtcctg

SEQ ID NO: 8094935 - DNA, 20 bp, Homo sapiens
tgctttatgctatactttgt

SEQ ID NO: 8094936 - DNA, 20 bp, Homo sapiens
tgctttatgctatactttgt

SEQ ID NO: 8094937 - DNA, 22 bp, Homo sapiens
tgctttatgtggctgatactca

SEQ ID NO: 8094938 - DNA, 21 bp, Homo sapiens
tgctttatgggaaaaatgtca

SEQ ID NO: 8094939 - DNA, 21 bp, Homo sapiens
tggaaaacatttaaatagcaa

SEQ ID NO: 8094940 - DNA, 22 bp, Homo sapiens
tggaaatggatctgatgagtct

SEQ ID NO: 8094941 - DNA, 22 bp, Homo sapiens
tggaaaggaggcttgtggaata

SEQ ID NO: 8094942 - DNA, 22 bp, Homo sapiens
tggaaagtctcttttgactgta

SEQ ID NO: 8094943 - DNA, 22 bp, Homo sapiens
tggaaatgtatttgggcatgcc

SEQ ID NO: 8094944 - DNA, 22 bp, Homo sapiens
tggaagaaaattcaatcgagtt

SEQ ID NO: 8094945 - DNA, 18 bp, Homo sapiens
tggagggcttgctgcagc

SEQ ID NO: 8094946 - DNA, 22 bp, Homo sapiens
tggagggctctttcacctggta

SEQ ID NO: 8094947 - DNA, 22 bp, Homo sapiens
tggagggcgcttagatggaggg

SEQ ID NO: 8094948 - DNA, 22 bp, Homo sapiens
tggagggcatctgtggtcaggc

SEQ ID NO: 8094949 - DNA, 23 bp, Homo sapiens
tggagggcagaataacagactac

SEQ ID NO: 8094950 - DNA, 19 bp, Homo sapiens
tggaggcaagacatggagg

SEQ ID NO: 8094951 - DNA, 20 bp, Homo sapiens
tggaggcagagccagaggga

SEQ ID NO: 8094952 - DNA, 22 bp, Homo sapiens
tggagctgtcactcagaaccaa

SEQ ID NO: 8094953 - DNA, 22 bp, Homo sapiens
tggagctgggagtcctgggctg

SEQ ID NO: 8094954 - DNA, 23 bp, Homo sapiens
tggagctgggctcagaccctggg

SEQ ID NO: 8094955 - DNA, 22 bp, Homo sapiens
tggagctggtaaacagtgacat

SEQ ID NO: 8094956 - DNA, 18 bp, Homo sapiens
tggagccattgccaccat

SEQ ID NO: 8094957 - DNA, 22 bp, Homo sapiens
tggagccataaccctttcgtac

SEQ ID NO: 8094958 - DNA, 22 bp, Homo sapiens
tggagccagtgttgcccaacac

SEQ ID NO: 8094959 - DNA, 22 bp, Homo sapiens
tggagctgaactttgaggccag

SEQ ID NO: 8094960 - DNA, 18 bp, Homo sapiens
tggagctgagtgctgtgc

SEQ ID NO: 8094961 - DNA, 22 bp, Homo sapiens
tggagctgatacagctggcttt

SEQ ID NO: 8094962 - DNA, 22 bp, Homo sapiens
tggagctggaatttctgggcct

SEQ ID NO: 8094963 - DNA, 22 bp, Homo sapiens
tggagcaggaaacatctagagg

SEQ ID NO: 8094964 - DNA, 22 bp, Homo sapiens
tggagcagctctagcgggcgcc

SEQ ID NO: 8094965 - DNA, 22 bp, Homo sapiens
tggagcaggtgccaggtgtgtg

SEQ ID NO: 8094966 - DNA, 22 bp, Homo sapiens
tggagccaatgaacatttgctg

SEQ ID NO: 8094967 - DNA, 22 bp, Homo sapiens
tggagcagtggtcctggagatg

SEQ ID NO: 8094968 - DNA, 22 bp, Homo sapiens
tggagccaggctggccctgcca

SEQ ID NO: 8094969 - DNA, 22 bp, Homo sapiens
tggagccaggagcctgggagtc

SEQ ID NO: 8094970 - DNA, 22 bp, Homo sapiens
tggagccagcgagccgaggcgg

SEQ ID NO: 8094971 - DNA, 22 bp, Homo sapiens
tggagccagcccaggcccctct

SEQ ID NO: 8094972 - DNA, 22 bp, Homo sapiens
tggagccactcactatctgagt

SEQ ID NO: 8094973 - DNA, 22 bp, Homo sapiens
tggagccagagcgcagcctggg

SEQ ID NO: 8094974 - DNA, 22 bp, Homo sapiens
tggagcagagatgggagcccaa

SEQ ID NO: 8094975 - DNA, 22 bp, Homo sapiens
tggagcagagttcagcggggag

SEQ ID NO: 8094976 - DNA, 22 bp, Homo sapiens
tggagcagagatggtggccttc

SEQ ID NO: 8094977 - DNA, 22 bp, Homo sapiens
tggagagcgcgacgggaggaag

SEQ ID NO: 8094978 - DNA, 22 bp, Homo sapiens
tggagaagtcaaagtgaacagg

SEQ ID NO: 8094979 - DNA, 17 bp, Homo sapiens
tgctcctgtggcagcct

SEQ ID NO: 8094980 - DNA, 21 bp, Homo sapiens
tgctccttagctgcccctgcc

SEQ ID NO: 8094981 - DNA, 22 bp, Homo sapiens
tgctccttcctcatcctgtgca

SEQ ID NO: 8094982 - DNA, 22 bp, Homo sapiens
tgctccttcccttcccagtgag

SEQ ID NO: 8094983 - DNA, 22 bp, Homo sapiens
tgctcctttcatccaattctca

SEQ ID NO: 8094984 - DNA, 22 bp, Homo sapiens
tgctccctgctcagagaggcca

SEQ ID NO: 8094985 - DNA, 22 bp, Homo sapiens
tgctcccttgccagaggggaag

SEQ ID NO: 8094986 - DNA, 22 bp, Homo sapiens
tgctcccagggactctggctgg

SEQ ID NO: 8094987 - DNA, 22 bp, Homo sapiens
tgctccagggctgccagaccct

SEQ ID NO: 8094988 - DNA, 20 bp, Homo sapiens
tgctccaggaacactggccg

SEQ ID NO: 8094989 - DNA, 21 bp, Homo sapiens
tgctccagggcagcttccagc

SEQ ID NO: 8094990 - DNA, 22 bp, Homo sapiens
tgctccagggcctccagtgggg

SEQ ID NO: 8094991 - DNA, 18 bp, Homo sapiens
tgctccaggcccatgggc

SEQ ID NO: 8094992 - DNA, 22 bp, Homo sapiens
tgcctgggtgctggctggtcac

SEQ ID NO: 8094993 - DNA, 22 bp, Homo sapiens
tgcctgggtgtaaagggccaac

SEQ ID NO: 8094994 - DNA, 22 bp, Homo sapiens
tgcctggggattgctctgggcc

SEQ ID NO: 8094995 - DNA, 22 bp, Homo sapiens
tgcctggggattgctctgggcc

SEQ ID NO: 8094996 - DNA, 22 bp, Homo sapiens
tgcctgggtccaggccaagcct

SEQ ID NO: 8094997 - DNA, 22 bp, Homo sapiens
tgcctggggttggcaaactgct

SEQ ID NO: 8094998 - DNA, 22 bp, Homo sapiens
tgcctgggggactaaggccaaa

SEQ ID NO: 8094999 - DNA, 22 bp, Homo sapiens
tgccttgcacataatatacatt

SEQ ID NO: 8095000 - DNA, 22 bp, Homo sapiens
tgctcagaaacgaggtgcagcc

SEQ ID NO: 8095001 - DNA, 22 bp, Homo sapiens
tgctcagcagatctcaggagat

SEQ ID NO: 8095002 - DNA, 22 bp, Homo sapiens
tgctcagaattgcgctggtgga

SEQ ID NO: 8095003 - DNA, 22 bp, Homo sapiens
tgctcagagctctggtgcaggt

SEQ ID NO: 8095004 - DNA, 22 bp, Homo sapiens
tgctccagcaccaagagctcca

SEQ ID NO: 8095005 - DNA, 22 bp, Homo sapiens
tgctccagaacctgaccatgct

SEQ ID NO: 8095006 - DNA, 22 bp, Homo sapiens
tgcttccctgaaggcacaggag

SEQ ID NO: 8095007 - DNA, 22 bp, Homo sapiens
tgcttccctcacttcacctggc

SEQ ID NO: 8095008 - DNA, 22 bp, Homo sapiens
tgcttcccaaggtttcatgtgc

SEQ ID NO: 8095009 - DNA, 20 bp, Homo sapiens
tgcttcattatgtgagatag

SEQ ID NO: 8095010 - DNA, 22 bp, Homo sapiens
tgcttagacgtcaagtacagcc

SEQ ID NO: 8095011 - DNA, 22 bp, Homo sapiens
tgcttaaagtgttaaccctgtt

SEQ ID NO: 8095012 - DNA, 21 bp, Homo sapiens
tgctggtgagctcatgtggct

SEQ ID NO: 8095013 - DNA, 22 bp, Homo sapiens
tgctggggtcatggggcgcccg

SEQ ID NO: 8095014 - DNA, 22 bp, Homo sapiens
tgctggggtctctccggtgccc

SEQ ID NO: 8095015 - DNA, 22 bp, Homo sapiens
tgctgggctgttcctgtccatg

SEQ ID NO: 8095016 - DNA, 22 bp, Homo sapiens
tgctgggcttcaactgcctgag

SEQ ID NO: 8095017 - DNA, 22 bp, Homo sapiens
tgctgggcttcacccccacagt

SEQ ID NO: 8095018 - DNA, 21 bp, Homo sapiens
tgctgggctgcaggggatgca

SEQ ID NO: 8095019 - DNA, 22 bp, Homo sapiens
tgctgggctggagctgccaggg

SEQ ID NO: 8095020 - DNA, 22 bp, Homo sapiens
tgctgggctagaagctgaggcc

SEQ ID NO: 8095021 - DNA, 22 bp, Homo sapiens
tgctgggctagaagctgaggcc

SEQ ID NO: 8095022 - DNA, 22 bp, Homo sapiens
tgctgggcggtgggctcatccc

SEQ ID NO: 8095023 - DNA, 22 bp, Homo sapiens
tgctgggcctttacctccaggg

SEQ ID NO: 8095024 - DNA, 22 bp, Homo sapiens
tgctgggctagggtggagctct

SEQ ID NO: 8095025 - DNA, 22 bp, Homo sapiens
tgctgggcactgtctctgggga

SEQ ID NO: 8095026 - DNA, 22 bp, Homo sapiens
tgctgggcatcgtaggaggtac

SEQ ID NO: 8095027 - DNA, 23 bp, Homo sapiens
tgctgggcagagctggtgctgag

SEQ ID NO: 8095028 - DNA, 22 bp, Homo sapiens
tgctgggcagtgtgccctcgag

SEQ ID NO: 8095029 - DNA, 22 bp, Homo sapiens
tgctgggcctgcccctgtcagc

SEQ ID NO: 8095030 - DNA, 22 bp, Homo sapiens
tgctgggcctcttccctggata

SEQ ID NO: 8095031 - DNA, 22 bp, Homo sapiens
tgctgccagggctctgcccaca

SEQ ID NO: 8095032 - DNA, 22 bp, Homo sapiens
tgctggaataatttcatgttaa

SEQ ID NO: 8095033 - DNA, 22 bp, Homo sapiens
tgctggccaacaaggctccaag

SEQ ID NO: 8095034 - DNA, 22 bp, Homo sapiens
tggcagcagggaggccagtgtt

SEQ ID NO: 8095035 - DNA, 22 bp, Homo sapiens
tggcagcagggcccctggagga

SEQ ID NO: 8095036 - DNA, 22 bp, Homo sapiens
tggcagccatcagagcaggggt

SEQ ID NO: 8095037 - DNA, 22 bp, Homo sapiens
tggcagccttctctgagaaggt

SEQ ID NO: 8095038 - DNA, 22 bp, Homo sapiens
tggcaggaagacgtggggcacc

SEQ ID NO: 8095039 - DNA, 22 bp, Homo sapiens
tggcactggcgcaggatggcgg

SEQ ID NO: 8095040 - DNA, 22 bp, Homo sapiens
tggcactggaatcgtagccttg

SEQ ID NO: 8095041 - DNA, 22 bp, Homo sapiens
tggcactgaccccaggcctgtg

SEQ ID NO: 8095042 - DNA, 22 bp, Homo sapiens
tggcactgaagctggaaagcct

SEQ ID NO: 8095043 - DNA, 22 bp, Homo sapiens
tggcactgaaaaaggagaggtt

SEQ ID NO: 8095044 - DNA, 22 bp, Homo sapiens
tggcaccatgttggcaaatgtt

SEQ ID NO: 8095045 - DNA, 23 bp, Homo sapiens
tggcaccaggcattctaggggta

SEQ ID NO: 8095046 - DNA, 22 bp, Homo sapiens
tggcaccatcaaggctgagaac

SEQ ID NO: 8095047 - DNA, 20 bp, Homo sapiens
tggcaccaggtggtggcccc

SEQ ID NO: 8095048 - DNA, 22 bp, Homo sapiens
tggcaccaggcggggtggctgt

SEQ ID NO: 8095049 - DNA, 22 bp, Homo sapiens
tggcacagttaaagttgtagaa

SEQ ID NO: 8095050 - DNA, 22 bp, Homo sapiens
tggcacagaaaaatgctccatt

SEQ ID NO: 8095051 - DNA, 22 bp, Homo sapiens
tggcacagacagatcaggagtc

SEQ ID NO: 8095052 - DNA, 22 bp, Homo sapiens
tggcacagacagatcaggagtc

SEQ ID NO: 8095053 - DNA, 21 bp, Homo sapiens
tggcacagaaaggaaagttca

SEQ ID NO: 8095054 - DNA, 20 bp, Homo sapiens
tggcacagaacccttgccta

SEQ ID NO: 8095055 - DNA, 22 bp, Homo sapiens
tggcacagacagcacagcaatg

SEQ ID NO: 8095056 - DNA, 22 bp, Homo sapiens
tggcacagacagcacagcaatg

SEQ ID NO: 8095057 - DNA, 22 bp, Homo sapiens
tggcacagacatttaatagcct

SEQ ID NO: 8095058 - DNA, 22 bp, Homo sapiens
tggcacagaccttatcttctct

SEQ ID NO: 8095059 - DNA, 22 bp, Homo sapiens
tggcacagcccagagctcttga

SEQ ID NO: 8095060 - DNA, 22 bp, Homo sapiens
tggcacagccatcttctcctgc

SEQ ID NO: 8095061 - DNA, 22 bp, Homo sapiens
tggcacagccactgaatcggga

SEQ ID NO: 8095062 - DNA, 21 bp, Homo sapiens
tggcacagcaagtgggctcat

SEQ ID NO: 8095063 - DNA, 21 bp, Homo sapiens
tggcacagcaagtgggctcat

SEQ ID NO: 8095064 - DNA, 23 bp, Homo sapiens
tggcacagcaggtgtgctttgtt

SEQ ID NO: 8095065 - DNA, 22 bp, Homo sapiens
tggcacagcttgtcataaactc

SEQ ID NO: 8095066 - DNA, 22 bp, Homo sapiens
tggcacagcctttaaagtacca

SEQ ID NO: 8095067 - DNA, 22 bp, Homo sapiens
tggcacagcctccatgtcgtcc

SEQ ID NO: 8095068 - DNA, 22 bp, Homo sapiens
tggcacagcccggattctatga

SEQ ID NO: 8095069 - DNA, 22 bp, Homo sapiens
tggcacagcccattcagagaag

SEQ ID NO: 8095070 - DNA, 17 bp, Homo sapiens
tggcacagaggtgctat

SEQ ID NO: 8095071 - DNA, 22 bp, Homo sapiens
tggcacagagggacccagcagc

SEQ ID NO: 8095072 - DNA, 22 bp, Homo sapiens
tggcacagcaagagtttgggaa

SEQ ID NO: 8095073 - DNA, 19 bp, Homo sapiens
tggcacagatttcctccct

SEQ ID NO: 8095074 - DNA, 16 bp, Homo sapiens
tggcacagagcagata

SEQ ID NO: 8095075 - DNA, 16 bp, Homo sapiens
tggcacagagcagata

SEQ ID NO: 8095076 - DNA, 23 bp, Homo sapiens
tggcacagaggaccatgctttgc

SEQ ID NO: 8095077 - DNA, 22 bp, Homo sapiens
tggcacagactgggccaaggaa

SEQ ID NO: 8095078 - DNA, 22 bp, Homo sapiens
tggcccaggggctcttggtgtt

SEQ ID NO: 8095079 - DNA, 22 bp, Homo sapiens
tggcccagccctgctctagggc

SEQ ID NO: 8095080 - DNA, 18 bp, Homo sapiens
tggcaggtccagctgtgg

SEQ ID NO: 8095081 - DNA, 22 bp, Homo sapiens
tggccacagcctctgccagttc

SEQ ID NO: 8095082 - DNA, 23 bp, Homo sapiens
tggccacagtccatgcatgccca

SEQ ID NO: 8095083 - DNA, 22 bp, Homo sapiens
tggccaggttgggctttgcagc

SEQ ID NO: 8095084 - DNA, 22 bp, Homo sapiens
tggccaggtgtgggttctcaga

SEQ ID NO: 8095085 - DNA, 22 bp, Homo sapiens
tggccaggtgtgggttctcaga

SEQ ID NO: 8095086 - DNA, 19 bp, Homo sapiens
tggccaggtactgtctgct

SEQ ID NO: 8095087 - DNA, 23 bp, Homo sapiens
tggccaggtagaggaggtagtga

SEQ ID NO: 8095088 - DNA, 22 bp, Homo sapiens
tggccaggggagttcccctcca

SEQ ID NO: 8095089 - DNA, 22 bp, Homo sapiens
tggccaggggagttcccctcca

SEQ ID NO: 8095090 - DNA, 23 bp, Homo sapiens
tggccagggtactacacccaccc

SEQ ID NO: 8095091 - DNA, 23 bp, Homo sapiens
tggccagggtactacacccaccc

SEQ ID NO: 8095092 - DNA, 22 bp, Homo sapiens
tggccaggctggtctggaacgc

SEQ ID NO: 8095093 - DNA, 22 bp, Homo sapiens
tggccaggcctcttggtgccca

SEQ ID NO: 8095094 - DNA, 22 bp, Homo sapiens
tggccaggcctcttggtgccca

SEQ ID NO: 8095095 - DNA, 22 bp, Homo sapiens
tggccagcagagttcactctct

SEQ ID NO: 8095096 - DNA, 22 bp, Homo sapiens
tggccaggccggggacagaact

SEQ ID NO: 8095097 - DNA, 17 bp, Homo sapiens
tggccaggccccgccag

SEQ ID NO: 8095098 - DNA, 22 bp, Homo sapiens
tggccaggccggggacagaact

SEQ ID NO: 8095099 - DNA, 22 bp, Homo sapiens
tggccagccttgtcatcgcttt

SEQ ID NO: 8095100 - DNA, 22 bp, Homo sapiens
tggccaggcattcagataagac

SEQ ID NO: 8095101 - DNA, 22 bp, Homo sapiens
tgggaagagttagagacagctg

SEQ ID NO: 8095102 - DNA, 22 bp, Homo sapiens
tgggaagcattaatgatagggg

SEQ ID NO: 8095103 - DNA, 22 bp, Homo sapiens
tgggacagttgtcctccactct

SEQ ID NO: 8095104 - DNA, 22 bp, Homo sapiens
tgggacctctcttgagagagca

SEQ ID NO: 8095105 - DNA, 22 bp, Homo sapiens
tgggacagtgaccccagaggtc

SEQ ID NO: 8095106 - DNA, 22 bp, Homo sapiens
tgggacaggttggagagaagca

SEQ ID NO: 8095107 - DNA, 22 bp, Homo sapiens
tgggagctctgagcctgctatg

SEQ ID NO: 8095108 - DNA, 22 bp, Homo sapiens
tgggagctctgagcctgctatg

SEQ ID NO: 8095109 - DNA, 22 bp, Homo sapiens
tgggagctctgagcctgctgtg

SEQ ID NO: 8095110 - DNA, 22 bp, Homo sapiens
tgggagcaggaagcaggaagta

SEQ ID NO: 8095111 - DNA, 22 bp, Homo sapiens
tgggagctcctggagggcagga

SEQ ID NO: 8095112 - DNA, 22 bp, Homo sapiens
tgggagcaccttgagggcagaa

SEQ ID NO: 8095113 - DNA, 22 bp, Homo sapiens
tgggagacactggtgggagctt

SEQ ID NO: 8095114 - DNA, 19 bp, Homo sapiens
tggctgggtgccaatggcc

SEQ ID NO: 8095115 - DNA, 22 bp, Homo sapiens
tggctgggggtgctatagctgc

SEQ ID NO: 8095116 - DNA, 22 bp, Homo sapiens
tggctgggtgctatccagtact

SEQ ID NO: 8095117 - DNA, 19 bp, Homo sapiens
tggctgggcgtgcctccgt

SEQ ID NO: 8095118 - DNA, 22 bp, Homo sapiens
tggctggggagccccgactccc

SEQ ID NO: 8095119 - DNA, 22 bp, Homo sapiens
tggctgggccgggccttgtgcc

SEQ ID NO: 8095120 - DNA, 22 bp, Homo sapiens
tggctggggccacagttttcct

SEQ ID NO: 8095121 - DNA, 22 bp, Homo sapiens
tggctggggcctgaatcctgca

SEQ ID NO: 8095122 - DNA, 18 bp, Homo sapiens
tggctggcagtgggcagc

SEQ ID NO: 8095123 - DNA, 22 bp, Homo sapiens
tggctgggagctggaactgggc

SEQ ID NO: 8095124 - DNA, 22 bp, Homo sapiens
tggctgggcccccacctgcctc

SEQ ID NO: 8095125 - DNA, 22 bp, Homo sapiens
tggctcccgcttgcacctaaga

SEQ ID NO: 8095126 - DNA, 22 bp, Homo sapiens
tggctcccaaggagctcctgcc

SEQ ID NO: 8095127 - DNA, 22 bp, Homo sapiens
tggctcccacaaactcactact

SEQ ID NO: 8095128 - DNA, 22 bp, Homo sapiens
tggctcagttccatcatctgga

SEQ ID NO: 8095129 - DNA, 22 bp, Homo sapiens
tggctcagttaggtcagaaaca

SEQ ID NO: 8095130 - DNA, 21 bp, Homo sapiens
tggctcagttgctgggcacag

SEQ ID NO: 8095131 - DNA, 22 bp, Homo sapiens
tggctcaggccacttcttttat

SEQ ID NO: 8095132 - DNA, 22 bp, Homo sapiens
tggctcaggcttgaaaatagat

SEQ ID NO: 8095133 - DNA, 22 bp, Homo sapiens
tggctcaggcctacgacgcctt

SEQ ID NO: 8095134 - DNA, 22 bp, Homo sapiens
tggctcaggatctaagcagaat

SEQ ID NO: 8095135 - DNA, 22 bp, Homo sapiens
tggctcaggataattttcccaa

SEQ ID NO: 8095136 - DNA, 22 bp, Homo sapiens
tggctcaggagggatctttgct

SEQ ID NO: 8095137 - DNA, 22 bp, Homo sapiens
tggctcagcattcactggtctt

SEQ ID NO: 8095138 - DNA, 22 bp, Homo sapiens
tggctcagccagccctaggaac

SEQ ID NO: 8095139 - DNA, 22 bp, Homo sapiens
tggctcagcaagacattgacct

SEQ ID NO: 8095140 - DNA, 22 bp, Homo sapiens
tggctcagcaggttagaaacta

SEQ ID NO: 8095141 - DNA, 22 bp, Homo sapiens
tggctcagcttacttttgaggg

SEQ ID NO: 8095142 - DNA, 22 bp, Homo sapiens
tggctcagctttccccatctgg

SEQ ID NO: 8095143 - DNA, 23 bp, Homo sapiens
tggctcagggtctcttatgaagt

SEQ ID NO: 8095144 - DNA, 22 bp, Homo sapiens
tggctcagggtccccaaatggt

SEQ ID NO: 8095145 - DNA, 22 bp, Homo sapiens
tggctcaggggtctggctctgt

SEQ ID NO: 8095146 - DNA, 22 bp, Homo sapiens
tggctcagtaatcgagtctcct

SEQ ID NO: 8095147 - DNA, 22 bp, Homo sapiens
tggctcaggtgtgagctgaaga

SEQ ID NO: 8095148 - DNA, 22 bp, Homo sapiens
tggctcagtagcagtgtggtca

SEQ ID NO: 8095149 - DNA, 22 bp, Homo sapiens
tggctcagtctgggttgactga

SEQ ID NO: 8095150 - DNA, 22 bp, Homo sapiens
tggctcagtcatggatgagtaa

SEQ ID NO: 8095151 - DNA, 22 bp, Homo sapiens
tggctcagtgaagagataactt

SEQ ID NO: 8095152 - DNA, 22 bp, Homo sapiens
tggctcagtggcagccgcagct

SEQ ID NO: 8095153 - DNA, 22 bp, Homo sapiens
tggctcagtgacattcctccca

SEQ ID NO: 8095154 - DNA, 22 bp, Homo sapiens
tggctcagtgcattcacagtaa

SEQ ID NO: 8095155 - DNA, 22 bp, Homo sapiens
tggctcagaactacttctagtt

SEQ ID NO: 8095156 - DNA, 22 bp, Homo sapiens
tggctcagagcagggactctgg

SEQ ID NO: 8095157 - DNA, 22 bp, Homo sapiens
tggctcagagccttgagagctg

SEQ ID NO: 8095158 - DNA, 22 bp, Homo sapiens
tggctcagaagaaaaggtaaac

SEQ ID NO: 8095159 - DNA, 22 bp, Homo sapiens
tggctcagaaggctgccttcac

SEQ ID NO: 8095160 - DNA, 22 bp, Homo sapiens
tggctcagagagggagtgtgga

SEQ ID NO: 8095161 - DNA, 22 bp, Homo sapiens
tggctcagatttttgtaggctt

SEQ ID NO: 8095162 - DNA, 18 bp, Homo sapiens
tggctcagatggctttaa

SEQ ID NO: 8095163 - DNA, 22 bp, Homo sapiens
tggctcagataattcaaggggc

SEQ ID NO: 8095164 - DNA, 22 bp, Homo sapiens
tggctcagatgctcttccagtg

SEQ ID NO: 8095165 - DNA, 22 bp, Homo sapiens
tggctcagagttcatcttttag

SEQ ID NO: 8095166 - DNA, 22 bp, Homo sapiens
tggctcagaggggaagtggttt

SEQ ID NO: 8095167 - DNA, 22 bp, Homo sapiens
tggctgcagttcacaggagcaa

SEQ ID NO: 8095168 - DNA, 22 bp, Homo sapiens
tggctgctgagaaggcagctgt

SEQ ID NO: 8095169 - DNA, 22 bp, Homo sapiens
tggctgctgcagacagacagga

SEQ ID NO: 8095170 - DNA, 22 bp, Homo sapiens
tggctgacaatgtagcagtaac

SEQ ID NO: 8095171 - DNA, 21 bp, Homo sapiens
tggctgactcttcctatcatt

SEQ ID NO: 8095172 - DNA, 21 bp, Homo sapiens
tggctctgctcagagcagtcc

SEQ ID NO: 8095173 - DNA, 22 bp, Homo sapiens
tgaagccacagagcatctgcct

SEQ ID NO: 8095174 - DNA, 22 bp, Homo sapiens
tgaaggggttcagcatgggggt

SEQ ID NO: 8095175 - DNA, 21 bp, Homo sapiens
tgaaggggtggcagtgtgctt

SEQ ID NO: 8095176 - DNA, 22 bp, Homo sapiens
tgaatcatggataaatagctta

SEQ ID NO: 8095177 - DNA, 22 bp, Homo sapiens
tgaatgaactaaatcatagttc

SEQ ID NO: 8095178 - DNA, 22 bp, Homo sapiens
tgactgtgccgtgcccctagga

SEQ ID NO: 8095179 - DNA, 22 bp, Homo sapiens
tgaccttgataaaggctaagtt

SEQ ID NO: 8095180 - DNA, 22 bp, Homo sapiens
tgacctgggcattacaggtgca

SEQ ID NO: 8095181 - DNA, 22 bp, Homo sapiens
tgacatttcagatatggtattt

SEQ ID NO: 8095182 - DNA, 22 bp, Homo sapiens
tgacatttcagatatggtattt

SEQ ID NO: 8095183 - DNA, 18 bp, Homo sapiens
tgacatttccagagtgta

SEQ ID NO: 8095184 - DNA, 21 bp, Homo sapiens
tgacatttagtagcattgtca

SEQ ID NO: 8095185 - DNA, 22 bp, Homo sapiens
tgacatttactattcctggtta

SEQ ID NO: 8095186 - DNA, 22 bp, Homo sapiens
tgacatttcctagtgctttgtg

SEQ ID NO: 8095187 - DNA, 22 bp, Homo sapiens
tgacatttttaaaaccactagt

SEQ ID NO: 8095188 - DNA, 22 bp, Homo sapiens
tgacagcagcatagtgagcaat

SEQ ID NO: 8095189 - DNA, 22 bp, Homo sapiens
tgacagtgaatgacaaggttct

SEQ ID NO: 8095190 - DNA, 22 bp, Homo sapiens
tgacagtgcatgtgacaaagga

SEQ ID NO: 8095191 - DNA, 22 bp, Homo sapiens
tgacagtgacagccaaaggctt

SEQ ID NO: 8095192 - DNA, 22 bp, Homo sapiens
tgacagctgcacaccccttcag

SEQ ID NO: 8095193 - DNA, 22 bp, Homo sapiens
tgacagctgaggcccagagtac

SEQ ID NO: 8095194 - DNA, 22 bp, Homo sapiens
tgacagctgagccccaggcaag

SEQ ID NO: 8095195 - DNA, 22 bp, Homo sapiens
tgaagaaaggtgtgggatactc

SEQ ID NO: 8095196 - DNA, 22 bp, Homo sapiens
tgaagaaaatatgattacccca

SEQ ID NO: 8095197 - DNA, 22 bp, Homo sapiens
tgaagaaacagaccaagaggat

SEQ ID NO: 8095198 - DNA, 22 bp, Homo sapiens
tgaagaaacgcagagaggtagg

SEQ ID NO: 8095199 - DNA, 22 bp, Homo sapiens
tgaacaaatggaaataaccagt

SEQ ID NO: 8095200 - DNA, 22 bp, Homo sapiens
tgaacacacacatcttaataat

SEQ ID NO: 8095201 - DNA, 21 bp, Homo sapiens
tgaacaaagttcttatcgtga

SEQ ID NO: 8095202 - DNA, 22 bp, Homo sapiens
tgaacaaactgcattcttcact

SEQ ID NO: 8095203 - DNA, 22 bp, Homo sapiens
tgaaagcacaagttctaacagg

SEQ ID NO: 8095204 - DNA, 23 bp, Homo sapiens
tgaaatattcttttgcatgagct

SEQ ID NO: 8095205 - DNA, 22 bp, Homo sapiens
tgaaacttgctaattgcacgta

SEQ ID NO: 8095206 - DNA, 17 bp, Homo sapiens
tgaaagaatcagggaga

SEQ ID NO: 8095207 - DNA, 22 bp, Homo sapiens
tgaaacaggcaaaactgcagat

SEQ ID NO: 8095208 - DNA, 22 bp, Homo sapiens
tgaaacaggaagtaaacagaca

SEQ ID NO: 8095209 - DNA, 22 bp, Homo sapiens
tgaaacatttgatgatctttgg

SEQ ID NO: 8095210 - DNA, 22 bp, Homo sapiens
tgaaaaggagtccttgttttca

SEQ ID NO: 8095211 - DNA, 22 bp, Homo sapiens
tgaaaattgttgtacttgataa

SEQ ID NO: 8095212 - DNA, 22 bp, Homo sapiens
tctttggaaaaaatggacaatc

SEQ ID NO: 8095213 - DNA, 20 bp, Homo sapiens
tctttgtgtcagatggacag

SEQ ID NO: 8095214 - DNA, 22 bp, Homo sapiens
tgaggcaggagaatggcgggaa

SEQ ID NO: 8095215 - DNA, 22 bp, Homo sapiens
tgaggccaactagggagatgga

SEQ ID NO: 8095216 - DNA, 22 bp, Homo sapiens
tgaggccaagaaaagctgggtg

SEQ ID NO: 8095217 - DNA, 19 bp, Homo sapiens
tgaggccaaggtcacagat

SEQ ID NO: 8095218 - DNA, 22 bp, Homo sapiens
tgaggccacaggaaagggcccg

SEQ ID NO: 8095219 - DNA, 22 bp, Homo sapiens
tgaggccaatgaccctgggcag

SEQ ID NO: 8095220 - DNA, 22 bp, Homo sapiens
tgaggccacttccccacagccc

SEQ ID NO: 8095221 - DNA, 22 bp, Homo sapiens
tgaggccagactgaaaccaaca

SEQ ID NO: 8095222 - DNA, 18 bp, Homo sapiens
tgaggccagagtgggcat

SEQ ID NO: 8095223 - DNA, 22 bp, Homo sapiens
tgaggccagccacagccaccct

SEQ ID NO: 8095224 - DNA, 22 bp, Homo sapiens
tgaggccaggacccccagcagg

SEQ ID NO: 8095225 - DNA, 22 bp, Homo sapiens
tgaggccagcttcagcagtgga

SEQ ID NO: 8095226 - DNA, 22 bp, Homo sapiens
tgaggaaagaaaggcatgcatg

SEQ ID NO: 8095227 - DNA, 22 bp, Homo sapiens
tgaggagaaatgctcagagcca

SEQ ID NO: 8095228 - DNA, 19 bp, Homo sapiens
tgaggggctcacagtctca

SEQ ID NO: 8095229 - DNA, 22 bp, Homo sapiens
tgaggtgtgtccccagggaggt

SEQ ID NO: 8095230 - DNA, 22 bp, Homo sapiens
tgaggtggctagggaggcactc

SEQ ID NO: 8095231 - DNA, 22 bp, Homo sapiens
tgagggactgcatacccagctt

SEQ ID NO: 8095232 - DNA, 22 bp, Homo sapiens
tgagggaatcctcacatcaatc

SEQ ID NO: 8095233 - DNA, 22 bp, Homo sapiens
tgagggagtgtggatacagtag

SEQ ID NO: 8095234 - DNA, 22 bp, Homo sapiens
tgaggggagaagcagcagcctg

SEQ ID NO: 8095235 - DNA, 22 bp, Homo sapiens
tgaggggaaggcatgataaata

SEQ ID NO: 8095236 - DNA, 22 bp, Homo sapiens
tgaggggagacagagtggactc

SEQ ID NO: 8095237 - DNA, 22 bp, Homo sapiens
tgaggggaggttggggcacatc

SEQ ID NO: 8095238 - DNA, 22 bp, Homo sapiens
tgaggggatacggtacacattg

SEQ ID NO: 8095239 - DNA, 19 bp, Homo sapiens
tgaggggaggagaggcctg

SEQ ID NO: 8095240 - DNA, 22 bp, Homo sapiens
tgaggggagcccgccctggacg

SEQ ID NO: 8095241 - DNA, 22 bp, Homo sapiens
tgaggggagctagcatgccttg

SEQ ID NO: 8095242 - DNA, 22 bp, Homo sapiens
tgaggctcaagaatagacagta

SEQ ID NO: 8095243 - DNA, 22 bp, Homo sapiens
tgaggctccagccaggccagca

SEQ ID NO: 8095244 - DNA, 22 bp, Homo sapiens
tgaggctcagaaatgtaagttt

SEQ ID NO: 8095245 - DNA, 22 bp, Homo sapiens
tgagagcttgagtatcactggc

SEQ ID NO: 8095246 - DNA, 22 bp, Homo sapiens
tgagagctgccacgtgaccatg

SEQ ID NO: 8095247 - DNA, 22 bp, Homo sapiens
tgagaggtaggaaatgaacaag

SEQ ID NO: 8095248 - DNA, 22 bp, Homo sapiens
tgagatgtaaggtatgcttact

SEQ ID NO: 8095249 - DNA, 20 bp, Homo sapiens
tgagaaagtagagactcagg

SEQ ID NO: 8095250 - DNA, 22 bp, Homo sapiens
tgagcacactcctggtgagcga

SEQ ID NO: 8095251 - DNA, 22 bp, Homo sapiens
tgagcacaagtttgcatgtgtg

SEQ ID NO: 8095252 - DNA, 22 bp, Homo sapiens
tgcatggactcatcagacaaga

SEQ ID NO: 8095253 - DNA, 22 bp, Homo sapiens
tgcatggaggaagatgaatgca

SEQ ID NO: 8095254 - DNA, 22 bp, Homo sapiens
tgcatgtgtttgccacagtgag

SEQ ID NO: 8095255 - DNA, 19 bp, Homo sapiens
tgccagcattaggctgaag

SEQ ID NO: 8095256 - DNA, 21 bp, Homo sapiens
tgccagcattaaacagtcatt

SEQ ID NO: 8095257 - DNA, 22 bp, Homo sapiens
tgccagcagtagcagtaggcca

SEQ ID NO: 8095258 - DNA, 21 bp, Homo sapiens
tgccagcatgtaggctagttg

SEQ ID NO: 8095259 - DNA, 23 bp, Homo sapiens
tgccagcagggaatgggaaggac

SEQ ID NO: 8095260 - DNA, 22 bp, Homo sapiens
tgccagcagaaataaatacttg

SEQ ID NO: 8095261 - DNA, 22 bp, Homo sapiens
tgccagcaagaatagacagtaa

SEQ ID NO: 8095262 - DNA, 22 bp, Homo sapiens
tgccagcacaagttaagagatc

SEQ ID NO: 8095263 - DNA, 22 bp, Homo sapiens
tgccagcaccttcctgctccct

SEQ ID NO: 8095264 - DNA, 22 bp, Homo sapiens
tgccagcacttctggctgtctg

SEQ ID NO: 8095265 - DNA, 22 bp, Homo sapiens
tgcagtgggccggaggccaggg

SEQ ID NO: 8095266 - DNA, 22 bp, Homo sapiens
tgcagtggttgagagcccagac

SEQ ID NO: 8095267 - DNA, 22 bp, Homo sapiens
tgcaggggcttgtctgggcctg

SEQ ID NO: 8095268 - DNA, 20 bp, Homo sapiens
tgcagggctctgcttctctc

SEQ ID NO: 8095269 - DNA, 22 bp, Homo sapiens
tgcagggccgctggaggtcatg

SEQ ID NO: 8095270 - DNA, 22 bp, Homo sapiens
tgcagggctacaggactacaac

SEQ ID NO: 8095271 - DNA, 22 bp, Homo sapiens
tgcagggctataactccattct

SEQ ID NO: 8095272 - DNA, 22 bp, Homo sapiens
tgcagggctcctggctccaatc

SEQ ID NO: 8095273 - DNA, 22 bp, Homo sapiens
tgcagggcccttggggttgaac

SEQ ID NO: 8095274 - DNA, 22 bp, Homo sapiens
tgcagggccctcattcctgtcc

SEQ ID NO: 8095275 - DNA, 22 bp, Homo sapiens
tgcagggcatctttgaagtgtg

SEQ ID NO: 8095276 - DNA, 22 bp, Homo sapiens
tgcaggctggaggagggactaa

SEQ ID NO: 8095277 - DNA, 22 bp, Homo sapiens
tgcaggctgctggcagtagctt

SEQ ID NO: 8095278 - DNA, 22 bp, Homo sapiens
tgcaggctccatgaggacaggc

SEQ ID NO: 8095279 - DNA, 22 bp, Homo sapiens
tgcaggctctctgctgccagat

SEQ ID NO: 8095280 - DNA, 22 bp, Homo sapiens
tgccaggctcaggatgtccctg

SEQ ID NO: 8095281 - DNA, 22 bp, Homo sapiens
tgcccaagccgagctctctgtt

SEQ ID NO: 8095282 - DNA, 22 bp, Homo sapiens
tgcccacatggtgccatggcca

SEQ ID NO: 8095283 - DNA, 22 bp, Homo sapiens
tgcccagggtggagtgcagcgg

SEQ ID NO: 8095284 - DNA, 22 bp, Homo sapiens
tgcccagggtggagtgcagcgg

SEQ ID NO: 8095285 - DNA, 22 bp, Homo sapiens
tgcccagggataagcctagaga

SEQ ID NO: 8095286 - DNA, 22 bp, Homo sapiens
tgcccagggataagcctagaga

SEQ ID NO: 8095287 - DNA, 22 bp, Homo sapiens
tgcccaggctggagtgcagagg

SEQ ID NO: 8095288 - DNA, 22 bp, Homo sapiens
tgcccaggctcctcgcagcctt

SEQ ID NO: 8095289 - DNA, 22 bp, Homo sapiens
tgcccaggctggaatgcagtgg

SEQ ID NO: 8095290 - DNA, 22 bp, Homo sapiens
tgcccaggctggagtacagtgg

SEQ ID NO: 8095291 - DNA, 22 bp, Homo sapiens
tgcccaggattgtgaggtcagg

SEQ ID NO: 8095292 - DNA, 22 bp, Homo sapiens
tgcccaggtttgagtgcccaag

SEQ ID NO: 8095293 - DNA, 22 bp, Homo sapiens
tgcccctcgacgcaatgaaggg

SEQ ID NO: 8095294 - DNA, 22 bp, Homo sapiens
tgcccctcagggaacgggtatc

SEQ ID NO: 8095295 - DNA, 22 bp, Homo sapiens
tgccccagactctgctcacctc

SEQ ID NO: 8095296 - DNA, 22 bp, Homo sapiens
tgcctggattcggttgttgtca

SEQ ID NO: 8095297 - DNA, 22 bp, Homo sapiens
tgcctgcatcttggaggcccca

SEQ ID NO: 8095298 - DNA, 22 bp, Homo sapiens
tgcctgcttgtgtacctggtga

SEQ ID NO: 8095299 - DNA, 22 bp, Homo sapiens
tgcctgcttgtttacctactcc

SEQ ID NO: 8095300 - DNA, 19 bp, Homo sapiens
tgcctggacaaatgtgggg

SEQ ID NO: 8095301 - DNA, 22 bp, Homo sapiens
tgcctggaaggcccatgggaag

SEQ ID NO: 8095302 - DNA, 22 bp, Homo sapiens
tgcctcctctttgccaaggtca

SEQ ID NO: 8095303 - DNA, 22 bp, Homo sapiens
tgcctcaagccctccactgcac

SEQ ID NO: 8095304 - DNA, 22 bp, Homo sapiens
tgccgtggggctgaggctggag

SEQ ID NO: 8095305 - DNA, 22 bp, Homo sapiens
tgccgtggggctgaggctggag

SEQ ID NO: 8095306 - DNA, 22 bp, Homo sapiens
tgcaaagatatgagaagctgta

SEQ ID NO: 8095307 - DNA, 20 bp, Homo sapiens
tgcaaacacagagtgtatga

SEQ ID NO: 8095308 - DNA, 22 bp, Homo sapiens
tgcaaacacttcaacgtgcatc

SEQ ID NO: 8095309 - DNA, 22 bp, Homo sapiens
tgcaaacatccgactgaaagcc

SEQ ID NO: 8095310 - DNA, 22 bp, Homo sapiens
tgatttcctaggtctggagaag

SEQ ID NO: 8095311 - DNA, 22 bp, Homo sapiens
tgatttacaattgtaaaagttt

SEQ ID NO: 8095312 - DNA, 21 bp, Homo sapiens
tgcaagcagcagagatatggg

SEQ ID NO: 8095313 - DNA, 22 bp, Homo sapiens
tgcaatctcggcactttgggag

SEQ ID NO: 8095314 - DNA, 18 bp, Homo sapiens
tgattggctcaaggctgt

SEQ ID NO: 8095315 - DNA, 22 bp, Homo sapiens
tgatgttatggtactattcatt

SEQ ID NO: 8095316 - DNA, 22 bp, Homo sapiens
tgatgaaagttcagtagtgaat

SEQ ID NO: 8095317 - DNA, 22 bp, Homo sapiens
tgatgctgttccagttatattg

SEQ ID NO: 8095318 - DNA, 17 bp, Homo sapiens
tgatagttcattttaag

SEQ ID NO: 8095319 - DNA, 22 bp, Homo sapiens
tgatccctcacttctctttggg

SEQ ID NO: 8095320 - DNA, 22 bp, Homo sapiens
tgatcccttctccttcccttgg

SEQ ID NO: 8095321 - DNA, 20 bp, Homo sapiens
tgatccctggcggcctttcc

SEQ ID NO: 8095322 - DNA, 22 bp, Homo sapiens
tgatccctgattgccttgactc

SEQ ID NO: 8095323 - DNA, 22 bp, Homo sapiens
tgatctaggttggcttcaactg

SEQ ID NO: 8095324 - DNA, 22 bp, Homo sapiens
tgatcagcatcttcccagctcg

SEQ ID NO: 8095325 - DNA, 22 bp, Homo sapiens
tgcagatgagggatgaaaatga

SEQ ID NO: 8095326 - DNA, 22 bp, Homo sapiens
tgcagattcaaatgaaatgcaa

SEQ ID NO: 8095327 - DNA, 22 bp, Homo sapiens
tgcagcagaagtgttcttctct

SEQ ID NO: 8095328 - DNA, 22 bp, Homo sapiens
tgcagcagaatatggctgcagg

SEQ ID NO: 8095329 - DNA, 21 bp, Homo sapiens
tgcagcagaagtctctgtgtc

SEQ ID NO: 8095330 - DNA, 20 bp, Homo sapiens
tgcagcagaagcccatgctc

SEQ ID NO: 8095331 - DNA, 22 bp, Homo sapiens
tgcagaagacacaaggtaacgt

SEQ ID NO: 8095332 - DNA, 22 bp, Homo sapiens
tgcagaagaatgtaggcataag

SEQ ID NO: 8095333 - DNA, 22 bp, Homo sapiens
tgcagaagaaaacagctgtgtg

SEQ ID NO: 8095334 - DNA, 22 bp, Homo sapiens
tgcagaagatggtctgagcacc

SEQ ID NO: 8095335 - DNA, 22 bp, Homo sapiens
tgcagaaggaggaggaaatcca

SEQ ID NO: 8095336 - DNA, 22 bp, Homo sapiens
tgcacagcgggtgtctgtcagg

SEQ ID NO: 8095337 - DNA, 23 bp, Homo sapiens
tgcaggctaggaagagagccttc

SEQ ID NO: 8095338 - DNA, 22 bp, Homo sapiens
tgcaggctcacctgccagggcc

SEQ ID NO: 8095339 - DNA, 22 bp, Homo sapiens
tgcaggagctgctgtcctgctc

SEQ ID NO: 8095340 - DNA, 23 bp, Homo sapiens
tgcagcagggtggtctacttctc

SEQ ID NO: 8095341 - DNA, 22 bp, Homo sapiens
tgcagcaggtatggcaagctcc

SEQ ID NO: 8095342 - DNA, 22 bp, Homo sapiens
tgcagccattttctgccaatgc

SEQ ID NO: 8095343 - DNA, 22 bp, Homo sapiens
tgcagcagactgagtatgagaa

SEQ ID NO: 8095344 - DNA, 22 bp, Homo sapiens
tgcagcagacataatgtggatt

SEQ ID NO: 8095345 - DNA, 21 bp, Homo sapiens
tgcagcagagtaagcagggga

SEQ ID NO: 8095346 - DNA, 21 bp, Homo sapiens
tgcagcagatttgggggaaga

SEQ ID NO: 8095347 - DNA, 22 bp, Homo sapiens
tgcagcagcagggaggaggctc

SEQ ID NO: 8095348 - DNA, 22 bp, Homo sapiens
tgcagcagagtgggcctgggtg

SEQ ID NO: 8095349 - DNA, 22 bp, Homo sapiens
tgcagcagccaaggttctgtgc

SEQ ID NO: 8095350 - DNA, 22 bp, Homo sapiens
tgcagcagcctcatctggtttc

SEQ ID NO: 8095351 - DNA, 22 bp, Homo sapiens
tgcagcagctccaggttaccct

SEQ ID NO: 8095352 - DNA, 22 bp, Homo sapiens
tgcagcaggagccaggcctggt

SEQ ID NO: 8095353 - DNA, 22 bp, Homo sapiens
tgcagcaggcacaggacggaag

SEQ ID NO: 8095354 - DNA, 22 bp, Homo sapiens
tgcagcagggacctctatgtga

SEQ ID NO: 8095355 - DNA, 22 bp, Homo sapiens
tgcagcagggcccaggcacaga

SEQ ID NO: 8095356 - DNA, 22 bp, Homo sapiens
tcctggctgttagagaggcaag

SEQ ID NO: 8095357 - DNA, 18 bp, Homo sapiens
tcctgggaaaggcataca

SEQ ID NO: 8095358 - DNA, 22 bp, Homo sapiens
tcctgggaccgagggaagagct

SEQ ID NO: 8095359 - DNA, 22 bp, Homo sapiens
tcctgggaccctgggtgcagag

SEQ ID NO: 8095360 - DNA, 22 bp, Homo sapiens
tcctgggagtaattgagtcatg

SEQ ID NO: 8095361 - DNA, 22 bp, Homo sapiens
tcctgggcacaagtgagtctcc

SEQ ID NO: 8095362 - DNA, 22 bp, Homo sapiens
tcctgggcccaggctgccaggg

SEQ ID NO: 8095363 - DNA, 17 bp, Homo sapiens
tcctgtgggtgcagcag

SEQ ID NO: 8095364 - DNA, 18 bp, Homo sapiens
tcctgtggcccagagttt

SEQ ID NO: 8095365 - DNA, 22 bp, Homo sapiens
tcctgtgctttggaggatgttc

SEQ ID NO: 8095366 - DNA, 22 bp, Homo sapiens
taagaacagataaagtttcccc

SEQ ID NO: 8095367 - DNA, 22 bp, Homo sapiens
taagaacagtagaacagtaggt

SEQ ID NO: 8095368 - DNA, 22 bp, Homo sapiens
taagaacagtgtctgtctcaca

SEQ ID NO: 8095369 - DNA, 22 bp, Homo sapiens
taagaacttcggacatgttatc

SEQ ID NO: 8095370 - DNA, 22 bp, Homo sapiens
tcctggagaaactcagagatct

SEQ ID NO: 8095371 - DNA, 22 bp, Homo sapiens
tcctggcacattgcaggggctc

SEQ ID NO: 8095372 - DNA, 22 bp, Homo sapiens
tcgcaccattgcactccagcca

SEQ ID NO: 8095373 - DNA, 22 bp, Homo sapiens
tcgagctctggagccaaggatg

SEQ ID NO: 8095374 - DNA, 22 bp, Homo sapiens
tctaaacagtttcactcttaat

SEQ ID NO: 8095375 - DNA, 22 bp, Homo sapiens
tctaaacactaagtcttgatgc

SEQ ID NO: 8095376 - DNA, 22 bp, Homo sapiens
tctaaagacactttttacaggg

SEQ ID NO: 8095377 - DNA, 22 bp, Homo sapiens
tctaaagaagagggttctgcgg

SEQ ID NO: 8095378 - DNA, 22 bp, Homo sapiens
tccttctttccccctagtcatt

SEQ ID NO: 8095379 - DNA, 22 bp, Homo sapiens
tccttctttgacaagtggcaga

SEQ ID NO: 8095380 - DNA, 22 bp, Homo sapiens
tccttgccctaaatgtctgtgt

SEQ ID NO: 8095381 - DNA, 22 bp, Homo sapiens
tccttcaactttttacttgccc

SEQ ID NO: 8095382 - DNA, 22 bp, Homo sapiens
tccttcaagtgcagtacctgag

SEQ ID NO: 8095383 - DNA, 18 bp, Homo sapiens
tccttagctgagcttgtc

SEQ ID NO: 8095384 - DNA, 22 bp, Homo sapiens
tccttcaggcctcattctcata

SEQ ID NO: 8095385 - DNA, 22 bp, Homo sapiens
tccttcagctactcagtttcca

SEQ ID NO: 8095386 - DNA, 22 bp, Homo sapiens
tctacccagagctatgacctga

SEQ ID NO: 8095387 - DNA, 22 bp, Homo sapiens
tctaacctttgaaactgctttc

SEQ ID NO: 8095388 - DNA, 20 bp, Homo sapiens
tctacatgcctcttcccatc

SEQ ID NO: 8095389 - DNA, 22 bp, Homo sapiens
tctaggtagagtggaccttgct

SEQ ID NO: 8095390 - DNA, 22 bp, Homo sapiens
tctaggtaggctgtgtgtggaa

SEQ ID NO: 8095391 - DNA, 22 bp, Homo sapiens
tctatgttggtccatattatgg

SEQ ID NO: 8095392 - DNA, 22 bp, Homo sapiens
tctcaaataggccttggtcctg

SEQ ID NO: 8095393 - DNA, 23 bp, Homo sapiens
tctcaaatatgatctgggtcatc

SEQ ID NO: 8095394 - DNA, 22 bp, Homo sapiens
tctcaaatatttggagagagga

SEQ ID NO: 8095395 - DNA, 22 bp, Homo sapiens
tctcaaatggcaaatgtgggtc

SEQ ID NO: 8095396 - DNA, 22 bp, Homo sapiens
tctcaaatcaaactttgagctt

SEQ ID NO: 8095397 - DNA, 23 bp, Homo sapiens
tctcaaatctttgcgttgtatct

SEQ ID NO: 8095398 - DNA, 22 bp, Homo sapiens
tctcaaatggacaatattgtgg

SEQ ID NO: 8095399 - DNA, 22 bp, Homo sapiens
tctgaagattaccagctaaatg

SEQ ID NO: 8095400 - DNA, 22 bp, Homo sapiens
tctgaagagtcttgcaagaaag

SEQ ID NO: 8095401 - DNA, 22 bp, Homo sapiens
tctgaagaactgagtaaacatg

SEQ ID NO: 8095402 - DNA, 22 bp, Homo sapiens
tctgaagaataggatgttgtgt

SEQ ID NO: 8095403 - DNA, 22 bp, Homo sapiens
tctgaaatgcaaatttgactga

SEQ ID NO: 8095404 - DNA, 22 bp, Homo sapiens
tctgaaagaagggcagtctttt

SEQ ID NO: 8095405 - DNA, 18 bp, Homo sapiens
tctgaaagcaccggtgaa

SEQ ID NO: 8095406 - DNA, 22 bp, Homo sapiens
tctctttaagtataatcttata

SEQ ID NO: 8095407 - DNA, 23 bp, Homo sapiens
tctctttcaagagcttaatgtgc

SEQ ID NO: 8095408 - DNA, 22 bp, Homo sapiens
tctctttactttcaccaatttg

SEQ ID NO: 8095409 - DNA, 22 bp, Homo sapiens
tctctttctatatgtgagtctt

SEQ ID NO: 8095410 - DNA, 22 bp, Homo sapiens
tctcttccttgacctattgtaa

SEQ ID NO: 8095411 - DNA, 22 bp, Homo sapiens
tctcttcctagtgatgggcttt

SEQ ID NO: 8095412 - DNA, 22 bp, Homo sapiens
tctcttcctcagcctggggcct

SEQ ID NO: 8095413 - DNA, 22 bp, Homo sapiens
tctcttcctcagcctggggcct

SEQ ID NO: 8095414 - DNA, 21 bp, Homo sapiens
tctcttcctccgcgccgccgc

SEQ ID NO: 8095415 - DNA, 21 bp, Homo sapiens
tctcttcccatcaggacacta

SEQ ID NO: 8095416 - DNA, 22 bp, Homo sapiens
tctcttccctttatggtatgtg

SEQ ID NO: 8095417 - DNA, 22 bp, Homo sapiens
tctcttcccggataaagtaagt

SEQ ID NO: 8095418 - DNA, 22 bp, Homo sapiens
tctcttcccctttcctttaaca

SEQ ID NO: 8095419 - DNA, 22 bp, Homo sapiens
tctcttccatgtttcagcccca

SEQ ID NO: 8095420 - DNA, 22 bp, Homo sapiens
tctcttccagtaagagtcttta

SEQ ID NO: 8095421 - DNA, 22 bp, Homo sapiens
tctcttccagtggctttgattt

SEQ ID NO: 8095422 - DNA, 22 bp, Homo sapiens
tctcttctgacctagccttgga

SEQ ID NO: 8095423 - DNA, 22 bp, Homo sapiens
tctctctcagccattacagaac

SEQ ID NO: 8095424 - DNA, 22 bp, Homo sapiens
tctctctaggcatctattttca

SEQ ID NO: 8095425 - DNA, 19 bp, Homo sapiens
tctctcaattgcttcaatt

SEQ ID NO: 8095426 - DNA, 22 bp, Homo sapiens
tctctcatagagaaaaatatat

SEQ ID NO: 8095427 - DNA, 22 bp, Homo sapiens
tctctgaagagctcagactagt

SEQ ID NO: 8095428 - DNA, 22 bp, Homo sapiens
tctctctttttaatcatgtaat

SEQ ID NO: 8095429 - DNA, 22 bp, Homo sapiens
tctctgaacttcctggaaaggc

SEQ ID NO: 8095430 - DNA, 21 bp, Homo sapiens
tctctgagaggtctgcttaga

SEQ ID NO: 8095431 - DNA, 22 bp, Homo sapiens
tctctgagcatgccatattgct

SEQ ID NO: 8095432 - DNA, 22 bp, Homo sapiens
tctctgagatcagccactgact

SEQ ID NO: 8095433 - DNA, 22 bp, Homo sapiens
tctctgagcccaatgtagcaat

SEQ ID NO: 8095434 - DNA, 23 bp, Homo sapiens
tctccaggccttactccaggcct

SEQ ID NO: 8095435 - DNA, 22 bp, Homo sapiens
tctccaggagcaagtcacccag

SEQ ID NO: 8095436 - DNA, 22 bp, Homo sapiens
tctccaggactgagctccagcc

SEQ ID NO: 8095437 - DNA, 22 bp, Homo sapiens
tctcagggctcagagctcaggc

SEQ ID NO: 8095438 - DNA, 22 bp, Homo sapiens
tctcactcatttcctaggtctt

SEQ ID NO: 8095439 - DNA, 22 bp, Homo sapiens
tctcacccaacgtgcaatgagt

SEQ ID NO: 8095440 - DNA, 22 bp, Homo sapiens
tctcagagattttgtttccctt

SEQ ID NO: 8095441 - DNA, 23 bp, Homo sapiens
tctcagaggattcctgggccttg

SEQ ID NO: 8095442 - DNA, 22 bp, Homo sapiens
tctcagggcctccctctgtttc

SEQ ID NO: 8095443 - DNA, 22 bp, Homo sapiens
tctcagggaggttccccgttct

SEQ ID NO: 8095444 - DNA, 22 bp, Homo sapiens
tctcagggcaattctcagcgac

SEQ ID NO: 8095445 - DNA, 22 bp, Homo sapiens
tctcaggcttcctggtgctgtg

SEQ ID NO: 8095446 - DNA, 20 bp, Homo sapiens
tctcaggccccctccttgct

SEQ ID NO: 8095447 - DNA, 22 bp, Homo sapiens
tctcagagtggtggtccctctg

SEQ ID NO: 8095448 - DNA, 22 bp, Homo sapiens
tctcagagttcctctggagtcc

SEQ ID NO: 8095449 - DNA, 22 bp, Homo sapiens
tctcagaggtcttcagcctctg

SEQ ID NO: 8095450 - DNA, 22 bp, Homo sapiens
tctcagagggaaacatgagtga

SEQ ID NO: 8095451 - DNA, 22 bp, Homo sapiens
tctcagaggcccgacgttctcc

SEQ ID NO: 8095452 - DNA, 22 bp, Homo sapiens
tctccaggcttaatctcagctt

SEQ ID NO: 8095453 - DNA, 22 bp, Homo sapiens
tctccaggcctttcccatctta

SEQ ID NO: 8095454 - DNA, 22 bp, Homo sapiens
tctccagggaggtagcccagtg

SEQ ID NO: 8095455 - DNA, 22 bp, Homo sapiens
tctccaggtaaatggcatcctg

SEQ ID NO: 8095456 - DNA, 22 bp, Homo sapiens
tctccaggtgaaacttgcaggg

SEQ ID NO: 8095457 - DNA, 22 bp, Homo sapiens
tctccaggtgctaagtgtgcct

SEQ ID NO: 8095458 - DNA, 22 bp, Homo sapiens
tctccaggtggggtcacctttt

SEQ ID NO: 8095459 - DNA, 22 bp, Homo sapiens
tctccaggttcagtcgatggaa

SEQ ID NO: 8095460 - DNA, 22 bp, Homo sapiens
tctcccactgcaagcccaggct

SEQ ID NO: 8095461 - DNA, 22 bp, Homo sapiens
tctcccagaggatcccagtgga

SEQ ID NO: 8095462 - DNA, 22 bp, Homo sapiens
tctcccaggtgggtgcctggag

SEQ ID NO: 8095463 - DNA, 22 bp, Homo sapiens
tctcccctactctaaatctgca

SEQ ID NO: 8095464 - DNA, 22 bp, Homo sapiens
tctcccctccctggaccagtgc

SEQ ID NO: 8095465 - DNA, 22 bp, Homo sapiens
tctcctactcactcaaggcttg

SEQ ID NO: 8095466 - DNA, 22 bp, Homo sapiens
tctcccagtgtctggcagtcag

SEQ ID NO: 8095467 - DNA, 22 bp, Homo sapiens
tctcgctctgtcgcccaggctg

SEQ ID NO: 8095468 - DNA, 22 bp, Homo sapiens
tctcgatctcctgaccttgtga

SEQ ID NO: 8095469 - DNA, 22 bp, Homo sapiens
tctccttcgaggcccagctccc

SEQ ID NO: 8095470 - DNA, 22 bp, Homo sapiens
tctccttgacaggcaggcagac

SEQ ID NO: 8095471 - DNA, 22 bp, Homo sapiens
tctccttgtgctgggtccttcc

SEQ ID NO: 8095472 - DNA, 22 bp, Homo sapiens
tctcctttctggagcctgctca

SEQ ID NO: 8095473 - DNA, 22 bp, Homo sapiens
tctccttgctacccagtatgtc

SEQ ID NO: 8095474 - DNA, 22 bp, Homo sapiens
tctcctcaccaccagcagcaga

SEQ ID NO: 8095475 - DNA, 21 bp, Homo sapiens
tctcctcccggggagaggccg

SEQ ID NO: 8095476 - DNA, 23 bp, Homo sapiens
tctcctcctagatacagtcatgg

SEQ ID NO: 8095477 - DNA, 22 bp, Homo sapiens
tctcctctactgggtctgcaga

SEQ ID NO: 8095478 - DNA, 22 bp, Homo sapiens
tctcctctgtgccacagcttgg

SEQ ID NO: 8095479 - DNA, 22 bp, Homo sapiens
tctcctgaagtttatgaaaact

SEQ ID NO: 8095480 - DNA, 22 bp, Homo sapiens
tctcctctcttacctggtacaa

SEQ ID NO: 8095481 - DNA, 22 bp, Homo sapiens
tctcctctcctttcatgttgtt

SEQ ID NO: 8095482 - DNA, 22 bp, Homo sapiens
tctcctgcttcaactgatggac

SEQ ID NO: 8095483 - DNA, 22 bp, Homo sapiens
tctcctgctcccaactgctgca

SEQ ID NO: 8095484 - DNA, 21 bp, Homo sapiens
tctgggctgctgctgcccatc

SEQ ID NO: 8095485 - DNA, 22 bp, Homo sapiens
tctgggaatttattggcacttt

SEQ ID NO: 8095486 - DNA, 22 bp, Homo sapiens
tctgggaatgaataagacctgt

SEQ ID NO: 8095487 - DNA, 22 bp, Homo sapiens
tctgggaagtcctctgtcatgc

SEQ ID NO: 8095488 - DNA, 22 bp, Homo sapiens
tctgggagtaaggcctaggcat

SEQ ID NO: 8095489 - DNA, 22 bp, Homo sapiens
tctgggaagctgcgtgcctgtt

SEQ ID NO: 8095490 - DNA, 22 bp, Homo sapiens
tctgggaagctggtcctgttct

SEQ ID NO: 8095491 - DNA, 22 bp, Homo sapiens
tctgggaaccagtgcggctggg

SEQ ID NO: 8095492 - DNA, 22 bp, Homo sapiens
tctgggaactgagctcccctag

SEQ ID NO: 8095493 - DNA, 22 bp, Homo sapiens
tctgggaactctgtcatttccc

SEQ ID NO: 8095494 - DNA, 22 bp, Homo sapiens
tctgggaacacacgtcacttca

SEQ ID NO: 8095495 - DNA, 22 bp, Homo sapiens
tctgggaacagcctggctgtgt

SEQ ID NO: 8095496 - DNA, 22 bp, Homo sapiens
tctgggaaatgctgttccttgt

SEQ ID NO: 8095497 - DNA, 22 bp, Homo sapiens
tctgcccctgctgggcacagag

SEQ ID NO: 8095498 - DNA, 22 bp, Homo sapiens
tctgagccaatttctgtgtcca

SEQ ID NO: 8095499 - DNA, 22 bp, Homo sapiens
tctgagccagggtctcctccct

SEQ ID NO: 8095500 - DNA, 20 bp, Homo sapiens
tctgagacttgtagtgtgga

SEQ ID NO: 8095501 - DNA, 22 bp, Homo sapiens
tctgagacttctgaagctagaa

SEQ ID NO: 8095502 - DNA, 22 bp, Homo sapiens
tctgagacaggaagtggagggt

SEQ ID NO: 8095503 - DNA, 20 bp, Homo sapiens
tctgagacctttccacaccc

SEQ ID NO: 8095504 - DNA, 22 bp, Homo sapiens
tctgagacaacttagccctcga

SEQ ID NO: 8095505 - DNA, 22 bp, Homo sapiens
tctgagacactcttgtgatggg

SEQ ID NO: 8095506 - DNA, 22 bp, Homo sapiens
tctgagctgcccctttactttg

SEQ ID NO: 8095507 - DNA, 22 bp, Homo sapiens
tctgagccgtatggcttggcta

SEQ ID NO: 8095508 - DNA, 22 bp, Homo sapiens
tcttattttagagccccgagcc

SEQ ID NO: 8095509 - DNA, 22 bp, Homo sapiens
tcttcaaaaatacaggttttca

SEQ ID NO: 8095510 - DNA, 22 bp, Homo sapiens
tcttcacaggagcctgcctgcc

SEQ ID NO: 8095511 - DNA, 22 bp, Homo sapiens
tcttcagatggccagttgtccc

SEQ ID NO: 8095512 - DNA, 22 bp, Homo sapiens
tcttcacatggaacatgaagct

SEQ ID NO: 8095513 - DNA, 22 bp, Homo sapiens
tcttcacatgaccttcatgtct

SEQ ID NO: 8095514 - DNA, 22 bp, Homo sapiens
tcttcaattagatttaccaatt

SEQ ID NO: 8095515 - DNA, 22 bp, Homo sapiens
tcttcaagttccaaagtgcagg

SEQ ID NO: 8095516 - DNA, 18 bp, Homo sapiens
tcttccaacactgacacc

SEQ ID NO: 8095517 - DNA, 22 bp, Homo sapiens
tcttccaaggttgcacactatc

SEQ ID NO: 8095518 - DNA, 22 bp, Homo sapiens
tcttcttcctcatttatacata

SEQ ID NO: 8095519 - DNA, 22 bp, Homo sapiens
tcttcttcccatccctcaaatg

SEQ ID NO: 8095520 - DNA, 22 bp, Homo sapiens
tcttctcccatctccaggcagg

SEQ ID NO: 8095521 - DNA, 22 bp, Homo sapiens
tcttctcccatcggccgcaggg

SEQ ID NO: 8095522 - DNA, 22 bp, Homo sapiens
tcttctccagtgcttctgcaca

SEQ ID NO: 8095523 - DNA, 22 bp, Homo sapiens
tcttctccagtgcttctgcaca

SEQ ID NO: 8095524 - DNA, 22 bp, Homo sapiens
tcttctcctttgccatgtgttt

SEQ ID NO: 8095525 - DNA, 23 bp, Homo sapiens
tctttagaagaacatcagaaatg

SEQ ID NO: 8095526 - DNA, 22 bp, Homo sapiens
tctttagaaacttttcttcatg

SEQ ID NO: 8095527 - DNA, 22 bp, Homo sapiens
tcttgggatcacctcctggctt

SEQ ID NO: 8095528 - DNA, 22 bp, Homo sapiens
tcttggcaagtggcagattctt

SEQ ID NO: 8095529 - DNA, 22 bp, Homo sapiens
tcttggcaagaagcttcagcta

SEQ ID NO: 8095530 - DNA, 20 bp, Homo sapiens
tctttagatttatcttatgt

SEQ ID NO: 8095531 - DNA, 22 bp, Homo sapiens
tctttagagctcagaaatacag

SEQ ID NO: 8095532 - DNA, 22 bp, Homo sapiens
tctttagagttaacaataatga

SEQ ID NO: 8095533 - DNA, 22 bp, Homo sapiens
tctttagatgtttagaggaaga

SEQ ID NO: 8095534 - DNA, 22 bp, Homo sapiens
tctttagagcacgggaaaaaca

SEQ ID NO: 8095535 - DNA, 22 bp, Homo sapiens
tctttagacatccagtttctct

SEQ ID NO: 8095536 - DNA, 22 bp, Homo sapiens
tctttagagcctttcctcccga

SEQ ID NO: 8095537 - DNA, 22 bp, Homo sapiens
tctttccatggccacacagtct

SEQ ID NO: 8095538 - DNA, 22 bp, Homo sapiens
tctttccaaggactctgtagca

SEQ ID NO: 8095539 - DNA, 22 bp, Homo sapiens
tctttcaatgagcattctttcc

SEQ ID NO: 8095540 - DNA, 22 bp, Homo sapiens
tctttattgctactggtttgtc

SEQ ID NO: 8095541 - DNA, 22 bp, Homo sapiens
tcttagcatttcataacaactg

SEQ ID NO: 8095542 - DNA, 22 bp, Homo sapiens
tcttagcacagctatataagtt

SEQ ID NO: 8095543 - DNA, 22 bp, Homo sapiens
tcttaaagagcgcaatttgagg

SEQ ID NO: 8095544 - DNA, 22 bp, Homo sapiens
tctgtggattttagtgttcatg

SEQ ID NO: 8095545 - DNA, 20 bp, Homo sapiens
tctgtaaagactccagaagc

SEQ ID NO: 8095546 - DNA, 22 bp, Homo sapiens
tctgtaaacaccatgttagagt

SEQ ID NO: 8095547 - DNA, 22 bp, Homo sapiens
tctgtaaagactccaaaagcca

SEQ ID NO: 8095548 - DNA, 22 bp, Homo sapiens
tctgtaaagactccaaaagcca

SEQ ID NO: 8095549 - DNA, 20 bp, Homo sapiens
tctgtacactcatcttctgc

SEQ ID NO: 8095550 - DNA, 22 bp, Homo sapiens
tctgtccattttccattttggc

SEQ ID NO: 8095551 - DNA, 22 bp, Homo sapiens
tctgtccctgagagctcaggag

SEQ ID NO: 8095552 - DNA, 22 bp, Homo sapiens
tctgtcctccggagctcccagt

SEQ ID NO: 8095553 - DNA, 22 bp, Homo sapiens
tctgtccattcagccatccatc

SEQ ID NO: 8095554 - DNA, 22 bp, Homo sapiens
agagcagtcaggctaggacact

SEQ ID NO: 8095555 - DNA, 22 bp, Homo sapiens
agagcctggaggttctgctgaa

SEQ ID NO: 8095556 - DNA, 22 bp, Homo sapiens
aatggcactttataaatgttaa

SEQ ID NO: 8095557 - DNA, 22 bp, Homo sapiens
acaaccttctggagatatctgt

SEQ ID NO: 8095558 - DNA, 22 bp, Homo sapiens
agaggctgaatgatgtcatcat

SEQ ID NO: 8095559 - DNA, 22 bp, Homo sapiens
acacagagtatttagaaggggt

SEQ ID NO: 8095560 - DNA, 22 bp, Homo sapiens
aaagcagaggttgcagtgagct

SEQ ID NO: 8095561 - DNA, 22 bp, Homo sapiens
aagcagcttccctggctcctgg

SEQ ID NO: 8095562 - DNA, 22 bp, Homo sapiens
aagcagctttctttcctgtgaa

SEQ ID NO: 8095563 - DNA, 22 bp, Homo sapiens
aagcagcttaaattagagcctg

SEQ ID NO: 8095564 - DNA, 17 bp, Homo sapiens
agctgccttgcttgagc

SEQ ID NO: 8095565 - DNA, 22 bp, Homo sapiens
agtttccttggattcaatttgg

SEQ ID NO: 8095566 - DNA, 22 bp, Homo sapiens
agtttcatttcttagtaccagt

SEQ ID NO: 8095567 - DNA, 21 bp, Homo sapiens
agcacagcatatccaatgtca

SEQ ID NO: 8095568 - DNA, 20 bp, Homo sapiens
agcacagcgcggtgttcctt

SEQ ID NO: 8095569 - DNA, 22 bp, Homo sapiens
agcagcttatcttggagaggca

SEQ ID NO: 8095570 - DNA, 22 bp, Homo sapiens
cacaggaggttaggaagtggtc

SEQ ID NO: 8095571 - DNA, 22 bp, Homo sapiens
agcagtttttataacactggaa

SEQ ID NO: 8095572 - DNA, 22 bp, Homo sapiens
agcagttttcctgagctcctca

SEQ ID NO: 8095573 - DNA, 22 bp, Homo sapiens
agcagttttagggagacacatt

SEQ ID NO: 8095574 - DNA, 22 bp, Homo sapiens
agcagtttggaaaatactagaa

SEQ ID NO: 8095575 - DNA, 20 bp, Homo sapiens
agcagtttcctaactcagct

SEQ ID NO: 8095576 - DNA, 22 bp, Homo sapiens
agcctggtttaagcattttata

SEQ ID NO: 8095577 - DNA, 18 bp, Homo sapiens
aggaagcaggaggaaggc

SEQ ID NO: 8095578 - DNA, 23 bp, Homo sapiens
agctgggaattttctgaagcttt

SEQ ID NO: 8095579 - DNA, 22 bp, Homo sapiens
agctgtgttctggttgattcac

SEQ ID NO: 8095580 - DNA, 22 bp, Homo sapiens
agcttcttaagttcctgcagca

SEQ ID NO: 8095581 - DNA, 21 bp, Homo sapiens
agctggcctggtttgagctcc

SEQ ID NO: 8095582 - DNA, 22 bp, Homo sapiens
agctggcttctctgcagacatt

SEQ ID NO: 8095583 - DNA, 22 bp, Homo sapiens
agctggctttgagctgggaggt

SEQ ID NO: 8095584 - DNA, 22 bp, Homo sapiens
aggaaggaagagacaccatttg

SEQ ID NO: 8095585 - DNA, 19 bp, Homo sapiens
aggaaggaacctgagtctg

SEQ ID NO: 8095586 - DNA, 20 bp, Homo sapiens
aggaaggaagtttgcatgga

SEQ ID NO: 8095587 - DNA, 22 bp, Homo sapiens
aggaaggactccatggtccgtc

SEQ ID NO: 8095588 - DNA, 22 bp, Homo sapiens
aggaaggactgcagcatttggt

SEQ ID NO: 8095589 - DNA, 22 bp, Homo sapiens
aggagaggtctcccttccccag

SEQ ID NO: 8095590 - DNA, 22 bp, Homo sapiens
aggagagggtggcattaagttt

SEQ ID NO: 8095591 - DNA, 22 bp, Homo sapiens
aggagaggggtaggattaattt

SEQ ID NO: 8095592 - DNA, 22 bp, Homo sapiens
aggagaggctctaactctgtgt

SEQ ID NO: 8095593 - DNA, 22 bp, Homo sapiens
aggagaggcatcaagaaaatcg

SEQ ID NO: 8095594 - DNA, 22 bp, Homo sapiens
aggagaggaatcattattacaa

SEQ ID NO: 8095595 - DNA, 22 bp, Homo sapiens
agggagagtttgatgtttcctc

SEQ ID NO: 8095596 - DNA, 22 bp, Homo sapiens
aggcagttgttgctgagcagct

SEQ ID NO: 8095597 - DNA, 22 bp, Homo sapiens
aggcagtttaggcagcgattta

SEQ ID NO: 8095598 - DNA, 22 bp, Homo sapiens
aggcagtttatccccagagcct

SEQ ID NO: 8095599 - DNA, 22 bp, Homo sapiens
ctgtggagtggggagtactggt

SEQ ID NO: 8095600 - DNA, 22 bp, Homo sapiens
ctgtggagtgcttggctcagtg

SEQ ID NO: 8095601 - DNA, 22 bp, Homo sapiens
ctgtggaggtaggagcaggaca

SEQ ID NO: 8095602 - DNA, 22 bp, Homo sapiens
ctgtggagtcctggggaatgga

SEQ ID NO: 8095603 - DNA, 22 bp, Homo sapiens
ctgtggagcttgtggcagtggg

SEQ ID NO: 8095604 - DNA, 22 bp, Homo sapiens
ctgtggagcagggcagggtcac

SEQ ID NO: 8095605 - DNA, 22 bp, Homo sapiens
ctgtggagatgcagaccaggcc

SEQ ID NO: 8095606 - DNA, 22 bp, Homo sapiens
aggtgcctatctggtctctgca

SEQ ID NO: 8095607 - DNA, 22 bp, Homo sapiens
gggcacagagaaggttttagtg

SEQ ID NO: 8095608 - DNA, 22 bp, Homo sapiens
gggcacagagggtcttgaagaa

SEQ ID NO: 8095609 - DNA, 22 bp, Homo sapiens
gggcacagaagtctaagacatc

SEQ ID NO: 8095610 - DNA, 20 bp, Homo sapiens
gggatgagagtcctagctct

SEQ ID NO: 8095611 - DNA, 22 bp, Homo sapiens
gggacaatggaggcctctctcc

SEQ ID NO: 8095612 - DNA, 22 bp, Homo sapiens
ggcatagcggctcagcgtccag

SEQ ID NO: 8095613 - DNA, 22 bp, Homo sapiens
ggcagttttaacagaggtagta

SEQ ID NO: 8095614 - DNA, 22 bp, Homo sapiens
ggcagtttctcaggcaggggta

SEQ ID NO: 8095615 - DNA, 22 bp, Homo sapiens
ggcagtttcatcaggagaaaag

SEQ ID NO: 8095616 - DNA, 22 bp, Homo sapiens
ggcagtttggcaggatggaggg

SEQ ID NO: 8095617 - DNA, 22 bp, Homo sapiens
atgaggtaatactttcagtcct

SEQ ID NO: 8095618 - DNA, 22 bp, Homo sapiens
cttgcctttgtcttcaaaggct

SEQ ID NO: 8095619 - DNA, 18 bp, Homo sapiens
gcctgggaggaggaaatg

SEQ ID NO: 8095620 - DNA, 23 bp, Homo sapiens
gcctgggagttgcgatctgcccg

SEQ ID NO: 8095621 - DNA, 22 bp, Homo sapiens
gcctgggagtgcacagtgaggt

SEQ ID NO: 8095622 - DNA, 22 bp, Homo sapiens
gcctgggagagggatagtgcag

SEQ ID NO: 8095623 - DNA, 22 bp, Homo sapiens
gcctgggagattaattaggaag

SEQ ID NO: 8095624 - DNA, 22 bp, Homo sapiens
gcctgggagcacatcggggtcc

SEQ ID NO: 8095625 - DNA, 22 bp, Homo sapiens
attgcacttcagcctgggtgac

SEQ ID NO: 8095626 - DNA, 21 bp, Homo sapiens
attcagagtaattcatcttta

SEQ ID NO: 8095627 - DNA, 22 bp, Homo sapiens
tcagtttcacagtctgtgcaga

SEQ ID NO: 8095628 - DNA, 22 bp, Homo sapiens
catgagtgtcatctcagcagct

SEQ ID NO: 8095629 - DNA, 22 bp, Homo sapiens
cagtttcttagtgacacaaatc

SEQ ID NO: 8095630 - DNA, 22 bp, Homo sapiens
catacattttgcatatttacca

SEQ ID NO: 8095631 - DNA, 22 bp, Homo sapiens
tataagaagtgaagaagagtta

SEQ ID NO: 8095632 - DNA, 17 bp, Homo sapiens
ccacagcctggcacttg

SEQ ID NO: 8095633 - DNA, 22 bp, Homo sapiens
ccagctggtgggtctttctctg

SEQ ID NO: 8095634 - DNA, 17 bp, Homo sapiens
tctgtcttgactgtcac

SEQ ID NO: 8095635 - DNA, 22 bp, Homo sapiens
caggaagggggatccttggaag

SEQ ID NO: 8095636 - DNA, 22 bp, Homo sapiens
caggaatgactgcagatggggc

SEQ ID NO: 8095637 - DNA, 22 bp, Homo sapiens
taaagcagtgtggttgtgtccc

SEQ ID NO: 8095638 - DNA, 22 bp, Homo sapiens
tacatatttgtctttgtactgt

SEQ ID NO: 8095639 - DNA, 22 bp, Homo sapiens
gtttcctgaccctggcccagca

SEQ ID NO: 8095640 - DNA, 22 bp, Homo sapiens
cctgggagccaagcctctgtgt

SEQ ID NO: 8095641 - DNA, 22 bp, Homo sapiens
tgtggggatcttctagcttttc

SEQ ID NO: 8095642 - DNA, 22 bp, Homo sapiens
tggatgagtctgagattgggca

SEQ ID NO: 8095643 - DNA, 22 bp, Homo sapiens
tggcacaggatctcagcggcca

SEQ ID NO: 8095644 - DNA, 22 bp, Homo sapiens
tggcacagggcttggtcgctca

SEQ ID NO: 8095645 - DNA, 22 bp, Homo sapiens
tggcacagtcctgggtgcctgc

SEQ ID NO: 8095646 - DNA, 22 bp, Homo sapiens
ctggcagcattaacagagagca

SEQ ID NO: 8095647 - DNA, 22 bp, Homo sapiens
ctggcctggggcctcagctgct

SEQ ID NO: 8095648 - DNA, 22 bp, Homo sapiens
ctggcctgaggccgccttcaga

SEQ ID NO: 8095649 - DNA, 22 bp, Homo sapiens
tttgtgaataggttggcttcca

SEQ ID NO: 8095650 - DNA, 22 bp, Homo sapiens
ctctgggcggcccaggccaacc

SEQ ID NO: 8095651 - DNA, 22 bp, Homo sapiens
ctctcccccacagcagccttct

SEQ ID NO: 8095652 - DNA, 22 bp, Homo sapiens
gcctgggaaagagtagggaaat

SEQ ID NO: 8095653 - DNA, 21 bp, Homo sapiens
gcctgggaaatctgggaagcc

SEQ ID NO: 8095654 - DNA, 22 bp, Homo sapiens
gcctgggacccttagctcttgg

SEQ ID NO: 8095655 - DNA, 21 bp, Homo sapiens
gcctgggaagagaaaggtaag

SEQ ID NO: 8095656 - DNA, 22 bp, Homo sapiens
gcctgggaagactaagtgggag

SEQ ID NO: 8095657 - DNA, 23 bp, Homo sapiens
gcctgggactcaggaggagctca

SEQ ID NO: 8095658 - DNA, 19 bp, Homo sapiens
gcctgggatgggcagaact

SEQ ID NO: 8095659 - DNA, 22 bp, Homo sapiens
gcctgggattctcaaaggggtg

SEQ ID NO: 8095660 - DNA, 22 bp, Homo sapiens
gcctgggattcccagaggggca

SEQ ID NO: 8095661 - DNA, 21 bp, Homo sapiens
gcctgggatagtggcctccgg

SEQ ID NO: 8095662 - DNA, 22 bp, Homo sapiens
gcctgggagaatgacctccaac

SEQ ID NO: 8095663 - DNA, 22 bp, Homo sapiens
gcctgggatagaggcaatgcat

SEQ ID NO: 8095664 - DNA, 22 bp, Homo sapiens
gcctgggattgtgtaagtgaat

SEQ ID NO: 8095665 - DNA, 22 bp, Homo sapiens
gctgggagtgggcaagatgaga

SEQ ID NO: 8095666 - DNA, 22 bp, Homo sapiens
gctggcctgtctagagccttac

SEQ ID NO: 8095667 - DNA, 22 bp, Homo sapiens
gctggccttgtgtctgaggaag

SEQ ID NO: 8095668 - DNA, 22 bp, Homo sapiens
gctggcctcgcaggcaggatgt

SEQ ID NO: 8095669 - DNA, 22 bp, Homo sapiens
gcagctattgtctcctgggccc

SEQ ID NO: 8095670 - DNA, 22 bp, Homo sapiens
gcaggagaacaaagcaagctgc

SEQ ID NO: 8095671 - DNA, 22 bp, Homo sapiens
gcaggagaaatgaagattgggt

SEQ ID NO: 8095672 - DNA, 22 bp, Homo sapiens
gccagcagcttcttctcatcct

SEQ ID NO: 8095673 - DNA, 22 bp, Homo sapiens
gcacaaactgcaattacttttg

SEQ ID NO: 8095674 - DNA, 22 bp, Homo sapiens
gcagaacaacgtaggagtggag

SEQ ID NO: 8095675 - DNA, 22 bp, Homo sapiens
gatggcctcatggctgcaggcc

SEQ ID NO: 8095676 - DNA, 22 bp, Homo sapiens
gagagctgggctttgggtgaag

SEQ ID NO: 8095677 - DNA, 22 bp, Homo sapiens
gagagctggattctggataggt

SEQ ID NO: 8095678 - DNA, 22 bp, Homo sapiens
gagagctgggggactgtggatg

SEQ ID NO: 8095679 - DNA, 22 bp, Homo sapiens
gagagctgatagatgagctact

SEQ ID NO: 8095680 - DNA, 22 bp, Homo sapiens
gaaggagagggtcaaggataat

SEQ ID NO: 8095681 - DNA, 22 bp, Homo sapiens
gacaggaagtctgaaggaggga

SEQ ID NO: 8095682 - DNA, 22 bp, Homo sapiens
ctggctggtcctcggggacagc

SEQ ID NO: 8095683 - DNA, 22 bp, Homo sapiens
ctggctggttactatttctggt

SEQ ID NO: 8095684 - DNA, 22 bp, Homo sapiens
gagagtctagtgcacctagttt

SEQ ID NO: 8095685 - DNA, 19 bp, Homo sapiens
ggccttgctctgtggcagc

SEQ ID NO: 8095686 - DNA, 22 bp, Homo sapiens
ggaggggtggaaggagtgcctg

SEQ ID NO: 8095687 - DNA, 22 bp, Homo sapiens
ggagtggcctctcctgtgcagg

SEQ ID NO: 8095688 - DNA, 22 bp, Homo sapiens
ggcacagcacagtggacccagg

SEQ ID NO: 8095689 - DNA, 22 bp, Homo sapiens
ggcacagcacagagcacatgta

SEQ ID NO: 8095690 - DNA, 22 bp, Homo sapiens
ggcacagcaagaagggaaatga

SEQ ID NO: 8095691 - DNA, 22 bp, Homo sapiens
ggcacagcactgtaggcctggg

SEQ ID NO: 8095692 - DNA, 22 bp, Homo sapiens
ggcacagcaccttttcacattg

SEQ ID NO: 8095693 - DNA, 22 bp, Homo sapiens
ggaaggtcgagctgcatctggc

SEQ ID NO: 8095694 - DNA, 22 bp, Homo sapiens
ggagagggtaggggtcctgccc

SEQ ID NO: 8095695 - DNA, 22 bp, Homo sapiens
ggagaggtgaatggctgctcta

SEQ ID NO: 8095696 - DNA, 22 bp, Homo sapiens
ggagaggtgcaggtcagtggca

SEQ ID NO: 8095697 - DNA, 22 bp, Homo sapiens
ggagaggtgagaggtacaagtt

SEQ ID NO: 8095698 - DNA, 22 bp, Homo sapiens
ggagaggtgtattcagtgggtc

SEQ ID NO: 8095699 - DNA, 22 bp, Homo sapiens
taaagcaggcatctctctcctc

SEQ ID NO: 8095700 - DNA, 22 bp, Homo sapiens
gttgtgaatagtgccgcaataa

SEQ ID NO: 8095701 - DNA, 22 bp, Homo sapiens
gttctgagtcctcctttgaagg

SEQ ID NO: 8095702 - DNA, 22 bp, Homo sapiens
gtgtgagcatcaaagcctgtca

SEQ ID NO: 8095703 - DNA, 22 bp, Homo sapiens
gtccttgcttgagacaggcagt

SEQ ID NO: 8095704 - DNA, 20 bp, Homo sapiens
gtctgaggagcagtgggaaa

SEQ ID NO: 8095705 - DNA, 22 bp, Homo sapiens
gtggcagctgtgggacactggt

SEQ ID NO: 8095706 - DNA, 22 bp, Homo sapiens
gtggcagctggtatgcagacag

SEQ ID NO: 8095707 - DNA, 22 bp, Homo sapiens
gtgggagaagatttggtcatct

SEQ ID NO: 8095708 - DNA, 22 bp, Homo sapiens
gtgggagaagccctgttcgtag

SEQ ID NO: 8095709 - DNA, 22 bp, Homo sapiens
gtggagaggaacccagctctgt

SEQ ID NO: 8095710 - DNA, 22 bp, Homo sapiens
tctgtctttgagatctcagcct

SEQ ID NO: 8095711 - DNA, 22 bp, Homo sapiens
tctttcagctcttcaggaccca

SEQ ID NO: 8095712 - DNA, 22 bp, Homo sapiens
tctttataaaagtcattatgtc

SEQ ID NO: 8095713 - DNA, 22 bp, Homo sapiens
tcttgggagtcccaggacatag

SEQ ID NO: 8095714 - DNA, 23 bp, Homo sapiens
tctggctttgctggaagttttga

SEQ ID NO: 8095715 - DNA, 22 bp, Homo sapiens
tctgggaggtgttttgagaact

SEQ ID NO: 8095716 - DNA, 22 bp, Homo sapiens
tctgggagttagaatacatggg

SEQ ID NO: 8095717 - DNA, 22 bp, Homo sapiens
tctgggagagcacgtggctgac

SEQ ID NO: 8095718 - DNA, 22 bp, Homo sapiens
tctgggagagggaaagaagact

SEQ ID NO: 8095719 - DNA, 22 bp, Homo sapiens
tctgggagaagctgatgtgaag

SEQ ID NO: 8095720 - DNA, 22 bp, Homo sapiens
tctcacaggtgcacgtggctgt

SEQ ID NO: 8095721 - DNA, 22 bp, Homo sapiens
tctctgggttgagaactaggac

SEQ ID NO: 8095722 - DNA, 22 bp, Homo sapiens
tccttcagcttatttcttagga

SEQ ID NO: 8095723 - DNA, 21 bp, Homo sapiens
tcgtgcagcagctgaggcttg

SEQ ID NO: 8095724 - DNA, 22 bp, Homo sapiens
tcctgggattctgcatttctaa

SEQ ID NO: 8095725 - DNA, 21 bp, Homo sapiens
tcctgggagtctgagatcctg

SEQ ID NO: 8095726 - DNA, 22 bp, Homo sapiens
tcctgggagtggccatgtaatg

SEQ ID NO: 8095727 - DNA, 22 bp, Homo sapiens
tcctgggaagagacctgagcat

SEQ ID NO: 8095728 - DNA, 22 bp, Homo sapiens
tcctgggaagttgcatcaccgt

SEQ ID NO: 8095729 - DNA, 22 bp, Homo sapiens
tcctgggaccaggcacctactg

SEQ ID NO: 8095730 - DNA, 18 bp, Homo sapiens
tcctgggaaaggcataca

SEQ ID NO: 8095731 - DNA, 22 bp, Homo sapiens
tcctgggaactcggaaagctct

SEQ ID NO: 8095732 - DNA, 18 bp, Homo sapiens
tcctgggaacttgctagc

SEQ ID NO: 8095733 - DNA, 21 bp, Homo sapiens
tgcacagccataccctccttg

SEQ ID NO: 8095734 - DNA, 20 bp, Homo sapiens
tgcacagctgtgaataggat

SEQ ID NO: 8095735 - DNA, 22 bp, Homo sapiens
tgcacagctgcctcctctctgc

SEQ ID NO: 8095736 - DNA, 22 bp, Homo sapiens
tgagtggacacctgcttcttta

SEQ ID NO: 8095737 - DNA, 22 bp, Homo sapiens
tgcctctgtgtgcaggtgagca

SEQ ID NO: 8095738 - DNA, 22 bp, Homo sapiens
tgcatgtcaaggcactcaggat

SEQ ID NO: 8095739 - DNA, 22 bp, Homo sapiens
tgcagttttgccaggcaatgga

SEQ ID NO: 8095740 - DNA, 22 bp, Homo sapiens
tgcagttttggccattgaaggc

SEQ ID NO: 8095741 - DNA, 22 bp, Homo sapiens
tgagagaggggactgcctgctt

SEQ ID NO: 8095742 - DNA, 22 bp, Homo sapiens
tgagggagtcatgattaaggaa

SEQ ID NO: 8095743 - DNA, 22 bp, Homo sapiens
tgaggtagaagcctgggttgag

SEQ ID NO: 8095744 - DNA, 22 bp, Homo sapiens
tgaagcagaggggtcttgagct

SEQ ID NO: 8095745 - DNA, 21 bp, Homo sapiens
tggctctgctcagagcagtcc

SEQ ID NO: 8095746 - DNA, 22 bp, Homo sapiens
tggctctggccaccgggagggc

SEQ ID NO: 8095747 - DNA, 23 bp, Homo sapiens
tggctctgtgtcacatacaggat

SEQ ID NO: 8095748 - DNA, 22 bp, Homo sapiens
tggctctgttcgccatcaggag

SEQ ID NO: 8095749 - DNA, 22 bp, Homo sapiens
tggccttggagaggcacggccc

SEQ ID NO: 8095750 - DNA, 22 bp, Homo sapiens
tggccttgtgtttaagcaagaa

SEQ ID NO: 8095751 - DNA, 20 bp, Homo sapiens
tggccttggggagctcacac

SEQ ID NO: 8095752 - DNA, 22 bp, Homo sapiens
tgggagagtgctcaatgtgcaa

SEQ ID NO: 8095753 - DNA, 22 bp, Homo sapiens
tgggagagtctaaaaccgaggt

SEQ ID NO: 8095754 - DNA, 19 bp, Homo sapiens
tgggagaggcaacagagta

SEQ ID NO: 8095755 - DNA, 22 bp, Homo sapiens
tgggagaggctgccatcttgca

SEQ ID NO: 8095756 - DNA, 22 bp, Homo sapiens
tggccagccttgtcatcgcttt

SEQ ID NO: 8095757 - DNA, 22 bp, Homo sapiens
tggccagcagagttcactctct

SEQ ID NO: 8095758 - DNA, 22 bp, Homo sapiens
tggccagccctcttcccacact

SEQ ID NO: 8095759 - DNA, 22 bp, Homo sapiens
tggcatggcaaccctgcaggga

SEQ ID NO: 8095760 - DNA, 21 bp, Homo sapiens
tggcatggaggtagcagtgtg

SEQ ID NO: 8095761 - DNA, 22 bp, Homo sapiens
tggcctgagttgtctgcaggcc

SEQ ID NO: 8095762 - DNA, 22 bp, Homo sapiens
tggcacagagggacccagcagc

SEQ ID NO: 8095763 - DNA, 17 bp, Homo sapiens
tggcacagaggtgctat

SEQ ID NO: 8095764 - DNA, 22 bp, Homo sapiens
tggcacagaaaaatgctccatt

SEQ ID NO: 8095765 - DNA, 22 bp, Homo sapiens
tggcagccatcagagcaggggt

SEQ ID NO: 8095766 - DNA, 22 bp, Homo sapiens
tgctcctgctgcatgcatctcc

SEQ ID NO: 8095767 - DNA, 22 bp, Homo sapiens
tggagagcgcgacgggaggaag

SEQ ID NO: 8095768 - DNA, 22 bp, Homo sapiens
tggagaggaaagtgcagttttg

SEQ ID NO: 8095769 - DNA, 22 bp, Homo sapiens
tggagaggagcaccatggccat

SEQ ID NO: 8095770 - DNA, 19 bp, Homo sapiens
tggagaggaaatgctgctc

SEQ ID NO: 8095771 - DNA, 22 bp, Homo sapiens
tggagaggtttaaacaaaagtt

SEQ ID NO: 8095772 - DNA, 22 bp, Homo sapiens
tggagaggttgaataacttgtc

SEQ ID NO: 8095773 - DNA, 22 bp, Homo sapiens
tggagcatgagagtctttagct

SEQ ID NO: 8095774 - DNA, 22 bp, Homo sapiens
tggaaggagactgggaagtgtg

SEQ ID NO: 8095775 - DNA, 22 bp, Homo sapiens
tggaaggaagccaaggaaggtt

SEQ ID NO: 8095776 - DNA, 22 bp, Homo sapiens
tggaaggaaaggtagcagagaa

SEQ ID NO: 8095777 - DNA, 22 bp, Homo sapiens
tggtttgagagtgtgagctttt

SEQ ID NO: 8095778 - DNA, 23 bp, Homo sapiens
tgtcatctccagactcccagtgc

SEQ ID NO: 8095779 - DNA, 17 bp, Homo sapiens
tggggatggttcatgag

SEQ ID NO: 8095780 - DNA, 22 bp, Homo sapiens
tgggcacaggggaatggatgaa

SEQ ID NO: 8095781 - DNA, 22 bp, Homo sapiens
tgggcacaggggtaggaatgag

SEQ ID NO: 8095782 - DNA, 20 bp, Homo sapiens
tgggattgttttttagcttc

SEQ ID NO: 8095783 - DNA, 22 bp, Homo sapiens
tgggcacagaatagatggccca

SEQ ID NO: 8095784 - DNA, 22 bp, Homo sapiens
tgggcacaaacatctgcctgtt

SEQ ID NO: 8095785 - DNA, 22 bp, Homo sapiens
ttcaccctggaccagaaattgg

SEQ ID NO: 8095786 - DNA, 22 bp, Homo sapiens
ttcagcaggtggtgagttctgc

SEQ ID NO: 8095787 - DNA, 21 bp, Homo sapiens
ttcagcttatgtgtcacttgc

SEQ ID NO: 8095788 - DNA, 22 bp, Homo sapiens
ttcagcttcatttgtctttatg

SEQ ID NO: 8095789 - DNA, 22 bp, Homo sapiens
ttcagcttgaatctggctttga

SEQ ID NO: 8095790 - DNA, 22 bp, Homo sapiens
tgtctgtggcaattgtgggtaa

SEQ ID NO: 8095791 - DNA, 22 bp, Homo sapiens
tgtcttttacctaatgagctgg

SEQ ID NO: 8095792 - DNA, 22 bp, Homo sapiens
tgtcttttggagcatctttctt

SEQ ID NO: 8095793 - DNA, 22 bp, Homo sapiens
tgtggggaagagtatgacttgg

SEQ ID NO: 8095794 - DNA, 22 bp, Homo sapiens
tgtgggaggtctggaaggctcc

SEQ ID NO: 8095795 - DNA, 22 bp, Homo sapiens
tgtgtggcaagctgtatgctag

SEQ ID NO: 8095796 - DNA, 22 bp, Homo sapiens
aaagaactacctgtatgatatt

SEQ ID NO: 8095797 - DNA, 22 bp, Homo sapiens
aaagaactcagagaggatttta

SEQ ID NO: 8095798 - DNA, 22 bp, Homo sapiens
aaatggcaggctctttgctagt

SEQ ID NO: 8095799 - DNA, 22 bp, Homo sapiens
agagtctgtgctttcatcagga

SEQ ID NO: 8095800 - DNA, 22 bp, Homo sapiens
agagtctgcctttttctcctgc

SEQ ID NO: 8095801 - DNA, 19 bp, Homo sapiens
agagtctgtgctcttccta

SEQ ID NO: 8095802 - DNA, 22 bp, Homo sapiens
acagaacaggctgagaaaaaca

SEQ ID NO: 8095803 - DNA, 18 bp, Homo sapiens
acatacattctgtctgca

SEQ ID NO: 8095804 - DNA, 20 bp, Homo sapiens
acctgggaaaaccttttcct

SEQ ID NO: 8095805 - DNA, 22 bp, Homo sapiens
acctgggagtatgcagtggtga

SEQ ID NO: 8095806 - DNA, 22 bp, Homo sapiens
acctgggatggggccaggttta

SEQ ID NO: 8095807 - DNA, 22 bp, Homo sapiens
acctgggaggcagaggttgcag

SEQ ID NO: 8095808 - DNA, 22 bp, Homo sapiens
acctgggaggcggaggttgcag

SEQ ID NO: 8095809 - DNA, 22 bp, Homo sapiens
agagtctgatatttgtaccaga

SEQ ID NO: 8095810 - DNA, 22 bp, Homo sapiens
agaggctggattgagcatagac

SEQ ID NO: 8095811 - DNA, 22 bp, Homo sapiens
aggaggggttctcgggtgctga

SEQ ID NO: 8095812 - DNA, 22 bp, Homo sapiens
acatacatcaagtatcacaaga

SEQ ID NO: 8095813 - DNA, 22 bp, Homo sapiens
aggaaggagggcagatattaag

SEQ ID NO: 8095814 - DNA, 23 bp, Homo sapiens
aggaaggaggtcctaacagtatc

SEQ ID NO: 8095815 - DNA, 22 bp, Homo sapiens
agctgtggtgttttcaagccct

SEQ ID NO: 8095816 - DNA, 22 bp, Homo sapiens
agctggctatgccctgtgaacc

SEQ ID NO: 8095817 - DNA, 21 bp, Homo sapiens
agctggctctctctggagaga

SEQ ID NO: 8095818 - DNA, 22 bp, Homo sapiens
acatctttgctcttatagagct

SEQ ID NO: 8095819 - DNA, 22 bp, Homo sapiens
acatacatggtgctttcttggt

SEQ ID NO: 8095820 - DNA, 22 bp, Homo sapiens
acatacatgtaaaggaaattat

SEQ ID NO: 8095821 - DNA, 22 bp, Homo sapiens
agaaggagtgtacaggtcatgc

SEQ ID NO: 8095822 - DNA, 22 bp, Homo sapiens
aggtgactggtttatctggcag

SEQ ID NO: 8095823 - DNA, 22 bp, Homo sapiens
agtgatggggccctgcactgat

SEQ ID NO: 8095824 - DNA, 22 bp, Homo sapiens
aggtcctgggagttctagtgtg

SEQ ID NO: 8095825 - DNA, 20 bp, Homo sapiens
aggtcctggttctctgggat

SEQ ID NO: 8095826 - DNA, 18 bp, Homo sapiens
ctgggtctccaggctgcc

SEQ ID NO: 8095827 - DNA, 22 bp, Homo sapiens
atctgtggctggtgagaggcag

SEQ ID NO: 8095828 - DNA, 22 bp, Homo sapiens
atctgtggcgcaaacaaaggct

SEQ ID NO: 8095829 - DNA, 22 bp, Homo sapiens
atctgtctatgtggctatgtat

SEQ ID NO: 8095830 - DNA, 22 bp, Homo sapiens
caggtcctcgggggaggccggc

SEQ ID NO: 8095831 - DNA, 22 bp, Homo sapiens
caggtcctgcagggagagtaaa

SEQ ID NO: 8095832 - DNA, 22 bp, Homo sapiens
caggtcctggcatcaggcaggt

SEQ ID NO: 8095833 - DNA, 20 bp, Homo sapiens
aggaaggagaatctgagcaa

SEQ ID NO: 8095834 - DNA, 22 bp, Homo sapiens
agcttctgttcatcttccaggc

SEQ ID NO: 8095835 - DNA, 22 bp, Homo sapiens
ccagctggcccagctgtgctcc

SEQ ID NO: 8095836 - DNA, 22 bp, Homo sapiens
ccctcaccaggctccaggcatg

SEQ ID NO: 8095837 - DNA, 22 bp, Homo sapiens
atgtcaccttcggtggcacggt

SEQ ID NO: 8095838 - DNA, 22 bp, Homo sapiens
gagcagggagacaactctggtg

SEQ ID NO: 8095839 - DNA, 22 bp, Homo sapiens
gagcaggtgcctgtagctctct

SEQ ID NO: 8095840 - DNA, 22 bp, Homo sapiens
gagaggctgactggctgtcctg

SEQ ID NO: 8095841 - DNA, 22 bp, Homo sapiens
cagcaggtggacacactcacct

SEQ ID NO: 8095842 - DNA, 19 bp, Homo sapiens
gctgggagcagaccctccc

SEQ ID NO: 8095843 - DNA, 22 bp, Homo sapiens
gctgggagcaaagccatgcata

SEQ ID NO: 8095844 - DNA, 22 bp, Homo sapiens
gctgggagccgtacctgtcacg

SEQ ID NO: 8095845 - DNA, 22 bp, Homo sapiens
gctgggagccctggtctgctcc

SEQ ID NO: 8095846 - DNA, 22 bp, Homo sapiens
ggagagctgacatcatgatgtt

SEQ ID NO: 8095847 - DNA, 22 bp, Homo sapiens
ggagaggttatccgtgttatgt

SEQ ID NO: 8095848 - DNA, 22 bp, Homo sapiens
ggagagttgtttttgcctagat

SEQ ID NO: 8095849 - DNA, 22 bp, Homo sapiens
cacaggagagctgggaggtgcc

SEQ ID NO: 8095850 - DNA, 22 bp, Homo sapiens
cacagccctgcgccccagtttg

SEQ ID NO: 8095851 - DNA, 22 bp, Homo sapiens
tagtgtggtaaataaatgtttt

SEQ ID NO: 8095852 - DNA, 22 bp, Homo sapiens
tcaaatgctgcctttgtgtgcc

SEQ ID NO: 8095853 - DNA, 22 bp, Homo sapiens
gtggagcaggactagctgagaa

SEQ ID NO: 8095854 - DNA, 22 bp, Homo sapiens
tcatacataaataagagtttag

SEQ ID NO: 8095855 - DNA, 22 bp, Homo sapiens
ccagaggtcctgctcactggtg

SEQ ID NO: 8095856 - DNA, 22 bp, Homo sapiens
cctgcctatgagacgttttgcc

SEQ ID NO: 8095857 - DNA, 22 bp, Homo sapiens
tggggagaagcaatagactcta

SEQ ID NO: 8095858 - DNA, 22 bp, Homo sapiens
tggggagaaatgtctttgttcc

SEQ ID NO: 8095859 - DNA, 22 bp, Homo sapiens
cctgagtggagggattctgcag

SEQ ID NO: 8095860 - DNA, 22 bp, Homo sapiens
tggggagaggtatcattgagat

SEQ ID NO: 8095861 - DNA, 22 bp, Homo sapiens
tggcttggctaagatctaagct

SEQ ID NO: 8095862 - DNA, 22 bp, Homo sapiens
tgggagagaattctggtgactg

SEQ ID NO: 8095863 - DNA, 22 bp, Homo sapiens
tcttgcacttcatgaatatgtt

SEQ ID NO: 8095864 - DNA, 22 bp, Homo sapiens
tgagcagtaacagctcacaggg

SEQ ID NO: 8095865 - DNA, 22 bp, Homo sapiens
ctgtgctttcgagatgtgatct

SEQ ID NO: 8095866 - DNA, 21 bp, Homo sapiens
ctgtgctttttaagtgtgatg

SEQ ID NO: 8095867 - DNA, 22 bp, Homo sapiens
ctgtgcttgtgttcattgttaa

SEQ ID NO: 8095868 - DNA, 22 bp, Homo sapiens
ctgtgcttgcgggtgtggagcc

SEQ ID NO: 8095869 - DNA, 22 bp, Homo sapiens
ctgtgcttcagagtcagtgctg

SEQ ID NO: 8095870 - DNA, 22 bp, Homo sapiens
gagcagttgggctctaggaagt

SEQ ID NO: 8095871 - DNA, 22 bp, Homo sapiens
gaggcagttcctgagtgacaag

SEQ ID NO: 8095872 - DNA, 19 bp, Homo sapiens
gaggcagtagtcaaagctt

SEQ ID NO: 8095873 - DNA, 22 bp, Homo sapiens
gaggcagtggtctgatgcaagg

SEQ ID NO: 8095874 - DNA, 22 bp, Homo sapiens
gagggagtaacgtactacagtg

SEQ ID NO: 8095875 - DNA, 22 bp, Homo sapiens
gaaggtccagcgtggccaagtc

SEQ ID NO: 8095876 - DNA, 22 bp, Homo sapiens
gactctgtgggaggaggctcag

SEQ ID NO: 8095877 - DNA, 22 bp, Homo sapiens
tttctctcagcctgtagaaact

SEQ ID NO: 8095878 - DNA, 22 bp, Homo sapiens
tgtttcttctcacacaaactca

SEQ ID NO: 8095879 - DNA, 22 bp, Homo sapiens
ttgcactccagcccgagcaaca

SEQ ID NO: 8095880 - DNA, 22 bp, Homo sapiens
gggcacagtactccaatcaact

SEQ ID NO: 8095881 - DNA, 22 bp, Homo sapiens
gggcacaggagaaggatctggc

SEQ ID NO: 8095882 - DNA, 22 bp, Homo sapiens
gggcacagtctgcagcccccca

SEQ ID NO: 8095883 - DNA, 22 bp, Homo sapiens
gggcacagtctaaagttgggcc

SEQ ID NO: 8095884 - DNA, 22 bp, Homo sapiens
gggcactgctggaggctccctg

SEQ ID NO: 8095885 - DNA, 22 bp, Homo sapiens
ggcatcagggtaggaaggtatc

SEQ ID NO: 8095886 - DNA, 22 bp, Homo sapiens
ggcctggagtcagggaaagcaa

SEQ ID NO: 8095887 - DNA, 23 bp, Homo sapiens
ggatggacgtgatgccttagcca

SEQ ID NO: 8095888 - DNA, 22 bp, Homo sapiens
gtgaggtggtacaatattaact

SEQ ID NO: 8095889 - DNA, 22 bp, Homo sapiens
ggtgggatcaaagagtcattcg

SEQ ID NO: 8095890 - DNA, 23 bp, Homo sapiens
ggtgggagattatccagaattat

SEQ ID NO: 8095891 - DNA, 22 bp, Homo sapiens
ggtctgtgctctggagcctctg

SEQ ID NO: 8095892 - DNA, 22 bp, Homo sapiens
gcacagccactgagtgagaacc

SEQ ID NO: 8095893 - DNA, 22 bp, Homo sapiens
gcacagccacgtaatgtggtca

SEQ ID NO: 8095894 - DNA, 22 bp, Homo sapiens
gcacagccagcatctgagggat

SEQ ID NO: 8095895 - DNA, 22 bp, Homo sapiens
gcacagccctgagcgcatgtct

SEQ ID NO: 8095896 - DNA, 22 bp, Homo sapiens
gcacagccctggtcggggcccc

SEQ ID NO: 8095897 - DNA, 22 bp, Homo sapiens
gcacagccggaccgaggaaaag

SEQ ID NO: 8095898 - DNA, 22 bp, Homo sapiens
gcacagcctgtccctgtcctgg

SEQ ID NO: 8095899 - DNA, 22 bp, Homo sapiens
gcacagccttgccctgtgccct

SEQ ID NO: 8095900 - DNA, 22 bp, Homo sapiens
gctgggagaggcagctttcgga

SEQ ID NO: 8095901 - DNA, 22 bp, Homo sapiens
gctgggagaggccctgaagtga

SEQ ID NO: 8095902 - DNA, 22 bp, Homo sapiens
gctgggaggcagcacctttagc

SEQ ID NO: 8095903 - DNA, 16 bp, Homo sapiens
gctgggagggagaggt

SEQ ID NO: 8095904 - DNA, 22 bp, Homo sapiens
gctgtcttgatgattggatgct

SEQ ID NO: 8095905 - DNA, 22 bp, Homo sapiens
ggaaagtggtggtggaaagagg

SEQ ID NO: 8095906 - DNA, 22 bp, Homo sapiens
ggagaggcgatgagtcacagcc

SEQ ID NO: 8095907 - DNA, 22 bp, Homo sapiens
tacatacaagcattcaatttta

SEQ ID NO: 8095908 - DNA, 22 bp, Homo sapiens
tacatacacaaatatactgttt

SEQ ID NO: 8095909 - DNA, 22 bp, Homo sapiens
tcatccagcctcatcaggagct

SEQ ID NO: 8095910 - DNA, 20 bp, Homo sapiens
tcatccaggacaggagtggc

SEQ ID NO: 8095911 - DNA, 23 bp, Homo sapiens
tcacacagctggtcaggtacaga

SEQ ID NO: 8095912 - DNA, 22 bp, Homo sapiens
tcacagcctggtcactctgccc

SEQ ID NO: 8095913 - DNA, 22 bp, Homo sapiens
tcacagcctggacagttgcctg

SEQ ID NO: 8095914 - DNA, 22 bp, Homo sapiens
ttttggctctgtctgtatcttt

SEQ ID NO: 8095915 - DNA, 22 bp, Homo sapiens
ttggggtacgcaggtctgggag

SEQ ID NO: 8095916 - DNA, 23 bp, Homo sapiens
aaatgcacagtattgatttttaa

SEQ ID NO: 8095917 - DNA, 22 bp, Homo sapiens
aaatgcactgaacacatgttgt

SEQ ID NO: 8095918 - DNA, 22 bp, Homo sapiens
aaggtcctgtagccacagagcc

SEQ ID NO: 8095919 - DNA, 22 bp, Homo sapiens
aaggtccttttgcagtgtgatc

SEQ ID NO: 8095920 - DNA, 22 bp, Homo sapiens
acagcaggcacacaaggataga

SEQ ID NO: 8095921 - DNA, 22 bp, Homo sapiens
agaggtcttttggtctgcagaa

SEQ ID NO: 8095922 - DNA, 22 bp, Homo sapiens
agagctgttaattttgcactgg

SEQ ID NO: 8095923 - DNA, 22 bp, Homo sapiens
agagctgtttggacatctgagt

SEQ ID NO: 8095924 - DNA, 22 bp, Homo sapiens
agagcctgggaatttgcatgtt

SEQ ID NO: 8095925 - DNA, 22 bp, Homo sapiens
agagcctgtacttttctgtgaa

SEQ ID NO: 8095926 - DNA, 22 bp, Homo sapiens
agagcctgtgattgtcatcacc

SEQ ID NO: 8095927 - DNA, 19 bp, Homo sapiens
agccagaactagtgtttct

SEQ ID NO: 8095928 - DNA, 22 bp, Homo sapiens
agccagaaaggggcattatctg

SEQ ID NO: 8095929 - DNA, 22 bp, Homo sapiens
agcatatacaaactcatataca

SEQ ID NO: 8095930 - DNA, 22 bp, Homo sapiens
cagaggtccctgttcttaagga

SEQ ID NO: 8095931 - DNA, 22 bp, Homo sapiens
agcctctgctggccctggcact

SEQ ID NO: 8095932 - DNA, 20 bp, Homo sapiens
agcctctgcccttcccactg

SEQ ID NO: 8095933 - DNA, 22 bp, Homo sapiens
agcctctgtcaagcttttcaaa

SEQ ID NO: 8095934 - DNA, 22 bp, Homo sapiens
agcagggggcatccttgccctt

SEQ ID NO: 8095935 - DNA, 22 bp, Homo sapiens
actttcctagacttcagtgaca

SEQ ID NO: 8095936 - DNA, 22 bp, Homo sapiens
aggtcctgtcttatctctgtaa

SEQ ID NO: 8095937 - DNA, 22 bp, Homo sapiens
aggtctctgagtactgctggac

SEQ ID NO: 8095938 - DNA, 22 bp, Homo sapiens
acggcttcttgactgtgggttg

SEQ ID NO: 8095939 - DNA, 22 bp, Homo sapiens
agtggcagtagatgagctggtt

SEQ ID NO: 8095940 - DNA, 22 bp, Homo sapiens
actctgtgttttggtggcagca

SEQ ID NO: 8095941 - DNA, 22 bp, Homo sapiens
agggagagacatttccttcttg

SEQ ID NO: 8095942 - DNA, 18 bp, Homo sapiens
agggagagaccgcgggtc

SEQ ID NO: 8095943 - DNA, 22 bp, Homo sapiens
agggagaggagggtcttgttga

SEQ ID NO: 8095944 - DNA, 22 bp, Homo sapiens
acatgtttggctctatgctata

SEQ ID NO: 8095945 - DNA, 22 bp, Homo sapiens
acatagagttcaattttcagtc

SEQ ID NO: 8095946 - DNA, 22 bp, Homo sapiens
caggtcctttagtgtccagaac

SEQ ID NO: 8095947 - DNA, 22 bp, Homo sapiens
caggccagcagggcctccgtgg

SEQ ID NO: 8095948 - DNA, 18 bp, Homo sapiens
agctggccctggctgccg

SEQ ID NO: 8095949 - DNA, 22 bp, Homo sapiens
agctggccattgtgagtggcct

SEQ ID NO: 8095950 - DNA, 22 bp, Homo sapiens
agctgctgagccatgtcctgct

SEQ ID NO: 8095951 - DNA, 22 bp, Homo sapiens
agctgattccactttttcccca

SEQ ID NO: 8095952 - DNA, 22 bp, Homo sapiens
caggaaggcgcggctgtgcctg

SEQ ID NO: 8095953 - DNA, 22 bp, Homo sapiens
caggaaggcccacctgtcctgt

SEQ ID NO: 8095954 - DNA, 22 bp, Homo sapiens
caggaaggggctcactctggcc

SEQ ID NO: 8095955 - DNA, 22 bp, Homo sapiens
ccatgggaattgggaggtccca

SEQ ID NO: 8095956 - DNA, 22 bp, Homo sapiens
agtttcttgaagactgatgttt

SEQ ID NO: 8095957 - DNA, 22 bp, Homo sapiens
agtttcatattaccatgtcacc

SEQ ID NO: 8095958 - DNA, 22 bp, Homo sapiens
atccttcaaaaggaatagcagg

SEQ ID NO: 8095959 - DNA, 22 bp, Homo sapiens
cttcagagaacttgatcgctgc

SEQ ID NO: 8095960 - DNA, 22 bp, Homo sapiens
agtgggagagaagcaagtagta

SEQ ID NO: 8095961 - DNA, 22 bp, Homo sapiens
ctctctggtacatagagtttgg

SEQ ID NO: 8095962 - DNA, 22 bp, Homo sapiens
cgcggtggcggcctccagcgcc

SEQ ID NO: 8095963 - DNA, 22 bp, Homo sapiens
agtcagttgcaaacatcaggca

SEQ ID NO: 8095964 - DNA, 22 bp, Homo sapiens
agtcagttaacctcacagcatc

SEQ ID NO: 8095965 - DNA, 23 bp, Homo sapiens
aggttcaggagatggaggaacaa

SEQ ID NO: 8095966 - DNA, 22 bp, Homo sapiens
cctggccttaagggcagggagc

SEQ ID NO: 8095967 - DNA, 22 bp, Homo sapiens
aggtcctgtccttggtctctga

SEQ ID NO: 8095968 - DNA, 22 bp, Homo sapiens
aggtctcttgctgtctctgggc

SEQ ID NO: 8095969 - DNA, 22 bp, Homo sapiens
attgcactccagcctgggggac

SEQ ID NO: 8095970 - DNA, 22 bp, Homo sapiens
attgcactccagcctgggtgac

SEQ ID NO: 8095971 - DNA, 22 bp, Homo sapiens
attgcactccggcctgggtgac

SEQ ID NO: 8095972 - DNA, 21 bp, Homo sapiens
gccagctgcagggcttccttg

SEQ ID NO: 8095973 - DNA, 20 bp, Homo sapiens
gccagctgcccttccaccct

SEQ ID NO: 8095974 - DNA, 22 bp, Homo sapiens
ctttattagatgtagactttct

SEQ ID NO: 8095975 - DNA, 22 bp, Homo sapiens
ggggccttggatctgtgccccg

SEQ ID NO: 8095976 - DNA, 22 bp, Homo sapiens
gctgccctgtctgcagcaggac

SEQ ID NO: 8095977 - DNA, 22 bp, Homo sapiens
gctggactcaggggactcaggg

SEQ ID NO: 8095978 - DNA, 22 bp, Homo sapiens
ggagaaggtgctggtcactgtg

SEQ ID NO: 8095979 - DNA, 22 bp, Homo sapiens
cactgcaacctccacctcctgg

SEQ ID NO: 8095980 - DNA, 22 bp, Homo sapiens
cactgcaacctccacctcctgg

SEQ ID NO: 8095981 - DNA, 20 bp, Homo sapiens
tcacaggagggaaggcaggt

SEQ ID NO: 8095982 - DNA, 18 bp, Homo sapiens
tcatgaggtagaggctgg

SEQ ID NO: 8095983 - DNA, 22 bp, Homo sapiens
tctctgggaattcacaagccct

SEQ ID NO: 8095984 - DNA, 22 bp, Homo sapiens
ccagcagggttggtttcttctg

SEQ ID NO: 8095985 - DNA, 19 bp, Homo sapiens
ccagcaggttcatttcagg

SEQ ID NO: 8095986 - DNA, 22 bp, Homo sapiens
tgaggcagtgatgtttaagcac

SEQ ID NO: 8095987 - DNA, 22 bp, Homo sapiens
ccgggcctcgggacaccgggta

SEQ ID NO: 8095988 - DNA, 21 bp, Homo sapiens
tgggagagcgttgctgtcctc

SEQ ID NO: 8095989 - DNA, 22 bp, Homo sapiens
ttatcagttgtgtgtatacacg

SEQ ID NO: 8095990 - DNA, 22 bp, Homo sapiens
cggagaggacctgcaactcgct

SEQ ID NO: 8095991 - DNA, 22 bp, Homo sapiens
cggagaggtgggggcagcatct

SEQ ID NO: 8095992 - DNA, 22 bp, Homo sapiens
cggcacagccgggcaaggctgg

SEQ ID NO: 8095993 - DNA, 22 bp, Homo sapiens
ctataagacagatactgacttt

SEQ ID NO: 8095994 - DNA, 22 bp, Homo sapiens
ctgtgggcgcctgtcagcctca

SEQ ID NO: 8095995 - DNA, 22 bp, Homo sapiens
ctgtgggcctagtctggcctag

SEQ ID NO: 8095996 - DNA, 22 bp, Homo sapiens
ctgtgggcatttgagtgtgggt

SEQ ID NO: 8095997 - DNA, 22 bp, Homo sapiens
ctgtgggctgaaagtgctcccg

SEQ ID NO: 8095998 - DNA, 18 bp, Homo sapiens
ctgtgggctggtgcatga

SEQ ID NO: 8095999 - DNA, 22 bp, Homo sapiens
ctgggatgatagtgctagtatt

SEQ ID NO: 8096000 - DNA, 22 bp, Homo sapiens
cttcccttctgtgcagggcaga

SEQ ID NO: 8096001 - DNA, 22 bp, Homo sapiens
cttctgtagccagtaacatata

SEQ ID NO: 8096002 - DNA, 22 bp, Homo sapiens
cttggactttagtctctctcca

SEQ ID NO: 8096003 - DNA, 22 bp, Homo sapiens
gaggagagaagctaacggtgct

SEQ ID NO: 8096004 - DNA, 22 bp, Homo sapiens
gaggtcctctgtgtccgcgggc

SEQ ID NO: 8096005 - DNA, 22 bp, Homo sapiens
gagagctgtaatagtcatgtct

SEQ ID NO: 8096006 - DNA, 22 bp, Homo sapiens
taaagcagccagggtctaagcc

SEQ ID NO: 8096007 - DNA, 22 bp, Homo sapiens
gtttattaactgtcaagtgatt

SEQ ID NO: 8096008 - DNA, 22 bp, Homo sapiens
tcatacatctgtcctggagctc

SEQ ID NO: 8096009 - DNA, 22 bp, Homo sapiens
tcagtctcatcaactctattcc

SEQ ID NO: 8096010 - DNA, 22 bp, Homo sapiens
tcaaatgcacctctcatttgtt

SEQ ID NO: 8096011 - DNA, 22 bp, Homo sapiens
tcactgcaacctccacctcccg

SEQ ID NO: 8096012 - DNA, 22 bp, Homo sapiens
tcactgcaacctccacctcctg

SEQ ID NO: 8096013 - DNA, 22 bp, Homo sapiens
tcagcagggaggctctgtgccc

SEQ ID NO: 8096014 - DNA, 22 bp, Homo sapiens
tcagcaggcccatcctccaggc

SEQ ID NO: 8096015 - DNA, 22 bp, Homo sapiens
tcagattttccagcctttctct

SEQ ID NO: 8096016 - DNA, 22 bp, Homo sapiens
tcagatttgaatattcctttcg

SEQ ID NO: 8096017 - DNA, 19 bp, Homo sapiens
tccctcagtctgccaggcc

SEQ ID NO: 8096018 - DNA, 22 bp, Homo sapiens
tccctcagtccctggacaggca

SEQ ID NO: 8096019 - DNA, 22 bp, Homo sapiens
tccctctggtcctcggtggaga

SEQ ID NO: 8096020 - DNA, 21 bp, Homo sapiens
tccagggaatttcaactttta

SEQ ID NO: 8096021 - DNA, 22 bp, Homo sapiens
gccagctggctgcaggtcccag

SEQ ID NO: 8096022 - DNA, 22 bp, Homo sapiens
gccagctgttcagacattcttt

SEQ ID NO: 8096023 - DNA, 22 bp, Homo sapiens
gcagttttattatgatggaaat

SEQ ID NO: 8096024 - DNA, 22 bp, Homo sapiens
gctggccacagatccccaggga

SEQ ID NO: 8096025 - DNA, 22 bp, Homo sapiens
gctgtctggaggctctgaggga

SEQ ID NO: 8096026 - DNA, 22 bp, Homo sapiens
gctagctttataatgctgggcg

SEQ ID NO: 8096027 - DNA, 22 bp, Homo sapiens
gtcaccctgctgtttgtccatt

SEQ ID NO: 8096028 - DNA, 22 bp, Homo sapiens
gtcaccctgctggctgttcagc

SEQ ID NO: 8096029 - DNA, 22 bp, Homo sapiens
gtcactttattaattttggtga

SEQ ID NO: 8096030 - DNA, 22 bp, Homo sapiens
gtcctctggcctttcccaggac

SEQ ID NO: 8096031 - DNA, 22 bp, Homo sapiens
gggccggagctgggtcccgcgc

SEQ ID NO: 8096032 - DNA, 21 bp, Homo sapiens
gggcagaggggcctcctgggt

SEQ ID NO: 8096033 - DNA, 18 bp, Homo sapiens
ggcctctggactggcagc

SEQ ID NO: 8096034 - DNA, 18 bp, Homo sapiens
ttcagcagcagacacact

SEQ ID NO: 8096035 - DNA, 22 bp, Homo sapiens
tttcagagctctaggctctcag

SEQ ID NO: 8096036 - DNA, 22 bp, Homo sapiens
tttcagagaactgagtccttgc

SEQ ID NO: 8096037 - DNA, 22 bp, Homo sapiens
tttcagagaggcttcaaatctt

SEQ ID NO: 8096038 - DNA, 22 bp, Homo sapiens
tttcagagaattagaagctgat

SEQ ID NO: 8096039 - DNA, 22 bp, Homo sapiens
tttcagagatgcagaattcagg

SEQ ID NO: 8096040 - DNA, 22 bp, Homo sapiens
tttcagagcctttatctctcta

SEQ ID NO: 8096041 - DNA, 17 bp, Homo sapiens
acacagccaggttctcc

SEQ ID NO: 8096042 - DNA, 20 bp, Homo sapiens
aaagcagtatgcaagtagag

SEQ ID NO: 8096043 - DNA, 22 bp, Homo sapiens
aaagcagtctcagacttaagca

SEQ ID NO: 8096044 - DNA, 22 bp, Homo sapiens
aaagcagtataagtaacggaag

SEQ ID NO: 8096045 - DNA, 22 bp, Homo sapiens
aaagcagtatagtggaagggct

SEQ ID NO: 8096046 - DNA, 22 bp, Homo sapiens
aaatgcacaggagaaccaattc

SEQ ID NO: 8096047 - DNA, 22 bp, Homo sapiens
aaatgcacaaagattttgcact

SEQ ID NO: 8096048 - DNA, 22 bp, Homo sapiens
aagctgttgttcatcctgaatt

SEQ ID NO: 8096049 - DNA, 22 bp, Homo sapiens
aatagcataagatgtcaaatag

SEQ ID NO: 8096050 - DNA, 22 bp, Homo sapiens
aatagcatagagttaaaatgca

SEQ ID NO: 8096051 - DNA, 22 bp, Homo sapiens
aagtgtgggaagtaggtggcga

SEQ ID NO: 8096052 - DNA, 21 bp, Homo sapiens
agagactgtcactgcagtacc

SEQ ID NO: 8096053 - DNA, 22 bp, Homo sapiens
atctgttgtttgtttgctaaag

SEQ ID NO: 8096054 - DNA, 22 bp, Homo sapiens
agagaacagcattgcagctttg

SEQ ID NO: 8096055 - DNA, 22 bp, Homo sapiens
caaggaagttttaggagaggaa

SEQ ID NO: 8096056 - DNA, 22 bp, Homo sapiens
cagctgggtggctcttctgctc

SEQ ID NO: 8096057 - DNA, 22 bp, Homo sapiens
cagctggcagccctggccctgc

SEQ ID NO: 8096058 - DNA, 22 bp, Homo sapiens
agttaataatggaaagacacat

SEQ ID NO: 8096059 - DNA, 20 bp, Homo sapiens
agtgggagagggcagactgc

SEQ ID NO: 8096060 - DNA, 22 bp, Homo sapiens
agtgggagccagcagcttgggg

SEQ ID NO: 8096061 - DNA, 22 bp, Homo sapiens
actcacagtccctgtaggagtg

SEQ ID NO: 8096062 - DNA, 22 bp, Homo sapiens
atagcatataagttataaaact

SEQ ID NO: 8096063 - DNA, 22 bp, Homo sapiens
acatatatgtaaagtactttgt

SEQ ID NO: 8096064 - DNA, 22 bp, Homo sapiens
aggcacagcacacctggccccc

SEQ ID NO: 8096065 - DNA, 22 bp, Homo sapiens
agggcacaggctccgggtccag

SEQ ID NO: 8096066 - DNA, 22 bp, Homo sapiens
cagtgtggtgtgcacagcttag

SEQ ID NO: 8096067 - DNA, 22 bp, Homo sapiens
cataacattgagcagcattcct

SEQ ID NO: 8096068 - DNA, 22 bp, Homo sapiens
catacaatcaagttctttatta

SEQ ID NO: 8096069 - DNA, 22 bp, Homo sapiens
cgggcacacacttgacaggttc

SEQ ID NO: 8096070 - DNA, 22 bp, Homo sapiens
ggtcattgaaatcagaagggtt

SEQ ID NO: 8096071 - DNA, 22 bp, Homo sapiens
gggcagcagcaggaggtctctg

SEQ ID NO: 8096072 - DNA, 22 bp, Homo sapiens
gtctgtggcaggggagaagttt

SEQ ID NO: 8096073 - DNA, 22 bp, Homo sapiens
cagcaggacatggaggagtaaa

SEQ ID NO: 8096074 - DNA, 22 bp, Homo sapiens
ggcatcaggatctgtcttgctt

SEQ ID NO: 8096075 - DNA, 22 bp, Homo sapiens
cacttttaacaggagaattccc

SEQ ID NO: 8096076 - DNA, 18 bp, Homo sapiens
ggcctgaggatttcagca

SEQ ID NO: 8096077 - DNA, 22 bp, Homo sapiens
cacaggagaaaggggaagctcg

SEQ ID NO: 8096078 - DNA, 22 bp, Homo sapiens
cacagaggactgtagcggggag

SEQ ID NO: 8096079 - DNA, 22 bp, Homo sapiens
ctttcccttagccccattctat

SEQ ID NO: 8096080 - DNA, 22 bp, Homo sapiens
attgtgaatagtgccgcagtaa

SEQ ID NO: 8096081 - DNA, 19 bp, Homo sapiens
tggctctgtcgaaggcaca

SEQ ID NO: 8096082 - DNA, 22 bp, Homo sapiens
tctgggagatccaagcagaact

SEQ ID NO: 8096083 - DNA, 22 bp, Homo sapiens
tctgggagcacacgcagtgatc

SEQ ID NO: 8096084 - DNA, 22 bp, Homo sapiens
tctgggagcagctcagcagatt

SEQ ID NO: 8096085 - DNA, 22 bp, Homo sapiens
tgaggcagatatttattgggtt

SEQ ID NO: 8096086 - DNA, 22 bp, Homo sapiens
tcagcagggtttgacttctaat

SEQ ID NO: 8096087 - DNA, 22 bp, Homo sapiens
cagttttggtcctttctaggta

SEQ ID NO: 8096088 - DNA, 22 bp, Homo sapiens
tcctgggagcccttgctccacc

SEQ ID NO: 8096089 - DNA, 22 bp, Homo sapiens
tcctgggagcacatggtcctgc

SEQ ID NO: 8096090 - DNA, 22 bp, Homo sapiens
tcctgggactttcaaggctagg

SEQ ID NO: 8096091 - DNA, 22 bp, Homo sapiens
tttcctcacacagaagatcttg

SEQ ID NO: 8096092 - DNA, 20 bp, Homo sapiens
ctgagccaactctcttcttg

SEQ ID NO: 8096093 - DNA, 22 bp, Homo sapiens
cgccggcttgaggcaggcggca

SEQ ID NO: 8096094 - DNA, 22 bp, Homo sapiens
ctggccactgattcctcccctg

SEQ ID NO: 8096095 - DNA, 22 bp, Homo sapiens
ctggcagcccaacctagagtct

SEQ ID NO: 8096096 - DNA, 22 bp, Homo sapiens
ctggcagcttcaggacactcgg

SEQ ID NO: 8096097 - DNA, 22 bp, Homo sapiens
ctggcttgttttaagaatacaa

SEQ ID NO: 8096098 - DNA, 22 bp, Homo sapiens
ctgggcaggagggctctatgga

SEQ ID NO: 8096099 - DNA, 22 bp, Homo sapiens
ctgttcacagaatcctcccctg

SEQ ID NO: 8096100 - DNA, 22 bp, Homo sapiens
cttgtagaattgaaatggtctc

SEQ ID NO: 8096101 - DNA, 22 bp, Homo sapiens
gaaatgcataatcttagtagat

SEQ ID NO: 8096102 - DNA, 22 bp, Homo sapiens
gaagagctggaatccagtctgg

SEQ ID NO: 8096103 - DNA, 22 bp, Homo sapiens
gagaggccatggctgtgcagtg

SEQ ID NO: 8096104 - DNA, 22 bp, Homo sapiens
ggtccttgggtctcctgtgttt

SEQ ID NO: 8096105 - DNA, 22 bp, Homo sapiens
gggagaggttacccgagcaact

SEQ ID NO: 8096106 - DNA, 22 bp, Homo sapiens
gggcacaggaatttgggatgtg

SEQ ID NO: 8096107 - DNA, 22 bp, Homo sapiens
gggcacagctgctacccagtgc

SEQ ID NO: 8096108 - DNA, 22 bp, Homo sapiens
gggcacagcctaactatggaga

SEQ ID NO: 8096109 - DNA, 19 bp, Homo sapiens
gggcacagcctccccccag

SEQ ID NO: 8096110 - DNA, 22 bp, Homo sapiens
gggcacagcccagtggggtccc

SEQ ID NO: 8096111 - DNA, 22 bp, Homo sapiens
gggaggagctgagtgtgtgtgc

SEQ ID NO: 8096112 - DNA, 22 bp, Homo sapiens
ggcacagctacttgctcactct

SEQ ID NO: 8096113 - DNA, 21 bp, Homo sapiens
ggcacagcctgaaatgcctca

SEQ ID NO: 8096114 - DNA, 22 bp, Homo sapiens
ggcacagcgactaccatcgaaa

SEQ ID NO: 8096115 - DNA, 22 bp, Homo sapiens
ggcacagcaggagctatgtgaa

SEQ ID NO: 8096116 - DNA, 22 bp, Homo sapiens
ggcacagccactttggagaact

SEQ ID NO: 8096117 - DNA, 22 bp, Homo sapiens
ggcacagccctctctgtggaca

SEQ ID NO: 8096118 - DNA, 22 bp, Homo sapiens
ggcacagctcaggtcccagctc

SEQ ID NO: 8096119 - DNA, 22 bp, Homo sapiens
ggcacagctgatgcagacacac

SEQ ID NO: 8096120 - DNA, 22 bp, Homo sapiens
ggccacagaacagctacaggac

SEQ ID NO: 8096121 - DNA, 22 bp, Homo sapiens
gcagctttcttgccctaatctt

SEQ ID NO: 8096122 - DNA, 22 bp, Homo sapiens
gcagggacaactgtgcacctga

SEQ ID NO: 8096123 - DNA, 21 bp, Homo sapiens
gcagggaccgcgacttctggg

SEQ ID NO: 8096124 - DNA, 21 bp, Homo sapiens
gcagggacaaagcttcaggag

SEQ ID NO: 8096125 - DNA, 22 bp, Homo sapiens
gccagctgaaatttcagttctg

SEQ ID NO: 8096126 - DNA, 22 bp, Homo sapiens
gctggcttttgaagtctagcta

SEQ ID NO: 8096127 - DNA, 22 bp, Homo sapiens
gctggcttccttctgcagctag

SEQ ID NO: 8096128 - DNA, 22 bp, Homo sapiens
gctggcttgacagaggcctggg

SEQ ID NO: 8096129 - DNA, 22 bp, Homo sapiens
gctgccctgtggtccagcaggt

SEQ ID NO: 8096130 - DNA, 22 bp, Homo sapiens
gcctctgtggctcagccttgct

SEQ ID NO: 8096131 - DNA, 22 bp, Homo sapiens
tacatacattacctcatttagt

SEQ ID NO: 8096132 - DNA, 22 bp, Homo sapiens
gttttgtgaggcacccacaggt

SEQ ID NO: 8096133 - DNA, 22 bp, Homo sapiens
gttttggctctggcatgtggaa

SEQ ID NO: 8096134 - DNA, 22 bp, Homo sapiens
gttttggcagccgtgttcacat

SEQ ID NO: 8096135 - DNA, 22 bp, Homo sapiens
taaagtgtatgccatctctcat

SEQ ID NO: 8096136 - DNA, 22 bp, Homo sapiens
taaagtgtctgcctcagctcag

SEQ ID NO: 8096137 - DNA, 21 bp, Homo sapiens
tccagaggaggacagactcag

SEQ ID NO: 8096138 - DNA, 22 bp, Homo sapiens
tcattgcagtagggagagaccc

SEQ ID NO: 8096139 - DNA, 22 bp, Homo sapiens
tcagcaggcacggacaggctgc

SEQ ID NO: 8096140 - DNA, 22 bp, Homo sapiens
tttccttccaggttcctaaggc

SEQ ID NO: 8096141 - DNA, 22 bp, Homo sapiens
tttcagaggtatgctgcttatc

SEQ ID NO: 8096142 - DNA, 22 bp, Homo sapiens
tttcagaggaggaaggcagtta

SEQ ID NO: 8096143 - DNA, 22 bp, Homo sapiens
tttcagaggaaatctcattgag

SEQ ID NO: 8096144 - DNA, 22 bp, Homo sapiens
tttcagagtcagctcctctcta

SEQ ID NO: 8096145 - DNA, 22 bp, Homo sapiens
tttcagagttagtagagcatgt

SEQ ID NO: 8096146 - DNA, 20 bp, Homo sapiens
tttcagagtgtctttccatt

SEQ ID NO: 8096147 - DNA, 22 bp, Homo sapiens
tttcagagtctggctgcagcct

SEQ ID NO: 8096148 - DNA, 22 bp, Homo sapiens
ttgtttccattgcagactgtgt

SEQ ID NO: 8096149 - DNA, 21 bp, Homo sapiens
ttgtttcctcccaaaatgcca

SEQ ID NO: 8096150 - DNA, 22 bp, Homo sapiens
ttgtttcctttctatacaggat

SEQ ID NO: 8096151 - DNA, 22 bp, Homo sapiens
tttattattctgttctctctac

SEQ ID NO: 8096152 - DNA, 22 bp, Homo sapiens
ttgagtgtaaggaatgtggggc

SEQ ID NO: 8096153 - DNA, 22 bp, Homo sapiens
tgtggagaagaaggccactgca

SEQ ID NO: 8096154 - DNA, 18 bp, Homo sapiens
attgtgactctcagttca

SEQ ID NO: 8096155 - DNA, 22 bp, Homo sapiens
attgtcttctgtcttatagttc

SEQ ID NO: 8096156 - DNA, 22 bp, Homo sapiens
attgtcttggaaccaaggtctt

SEQ ID NO: 8096157 - DNA, 22 bp, Homo sapiens
attgtctttgtttaagggatac

SEQ ID NO: 8096158 - DNA, 22 bp, Homo sapiens
attgtctttaacctctgagggg

SEQ ID NO: 8096159 - DNA, 22 bp, Homo sapiens
attgtctttccactgagaagtt

SEQ ID NO: 8096160 - DNA, 22 bp, Homo sapiens
gcatacaaaggtttacaactga

SEQ ID NO: 8096161 - DNA, 22 bp, Homo sapiens
gcatagaaggttttggtatcaa

SEQ ID NO: 8096162 - DNA, 22 bp, Homo sapiens
gcatacaaaggtttacaactga

SEQ ID NO: 8096163 - DNA, 22 bp, Homo sapiens
gcatagctttgatgctgcctta

SEQ ID NO: 8096164 - DNA, 22 bp, Homo sapiens
gcatagctgttaatttggtttc

SEQ ID NO: 8096165 - DNA, 22 bp, Homo sapiens
attgatatattatttctaactg

SEQ ID NO: 8096166 - DNA, 22 bp, Homo sapiens
attgatatcagtttgctgattg

SEQ ID NO: 8096167 - DNA, 22 bp, Homo sapiens
attgatttgaacaaagatatta

SEQ ID NO: 8096168 - DNA, 18 bp, Homo sapiens
gcagggctgcacacgcat

SEQ ID NO: 8096169 - DNA, 22 bp, Homo sapiens
gcagggctgagtcatgtgtgcc

SEQ ID NO: 8096170 - DNA, 22 bp, Homo sapiens
gcagggctgcagagggcactgt

SEQ ID NO: 8096171 - DNA, 19 bp, Homo sapiens
attcttcagcagtgagacc

SEQ ID NO: 8096172 - DNA, 22 bp, Homo sapiens
attctttcaaggaatagttatt

SEQ ID NO: 8096173 - DNA, 22 bp, Homo sapiens
attcagaaagcaagtgctgggt

SEQ ID NO: 8096174 - DNA, 22 bp, Homo sapiens
attcagaaagttgtcatatttg

SEQ ID NO: 8096175 - DNA, 22 bp, Homo sapiens
attcagaaactctgggcagaac

SEQ ID NO: 8096176 - DNA, 22 bp, Homo sapiens
attcacattgagcttcactgtg

SEQ ID NO: 8096177 - DNA, 22 bp, Homo sapiens
attcacattttatttcactgga

SEQ ID NO: 8096178 - DNA, 22 bp, Homo sapiens
attcaaggtatttaaaacataa

SEQ ID NO: 8096179 - DNA, 22 bp, Homo sapiens
attcaaggttggctcaggaatt

SEQ ID NO: 8096180 - DNA, 22 bp, Homo sapiens
attcatacaggctttgctctta

SEQ ID NO: 8096181 - DNA, 17 bp, Homo sapiens
gcagcagagagaccctc

SEQ ID NO: 8096182 - DNA, 22 bp, Homo sapiens
gcagcagagaccccaggaagga

SEQ ID NO: 8096183 - DNA, 22 bp, Homo sapiens
attcagaatggcaaacttctag

SEQ ID NO: 8096184 - DNA, 22 bp, Homo sapiens
attcagaattgtgggcagtaca

SEQ ID NO: 8096185 - DNA, 22 bp, Homo sapiens
attcagaattgtgggcagtaca

SEQ ID NO: 8096186 - DNA, 22 bp, Homo sapiens
attcagaattttggggagctaa

SEQ ID NO: 8096187 - DNA, 22 bp, Homo sapiens
gcagatgcttggcactgacagt

SEQ ID NO: 8096188 - DNA, 22 bp, Homo sapiens
gatttccaggtcattaataaag

SEQ ID NO: 8096189 - DNA, 22 bp, Homo sapiens
gatttcagggtgcagatgatga

SEQ ID NO: 8096190 - DNA, 23 bp, Homo sapiens
attaccagcctgacaccaacaaa

SEQ ID NO: 8096191 - DNA, 22 bp, Homo sapiens
attacatatgttggcaacattt

SEQ ID NO: 8096192 - DNA, 22 bp, Homo sapiens
attacaatcgagagaaacaaat

SEQ ID NO: 8096193 - DNA, 22 bp, Homo sapiens
gatattgtgatgatgtctttgg

SEQ ID NO: 8096194 - DNA, 22 bp, Homo sapiens
gatattcctgaaggacagggtt

SEQ ID NO: 8096195 - DNA, 22 bp, Homo sapiens
attagtaaaacattgtatatgt

SEQ ID NO: 8096196 - DNA, 22 bp, Homo sapiens
attaggcagacaacgtagccgg

SEQ ID NO: 8096197 - DNA, 22 bp, Homo sapiens
attaggcattcatgcagctcct

SEQ ID NO: 8096198 - DNA, 22 bp, Homo sapiens
attcaaattaagttaattcagc

SEQ ID NO: 8096199 - DNA, 22 bp, Homo sapiens
attcaaagtctagatgtagtgt

SEQ ID NO: 8096200 - DNA, 21 bp, Homo sapiens
attcaactagatgattatttc

SEQ ID NO: 8096201 - DNA, 22 bp, Homo sapiens
attcaactagtgattgtgttat

SEQ ID NO: 8096202 - DNA, 22 bp, Homo sapiens
atttccagtcctaatgatctgg

SEQ ID NO: 8096203 - DNA, 22 bp, Homo sapiens
atttccagtatgcaaatgcctc

SEQ ID NO: 8096204 - DNA, 22 bp, Homo sapiens
atttccagtgcactgaatagaa

SEQ ID NO: 8096205 - DNA, 22 bp, Homo sapiens
atttccaggtaacctgttgagt

SEQ ID NO: 8096206 - DNA, 22 bp, Homo sapiens
atttccagtacccagaacagag

SEQ ID NO: 8096207 - DNA, 22 bp, Homo sapiens
gccaggctggccagcaccttct

SEQ ID NO: 8096208 - DNA, 22 bp, Homo sapiens
gccaggctggtcttgaactcct

SEQ ID NO: 8096209 - DNA, 22 bp, Homo sapiens
atttccatgtccaaaaattagt

SEQ ID NO: 8096210 - DNA, 22 bp, Homo sapiens
atttccattttcagccattact

SEQ ID NO: 8096211 - DNA, 22 bp, Homo sapiens
atttctgtgcagtaaatggtga

SEQ ID NO: 8096212 - DNA, 22 bp, Homo sapiens
gcccccagaagggccacagatt

SEQ ID NO: 8096213 - DNA, 22 bp, Homo sapiens
gcccccagaagggccacagatt

SEQ ID NO: 8096214 - DNA, 21 bp, Homo sapiens
gcctagggagatgggactgcc

SEQ ID NO: 8096215 - DNA, 19 bp, Homo sapiens
gcctatgtcttcaaatcat

SEQ ID NO: 8096216 - DNA, 22 bp, Homo sapiens
gcctggcaaggccctgttgact

SEQ ID NO: 8096217 - DNA, 22 bp, Homo sapiens
gcctgagattctgcatttctaa

SEQ ID NO: 8096218 - DNA, 22 bp, Homo sapiens
gcctgagacagtgtggtccaat

SEQ ID NO: 8096219 - DNA, 22 bp, Homo sapiens
gcctgagagttgaagttcagtg

SEQ ID NO: 8096220 - DNA, 22 bp, Homo sapiens
gcctgagagtctgcatttctaa

SEQ ID NO: 8096221 - DNA, 22 bp, Homo sapiens
gcctgagatcagccaagcccct

SEQ ID NO: 8096222 - DNA, 22 bp, Homo sapiens
gcctgagagtctccagaccttg

SEQ ID NO: 8096223 - DNA, 22 bp, Homo sapiens
gcctgagagacccatggggcaa

SEQ ID NO: 8096224 - DNA, 22 bp, Homo sapiens
attttagagaaacaaacgtagg

SEQ ID NO: 8096225 - DNA, 22 bp, Homo sapiens
atttttcaactttggaaatggc

SEQ ID NO: 8096226 - DNA, 22 bp, Homo sapiens
atttttctctcacacttaccag

SEQ ID NO: 8096227 - DNA, 22 bp, Homo sapiens
atttttctctccactccattaa

SEQ ID NO: 8096228 - DNA, 22 bp, Homo sapiens
atttttctctttccactgagat

SEQ ID NO: 8096229 - DNA, 22 bp, Homo sapiens
atttttctctttccactgagat

SEQ ID NO: 8096230 - DNA, 19 bp, Homo sapiens
atttttcttcctctgtgca

SEQ ID NO: 8096231 - DNA, 19 bp, Homo sapiens
atttttcttcctctgtgca

SEQ ID NO: 8096232 - DNA, 22 bp, Homo sapiens
caaaagcagttctatctgagtt

SEQ ID NO: 8096233 - DNA, 22 bp, Homo sapiens
caaaattctgcatttctaataa

SEQ ID NO: 8096234 - DNA, 22 bp, Homo sapiens
caaaattagggagtgagctgga

SEQ ID NO: 8096235 - DNA, 22 bp, Homo sapiens
caaaattagaaatgcagctgtt

SEQ ID NO: 8096236 - DNA, 22 bp, Homo sapiens
caaagcagcggattgggatagt

SEQ ID NO: 8096237 - DNA, 22 bp, Homo sapiens
caaagcagagaactgtctcatt

SEQ ID NO: 8096238 - DNA, 22 bp, Homo sapiens
caaaggaaatactaatctggaa

SEQ ID NO: 8096239 - DNA, 22 bp, Homo sapiens
caaatacaaatacgggcagctt

SEQ ID NO: 8096240 - DNA, 22 bp, Homo sapiens
caaaggaggtgataggccctct

SEQ ID NO: 8096241 - DNA, 22 bp, Homo sapiens
caaaggaagctccttgatggcg

SEQ ID NO: 8096242 - DNA, 22 bp, Homo sapiens
caaatactgggtaagttaattt

SEQ ID NO: 8096243 - DNA, 22 bp, Homo sapiens
caaatactgtactgaacactgt

SEQ ID NO: 8096244 - DNA, 22 bp, Homo sapiens
caaatagaactcacagacaaga

SEQ ID NO: 8096245 - DNA, 21 bp, Homo sapiens
caaatacttagaaacttaaga

SEQ ID NO: 8096246 - DNA, 21 bp, Homo sapiens
caaatacttagaaacttaaga

SEQ ID NO: 8096247 - DNA, 22 bp, Homo sapiens
caaatgcatgagaaataagagg

SEQ ID NO: 8096248 - DNA, 22 bp, Homo sapiens
gctgacagcaaggggctgccct

SEQ ID NO: 8096249 - DNA, 22 bp, Homo sapiens
gctgacccctacaggttgtgtt

SEQ ID NO: 8096250 - DNA, 23 bp, Homo sapiens
gctctttgttcatgtggatgcct

SEQ ID NO: 8096251 - DNA, 22 bp, Homo sapiens
ctttccaggtctaaaggcaggg

SEQ ID NO: 8096252 - DNA, 22 bp, Homo sapiens
ctttccaggaatcctcacagcc

SEQ ID NO: 8096253 - DNA, 22 bp, Homo sapiens
ctttccaggacttgcatttctg

SEQ ID NO: 8096254 - DNA, 22 bp, Homo sapiens
ctttcaaagagtaggaggtttt

SEQ ID NO: 8096255 - DNA, 22 bp, Homo sapiens
ctttcaaagaccttggcatggg

SEQ ID NO: 8096256 - DNA, 22 bp, Homo sapiens
ctttcaaagaccttggcatggg

SEQ ID NO: 8096257 - DNA, 22 bp, Homo sapiens
cttctttaatgtatacaaaaga

SEQ ID NO: 8096258 - DNA, 22 bp, Homo sapiens
atctggagatcagctggtggca

SEQ ID NO: 8096259 - DNA, 22 bp, Homo sapiens
atgaaacagtgtgtatagcaaa

SEQ ID NO: 8096260 - DNA, 22 bp, Homo sapiens
atgaacagcattgaaatccagc

SEQ ID NO: 8096261 - DNA, 22 bp, Homo sapiens
atgaaacagagtacttaatata

SEQ ID NO: 8096262 - DNA, 22 bp, Homo sapiens
atgaagaaaaatccagctgtcc

SEQ ID NO: 8096263 - DNA, 22 bp, Homo sapiens
atgaagaaactgttctgggtgg

SEQ ID NO: 8096264 - DNA, 22 bp, Homo sapiens
atgaagaaaaatccagctgtcc

SEQ ID NO: 8096265 - DNA, 22 bp, Homo sapiens
atgaactgtccaatcttagagg

SEQ ID NO: 8096266 - DNA, 22 bp, Homo sapiens
atgaactacatgatcctgaaat

SEQ ID NO: 8096267 - DNA, 22 bp, Homo sapiens
atgaactatcatcagttccacc

SEQ ID NO: 8096268 - DNA, 22 bp, Homo sapiens
ctttcttatacctgtcagggcc

SEQ ID NO: 8096269 - DNA, 22 bp, Homo sapiens
ctttcttcaacctcattctgca

SEQ ID NO: 8096270 - DNA, 22 bp, Homo sapiens
ctttcttaatttttaaggacac

SEQ ID NO: 8096271 - DNA, 22 bp, Homo sapiens
ctttctcttgagcaagagctgt

SEQ ID NO: 8096272 - DNA, 22 bp, Homo sapiens
atgatgaaattttctatcatgt

SEQ ID NO: 8096273 - DNA, 21 bp, Homo sapiens
atgatatgcttgtatttccaa

SEQ ID NO: 8096274 - DNA, 22 bp, Homo sapiens
gaaatacagttgggaggaggta

SEQ ID NO: 8096275 - DNA, 22 bp, Homo sapiens
gaaagtatttaagtccatattt

SEQ ID NO: 8096276 - DNA, 22 bp, Homo sapiens
ctttcttcatcaagtgccacgt

SEQ ID NO: 8096277 - DNA, 22 bp, Homo sapiens
ctttcttcaagctggtctcaat

SEQ ID NO: 8096278 - DNA, 22 bp, Homo sapiens
ctttctttcgaagacgtgatta

SEQ ID NO: 8096279 - DNA, 22 bp, Homo sapiens
atgacagctaaggaatgtgtag

SEQ ID NO: 8096280 - DNA, 22 bp, Homo sapiens
atgacagctctagcacacagta

SEQ ID NO: 8096281 - DNA, 22 bp, Homo sapiens
atgacagcattttcttctaagg

SEQ ID NO: 8096282 - DNA, 22 bp, Homo sapiens
atgacagccttgggtacgagag

SEQ ID NO: 8096283 - DNA, 22 bp, Homo sapiens
atgacagcattcaagacataga

SEQ ID NO: 8096284 - DNA, 17 bp, Homo sapiens
atgacagcattaaggta

SEQ ID NO: 8096285 - DNA, 22 bp, Homo sapiens
atgacagcagaagcggacgaag

SEQ ID NO: 8096286 - DNA, 22 bp, Homo sapiens
gaacaactccaagggacatcat

SEQ ID NO: 8096287 - DNA, 22 bp, Homo sapiens
gaacaactttgaaacatgaaga

SEQ ID NO: 8096288 - DNA, 22 bp, Homo sapiens
gaacaagtttccaaattataac

SEQ ID NO: 8096289 - DNA, 22 bp, Homo sapiens
gaacaatagtggtaacaaagcc

SEQ ID NO: 8096290 - DNA, 22 bp, Homo sapiens
gaaggctggctttctgagagca

SEQ ID NO: 8096291 - DNA, 22 bp, Homo sapiens
gaaggctggaaggcaagtagga

SEQ ID NO: 8096292 - DNA, 22 bp, Homo sapiens
gaaggctgctgggaagtgtggt

SEQ ID NO: 8096293 - DNA, 22 bp, Homo sapiens
atgcacagaacaattttaagag

SEQ ID NO: 8096294 - DNA, 22 bp, Homo sapiens
atgcacagatcctggcacttag

SEQ ID NO: 8096295 - DNA, 22 bp, Homo sapiens
atgcacaggaccacacataatg

SEQ ID NO: 8096296 - DNA, 22 bp, Homo sapiens
gaaggctgtaggcaaagtagga

SEQ ID NO: 8096297 - DNA, 22 bp, Homo sapiens
gaaggctgtcagagaggagggc

SEQ ID NO: 8096298 - DNA, 22 bp, Homo sapiens
gaaggctgtggctggtctcagt

SEQ ID NO: 8096299 - DNA, 22 bp, Homo sapiens
gaaggctgtttctggtagtgat

SEQ ID NO: 8096300 - DNA, 22 bp, Homo sapiens
gaatcaatggtagattaagtaa

SEQ ID NO: 8096301 - DNA, 22 bp, Homo sapiens
gaatcaattatccaggctgttg

SEQ ID NO: 8096302 - DNA, 22 bp, Homo sapiens
gaatcaattgtgaagactatga

SEQ ID NO: 8096303 - DNA, 22 bp, Homo sapiens
gaatacaaacttaaggctttac

SEQ ID NO: 8096304 - DNA, 22 bp, Homo sapiens
gaatacaaataataccaaggtg

SEQ ID NO: 8096305 - DNA, 22 bp, Homo sapiens
gacatacaagctggtacctcct

SEQ ID NO: 8096306 - DNA, 22 bp, Homo sapiens
gacatttgttcctctaagtgac

SEQ ID NO: 8096307 - DNA, 21 bp, Homo sapiens
gacacaaagggtagtaatggt

SEQ ID NO: 8096308 - DNA, 22 bp, Homo sapiens
gacacatatgcgtatagtttag

SEQ ID NO: 8096309 - DNA, 22 bp, Homo sapiens
gacgagagactccatccaccac

SEQ ID NO: 8096310 - DNA, 22 bp, Homo sapiens
gacggagctggttgctgcggct

SEQ ID NO: 8096311 - DNA, 22 bp, Homo sapiens
gacgcctcttccctgctgcact

SEQ ID NO: 8096312 - DNA, 22 bp, Homo sapiens
gactgggagggttcagctgggt

SEQ ID NO: 8096313 - DNA, 22 bp, Homo sapiens
gagggctgaagattgtggcccc

SEQ ID NO: 8096314 - DNA, 23 bp, Homo sapiens
gaggtggcaatgagggcagttgg

SEQ ID NO: 8096315 - DNA, 22 bp, Homo sapiens
atgtcctggagcagaggcaagg

SEQ ID NO: 8096316 - DNA, 22 bp, Homo sapiens
atgtttaaagggttgagaaata

SEQ ID NO: 8096317 - DNA, 22 bp, Homo sapiens
gagttcaatttccagctgttct

SEQ ID NO: 8096318 - DNA, 22 bp, Homo sapiens
atgtttaatcggctgcctttcc

SEQ ID NO: 8096319 - DNA, 22 bp, Homo sapiens
gatacaaattcatgtctgaatt

SEQ ID NO: 8096320 - DNA, 22 bp, Homo sapiens
gatacaagactaataggaaaca

SEQ ID NO: 8096321 - DNA, 18 bp, Homo sapiens
gatatggaaggccatgcc

SEQ ID NO: 8096322 - DNA, 22 bp, Homo sapiens
gatacaaaatataaatggagag

SEQ ID NO: 8096323 - DNA, 22 bp, Homo sapiens
gaggtggcaatttaatgcagtc

SEQ ID NO: 8096324 - DNA, 22 bp, Homo sapiens
gaggtggcagaggcctggacct

SEQ ID NO: 8096325 - DNA, 22 bp, Homo sapiens
gaggtggcattaagattctggt

SEQ ID NO: 8096326 - DNA, 22 bp, Homo sapiens
gaggtggcagaggcctggacct

SEQ ID NO: 8096327 - DNA, 22 bp, Homo sapiens
gaggtggcactgtgaggagcac

SEQ ID NO: 8096328 - DNA, 22 bp, Homo sapiens
gaggtggcctcaagcagtcttc

SEQ ID NO: 8096329 - DNA, 22 bp, Homo sapiens
gaggtggccaagcgaggaaggg

SEQ ID NO: 8096330 - DNA, 22 bp, Homo sapiens
gaggtggcctcaagcagtcttc

SEQ ID NO: 8096331 - DNA, 22 bp, Homo sapiens
gaggcagcctcagtggacctcg

SEQ ID NO: 8096332 - DNA, 22 bp, Homo sapiens
gaggcagccagaggttctcatt

SEQ ID NO: 8096333 - DNA, 22 bp, Homo sapiens
gaggcagcatggtaccttggag

SEQ ID NO: 8096334 - DNA, 22 bp, Homo sapiens
atggtggaagagcatcagaaag

SEQ ID NO: 8096335 - DNA, 22 bp, Homo sapiens
atggtctgatgtcccatggctt

SEQ ID NO: 8096336 - DNA, 22 bp, Homo sapiens
atggtctgaatgtgtgctccaa

SEQ ID NO: 8096337 - DNA, 22 bp, Homo sapiens
atggtctgttaggagctacttt

SEQ ID NO: 8096338 - DNA, 22 bp, Homo sapiens
atggtctgctgagtcatgaggc

SEQ ID NO: 8096339 - DNA, 22 bp, Homo sapiens
gaggagaatgcgcaccacatat

SEQ ID NO: 8096340 - DNA, 22 bp, Homo sapiens
atggggagagcctctgtcccca

SEQ ID NO: 8096341 - DNA, 22 bp, Homo sapiens
atgggctgtccattgctggctg

SEQ ID NO: 8096342 - DNA, 22 bp, Homo sapiens
atgggagaaacatcatgaggca

SEQ ID NO: 8096343 - DNA, 22 bp, Homo sapiens
atgggaagtgaagtcagggagg

SEQ ID NO: 8096344 - DNA, 22 bp, Homo sapiens
gactgggctccaagagggagag

SEQ ID NO: 8096345 - DNA, 22 bp, Homo sapiens
gagacagtgtccatccaggggc

SEQ ID NO: 8096346 - DNA, 22 bp, Homo sapiens
gagacagtggttgcagaagctc

SEQ ID NO: 8096347 - DNA, 22 bp, Homo sapiens
gagagagaagtgggtgtcacct

SEQ ID NO: 8096348 - DNA, 22 bp, Homo sapiens
gagagagacatgtaaacgcggt

SEQ ID NO: 8096349 - DNA, 22 bp, Homo sapiens
gagagagagctaatattaagct

SEQ ID NO: 8096350 - DNA, 22 bp, Homo sapiens
gagagagaggtgctgccaggca

SEQ ID NO: 8096351 - DNA, 22 bp, Homo sapiens
gagagcagactctcaaagctgg

SEQ ID NO: 8096352 - DNA, 23 bp, Homo sapiens
gagagcaatgagatgtaaacact

SEQ ID NO: 8096353 - DNA, 23 bp, Homo sapiens
gagagagattgctaaaccactcc

SEQ ID NO: 8096354 - DNA, 22 bp, Homo sapiens
atggagggtggtaagacagaga

SEQ ID NO: 8096355 - DNA, 22 bp, Homo sapiens
gagagtccaggtctgggtcctt

SEQ ID NO: 8096356 - DNA, 22 bp, Homo sapiens
gagaggtttgtacactccgagg

SEQ ID NO: 8096357 - DNA, 22 bp, Homo sapiens
atggagggtgtcagagagcgaa

SEQ ID NO: 8096358 - DNA, 22 bp, Homo sapiens
cacagaggaatgcatcagcaga

SEQ ID NO: 8096359 - DNA, 22 bp, Homo sapiens
cacagaggaatgcatcagcaga

SEQ ID NO: 8096360 - DNA, 22 bp, Homo sapiens
cacagaggaaaggcagttggta

SEQ ID NO: 8096361 - DNA, 22 bp, Homo sapiens
ggactgggagaatggaggcaag

SEQ ID NO: 8096362 - DNA, 22 bp, Homo sapiens
cacagacttgagaagcacctta

SEQ ID NO: 8096363 - DNA, 22 bp, Homo sapiens
ggactgggattctggatctgct

SEQ ID NO: 8096364 - DNA, 17 bp, Homo sapiens
ggactgggcggggcagg

SEQ ID NO: 8096365 - DNA, 22 bp, Homo sapiens
ggactgggccaggggttggact

SEQ ID NO: 8096366 - DNA, 22 bp, Homo sapiens
ggactgggtaggagcccagggc

SEQ ID NO: 8096367 - DNA, 22 bp, Homo sapiens
ggaaggggagctggaaagggta

SEQ ID NO: 8096368 - DNA, 21 bp, Homo sapiens
ggaagggctctgaggacggct

SEQ ID NO: 8096369 - DNA, 20 bp, Homo sapiens
ggaaggggcaaagtgtgtga

SEQ ID NO: 8096370 - DNA, 22 bp, Homo sapiens
cacagaataaattggtatcaga

SEQ ID NO: 8096371 - DNA, 22 bp, Homo sapiens
caatgttttcaactgacaagta

SEQ ID NO: 8096372 - DNA, 22 bp, Homo sapiens
ggaagggcctcgggcgtgggac

SEQ ID NO: 8096373 - DNA, 22 bp, Homo sapiens
cacacaggagagtgctggaggt

SEQ ID NO: 8096374 - DNA, 22 bp, Homo sapiens
cacacaggaaaattggaattaa

SEQ ID NO: 8096375 - DNA, 22 bp, Homo sapiens
ggaggcaggaaagacaggttca

SEQ ID NO: 8096376 - DNA, 20 bp, Homo sapiens
ggagctggcatccagcctct

SEQ ID NO: 8096377 - DNA, 22 bp, Homo sapiens
ggaggcattatggggaagactt

SEQ ID NO: 8096378 - DNA, 20 bp, Homo sapiens
ggagctggcatccagcctct

SEQ ID NO: 8096379 - DNA, 23 bp, Homo sapiens
ggagctgctgttgggggagctgc

SEQ ID NO: 8096380 - DNA, 22 bp, Homo sapiens
ggagcctgcgggagctcccatt

SEQ ID NO: 8096381 - DNA, 22 bp, Homo sapiens
ggagcctgacagtgcccagcat

SEQ ID NO: 8096382 - DNA, 22 bp, Homo sapiens
ggagcctgaaaagtctgcattt

SEQ ID NO: 8096383 - DNA, 22 bp, Homo sapiens
ggagccgcacgtgctgggcccg

SEQ ID NO: 8096384 - DNA, 22 bp, Homo sapiens
ggagccctgctgacatgggtgt

SEQ ID NO: 8096385 - DNA, 22 bp, Homo sapiens
cacagaggtgatagtggtcaag

SEQ ID NO: 8096386 - DNA, 22 bp, Homo sapiens
cacagaggtctgggcccagcag

SEQ ID NO: 8096387 - DNA, 22 bp, Homo sapiens
caagtttggattatgaaaaagt

SEQ ID NO: 8096388 - DNA, 22 bp, Homo sapiens
caataaagaagatttttgcaat

SEQ ID NO: 8096389 - DNA, 21 bp, Homo sapiens
caataaactgcacattgagac

SEQ ID NO: 8096390 - DNA, 22 bp, Homo sapiens
gctttcttagtgtgttaattgg

SEQ ID NO: 8096391 - DNA, 22 bp, Homo sapiens
gctttcttcatactcaagcatc

SEQ ID NO: 8096392 - DNA, 22 bp, Homo sapiens
caatgttccctgtactgctttt

SEQ ID NO: 8096393 - DNA, 22 bp, Homo sapiens
caatgtatcaagaagcatcagt

SEQ ID NO: 8096394 - DNA, 18 bp, Homo sapiens
gctgttcttcgcactggc

SEQ ID NO: 8096395 - DNA, 22 bp, Homo sapiens
gctgttctttcagcccagggct

SEQ ID NO: 8096396 - DNA, 22 bp, Homo sapiens
gctgttctttgcatctctggtg

SEQ ID NO: 8096397 - DNA, 22 bp, Homo sapiens
gctgttctagcttcagtttcgc

SEQ ID NO: 8096398 - DNA, 22 bp, Homo sapiens
gctgttctctgtaacatgcatt

SEQ ID NO: 8096399 - DNA, 22 bp, Homo sapiens
gctgttctgtccccatgggtaa

SEQ ID NO: 8096400 - DNA, 22 bp, Homo sapiens
gctgttctgcaccagacttcag

SEQ ID NO: 8096401 - DNA, 22 bp, Homo sapiens
caagtcaaagactagaactagt

SEQ ID NO: 8096402 - DNA, 22 bp, Homo sapiens
caagtcaaagactagaactagt

SEQ ID NO: 8096403 - DNA, 22 bp, Homo sapiens
caaggtcacataacttgtcaaa

SEQ ID NO: 8096404 - DNA, 22 bp, Homo sapiens
caaggtcagcgtgaagttctgt

SEQ ID NO: 8096405 - DNA, 22 bp, Homo sapiens
caaggtgatacttacattagtg

SEQ ID NO: 8096406 - DNA, 22 bp, Homo sapiens
caaggttctatagcaaaatctg

SEQ ID NO: 8096407 - DNA, 22 bp, Homo sapiens
caagtattctgtaaaaagtcaa

SEQ ID NO: 8096408 - DNA, 22 bp, Homo sapiens
caagtagaaggatgtgattgta

SEQ ID NO: 8096409 - DNA, 22 bp, Homo sapiens
caaggccataagagatacaaaa

SEQ ID NO: 8096410 - DNA, 22 bp, Homo sapiens
caaggccagagccagcgataag

SEQ ID NO: 8096411 - DNA, 22 bp, Homo sapiens
caaggcaggaagcctgtcttat

SEQ ID NO: 8096412 - DNA, 22 bp, Homo sapiens
gctggaggctggagtgcagtgg

SEQ ID NO: 8096413 - DNA, 20 bp, Homo sapiens
caagggtttgcattggcttt

SEQ ID NO: 8096414 - DNA, 22 bp, Homo sapiens
caaggcttcagtgtgacaaaac

SEQ ID NO: 8096415 - DNA, 22 bp, Homo sapiens
caaggctttctcattatccttt

SEQ ID NO: 8096416 - DNA, 21 bp, Homo sapiens
gctggctgtcccagggaagca

SEQ ID NO: 8096417 - DNA, 22 bp, Homo sapiens
gctggctggtccagcaggggct

SEQ ID NO: 8096418 - DNA, 22 bp, Homo sapiens
caaatgtaataaggagtttccc

SEQ ID NO: 8096419 - DNA, 22 bp, Homo sapiens
gctggaggaggaagtgtgaggg

SEQ ID NO: 8096420 - DNA, 22 bp, Homo sapiens
gctggaggatggactggaagaa

SEQ ID NO: 8096421 - DNA, 22 bp, Homo sapiens
ggcctgagcttgggcagcgtat

SEQ ID NO: 8096422 - DNA, 22 bp, Homo sapiens
ggcctctctccttggcttgcag

SEQ ID NO: 8096423 - DNA, 22 bp, Homo sapiens
ggcctgggctccgggagttact

SEQ ID NO: 8096424 - DNA, 22 bp, Homo sapiens
ggcctgaggcgtcccagctgtg

SEQ ID NO: 8096425 - DNA, 22 bp, Homo sapiens
ggcctgaggccaccagcagccc

SEQ ID NO: 8096426 - DNA, 22 bp, Homo sapiens
ggcctgtgcaagacagcacccc

SEQ ID NO: 8096427 - DNA, 17 bp, Homo sapiens
ggcctgtgtggctgcag

SEQ ID NO: 8096428 - DNA, 22 bp, Homo sapiens
ggcctgtgtcggccccgggttc

SEQ ID NO: 8096429 - DNA, 22 bp, Homo sapiens
ggcctgtgtctgtgcctgtcct

SEQ ID NO: 8096430 - DNA, 22 bp, Homo sapiens
ggcctgtgtcctccttgccctg

SEQ ID NO: 8096431 - DNA, 22 bp, Homo sapiens
ggcctgtgctgtcagccctagt

SEQ ID NO: 8096432 - DNA, 22 bp, Homo sapiens
ggcctgtgctgagaacctggct

SEQ ID NO: 8096433 - DNA, 19 bp, Homo sapiens
ggcctgtgcagagcccgtc

SEQ ID NO: 8096434 - DNA, 22 bp, Homo sapiens
ggcctgtgggaggacagctggg

SEQ ID NO: 8096435 - DNA, 22 bp, Homo sapiens
ggctgagcttttcatgatggtt

SEQ ID NO: 8096436 - DNA, 22 bp, Homo sapiens
ggctgagcggactggggtccct

SEQ ID NO: 8096437 - DNA, 22 bp, Homo sapiens
ggctgagcctggagcatctggt

SEQ ID NO: 8096438 - DNA, 22 bp, Homo sapiens
ggctgagccccctctgcgtagg

SEQ ID NO: 8096439 - DNA, 19 bp, Homo sapiens
ggctgagcgccttggctgc

SEQ ID NO: 8096440 - DNA, 22 bp, Homo sapiens
ggctctggtgagggtaggagat

SEQ ID NO: 8096441 - DNA, 22 bp, Homo sapiens
ggctctggtgggaaggttagat

SEQ ID NO: 8096442 - DNA, 22 bp, Homo sapiens
ggctccaggtgcatgccaggct

SEQ ID NO: 8096443 - DNA, 22 bp, Homo sapiens
cagaaaacctgactctagaact

SEQ ID NO: 8096444 - DNA, 22 bp, Homo sapiens
cactttgtttattgtgcagtta

SEQ ID NO: 8096445 - DNA, 17 bp, Homo sapiens
cactttgttgctgtggg

SEQ ID NO: 8096446 - DNA, 22 bp, Homo sapiens
cactttacccttgttactcatg

SEQ ID NO: 8096447 - DNA, 22 bp, Homo sapiens
cagaaataaagtggacagagta

SEQ ID NO: 8096448 - DNA, 22 bp, Homo sapiens
cagaaaggacagagtgagggtg

SEQ ID NO: 8096449 - DNA, 22 bp, Homo sapiens
cagaaaggcacccactgggtct

SEQ ID NO: 8096450 - DNA, 22 bp, Homo sapiens
ggctgtccttggccaaggcact

SEQ ID NO: 8096451 - DNA, 22 bp, Homo sapiens
ggctgtccacctaccatgccgg

SEQ ID NO: 8096452 - DNA, 22 bp, Homo sapiens
ggctgtcaattcataggtcaga

SEQ ID NO: 8096453 - DNA, 22 bp, Homo sapiens
ggctggtgttgagtgcctgtag

SEQ ID NO: 8096454 - DNA, 21 bp, Homo sapiens
ggctggtgtttagctgtgata

SEQ ID NO: 8096455 - DNA, 22 bp, Homo sapiens
ggcatttgagccattggcctgt

SEQ ID NO: 8096456 - DNA, 22 bp, Homo sapiens
ggcaggtgcccagagagcacga

SEQ ID NO: 8096457 - DNA, 22 bp, Homo sapiens
ggcaggtgcacctgagccatct

SEQ ID NO: 8096458 - DNA, 22 bp, Homo sapiens
cacgagatgtgccctgctggaa

SEQ ID NO: 8096459 - DNA, 22 bp, Homo sapiens
ggcctctctccctggcttgcag

SEQ ID NO: 8096460 - DNA, 20 bp, Homo sapiens
caccttcaaatttcctggca

SEQ ID NO: 8096461 - DNA, 21 bp, Homo sapiens
cacctgtgagactctcagacc

SEQ ID NO: 8096462 - DNA, 22 bp, Homo sapiens
ggccctgtcctggctgtctccg

SEQ ID NO: 8096463 - DNA, 22 bp, Homo sapiens
ggcccttggagcctccacagtg

SEQ ID NO: 8096464 - DNA, 22 bp, Homo sapiens
ggccctgtggttttgcaaagtc

SEQ ID NO: 8096465 - DNA, 22 bp, Homo sapiens
ggccctgttagagctcccacaa

SEQ ID NO: 8096466 - DNA, 22 bp, Homo sapiens
ggccactgtcctctagcccaga

SEQ ID NO: 8096467 - DNA, 22 bp, Homo sapiens
ggccactgtttcctgggcagtt

SEQ ID NO: 8096468 - DNA, 22 bp, Homo sapiens
ggccactgctgctctggtggag

SEQ ID NO: 8096469 - DNA, 22 bp, Homo sapiens
ggccactgctctccagcctggg

SEQ ID NO: 8096470 - DNA, 22 bp, Homo sapiens
ggccactgacctacatctgggg

SEQ ID NO: 8096471 - DNA, 22 bp, Homo sapiens
ggccactgcctccgccatggct

SEQ ID NO: 8096472 - DNA, 22 bp, Homo sapiens
ggcaggcatggggtctgccatt

SEQ ID NO: 8096473 - DNA, 20 bp, Homo sapiens
ggcaggcaggaggtttccag

SEQ ID NO: 8096474 - DNA, 22 bp, Homo sapiens
ggcaggcaggtcttcatggccc

SEQ ID NO: 8096475 - DNA, 22 bp, Homo sapiens
cacatttaggttcctatagcca

SEQ ID NO: 8096476 - DNA, 22 bp, Homo sapiens
cacatttatctgttctttctag

SEQ ID NO: 8096477 - DNA, 22 bp, Homo sapiens
ggaggtgatcagagttttgagg

SEQ ID NO: 8096478 - DNA, 22 bp, Homo sapiens
ggaggtgactggatcatgggca

SEQ ID NO: 8096479 - DNA, 22 bp, Homo sapiens
ggaggtggaggttgcagtgagc

SEQ ID NO: 8096480 - DNA, 22 bp, Homo sapiens
ggaggtggaggttgcaatgagc

SEQ ID NO: 8096481 - DNA, 22 bp, Homo sapiens
ggaggtggagctggaagttcca

SEQ ID NO: 8096482 - DNA, 22 bp, Homo sapiens
ggaggtggagctggaagttcca

SEQ ID NO: 8096483 - DNA, 22 bp, Homo sapiens
cacataaatggtgccatgtttt

SEQ ID NO: 8096484 - DNA, 22 bp, Homo sapiens
cacatacatacgtatgtataca

SEQ ID NO: 8096485 - DNA, 22 bp, Homo sapiens
cacatacaatggtgttatttgg

SEQ ID NO: 8096486 - DNA, 22 bp, Homo sapiens
gtcataaagacagaaacattcc

SEQ ID NO: 8096487 - DNA, 22 bp, Homo sapiens
cagcagctggtgagacacagcc

SEQ ID NO: 8096488 - DNA, 22 bp, Homo sapiens
cagcagctgtttacggaacacc

SEQ ID NO: 8096489 - DNA, 22 bp, Homo sapiens
cagcagcttctgttgatcagaa

SEQ ID NO: 8096490 - DNA, 22 bp, Homo sapiens
cagcagctgcgtgcccaggccg

SEQ ID NO: 8096491 - DNA, 22 bp, Homo sapiens
gtcatataggtaggattcagct

SEQ ID NO: 8096492 - DNA, 22 bp, Homo sapiens
gtcatattataaatgttctgtt

SEQ ID NO: 8096493 - DNA, 22 bp, Homo sapiens
gtctgtatcagaggagtgaatg

SEQ ID NO: 8096494 - DNA, 22 bp, Homo sapiens
cagccctcaggtcctcagcagc

SEQ ID NO: 8096495 - DNA, 22 bp, Homo sapiens
cagccctcatcccgcctgcgtt

SEQ ID NO: 8096496 - DNA, 22 bp, Homo sapiens
cagccccttgtccggtagccac

SEQ ID NO: 8096497 - DNA, 22 bp, Homo sapiens
gtccctggcgctttcgagcctt

SEQ ID NO: 8096498 - DNA, 22 bp, Homo sapiens
gtccctgggatgcccttctggg

SEQ ID NO: 8096499 - DNA, 19 bp, Homo sapiens
gtccctgggcagaggcacc

SEQ ID NO: 8096500 - DNA, 22 bp, Homo sapiens
gtccctgggcgcctccgtgctc

SEQ ID NO: 8096501 - DNA, 22 bp, Homo sapiens
gtcccttcctcattccacttta

SEQ ID NO: 8096502 - DNA, 22 bp, Homo sapiens
gtgcccagttgaggccaggact

SEQ ID NO: 8096503 - DNA, 22 bp, Homo sapiens
gtgcccagtgcaggcccgcagg

SEQ ID NO: 8096504 - DNA, 20 bp, Homo sapiens
cagcctccactcactcagct

SEQ ID NO: 8096505 - DNA, 22 bp, Homo sapiens
cagccctggcccaggtgcctta

SEQ ID NO: 8096506 - DNA, 22 bp, Homo sapiens
cagccctggaacagctgactca

SEQ ID NO: 8096507 - DNA, 22 bp, Homo sapiens
cagccctgctgacactgtctga

SEQ ID NO: 8096508 - DNA, 22 bp, Homo sapiens
cagccctgctcttagtgtctcc

SEQ ID NO: 8096509 - DNA, 22 bp, Homo sapiens
cagccctgcttccccgctagtt

SEQ ID NO: 8096510 - DNA, 22 bp, Homo sapiens
cagccctgccatggagcctcct

SEQ ID NO: 8096511 - DNA, 22 bp, Homo sapiens
cagcctgtggcagaggtctaat

SEQ ID NO: 8096512 - DNA, 22 bp, Homo sapiens
cagctactcctcccatgacttc

SEQ ID NO: 8096513 - DNA, 22 bp, Homo sapiens
cagctactcctcccatgacttc

SEQ ID NO: 8096514 - DNA, 22 bp, Homo sapiens
cagctatggtgacaaggtcagg

SEQ ID NO: 8096515 - DNA, 22 bp, Homo sapiens
gggcagtgggaccaggcaccag

SEQ ID NO: 8096516 - DNA, 22 bp, Homo sapiens
gggcagtggtccaggctacagc

SEQ ID NO: 8096517 - DNA, 22 bp, Homo sapiens
cagagacagggcagggagtgtg

SEQ ID NO: 8096518 - DNA, 22 bp, Homo sapiens
cagactggccacatctgcactg

SEQ ID NO: 8096519 - DNA, 22 bp, Homo sapiens
cagacctgggtccctggcctgt

SEQ ID NO: 8096520 - DNA, 20 bp, Homo sapiens
cagacctgcacccacttcga

SEQ ID NO: 8096521 - DNA, 22 bp, Homo sapiens
cagaccatcttgaagcaaactg

SEQ ID NO: 8096522 - DNA, 17 bp, Homo sapiens
ggcttcagggagctggg

SEQ ID NO: 8096523 - DNA, 22 bp, Homo sapiens
ggcttcagaagactggacaggt

SEQ ID NO: 8096524 - DNA, 22 bp, Homo sapiens
ggcttcagaggagaagagggtg

SEQ ID NO: 8096525 - DNA, 22 bp, Homo sapiens
ggcttcaagtcgtatatttggg

SEQ ID NO: 8096526 - DNA, 22 bp, Homo sapiens
cagagctggctctgcatgtaca

SEQ ID NO: 8096527 - DNA, 22 bp, Homo sapiens
cagagctgcttcccagtttgtg

SEQ ID NO: 8096528 - DNA, 20 bp, Homo sapiens
cagagctgggatttgaacac

SEQ ID NO: 8096529 - DNA, 22 bp, Homo sapiens
cagagctgggcatggtgaaagg

SEQ ID NO: 8096530 - DNA, 22 bp, Homo sapiens
cagagctggggactgttggatg

SEQ ID NO: 8096531 - DNA, 22 bp, Homo sapiens
cagagctgggtttgggaaacct

SEQ ID NO: 8096532 - DNA, 22 bp, Homo sapiens
cagagctgggatcccatgggcg

SEQ ID NO: 8096533 - DNA, 22 bp, Homo sapiens
gggctgagtctgctgcctgtca

SEQ ID NO: 8096534 - DNA, 22 bp, Homo sapiens
cagaggagaattgcgggatcat

SEQ ID NO: 8096535 - DNA, 22 bp, Homo sapiens
cagaggattccctagtgacctg

SEQ ID NO: 8096536 - DNA, 20 bp, Homo sapiens
cagaggcaaggagacttgga

SEQ ID NO: 8096537 - DNA, 22 bp, Homo sapiens
cagaggcaaaagaggtggaggt

SEQ ID NO: 8096538 - DNA, 22 bp, Homo sapiens
gggccagagcacagaggatgtt

SEQ ID NO: 8096539 - DNA, 22 bp, Homo sapiens
gggcagtgtcggggcccaggga

SEQ ID NO: 8096540 - DNA, 20 bp, Homo sapiens
gggctcttaggtagcagggg

SEQ ID NO: 8096541 - DNA, 22 bp, Homo sapiens
gggctcttttctgagcttcact

SEQ ID NO: 8096542 - DNA, 22 bp, Homo sapiens
gggctcttctcaggagctatct

SEQ ID NO: 8096543 - DNA, 22 bp, Homo sapiens
ggtcattttcactttcaagtta

SEQ ID NO: 8096544 - DNA, 22 bp, Homo sapiens
cagagtcatatcagagaatatg

SEQ ID NO: 8096545 - DNA, 22 bp, Homo sapiens
cagagtcagtattgaattgaaa

SEQ ID NO: 8096546 - DNA, 19 bp, Homo sapiens
cagagtccttgaccagtcc

SEQ ID NO: 8096547 - DNA, 17 bp, Homo sapiens
cagagtctgtctgcatc

SEQ ID NO: 8096548 - DNA, 22 bp, Homo sapiens
cagagggttgatgtgaggctta

SEQ ID NO: 8096549 - DNA, 22 bp, Homo sapiens
cagaggtagaactggccctcac

SEQ ID NO: 8096550 - DNA, 22 bp, Homo sapiens
ggggagcttagggtctctgaat

SEQ ID NO: 8096551 - DNA, 22 bp, Homo sapiens
cagagggctgccctgagttcgt

SEQ ID NO: 8096552 - DNA, 22 bp, Homo sapiens
cagagggctcagtcctgctgga

SEQ ID NO: 8096553 - DNA, 22 bp, Homo sapiens
cagagggctcggcggccgctcc

SEQ ID NO: 8096554 - DNA, 22 bp, Homo sapiens
cagagggcttcaggttcaggat

SEQ ID NO: 8096555 - DNA, 22 bp, Homo sapiens
cagcaccatttgcagcctcttt

SEQ ID NO: 8096556 - DNA, 22 bp, Homo sapiens
cagcaccagcatattccagggc

SEQ ID NO: 8096557 - DNA, 19 bp, Homo sapiens
ggtgaccacctggtcagtg

SEQ ID NO: 8096558 - DNA, 22 bp, Homo sapiens
ggtgacagttccggaggtacag

SEQ ID NO: 8096559 - DNA, 22 bp, Homo sapiens
ggtgacagtggttaaaatttgt

SEQ ID NO: 8096560 - DNA, 22 bp, Homo sapiens
cgggcagtgtggctccagagtc

SEQ ID NO: 8096561 - DNA, 22 bp, Homo sapiens
cgggcgcactccgggcagctgt

SEQ ID NO: 8096562 - DNA, 21 bp, Homo sapiens
cgggctggccgggccctcacc

SEQ ID NO: 8096563 - DNA, 22 bp, Homo sapiens
ctaagaaggaggaaaagtgcca

SEQ ID NO: 8096564 - DNA, 22 bp, Homo sapiens
agtacaatttaatgaagatagc

SEQ ID NO: 8096565 - DNA, 22 bp, Homo sapiens
agtaaaaagttcagaatggttg

SEQ ID NO: 8096566 - DNA, 22 bp, Homo sapiens
aggtttctggatttattatggc

SEQ ID NO: 8096567 - DNA, 22 bp, Homo sapiens
cctgttctgttaattaaacttt

SEQ ID NO: 8096568 - DNA, 22 bp, Homo sapiens
cctgttctgtggctctcaaagg

SEQ ID NO: 8096569 - DNA, 22 bp, Homo sapiens
cctgttctgtagtgagtttgag

SEQ ID NO: 8096570 - DNA, 20 bp, Homo sapiens
cctgttggatgaggtccaga

SEQ ID NO: 8096571 - DNA, 22 bp, Homo sapiens
agtatttcctggcttatctgct

SEQ ID NO: 8096572 - DNA, 22 bp, Homo sapiens
agtatttagagacacaagatgg

SEQ ID NO: 8096573 - DNA, 22 bp, Homo sapiens
agtattaccctcagaacttgat

SEQ ID NO: 8096574 - DNA, 22 bp, Homo sapiens
agtatgcagggtaggatcatct

SEQ ID NO: 8096575 - DNA, 22 bp, Homo sapiens
agtatgcaaattatttcattgt

SEQ ID NO: 8096576 - DNA, 22 bp, Homo sapiens
agtatgcacctcactgtcaggc

SEQ ID NO: 8096577 - DNA, 22 bp, Homo sapiens
ctagtatttaaaggctatgatt

SEQ ID NO: 8096578 - DNA, 22 bp, Homo sapiens
agtccataggcagttcataaca

SEQ ID NO: 8096579 - DNA, 22 bp, Homo sapiens
agtccatagaggctgctttcat

SEQ ID NO: 8096580 - DNA, 22 bp, Homo sapiens
agtccaggtggaccttggccag

SEQ ID NO: 8096581 - DNA, 22 bp, Homo sapiens
ctagaacagaaagtacaggaaa

SEQ ID NO: 8096582 - DNA, 22 bp, Homo sapiens
ctagaagcaatgtaggggagac

SEQ ID NO: 8096583 - DNA, 20 bp, Homo sapiens
ctagaagcagaattgctgat

SEQ ID NO: 8096584 - DNA, 22 bp, Homo sapiens
ctagaagcaactagatctgttt

SEQ ID NO: 8096585 - DNA, 22 bp, Homo sapiens
ctagaatactcgtattattccc

SEQ ID NO: 8096586 - DNA, 22 bp, Homo sapiens
aggtggggccaaatgctacagt

SEQ ID NO: 8096587 - DNA, 21 bp, Homo sapiens
aggtggggctgcacctctgct

SEQ ID NO: 8096588 - DNA, 21 bp, Homo sapiens
aggtggggctgcacctctgct

SEQ ID NO: 8096589 - DNA, 22 bp, Homo sapiens
aggtggggaggagtgtctcttt

SEQ ID NO: 8096590 - DNA, 22 bp, Homo sapiens
aggtggggaggagtgtctcttt

SEQ ID NO: 8096591 - DNA, 22 bp, Homo sapiens
cctgtcatatacatacctcctc

SEQ ID NO: 8096592 - DNA, 22 bp, Homo sapiens
cctgtgagtcaacccctccttg

SEQ ID NO: 8096593 - DNA, 22 bp, Homo sapiens
cctgtgatggtgttacactgtt

SEQ ID NO: 8096594 - DNA, 19 bp, Homo sapiens
cctgtgagaggacaggtgt

SEQ ID NO: 8096595 - DNA, 22 bp, Homo sapiens
cctgggctcgcgcacttcaccc

SEQ ID NO: 8096596 - DNA, 22 bp, Homo sapiens
cctgggcttgcatctgtgctgg

SEQ ID NO: 8096597 - DNA, 22 bp, Homo sapiens
cctgggctttgagggcaggatg

SEQ ID NO: 8096598 - DNA, 22 bp, Homo sapiens
cctgggctttcggcggcttcct

SEQ ID NO: 8096599 - DNA, 22 bp, Homo sapiens
cctggctctggttccctcagct

SEQ ID NO: 8096600 - DNA, 22 bp, Homo sapiens
cctgggctcaccatgccttgga

SEQ ID NO: 8096601 - DNA, 22 bp, Homo sapiens
cctgggctcacagccaaggctc

SEQ ID NO: 8096602 - DNA, 22 bp, Homo sapiens
cctgggctcaggcttgggcagc

SEQ ID NO: 8096603 - DNA, 22 bp, Homo sapiens
cctggcacaagagcagcattgg

SEQ ID NO: 8096604 - DNA, 18 bp, Homo sapiens
cctggcacactggctcat

SEQ ID NO: 8096605 - DNA, 22 bp, Homo sapiens
cctggagtgacaggtgtagcct

SEQ ID NO: 8096606 - DNA, 23 bp, Homo sapiens
cctggagtactaaggggatggaa

SEQ ID NO: 8096607 - DNA, 22 bp, Homo sapiens
cctggctctgccgtaaccacca

SEQ ID NO: 8096608 - DNA, 22 bp, Homo sapiens
aggtcccagtctgtgatgactc

SEQ ID NO: 8096609 - DNA, 22 bp, Homo sapiens
aggtagggaagaaggcatgaaa

SEQ ID NO: 8096610 - DNA, 21 bp, Homo sapiens
cctgccaggaaactgagtgtc

SEQ ID NO: 8096611 - DNA, 22 bp, Homo sapiens
cctgccagctgggtaccttcat

SEQ ID NO: 8096612 - DNA, 22 bp, Homo sapiens
cctgccagctgtgggccagcct

SEQ ID NO: 8096613 - DNA, 22 bp, Homo sapiens
cctgccagcgcttatctctcgg

SEQ ID NO: 8096614 - DNA, 22 bp, Homo sapiens
cctgcagcagctgaaatcacag

SEQ ID NO: 8096615 - DNA, 23 bp, Homo sapiens
cctgcagctgccacgccctgctc

SEQ ID NO: 8096616 - DNA, 22 bp, Homo sapiens
cctgccagaggcaaagttttag

SEQ ID NO: 8096617 - DNA, 22 bp, Homo sapiens
cctgccagatcccctgagctga

SEQ ID NO: 8096618 - DNA, 23 bp, Homo sapiens
cctgcagctgctggggctccacc

SEQ ID NO: 8096619 - DNA, 22 bp, Homo sapiens
cctgccagcccccatagagaca

SEQ ID NO: 8096620 - DNA, 22 bp, Homo sapiens
cctgccagccagatcactcgcc

SEQ ID NO: 8096621 - DNA, 22 bp, Homo sapiens
cctgccagcatcttcagcccct

SEQ ID NO: 8096622 - DNA, 22 bp, Homo sapiens
ctcctgcctgtgggactgagga

SEQ ID NO: 8096623 - DNA, 22 bp, Homo sapiens
ctcctgccaccgcggtgtcctg

SEQ ID NO: 8096624 - DNA, 22 bp, Homo sapiens
ctccctcctcaaatatctttgt

SEQ ID NO: 8096625 - DNA, 22 bp, Homo sapiens
ctccctcaggccttagccctgc

SEQ ID NO: 8096626 - DNA, 20 bp, Homo sapiens
ctcctgggactgctggttat

SEQ ID NO: 8096627 - DNA, 22 bp, Homo sapiens
ctcctgggaaaggctggacaca

SEQ ID NO: 8096628 - DNA, 22 bp, Homo sapiens
ctcattgcaacctccgcctccc

SEQ ID NO: 8096629 - DNA, 22 bp, Homo sapiens
ctccagcttctgcccagagact

SEQ ID NO: 8096630 - DNA, 22 bp, Homo sapiens
ctccagcttccctcagctgtgg

SEQ ID NO: 8096631 - DNA, 22 bp, Homo sapiens
ctccagctgccaccagatgttt

SEQ ID NO: 8096632 - DNA, 22 bp, Homo sapiens
ctccagctttttcccagttggc

SEQ ID NO: 8096633 - DNA, 22 bp, Homo sapiens
agtcttctcatttcacatgctt

SEQ ID NO: 8096634 - DNA, 22 bp, Homo sapiens
agtcttctagctgggtttggtt

SEQ ID NO: 8096635 - DNA, 22 bp, Homo sapiens
agtcttcagcatagcatatggc

SEQ ID NO: 8096636 - DNA, 22 bp, Homo sapiens
ctctgcctgtctcatcctgcaa

SEQ ID NO: 8096637 - DNA, 22 bp, Homo sapiens
ctctgctgatctcagctgggct

SEQ ID NO: 8096638 - DNA, 22 bp, Homo sapiens
ctgaaaggtataaataagactt

SEQ ID NO: 8096639 - DNA, 22 bp, Homo sapiens
ctgaaagggttacatagtaagt

SEQ ID NO: 8096640 - DNA, 22 bp, Homo sapiens
ctgaaagggagaacaccaagag

SEQ ID NO: 8096641 - DNA, 22 bp, Homo sapiens
ctgaaaggcagtgggtagtgtg

SEQ ID NO: 8096642 - DNA, 22 bp, Homo sapiens
agttagaatataattatgttaa

SEQ ID NO: 8096643 - DNA, 22 bp, Homo sapiens
agttagaatggatgttgagagc

SEQ ID NO: 8096644 - DNA, 22 bp, Homo sapiens
agttagaatagtcagattgtag

SEQ ID NO: 8096645 - DNA, 22 bp, Homo sapiens
agttagaaagtaaatcatttga

SEQ ID NO: 8096646 - DNA, 22 bp, Homo sapiens
agttagaagtgtgtcatctgtg

SEQ ID NO: 8096647 - DNA, 18 bp, Homo sapiens
agttagaaatgaaggcca

SEQ ID NO: 8096648 - DNA, 22 bp, Homo sapiens
ctgaggagaggtggcctgtgtt

SEQ ID NO: 8096649 - DNA, 22 bp, Homo sapiens
ctgagcagcagggagactggtg

SEQ ID NO: 8096650 - DNA, 22 bp, Homo sapiens
ctgagcagcacagggcgccagg

SEQ ID NO: 8096651 - DNA, 19 bp, Homo sapiens
ctgagcagagggaggaact

SEQ ID NO: 8096652 - DNA, 22 bp, Homo sapiens
ctgaaatcaattttgattatct

SEQ ID NO: 8096653 - DNA, 22 bp, Homo sapiens
ctgaattaagcattacatacat

SEQ ID NO: 8096654 - DNA, 22 bp, Homo sapiens
ctgacacactgagcatttgata

SEQ ID NO: 8096655 - DNA, 22 bp, Homo sapiens
ctgctgaggccttccctgtcct

SEQ ID NO: 8096656 - DNA, 22 bp, Homo sapiens
ctgctgatgtaagccatgctct

SEQ ID NO: 8096657 - DNA, 22 bp, Homo sapiens
ctgctgatgacctcaaactctt

SEQ ID NO: 8096658 - DNA, 22 bp, Homo sapiens
ctgctgatcagggcaaagcaaa

SEQ ID NO: 8096659 - DNA, 22 bp, Homo sapiens
ctgctgatcgaatcagtcaccc

SEQ ID NO: 8096660 - DNA, 22 bp, Homo sapiens
ctgctgaggtccttgctcagac

SEQ ID NO: 8096661 - DNA, 22 bp, Homo sapiens
atacaaatttatagatgcattt

SEQ ID NO: 8096662 - DNA, 22 bp, Homo sapiens
atacaaagtattaatcctggat

SEQ ID NO: 8096663 - DNA, 22 bp, Homo sapiens
atacaaagtattgatcctgagt

SEQ ID NO: 8096664 - DNA, 21 bp, Homo sapiens
ataagcatgctgattacattt

SEQ ID NO: 8096665 - DNA, 22 bp, Homo sapiens
atacaaagctaaatatggtttc

SEQ ID NO: 8096666 - DNA, 22 bp, Homo sapiens
ataagaataattaagttagtcc

SEQ ID NO: 8096667 - DNA, 22 bp, Homo sapiens
ataaatggctttcattcctagg

SEQ ID NO: 8096668 - DNA, 22 bp, Homo sapiens
ataaatctcttaagactcaaca

SEQ ID NO: 8096669 - DNA, 22 bp, Homo sapiens
ataaccctctggataggacagg

SEQ ID NO: 8096670 - DNA, 22 bp, Homo sapiens
ataaatgtttgttgaatgaata

SEQ ID NO: 8096671 - DNA, 22 bp, Homo sapiens
agttattactctttaacatatt

SEQ ID NO: 8096672 - DNA, 22 bp, Homo sapiens
ctgcaagatgttgtcatatgct

SEQ ID NO: 8096673 - DNA, 22 bp, Homo sapiens
atacatagcagagtcaattaat

SEQ ID NO: 8096674 - DNA, 22 bp, Homo sapiens
atacatacgtacatacgtatgt

SEQ ID NO: 8096675 - DNA, 22 bp, Homo sapiens
atacataattacttccgatgtt

SEQ ID NO: 8096676 - DNA, 17 bp, Homo sapiens
atacagtttattttaca

SEQ ID NO: 8096677 - DNA, 21 bp, Homo sapiens
atacagtggtatgaatgtagg

SEQ ID NO: 8096678 - DNA, 22 bp, Homo sapiens
atacatagttctgtgaaaagta

SEQ ID NO: 8096679 - DNA, 22 bp, Homo sapiens
atacatgtgtgtgcatacatgt

SEQ ID NO: 8096680 - DNA, 22 bp, Homo sapiens
atacccagccccagctgcagga

SEQ ID NO: 8096681 - DNA, 22 bp, Homo sapiens
atacccagagtgggtagagtta

SEQ ID NO: 8096682 - DNA, 22 bp, Homo sapiens
ctgctgccaagggtgccacagg

SEQ ID NO: 8096683 - DNA, 22 bp, Homo sapiens
ctggagagaatgtggaatgatt

SEQ ID NO: 8096684 - DNA, 22 bp, Homo sapiens
ctggaatgtatgtatcttaaga

SEQ ID NO: 8096685 - DNA, 22 bp, Homo sapiens
ctggctggcagatgctcttgct

SEQ ID NO: 8096686 - DNA, 22 bp, Homo sapiens
ctggctgcagctccgaggaaga

SEQ ID NO: 8096687 - DNA, 22 bp, Homo sapiens
atactaaagtatagaacttagt

SEQ ID NO: 8096688 - DNA, 22 bp, Homo sapiens
atactaaagtatagaacttagt

SEQ ID NO: 8096689 - DNA, 22 bp, Homo sapiens
atactacacattgactatattt

SEQ ID NO: 8096690 - DNA, 21 bp, Homo sapiens
atactacatttctctgacttt

SEQ ID NO: 8096691 - DNA, 22 bp, Homo sapiens
atccagggtgtggagagagctc

SEQ ID NO: 8096692 - DNA, 22 bp, Homo sapiens
atccagttaagatgaggtcata

SEQ ID NO: 8096693 - DNA, 22 bp, Homo sapiens
atccagttccaaagatcattta

SEQ ID NO: 8096694 - DNA, 22 bp, Homo sapiens
atccagttcttggaagcacagg

SEQ ID NO: 8096695 - DNA, 22 bp, Homo sapiens
atccagtttatgtcatattctt

SEQ ID NO: 8096696 - DNA, 22 bp, Homo sapiens
ctgtgtgctgaaatgcagtgag

SEQ ID NO: 8096697 - DNA, 22 bp, Homo sapiens
ctgtgggaatactgcgagtgta

SEQ ID NO: 8096698 - DNA, 22 bp, Homo sapiens
ctgtggctcaaaatcccatgat

SEQ ID NO: 8096699 - DNA, 23 bp, Homo sapiens
ctgtggccctgcttcatgcagcc

SEQ ID NO: 8096700 - DNA, 22 bp, Homo sapiens
ctgtggcctgtgccagaactgg

SEQ ID NO: 8096701 - DNA, 22 bp, Homo sapiens
ctgtggcctttgttggaggtcc

SEQ ID NO: 8096702 - DNA, 22 bp, Homo sapiens
atcagagacaaaaccagcactt

SEQ ID NO: 8096703 - DNA, 22 bp, Homo sapiens
ctgtggagtgtagatgctgggt

SEQ ID NO: 8096704 - DNA, 22 bp, Homo sapiens
atcagaattagccagtgaggct

SEQ ID NO: 8096705 - DNA, 22 bp, Homo sapiens
atcagacaattgttgagtactg

SEQ ID NO: 8096706 - DNA, 22 bp, Homo sapiens
atcagaatgcagccagcagtta

SEQ ID NO: 8096707 - DNA, 22 bp, Homo sapiens
atcagaatgcagccagcagtta

SEQ ID NO: 8096708 - DNA, 22 bp, Homo sapiens
atcagaatgttttggtgtgctc

SEQ ID NO: 8096709 - DNA, 22 bp, Homo sapiens
atcagaatggagcccacatggt

SEQ ID NO: 8096710 - DNA, 22 bp, Homo sapiens
atcagaatggagcccacatggt

SEQ ID NO: 8096711 - DNA, 22 bp, Homo sapiens
cttccaggttctggttgggaag

SEQ ID NO: 8096712 - DNA, 22 bp, Homo sapiens
cttccagtagtatcattctcat

SEQ ID NO: 8096713 - DNA, 22 bp, Homo sapiens
cttccagtctagagctatctgt

SEQ ID NO: 8096714 - DNA, 22 bp, Homo sapiens
cttcctcccggcccatgctctg

SEQ ID NO: 8096715 - DNA, 22 bp, Homo sapiens
cttagagatgggttttacttag

SEQ ID NO: 8096716 - DNA, 22 bp, Homo sapiens
cttcctccgaagaagttgctgg

SEQ ID NO: 8096717 - DNA, 22 bp, Homo sapiens
atctgaaagctaggagttctca

SEQ ID NO: 8096718 - DNA, 22 bp, Homo sapiens
atctgaagtggagaaaaatata

SEQ ID NO: 8096719 - DNA, 22 bp, Homo sapiens
cttcttggaagtcgtccttcca

SEQ ID NO: 8096720 - DNA, 21 bp, Homo sapiens
atcaacattgaaagagctgga

SEQ ID NO: 8096721 - DNA, 22 bp, Homo sapiens
atcaacatatgcatgggaaagt

SEQ ID NO: 8096722 - DNA, 22 bp, Homo sapiens
atcagaaaaacataatgttatt

SEQ ID NO: 8096723 - DNA, 22 bp, Homo sapiens
atcaaatacaaagggcataagg

SEQ ID NO: 8096724 - DNA, 22 bp, Homo sapiens
atcaaataaaggtacctagctt

SEQ ID NO: 8096725 - DNA, 22 bp, Homo sapiens
atcaaagtttcccagaagttgt

SEQ ID NO: 8096726 - DNA, 22 bp, Homo sapiens
atcaaattatgtgctacaagaa

SEQ ID NO: 8096727 - DNA, 22 bp, Homo sapiens
atcaaattggaatgaaaggctc

SEQ ID NO: 8096728 - DNA, 22 bp, Homo sapiens
atcaaatcattgcattaatgtt

SEQ ID NO: 8096729 - DNA, 22 bp, Homo sapiens
atcaaatataataattttcgct

SEQ ID NO: 8096730 - DNA, 22 bp, Homo sapiens
atcagaaagttcatcatgtttg

SEQ ID NO: 8096731 - DNA, 22 bp, Homo sapiens
atcagaaagttcatcatgtttg

SEQ ID NO: 8096732 - DNA, 22 bp, Homo sapiens
atcagaaaggtgggcaagcaga

SEQ ID NO: 8096733 - DNA, 22 bp, Homo sapiens
atcagaaatagtcatgttactt

SEQ ID NO: 8096734 - DNA, 22 bp, Homo sapiens
atcagaaatctaggattcagaa

SEQ ID NO: 8096735 - DNA, 22 bp, Homo sapiens
atcagaaaatacccagtgttta

SEQ ID NO: 8096736 - DNA, 22 bp, Homo sapiens
atcagaaaatacccagtgttta

SEQ ID NO: 8096737 - DNA, 22 bp, Homo sapiens
atcagaaaaatgagaagagctg

SEQ ID NO: 8096738 - DNA, 22 bp, Homo sapiens
atcagaaactcttagagcaggg

SEQ ID NO: 8096739 - DNA, 22 bp, Homo sapiens
atcagaaattgcccagctgttt

SEQ ID NO: 8096740 - DNA, 22 bp, Homo sapiens
atcagaatagtgggggacagtc

SEQ ID NO: 8096741 - DNA, 22 bp, Homo sapiens
atcagaatcatttcatccctat

SEQ ID NO: 8096742 - DNA, 22 bp, Homo sapiens
atcagaatactatcaacagtga

SEQ ID NO: 8096743 - DNA, 22 bp, Homo sapiens
atcagaatactatcaacagtga

SEQ ID NO: 8096744 - DNA, 22 bp, Homo sapiens
atcagaataattagatttcaga

SEQ ID NO: 8096745 - DNA, 22 bp, Homo sapiens
atattttggcaaatgtctagat

SEQ ID NO: 8096746 - DNA, 22 bp, Homo sapiens
atatttactgctgtggtgaagg

SEQ ID NO: 8096747 - DNA, 22 bp, Homo sapiens
atcaaagagtgagatttttact

SEQ ID NO: 8096748 - DNA, 22 bp, Homo sapiens
atcaaagatgtttcagggtgta

SEQ ID NO: 8096749 - DNA, 22 bp, Homo sapiens
atcaaagagcttgacaatccta

SEQ ID NO: 8096750 - DNA, 22 bp, Homo sapiens
atcaaagtaggcatatgttttt

SEQ ID NO: 8096751 - DNA, 22 bp, Homo sapiens
atcaaagtatctcaatatggta

SEQ ID NO: 8096752 - DNA, 22 bp, Homo sapiens
atcaaagtatctcaatatggta

SEQ ID NO: 8096753 - DNA, 22 bp, Homo sapiens
atcaaagtaattaacactgaga

SEQ ID NO: 8096754 - DNA, 22 bp, Homo sapiens
atcaaagtgatttgtaaacagg

SEQ ID NO: 8096755 - DNA, 22 bp, Homo sapiens
atcaaagtccatcagaaggtag

SEQ ID NO: 8096756 - DNA, 22 bp, Homo sapiens
atcaaagtccatcagaaggtag

SEQ ID NO: 8096757 - DNA, 22 bp, Homo sapiens
atcaaagtgaaaagtgctgatg

SEQ ID NO: 8096758 - DNA, 22 bp, Homo sapiens
atcaaagtggaagtttactagg

SEQ ID NO: 8096759 - DNA, 22 bp, Homo sapiens
atcaaagtggttttctgtgctt

SEQ ID NO: 8096760 - DNA, 22 bp, Homo sapiens
ctgggctcacctgtggctggca

SEQ ID NO: 8096761 - DNA, 22 bp, Homo sapiens
ctgggctcagcaggccaaggcc

SEQ ID NO: 8096762 - DNA, 22 bp, Homo sapiens
ctgggctcagaaccttgttaag

SEQ ID NO: 8096763 - DNA, 22 bp, Homo sapiens
ctgggcctggtagggcttgaaa

SEQ ID NO: 8096764 - DNA, 22 bp, Homo sapiens
ctgggcctggtagggcttgaaa

SEQ ID NO: 8096765 - DNA, 22 bp, Homo sapiens
ctgggcctggtgtggcacctgc

SEQ ID NO: 8096766 - DNA, 20 bp, Homo sapiens
ctgggctcaagtgagcctcc

SEQ ID NO: 8096767 - DNA, 20 bp, Homo sapiens
ctgggctcaagtgatcctcc

SEQ ID NO: 8096768 - DNA, 22 bp, Homo sapiens
atattagcagtgatcaaaatgg

SEQ ID NO: 8096769 - DNA, 22 bp, Homo sapiens
atattagtgtaggtagctaata

SEQ ID NO: 8096770 - DNA, 22 bp, Homo sapiens
ctgggctctgcggtgtcgctct

SEQ ID NO: 8096771 - DNA, 22 bp, Homo sapiens
atattatggccccatctaagct

SEQ ID NO: 8096772 - DNA, 22 bp, Homo sapiens
ctgggctctgtgtttcagtttc

SEQ ID NO: 8096773 - DNA, 22 bp, Homo sapiens
ctgggctcttctcaccctgttt

SEQ ID NO: 8096774 - DNA, 22 bp, Homo sapiens
catacaatcaagttctttatta

SEQ ID NO: 8096775 - DNA, 22 bp, Homo sapiens
catacaagcgtgcatgtgcttg

SEQ ID NO: 8096776 - DNA, 22 bp, Homo sapiens
catacaagcgttcaatagatgt

SEQ ID NO: 8096777 - DNA, 22 bp, Homo sapiens
catacatatgcatgtgtgtata

SEQ ID NO: 8096778 - DNA, 22 bp, Homo sapiens
catacagagaaggataataaag

SEQ ID NO: 8096779 - DNA, 22 bp, Homo sapiens
catacaaatgtgtccaggctct

SEQ ID NO: 8096780 - DNA, 20 bp, Homo sapiens
aggaggcctgcagatagttc

SEQ ID NO: 8096781 - DNA, 22 bp, Homo sapiens
aggaggcctgcagctgccattc

SEQ ID NO: 8096782 - DNA, 22 bp, Homo sapiens
aggaggcctggctggggagatc

SEQ ID NO: 8096783 - DNA, 20 bp, Homo sapiens
catctcctgcctccatgttc

SEQ ID NO: 8096784 - DNA, 22 bp, Homo sapiens
catctcatagtgcagtgctgta

SEQ ID NO: 8096785 - DNA, 22 bp, Homo sapiens
catacatatgtggatgtcatat

SEQ ID NO: 8096786 - DNA, 22 bp, Homo sapiens
catcttaatttctaacaggcac

SEQ ID NO: 8096787 - DNA, 19 bp, Homo sapiens
catctctgcaaggagctgc

SEQ ID NO: 8096788 - DNA, 22 bp, Homo sapiens
catgagcttaactgtgaaatgg

SEQ ID NO: 8096789 - DNA, 22 bp, Homo sapiens
catgagataatttttctccagt

SEQ ID NO: 8096790 - DNA, 22 bp, Homo sapiens
aggatggggtctgcagcctggt

SEQ ID NO: 8096791 - DNA, 23 bp, Homo sapiens
aggatgggtggcaatagaaagac

SEQ ID NO: 8096792 - DNA, 23 bp, Homo sapiens
aggatgtaggatgtatggcagag

SEQ ID NO: 8096793 - DNA, 22 bp, Homo sapiens
cataacatctgtgaagcaggaa

SEQ ID NO: 8096794 - DNA, 22 bp, Homo sapiens
cataacatgtacatataaatgc

SEQ ID NO: 8096795 - DNA, 22 bp, Homo sapiens
aggaggcagatgcttggctgta

SEQ ID NO: 8096796 - DNA, 22 bp, Homo sapiens
aggaggcaggaagtctatggga

SEQ ID NO: 8096797 - DNA, 22 bp, Homo sapiens
aggaggcctctatccagagaga

SEQ ID NO: 8096798 - DNA, 22 bp, Homo sapiens
aggaggccgggattctggagat

SEQ ID NO: 8096799 - DNA, 22 bp, Homo sapiens
aggaggcctacgcacatgtcta

SEQ ID NO: 8096800 - DNA, 22 bp, Homo sapiens
cagtgtggtgtgcacagcttag

SEQ ID NO: 8096801 - DNA, 21 bp, Homo sapiens
cagtgtggtgaccagggtctc

SEQ ID NO: 8096802 - DNA, 22 bp, Homo sapiens
cagtgttccctgaacatatgtt

SEQ ID NO: 8096803 - DNA, 22 bp, Homo sapiens
aggagccagaatccagactcgg

SEQ ID NO: 8096804 - DNA, 22 bp, Homo sapiens
aggagccagcgttcctcaggat

SEQ ID NO: 8096805 - DNA, 23 bp, Homo sapiens
aggagccaggtgcagcccttgtg

SEQ ID NO: 8096806 - DNA, 22 bp, Homo sapiens
aggagccaggaaacctgctctg

SEQ ID NO: 8096807 - DNA, 22 bp, Homo sapiens
cagtccagagcccaccagagga

SEQ ID NO: 8096808 - DNA, 22 bp, Homo sapiens
cagtccagagtatatccgcttt

SEQ ID NO: 8096809 - DNA, 22 bp, Homo sapiens
cagtccaggcctggaggagcca

SEQ ID NO: 8096810 - DNA, 22 bp, Homo sapiens
cagtccagctcatcagtggcac

SEQ ID NO: 8096811 - DNA, 20 bp, Homo sapiens
cagtccaggctgcagcatct

SEQ ID NO: 8096812 - DNA, 22 bp, Homo sapiens
cagtgtgggtttgggaggagta

SEQ ID NO: 8096813 - DNA, 21 bp, Homo sapiens
aggcacttaaccaatgttagc

SEQ ID NO: 8096814 - DNA, 22 bp, Homo sapiens
aggcactttaggatcaggttga

SEQ ID NO: 8096815 - DNA, 22 bp, Homo sapiens
aggcactttaggatcaggttga

SEQ ID NO: 8096816 - DNA, 22 bp, Homo sapiens
aggcacttaacctactaactga

SEQ ID NO: 8096817 - DNA, 22 bp, Homo sapiens
ccacagagacagagcccagggt

SEQ ID NO: 8096818 - DNA, 19 bp, Homo sapiens
ccacagagcatgctgaggc

SEQ ID NO: 8096819 - DNA, 17 bp, Homo sapiens
aggcaggagattggaga

SEQ ID NO: 8096820 - DNA, 20 bp, Homo sapiens
ccacctggccaaggctgtgc

SEQ ID NO: 8096821 - DNA, 22 bp, Homo sapiens
ccacggccacccgctcatgggc

SEQ ID NO: 8096822 - DNA, 22 bp, Homo sapiens
agctgtctttcattacctcatt

SEQ ID NO: 8096823 - DNA, 22 bp, Homo sapiens
agctgtctgtctcctgaggaga

SEQ ID NO: 8096824 - DNA, 22 bp, Homo sapiens
agcttactcttcaagaacaagc

SEQ ID NO: 8096825 - DNA, 22 bp, Homo sapiens
caggcccatgagggcagccaca

SEQ ID NO: 8096826 - DNA, 22 bp, Homo sapiens
caggcccatctgctcccaggct

SEQ ID NO: 8096827 - DNA, 22 bp, Homo sapiens
agctgtctacagcaataaagga

SEQ ID NO: 8096828 - DNA, 22 bp, Homo sapiens
agctgtctccagatacaggatt

SEQ ID NO: 8096829 - DNA, 22 bp, Homo sapiens
caggcagtgtcccaggaagcca

SEQ ID NO: 8096830 - DNA, 22 bp, Homo sapiens
caggcaggtcagtgaagaagga

SEQ ID NO: 8096831 - DNA, 22 bp, Homo sapiens
caggagccagaggcggatggag

SEQ ID NO: 8096832 - DNA, 22 bp, Homo sapiens
caggcacacagcacatggcctg

SEQ ID NO: 8096833 - DNA, 22 bp, Homo sapiens
caggatggtcagatgcattgtc

SEQ ID NO: 8096834 - DNA, 22 bp, Homo sapiens
caggatggtcagatgcattgtc

SEQ ID NO: 8096835 - DNA, 22 bp, Homo sapiens
cagctgttgactggtacatgaa

SEQ ID NO: 8096836 - DNA, 22 bp, Homo sapiens
cagctgttcttgggacagacag

SEQ ID NO: 8096837 - DNA, 22 bp, Homo sapiens
cagctgttcggggctggcatgt

SEQ ID NO: 8096838 - DNA, 22 bp, Homo sapiens
cagctgttgatctcttaagcct

SEQ ID NO: 8096839 - DNA, 22 bp, Homo sapiens
cagctgttgatctcttaagcct

SEQ ID NO: 8096840 - DNA, 22 bp, Homo sapiens
cagctgttgtcacctcacatcc

SEQ ID NO: 8096841 - DNA, 22 bp, Homo sapiens
cagctgttgcagcactgagaga

SEQ ID NO: 8096842 - DNA, 22 bp, Homo sapiens
cagctgggtttagtggggtgtg

SEQ ID NO: 8096843 - DNA, 22 bp, Homo sapiens
cagctggttatcagagaggcct

SEQ ID NO: 8096844 - DNA, 23 bp, Homo sapiens
cagctggttgtgggagtggctgc

SEQ ID NO: 8096845 - DNA, 22 bp, Homo sapiens
cagctgtccaaacacattaact

SEQ ID NO: 8096846 - DNA, 22 bp, Homo sapiens
cagctgtcagccggtgcaggct

SEQ ID NO: 8096847 - DNA, 22 bp, Homo sapiens
cagctgttaccaatcttagggc

SEQ ID NO: 8096848 - DNA, 22 bp, Homo sapiens
cagctgttatgaggtgtacatg

SEQ ID NO: 8096849 - DNA, 22 bp, Homo sapiens
cagctgttactctgagtaaatg

SEQ ID NO: 8096850 - DNA, 22 bp, Homo sapiens
cagctgttactgaagtaaaatg

SEQ ID NO: 8096851 - DNA, 22 bp, Homo sapiens
cagctgttcacatttccaaaac

SEQ ID NO: 8096852 - DNA, 22 bp, Homo sapiens
cagctgttcctggaaggagacc

SEQ ID NO: 8096853 - DNA, 22 bp, Homo sapiens
cagctgttcattgttgccaccc

SEQ ID NO: 8096854 - DNA, 22 bp, Homo sapiens
cagctgttcctggttggtggga

SEQ ID NO: 8096855 - DNA, 22 bp, Homo sapiens
cagctgttcagcaactcgcaga

SEQ ID NO: 8096856 - DNA, 22 bp, Homo sapiens
aggaagagctggaccagaggac

SEQ ID NO: 8096857 - DNA, 22 bp, Homo sapiens
aggaagagcccgggtgacataa

SEQ ID NO: 8096858 - DNA, 23 bp, Homo sapiens
aggaagaggcaatttctcttaga

SEQ ID NO: 8096859 - DNA, 22 bp, Homo sapiens
aggaaaggcctcagcagaaacc

SEQ ID NO: 8096860 - DNA, 22 bp, Homo sapiens
cagggctgggttaaaagcaggg

SEQ ID NO: 8096861 - DNA, 22 bp, Homo sapiens
cagggctggctcatgaaaagtt

SEQ ID NO: 8096862 - DNA, 22 bp, Homo sapiens
cagggctggctgtggcaatctc

SEQ ID NO: 8096863 - DNA, 22 bp, Homo sapiens
aggaatatgagctgctgcagtg

SEQ ID NO: 8096864 - DNA, 22 bp, Homo sapiens
caggtgggattttgctgcttga

SEQ ID NO: 8096865 - DNA, 22 bp, Homo sapiens
cagtaaatttgagggatctaat

SEQ ID NO: 8096866 - DNA, 22 bp, Homo sapiens
cagtattcatctaaggagcttg

SEQ ID NO: 8096867 - DNA, 22 bp, Homo sapiens
cagtatttcctcttcttaactt

SEQ ID NO: 8096868 - DNA, 22 bp, Homo sapiens
cagtatttggaatatagctaag

SEQ ID NO: 8096869 - DNA, 22 bp, Homo sapiens
cagtatttggaatatagctaag

SEQ ID NO: 8096870 - DNA, 22 bp, Homo sapiens
cagtaactgatgtgatcaaacg

SEQ ID NO: 8096871 - DNA, 22 bp, Homo sapiens
cagtaatagatttgagagtggt

SEQ ID NO: 8096872 - DNA, 22 bp, Homo sapiens
cagtatgattgccagttctatc

SEQ ID NO: 8096873 - DNA, 22 bp, Homo sapiens
agggaaaggctgatgctgtggg

SEQ ID NO: 8096874 - DNA, 22 bp, Homo sapiens
aggcttttggagaagcatatgc

SEQ ID NO: 8096875 - DNA, 22 bp, Homo sapiens
cccagatgcaggttcaagagta

SEQ ID NO: 8096876 - DNA, 23 bp, Homo sapiens
cccagagtcatctgtagctgtgg

SEQ ID NO: 8096877 - DNA, 22 bp, Homo sapiens
cccagagtggacggtggcccct

SEQ ID NO: 8096878 - DNA, 22 bp, Homo sapiens
cccagagtggagggtgcagaat

SEQ ID NO: 8096879 - DNA, 22 bp, Homo sapiens
cccagagttcaaaccctgcgtc

SEQ ID NO: 8096880 - DNA, 22 bp, Homo sapiens
cccagagttggtcaggggaccc

SEQ ID NO: 8096881 - DNA, 22 bp, Homo sapiens
cccagagtatttgtgatgttag

SEQ ID NO: 8096882 - DNA, 22 bp, Homo sapiens
cccagagtcaagcttaccatta

SEQ ID NO: 8096883 - DNA, 22 bp, Homo sapiens
cccagagtcacatggggtgttc

SEQ ID NO: 8096884 - DNA, 22 bp, Homo sapiens
cccagagtctctgctcttgcct

SEQ ID NO: 8096885 - DNA, 22 bp, Homo sapiens
cccaggccctggcagagcttgt

SEQ ID NO: 8096886 - DNA, 22 bp, Homo sapiens
agggcatgtgggagaggagcct

SEQ ID NO: 8096887 - DNA, 22 bp, Homo sapiens
cccctgggtccaggcttctctg

SEQ ID NO: 8096888 - DNA, 22 bp, Homo sapiens
cccctgggtccaggcttctctg

SEQ ID NO: 8096889 - DNA, 22 bp, Homo sapiens
cccctgccagctatccctgaac

SEQ ID NO: 8096890 - DNA, 22 bp, Homo sapiens
cccctgccagctatccctgaac

SEQ ID NO: 8096891 - DNA, 22 bp, Homo sapiens
cccctgaagacaatggagaggt

SEQ ID NO: 8096892 - DNA, 22 bp, Homo sapiens
cccctgccatagtcaaatctaa

SEQ ID NO: 8096893 - DNA, 21 bp, Homo sapiens
cccctgggagccctgtcagta

SEQ ID NO: 8096894 - DNA, 22 bp, Homo sapiens
agggcagaagtacagacactta

SEQ ID NO: 8096895 - DNA, 22 bp, Homo sapiens
agggatggtggaggaatttcaa

SEQ ID NO: 8096896 - DNA, 22 bp, Homo sapiens
aggggcctggttggcctctgtt

SEQ ID NO: 8096897 - DNA, 22 bp, Homo sapiens
aggggctcaaagtgtgcaggga

SEQ ID NO: 8096898 - DNA, 22 bp, Homo sapiens
aggggctcctggcctggagagc

SEQ ID NO: 8096899 - DNA, 22 bp, Homo sapiens
aggggctcctctctgagagtag

SEQ ID NO: 8096900 - DNA, 22 bp, Homo sapiens
cctccttctggggccttctgct

SEQ ID NO: 8096901 - DNA, 22 bp, Homo sapiens
cctcctggtgggcgcttctggc

SEQ ID NO: 8096902 - DNA, 22 bp, Homo sapiens
cctcctggtgggcgcttctggc

SEQ ID NO: 8096903 - DNA, 22 bp, Homo sapiens
aggggtcttgggagtcctggct

SEQ ID NO: 8096904 - DNA, 20 bp, Homo sapiens
aggggtctagcagcagtgct

SEQ ID NO: 8096905 - DNA, 22 bp, Homo sapiens
aggggtcagtgaccattgagga

SEQ ID NO: 8096906 - DNA, 22 bp, Homo sapiens
aggggtcagcccttttgtcagc

SEQ ID NO: 8096907 - DNA, 22 bp, Homo sapiens
aggggtagagattgctggtgta

SEQ ID NO: 8096908 - DNA, 22 bp, Homo sapiens
agggggagacatgtgtgtgttt

SEQ ID NO: 8096909 - DNA, 22 bp, Homo sapiens
cctctgtgtgtgcatgcatgcg

SEQ ID NO: 8096910 - DNA, 20 bp, Homo sapiens
cctctgtgtcctgtgtcata

SEQ ID NO: 8096911 - DNA, 22 bp, Homo sapiens
cctctgtgtcctggtcattgaa

SEQ ID NO: 8096912 - DNA, 22 bp, Homo sapiens
cctctgtgggccgggcctgctg

SEQ ID NO: 8096913 - DNA, 22 bp, Homo sapiens
cctactctgagcgcctccgcat

SEQ ID NO: 8096914 - DNA, 22 bp, Homo sapiens
agggcctgtgaattctccctgc

SEQ ID NO: 8096915 - DNA, 21 bp, Homo sapiens
agggcctgtgctctccaggtc

SEQ ID NO: 8096916 - DNA, 22 bp, Homo sapiens
agggcctgtccgctcccgcccg

SEQ ID NO: 8096917 - DNA, 22 bp, Homo sapiens
agggcctgggaagaggaaccct

SEQ ID NO: 8096918 - DNA, 22 bp, Homo sapiens
agggcctgtccgctcccgcccg

SEQ ID NO: 8096919 - DNA, 22 bp, Homo sapiens
agggcctgtctgtagaactgaa

SEQ ID NO: 8096920 - DNA, 22 bp, Homo sapiens
agggcctgtgcttcctgagata

SEQ ID NO: 8096921 - DNA, 22 bp, Homo sapiens
cctacagagcagcaggaccaga

SEQ ID NO: 8096922 - DNA, 22 bp, Homo sapiens
cctacagacaaaccagtgacta

SEQ ID NO: 8096923 - DNA, 22 bp, Homo sapiens
ccctggcatgcatgtccctggc

SEQ ID NO: 8096924 - DNA, 22 bp, Homo sapiens
cccacctctcagagagccttgc

SEQ ID NO: 8096925 - DNA, 22 bp, Homo sapiens
cccaccctgggctacacatcca

SEQ ID NO: 8096926 - DNA, 22 bp, Homo sapiens
cccacgtcgaacttgctccaga

SEQ ID NO: 8096927 - DNA, 21 bp, Homo sapiens
cccacggaatgatgaggcact

SEQ ID NO: 8096928 - DNA, 22 bp, Homo sapiens
aggctgtgctcagccaatggga

SEQ ID NO: 8096929 - DNA, 22 bp, Homo sapiens
aggctgtgcgaggtctcagagt

SEQ ID NO: 8096930 - DNA, 22 bp, Homo sapiens
cccagaggttccttagggacca

SEQ ID NO: 8096931 - DNA, 22 bp, Homo sapiens
cccagaggtgcttcagaggtgc

SEQ ID NO: 8096932 - DNA, 22 bp, Homo sapiens
ccagtgtctactgtggcatatc

SEQ ID NO: 8096933 - DNA, 22 bp, Homo sapiens
ccattttgtctcctgaaatcta

SEQ ID NO: 8096934 - DNA, 22 bp, Homo sapiens
cccacacatttttcacttaccg

SEQ ID NO: 8096935 - DNA, 22 bp, Homo sapiens
ccagtgggtaggccatggtgag

SEQ ID NO: 8096936 - DNA, 22 bp, Homo sapiens
ccagtgggtgctgggctctgcc

SEQ ID NO: 8096937 - DNA, 22 bp, Homo sapiens
aggctgcagtgcaggtaggatt

SEQ ID NO: 8096938 - DNA, 22 bp, Homo sapiens
aggctcagcctgggcctagagc

SEQ ID NO: 8096939 - DNA, 22 bp, Homo sapiens
aggctcagcatctgattcatat

SEQ ID NO: 8096940 - DNA, 22 bp, Homo sapiens
aggctcagattcacatttggtt

SEQ ID NO: 8096941 - DNA, 22 bp, Homo sapiens
aggctcagatccttgtgtcctg

SEQ ID NO: 8096942 - DNA, 22 bp, Homo sapiens
ccaggcctcccttttccagcca

SEQ ID NO: 8096943 - DNA, 22 bp, Homo sapiens
ccaggtggtgaaagtgggccct

SEQ ID NO: 8096944 - DNA, 22 bp, Homo sapiens
ccagccagctggttggacgcct

SEQ ID NO: 8096945 - DNA, 22 bp, Homo sapiens
ccagagtccctgttctcggcct

SEQ ID NO: 8096946 - DNA, 22 bp, Homo sapiens
ccagagtcccttgcagctcagt

SEQ ID NO: 8096947 - DNA, 22 bp, Homo sapiens
ccagagtctatgagtcctcatt

SEQ ID NO: 8096948 - DNA, 22 bp, Homo sapiens
ccagagtctttatattcctgaa

SEQ ID NO: 8096949 - DNA, 22 bp, Homo sapiens
ccagagtctgtgtgtgtcatcc

SEQ ID NO: 8096950 - DNA, 17 bp, Homo sapiens
ccagccctcgcgctttt

SEQ ID NO: 8096951 - DNA, 22 bp, Homo sapiens
ccagccctcctccatcagagga

SEQ ID NO: 8096952 - DNA, 23 bp, Homo sapiens
ccagccctccaccagctctaggc

SEQ ID NO: 8096953 - DNA, 22 bp, Homo sapiens
ccagccctgattagagaatgtc

SEQ ID NO: 8096954 - DNA, 22 bp, Homo sapiens
ccagccctgaaccctgctgcat

SEQ ID NO: 8096955 - DNA, 18 bp, Homo sapiens
ccagccctgcagcacctg

SEQ ID NO: 8096956 - DNA, 22 bp, Homo sapiens
aggccctgcccagtgccacaag

SEQ ID NO: 8096957 - DNA, 19 bp, Homo sapiens
ccagagtcatgtctccccc

SEQ ID NO: 8096958 - DNA, 22 bp, Homo sapiens
ccagagtcattttgagtcataa

SEQ ID NO: 8096959 - DNA, 22 bp, Homo sapiens
ccagagtcaggagctcatgtga

SEQ ID NO: 8096960 - DNA, 19 bp, Homo sapiens
ccagaggcagcttctgtaa

SEQ ID NO: 8096961 - DNA, 22 bp, Homo sapiens
aggctcagaggtgagcatctgc

SEQ ID NO: 8096962 - DNA, 20 bp, Homo sapiens
aggctcagagcagtagtaca

SEQ ID NO: 8096963 - DNA, 20 bp, Homo sapiens
aggctcagatacccagggaa

SEQ ID NO: 8096964 - DNA, 22 bp, Homo sapiens
aggctcagagagctgtgtccat

SEQ ID NO: 8096965 - DNA, 21 bp, Homo sapiens
aggctcagagagaaactcttg

SEQ ID NO: 8096966 - DNA, 22 bp, Homo sapiens
ccaggaggatgaggggcataga

SEQ ID NO: 8096967 - DNA, 22 bp, Homo sapiens
ccaggaggggtctctgtctccc

SEQ ID NO: 8096968 - DNA, 22 bp, Homo sapiens
ccaggaggtggcaggacttgcc

SEQ ID NO: 8096969 - DNA, 22 bp, Homo sapiens
ccaggaggtggagattgcagtg

SEQ ID NO: 8096970 - DNA, 22 bp, Homo sapiens
aggccctgctttccagagctca

SEQ ID NO: 8096971 - DNA, 22 bp, Homo sapiens
aggccctgctgaggcctccctc

SEQ ID NO: 8096972 - DNA, 21 bp, Homo sapiens
aggccctggaggtcagagaaa

SEQ ID NO: 8096973 - DNA, 22 bp, Homo sapiens
ccagctcccgcaggctgcacag

SEQ ID NO: 8096974 - DNA, 20 bp, Homo sapiens
agggcaaaatccaaaagtct

SEQ ID NO: 8096975 - DNA, 20 bp, Homo sapiens
agggaggtgctgggcctgag

SEQ ID NO: 8096976 - DNA, 22 bp, Homo sapiens
agggaggtccatccctgcagag

SEQ ID NO: 8096977 - DNA, 22 bp, Homo sapiens
accagagatgtctaataggggc

SEQ ID NO: 8096978 - DNA, 22 bp, Homo sapiens
agggaggatagtagtcagttta

SEQ ID NO: 8096979 - DNA, 22 bp, Homo sapiens
agggaggcaggaaagttgtctg

SEQ ID NO: 8096980 - DNA, 22 bp, Homo sapiens
agggccagcagcttggccaacc

SEQ ID NO: 8096981 - DNA, 22 bp, Homo sapiens
agggcatgctggaggagagaca

SEQ ID NO: 8096982 - DNA, 22 bp, Homo sapiens
agggcctgtcagcggtgtcctg

SEQ ID NO: 8096983 - DNA, 22 bp, Homo sapiens
agggctcaatggtgggcatgta

SEQ ID NO: 8096984 - DNA, 22 bp, Homo sapiens
acctcagagggatgttacaggc

SEQ ID NO: 8096985 - DNA, 22 bp, Homo sapiens
acctcagagacctctcaggtgc

SEQ ID NO: 8096986 - DNA, 20 bp, Homo sapiens
aggggcctggaacaggcctt

SEQ ID NO: 8096987 - DNA, 22 bp, Homo sapiens
aggggcctggacatggacgcgc

SEQ ID NO: 8096988 - DNA, 20 bp, Homo sapiens
aggggcctggaacaggcctt

SEQ ID NO: 8096989 - DNA, 22 bp, Homo sapiens
aggggcctcgcaggaccgctcc

SEQ ID NO: 8096990 - DNA, 22 bp, Homo sapiens
aggggccattgttctgcccgct

SEQ ID NO: 8096991 - DNA, 22 bp, Homo sapiens
acctccattttgtttcaggctg

SEQ ID NO: 8096992 - DNA, 22 bp, Homo sapiens
acctccatccactagatgccag

SEQ ID NO: 8096993 - DNA, 22 bp, Homo sapiens
acctccatggctcagtttcaga

SEQ ID NO: 8096994 - DNA, 22 bp, Homo sapiens
aggggtggagagtgttgccagt

SEQ ID NO: 8096995 - DNA, 23 bp, Homo sapiens
aggggtggtcagtacccgcagtg

SEQ ID NO: 8096996 - DNA, 22 bp, Homo sapiens
agggctcactacaaccctggga

SEQ ID NO: 8096997 - DNA, 22 bp, Homo sapiens
agggctcagcctcctcctcagc

SEQ ID NO: 8096998 - DNA, 22 bp, Homo sapiens
agggctcaggggccccaagctg

SEQ ID NO: 8096999 - DNA, 22 bp, Homo sapiens
agggctcagtaaacggtggatt

SEQ ID NO: 8097000 - DNA, 22 bp, Homo sapiens
aggggcaggtgctgcacttaga

SEQ ID NO: 8097001 - DNA, 22 bp, Homo sapiens
aggggaggagcttttcttgcct

SEQ ID NO: 8097002 - DNA, 23 bp, Homo sapiens
aggctgcagaagaatagggtcat

SEQ ID NO: 8097003 - DNA, 22 bp, Homo sapiens
aggctggccagtgctgcagtgg

SEQ ID NO: 8097004 - DNA, 23 bp, Homo sapiens
aggctggcttcaggagcctctcc

SEQ ID NO: 8097005 - DNA, 22 bp, Homo sapiens
acatttctcaggtaagtcattt

SEQ ID NO: 8097006 - DNA, 22 bp, Homo sapiens
aggctgggaaatgtattccagc

SEQ ID NO: 8097007 - DNA, 22 bp, Homo sapiens
aggctggctttggtagcatggt

SEQ ID NO: 8097008 - DNA, 22 bp, Homo sapiens
aggctgtgagttttgtctcaga

SEQ ID NO: 8097009 - DNA, 22 bp, Homo sapiens
aggctgtgagttttgtctcaga

SEQ ID NO: 8097010 - DNA, 22 bp, Homo sapiens
accactttggtatttcaatttt

SEQ ID NO: 8097011 - DNA, 17 bp, Homo sapiens
accactttgccaagttg

SEQ ID NO: 8097012 - DNA, 22 bp, Homo sapiens
accagaagctggagcacaagga

SEQ ID NO: 8097013 - DNA, 22 bp, Homo sapiens
accactgcccatggtgaaaact

SEQ ID NO: 8097014 - DNA, 22 bp, Homo sapiens
acatgtggtcaatctgtgtagg

SEQ ID NO: 8097015 - DNA, 22 bp, Homo sapiens
aggctcagggacggggcccctt

SEQ ID NO: 8097016 - DNA, 22 bp, Homo sapiens
aggctcagctggtggtgatcgc

SEQ ID NO: 8097017 - DNA, 20 bp, Homo sapiens
aggctcagctgagctcttgg

SEQ ID NO: 8097018 - DNA, 22 bp, Homo sapiens
acatggctaaattagctttact

SEQ ID NO: 8097019 - DNA, 21 bp, Homo sapiens
acatgtacacatgtatgcaca

SEQ ID NO: 8097020 - DNA, 20 bp, Homo sapiens
aggctcagggtgtttaggaa

SEQ ID NO: 8097021 - DNA, 22 bp, Homo sapiens
aggctcaggtctcaggtctggc

SEQ ID NO: 8097022 - DNA, 22 bp, Homo sapiens
acattaaatttcatagtgatta

SEQ ID NO: 8097023 - DNA, 22 bp, Homo sapiens
aggcaccaggttgtggtttgtc

SEQ ID NO: 8097024 - DNA, 22 bp, Homo sapiens
acagtctggaggctgcttcatt

SEQ ID NO: 8097025 - DNA, 22 bp, Homo sapiens
aggaggccctagagctctagag

SEQ ID NO: 8097026 - DNA, 22 bp, Homo sapiens
aggaggcccctcctgggttgct

SEQ ID NO: 8097027 - DNA, 22 bp, Homo sapiens
aggaggccattctctcagtagc

SEQ ID NO: 8097028 - DNA, 22 bp, Homo sapiens
aggaggccatcagttccttcct

SEQ ID NO: 8097029 - DNA, 19 bp, Homo sapiens
aggaggccatgccactaga

SEQ ID NO: 8097030 - DNA, 22 bp, Homo sapiens
aggaggccaggccctcaagcct

SEQ ID NO: 8097031 - DNA, 22 bp, Homo sapiens
aggaggccgatttcagaggtcg

SEQ ID NO: 8097032 - DNA, 22 bp, Homo sapiens
acatataagggatcagtgacag

SEQ ID NO: 8097033 - DNA, 22 bp, Homo sapiens
aggcagtgtattgctagcggct

SEQ ID NO: 8097034 - DNA, 22 bp, Homo sapiens
aggcagtgtggagggctgttgc

SEQ ID NO: 8097035 - DNA, 22 bp, Homo sapiens
aggcagtgtgtagctggaagag

SEQ ID NO: 8097036 - DNA, 22 bp, Homo sapiens
aggcagtggtgtttgctggtgg

SEQ ID NO: 8097037 - DNA, 22 bp, Homo sapiens
aggcagcaaatgtctggaacag

SEQ ID NO: 8097038 - DNA, 22 bp, Homo sapiens
aggcagcaatgaatgaaatgga

SEQ ID NO: 8097039 - DNA, 22 bp, Homo sapiens
aggcaggggagctggaagggta

SEQ ID NO: 8097040 - DNA, 22 bp, Homo sapiens
aggcagagaaaaaccagatatg

SEQ ID NO: 8097041 - DNA, 22 bp, Homo sapiens
aggcagaaccagctgggacttt

SEQ ID NO: 8097042 - DNA, 22 bp, Homo sapiens
aggacaggtgtagtgggctctg

SEQ ID NO: 8097043 - DNA, 22 bp, Homo sapiens
agcttcttgtagaactcaaaag

SEQ ID NO: 8097044 - DNA, 22 bp, Homo sapiens
acaggcacaactgagtagactc

SEQ ID NO: 8097045 - DNA, 22 bp, Homo sapiens
acaggcaaggccagtgagaaat

SEQ ID NO: 8097046 - DNA, 22 bp, Homo sapiens
acaggacagggaattcgaaatt

SEQ ID NO: 8097047 - DNA, 22 bp, Homo sapiens
acaggaacgaatgtacattgtt

SEQ ID NO: 8097048 - DNA, 22 bp, Homo sapiens
acagcagttactgaaataaagt

SEQ ID NO: 8097049 - DNA, 22 bp, Homo sapiens
acagcagtttagaggacagcca

SEQ ID NO: 8097050 - DNA, 22 bp, Homo sapiens
acagcagttcaggccgcagagg

SEQ ID NO: 8097051 - DNA, 22 bp, Homo sapiens
acagcagttaacgatcagactc

SEQ ID NO: 8097052 - DNA, 22 bp, Homo sapiens
acagcagtgtctggtactgagt

SEQ ID NO: 8097053 - DNA, 22 bp, Homo sapiens
acagcagtggtgcactgagcca

SEQ ID NO: 8097054 - DNA, 22 bp, Homo sapiens
actttacaggcacttcaagtat

SEQ ID NO: 8097055 - DNA, 22 bp, Homo sapiens
actttacaggcacttcaagtat

SEQ ID NO: 8097056 - DNA, 20 bp, Homo sapiens
actttacagagaagactgac

SEQ ID NO: 8097057 - DNA, 22 bp, Homo sapiens
actttacagatggtttcctgac

SEQ ID NO: 8097058 - DNA, 22 bp, Homo sapiens
actttacatttgatctctctaa

SEQ ID NO: 8097059 - DNA, 22 bp, Homo sapiens
atagaatagcatagaaaattga

SEQ ID NO: 8097060 - DNA, 22 bp, Homo sapiens
atagaatagcatagaaaattga

SEQ ID NO: 8097061 - DNA, 20 bp, Homo sapiens
atagaagtattatgtaatgt

SEQ ID NO: 8097062 - DNA, 20 bp, Homo sapiens
agaaaaagtgtggaaatttc

SEQ ID NO: 8097063 - DNA, 22 bp, Homo sapiens
atagttcttaagccatgttgct

SEQ ID NO: 8097064 - DNA, 17 bp, Homo sapiens
agaaaagagaccagcag

SEQ ID NO: 8097065 - DNA, 22 bp, Homo sapiens
atagctttcttaaatatataaa

SEQ ID NO: 8097066 - DNA, 22 bp, Homo sapiens
atagctttttgtcatagagtct

SEQ ID NO: 8097067 - DNA, 22 bp, Homo sapiens
atagccttggtccttgctccac

SEQ ID NO: 8097068 - DNA, 22 bp, Homo sapiens
atacaattattctgcagatatt

SEQ ID NO: 8097069 - DNA, 19 bp, Homo sapiens
atacactaatataaaccac

SEQ ID NO: 8097070 - DNA, 22 bp, Homo sapiens
atacactactaagcacagattg

SEQ ID NO: 8097071 - DNA, 22 bp, Homo sapiens
ataaggaaaattggagaaattg

SEQ ID NO: 8097072 - DNA, 22 bp, Homo sapiens
ataaggaaatgaaactctaata

SEQ ID NO: 8097073 - DNA, 22 bp, Homo sapiens
atacaagttgtgataatgtaaa

SEQ ID NO: 8097074 - DNA, 17 bp, Homo sapiens
atacaaagccataaacc

SEQ ID NO: 8097075 - DNA, 22 bp, Homo sapiens
atacaagttgtgataatgtaaa

SEQ ID NO: 8097076 - DNA, 22 bp, Homo sapiens
atacaaagacaaatctcaatct

SEQ ID NO: 8097077 - DNA, 20 bp, Homo sapiens
atacaaagagattgatgtat

SEQ ID NO: 8097078 - DNA, 22 bp, Homo sapiens
ataaggcttaaaccttgttgcc

SEQ ID NO: 8097079 - DNA, 23 bp, Homo sapiens
agttcataatttcttatttgtgt

SEQ ID NO: 8097080 - DNA, 22 bp, Homo sapiens
agttcacaagtgcatttcagga

SEQ ID NO: 8097081 - DNA, 22 bp, Homo sapiens
agttcacaccaaagttaggtag

SEQ ID NO: 8097082 - DNA, 22 bp, Homo sapiens
agttcacattccgaggtactgg

SEQ ID NO: 8097083 - DNA, 22 bp, Homo sapiens
agttcaggcataaggcatgaac

SEQ ID NO: 8097084 - DNA, 22 bp, Homo sapiens
ataaattctctgatgtatagta

SEQ ID NO: 8097085 - DNA, 22 bp, Homo sapiens
ataaattcaaagcatttaggac

SEQ ID NO: 8097086 - DNA, 22 bp, Homo sapiens
ataaattctctgatgtatagta

SEQ ID NO: 8097087 - DNA, 22 bp, Homo sapiens
agttgcactttctagatactgt

SEQ ID NO: 8097088 - DNA, 22 bp, Homo sapiens
ataaatttataattgtttcctg

SEQ ID NO: 8097089 - DNA, 22 bp, Homo sapiens
ataaattttcttgctgtactta

SEQ ID NO: 8097090 - DNA, 22 bp, Homo sapiens
ataaattttcttgctgtactta

SEQ ID NO: 8097091 - DNA, 20 bp, Homo sapiens
ataacaaggctctgcaagct

SEQ ID NO: 8097092 - DNA, 20 bp, Homo sapiens
atatagagtcaaaatggctt

SEQ ID NO: 8097093 - DNA, 22 bp, Homo sapiens
atatagatcaaatgatgctaat

SEQ ID NO: 8097094 - DNA, 19 bp, Homo sapiens
atatagcattattcaattt

SEQ ID NO: 8097095 - DNA, 22 bp, Homo sapiens
agaaagaacgcacttgtgctgc

SEQ ID NO: 8097096 - DNA, 22 bp, Homo sapiens
agaaagaacgttggttatctta

SEQ ID NO: 8097097 - DNA, 22 bp, Homo sapiens
atattaatgagcaagtaagtga

SEQ ID NO: 8097098 - DNA, 22 bp, Homo sapiens
atattaatgggatttagtcagg

SEQ ID NO: 8097099 - DNA, 22 bp, Homo sapiens
agaaatcaatatctatatgttg

SEQ ID NO: 8097100 - DNA, 22 bp, Homo sapiens
agaaatcagaaccctgaagttc

SEQ ID NO: 8097101 - DNA, 22 bp, Homo sapiens
agaaatcagaaccctgaagttc

SEQ ID NO: 8097102 - DNA, 22 bp, Homo sapiens
agaaatcacttagaggaagtga

SEQ ID NO: 8097103 - DNA, 22 bp, Homo sapiens
atcaattttgaggatacaagaa

SEQ ID NO: 8097104 - DNA, 22 bp, Homo sapiens
atcaattcttaggaaaatagct

SEQ ID NO: 8097105 - DNA, 22 bp, Homo sapiens
agaaatgcattagcacatatag

SEQ ID NO: 8097106 - DNA, 22 bp, Homo sapiens
agaaatgcagtttcaagacaaa

SEQ ID NO: 8097107 - DNA, 22 bp, Homo sapiens
agaaatggaaatccaagcaact

SEQ ID NO: 8097108 - DNA, 22 bp, Homo sapiens
agaagccatagtatctcagggt

SEQ ID NO: 8097109 - DNA, 22 bp, Homo sapiens
agaagccaccagctgaggaaga

SEQ ID NO: 8097110 - DNA, 22 bp, Homo sapiens
agaagccatagtctgggaggca

SEQ ID NO: 8097111 - DNA, 21 bp, Homo sapiens
agaagccatgccagtaaaatt

SEQ ID NO: 8097112 - DNA, 22 bp, Homo sapiens
agaagccatatttagggaggag

SEQ ID NO: 8097113 - DNA, 21 bp, Homo sapiens
agaagccatgtggtggagaac

SEQ ID NO: 8097114 - DNA, 22 bp, Homo sapiens
agaagccatggggtcaccagag

SEQ ID NO: 8097115 - DNA, 22 bp, Homo sapiens
agaagccatggtatgcaactac

SEQ ID NO: 8097116 - DNA, 22 bp, Homo sapiens
agaagctatttagctgcacttt

SEQ ID NO: 8097117 - DNA, 22 bp, Homo sapiens
agaagccattccctgtaggctc

SEQ ID NO: 8097118 - DNA, 22 bp, Homo sapiens
agaagccatgtttagtaggatg

SEQ ID NO: 8097119 - DNA, 22 bp, Homo sapiens
agaagccattgaagcagacctc

SEQ ID NO: 8097120 - DNA, 22 bp, Homo sapiens
agaagccattctcagttcctga

SEQ ID NO: 8097121 - DNA, 21 bp, Homo sapiens
agaagccatttgttaggactt

SEQ ID NO: 8097122 - DNA, 22 bp, Homo sapiens
agaagccaaatgccagtgacct

SEQ ID NO: 8097123 - DNA, 22 bp, Homo sapiens
agaagccaaaggggccagatat

SEQ ID NO: 8097124 - DNA, 22 bp, Homo sapiens
actcacaggactctgcatatag

SEQ ID NO: 8097125 - DNA, 22 bp, Homo sapiens
aggttctgtttggctgaggatc

SEQ ID NO: 8097126 - DNA, 22 bp, Homo sapiens
aggttctggagcttagagggag

SEQ ID NO: 8097127 - DNA, 22 bp, Homo sapiens
aggttctggagaacttggaggt

SEQ ID NO: 8097128 - DNA, 22 bp, Homo sapiens
aggttctgattctctgggtatg

SEQ ID NO: 8097129 - DNA, 22 bp, Homo sapiens
aggtgtcagaagtgacagttgg

SEQ ID NO: 8097130 - DNA, 22 bp, Homo sapiens
aggtggagacccagagaaggcg

SEQ ID NO: 8097131 - DNA, 22 bp, Homo sapiens
aggtggagaagagatgggcagt

SEQ ID NO: 8097132 - DNA, 22 bp, Homo sapiens
aggtgaggataggtggccaagg

SEQ ID NO: 8097133 - DNA, 19 bp, Homo sapiens
aggtgaggggcaccatgtc

SEQ ID NO: 8097134 - DNA, 22 bp, Homo sapiens
aggtgcagtggctcatgcctgt

SEQ ID NO: 8097135 - DNA, 19 bp, Homo sapiens
aggtgcaggtcacagggga

SEQ ID NO: 8097136 - DNA, 22 bp, Homo sapiens
actcagaggcagctgctcaccc

SEQ ID NO: 8097137 - DNA, 22 bp, Homo sapiens
actcagcttcctacagctagaa

SEQ ID NO: 8097138 - DNA, 22 bp, Homo sapiens
agtaacatttagcttctcactg

SEQ ID NO: 8097139 - DNA, 22 bp, Homo sapiens
agtcagtctgctagcctgtgga

SEQ ID NO: 8097140 - DNA, 22 bp, Homo sapiens
agtcagtcaccatttaagaaca

SEQ ID NO: 8097141 - DNA, 22 bp, Homo sapiens
agtcagtagatccaaacttttg

SEQ ID NO: 8097142 - DNA, 22 bp, Homo sapiens
agtcagtatttattacttagct

SEQ ID NO: 8097143 - DNA, 22 bp, Homo sapiens
agtcagtagatccaaacttttg

SEQ ID NO: 8097144 - DNA, 22 bp, Homo sapiens
agtcagtatgacttatagttct

SEQ ID NO: 8097145 - DNA, 22 bp, Homo sapiens
agtcagggttgtaggctcaccc

SEQ ID NO: 8097146 - DNA, 22 bp, Homo sapiens
agtcacttctattctattaagt

SEQ ID NO: 8097147 - DNA, 22 bp, Homo sapiens
actctgggccccaggtggagct

SEQ ID NO: 8097148 - DNA, 22 bp, Homo sapiens
agtgggagccagcagcttgggg

SEQ ID NO: 8097149 - DNA, 20 bp, Homo sapiens
agtgggagagggcagactgc

SEQ ID NO: 8097150 - DNA, 22 bp, Homo sapiens
agtggctggaattgcaggtgcg

SEQ ID NO: 8097151 - DNA, 22 bp, Homo sapiens
agtgcttaatagatgtccagca

SEQ ID NO: 8097152 - DNA, 22 bp, Homo sapiens
agtgaatgtccccgcgggtcag

SEQ ID NO: 8097153 - DNA, 22 bp, Homo sapiens
agtgagccataagggctgccac

SEQ ID NO: 8097154 - DNA, 22 bp, Homo sapiens
agttaataatggaaagacacat

SEQ ID NO: 8097155 - DNA, 22 bp, Homo sapiens
agttacaaacactatcagttct

SEQ ID NO: 8097156 - DNA, 19 bp, Homo sapiens
agttaatgagcttttgatc

SEQ ID NO: 8097157 - DNA, 22 bp, Homo sapiens
actggggcagtgggcagtggtt

SEQ ID NO: 8097158 - DNA, 22 bp, Homo sapiens
agttcaaagtcaaggaaactgt

SEQ ID NO: 8097159 - DNA, 22 bp, Homo sapiens
agttcacaagcgtaggtgctga

SEQ ID NO: 8097160 - DNA, 22 bp, Homo sapiens
agttcaatagaaaaatatatta

SEQ ID NO: 8097161 - DNA, 22 bp, Homo sapiens
agttcaaactctataagaactt

SEQ ID NO: 8097162 - DNA, 23 bp, Homo sapiens
agttcaaaatcaaccaggacact

SEQ ID NO: 8097163 - DNA, 22 bp, Homo sapiens
agttacaaccatgacacaagca

SEQ ID NO: 8097164 - DNA, 21 bp, Homo sapiens
agttacatgtatagataaagt

SEQ ID NO: 8097165 - DNA, 22 bp, Homo sapiens
agtgtgggttttatggagccct

SEQ ID NO: 8097166 - DNA, 22 bp, Homo sapiens
agtggggccggtgaggccgagg

SEQ ID NO: 8097167 - DNA, 22 bp, Homo sapiens
agtggggcggacaggaccagga

SEQ ID NO: 8097168 - DNA, 22 bp, Homo sapiens
agtgggggcagagcctctctcg

SEQ ID NO: 8097169 - DNA, 22 bp, Homo sapiens
agtgggggctggctctgtctgt

SEQ ID NO: 8097170 - DNA, 22 bp, Homo sapiens
cagctggcatacctgggcccgg

SEQ ID NO: 8097171 - DNA, 22 bp, Homo sapiens
cagctggcagccctggccctgc

SEQ ID NO: 8097172 - DNA, 22 bp, Homo sapiens
cagctgggtggctcttctgctc

SEQ ID NO: 8097173 - DNA, 22 bp, Homo sapiens
cagctggcagaacctgcatcca

SEQ ID NO: 8097174 - DNA, 19 bp, Homo sapiens
cagctggaatcatctgagg

SEQ ID NO: 8097175 - DNA, 23 bp, Homo sapiens
agctgaggcagaggggcattctc

SEQ ID NO: 8097176 - DNA, 17 bp, Homo sapiens
agctgagctggccaggg

SEQ ID NO: 8097177 - DNA, 22 bp, Homo sapiens
agctctggacctgacatctggt

SEQ ID NO: 8097178 - DNA, 21 bp, Homo sapiens
agctctggagcagcaatcaag

SEQ ID NO: 8097179 - DNA, 22 bp, Homo sapiens
cagccttttcttaaaatgcaag

SEQ ID NO: 8097180 - DNA, 22 bp, Homo sapiens
cagcctttgggtcagaagattc

SEQ ID NO: 8097181 - DNA, 22 bp, Homo sapiens
cagcctctgtggctgccacacc

SEQ ID NO: 8097182 - DNA, 22 bp, Homo sapiens
cagcctctgacaccacagtcgt

SEQ ID NO: 8097183 - DNA, 22 bp, Homo sapiens
cagcccagaactcacgtctcca

SEQ ID NO: 8097184 - DNA, 22 bp, Homo sapiens
cagccatgagtctaagcagttt

SEQ ID NO: 8097185 - DNA, 22 bp, Homo sapiens
cagcctctctgtatctcaggat

SEQ ID NO: 8097186 - DNA, 22 bp, Homo sapiens
cagcctctaagcacagcctctc

SEQ ID NO: 8097187 - DNA, 22 bp, Homo sapiens
cagcatcatactacctaaatga

SEQ ID NO: 8097188 - DNA, 22 bp, Homo sapiens
agcgagagattcaacagcaagt

SEQ ID NO: 8097189 - DNA, 22 bp, Homo sapiens
cagagtggcagtcccaggccca

SEQ ID NO: 8097190 - DNA, 22 bp, Homo sapiens
cagagtggcactctgctggatg

SEQ ID NO: 8097191 - DNA, 22 bp, Homo sapiens
cagagtggagatgtgtgtggaa

SEQ ID NO: 8097192 - DNA, 22 bp, Homo sapiens
agccctgagccagcctggtcag

SEQ ID NO: 8097193 - DNA, 22 bp, Homo sapiens
agccctgacctgtcctgttctg

SEQ ID NO: 8097194 - DNA, 22 bp, Homo sapiens
agccctgggctgtagataagca

SEQ ID NO: 8097195 - DNA, 22 bp, Homo sapiens
cagaggagttcagtacacagcc

SEQ ID NO: 8097196 - DNA, 22 bp, Homo sapiens
cagaggagtgggccgttatggt

SEQ ID NO: 8097197 - DNA, 20 bp, Homo sapiens
cagaggagtacatatgttca

SEQ ID NO: 8097198 - DNA, 22 bp, Homo sapiens
cagaggaggccaccgcataggc

SEQ ID NO: 8097199 - DNA, 22 bp, Homo sapiens
cagaggaggcggtatacactgc

SEQ ID NO: 8097200 - DNA, 18 bp, Homo sapiens
cagaggagagacattcag

SEQ ID NO: 8097201 - DNA, 17 bp, Homo sapiens
cagaggagctttggggg

SEQ ID NO: 8097202 - DNA, 22 bp, Homo sapiens
agccctttccaatttgatttat

SEQ ID NO: 8097203 - DNA, 22 bp, Homo sapiens
cagatcacttgaagccaggagt

SEQ ID NO: 8097204 - DNA, 22 bp, Homo sapiens
cagatccatagagttctggaga

SEQ ID NO: 8097205 - DNA, 18 bp, Homo sapiens
cagatccaggcagctatt

SEQ ID NO: 8097206 - DNA, 22 bp, Homo sapiens
cagatcaagctgtatggtcaga

SEQ ID NO: 8097207 - DNA, 22 bp, Homo sapiens
agcctattcatctgatcttgaa

SEQ ID NO: 8097208 - DNA, 22 bp, Homo sapiens
agcctattccaggatgagctca

SEQ ID NO: 8097209 - DNA, 22 bp, Homo sapiens
cagagcagtaaatctggggcac

SEQ ID NO: 8097210 - DNA, 22 bp, Homo sapiens
cagagcagtccttgtcaatcag

SEQ ID NO: 8097211 - DNA, 18 bp, Homo sapiens
cagagcagtatgaatgtt

SEQ ID NO: 8097212 - DNA, 22 bp, Homo sapiens
cagagccaggtctaggagtctc

SEQ ID NO: 8097213 - DNA, 22 bp, Homo sapiens
cagagccaggcctgccctcttt

SEQ ID NO: 8097214 - DNA, 22 bp, Homo sapiens
cagagcagtctggagatccagc

SEQ ID NO: 8097215 - DNA, 20 bp, Homo sapiens
cagagctgttatggatgatg

SEQ ID NO: 8097216 - DNA, 22 bp, Homo sapiens
cagagctgttgcggggcttggc

SEQ ID NO: 8097217 - DNA, 22 bp, Homo sapiens
cagagctgtccaaaccctgaca

SEQ ID NO: 8097218 - DNA, 22 bp, Homo sapiens
cagagctgtgataaatagatat

SEQ ID NO: 8097219 - DNA, 22 bp, Homo sapiens
cagagctgttactattcatgaa

SEQ ID NO: 8097220 - DNA, 21 bp, Homo sapiens
cagagctgtccaaaccctgac

SEQ ID NO: 8097221 - DNA, 22 bp, Homo sapiens
agccaggctcaaggcctgctcc

SEQ ID NO: 8097222 - DNA, 22 bp, Homo sapiens
agccaacttggaaagtcagatt

SEQ ID NO: 8097223 - DNA, 22 bp, Homo sapiens
agccaacttagaagaaatttga

SEQ ID NO: 8097224 - DNA, 22 bp, Homo sapiens
agccagggacgctgcaggctac

SEQ ID NO: 8097225 - DNA, 22 bp, Homo sapiens
agccaggctgcagttggctggc

SEQ ID NO: 8097226 - DNA, 22 bp, Homo sapiens
agccaggctcaaggcctgctcc

SEQ ID NO: 8097227 - DNA, 22 bp, Homo sapiens
agccaggctgcagttggctggc

SEQ ID NO: 8097228 - DNA, 22 bp, Homo sapiens
agccaggggagtcagctgctgg

SEQ ID NO: 8097229 - DNA, 22 bp, Homo sapiens
cagagcagggtgcaccttgggc

SEQ ID NO: 8097230 - DNA, 22 bp, Homo sapiens
agccagggctctccttcgcgtg

SEQ ID NO: 8097231 - DNA, 22 bp, Homo sapiens
agccagggctgcgagcagacag

SEQ ID NO: 8097232 - DNA, 23 bp, Homo sapiens
agccagggcactggtggagattg

SEQ ID NO: 8097233 - DNA, 22 bp, Homo sapiens
agccagggatggcagtgcccag

SEQ ID NO: 8097234 - DNA, 22 bp, Homo sapiens
agccagggaggtggaggttgca

SEQ ID NO: 8097235 - DNA, 22 bp, Homo sapiens
caaggaagttttaggagaggaa

SEQ ID NO: 8097236 - DNA, 22 bp, Homo sapiens
caaggaaggagagatgatgggt

SEQ ID NO: 8097237 - DNA, 22 bp, Homo sapiens
caaggaagacccacgcagatat

SEQ ID NO: 8097238 - DNA, 22 bp, Homo sapiens
caaggaaaacagatgatcaaca

SEQ ID NO: 8097239 - DNA, 22 bp, Homo sapiens
caagtcattactgaaatgtcac

SEQ ID NO: 8097240 - DNA, 23 bp, Homo sapiens
caagtcatggattggagtttcag

SEQ ID NO: 8097241 - DNA, 22 bp, Homo sapiens
caagtcatcatagaagttcccc

SEQ ID NO: 8097242 - DNA, 22 bp, Homo sapiens
caagtcatcatagaagttcccc

SEQ ID NO: 8097243 - DNA, 22 bp, Homo sapiens
caagtcattactgaaatgtcac

SEQ ID NO: 8097244 - DNA, 22 bp, Homo sapiens
caagtcattgtttagtcatgtt

SEQ ID NO: 8097245 - DNA, 22 bp, Homo sapiens
caagggagttactgagggcggg

SEQ ID NO: 8097246 - DNA, 22 bp, Homo sapiens
caagggagttgctgcatgcagg

SEQ ID NO: 8097247 - DNA, 22 bp, Homo sapiens
caagggcagcagcctcaagcgg

SEQ ID NO: 8097248 - DNA, 22 bp, Homo sapiens
caattatatttagaatgataca

SEQ ID NO: 8097249 - DNA, 22 bp, Homo sapiens
caagtctgacctctgggtgaag

SEQ ID NO: 8097250 - DNA, 22 bp, Homo sapiens
caagtctgacctctgggtgaag

SEQ ID NO: 8097251 - DNA, 22 bp, Homo sapiens
cacagctggggaagctgaggcc

SEQ ID NO: 8097252 - DNA, 20 bp, Homo sapiens
cacaggaaagctactcagtt

SEQ ID NO: 8097253 - DNA, 22 bp, Homo sapiens
cacagaacaccaaagaaccttc

SEQ ID NO: 8097254 - DNA, 22 bp, Homo sapiens
cacagaacaccaaagaaccttc

SEQ ID NO: 8097255 - DNA, 22 bp, Homo sapiens
cacagaaattattaggatgctt

SEQ ID NO: 8097256 - DNA, 22 bp, Homo sapiens
caatttcttgttaattctcagg

SEQ ID NO: 8097257 - DNA, 22 bp, Homo sapiens
caattcaaatgcatagttcaca

SEQ ID NO: 8097258 - DNA, 22 bp, Homo sapiens
caattattcagtgacttaagag

SEQ ID NO: 8097259 - DNA, 22 bp, Homo sapiens
cacatgggcttagcaggcaggg

SEQ ID NO: 8097260 - DNA, 22 bp, Homo sapiens
cacatggggcgctgcattggcc

SEQ ID NO: 8097261 - DNA, 22 bp, Homo sapiens
cacatgggtgtgcctggaggaa

SEQ ID NO: 8097262 - DNA, 22 bp, Homo sapiens
cacatggtggtgcttgataagc

SEQ ID NO: 8097263 - DNA, 22 bp, Homo sapiens
cacatgcttcttttgattatga

SEQ ID NO: 8097264 - DNA, 22 bp, Homo sapiens
cacatgcttagatttcagtgga

SEQ ID NO: 8097265 - DNA, 22 bp, Homo sapiens
agcaggctaggaacctcactgc

SEQ ID NO: 8097266 - DNA, 19 bp, Homo sapiens
agcaggctaggctgcctct

SEQ ID NO: 8097267 - DNA, 22 bp, Homo sapiens
cactacaggggtccacagctga

SEQ ID NO: 8097268 - DNA, 20 bp, Homo sapiens
cactacttgtttttgtcaat

SEQ ID NO: 8097269 - DNA, 22 bp, Homo sapiens
cacatttaagtgcttgttcaga

SEQ ID NO: 8097270 - DNA, 22 bp, Homo sapiens
cacatttaaaaaatccacgatc

SEQ ID NO: 8097271 - DNA, 22 bp, Homo sapiens
cacattgaaccatatattagtg

SEQ ID NO: 8097272 - DNA, 22 bp, Homo sapiens
agcatttatttcttagaaattg

SEQ ID NO: 8097273 - DNA, 22 bp, Homo sapiens
cactgcacttcagcctgggtga

SEQ ID NO: 8097274 - DNA, 22 bp, Homo sapiens
cactgcacttcagcctgggtga

SEQ ID NO: 8097275 - DNA, 22 bp, Homo sapiens
cactgcactccagcccgggcaa

SEQ ID NO: 8097276 - DNA, 22 bp, Homo sapiens
cactgcactccagcccgggcaa

SEQ ID NO: 8097277 - DNA, 22 bp, Homo sapiens
cactgcactccatcctgggaaa

SEQ ID NO: 8097278 - DNA, 22 bp, Homo sapiens
cactgcactccatcctgggaaa

SEQ ID NO: 8097279 - DNA, 22 bp, Homo sapiens
cactgggcgtgtcctgggtgag

SEQ ID NO: 8097280 - DNA, 22 bp, Homo sapiens
cactgggcgccagctgctgagc

SEQ ID NO: 8097281 - DNA, 23 bp, Homo sapiens
cactgggcccagggtgtggaggc

SEQ ID NO: 8097282 - DNA, 22 bp, Homo sapiens
cactgggctttgtagttagcat

SEQ ID NO: 8097283 - DNA, 22 bp, Homo sapiens
cactgggctgataccaggcttc

SEQ ID NO: 8097284 - DNA, 20 bp, Homo sapiens
cactgggctggagtcagggc

SEQ ID NO: 8097285 - DNA, 22 bp, Homo sapiens
cagaaactgcttgtggtcatct

SEQ ID NO: 8097286 - DNA, 22 bp, Homo sapiens
cagaaactatgtaagaaagtga

SEQ ID NO: 8097287 - DNA, 22 bp, Homo sapiens
cagaaactagatttagacacaa

SEQ ID NO: 8097288 - DNA, 22 bp, Homo sapiens
cagaaactgtggattcattaaa

SEQ ID NO: 8097289 - DNA, 22 bp, Homo sapiens
cagaaactgcttgtggtcatct

SEQ ID NO: 8097290 - DNA, 22 bp, Homo sapiens
cagaaactgtttgttaatattt

SEQ ID NO: 8097291 - DNA, 22 bp, Homo sapiens
cagaaacttctggtgtcaaata

SEQ ID NO: 8097292 - DNA, 22 bp, Homo sapiens
cagaaacttttgatgagtgtat

SEQ ID NO: 8097293 - DNA, 22 bp, Homo sapiens
agccaactaattaaacaacttt

SEQ ID NO: 8097294 - DNA, 22 bp, Homo sapiens
atgcttgaaagttatttcattt

SEQ ID NO: 8097295 - DNA, 22 bp, Homo sapiens
atgcttcagtgctaccttcaaa

SEQ ID NO: 8097296 - DNA, 22 bp, Homo sapiens
atgctgagaaacctgtctggca

SEQ ID NO: 8097297 - DNA, 22 bp, Homo sapiens
atgctgatgctgcttttgccct

SEQ ID NO: 8097298 - DNA, 23 bp, Homo sapiens
agacagtggccgagaggtactag

SEQ ID NO: 8097299 - DNA, 19 bp, Homo sapiens
agacagtggctaggactta

SEQ ID NO: 8097300 - DNA, 22 bp, Homo sapiens
atgccagtaagtctcagctagg

SEQ ID NO: 8097301 - DNA, 22 bp, Homo sapiens
atgccaggctgtttggcctcag

SEQ ID NO: 8097302 - DNA, 23 bp, Homo sapiens
atgccaggctgcctggccagcct

SEQ ID NO: 8097303 - DNA, 22 bp, Homo sapiens
atgccagggtcatcccctgggt

SEQ ID NO: 8097304 - DNA, 22 bp, Homo sapiens
atgccagaccatccagttggga

SEQ ID NO: 8097305 - DNA, 22 bp, Homo sapiens
atgccagacgtgtgttggccgg

SEQ ID NO: 8097306 - DNA, 22 bp, Homo sapiens
atgccagaattgttgaccttat

SEQ ID NO: 8097307 - DNA, 22 bp, Homo sapiens
atgccagacattaacgactatg

SEQ ID NO: 8097308 - DNA, 22 bp, Homo sapiens
atgcaacagttcatagttttat

SEQ ID NO: 8097309 - DNA, 21 bp, Homo sapiens
atcttaaaaggtcttaacttt

SEQ ID NO: 8097310 - DNA, 22 bp, Homo sapiens
atgactctaagaattctagatg

SEQ ID NO: 8097311 - DNA, 22 bp, Homo sapiens
atgacgtgtcactttgtaagaa

SEQ ID NO: 8097312 - DNA, 22 bp, Homo sapiens
atgattcagggagttttcagga

SEQ ID NO: 8097313 - DNA, 22 bp, Homo sapiens
atgattcaggattgaaccattt

SEQ ID NO: 8097314 - DNA, 22 bp, Homo sapiens
atgattgtctataaaggaaggg

SEQ ID NO: 8097315 - DNA, 22 bp, Homo sapiens
atgcaaatgtttaagttactat

SEQ ID NO: 8097316 - DNA, 21 bp, Homo sapiens
agagactgtcactgcagtacc

SEQ ID NO: 8097317 - DNA, 22 bp, Homo sapiens
agagactgtcacataacagagg

SEQ ID NO: 8097318 - DNA, 22 bp, Homo sapiens
agagagaacaccctcggcatgg

SEQ ID NO: 8097319 - DNA, 17 bp, Homo sapiens
agagagaaaagggccat

SEQ ID NO: 8097320 - DNA, 22 bp, Homo sapiens
agagagaagcaatcagtggcca

SEQ ID NO: 8097321 - DNA, 22 bp, Homo sapiens
agagactgtacgtggcaagtat

SEQ ID NO: 8097322 - DNA, 22 bp, Homo sapiens
agagactggagatgggcagtgt

SEQ ID NO: 8097323 - DNA, 22 bp, Homo sapiens
agagactgcgtgtcagcgctgg

SEQ ID NO: 8097324 - DNA, 22 bp, Homo sapiens
atgggctcggcgctgctgggat

SEQ ID NO: 8097325 - DNA, 22 bp, Homo sapiens
atgggctctatgtctaggagat

SEQ ID NO: 8097326 - DNA, 22 bp, Homo sapiens
atgggccttgacacatggagtg

SEQ ID NO: 8097327 - DNA, 22 bp, Homo sapiens
atgggcctgttcctatgctggt

SEQ ID NO: 8097328 - DNA, 22 bp, Homo sapiens
atgggccttgacacatggagtg

SEQ ID NO: 8097329 - DNA, 22 bp, Homo sapiens
agagactgatggatcaccaaat

SEQ ID NO: 8097330 - DNA, 22 bp, Homo sapiens
atggaattgagcatcagttgtt

SEQ ID NO: 8097331 - DNA, 18 bp, Homo sapiens
atgggaggggccaagaga

SEQ ID NO: 8097332 - DNA, 22 bp, Homo sapiens
atgggcagttaggaggccagga

SEQ ID NO: 8097333 - DNA, 22 bp, Homo sapiens
atgggcagtgtattggaaggaa

SEQ ID NO: 8097334 - DNA, 16 bp, Homo sapiens
atgggcagtgaggaag

SEQ ID NO: 8097335 - DNA, 22 bp, Homo sapiens
atgggcagtaacagtggcagtc

SEQ ID NO: 8097336 - DNA, 22 bp, Homo sapiens
attaaatactgcaggctaagca

SEQ ID NO: 8097337 - DNA, 22 bp, Homo sapiens
attaagtgactaaagtaatgct

SEQ ID NO: 8097338 - DNA, 22 bp, Homo sapiens
atgttcatcaacacattacaag

SEQ ID NO: 8097339 - DNA, 18 bp, Homo sapiens
atgttcatatttttaggg

SEQ ID NO: 8097340 - DNA, 22 bp, Homo sapiens
atgttcagcattctataaatat

SEQ ID NO: 8097341 - DNA, 22 bp, Homo sapiens
agagcctgttttgtgggagatg

SEQ ID NO: 8097342 - DNA, 22 bp, Homo sapiens
agagccagccttctcagcttac

SEQ ID NO: 8097343 - DNA, 22 bp, Homo sapiens
agagccagcatttgggccctgc

SEQ ID NO: 8097344 - DNA, 22 bp, Homo sapiens
atgttacagaaagcaaagatga

SEQ ID NO: 8097345 - DNA, 22 bp, Homo sapiens
atgttacagaaagcaaagatga

SEQ ID NO: 8097346 - DNA, 22 bp, Homo sapiens
atgttattttggaaaatacaaa

SEQ ID NO: 8097347 - DNA, 22 bp, Homo sapiens
agattctactctagatccatgg

SEQ ID NO: 8097348 - DNA, 22 bp, Homo sapiens
agatttcaatgtgagcattagt

SEQ ID NO: 8097349 - DNA, 22 bp, Homo sapiens
agatttatgtggtcacactcag

SEQ ID NO: 8097350 - DNA, 22 bp, Homo sapiens
attttctgtgtgcagataaata

SEQ ID NO: 8097351 - DNA, 22 bp, Homo sapiens
atttctttctggccacggtttt

SEQ ID NO: 8097352 - DNA, 22 bp, Homo sapiens
atttctcttcctcctagggttg

SEQ ID NO: 8097353 - DNA, 22 bp, Homo sapiens
atttcttttcaagagggtgctt

SEQ ID NO: 8097354 - DNA, 22 bp, Homo sapiens
atttgaaccactcagaactcat

SEQ ID NO: 8097355 - DNA, 22 bp, Homo sapiens
attttttcagattgagtgttaa

SEQ ID NO: 8097356 - DNA, 22 bp, Homo sapiens
agcaagatgaaggattcaagac

SEQ ID NO: 8097357 - DNA, 22 bp, Homo sapiens
agcaagatgcaaacatccgtcc

SEQ ID NO: 8097358 - DNA, 22 bp, Homo sapiens
attttttctgtaaactggcctt

SEQ ID NO: 8097359 - DNA, 22 bp, Homo sapiens
attttttcccagttagccagga

SEQ ID NO: 8097360 - DNA, 22 bp, Homo sapiens
attttttcccagttagccagga

SEQ ID NO: 8097361 - DNA, 22 bp, Homo sapiens
caaagttctcggctcaagtcct

SEQ ID NO: 8097362 - DNA, 22 bp, Homo sapiens
agcaatgaccagtgatcttgta

SEQ ID NO: 8097363 - DNA, 22 bp, Homo sapiens
agcaatgactaaggcactttgg

SEQ ID NO: 8097364 - DNA, 22 bp, Homo sapiens
agatacaactgtttaaacatta

SEQ ID NO: 8097365 - DNA, 22 bp, Homo sapiens
agatacaactgtttaaacatta

SEQ ID NO: 8097366 - DNA, 22 bp, Homo sapiens
attgtgtatgtatgagacagct

SEQ ID NO: 8097367 - DNA, 22 bp, Homo sapiens
attgtgtcctcattgaccttca

SEQ ID NO: 8097368 - DNA, 22 bp, Homo sapiens
attgtgtatcacagagcagctg

SEQ ID NO: 8097369 - DNA, 22 bp, Homo sapiens
attgagatctgcatcataagct

SEQ ID NO: 8097370 - DNA, 22 bp, Homo sapiens
attatttgagttcctctctacc

SEQ ID NO: 8097371 - DNA, 22 bp, Homo sapiens
attattttatgtgcggcctgat

SEQ ID NO: 8097372 - DNA, 22 bp, Homo sapiens
agaggccggccgagcccatggg

SEQ ID NO: 8097373 - DNA, 22 bp, Homo sapiens
agaggccctgggctggtgtgct

SEQ ID NO: 8097374 - DNA, 22 bp, Homo sapiens
agaggccctggctagagcagct

SEQ ID NO: 8097375 - DNA, 22 bp, Homo sapiens
agaggaacccagacagggcttt

SEQ ID NO: 8097376 - DNA, 22 bp, Homo sapiens
attaataaaataccactttgtt

SEQ ID NO: 8097377 - DNA, 22 bp, Homo sapiens
attaataaaataccactttgtt

SEQ ID NO: 8097378 - DNA, 20 bp, Homo sapiens
attctacaagaataagcatg

SEQ ID NO: 8097379 - DNA, 22 bp, Homo sapiens
attctacaatcatgtagatcct

SEQ ID NO: 8097380 - DNA, 22 bp, Homo sapiens
attctacaatcatgtagatcct

SEQ ID NO: 8097381 - DNA, 22 bp, Homo sapiens
attctctgaagtcaatggaaat

SEQ ID NO: 8097382 - DNA, 22 bp, Homo sapiens
attcaaaagaccatgcagactc

SEQ ID NO: 8097383 - DNA, 22 bp, Homo sapiens
attctaagtcttgttcacattc

SEQ ID NO: 8097384 - DNA, 22 bp, Homo sapiens
attctacaacccaataataatt

SEQ ID NO: 8097385 - DNA, 22 bp, Homo sapiens
attctacaaaagaactggatct

SEQ ID NO: 8097386 - DNA, 22 bp, Homo sapiens
attctaaatcagagagctctgt

SEQ ID NO: 8097387 - DNA, 20 bp, Homo sapiens
attctaaagctctgctcttt

SEQ ID NO: 8097388 - DNA, 22 bp, Homo sapiens
acctgcctctaagcagcaggtg

SEQ ID NO: 8097389 - DNA, 22 bp, Homo sapiens
actcttgattgatttagtcttt

SEQ ID NO: 8097390 - DNA, 20 bp, Homo sapiens
actcttgagaaattctctgt

SEQ ID NO: 8097391 - DNA, 22 bp, Homo sapiens
actcttgtctcaacttttgtat

SEQ ID NO: 8097392 - DNA, 19 bp, Homo sapiens
actcttttccttttgaatc

SEQ ID NO: 8097393 - DNA, 22 bp, Homo sapiens
actgaaaatgaattagaaacag

SEQ ID NO: 8097394 - DNA, 22 bp, Homo sapiens
aagttcaagtctgcatcttttt

SEQ ID NO: 8097395 - DNA, 22 bp, Homo sapiens
actgcactccagcctgggtgac

SEQ ID NO: 8097396 - DNA, 22 bp, Homo sapiens
aatagcacttcctgaacacatt

SEQ ID NO: 8097397 - DNA, 22 bp, Homo sapiens
aatagcaattacccttcaactc

SEQ ID NO: 8097398 - DNA, 22 bp, Homo sapiens
aatagcacctgaggtagtttgt

SEQ ID NO: 8097399 - DNA, 22 bp, Homo sapiens
aatagcaaacagacatgcacaa

SEQ ID NO: 8097400 - DNA, 22 bp, Homo sapiens
aatagaatgtaatctaatacat

SEQ ID NO: 8097401 - DNA, 22 bp, Homo sapiens
aatagaatgtaatctaatacat

SEQ ID NO: 8097402 - DNA, 22 bp, Homo sapiens
aatagaatttaaatgcagtggc

SEQ ID NO: 8097403 - DNA, 22 bp, Homo sapiens
actgtctcctcatcatgcctgg

SEQ ID NO: 8097404 - DNA, 23 bp, Homo sapiens
actgtctgatatgttttccatca

SEQ ID NO: 8097405 - DNA, 22 bp, Homo sapiens
actgggagggtcttgaagaggg

SEQ ID NO: 8097406 - DNA, 22 bp, Homo sapiens
actgggaggcatctggagctga

SEQ ID NO: 8097407 - DNA, 22 bp, Homo sapiens
actggctgagtttatgttcaca

SEQ ID NO: 8097408 - DNA, 22 bp, Homo sapiens
aataaaatgaactggtagagtt

SEQ ID NO: 8097409 - DNA, 21 bp, Homo sapiens
aataaaacagttggtgtcaat

SEQ ID NO: 8097410 - DNA, 22 bp, Homo sapiens
aataatacatgagattaatgtt

SEQ ID NO: 8097411 - DNA, 22 bp, Homo sapiens
aataataagatactaagggagt

SEQ ID NO: 8097412 - DNA, 22 bp, Homo sapiens
actgggcaataaattcagagaa

SEQ ID NO: 8097413 - DNA, 22 bp, Homo sapiens
aataagtgagtttagcaagttt

SEQ ID NO: 8097414 - DNA, 20 bp, Homo sapiens
aatgaatgaacgaatggatg

SEQ ID NO: 8097415 - DNA, 22 bp, Homo sapiens
agaagccactggaggttgagat

SEQ ID NO: 8097416 - DNA, 22 bp, Homo sapiens
agaagccagaggcagtgggtac

SEQ ID NO: 8097417 - DNA, 22 bp, Homo sapiens
agaagccagaatattcatggat

SEQ ID NO: 8097418 - DNA, 18 bp, Homo sapiens
agaagccacgaggagtcc

SEQ ID NO: 8097419 - DNA, 22 bp, Homo sapiens
agaagccactgctcccagtgag

SEQ ID NO: 8097420 - DNA, 22 bp, Homo sapiens
agaacttaggaacaacagctta

SEQ ID NO: 8097421 - DNA, 22 bp, Homo sapiens
agaacttacattatagagctgt

SEQ ID NO: 8097422 - DNA, 22 bp, Homo sapiens
agaactatacattactcattga

SEQ ID NO: 8097423 - DNA, 22 bp, Homo sapiens
agaaggaaggctgagtgctgat

SEQ ID NO: 8097424 - DNA, 22 bp, Homo sapiens
agaagccagcttcagctgcccg

SEQ ID NO: 8097425 - DNA, 22 bp, Homo sapiens
agaagccagtcgctctcccgca

SEQ ID NO: 8097426 - DNA, 22 bp, Homo sapiens
agaagccagattgtagtgggac

SEQ ID NO: 8097427 - DNA, 22 bp, Homo sapiens
agaagccagccttgcctccttt

SEQ ID NO: 8097428 - DNA, 22 bp, Homo sapiens
agaagcttcaagatatttggta

SEQ ID NO: 8097429 - DNA, 22 bp, Homo sapiens
aatgccttataggctgaaaatt

SEQ ID NO: 8097430 - DNA, 22 bp, Homo sapiens
aatagctcactgatttctcttt

SEQ ID NO: 8097431 - DNA, 22 bp, Homo sapiens
aatagtacaatctacagacata

SEQ ID NO: 8097432 - DNA, 22 bp, Homo sapiens
aataggaagcaccaaattctcc

SEQ ID NO: 8097433 - DNA, 22 bp, Homo sapiens
aataggactttggtcctagctc

SEQ ID NO: 8097434 - DNA, 22 bp, Homo sapiens
aatagctttggtcaccatctgg

SEQ ID NO: 8097435 - DNA, 22 bp, Homo sapiens
aatagcttatgggatagatgtt

SEQ ID NO: 8097436 - DNA, 22 bp, Homo sapiens
aatagcttttgtatgatgaaat

SEQ ID NO: 8097437 - DNA, 22 bp, Homo sapiens
aataggaaaatatttaacaaga

SEQ ID NO: 8097438 - DNA, 22 bp, Homo sapiens
actttgtttggctattagagtc

SEQ ID NO: 8097439 - DNA, 22 bp, Homo sapiens
actttgtttggctattagagtc

SEQ ID NO: 8097440 - DNA, 22 bp, Homo sapiens
aatcaagtattttccagtggca

SEQ ID NO: 8097441 - DNA, 22 bp, Homo sapiens
aatcaagagttgtgtaatattt

SEQ ID NO: 8097442 - DNA, 22 bp, Homo sapiens
aatcaagtattttccagtggca

SEQ ID NO: 8097443 - DNA, 22 bp, Homo sapiens
aatcaagtcaaccatcatgtgc

SEQ ID NO: 8097444 - DNA, 22 bp, Homo sapiens
acttttatgataatcaatgttc

SEQ ID NO: 8097445 - DNA, 22 bp, Homo sapiens
agaaaggagaccagctctgccc

SEQ ID NO: 8097446 - DNA, 22 bp, Homo sapiens
agaaaggagcaccgtgggggat

SEQ ID NO: 8097447 - DNA, 22 bp, Homo sapiens
agaaaggcagggatgaggattg

SEQ ID NO: 8097448 - DNA, 22 bp, Homo sapiens
agaaaggattagtttggtataa

SEQ ID NO: 8097449 - DNA, 22 bp, Homo sapiens
agaaaggaggaagaatgacctc

SEQ ID NO: 8097450 - DNA, 22 bp, Homo sapiens
agaaaggacatctccctttaag

SEQ ID NO: 8097451 - DNA, 22 bp, Homo sapiens
agaaaggaagggaggagtttat

SEQ ID NO: 8097452 - DNA, 22 bp, Homo sapiens
aatcacaaatttagacagagct

SEQ ID NO: 8097453 - DNA, 22 bp, Homo sapiens
aatcacagtgggtactagattg

SEQ ID NO: 8097454 - DNA, 22 bp, Homo sapiens
aatcacatcactgagaatgagg

SEQ ID NO: 8097455 - DNA, 22 bp, Homo sapiens
aatctacatgcaatatttttag

SEQ ID NO: 8097456 - DNA, 22 bp, Homo sapiens
aatctacatagagatcaaatga

SEQ ID NO: 8097457 - DNA, 22 bp, Homo sapiens
aatctacatagagatcaaatga

SEQ ID NO: 8097458 - DNA, 22 bp, Homo sapiens
aatctacatgcaatatttttag

SEQ ID NO: 8097459 - DNA, 22 bp, Homo sapiens
aatctaacttcatagctgattt

SEQ ID NO: 8097460 - DNA, 22 bp, Homo sapiens
agaaagggatgaggtagctgct

SEQ ID NO: 8097461 - DNA, 22 bp, Homo sapiens
agaaagggaactggcaaagcca

SEQ ID NO: 8097462 - DNA, 22 bp, Homo sapiens
aaggaagaagggaagttactta

SEQ ID NO: 8097463 - DNA, 22 bp, Homo sapiens
aaggaggccctctccttctgga

SEQ ID NO: 8097464 - DNA, 22 bp, Homo sapiens
aaggacaagtagtatttgcatc

SEQ ID NO: 8097465 - DNA, 22 bp, Homo sapiens
aaggacaatgaagacagccaca

SEQ ID NO: 8097466 - DNA, 22 bp, Homo sapiens
aaggaagggaaatagtgatgtc

SEQ ID NO: 8097467 - DNA, 22 bp, Homo sapiens
aaggaagatgctggcctgggga

SEQ ID NO: 8097468 - DNA, 22 bp, Homo sapiens
aaggaagaatcatcacgttggg

SEQ ID NO: 8097469 - DNA, 22 bp, Homo sapiens
aaggaattccctttctgacaga

SEQ ID NO: 8097470 - DNA, 17 bp, Homo sapiens
aaggaatgtcagaagtt

SEQ ID NO: 8097471 - DNA, 19 bp, Homo sapiens
aaggaatggctttaagtag

SEQ ID NO: 8097472 - DNA, 22 bp, Homo sapiens
aaggaaggtactcagtgattct

SEQ ID NO: 8097473 - DNA, 22 bp, Homo sapiens
aaggaaggttcatagtcaaaga

SEQ ID NO: 8097474 - DNA, 22 bp, Homo sapiens
aaggcattgagcagttacagta

SEQ ID NO: 8097475 - DNA, 22 bp, Homo sapiens
aaggcaatggcaagagaaagca

SEQ ID NO: 8097476 - DNA, 22 bp, Homo sapiens
acatgaaatgcagcctgtaacc

SEQ ID NO: 8097477 - DNA, 22 bp, Homo sapiens
acatctcacttctttgaaggct

SEQ ID NO: 8097478 - DNA, 22 bp, Homo sapiens
acatgaagcaagaaagatgcta

SEQ ID NO: 8097479 - DNA, 22 bp, Homo sapiens
aagtccatgatcaagatgtggc

SEQ ID NO: 8097480 - DNA, 22 bp, Homo sapiens
aagtcatagtctaacccagcca

SEQ ID NO: 8097481 - DNA, 22 bp, Homo sapiens
aagtcatagtcgggaaagacat

SEQ ID NO: 8097482 - DNA, 22 bp, Homo sapiens
aagtatcaaatggtagcatatg

SEQ ID NO: 8097483 - DNA, 22 bp, Homo sapiens
aagtcctgtgtgcttacacttg

SEQ ID NO: 8097484 - DNA, 17 bp, Homo sapiens
aagtcccagctaacaca

SEQ ID NO: 8097485 - DNA, 18 bp, Homo sapiens
aagtccttcctttgcttt

SEQ ID NO: 8097486 - DNA, 22 bp, Homo sapiens
acctctgaacatttttaagact

SEQ ID NO: 8097487 - DNA, 22 bp, Homo sapiens
acctctgaagggccaagcaatg

SEQ ID NO: 8097488 - DNA, 22 bp, Homo sapiens
acctctgaaacttaatctattg

SEQ ID NO: 8097489 - DNA, 19 bp, Homo sapiens
acctctgagaatgccagtc

SEQ ID NO: 8097490 - DNA, 22 bp, Homo sapiens
aaggtaatccataatagttact

SEQ ID NO: 8097491 - DNA, 22 bp, Homo sapiens
aagggtgggcaccgccaggtca

SEQ ID NO: 8097492 - DNA, 22 bp, Homo sapiens
aagggtggatttctgagctcta

SEQ ID NO: 8097493 - DNA, 22 bp, Homo sapiens
aagggtggatttctgagctcta

SEQ ID NO: 8097494 - DNA, 22 bp, Homo sapiens
aagggtgggccctggcagccat

SEQ ID NO: 8097495 - DNA, 22 bp, Homo sapiens
aaggggtcaagcggcagctaca

SEQ ID NO: 8097496 - DNA, 17 bp, Homo sapiens
accagagttttccatgc

SEQ ID NO: 8097497 - DNA, 22 bp, Homo sapiens
accagagttttattagttctaa

SEQ ID NO: 8097498 - DNA, 22 bp, Homo sapiens
accagagttggaataattttga

SEQ ID NO: 8097499 - DNA, 22 bp, Homo sapiens
accagagtcaattattttgcca

SEQ ID NO: 8097500 - DNA, 22 bp, Homo sapiens
accagagtaatgtgtggaaatt

SEQ ID NO: 8097501 - DNA, 20 bp, Homo sapiens
aagggagaataatgattgta

SEQ ID NO: 8097502 - DNA, 22 bp, Homo sapiens
aagggcaagatcctaagcatcc

SEQ ID NO: 8097503 - DNA, 20 bp, Homo sapiens
aagggcagagggaacagact

SEQ ID NO: 8097504 - DNA, 22 bp, Homo sapiens
acagaagtccccatgaagaagc

SEQ ID NO: 8097505 - DNA, 22 bp, Homo sapiens
acagaactttctgatcctgagc

SEQ ID NO: 8097506 - DNA, 22 bp, Homo sapiens
acagaagtttcaagtaagaagt

SEQ ID NO: 8097507 - DNA, 22 bp, Homo sapiens
acagaagttggaattagatact

SEQ ID NO: 8097508 - DNA, 22 bp, Homo sapiens
acagaagttggaattagatact

SEQ ID NO: 8097509 - DNA, 22 bp, Homo sapiens
acagaggccatgagctgccacc

SEQ ID NO: 8097510 - DNA, 22 bp, Homo sapiens
acagagctgtacatgtgccatg

SEQ ID NO: 8097511 - DNA, 22 bp, Homo sapiens
acagaattaacatttgatgaat

SEQ ID NO: 8097512 - DNA, 22 bp, Homo sapiens
acagaatgcgtagtgcatgttg

SEQ ID NO: 8097513 - DNA, 22 bp, Homo sapiens
acagaatagtagcttaaagtca

SEQ ID NO: 8097514 - DNA, 22 bp, Homo sapiens
acagaatagagactgcctgctc

SEQ ID NO: 8097515 - DNA, 22 bp, Homo sapiens
acagaggctgcgcttgggaacg

SEQ ID NO: 8097516 - DNA, 22 bp, Homo sapiens
acagaggccccgtgggagagcc

SEQ ID NO: 8097517 - DNA, 22 bp, Homo sapiens
acagaggcctcgtaggtacaac

SEQ ID NO: 8097518 - DNA, 22 bp, Homo sapiens
acagaggcctcggcctgcccag

SEQ ID NO: 8097519 - DNA, 22 bp, Homo sapiens
acagaggtcatggagagttctc

SEQ ID NO: 8097520 - DNA, 22 bp, Homo sapiens
agcgtgggtccaaggctctggt

SEQ ID NO: 8097521 - DNA, 22 bp, Homo sapiens
acagcagtgcacagagaaccct

SEQ ID NO: 8097522 - DNA, 22 bp, Homo sapiens
acagcagtcagtgaatatttaa

SEQ ID NO: 8097523 - DNA, 22 bp, Homo sapiens
acagcagtggattagaggatgg

SEQ ID NO: 8097524 - DNA, 23 bp, Homo sapiens
agctgaggtgcagatccaaagaa

SEQ ID NO: 8097525 - DNA, 22 bp, Homo sapiens
acagcagcataaactgactaag

SEQ ID NO: 8097526 - DNA, 22 bp, Homo sapiens
acagcagcatcctatttcactc

SEQ ID NO: 8097527 - DNA, 22 bp, Homo sapiens
acagcagccagccactgtgagc

SEQ ID NO: 8097528 - DNA, 20 bp, Homo sapiens
acagcagccttgctagaaac

SEQ ID NO: 8097529 - DNA, 22 bp, Homo sapiens
acagcagcaatagcagtgacat

SEQ ID NO: 8097530 - DNA, 22 bp, Homo sapiens
acagcagatttccctgggctcc

SEQ ID NO: 8097531 - DNA, 22 bp, Homo sapiens
acagcagatctgtggagcttat

SEQ ID NO: 8097532 - DNA, 22 bp, Homo sapiens
acagcagagtgtgagatagcca

SEQ ID NO: 8097533 - DNA, 22 bp, Homo sapiens
acagatatcctcagtctccaac

SEQ ID NO: 8097534 - DNA, 22 bp, Homo sapiens
acagcagatctggctacaggtt

SEQ ID NO: 8097535 - DNA, 22 bp, Homo sapiens
acagcagagttgagtagttgca

SEQ ID NO: 8097536 - DNA, 20 bp, Homo sapiens
acagataccctgtgctggtg

SEQ ID NO: 8097537 - DNA, 20 bp, Homo sapiens
acagataccagggacatggg

SEQ ID NO: 8097538 - DNA, 22 bp, Homo sapiens
agcagggaatagcggaaagaat

SEQ ID NO: 8097539 - DNA, 22 bp, Homo sapiens
acacatattcatatgtacttac

SEQ ID NO: 8097540 - DNA, 22 bp, Homo sapiens
acacatctcaggggacactctc

SEQ ID NO: 8097541 - DNA, 22 bp, Homo sapiens
agcaggcttggtccccagcctc

SEQ ID NO: 8097542 - DNA, 22 bp, Homo sapiens
acacaagttctaaagattgcgc

SEQ ID NO: 8097543 - DNA, 22 bp, Homo sapiens
acacaatgtgcaggacacctgt

SEQ ID NO: 8097544 - DNA, 22 bp, Homo sapiens
acacagtgtgtgcagtcggacg

SEQ ID NO: 8097545 - DNA, 22 bp, Homo sapiens
acacagttcaggatcaaatagc

SEQ ID NO: 8097546 - DNA, 22 bp, Homo sapiens
acacagtggtgtttacaaaatt

SEQ ID NO: 8097547 - DNA, 22 bp, Homo sapiens
acacagtggtgagtctggacct

SEQ ID NO: 8097548 - DNA, 22 bp, Homo sapiens
acacagtattgtgactataact

SEQ ID NO: 8097549 - DNA, 22 bp, Homo sapiens
acacagtatgcatctagaaatt

SEQ ID NO: 8097550 - DNA, 22 bp, Homo sapiens
agccaataaatttacaactaga

SEQ ID NO: 8097551 - DNA, 22 bp, Homo sapiens
agccaatacactgaagatctaa

SEQ ID NO: 8097552 - DNA, 20 bp, Homo sapiens
agccaatacagcaaaatttg

SEQ ID NO: 8097553 - DNA, 22 bp, Homo sapiens
acacttaatcttactgaggatc

SEQ ID NO: 8097554 - DNA, 22 bp, Homo sapiens
acacttaagcatgaagtataaa

SEQ ID NO: 8097555 - DNA, 22 bp, Homo sapiens
acacttaacttctgagaataaa

SEQ ID NO: 8097556 - DNA, 22 bp, Homo sapiens
aatttgacccatcttggaattt

SEQ ID NO: 8097557 - DNA, 22 bp, Homo sapiens
aatttgaaacatagtcaccact

SEQ ID NO: 8097558 - DNA, 22 bp, Homo sapiens
aatttgattcagcaaatgttca

SEQ ID NO: 8097559 - DNA, 22 bp, Homo sapiens
aatttcttgggagctcagagaa

SEQ ID NO: 8097560 - DNA, 18 bp, Homo sapiens
aatttctttgacaactta

SEQ ID NO: 8097561 - DNA, 22 bp, Homo sapiens
aatttcttcagctctaaaatgg

SEQ ID NO: 8097562 - DNA, 22 bp, Homo sapiens
aatttctcggttttgatattgt

SEQ ID NO: 8097563 - DNA, 22 bp, Homo sapiens
aatttcttcagctctaaaatgg

SEQ ID NO: 8097564 - DNA, 22 bp, Homo sapiens
aatttctctctcatgcttcatg

SEQ ID NO: 8097565 - DNA, 22 bp, Homo sapiens
aatttctcatggattcagttat

SEQ ID NO: 8097566 - DNA, 22 bp, Homo sapiens
agagtgggttataggcagactt

SEQ ID NO: 8097567 - DNA, 20 bp, Homo sapiens
agagtgggtgtcacaggctg

SEQ ID NO: 8097568 - DNA, 22 bp, Homo sapiens
agatgccaggttgggaagtgat

SEQ ID NO: 8097569 - DNA, 22 bp, Homo sapiens
acaacagtagcctttacaaggc

SEQ ID NO: 8097570 - DNA, 22 bp, Homo sapiens
agatgctgctccacaggccagg

SEQ ID NO: 8097571 - DNA, 22 bp, Homo sapiens
acaaagttattctttcagagga

SEQ ID NO: 8097572 - DNA, 22 bp, Homo sapiens
acaaagtttcttctaacatctg

SEQ ID NO: 8097573 - DNA, 22 bp, Homo sapiens
acaaagtgtgcggagcccaggg

SEQ ID NO: 8097574 - DNA, 22 bp, Homo sapiens
acaaagtgctgacattacaggc

SEQ ID NO: 8097575 - DNA, 16 bp, Homo sapiens
acaaatacaactgctg

SEQ ID NO: 8097576 - DNA, 22 bp, Homo sapiens
acaaagtatttttaggtttgta

SEQ ID NO: 8097577 - DNA, 22 bp, Homo sapiens
acaaagtcctggtgtatggcca

SEQ ID NO: 8097578 - DNA, 22 bp, Homo sapiens
agagttcagaaagtgcaggttt

SEQ ID NO: 8097579 - DNA, 22 bp, Homo sapiens
acaaagtcttttacaacagtca

SEQ ID NO: 8097580 - DNA, 22 bp, Homo sapiens
acaaagtctgaaacctgaggca

SEQ ID NO: 8097581 - DNA, 22 bp, Homo sapiens
acaatacaggcttctggactta

SEQ ID NO: 8097582 - DNA, 20 bp, Homo sapiens
acaatacaggttgtgtctga

SEQ ID NO: 8097583 - DNA, 22 bp, Homo sapiens
acaatacttaccaatgtttttg

SEQ ID NO: 8097584 - DNA, 22 bp, Homo sapiens
acaatactcatgctctttttct

SEQ ID NO: 8097585 - DNA, 18 bp, Homo sapiens
agcaaatattaagtgcat

SEQ ID NO: 8097586 - DNA, 22 bp, Homo sapiens
acaacatcagctgagaccttca

SEQ ID NO: 8097587 - DNA, 22 bp, Homo sapiens
acaacagtccagtatagactgt

SEQ ID NO: 8097588 - DNA, 22 bp, Homo sapiens
agcaaataaagacaattatgtc

SEQ ID NO: 8097589 - DNA, 21 bp, Homo sapiens
acacaacaggcagtcattttc

SEQ ID NO: 8097590 - DNA, 22 bp, Homo sapiens
acacaaattgtaggataattgc

SEQ ID NO: 8097591 - DNA, 22 bp, Homo sapiens
agagctgcgtctattcacaatc

SEQ ID NO: 8097592 - DNA, 22 bp, Homo sapiens
agagctggaatcagacctcagg

SEQ ID NO: 8097593 - DNA, 22 bp, Homo sapiens
agaggaggtggtgatgctttaa

SEQ ID NO: 8097594 - DNA, 22 bp, Homo sapiens
agaggaggtccttttctgatgt

SEQ ID NO: 8097595 - DNA, 22 bp, Homo sapiens
agaggatgttctaggcactcat

SEQ ID NO: 8097596 - DNA, 21 bp, Homo sapiens
agagctggtaggtaggtaggt

SEQ ID NO: 8097597 - DNA, 22 bp, Homo sapiens
aatgtgtagcagaaccaggatt

SEQ ID NO: 8097598 - DNA, 22 bp, Homo sapiens
aatgtgtagcatttaatgcagt

SEQ ID NO: 8097599 - DNA, 22 bp, Homo sapiens
agacatcatgttacagattaag

SEQ ID NO: 8097600 - DNA, 22 bp, Homo sapiens
aaatgcttagaggtgttcaaat

SEQ ID NO: 8097601 - DNA, 22 bp, Homo sapiens
aaatgcttattagtgtcacaaa

SEQ ID NO: 8097602 - DNA, 21 bp, Homo sapiens
aaatgctttgtatatatctgt

SEQ ID NO: 8097603 - DNA, 22 bp, Homo sapiens
aaatcacagggtctctaagtat

SEQ ID NO: 8097604 - DNA, 22 bp, Homo sapiens
aaatcaaggagggattatattt

SEQ ID NO: 8097605 - DNA, 22 bp, Homo sapiens
aaatcaaggagggattatattt

SEQ ID NO: 8097606 - DNA, 22 bp, Homo sapiens
aaatcacagggtctctaagtat

SEQ ID NO: 8097607 - DNA, 22 bp, Homo sapiens
aaatcaaaagacatgtgtttta

SEQ ID NO: 8097608 - DNA, 22 bp, Homo sapiens
aaatcagaggtcagctgtacca

SEQ ID NO: 8097609 - DNA, 22 bp, Homo sapiens
aaatcagaggcaacaactactt

SEQ ID NO: 8097610 - DNA, 22 bp, Homo sapiens
aaatcagagaatatatttagaa

SEQ ID NO: 8097611 - DNA, 22 bp, Homo sapiens
aaatcagacttgaattttcatc

SEQ ID NO: 8097612 - DNA, 22 bp, Homo sapiens
aaatcagacacagtgaaagtta

SEQ ID NO: 8097613 - DNA, 19 bp, Homo sapiens
aaatcagaatctgcatttt

SEQ ID NO: 8097614 - DNA, 22 bp, Homo sapiens
aagagagacaataggtagcatt

SEQ ID NO: 8097615 - DNA, 22 bp, Homo sapiens
aagagagaccatgggggacagg

SEQ ID NO: 8097616 - DNA, 22 bp, Homo sapiens
aagagagagcattcttctgtta

SEQ ID NO: 8097617 - DNA, 22 bp, Homo sapiens
aagagagagtgcgctcacagaa

SEQ ID NO: 8097618 - DNA, 22 bp, Homo sapiens
aagagagagttcctaggcaaaa

SEQ ID NO: 8097619 - DNA, 22 bp, Homo sapiens
aaatatacggtccctaacagtc

SEQ ID NO: 8097620 - DNA, 22 bp, Homo sapiens
aaatatactagatgatgaccca

SEQ ID NO: 8097621 - DNA, 22 bp, Homo sapiens
aaatatagtaaatgcatagttc

SEQ ID NO: 8097622 - DNA, 22 bp, Homo sapiens
aaatatagtgacacttatagtc

SEQ ID NO: 8097623 - DNA, 22 bp, Homo sapiens
aaatatgagatgttctctttcg

SEQ ID NO: 8097624 - DNA, 22 bp, Homo sapiens
aaagttctttgcatctttgctc

SEQ ID NO: 8097625 - DNA, 22 bp, Homo sapiens
aaagttggatttcatcctcatg

SEQ ID NO: 8097626 - DNA, 22 bp, Homo sapiens
aaatacaaaaattagccaggca

SEQ ID NO: 8097627 - DNA, 22 bp, Homo sapiens
aaatacagtgtgtgttctttga

SEQ ID NO: 8097628 - DNA, 22 bp, Homo sapiens
aaatacagtgtgtgttctttga

SEQ ID NO: 8097629 - DNA, 22 bp, Homo sapiens
aagagagaactcccttcgccag

SEQ ID NO: 8097630 - DNA, 22 bp, Homo sapiens
aagagagaagtctctctggttc

SEQ ID NO: 8097631 - DNA, 20 bp, Homo sapiens
aaagcagtatgcaagtagag

SEQ ID NO: 8097632 - DNA, 22 bp, Homo sapiens
aaagcagtcactccagtgtgat

SEQ ID NO: 8097633 - DNA, 22 bp, Homo sapiens
aaagcagcaacgtgcatataac

SEQ ID NO: 8097634 - DNA, 22 bp, Homo sapiens
aaattgtaggatcacatgacct

SEQ ID NO: 8097635 - DNA, 22 bp, Homo sapiens
aaattccaccagaatcagtaat

SEQ ID NO: 8097636 - DNA, 22 bp, Homo sapiens
aaattccagaaactcagtatat

SEQ ID NO: 8097637 - DNA, 22 bp, Homo sapiens
aaattccattatgataatttcg

SEQ ID NO: 8097638 - DNA, 22 bp, Homo sapiens
aaaggaagtgccactcttcttc

SEQ ID NO: 8097639 - DNA, 22 bp, Homo sapiens
aaaggaagattgagcttttcca

SEQ ID NO: 8097640 - DNA, 22 bp, Homo sapiens
aaagcagtgctgtgagaacact

SEQ ID NO: 8097641 - DNA, 20 bp, Homo sapiens
aaaggaatatatgaagtata

SEQ ID NO: 8097642 - DNA, 22 bp, Homo sapiens
aaaggaggccacatggctagga

SEQ ID NO: 8097643 - DNA, 22 bp, Homo sapiens
aaaggattctcttgatttcagt

SEQ ID NO: 8097644 - DNA, 22 bp, Homo sapiens
aaaggcaaaattcttagcagga

SEQ ID NO: 8097645 - DNA, 22 bp, Homo sapiens
aaaggcaagcatttatatagga

SEQ ID NO: 8097646 - DNA, 22 bp, Homo sapiens
aaagggaggggcgataagccgg

SEQ ID NO: 8097647 - DNA, 22 bp, Homo sapiens
aaaggctggggactgaggaagg

SEQ ID NO: 8097648 - DNA, 22 bp, Homo sapiens
aaagtctatcagttactaatca

SEQ ID NO: 8097649 - DNA, 22 bp, Homo sapiens
aaagtctaaattattcaataag

SEQ ID NO: 8097650 - DNA, 22 bp, Homo sapiens
aaagtctgaaagataagagtga

SEQ ID NO: 8097651 - DNA, 22 bp, Homo sapiens
aaagtctgagcagaatttctca

SEQ ID NO: 8097652 - DNA, 20 bp, Homo sapiens
aaagtctgtttatctctgga

SEQ ID NO: 8097653 - DNA, 22 bp, Homo sapiens
aacttcttggtcctgagctgtt

SEQ ID NO: 8097654 - DNA, 22 bp, Homo sapiens
aacttctaatctgtacagtttt

SEQ ID NO: 8097655 - DNA, 22 bp, Homo sapiens
aaagttctgatgctgatcaaag

SEQ ID NO: 8097656 - DNA, 22 bp, Homo sapiens
aaagttctgggggagaagaacg

SEQ ID NO: 8097657 - DNA, 22 bp, Homo sapiens
aaagttctgagaagcagtttac

SEQ ID NO: 8097658 - DNA, 19 bp, Homo sapiens
aaagttctgactgtagagc

SEQ ID NO: 8097659 - DNA, 22 bp, Homo sapiens
aaagttctcctggattgtgctg

SEQ ID NO: 8097660 - DNA, 22 bp, Homo sapiens
aaagttctatgtaatgtttttt

SEQ ID NO: 8097661 - DNA, 22 bp, Homo sapiens
aaaatgtaaagcttgagtgtag

SEQ ID NO: 8097662 - DNA, 21 bp, Homo sapiens
aaaatgtagacttttccctga

SEQ ID NO: 8097663 - DNA, 21 bp, Homo sapiens
aaaatgtgagcgtgatgctta

SEQ ID NO: 8097664 - DNA, 22 bp, Homo sapiens
aaaatactactgtcttcttccc

SEQ ID NO: 8097665 - DNA, 22 bp, Homo sapiens
aaaataacttctactatttgca

SEQ ID NO: 8097666 - DNA, 22 bp, Homo sapiens
aaaatacacatactaggggaaa

SEQ ID NO: 8097667 - DNA, 22 bp, Homo sapiens
aaaagttgcaaaattgctcttc

SEQ ID NO: 8097668 - DNA, 22 bp, Homo sapiens
aaaagttacctctgtaatataa

SEQ ID NO: 8097669 - DNA, 21 bp, Homo sapiens
aaaaggaaggtctgtttgggg

SEQ ID NO: 8097670 - DNA, 19 bp, Homo sapiens
aaaaggaatattctttggg

SEQ ID NO: 8097671 - DNA, 19 bp, Homo sapiens
aaaaggaatattctttggg

SEQ ID NO: 8097672 - DNA, 22 bp, Homo sapiens
aaaaatttatggttcttctctg

SEQ ID NO: 8097673 - DNA, 22 bp, Homo sapiens
aaacttcagtgaatgacttatg

SEQ ID NO: 8097674 - DNA, 22 bp, Homo sapiens
aaatgtctgtatgagaaagaga

SEQ ID NO: 8097675 - DNA, 22 bp, Homo sapiens
aaagacagtggattcaaaatcc

SEQ ID NO: 8097676 - DNA, 22 bp, Homo sapiens
aaatgtctttcaatagagaaat

SEQ ID NO: 8097677 - DNA, 22 bp, Homo sapiens
aaatgtctttgagtttttataa

SEQ ID NO: 8097678 - DNA, 22 bp, Homo sapiens
aaatacagagttatggacctca

SEQ ID NO: 8097679 - DNA, 22 bp, Homo sapiens
aaatacagagttgcttaaaagc

SEQ ID NO: 8097680 - DNA, 22 bp, Homo sapiens
aaatacaatttcaggctgtaat

SEQ ID NO: 8097681 - DNA, 22 bp, Homo sapiens
aaataacagtcagggacaacat

SEQ ID NO: 8097682 - DNA, 22 bp, Homo sapiens
aaataaaggaactgttttccca

SEQ ID NO: 8097683 - DNA, 22 bp, Homo sapiens
aaataaaggtccactttagggc

SEQ ID NO: 8097684 - DNA, 22 bp, Homo sapiens
aaactgttcctttttcagcaac

SEQ ID NO: 8097685 - DNA, 22 bp, Homo sapiens
aaactgttgtggtttatcatta

SEQ ID NO: 8097686 - DNA, 22 bp, Homo sapiens
aaatccagtgttcaaagtttga

SEQ ID NO: 8097687 - DNA, 22 bp, Homo sapiens
aaaggaatgagcttctgttagg

SEQ ID NO: 8097688 - DNA, 22 bp, Homo sapiens
aaagctctcccactgtatgaag

SEQ ID NO: 8097689 - DNA, 22 bp, Homo sapiens
aaaggagagtgagtcagatgcc

SEQ ID NO: 8097690 - DNA, 22 bp, Homo sapiens
aaagctatagggtcaagcattt

SEQ ID NO: 8097691 - DNA, 22 bp, Homo sapiens
aaaattgtaggaactgaatcaa

SEQ ID NO: 8097692 - DNA, 22 bp, Homo sapiens
aaaatttccaccatctttgtgt

SEQ ID NO: 8097693 - DNA, 22 bp, Homo sapiens
aaaattgtcgaacagtagtaac

SEQ ID NO: 8097694 - DNA, 22 bp, Homo sapiens
aaaattttgccctatccttcat

SEQ ID NO: 8097695 - DNA, 22 bp, Homo sapiens
aaaattttactggtgtttcctt

SEQ ID NO: 8097696 - DNA, 22 bp, Homo sapiens
aaataaactgaagcacagagag

SEQ ID NO: 8097697 - DNA, 22 bp, Homo sapiens
aaagttctaaaactctttgtga

SEQ ID NO: 8097698 - DNA, 22 bp, Homo sapiens
aaagtcattggaatattaatga

SEQ ID NO: 8097699 - DNA, 22 bp, Homo sapiens
aaagtcattgctgttatcaatg

SEQ ID NO: 8097700 - DNA, 22 bp, Homo sapiens
aaagtcattgtaatatatgcta

SEQ ID NO: 8097701 - DNA, 22 bp, Homo sapiens
aaagtcatggaaaatcttggaa

SEQ ID NO: 8097702 - DNA, 22 bp, Homo sapiens
aaagtcatgcagttgaactttt

SEQ ID NO: 8097703 - DNA, 22 bp, Homo sapiens
aaagtcatctgtcctaggctct

SEQ ID NO: 8097704 - DNA, 22 bp, Homo sapiens
aaagtcatctaggagcagattt

SEQ ID NO: 8097705 - DNA, 22 bp, Homo sapiens
aaagtcatcatttcttttcaaa

SEQ ID NO: 8097706 - DNA, 22 bp, Homo sapiens
aaagtcacttccttctgtcagc

SEQ ID NO: 8097707 - DNA, 22 bp, Homo sapiens
aaagtcatcagaaccttccaga

SEQ ID NO: 8097708 - DNA, 22 bp, Homo sapiens
aaagtcatcatttcttttcaaa

SEQ ID NO: 8097709 - DNA, 22 bp, Homo sapiens
aaagtcatacatggtgcttact

SEQ ID NO: 8097710 - DNA, 22 bp, Homo sapiens
aaagtacaaggaaaggatctga

SEQ ID NO: 8097711 - DNA, 22 bp, Homo sapiens
acacagccagggtagtaaggct

SEQ ID NO: 8097712 - DNA, 22 bp, Homo sapiens
acacagccccacggtgagcaaa

SEQ ID NO: 8097713 - DNA, 17 bp, Homo sapiens
acacagccaggttctcc

SEQ ID NO: 8097714 - DNA, 22 bp, Homo sapiens
acacagccgtgaatctgcttct

SEQ ID NO: 8097715 - DNA, 22 bp, Homo sapiens
aagatacacggtcaactctcaa

SEQ ID NO: 8097716 - DNA, 22 bp, Homo sapiens
acacagagcaaatcatgacaga

SEQ ID NO: 8097717 - DNA, 22 bp, Homo sapiens
acaatgttctacatatacataa

SEQ ID NO: 8097718 - DNA, 22 bp, Homo sapiens
acacagaagctttttctattcc

SEQ ID NO: 8097719 - DNA, 22 bp, Homo sapiens
acaatgtcacctctcatgtttt

SEQ ID NO: 8097720 - DNA, 22 bp, Homo sapiens
acaatgtaggatatgtacttgt

SEQ ID NO: 8097721 - DNA, 22 bp, Homo sapiens
acaatcacacatgcaattatac

SEQ ID NO: 8097722 - DNA, 22 bp, Homo sapiens
acaatattgtacccagaagttt

SEQ ID NO: 8097723 - DNA, 22 bp, Homo sapiens
acaatatacacatcctaatggg

SEQ ID NO: 8097724 - DNA, 22 bp, Homo sapiens
acaaatttgaatcctgacttct

SEQ ID NO: 8097725 - DNA, 22 bp, Homo sapiens
acaaatttggtgagagtaaata

SEQ ID NO: 8097726 - DNA, 22 bp, Homo sapiens
acaaaactcttgctgggatttt

SEQ ID NO: 8097727 - DNA, 22 bp, Homo sapiens
acaaaaccagaaaatctctacc

SEQ ID NO: 8097728 - DNA, 22 bp, Homo sapiens
aagaatatttcctgcacttggg

SEQ ID NO: 8097729 - DNA, 22 bp, Homo sapiens
aagaatatttcctgcacttggg

SEQ ID NO: 8097730 - DNA, 22 bp, Homo sapiens
acaaatctgttttatagacttt

SEQ ID NO: 8097731 - DNA, 22 bp, Homo sapiens
aagaatctctctactttattac

SEQ ID NO: 8097732 - DNA, 22 bp, Homo sapiens
aagaatcattgtaaagttctgt

SEQ ID NO: 8097733 - DNA, 22 bp, Homo sapiens
aatgtacaataagacaaagagg

SEQ ID NO: 8097734 - DNA, 22 bp, Homo sapiens
aagaactatctctggctgtagg

SEQ ID NO: 8097735 - DNA, 19 bp, Homo sapiens
aagaactatgtgattacag

SEQ ID NO: 8097736 - DNA, 22 bp, Homo sapiens
aagaactagtcttacagcctca

SEQ ID NO: 8097737 - DNA, 22 bp, Homo sapiens
aagaactgtgctccaggctcca

SEQ ID NO: 8097738 - DNA, 22 bp, Homo sapiens
acaaaaattagctgggcatggt

SEQ ID NO: 8097739 - DNA, 22 bp, Homo sapiens
aagaagatggttaactttcagt

SEQ ID NO: 8097740 - DNA, 22 bp, Homo sapiens
aagcccagggaatggtcgggag

SEQ ID NO: 8097741 - DNA, 22 bp, Homo sapiens
aagcccaggtaagtggctcatg

SEQ ID NO: 8097742 - DNA, 19 bp, Homo sapiens
aagcccagtgtatgctctt

SEQ ID NO: 8097743 - DNA, 20 bp, Homo sapiens
aagcccattaccatgcttgg

SEQ ID NO: 8097744 - DNA, 22 bp, Homo sapiens
acagctgctgtttttgaaggac

SEQ ID NO: 8097745 - DNA, 22 bp, Homo sapiens
acagcaggttacagtggcacag

SEQ ID NO: 8097746 - DNA, 22 bp, Homo sapiens
acagcagggggagctgttggac

SEQ ID NO: 8097747 - DNA, 19 bp, Homo sapiens
aagcagtttatatatttgt

SEQ ID NO: 8097748 - DNA, 22 bp, Homo sapiens
aagcagtttttcaactgtttag

SEQ ID NO: 8097749 - DNA, 22 bp, Homo sapiens
aagcagtgcgctcatctaaggg

SEQ ID NO: 8097750 - DNA, 22 bp, Homo sapiens
aagcagttactatttactatta

SEQ ID NO: 8097751 - DNA, 22 bp, Homo sapiens
aagcagttaatgttttgtcaat

SEQ ID NO: 8097752 - DNA, 22 bp, Homo sapiens
aagcagtgttcccagctggccc

SEQ ID NO: 8097753 - DNA, 22 bp, Homo sapiens
aagcagtatggtatttaagtca

SEQ ID NO: 8097754 - DNA, 22 bp, Homo sapiens
acagaaatgatgtttggcaata

SEQ ID NO: 8097755 - DNA, 23 bp, Homo sapiens
acagaaagttctgctggacagag

SEQ ID NO: 8097756 - DNA, 22 bp, Homo sapiens
acagaccagctttcattccctt

SEQ ID NO: 8097757 - DNA, 22 bp, Homo sapiens
aagatacatatttgttctagtg

SEQ ID NO: 8097758 - DNA, 22 bp, Homo sapiens
acacataagcctaatcatctcc

SEQ ID NO: 8097759 - DNA, 22 bp, Homo sapiens
aagatacagacagagccaaaat

SEQ ID NO: 8097760 - DNA, 22 bp, Homo sapiens
acacatacatggggaagatgag

SEQ ID NO: 8097761 - DNA, 22 bp, Homo sapiens
acagaaagatgatttgaaatgg

SEQ ID NO: 8097762 - DNA, 22 bp, Homo sapiens
acacttgaggaatgtggtgatt

SEQ ID NO: 8097763 - DNA, 22 bp, Homo sapiens
acacttggagcaacacttatgg

SEQ ID NO: 8097764 - DNA, 22 bp, Homo sapiens
aatgctttagcagtgattagtg

SEQ ID NO: 8097765 - DNA, 22 bp, Homo sapiens
aatgctttaattgcatgtagtg

SEQ ID NO: 8097766 - DNA, 22 bp, Homo sapiens
aatgtacaaaagtcagccaact

SEQ ID NO: 8097767 - DNA, 22 bp, Homo sapiens
aatgtacaaaccttctttgtag

SEQ ID NO: 8097768 - DNA, 22 bp, Homo sapiens
aatgaaatgtagcttatccata

SEQ ID NO: 8097769 - DNA, 22 bp, Homo sapiens
aatgaaatgtagcttatccata

SEQ ID NO: 8097770 - DNA, 18 bp, Homo sapiens
aatgaaatgtacaccttt

SEQ ID NO: 8097771 - DNA, 18 bp, Homo sapiens
aatgaaatgtacaccttt

SEQ ID NO: 8097772 - DNA, 22 bp, Homo sapiens
aatgaaatgaagatatgatcag

SEQ ID NO: 8097773 - DNA, 22 bp, Homo sapiens
aatgcactgtcagtattgttga

SEQ ID NO: 8097774 - DNA, 22 bp, Homo sapiens
aatgaaagaatgaaacagccca

SEQ ID NO: 8097775 - DNA, 22 bp, Homo sapiens
aagttaattaacctctccatca

SEQ ID NO: 8097776 - DNA, 22 bp, Homo sapiens
aacagttattatcacattagtg

SEQ ID NO: 8097777 - DNA, 22 bp, Homo sapiens
aagttacagtcagaggttaaca

SEQ ID NO: 8097778 - DNA, 22 bp, Homo sapiens
aatacagtcttactagaaaatc

SEQ ID NO: 8097779 - DNA, 22 bp, Homo sapiens
aatacagtgaaagtgagcaagg

SEQ ID NO: 8097780 - DNA, 19 bp, Homo sapiens
aatacagtgttatagaatt

SEQ ID NO: 8097781 - DNA, 19 bp, Homo sapiens
aatacagtgttatagaatt

SEQ ID NO: 8097782 - DNA, 21 bp, Homo sapiens
aatacagtgaagaatttcttt

SEQ ID NO: 8097783 - DNA, 22 bp, Homo sapiens
aatacataataagttttgtctg

SEQ ID NO: 8097784 - DNA, 22 bp, Homo sapiens
aatacataataagttttgtctg

SEQ ID NO: 8097785 - DNA, 22 bp, Homo sapiens
aatatcagtatattgtatcagt

SEQ ID NO: 8097786 - DNA, 22 bp, Homo sapiens
aatatcatctctcttttctgca

SEQ ID NO: 8097787 - DNA, 22 bp, Homo sapiens
aatatccattgggagcaaatgg

SEQ ID NO: 8097788 - DNA, 22 bp, Homo sapiens
aatattgtttcaagatcacaga

SEQ ID NO: 8097789 - DNA, 22 bp, Homo sapiens
aatattgagaaccagcatgttt

SEQ ID NO: 8097790 - DNA, 22 bp, Homo sapiens
aatccactttgtgcccctctct

SEQ ID NO: 8097791 - DNA, 22 bp, Homo sapiens
aacagttacccttaagatcttt

SEQ ID NO: 8097792 - DNA, 22 bp, Homo sapiens
aacagtgatatcaagacagaca

SEQ ID NO: 8097793 - DNA, 22 bp, Homo sapiens
aagtgctaggattacaggtgtg

SEQ ID NO: 8097794 - DNA, 22 bp, Homo sapiens
aagtgaaacatgtatctcttta

SEQ ID NO: 8097795 - DNA, 22 bp, Homo sapiens
aagtctttcataagtctcttat

SEQ ID NO: 8097796 - DNA, 22 bp, Homo sapiens
aagtctgtttgagtgtcacact

SEQ ID NO: 8097797 - DNA, 22 bp, Homo sapiens
aagtaaggcagtgaatgagatt

SEQ ID NO: 8097798 - DNA, 22 bp, Homo sapiens
aagtccaggtcctcattccatc

SEQ ID NO: 8097799 - DNA, 22 bp, Homo sapiens
aagggcagggagtttgtgtcta

SEQ ID NO: 8097800 - DNA, 21 bp, Homo sapiens
aaggtctgtaaagtgacagga

SEQ ID NO: 8097801 - DNA, 22 bp, Homo sapiens
aaggtgtgctgtgagacctggt

SEQ ID NO: 8097802 - DNA, 22 bp, Homo sapiens
aaggccctgtctccaaatacag

SEQ ID NO: 8097803 - DNA, 22 bp, Homo sapiens
aagggcaggaaaagatggatgt

SEQ ID NO: 8097804 - DNA, 22 bp, Homo sapiens
aagggaggccagaggttttgca

SEQ ID NO: 8097805 - DNA, 22 bp, Homo sapiens
aaggcactcattcaaggagata

SEQ ID NO: 8097806 - DNA, 22 bp, Homo sapiens
aaggagtctgggccattcagag

SEQ ID NO: 8097807 - DNA, 22 bp, Homo sapiens
aaggagaagggtaatcaacaca

SEQ ID NO: 8097808 - DNA, 22 bp, Homo sapiens
aaggagaagtctgttgagattg

SEQ ID NO: 8097809 - DNA, 16 bp, Homo sapiens
aaggagggaagagaat

SEQ ID NO: 8097810 - DNA, 22 bp, Homo sapiens
aaggagggaaagcagtgcttct

SEQ ID NO: 8097811 - DNA, 22 bp, Homo sapiens
aaggagggttcccaggtcctgg

SEQ ID NO: 8097812 - DNA, 22 bp, Homo sapiens
aaatggatggaattgacattta

SEQ ID NO: 8097813 - DNA, 22 bp, Homo sapiens
tcagcctgctccaagtgctgcc

SEQ ID NO: 8097814 - DNA, 21 bp, Homo sapiens
tcagcaggcaccagaaggctg

SEQ ID NO: 8097815 - DNA, 22 bp, Homo sapiens
tcagcagaaaggcactagatga

SEQ ID NO: 8097816 - DNA, 22 bp, Homo sapiens
tcagcacttttactctctttgc

SEQ ID NO: 8097817 - DNA, 18 bp, Homo sapiens
tcagcctgttgtctgcct

SEQ ID NO: 8097818 - DNA, 22 bp, Homo sapiens
tcagcctggtgattcctctgtc

SEQ ID NO: 8097819 - DNA, 22 bp, Homo sapiens
tcagcctggcaggatggcctgg

SEQ ID NO: 8097820 - DNA, 22 bp, Homo sapiens
tcagctcactctgcttcctggg

SEQ ID NO: 8097821 - DNA, 22 bp, Homo sapiens
tcaggaagggctcagtctgtgc

SEQ ID NO: 8097822 - DNA, 22 bp, Homo sapiens
tcaggaggttgaccacggggca

SEQ ID NO: 8097823 - DNA, 22 bp, Homo sapiens
tcaggaaggcgccccatcagga

SEQ ID NO: 8097824 - DNA, 22 bp, Homo sapiens
tcaggaagctgaattacaaaaa

SEQ ID NO: 8097825 - DNA, 22 bp, Homo sapiens
tcaggaagctactgccagcagc

SEQ ID NO: 8097826 - DNA, 22 bp, Homo sapiens
tcagctctgcaaggtcacctcc

SEQ ID NO: 8097827 - DNA, 22 bp, Homo sapiens
tcaggcctgcaggcttcctgga

SEQ ID NO: 8097828 - DNA, 22 bp, Homo sapiens
tcaggagtgataccatttgtca

SEQ ID NO: 8097829 - DNA, 22 bp, Homo sapiens
tcaggctggagtgcagtggcgc

SEQ ID NO: 8097830 - DNA, 22 bp, Homo sapiens
tcaggctggaatgcagtggggc

SEQ ID NO: 8097831 - DNA, 22 bp, Homo sapiens
tcaggccttcagacctggcccg

SEQ ID NO: 8097832 - DNA, 22 bp, Homo sapiens
tcagggaaaacatcccgcctaa

SEQ ID NO: 8097833 - DNA, 22 bp, Homo sapiens
tcagggaaacaggttttccctt

SEQ ID NO: 8097834 - DNA, 22 bp, Homo sapiens
tcagggaaacctaaggaagcca

SEQ ID NO: 8097835 - DNA, 22 bp, Homo sapiens
tcagggaaatagcagggctgaa

SEQ ID NO: 8097836 - DNA, 22 bp, Homo sapiens
tcagggaaatttccatgtgttt

SEQ ID NO: 8097837 - DNA, 22 bp, Homo sapiens
tcagggaacaatgttatggctt

SEQ ID NO: 8097838 - DNA, 22 bp, Homo sapiens
tcagggaatgtgatacaggaag

SEQ ID NO: 8097839 - DNA, 22 bp, Homo sapiens
tcagggaatgggcccagtccct

SEQ ID NO: 8097840 - DNA, 22 bp, Homo sapiens
tcagggacccctctgagtggag

SEQ ID NO: 8097841 - DNA, 21 bp, Homo sapiens
tcagggaagtgtgcagaaggg

SEQ ID NO: 8097842 - DNA, 22 bp, Homo sapiens
tcagggaataagtagatgagtg

SEQ ID NO: 8097843 - DNA, 22 bp, Homo sapiens
tcagggaatcagactctgcagc

SEQ ID NO: 8097844 - DNA, 17 bp, Homo sapiens
tcagggaatgaggttgt

SEQ ID NO: 8097845 - DNA, 22 bp, Homo sapiens
tcagggaagagagatctcctag

SEQ ID NO: 8097846 - DNA, 22 bp, Homo sapiens
tcagggaagaaatgggacttta

SEQ ID NO: 8097847 - DNA, 22 bp, Homo sapiens
tcagggaactacttctccctat

SEQ ID NO: 8097848 - DNA, 22 bp, Homo sapiens
tcagggaagacttcttagagga

SEQ ID NO: 8097849 - DNA, 23 bp, Homo sapiens
tcagtgcaaaaataggattttgg

SEQ ID NO: 8097850 - DNA, 20 bp, Homo sapiens
tcagtgattttgaagaggaa

SEQ ID NO: 8097851 - DNA, 22 bp, Homo sapiens
tcagtgcacccaattctctcca

SEQ ID NO: 8097852 - DNA, 22 bp, Homo sapiens
tcagtgcacagagatttttgtt

SEQ ID NO: 8097853 - DNA, 22 bp, Homo sapiens
tcagtgattggtggactgccta

SEQ ID NO: 8097854 - DNA, 22 bp, Homo sapiens
tcagtgaaccttctgtggcagg

SEQ ID NO: 8097855 - DNA, 18 bp, Homo sapiens
tcagtgtagatctgtgta

SEQ ID NO: 8097856 - DNA, 22 bp, Homo sapiens
tcagtgtccaaaaagaggcaag

SEQ ID NO: 8097857 - DNA, 22 bp, Homo sapiens
tcattatttgctttagttatgt

SEQ ID NO: 8097858 - DNA, 22 bp, Homo sapiens
tcattcatatctctcaagctta

SEQ ID NO: 8097859 - DNA, 22 bp, Homo sapiens
tcattataaacatatgctaaag

SEQ ID NO: 8097860 - DNA, 22 bp, Homo sapiens
tcattataaacatatgctaaag

SEQ ID NO: 8097861 - DNA, 22 bp, Homo sapiens
tcatataactggatattttcaa

SEQ ID NO: 8097862 - DNA, 22 bp, Homo sapiens
tcatataagtttaaaactatct

SEQ ID NO: 8097863 - DNA, 22 bp, Homo sapiens
tcatataagtttaaaactatct

SEQ ID NO: 8097864 - DNA, 22 bp, Homo sapiens
tcatataagagctttagagtca

SEQ ID NO: 8097865 - DNA, 22 bp, Homo sapiens
tcatatattttggcagtgatca

SEQ ID NO: 8097866 - DNA, 22 bp, Homo sapiens
tcatatttaggcctttaattca

SEQ ID NO: 8097867 - DNA, 22 bp, Homo sapiens
tcagagaggttaaatatcttgt

SEQ ID NO: 8097868 - DNA, 22 bp, Homo sapiens
tcagagaggcaatactgtttaa

SEQ ID NO: 8097869 - DNA, 22 bp, Homo sapiens
tcagagcattcgggtgacaaat

SEQ ID NO: 8097870 - DNA, 22 bp, Homo sapiens
tcagagcagactttgaaggagg

SEQ ID NO: 8097871 - DNA, 22 bp, Homo sapiens
tcagagcacttggctcatggca

SEQ ID NO: 8097872 - DNA, 22 bp, Homo sapiens
tcagagctaaggggagagcaaa

SEQ ID NO: 8097873 - DNA, 20 bp, Homo sapiens
tcagagctgcaggagagaaa

SEQ ID NO: 8097874 - DNA, 22 bp, Homo sapiens
tcagaggaaacaatctttagta

SEQ ID NO: 8097875 - DNA, 22 bp, Homo sapiens
tcagcactatacattttgaata

SEQ ID NO: 8097876 - DNA, 22 bp, Homo sapiens
tcagcactgtcttttatttgaa

SEQ ID NO: 8097877 - DNA, 22 bp, Homo sapiens
tcagcactgatgtttcagaaga

SEQ ID NO: 8097878 - DNA, 22 bp, Homo sapiens
tcagaggaaaggtcagatggct

SEQ ID NO: 8097879 - DNA, 22 bp, Homo sapiens
tcagaggaaagggaacatagtc

SEQ ID NO: 8097880 - DNA, 22 bp, Homo sapiens
tcagaggaaagggaacatagtc

SEQ ID NO: 8097881 - DNA, 22 bp, Homo sapiens
tcagaggaagcatcaagttctc

SEQ ID NO: 8097882 - DNA, 22 bp, Homo sapiens
tcagaggaacactgtttcatgc

SEQ ID NO: 8097883 - DNA, 22 bp, Homo sapiens
tcagaggaactggactaaagcc

SEQ ID NO: 8097884 - DNA, 22 bp, Homo sapiens
tcagaggaactggactaaagcc

SEQ ID NO: 8097885 - DNA, 22 bp, Homo sapiens
tcagcaaggctgcattctcatc

SEQ ID NO: 8097886 - DNA, 22 bp, Homo sapiens
tcagaaaagagaaaatcttata

SEQ ID NO: 8097887 - DNA, 22 bp, Homo sapiens
tcagaaaagagaaaatcttata

SEQ ID NO: 8097888 - DNA, 22 bp, Homo sapiens
tcagaaaagaccacattattct

SEQ ID NO: 8097889 - DNA, 22 bp, Homo sapiens
tcacttttgatccctatgcagt

SEQ ID NO: 8097890 - DNA, 22 bp, Homo sapiens
tcacttttgatccctatgcagt

SEQ ID NO: 8097891 - DNA, 22 bp, Homo sapiens
tcagacaggcctctccagcctc

SEQ ID NO: 8097892 - DNA, 22 bp, Homo sapiens
tcagaaaataactgttagtttg

SEQ ID NO: 8097893 - DNA, 20 bp, Homo sapiens
tcagacagtcgcagttctgg

SEQ ID NO: 8097894 - DNA, 22 bp, Homo sapiens
tcagacagggcttctcaaactt

SEQ ID NO: 8097895 - DNA, 22 bp, Homo sapiens
tcagacaggctggacagcttgc

SEQ ID NO: 8097896 - DNA, 22 bp, Homo sapiens
tcagagaagacatcattgtgaa

SEQ ID NO: 8097897 - DNA, 22 bp, Homo sapiens
tcagacatatttttaacaaagt

SEQ ID NO: 8097898 - DNA, 22 bp, Homo sapiens
tcagacatcgtaattacacaat

SEQ ID NO: 8097899 - DNA, 22 bp, Homo sapiens
tcacttcttcccttgcacatat

SEQ ID NO: 8097900 - DNA, 22 bp, Homo sapiens
tcacagtagttgttctctgttt

SEQ ID NO: 8097901 - DNA, 22 bp, Homo sapiens
tcaccagctctgcctcgccagt

SEQ ID NO: 8097902 - DNA, 22 bp, Homo sapiens
tcacagtaaatccagaagaaat

SEQ ID NO: 8097903 - DNA, 22 bp, Homo sapiens
tcacagtagacttctcaagagc

SEQ ID NO: 8097904 - DNA, 22 bp, Homo sapiens
tcacagtactccccaaagtttc

SEQ ID NO: 8097905 - DNA, 22 bp, Homo sapiens
tcacaggctggtctccgaggac

SEQ ID NO: 8097906 - DNA, 22 bp, Homo sapiens
tcacaggcctggggcagagggc

SEQ ID NO: 8097907 - DNA, 22 bp, Homo sapiens
tcacagaagttgaatttgcatg

SEQ ID NO: 8097908 - DNA, 22 bp, Homo sapiens
tcacagaagggaaagatgccaa

SEQ ID NO: 8097909 - DNA, 22 bp, Homo sapiens
tcacagaaggaccttgtttcat

SEQ ID NO: 8097910 - DNA, 22 bp, Homo sapiens
tcacagaagatgctggatgttg

SEQ ID NO: 8097911 - DNA, 22 bp, Homo sapiens
tcacagaagcttgaagattttc

SEQ ID NO: 8097912 - DNA, 22 bp, Homo sapiens
tcacagctccagactgcaactc

SEQ ID NO: 8097913 - DNA, 22 bp, Homo sapiens
tcacaaatagctatattaagga

SEQ ID NO: 8097914 - DNA, 22 bp, Homo sapiens
tcacaagagctggactgtcttt

SEQ ID NO: 8097915 - DNA, 22 bp, Homo sapiens
tcacaaagtgaagtgtgtcatg

SEQ ID NO: 8097916 - DNA, 22 bp, Homo sapiens
tcaattttatgaaacaaagtga

SEQ ID NO: 8097917 - DNA, 20 bp, Homo sapiens
tcaattttctacaacatttg

SEQ ID NO: 8097918 - DNA, 20 bp, Homo sapiens
tcaattttctacaacatttg

SEQ ID NO: 8097919 - DNA, 22 bp, Homo sapiens
tcacaaaagcttttgaatttgg

SEQ ID NO: 8097920 - DNA, 22 bp, Homo sapiens
tcacaaaagcttttgaatttgg

SEQ ID NO: 8097921 - DNA, 22 bp, Homo sapiens
tcacaaaagcttttgaatttgg

SEQ ID NO: 8097922 - DNA, 22 bp, Homo sapiens
tcacagaaataagatagttatt

SEQ ID NO: 8097923 - DNA, 22 bp, Homo sapiens
tcacagaaagctgtgtcctgac

SEQ ID NO: 8097924 - DNA, 22 bp, Homo sapiens
tcacaattcagaaaccaagtag

SEQ ID NO: 8097925 - DNA, 20 bp, Homo sapiens
tcacacatggtaagctatga

SEQ ID NO: 8097926 - DNA, 22 bp, Homo sapiens
tcaagagaagtgctccacagta

SEQ ID NO: 8097927 - DNA, 22 bp, Homo sapiens
tcaagatatagagggttctaga

SEQ ID NO: 8097928 - DNA, 22 bp, Homo sapiens
tatttcttgagtggtcagtttc

SEQ ID NO: 8097929 - DNA, 22 bp, Homo sapiens
tcaagaatttttaatgtgactg

SEQ ID NO: 8097930 - DNA, 22 bp, Homo sapiens
tcaagaatagctgcaaacaggg

SEQ ID NO: 8097931 - DNA, 22 bp, Homo sapiens
tatttcttcgggattcaagcta

SEQ ID NO: 8097932 - DNA, 22 bp, Homo sapiens
tatttcttcgggattcaagcta

SEQ ID NO: 8097933 - DNA, 22 bp, Homo sapiens
tatttcttcgggattcaagcta

SEQ ID NO: 8097934 - DNA, 22 bp, Homo sapiens
tatttcttgagactcgtcttcc

SEQ ID NO: 8097935 - DNA, 22 bp, Homo sapiens
tatttcttgagactcgtcttcc

SEQ ID NO: 8097936 - DNA, 22 bp, Homo sapiens
tatttcttgagactcgtcttcc

SEQ ID NO: 8097937 - DNA, 22 bp, Homo sapiens
tcaagtctcaatgtattatggt

SEQ ID NO: 8097938 - DNA, 22 bp, Homo sapiens
tcaagtctcaatgtattatggt

SEQ ID NO: 8097939 - DNA, 22 bp, Homo sapiens
tcaagtcatttgactgtgtgtt

SEQ ID NO: 8097940 - DNA, 22 bp, Homo sapiens
tcaagtattattacagatgtag

SEQ ID NO: 8097941 - DNA, 22 bp, Homo sapiens
tcaagtattattacagatgtag

SEQ ID NO: 8097942 - DNA, 22 bp, Homo sapiens
tcaaggtgactgaactataaac

SEQ ID NO: 8097943 - DNA, 22 bp, Homo sapiens
tcaagtatatctagtcattagg

SEQ ID NO: 8097944 - DNA, 22 bp, Homo sapiens
tcaagtatgacatcaagtttct

SEQ ID NO: 8097945 - DNA, 22 bp, Homo sapiens
tcaaggtctaggctcttctcca

SEQ ID NO: 8097946 - DNA, 22 bp, Homo sapiens
tcaaggtcctaattgtcctttt

SEQ ID NO: 8097947 - DNA, 22 bp, Homo sapiens
tcaaggtcaaagctcctgtcct

SEQ ID NO: 8097948 - DNA, 21 bp, Homo sapiens
tcaaggagtttctcttttcca

SEQ ID NO: 8097949 - DNA, 22 bp, Homo sapiens
tcaagtcttgatgagacaaacc

SEQ ID NO: 8097950 - DNA, 22 bp, Homo sapiens
tcaataaaattgttttcctatc

SEQ ID NO: 8097951 - DNA, 23 bp, Homo sapiens
tcaataactcgggttaaaataga

SEQ ID NO: 8097952 - DNA, 22 bp, Homo sapiens
tccagcaggtccgagacaagtt

SEQ ID NO: 8097953 - DNA, 22 bp, Homo sapiens
tccagcaggtgtttgccaactt

SEQ ID NO: 8097954 - DNA, 23 bp, Homo sapiens
tccagcagccaagaagggtagaa

SEQ ID NO: 8097955 - DNA, 22 bp, Homo sapiens
tccaggagggattgggctgtgg

SEQ ID NO: 8097956 - DNA, 20 bp, Homo sapiens
tccagctttgcctctaactg

SEQ ID NO: 8097957 - DNA, 22 bp, Homo sapiens
tccagctttggctctagctaca

SEQ ID NO: 8097958 - DNA, 22 bp, Homo sapiens
tccagcttataggtagatttaa

SEQ ID NO: 8097959 - DNA, 18 bp, Homo sapiens
tccagcttgcacttaaat

SEQ ID NO: 8097960 - DNA, 21 bp, Homo sapiens
tccagctcctgccactcctta

SEQ ID NO: 8097961 - DNA, 22 bp, Homo sapiens
tccaggccactgcagaggctct

SEQ ID NO: 8097962 - DNA, 22 bp, Homo sapiens
tccaggctcagcacttgctact

SEQ ID NO: 8097963 - DNA, 22 bp, Homo sapiens
tccaggccacatggatggcgat

SEQ ID NO: 8097964 - DNA, 22 bp, Homo sapiens
tccaggccaatgtagcaggccc

SEQ ID NO: 8097965 - DNA, 22 bp, Homo sapiens
tccaggctgccacagtgcaacg

SEQ ID NO: 8097966 - DNA, 22 bp, Homo sapiens
tccatctgggtggggagaagga

SEQ ID NO: 8097967 - DNA, 22 bp, Homo sapiens
tcccacagcatgagtaactctc

SEQ ID NO: 8097968 - DNA, 22 bp, Homo sapiens
tcccacaaacacccacttgagc

SEQ ID NO: 8097969 - DNA, 22 bp, Homo sapiens
tcccacaacctttctgtaaatc

SEQ ID NO: 8097970 - DNA, 20 bp, Homo sapiens
tcccaagggctgagaggatc

SEQ ID NO: 8097971 - DNA, 22 bp, Homo sapiens
tcccagtgagatgaaacaggta

SEQ ID NO: 8097972 - DNA, 22 bp, Homo sapiens
tcccagtgagcacaggtagtgc

SEQ ID NO: 8097973 - DNA, 22 bp, Homo sapiens
tcccagtgctacagacagggca

SEQ ID NO: 8097974 - DNA, 22 bp, Homo sapiens
tcccagtgaggtcctggctgtc

SEQ ID NO: 8097975 - DNA, 22 bp, Homo sapiens
tcccagtgctgctaaagaggta

SEQ ID NO: 8097976 - DNA, 19 bp, Homo sapiens
tcccagtggggagaggtgt

SEQ ID NO: 8097977 - DNA, 22 bp, Homo sapiens
tcccagtggcttcataaggcag

SEQ ID NO: 8097978 - DNA, 22 bp, Homo sapiens
tcccagtgggaagcagcacgct

SEQ ID NO: 8097979 - DNA, 22 bp, Homo sapiens
tcccagtggtgggtgcacattt

SEQ ID NO: 8097980 - DNA, 22 bp, Homo sapiens
tcccagtggtcttgaaacaggg

SEQ ID NO: 8097981 - DNA, 22 bp, Homo sapiens
tcccagtgtggcaggccatgga

SEQ ID NO: 8097982 - DNA, 22 bp, Homo sapiens
tcccagtggtcctggccctggg

SEQ ID NO: 8097983 - DNA, 22 bp, Homo sapiens
tcccagtgggtgactggaggct

SEQ ID NO: 8097984 - DNA, 22 bp, Homo sapiens
tcccatatatgtttatattgga

SEQ ID NO: 8097985 - DNA, 21 bp, Homo sapiens
tcccattgttcccctccagtg

SEQ ID NO: 8097986 - DNA, 23 bp, Homo sapiens
tcccattgccctatagtgcctca

SEQ ID NO: 8097987 - DNA, 22 bp, Homo sapiens
tcccattgtttgctctaggctg

SEQ ID NO: 8097988 - DNA, 22 bp, Homo sapiens
tcccatggtctatatagaggca

SEQ ID NO: 8097989 - DNA, 23 bp, Homo sapiens
tcccatgggctcactgccctgca

SEQ ID NO: 8097990 - DNA, 22 bp, Homo sapiens
tcccatggatagtgaccttgtt

SEQ ID NO: 8097991 - DNA, 23 bp, Homo sapiens
tcccatctattgtgatcaatgcc

SEQ ID NO: 8097992 - DNA, 22 bp, Homo sapiens
tcccatatatgcaaaaatgtaa

SEQ ID NO: 8097993 - DNA, 22 bp, Homo sapiens
tcccagggtgcgcctgccctcg

SEQ ID NO: 8097994 - DNA, 22 bp, Homo sapiens
tcccagggattaggacatggat

SEQ ID NO: 8097995 - DNA, 22 bp, Homo sapiens
tcccacagtctcacaatgcata

SEQ ID NO: 8097996 - DNA, 22 bp, Homo sapiens
taaattatgttccatgtccttt

SEQ ID NO: 8097997 - DNA, 22 bp, Homo sapiens
taaattatgttccatgtccttt

SEQ ID NO: 8097998 - DNA, 22 bp, Homo sapiens
taaattatgtcacatgactctg

SEQ ID NO: 8097999 - DNA, 22 bp, Homo sapiens
taaagtatattttttctcaata

SEQ ID NO: 8098000 - DNA, 22 bp, Homo sapiens
taaagtatccagttattcttct

SEQ ID NO: 8098001 - DNA, 22 bp, Homo sapiens
taaagtaatccttcataaggag

SEQ ID NO: 8098002 - DNA, 22 bp, Homo sapiens
taaatttacccaaggaacatgt

SEQ ID NO: 8098003 - DNA, 22 bp, Homo sapiens
taaatttttgttaacagcctct

SEQ ID NO: 8098004 - DNA, 22 bp, Homo sapiens
taacctcaatttaattatctgt

SEQ ID NO: 8098005 - DNA, 22 bp, Homo sapiens
taacctcagaaacataatcttt

SEQ ID NO: 8098006 - DNA, 18 bp, Homo sapiens
taaattgcttcacctgag

SEQ ID NO: 8098007 - DNA, 22 bp, Homo sapiens
taaatttacccaaggaacatgt

SEQ ID NO: 8098008 - DNA, 22 bp, Homo sapiens
taactcaaatacttatgttact

SEQ ID NO: 8098009 - DNA, 22 bp, Homo sapiens
taactcaactatctctgggtaa

SEQ ID NO: 8098010 - DNA, 22 bp, Homo sapiens
taactcaacttggagggttctt

SEQ ID NO: 8098011 - DNA, 22 bp, Homo sapiens
taactacaagggcggtctctgt

SEQ ID NO: 8098012 - DNA, 21 bp, Homo sapiens
gttttctttgatagagggaag

SEQ ID NO: 8098013 - DNA, 22 bp, Homo sapiens
gttttctttgaatgcttctaga

SEQ ID NO: 8098014 - DNA, 22 bp, Homo sapiens
gttttctttgaatgcttctaga

SEQ ID NO: 8098015 - DNA, 22 bp, Homo sapiens
gttttcttcctgcaattggcat

SEQ ID NO: 8098016 - DNA, 22 bp, Homo sapiens
gtttccaggaagggttgggagg

SEQ ID NO: 8098017 - DNA, 22 bp, Homo sapiens
gtttccagcctagagatggtga

SEQ ID NO: 8098018 - DNA, 22 bp, Homo sapiens
taaaatttgtccctgagtgttg

SEQ ID NO: 8098019 - DNA, 22 bp, Homo sapiens
taaagggtaggttttactgtaa

SEQ ID NO: 8098020 - DNA, 22 bp, Homo sapiens
taaacaagctgtctgatattct

SEQ ID NO: 8098021 - DNA, 22 bp, Homo sapiens
gttgtacaaaatatcagtgagg

SEQ ID NO: 8098022 - DNA, 22 bp, Homo sapiens
gtttcagaacaccccatttggg

SEQ ID NO: 8098023 - DNA, 22 bp, Homo sapiens
gtttcagactattctgtttctg

SEQ ID NO: 8098024 - DNA, 22 bp, Homo sapiens
gtttcagactattctgtttctg

SEQ ID NO: 8098025 - DNA, 22 bp, Homo sapiens
gtttcagaggtgttcattttca

SEQ ID NO: 8098026 - DNA, 22 bp, Homo sapiens
gtttcagaggtgttcattttca

SEQ ID NO: 8098027 - DNA, 22 bp, Homo sapiens
gtttcagagttagtgctggctg

SEQ ID NO: 8098028 - DNA, 22 bp, Homo sapiens
gtttcagagtagaacctcaagg

SEQ ID NO: 8098029 - DNA, 22 bp, Homo sapiens
gtttcagatttggtttcagaag

SEQ ID NO: 8098030 - DNA, 22 bp, Homo sapiens
gtttcagatatatttgtactta

SEQ ID NO: 8098031 - DNA, 22 bp, Homo sapiens
gtttcagatatatttgtactta

SEQ ID NO: 8098032 - DNA, 22 bp, Homo sapiens
gtttcattcggcagctcataag

SEQ ID NO: 8098033 - DNA, 22 bp, Homo sapiens
gtttcataattcaatcaaatga

SEQ ID NO: 8098034 - DNA, 22 bp, Homo sapiens
gtttcatatgcagttaacagca

SEQ ID NO: 8098035 - DNA, 22 bp, Homo sapiens
gtttcatataccaagcacttga

SEQ ID NO: 8098036 - DNA, 22 bp, Homo sapiens
gtttcatatatagtaactgaaa

SEQ ID NO: 8098037 - DNA, 22 bp, Homo sapiens
gttgggctgggagctgccctga

SEQ ID NO: 8098038 - DNA, 22 bp, Homo sapiens
gttgcagatgtggaactcgtgc

SEQ ID NO: 8098039 - DNA, 22 bp, Homo sapiens
gttgccagccctcagggactga

SEQ ID NO: 8098040 - DNA, 22 bp, Homo sapiens
gttgccagacttctgtggctcc

SEQ ID NO: 8098041 - DNA, 22 bp, Homo sapiens
gttgccaggacagcgcggcccg

SEQ ID NO: 8098042 - DNA, 22 bp, Homo sapiens
gttgccaggggctgctgtcacc

SEQ ID NO: 8098043 - DNA, 22 bp, Homo sapiens
gttcataatttgaaggaatagg

SEQ ID NO: 8098044 - DNA, 22 bp, Homo sapiens
gttcatttaggaaaggaagagt

SEQ ID NO: 8098045 - DNA, 22 bp, Homo sapiens
gttcattcatcaaatatttact

SEQ ID NO: 8098046 - DNA, 22 bp, Homo sapiens
gttcattcaatctatttgcttc

SEQ ID NO: 8098047 - DNA, 22 bp, Homo sapiens
gttcattcagctgggtaggagg

SEQ ID NO: 8098048 - DNA, 22 bp, Homo sapiens
gttcatgtgactactatgacct

SEQ ID NO: 8098049 - DNA, 22 bp, Homo sapiens
gttcatgctaccctttcctaat

SEQ ID NO: 8098050 - DNA, 22 bp, Homo sapiens
gttcatgtttgtgtattgctca

SEQ ID NO: 8098051 - DNA, 22 bp, Homo sapiens
gttcaatttagaaagcacagtt

SEQ ID NO: 8098052 - DNA, 22 bp, Homo sapiens
gttacaaaggactgggggccac

SEQ ID NO: 8098053 - DNA, 22 bp, Homo sapiens
gttcaagtttctgagctttaat

SEQ ID NO: 8098054 - DNA, 22 bp, Homo sapiens
gttcagatttgactggtttctc

SEQ ID NO: 8098055 - DNA, 22 bp, Homo sapiens
gttcagaaaacattggaataca

SEQ ID NO: 8098056 - DNA, 22 bp, Homo sapiens
gttcagaaattaggagaataaa

SEQ ID NO: 8098057 - DNA, 18 bp, Homo sapiens
gtgtgcagttgcaggggt

SEQ ID NO: 8098058 - DNA, 22 bp, Homo sapiens
gtgctcctggccacatgaagct

SEQ ID NO: 8098059 - DNA, 22 bp, Homo sapiens
gtgctcaggggcaatcctggga

SEQ ID NO: 8098060 - DNA, 22 bp, Homo sapiens
gtgctcagggcctggctgggga

SEQ ID NO: 8098061 - DNA, 22 bp, Homo sapiens
gttacaaactcaggtgccaaaa

SEQ ID NO: 8098062 - DNA, 22 bp, Homo sapiens
gttacaaagcacttcaagtgaa

SEQ ID NO: 8098063 - DNA, 22 bp, Homo sapiens
gttacaaaggaagcttcactgc

SEQ ID NO: 8098064 - DNA, 23 bp, Homo sapiens
gttaataatgaacactttctccc

SEQ ID NO: 8098065 - DNA, 22 bp, Homo sapiens
gttaataaaggtatagaatcag

SEQ ID NO: 8098066 - DNA, 22 bp, Homo sapiens
gttaatgtgtctgacacaatgg

SEQ ID NO: 8098067 - DNA, 22 bp, Homo sapiens
gttaatgttatctgaagacagt

SEQ ID NO: 8098068 - DNA, 22 bp, Homo sapiens
gtgtggctagaagtgtcttgtt

SEQ ID NO: 8098069 - DNA, 22 bp, Homo sapiens
gttaagaatcaagacttatctt

SEQ ID NO: 8098070 - DNA, 22 bp, Homo sapiens
tacatacattacctcatttagt

SEQ ID NO: 8098071 - DNA, 22 bp, Homo sapiens
tacatacatgtatgtgtgtatt

SEQ ID NO: 8098072 - DNA, 22 bp, Homo sapiens
tacatagagggtaatagcatca

SEQ ID NO: 8098073 - DNA, 22 bp, Homo sapiens
tacatagagaagttacagtgga

SEQ ID NO: 8098074 - DNA, 22 bp, Homo sapiens
tacaggcatgtagcatggtgat

SEQ ID NO: 8098075 - DNA, 22 bp, Homo sapiens
tacaggcatgaatgaaatctgt

SEQ ID NO: 8098076 - DNA, 21 bp, Homo sapiens
tacattgactacaaataaagc

SEQ ID NO: 8098077 - DNA, 22 bp, Homo sapiens
tacattctggaaaggcacagac

SEQ ID NO: 8098078 - DNA, 22 bp, Homo sapiens
tacattctggtggagaaagtaa

SEQ ID NO: 8098079 - DNA, 22 bp, Homo sapiens
tacatctttgtctatgaccagc

SEQ ID NO: 8098080 - DNA, 22 bp, Homo sapiens
tacatagtgttttgaagaatta

SEQ ID NO: 8098081 - DNA, 22 bp, Homo sapiens
tacatagtattcacattgtttt

SEQ ID NO: 8098082 - DNA, 22 bp, Homo sapiens
tacagaaggaagtttagctaaa

SEQ ID NO: 8098083 - DNA, 23 bp, Homo sapiens
tacagaaggagtagtcactaaga

SEQ ID NO: 8098084 - DNA, 22 bp, Homo sapiens
tacagatacagatctagataca

SEQ ID NO: 8098085 - DNA, 22 bp, Homo sapiens
tacagattgaggtttttaatat

SEQ ID NO: 8098086 - DNA, 22 bp, Homo sapiens
tacagatattgtacagttatag

SEQ ID NO: 8098087 - DNA, 22 bp, Homo sapiens
tacagatatgtatgcacttttt

SEQ ID NO: 8098088 - DNA, 22 bp, Homo sapiens
tacactattttactgatacaaa

SEQ ID NO: 8098089 - DNA, 22 bp, Homo sapiens
tacagaaacagcgtggttagaa

SEQ ID NO: 8098090 - DNA, 20 bp, Homo sapiens
tacagaaacaggacttttgg

SEQ ID NO: 8098091 - DNA, 22 bp, Homo sapiens
tacaacaggaatttcaactttg

SEQ ID NO: 8098092 - DNA, 22 bp, Homo sapiens
tacaaagtcagaataacaggtg

SEQ ID NO: 8098093 - DNA, 22 bp, Homo sapiens
tacaaagtcagaataacaggtg

SEQ ID NO: 8098094 - DNA, 22 bp, Homo sapiens
tacaaagtcttgggttctaggc

SEQ ID NO: 8098095 - DNA, 22 bp, Homo sapiens
tacaaagtcccattgccatgga

SEQ ID NO: 8098096 - DNA, 22 bp, Homo sapiens
tacaaagtcccattgccatgga

SEQ ID NO: 8098097 - DNA, 22 bp, Homo sapiens
tacaaagtgagcaacctctttt

SEQ ID NO: 8098098 - DNA, 22 bp, Homo sapiens
tacaaagtgattttggaattga

SEQ ID NO: 8098099 - DNA, 22 bp, Homo sapiens
tacaaagtgacaagctctgctg

SEQ ID NO: 8098100 - DNA, 22 bp, Homo sapiens
tacaaagtgaaataattctgag

SEQ ID NO: 8098101 - DNA, 22 bp, Homo sapiens
tacaaagtgtgcccatgctgag

SEQ ID NO: 8098102 - DNA, 22 bp, Homo sapiens
tacaaagtgctttagaaatgaa

SEQ ID NO: 8098103 - DNA, 22 bp, Homo sapiens
tacaaagtgggaaacgaaggtt

SEQ ID NO: 8098104 - DNA, 22 bp, Homo sapiens
tacaaagtgctttagaaatgaa

SEQ ID NO: 8098105 - DNA, 22 bp, Homo sapiens
tacaaagtttgagaatgctttc

SEQ ID NO: 8098106 - DNA, 22 bp, Homo sapiens
tacaaagtttgagaatgctttc

SEQ ID NO: 8098107 - DNA, 22 bp, Homo sapiens
tacaaagttttcttggattgag

SEQ ID NO: 8098108 - DNA, 22 bp, Homo sapiens
tacaaagtttggggtcctcaaa

SEQ ID NO: 8098109 - DNA, 22 bp, Homo sapiens
tacaaagtaatgtataatatcg

SEQ ID NO: 8098110 - DNA, 22 bp, Homo sapiens
tacaaagtaatgtataatatcg

SEQ ID NO: 8098111 - DNA, 22 bp, Homo sapiens
tacaaagtagaaattcagtaaa

SEQ ID NO: 8098112 - DNA, 22 bp, Homo sapiens
tacaaagtatatttctagctgt

SEQ ID NO: 8098113 - DNA, 22 bp, Homo sapiens
tacaaagtagaaattcagtaaa

SEQ ID NO: 8098114 - DNA, 22 bp, Homo sapiens
tacaaagtcacattgaaatgaa

SEQ ID NO: 8098115 - DNA, 22 bp, Homo sapiens
tacaaagtcacattgaaatgaa

SEQ ID NO: 8098116 - DNA, 22 bp, Homo sapiens
tacaaagtcaccagcttcttgc

SEQ ID NO: 8098117 - DNA, 22 bp, Homo sapiens
tacaaaggaaacttcttttccc

SEQ ID NO: 8098118 - DNA, 22 bp, Homo sapiens
tacaaagcctggtagatatctg

SEQ ID NO: 8098119 - DNA, 22 bp, Homo sapiens
tacaaagatagtgttagagtaa

SEQ ID NO: 8098120 - DNA, 22 bp, Homo sapiens
tacaaagatagtgttagagtaa

SEQ ID NO: 8098121 - DNA, 22 bp, Homo sapiens
tacaaactgttattattattgt

SEQ ID NO: 8098122 - DNA, 22 bp, Homo sapiens
tacaaactctttatatttcata

SEQ ID NO: 8098123 - DNA, 18 bp, Homo sapiens
tacaaactccttgaaggc

SEQ ID NO: 8098124 - DNA, 22 bp, Homo sapiens
tacaaaaaattgatactgacga

SEQ ID NO: 8098125 - DNA, 22 bp, Homo sapiens
tacaaaaaattgatactgacga

SEQ ID NO: 8098126 - DNA, 22 bp, Homo sapiens
tacaaagaggcagctccatttt

SEQ ID NO: 8098127 - DNA, 22 bp, Homo sapiens
tacaaacttgttttaagtaagt

SEQ ID NO: 8098128 - DNA, 22 bp, Homo sapiens
tacaaagaggtaattgcatata

SEQ ID NO: 8098129 - DNA, 22 bp, Homo sapiens
tacaaagaggtaattgcatata

SEQ ID NO: 8098130 - DNA, 22 bp, Homo sapiens
taatgtttccagtctatgatgg

SEQ ID NO: 8098131 - DNA, 22 bp, Homo sapiens
taataggagccaggtcacatag

SEQ ID NO: 8098132 - DNA, 22 bp, Homo sapiens
taatagaatagtggaaacattg

SEQ ID NO: 8098133 - DNA, 22 bp, Homo sapiens
taatagcattatcatcaaaact

SEQ ID NO: 8098134 - DNA, 22 bp, Homo sapiens
taatacttgctttggatgtatg

SEQ ID NO: 8098135 - DNA, 22 bp, Homo sapiens
taatagaaaggtattttttgca

SEQ ID NO: 8098136 - DNA, 22 bp, Homo sapiens
taatacttttgccttgtattca

SEQ ID NO: 8098137 - DNA, 22 bp, Homo sapiens
taatagaatagtggaaacattg

SEQ ID NO: 8098138 - DNA, 22 bp, Homo sapiens
taattactggaaatttcaaata

SEQ ID NO: 8098139 - DNA, 22 bp, Homo sapiens
taatacagggcactttgagtga

SEQ ID NO: 8098140 - DNA, 22 bp, Homo sapiens
taagtaaatttataatgtgatt

SEQ ID NO: 8098141 - DNA, 21 bp, Homo sapiens
taagtgcaaagagacagatac

SEQ ID NO: 8098142 - DNA, 22 bp, Homo sapiens
taactgctcagtgagtattttt

SEQ ID NO: 8098143 - DNA, 22 bp, Homo sapiens
taaggcaagtttttagtggaca

SEQ ID NO: 8098144 - DNA, 22 bp, Homo sapiens
taaggcagtgagaagaaacagg

SEQ ID NO: 8098145 - DNA, 22 bp, Homo sapiens
taaggctcatgtaattagagat

SEQ ID NO: 8098146 - DNA, 22 bp, Homo sapiens
taaggcttggacttctccaacc

SEQ ID NO: 8098147 - DNA, 22 bp, Homo sapiens
tattattgactattcagaatgt

SEQ ID NO: 8098148 - DNA, 22 bp, Homo sapiens
tattattgcaagtatataaagt

SEQ ID NO: 8098149 - DNA, 22 bp, Homo sapiens
tattattatgcatagcatgaaa

SEQ ID NO: 8098150 - DNA, 22 bp, Homo sapiens
tattcaaagtaccttcattgcc

SEQ ID NO: 8098151 - DNA, 22 bp, Homo sapiens
tattcatgagataggcagtttt

SEQ ID NO: 8098152 - DNA, 22 bp, Homo sapiens
tattccttggcaaaaaatatat

SEQ ID NO: 8098153 - DNA, 22 bp, Homo sapiens
tattcatgtcggctgaaaaagc

SEQ ID NO: 8098154 - DNA, 22 bp, Homo sapiens
tattgacaataggcaactgagg

SEQ ID NO: 8098155 - DNA, 22 bp, Homo sapiens
tattcttgtcttttccagaaat

SEQ ID NO: 8098156 - DNA, 22 bp, Homo sapiens
tattctcatcatcactggagct

SEQ ID NO: 8098157 - DNA, 22 bp, Homo sapiens
tattctcattagtctgtattcc

SEQ ID NO: 8098158 - DNA, 22 bp, Homo sapiens
tattctctccccaatcttgctt

SEQ ID NO: 8098159 - DNA, 22 bp, Homo sapiens
tattctcagtgctataagtaga

SEQ ID NO: 8098160 - DNA, 22 bp, Homo sapiens
tattctcagtgctataagtaga

SEQ ID NO: 8098161 - DNA, 22 bp, Homo sapiens
tattctcagcaacacacatgga

SEQ ID NO: 8098162 - DNA, 22 bp, Homo sapiens
tattctcagcaacacacatgga

SEQ ID NO: 8098163 - DNA, 22 bp, Homo sapiens
tattgacagatgcattatgttg

SEQ ID NO: 8098164 - DNA, 22 bp, Homo sapiens
tattgacactttttgtgtagcc

SEQ ID NO: 8098165 - DNA, 22 bp, Homo sapiens
tatttattggacagtgttgctg

SEQ ID NO: 8098166 - DNA, 22 bp, Homo sapiens
tatttattcattcagcaagcat

SEQ ID NO: 8098167 - DNA, 22 bp, Homo sapiens
tatttctaagctgtaagtctga

SEQ ID NO: 8098168 - DNA, 22 bp, Homo sapiens
tatttctcagcattttacatcc

SEQ ID NO: 8098169 - DNA, 22 bp, Homo sapiens
tatttctcttcaaaattgatgt

SEQ ID NO: 8098170 - DNA, 22 bp, Homo sapiens
tattacagttcgagtttctagg

SEQ ID NO: 8098171 - DNA, 22 bp, Homo sapiens
tattacatccacttttattgca

SEQ ID NO: 8098172 - DNA, 22 bp, Homo sapiens
tattacagaatcaggcataact

SEQ ID NO: 8098173 - DNA, 22 bp, Homo sapiens
tatgtgtgctttttccatgcat

SEQ ID NO: 8098174 - DNA, 22 bp, Homo sapiens
tatgtgatcaaaaaagtttgga

SEQ ID NO: 8098175 - DNA, 22 bp, Homo sapiens
tatgtacataacatgaaatgca

SEQ ID NO: 8098176 - DNA, 22 bp, Homo sapiens
tatgtacatacatgtgcatacg

SEQ ID NO: 8098177 - DNA, 22 bp, Homo sapiens
tatgtacacatacacttgtaat

SEQ ID NO: 8098178 - DNA, 22 bp, Homo sapiens
tatgtacaccggggaaggtggg

SEQ ID NO: 8098179 - DNA, 19 bp, Homo sapiens
tatgagctgacaaaggcct

SEQ ID NO: 8098180 - DNA, 22 bp, Homo sapiens
tatgagaatctgcagtatgctt

SEQ ID NO: 8098181 - DNA, 22 bp, Homo sapiens
tatgtacaagcacacatgtgac

SEQ ID NO: 8098182 - DNA, 22 bp, Homo sapiens
tatgtacacacacatgcatgta

SEQ ID NO: 8098183 - DNA, 23 bp, Homo sapiens
tatccagtagggcccagagctga

SEQ ID NO: 8098184 - DNA, 22 bp, Homo sapiens
tatccaaagtggcatattatag

SEQ ID NO: 8098185 - DNA, 22 bp, Homo sapiens
tatagcaattcagaatacatgt

SEQ ID NO: 8098186 - DNA, 22 bp, Homo sapiens
tatagcaattcagaatacatgt

SEQ ID NO: 8098187 - DNA, 19 bp, Homo sapiens
tatgacaagtactagttct

SEQ ID NO: 8098188 - DNA, 22 bp, Homo sapiens
tatgagaagaacaggtgacttt

SEQ ID NO: 8098189 - DNA, 22 bp, Homo sapiens
tatgagaactgacagagtgcca

SEQ ID NO: 8098190 - DNA, 22 bp, Homo sapiens
tatgagaaggtatggtgacttg

SEQ ID NO: 8098191 - DNA, 18 bp, Homo sapiens
tatgagaagattagcaat

SEQ ID NO: 8098192 - DNA, 22 bp, Homo sapiens
tatgagaacaagaacaatctcc

SEQ ID NO: 8098193 - DNA, 22 bp, Homo sapiens
tatgagaaattgctgatatttg

SEQ ID NO: 8098194 - DNA, 22 bp, Homo sapiens
tatgagaaaggagaatgacttt

SEQ ID NO: 8098195 - DNA, 22 bp, Homo sapiens
tataaattattaggctgctaaa

SEQ ID NO: 8098196 - DNA, 22 bp, Homo sapiens
tataaattaatgtgcccatgag

SEQ ID NO: 8098197 - DNA, 22 bp, Homo sapiens
tataaagtttcgaaagatgtat

SEQ ID NO: 8098198 - DNA, 22 bp, Homo sapiens
tataaagtttcgaaagatgtat

SEQ ID NO: 8098199 - DNA, 22 bp, Homo sapiens
tataaatgcacttttgaaatat

SEQ ID NO: 8098200 - DNA, 20 bp, Homo sapiens
tataaattcagagctttggt

SEQ ID NO: 8098201 - DNA, 22 bp, Homo sapiens
tataactaatactggccatgag

SEQ ID NO: 8098202 - DNA, 18 bp, Homo sapiens
tataacctgttttgatgg

SEQ ID NO: 8098203 - DNA, 22 bp, Homo sapiens
tataacactcagaaagaatcat

SEQ ID NO: 8098204 - DNA, 22 bp, Homo sapiens
tataacaccatgttctacagat

SEQ ID NO: 8098205 - DNA, 22 bp, Homo sapiens
tatacacacctccaaagcagga

SEQ ID NO: 8098206 - DNA, 22 bp, Homo sapiens
tatacacaaggtgtgcatttgt

SEQ ID NO: 8098207 - DNA, 22 bp, Homo sapiens
tatacacaaggtgtgcatttgt

SEQ ID NO: 8098208 - DNA, 22 bp, Homo sapiens
tatacaatggctgaatcatcca

SEQ ID NO: 8098209 - DNA, 22 bp, Homo sapiens
tatacaatgagtacattctggg

SEQ ID NO: 8098210 - DNA, 22 bp, Homo sapiens
tatacaagtgagaagaagagtt

SEQ ID NO: 8098211 - DNA, 22 bp, Homo sapiens
tatacaagtaatgctgaatgat

SEQ ID NO: 8098212 - DNA, 22 bp, Homo sapiens
tatacaagaggtgagatgagca

SEQ ID NO: 8098213 - DNA, 23 bp, Homo sapiens
tatacacatgtggcagtatagtg

SEQ ID NO: 8098214 - DNA, 22 bp, Homo sapiens
tatacacatttttacctatagt

SEQ ID NO: 8098215 - DNA, 22 bp, Homo sapiens
tatacagaaagaattcaagtct

SEQ ID NO: 8098216 - DNA, 22 bp, Homo sapiens
tatacagaacattaagaactgt

SEQ ID NO: 8098217 - DNA, 17 bp, Homo sapiens
tatacacagacagactg

SEQ ID NO: 8098218 - DNA, 22 bp, Homo sapiens
tatacacaggaatctgtgaaaa

SEQ ID NO: 8098219 - DNA, 22 bp, Homo sapiens
tatacacatcctccaaagatag

SEQ ID NO: 8098220 - DNA, 22 bp, Homo sapiens
tatacacatatcttctaggcct

SEQ ID NO: 8098221 - DNA, 22 bp, Homo sapiens
tagaatgacctcctcttagctt

SEQ ID NO: 8098222 - DNA, 22 bp, Homo sapiens
tagaatgagaaagtgtagcagg

SEQ ID NO: 8098223 - DNA, 22 bp, Homo sapiens
tagaaaggctgctgccaaccca

SEQ ID NO: 8098224 - DNA, 22 bp, Homo sapiens
tagaaaggcaagcgtgaaatat

SEQ ID NO: 8098225 - DNA, 22 bp, Homo sapiens
tagaaaggatattgagatgaat

SEQ ID NO: 8098226 - DNA, 22 bp, Homo sapiens
tagaaaggaagctacttagggg

SEQ ID NO: 8098227 - DNA, 22 bp, Homo sapiens
tagaaagcttggggtgtttaaa

SEQ ID NO: 8098228 - DNA, 22 bp, Homo sapiens
tacattttctaggggaccaaga

SEQ ID NO: 8098229 - DNA, 22 bp, Homo sapiens
taccaaaaccaagccattatct

SEQ ID NO: 8098230 - DNA, 22 bp, Homo sapiens
tactttgaattaaatatttcag

SEQ ID NO: 8098231 - DNA, 22 bp, Homo sapiens
tactttgataaggttcttctat

SEQ ID NO: 8098232 - DNA, 22 bp, Homo sapiens
tactttgagatgatgctgatcg

SEQ ID NO: 8098233 - DNA, 22 bp, Homo sapiens
taccaaaagcttgtttcataca

SEQ ID NO: 8098234 - DNA, 22 bp, Homo sapiens
taccaaaaagtgagccccagag

SEQ ID NO: 8098235 - DNA, 22 bp, Homo sapiens
taccaaaagcttgtttcataca

SEQ ID NO: 8098236 - DNA, 22 bp, Homo sapiens
taccaaaagcttgtttcataca

SEQ ID NO: 8098237 - DNA, 22 bp, Homo sapiens
tactttgtggagattaaaaata

SEQ ID NO: 8098238 - DNA, 22 bp, Homo sapiens
tactttgtcatgctaagagtga

SEQ ID NO: 8098239 - DNA, 22 bp, Homo sapiens
tactttgtcattctaaccttcc

SEQ ID NO: 8098240 - DNA, 22 bp, Homo sapiens
tactttgtgccaggcactgggt

SEQ ID NO: 8098241 - DNA, 22 bp, Homo sapiens
tactttgtccatttgcaggcag

SEQ ID NO: 8098242 - DNA, 22 bp, Homo sapiens
tacttttcataatgaagcagca

SEQ ID NO: 8098243 - DNA, 22 bp, Homo sapiens
tacttttctttgtcatgcatct

SEQ ID NO: 8098244 - DNA, 22 bp, Homo sapiens
tactttttgtctctttgaatgt

SEQ ID NO: 8098245 - DNA, 22 bp, Homo sapiens
tagaaaactaatacatgcttga

SEQ ID NO: 8098246 - DNA, 22 bp, Homo sapiens
tagaaaagataacattctgtgc

SEQ ID NO: 8098247 - DNA, 22 bp, Homo sapiens
tagaaaagaattttatttgata

SEQ ID NO: 8098248 - DNA, 22 bp, Homo sapiens
tagaaacaatgacatgcttgta

SEQ ID NO: 8098249 - DNA, 22 bp, Homo sapiens
tagaaacatgttctgttctgtt

SEQ ID NO: 8098250 - DNA, 22 bp, Homo sapiens
tagaaacattcagttgcagtcc

SEQ ID NO: 8098251 - DNA, 22 bp, Homo sapiens
tagaaactcacgttatcattgc

SEQ ID NO: 8098252 - DNA, 22 bp, Homo sapiens
tagcagagtatcttgcaaatta

SEQ ID NO: 8098253 - DNA, 22 bp, Homo sapiens
tagcagaggtaagtgtggcaat

SEQ ID NO: 8098254 - DNA, 22 bp, Homo sapiens
tagcagagcgggtgcgaggcgg

SEQ ID NO: 8098255 - DNA, 22 bp, Homo sapiens
tagcagaggctactgctccttg

SEQ ID NO: 8098256 - DNA, 22 bp, Homo sapiens
tagaggtgagattgtggtgctg

SEQ ID NO: 8098257 - DNA, 22 bp, Homo sapiens
tagcagagaggggacagtggca

SEQ ID NO: 8098258 - DNA, 22 bp, Homo sapiens
tagcagagatatgggcatagat

SEQ ID NO: 8098259 - DNA, 22 bp, Homo sapiens
tagaggtgagacttcagtgaca

SEQ ID NO: 8098260 - DNA, 22 bp, Homo sapiens
tagctgttttttgtgaggaaat

SEQ ID NO: 8098261 - DNA, 22 bp, Homo sapiens
tagctgttctctgtaaattgga

SEQ ID NO: 8098262 - DNA, 22 bp, Homo sapiens
tagctcttcatttcatctgatt

SEQ ID NO: 8098263 - DNA, 22 bp, Homo sapiens
tagctctagcactggataatcc

SEQ ID NO: 8098264 - DNA, 22 bp, Homo sapiens
taggctgggcattctggccagg

SEQ ID NO: 8098265 - DNA, 22 bp, Homo sapiens
taggagggttagagggaaatat

SEQ ID NO: 8098266 - DNA, 22 bp, Homo sapiens
taggagggggaacaaggcatac

SEQ ID NO: 8098267 - DNA, 22 bp, Homo sapiens
tagctttagaaatattctcaga

SEQ ID NO: 8098268 - DNA, 22 bp, Homo sapiens
tagctttaccatagaagagtat

SEQ ID NO: 8098269 - DNA, 22 bp, Homo sapiens
tagctttagtgaaaaatatcag

SEQ ID NO: 8098270 - DNA, 22 bp, Homo sapiens
taggaaaaagaggctggcaagg

SEQ ID NO: 8098271 - DNA, 21 bp, Homo sapiens
gcctgagcatgtcttcaggtc

SEQ ID NO: 8098272 - DNA, 22 bp, Homo sapiens
gcctgagcccaggtgtgcagag

SEQ ID NO: 8098273 - DNA, 22 bp, Homo sapiens
gccttgggcacaggcagggccc

SEQ ID NO: 8098274 - DNA, 22 bp, Homo sapiens
gccttgggaaagtgggaggaga

SEQ ID NO: 8098275 - DNA, 22 bp, Homo sapiens
gccttggccaacaccttgcaaa

SEQ ID NO: 8098276 - DNA, 20 bp, Homo sapiens
gcctgagctattgccaggat

SEQ ID NO: 8098277 - DNA, 20 bp, Homo sapiens
gcctgagctccgcctcctgt

SEQ ID NO: 8098278 - DNA, 22 bp, Homo sapiens
gccttgctgattaccttccttt

SEQ ID NO: 8098279 - DNA, 22 bp, Homo sapiens
gcggggttccgtgccccagagt

SEQ ID NO: 8098280 - DNA, 22 bp, Homo sapiens
gcgtctcaaggcccccaggcca

SEQ ID NO: 8098281 - DNA, 18 bp, Homo sapiens
gctccctggatgttactc

SEQ ID NO: 8098282 - DNA, 22 bp, Homo sapiens
gctcccagaaccaaggctgggg

SEQ ID NO: 8098283 - DNA, 21 bp, Homo sapiens
gctcagcaaaggtgaggtgca

SEQ ID NO: 8098284 - DNA, 22 bp, Homo sapiens
gctactgattgaccttggagag

SEQ ID NO: 8098285 - DNA, 22 bp, Homo sapiens
gctgagggcatgtgtggcgact

SEQ ID NO: 8098286 - DNA, 22 bp, Homo sapiens
gctgagggcagcctcctaggtc

SEQ ID NO: 8098287 - DNA, 22 bp, Homo sapiens
gctgagggcatgtgtggcgact

SEQ ID NO: 8098288 - DNA, 22 bp, Homo sapiens
gctgcctgttgaagggtctgtg

SEQ ID NO: 8098289 - DNA, 22 bp, Homo sapiens
gctgcctgtgcactttctcgta

SEQ ID NO: 8098290 - DNA, 19 bp, Homo sapiens
gctgcctgtcttagccagt

SEQ ID NO: 8098291 - DNA, 22 bp, Homo sapiens
gctgcctgtctgtttcttttat

SEQ ID NO: 8098292 - DNA, 22 bp, Homo sapiens
gctgcctgtctgctgacccagg

SEQ ID NO: 8098293 - DNA, 19 bp, Homo sapiens
gctgctcctggctgaccac

SEQ ID NO: 8098294 - DNA, 22 bp, Homo sapiens
gctgctccagctgtgctgcaga

SEQ ID NO: 8098295 - DNA, 22 bp, Homo sapiens
gctccctgttctcagccatgat

SEQ ID NO: 8098296 - DNA, 22 bp, Homo sapiens
gctctgggaattcagaaagcct

SEQ ID NO: 8098297 - DNA, 22 bp, Homo sapiens
gctctggggttggaaagtgatc

SEQ ID NO: 8098298 - DNA, 20 bp, Homo sapiens
gctctgggagggatgtgatg

SEQ ID NO: 8098299 - DNA, 22 bp, Homo sapiens
gctgagagatcaaggcaggatt

SEQ ID NO: 8098300 - DNA, 22 bp, Homo sapiens
gctgagagaaaagtgaggttct

SEQ ID NO: 8098301 - DNA, 22 bp, Homo sapiens
gctgagagcacatagaaggggc

SEQ ID NO: 8098302 - DNA, 22 bp, Homo sapiens
gctgagagcaaagcatgtctag

SEQ ID NO: 8098303 - DNA, 22 bp, Homo sapiens
gctgagagcagtgtggccttaa

SEQ ID NO: 8098304 - DNA, 22 bp, Homo sapiens
gctgagagcggccagctgggaa

SEQ ID NO: 8098305 - DNA, 17 bp, Homo sapiens
gctgagaggcagcacag

SEQ ID NO: 8098306 - DNA, 22 bp, Homo sapiens
gctgagaggcagccagaccctc

SEQ ID NO: 8098307 - DNA, 22 bp, Homo sapiens
gctgagagtgagcactggatat

SEQ ID NO: 8098308 - DNA, 22 bp, Homo sapiens
gctgagagtccaggaaaacatc

SEQ ID NO: 8098309 - DNA, 21 bp, Homo sapiens
gctgagaggttgggaagttca

SEQ ID NO: 8098310 - DNA, 22 bp, Homo sapiens
gctggcttccttctgcagctag

SEQ ID NO: 8098311 - DNA, 22 bp, Homo sapiens
gctgggctggccgccgagatcg

SEQ ID NO: 8098312 - DNA, 22 bp, Homo sapiens
gctgggcttcacctccagagtt

SEQ ID NO: 8098313 - DNA, 22 bp, Homo sapiens
gctgggcttctcaatgctgcct

SEQ ID NO: 8098314 - DNA, 22 bp, Homo sapiens
gctgggctgtagtttgctgacc

SEQ ID NO: 8098315 - DNA, 22 bp, Homo sapiens
gctggctgcgtcatcacagggc

SEQ ID NO: 8098316 - DNA, 22 bp, Homo sapiens
gctggctggaggtgaggaagaa

SEQ ID NO: 8098317 - DNA, 22 bp, Homo sapiens
gctggctggaggtgaggaagaa

SEQ ID NO: 8098318 - DNA, 22 bp, Homo sapiens
gctggctggaggagggaggttg

SEQ ID NO: 8098319 - DNA, 19 bp, Homo sapiens
gctggctggaggagggaca

SEQ ID NO: 8098320 - DNA, 22 bp, Homo sapiens
gcttggaagtaggattgggaga

SEQ ID NO: 8098321 - DNA, 22 bp, Homo sapiens
gctgtggtctgtgagctccaaa

SEQ ID NO: 8098322 - DNA, 22 bp, Homo sapiens
gctgtgggacaggtccagccag

SEQ ID NO: 8098323 - DNA, 19 bp, Homo sapiens
gctgtgcctctctcctgct

SEQ ID NO: 8098324 - DNA, 19 bp, Homo sapiens
gctgtgcccctgccgcttg

SEQ ID NO: 8098325 - DNA, 22 bp, Homo sapiens
gctgggcttggtttccctgctt

SEQ ID NO: 8098326 - DNA, 19 bp, Homo sapiens
gctgggcttgggtttgtag

SEQ ID NO: 8098327 - DNA, 22 bp, Homo sapiens
ggagcagggaattacagcgcag

SEQ ID NO: 8098328 - DNA, 22 bp, Homo sapiens
ggagcatgtggggtgagcaggg

SEQ ID NO: 8098329 - DNA, 22 bp, Homo sapiens
ggagccagaaatgctgtggttg

SEQ ID NO: 8098330 - DNA, 22 bp, Homo sapiens
ggagcagttgttgagcaagcca

SEQ ID NO: 8098331 - DNA, 22 bp, Homo sapiens
ggagcagtggtcattcagctgg

SEQ ID NO: 8098332 - DNA, 22 bp, Homo sapiens
ggagcagtctggtgatactcag

SEQ ID NO: 8098333 - DNA, 22 bp, Homo sapiens
ggagagaatctgaacctgctcc

SEQ ID NO: 8098334 - DNA, 22 bp, Homo sapiens
ggagagaaattgaggtagcaag

SEQ ID NO: 8098335 - DNA, 22 bp, Homo sapiens
ggagactcgggttctagccttg

SEQ ID NO: 8098336 - DNA, 22 bp, Homo sapiens
ggacagtgtgggccatctcact

SEQ ID NO: 8098337 - DNA, 22 bp, Homo sapiens
ggaagaggctgagccaggtccc

SEQ ID NO: 8098338 - DNA, 22 bp, Homo sapiens
ggaagaggctctcattgagggc

SEQ ID NO: 8098339 - DNA, 22 bp, Homo sapiens
ggaagaagggtcattggcagcc

SEQ ID NO: 8098340 - DNA, 22 bp, Homo sapiens
gctttctcttcactgatgttca

SEQ ID NO: 8098341 - DNA, 22 bp, Homo sapiens
gctttctgattgcgaaaacaaa

SEQ ID NO: 8098342 - DNA, 22 bp, Homo sapiens
gctttcaaatcctaattccaac

SEQ ID NO: 8098343 - DNA, 22 bp, Homo sapiens
ggaagagggaaccacgactgta

SEQ ID NO: 8098344 - DNA, 22 bp, Homo sapiens
ggaagcagcctgaagccaaggg

SEQ ID NO: 8098345 - DNA, 22 bp, Homo sapiens
ggaatcagatgaggggcagagc

SEQ ID NO: 8098346 - DNA, 22 bp, Homo sapiens
ggaattcagtggccagacatga

SEQ ID NO: 8098347 - DNA, 22 bp, Homo sapiens
ggacaaaatccaaacttcttag

SEQ ID NO: 8098348 - DNA, 22 bp, Homo sapiens
ggaatgcagtaagtgatttgaa

SEQ ID NO: 8098349 - DNA, 22 bp, Homo sapiens
ggaatgcactagactgtgaaac

SEQ ID NO: 8098350 - DNA, 22 bp, Homo sapiens
gccagctgaatttccaactgtt

SEQ ID NO: 8098351 - DNA, 22 bp, Homo sapiens
gccaggcagagccccgtgcagc

SEQ ID NO: 8098352 - DNA, 18 bp, Homo sapiens
gccagccctccaacctcc

SEQ ID NO: 8098353 - DNA, 20 bp, Homo sapiens
gccagccctgacacaggagc

SEQ ID NO: 8098354 - DNA, 22 bp, Homo sapiens
gccagccctgggagacttatgg

SEQ ID NO: 8098355 - DNA, 22 bp, Homo sapiens
gccaggcagccaccctctgcga

SEQ ID NO: 8098356 - DNA, 22 bp, Homo sapiens
gccagggctcgcggtccctcgt

SEQ ID NO: 8098357 - DNA, 17 bp, Homo sapiens
gccagggagaggaagcc

SEQ ID NO: 8098358 - DNA, 22 bp, Homo sapiens
gccaggcatgtcctctgcagaa

SEQ ID NO: 8098359 - DNA, 22 bp, Homo sapiens
gccagggaacccaagggcctca

SEQ ID NO: 8098360 - DNA, 20 bp, Homo sapiens
gcagtgatctcatcggtctg

SEQ ID NO: 8098361 - DNA, 22 bp, Homo sapiens
gcagtgatggggatctcactgg

SEQ ID NO: 8098362 - DNA, 22 bp, Homo sapiens
gcagtgagttatgatcatgcca

SEQ ID NO: 8098363 - DNA, 22 bp, Homo sapiens
gcagtgataactttactctttt

SEQ ID NO: 8098364 - DNA, 22 bp, Homo sapiens
gcaggggagtggcaggcccgga

SEQ ID NO: 8098365 - DNA, 22 bp, Homo sapiens
gcaggggagtggatgatggatt

SEQ ID NO: 8098366 - DNA, 22 bp, Homo sapiens
gcagtgggagcttaggcagtgc

SEQ ID NO: 8098367 - DNA, 22 bp, Homo sapiens
gcagtgggaaggttggcacatg

SEQ ID NO: 8098368 - DNA, 22 bp, Homo sapiens
gcatgctgctgaggctggaata

SEQ ID NO: 8098369 - DNA, 22 bp, Homo sapiens
gccctgggattgggtggaggct

SEQ ID NO: 8098370 - DNA, 22 bp, Homo sapiens
gccctggcctcctggaacaggc

SEQ ID NO: 8098371 - DNA, 22 bp, Homo sapiens
gccctgggcaaggttctggcca

SEQ ID NO: 8098372 - DNA, 17 bp, Homo sapiens
gccctggagccaggcta

SEQ ID NO: 8098373 - DNA, 22 bp, Homo sapiens
gcctcctgaagtgctgggatta

SEQ ID NO: 8098374 - DNA, 22 bp, Homo sapiens
gccctgtgtgatcacatgaaca

SEQ ID NO: 8098375 - DNA, 22 bp, Homo sapiens
gcctcctgcccagatgagtgat

SEQ ID NO: 8098376 - DNA, 22 bp, Homo sapiens
gcctcctggaagtcacatgttt

SEQ ID NO: 8098377 - DNA, 22 bp, Homo sapiens
gcctcctggaagtcacatgttt

SEQ ID NO: 8098378 - DNA, 22 bp, Homo sapiens
gcctcctggattttagtgccat

SEQ ID NO: 8098379 - DNA, 22 bp, Homo sapiens
gcctcctgagtagctgggattg

SEQ ID NO: 8098380 - DNA, 22 bp, Homo sapiens
gcctcctggggtgccatcatct

SEQ ID NO: 8098381 - DNA, 22 bp, Homo sapiens
gcctcctggggtgccatcatct

SEQ ID NO: 8098382 - DNA, 22 bp, Homo sapiens
gcctcctgggttcatgccattc

SEQ ID NO: 8098383 - DNA, 22 bp, Homo sapiens
gcccagcctccaagctccaagg

SEQ ID NO: 8098384 - DNA, 22 bp, Homo sapiens
gcccagcagctccacttggctt

SEQ ID NO: 8098385 - DNA, 22 bp, Homo sapiens
gcccagcactcctctctgacat

SEQ ID NO: 8098386 - DNA, 22 bp, Homo sapiens
gcccagcacctctctcagggtt

SEQ ID NO: 8098387 - DNA, 22 bp, Homo sapiens
gcccagcactcctctctgacat

SEQ ID NO: 8098388 - DNA, 22 bp, Homo sapiens
gccaggggtgcccacccaagga

SEQ ID NO: 8098389 - DNA, 21 bp, Homo sapiens
gcccagcaaggtgagaaggcc

SEQ ID NO: 8098390 - DNA, 22 bp, Homo sapiens
gcccagcacattgctgaggacc

SEQ ID NO: 8098391 - DNA, 22 bp, Homo sapiens
gcccagcacagctggaagagtc

SEQ ID NO: 8098392 - DNA, 22 bp, Homo sapiens
gcccaggaagtgactcagatgt

SEQ ID NO: 8098393 - DNA, 22 bp, Homo sapiens
gcccatggcttccctaggcaca

SEQ ID NO: 8098394 - DNA, 22 bp, Homo sapiens
gcccatgggctccagacctggg

SEQ ID NO: 8098395 - DNA, 18 bp, Homo sapiens
gcccatggtaaatgctgt

SEQ ID NO: 8098396 - DNA, 22 bp, Homo sapiens
gcccatggtcagggaggcaggg

SEQ ID NO: 8098397 - DNA, 22 bp, Homo sapiens
gcccatggttacttttctggct

SEQ ID NO: 8098398 - DNA, 22 bp, Homo sapiens
gcccatggtggcgttcggtgca

SEQ ID NO: 8098399 - DNA, 22 bp, Homo sapiens
gcagggaagtttgatctttttc

SEQ ID NO: 8098400 - DNA, 22 bp, Homo sapiens
gcagggaaggggcatgctggag

SEQ ID NO: 8098401 - DNA, 22 bp, Homo sapiens
gcagggaaggggacggaaccag

SEQ ID NO: 8098402 - DNA, 22 bp, Homo sapiens
gcagggaagatcttggagctgc

SEQ ID NO: 8098403 - DNA, 22 bp, Homo sapiens
gcagggctgggtgggagacaga

SEQ ID NO: 8098404 - DNA, 22 bp, Homo sapiens
gcagggctgtggacactttggt

SEQ ID NO: 8098405 - DNA, 22 bp, Homo sapiens
gcagggcttgcagcagctagac

SEQ ID NO: 8098406 - DNA, 22 bp, Homo sapiens
gcaggaagcatagaagaatgcc

SEQ ID NO: 8098407 - DNA, 22 bp, Homo sapiens
gcaggaagggaaaggttgactc

SEQ ID NO: 8098408 - DNA, 18 bp, Homo sapiens
gcagcccctcttccttcc

SEQ ID NO: 8098409 - DNA, 23 bp, Homo sapiens
gcagatggccccagagtgctgcc

SEQ ID NO: 8098410 - DNA, 22 bp, Homo sapiens
gaggcccacagggagtaccaag

SEQ ID NO: 8098411 - DNA, 22 bp, Homo sapiens
gcaaagaaagttttaatgaggt

SEQ ID NO: 8098412 - DNA, 22 bp, Homo sapiens
gcaaataaatgctcactgctgt

SEQ ID NO: 8098413 - DNA, 22 bp, Homo sapiens
gcaaataatatactttgatctc

SEQ ID NO: 8098414 - DNA, 22 bp, Homo sapiens
gcagacaggggcttaggaaagg

SEQ ID NO: 8098415 - DNA, 22 bp, Homo sapiens
gcacatccaatgattgttttga

SEQ ID NO: 8098416 - DNA, 22 bp, Homo sapiens
gcacagtgcaccactttgaaaa

SEQ ID NO: 8098417 - DNA, 22 bp, Homo sapiens
gcacagtggagtgtgtccaggg

SEQ ID NO: 8098418 - DNA, 22 bp, Homo sapiens
gcacagtgggtggtcatgtaca

SEQ ID NO: 8098419 - DNA, 22 bp, Homo sapiens
gcagagaagatgcccaggcttc

SEQ ID NO: 8098420 - DNA, 22 bp, Homo sapiens
gcagaggtcaaatacctcattt

SEQ ID NO: 8098421 - DNA, 22 bp, Homo sapiens
gcagaggccaggccaccagcaa

SEQ ID NO: 8098422 - DNA, 22 bp, Homo sapiens
gcagaggtgagaagggcctccc

SEQ ID NO: 8098423 - DNA, 22 bp, Homo sapiens
gcagaggcatttctgacgctgc

SEQ ID NO: 8098424 - DNA, 22 bp, Homo sapiens
gcagaggatcaggctctggaaa

SEQ ID NO: 8098425 - DNA, 22 bp, Homo sapiens
ggcatgtgcctgaggtcacaca

SEQ ID NO: 8098426 - DNA, 22 bp, Homo sapiens
ggccagtggctctgtgcttggg

SEQ ID NO: 8098427 - DNA, 21 bp, Homo sapiens
ggccagtggccttgactttcc

SEQ ID NO: 8098428 - DNA, 22 bp, Homo sapiens
ggcagtctttcccttgagctct

SEQ ID NO: 8098429 - DNA, 22 bp, Homo sapiens
ggcagtctagtgtccttgggcc

SEQ ID NO: 8098430 - DNA, 19 bp, Homo sapiens
ggcagtctcaagcagcaca

SEQ ID NO: 8098431 - DNA, 22 bp, Homo sapiens
ggcagtcttatcagcattggac

SEQ ID NO: 8098432 - DNA, 22 bp, Homo sapiens
ggcatgggccgaggtgcctcct

SEQ ID NO: 8098433 - DNA, 22 bp, Homo sapiens
ggcaggtggcactgctgctccc

SEQ ID NO: 8098434 - DNA, 22 bp, Homo sapiens
ggcctcagagaaggctgtgcgg

SEQ ID NO: 8098435 - DNA, 23 bp, Homo sapiens
ggcctcagcgcacagaaactgct

SEQ ID NO: 8098436 - DNA, 23 bp, Homo sapiens
ggcctcagcgcacagaaactgct

SEQ ID NO: 8098437 - DNA, 18 bp, Homo sapiens
ggcctcagcctggccgga

SEQ ID NO: 8098438 - DNA, 21 bp, Homo sapiens
ggcctcagccacctggctctg

SEQ ID NO: 8098439 - DNA, 22 bp, Homo sapiens
ggcctctgttctgcattcctcc

SEQ ID NO: 8098440 - DNA, 21 bp, Homo sapiens
ggcctctgtcatcctgggaag

SEQ ID NO: 8098441 - DNA, 21 bp, Homo sapiens
ggcctctgtcatcctgggaag

SEQ ID NO: 8098442 - DNA, 22 bp, Homo sapiens
ggcctctggttcgtggtgacct

SEQ ID NO: 8098443 - DNA, 22 bp, Homo sapiens
ggcctcagtttcttcaactgta

SEQ ID NO: 8098444 - DNA, 22 bp, Homo sapiens
ggcctcagtttcttcaactgta

SEQ ID NO: 8098445 - DNA, 22 bp, Homo sapiens
ggcgctggtggtcttgcgagcg

SEQ ID NO: 8098446 - DNA, 22 bp, Homo sapiens
ggcctttgcgtccacgccgctt

SEQ ID NO: 8098447 - DNA, 22 bp, Homo sapiens
ggccttggttctgtcacagccg

SEQ ID NO: 8098448 - DNA, 22 bp, Homo sapiens
ggccttgggctggctgcagtat

SEQ ID NO: 8098449 - DNA, 17 bp, Homo sapiens
ggccttgggctgctctt

SEQ ID NO: 8098450 - DNA, 20 bp, Homo sapiens
ggccttgggtttcgcctgtt

SEQ ID NO: 8098451 - DNA, 17 bp, Homo sapiens
ggccttggggcctcagt

SEQ ID NO: 8098452 - DNA, 18 bp, Homo sapiens
ggcctgcagtgaagcaag

SEQ ID NO: 8098453 - DNA, 22 bp, Homo sapiens
ggcctgagggtgggctctcagt

SEQ ID NO: 8098454 - DNA, 22 bp, Homo sapiens
ggcagaggaaggatgaattcac

SEQ ID NO: 8098455 - DNA, 22 bp, Homo sapiens
ggcagaggagctggaaacatgg

SEQ ID NO: 8098456 - DNA, 20 bp, Homo sapiens
ggcagagggcctgggagaag

SEQ ID NO: 8098457 - DNA, 22 bp, Homo sapiens
ggcagaggaggggtgaatttgc

SEQ ID NO: 8098458 - DNA, 22 bp, Homo sapiens
ggcagaggtagctggaaccagg

SEQ ID NO: 8098459 - DNA, 20 bp, Homo sapiens
ggcagagggcctgggagaag

SEQ ID NO: 8098460 - DNA, 22 bp, Homo sapiens
ggcaggcacatttgggggccgt

SEQ ID NO: 8098461 - DNA, 22 bp, Homo sapiens
ggcaggcaacggaccactagtc

SEQ ID NO: 8098462 - DNA, 22 bp, Homo sapiens
ggcaggaggtgagtggcgggtg

SEQ ID NO: 8098463 - DNA, 22 bp, Homo sapiens
ggcaggcaagtctgctctgtga

SEQ ID NO: 8098464 - DNA, 22 bp, Homo sapiens
ggcaagaggtccaagaggtctc

SEQ ID NO: 8098465 - DNA, 22 bp, Homo sapiens
ggcaagagtgaggagtgtctct

SEQ ID NO: 8098466 - DNA, 22 bp, Homo sapiens
ggcaagagggcagatggagtgc

SEQ ID NO: 8098467 - DNA, 22 bp, Homo sapiens
ggagtgagtactggagtagctg

SEQ ID NO: 8098468 - DNA, 22 bp, Homo sapiens
ggagtcagaggaaggcttgctc

SEQ ID NO: 8098469 - DNA, 22 bp, Homo sapiens
ggagtcagcctgtcagagtgta

SEQ ID NO: 8098470 - DNA, 21 bp, Homo sapiens
ggagtcagggtctggctgggg

SEQ ID NO: 8098471 - DNA, 22 bp, Homo sapiens
ggagtcaggagcaggctgggct

SEQ ID NO: 8098472 - DNA, 22 bp, Homo sapiens
ggagtcagaatggcagggtggt

SEQ ID NO: 8098473 - DNA, 22 bp, Homo sapiens
ggagtcagaacccaggcttcta

SEQ ID NO: 8098474 - DNA, 22 bp, Homo sapiens
ggagccagaggctgctgctgtg

SEQ ID NO: 8098475 - DNA, 22 bp, Homo sapiens
ggagccagagtctgcagtgtaa

SEQ ID NO: 8098476 - DNA, 22 bp, Homo sapiens
ggagccagcagggtgacactga

SEQ ID NO: 8098477 - DNA, 22 bp, Homo sapiens
gggaggagcttggagattcact

SEQ ID NO: 8098478 - DNA, 22 bp, Homo sapiens
gggaggagctgagtgtgtgtgc

SEQ ID NO: 8098479 - DNA, 22 bp, Homo sapiens
gggatggggggaagcgtccatg

SEQ ID NO: 8098480 - DNA, 22 bp, Homo sapiens
gggaggaaatgtgcagcgaatt

SEQ ID NO: 8098481 - DNA, 20 bp, Homo sapiens
gggcaaattgctatttcttt

SEQ ID NO: 8098482 - DNA, 22 bp, Homo sapiens
gggatggggtcgggaccctgct

SEQ ID NO: 8098483 - DNA, 22 bp, Homo sapiens
gggatgtcgtgggtggcagctg

SEQ ID NO: 8098484 - DNA, 22 bp, Homo sapiens
gggatgtcactgtgcctggcac

SEQ ID NO: 8098485 - DNA, 22 bp, Homo sapiens
gggcaggctgagcatgtcacct

SEQ ID NO: 8098486 - DNA, 23 bp, Homo sapiens
gggcatggagtgtaggtggaagg

SEQ ID NO: 8098487 - DNA, 22 bp, Homo sapiens
gggagagtagctggaaggttct

SEQ ID NO: 8098488 - DNA, 18 bp, Homo sapiens
gggagctgggaagctggt

SEQ ID NO: 8098489 - DNA, 19 bp, Homo sapiens
gggagagccaggctcaccc

SEQ ID NO: 8098490 - DNA, 22 bp, Homo sapiens
gggagagcgcgctagggccgag

SEQ ID NO: 8098491 - DNA, 22 bp, Homo sapiens
gggacatctttctagtcagggt

SEQ ID NO: 8098492 - DNA, 22 bp, Homo sapiens
ggctccagaggccttacctgca

SEQ ID NO: 8098493 - DNA, 22 bp, Homo sapiens
ggctccagatgtcccctggcaa

SEQ ID NO: 8098494 - DNA, 22 bp, Homo sapiens
ggctccagatgtcccctggcaa

SEQ ID NO: 8098495 - DNA, 22 bp, Homo sapiens
ggctctggagacatgtggagag

SEQ ID NO: 8098496 - DNA, 22 bp, Homo sapiens
ggctctgctggattgaggccag

SEQ ID NO: 8098497 - DNA, 19 bp, Homo sapiens
ggctctggcggctgtagcc

SEQ ID NO: 8098498 - DNA, 22 bp, Homo sapiens
ggctctggctactccaccctgt

SEQ ID NO: 8098499 - DNA, 22 bp, Homo sapiens
ggctctggcaaggggaggctac

SEQ ID NO: 8098500 - DNA, 22 bp, Homo sapiens
ggctctggcaaggggaggctac

SEQ ID NO: 8098501 - DNA, 22 bp, Homo sapiens
ggctgagaacaggcccagcctc

SEQ ID NO: 8098502 - DNA, 22 bp, Homo sapiens
ggctcttgggagctcagagttg

SEQ ID NO: 8098503 - DNA, 22 bp, Homo sapiens
ggctctgggccagagttggctt

SEQ ID NO: 8098504 - DNA, 22 bp, Homo sapiens
ggctctttaacttgtctaaatt

SEQ ID NO: 8098505 - DNA, 22 bp, Homo sapiens
ggctgggcaaacaagactcttc

SEQ ID NO: 8098506 - DNA, 22 bp, Homo sapiens
ggctgctggcattgaggtaggt

SEQ ID NO: 8098507 - DNA, 22 bp, Homo sapiens
ggctgctgggaatatgccagct

SEQ ID NO: 8098508 - DNA, 22 bp, Homo sapiens
ggctgctggccagcctaggagt

SEQ ID NO: 8098509 - DNA, 22 bp, Homo sapiens
ggctgctgggaatatgccagct

SEQ ID NO: 8098510 - DNA, 22 bp, Homo sapiens
ggctgctgagttggccaggaga

SEQ ID NO: 8098511 - DNA, 22 bp, Homo sapiens
ggctgctgaagtgtggcaatct

SEQ ID NO: 8098512 - DNA, 22 bp, Homo sapiens
ggctgggctgcggctgtacctg

SEQ ID NO: 8098513 - DNA, 22 bp, Homo sapiens
ggcttctgaaccaggccctgga

SEQ ID NO: 8098514 - DNA, 22 bp, Homo sapiens
ggcttctggtgggagcatgact

SEQ ID NO: 8098515 - DNA, 22 bp, Homo sapiens
ggctgggctccgggagcatgcg

SEQ ID NO: 8098516 - DNA, 22 bp, Homo sapiens
ggctgggccgcggctacccaga

SEQ ID NO: 8098517 - DNA, 22 bp, Homo sapiens
ggctgggcctctccctcagctg

SEQ ID NO: 8098518 - DNA, 22 bp, Homo sapiens
ggctgggccagggcctgtggac

SEQ ID NO: 8098519 - DNA, 22 bp, Homo sapiens
ggctgggccagggcctgtggac

SEQ ID NO: 8098520 - DNA, 22 bp, Homo sapiens
ggctgggcaggtctgcacaggg

SEQ ID NO: 8098521 - DNA, 22 bp, Homo sapiens
ggtcctttgaaaggggtgtgtc

SEQ ID NO: 8098522 - DNA, 22 bp, Homo sapiens
ggtctcagactggcaggcagtg

SEQ ID NO: 8098523 - DNA, 22 bp, Homo sapiens
ggtctacagagagaaatgaagc

SEQ ID NO: 8098524 - DNA, 22 bp, Homo sapiens
ggtccctggttccctctgagct

SEQ ID NO: 8098525 - DNA, 22 bp, Homo sapiens
ggtccctggttccctctgagct

SEQ ID NO: 8098526 - DNA, 22 bp, Homo sapiens
ggtcagcagtgcagggcagagc

SEQ ID NO: 8098527 - DNA, 22 bp, Homo sapiens
ggtcagcaggtccagccagtgc

SEQ ID NO: 8098528 - DNA, 22 bp, Homo sapiens
ggtcagcagccatgccatgaat

SEQ ID NO: 8098529 - DNA, 22 bp, Homo sapiens
ggtcagcaatttggactgggct

SEQ ID NO: 8098530 - DNA, 19 bp, Homo sapiens
ggtcagcagtttagggtct

SEQ ID NO: 8098531 - DNA, 22 bp, Homo sapiens
ggtccctggggaactaggctgt

SEQ ID NO: 8098532 - DNA, 22 bp, Homo sapiens
ggtcagagggtgggctgcctgt

SEQ ID NO: 8098533 - DNA, 22 bp, Homo sapiens
ggtggctctctgtcagtgacag

SEQ ID NO: 8098534 - DNA, 22 bp, Homo sapiens
ggtggctcggccagtgcaggcc

SEQ ID NO: 8098535 - DNA, 19 bp, Homo sapiens
ggtggctctccctcaggga

SEQ ID NO: 8098536 - DNA, 22 bp, Homo sapiens
ggtgttgggagagctggttttg

SEQ ID NO: 8098537 - DNA, 22 bp, Homo sapiens
ggtgttgcagttgaagactggt

SEQ ID NO: 8098538 - DNA, 22 bp, Homo sapiens
ggtggcctccagggcataggtg

SEQ ID NO: 8098539 - DNA, 22 bp, Homo sapiens
ggtggccttttatgagcagggt

SEQ ID NO: 8098540 - DNA, 21 bp, Homo sapiens
ggtggccttggtgagagacct

SEQ ID NO: 8098541 - DNA, 22 bp, Homo sapiens
ggtggccttggacaagtaacct

SEQ ID NO: 8098542 - DNA, 22 bp, Homo sapiens
ggtggctcagtgtcaggccctg

SEQ ID NO: 8098543 - DNA, 22 bp, Homo sapiens
ggtggctcaaagagagcacaga

SEQ ID NO: 8098544 - DNA, 22 bp, Homo sapiens
ggtctgaaaatggtgaccacca

SEQ ID NO: 8098545 - DNA, 22 bp, Homo sapiens
ggtctggaccctcctggagtgg

SEQ ID NO: 8098546 - DNA, 22 bp, Homo sapiens
ggtctgaattccagcccctctg

SEQ ID NO: 8098547 - DNA, 22 bp, Homo sapiens
ggtctgaaatgtgacttttgaa

SEQ ID NO: 8098548 - DNA, 22 bp, Homo sapiens
ggtctgaaattatgtcactgct

SEQ ID NO: 8098549 - DNA, 22 bp, Homo sapiens
ggtctgaatcactgtgcctatc

SEQ ID NO: 8098550 - DNA, 21 bp, Homo sapiens
gggccacaccttctgcagacc

SEQ ID NO: 8098551 - DNA, 22 bp, Homo sapiens
gggctgagattggtgccctgtc

SEQ ID NO: 8098552 - DNA, 22 bp, Homo sapiens
gggctgagagtgactgttctgt

SEQ ID NO: 8098553 - DNA, 22 bp, Homo sapiens
gggctgagctaagctgggttga

SEQ ID NO: 8098554 - DNA, 22 bp, Homo sapiens
gggctgagtgtcccaggccgaa

SEQ ID NO: 8098555 - DNA, 22 bp, Homo sapiens
gggctgcctgagcatctcctcc

SEQ ID NO: 8098556 - DNA, 22 bp, Homo sapiens
gggctgcatcagcaggacccgg

SEQ ID NO: 8098557 - DNA, 22 bp, Homo sapiens
gggctgcactagggcaaggtga

SEQ ID NO: 8098558 - DNA, 22 bp, Homo sapiens
gggctgctgcccaggaggcacc

SEQ ID NO: 8098559 - DNA, 22 bp, Homo sapiens
ggggcctatttgttcaacttcc

SEQ ID NO: 8098560 - DNA, 22 bp, Homo sapiens
ggggcctccagcactaggcagc

SEQ ID NO: 8098561 - DNA, 22 bp, Homo sapiens
ggggctctcaggtctccccaaa

SEQ ID NO: 8098562 - DNA, 22 bp, Homo sapiens
ggggctctgctctgagccgtgt

SEQ ID NO: 8098563 - DNA, 22 bp, Homo sapiens
ggggtgggcgtgcagggacacc

SEQ ID NO: 8098564 - DNA, 22 bp, Homo sapiens
ggggtgtgagtagagctgggga

SEQ ID NO: 8098565 - DNA, 22 bp, Homo sapiens
gggtagggtgacttaggctggc

SEQ ID NO: 8098566 - DNA, 22 bp, Homo sapiens
gggtggaggagaacaggcccca

SEQ ID NO: 8098567 - DNA, 22 bp, Homo sapiens
gggtggagtagaaagatgaatt

SEQ ID NO: 8098568 - DNA, 20 bp, Homo sapiens
gtacattttcaggaggggat

SEQ ID NO: 8098569 - DNA, 22 bp, Homo sapiens
gtacatttcatttaaatgatgt

SEQ ID NO: 8098570 - DNA, 22 bp, Homo sapiens
ggttttatagcagtactatcag

SEQ ID NO: 8098571 - DNA, 22 bp, Homo sapiens
gtagaataaatgtacacatctg

SEQ ID NO: 8098572 - DNA, 22 bp, Homo sapiens
gtattacatttagtaattaggc

SEQ ID NO: 8098573 - DNA, 22 bp, Homo sapiens
gtattattgtcatgaaataata

SEQ ID NO: 8098574 - DNA, 22 bp, Homo sapiens
gtatttcacatatggatatgct

SEQ ID NO: 8098575 - DNA, 22 bp, Homo sapiens
gtattcctaagtcatgacaaat

SEQ ID NO: 8098576 - DNA, 22 bp, Homo sapiens
gtattcctgcaaatagcagtga

SEQ ID NO: 8098577 - DNA, 22 bp, Homo sapiens
gtattccttcagaagacgttta

SEQ ID NO: 8098578 - DNA, 22 bp, Homo sapiens
gtcctgggcccaggggctgcct

SEQ ID NO: 8098579 - DNA, 22 bp, Homo sapiens
gtcctgggcatgcagggctttc

SEQ ID NO: 8098580 - DNA, 17 bp, Homo sapiens
gtcctgggaggagagag

SEQ ID NO: 8098581 - DNA, 22 bp, Homo sapiens
gtcctgggaaggaagccaggga

SEQ ID NO: 8098582 - DNA, 22 bp, Homo sapiens
gtccctgccctcctgggactca

SEQ ID NO: 8098583 - DNA, 22 bp, Homo sapiens
gtccctgcatctgcaggccatg

SEQ ID NO: 8098584 - DNA, 22 bp, Homo sapiens
gtcccctggtggctggagctgc

SEQ ID NO: 8098585 - DNA, 22 bp, Homo sapiens
gtccctgcatcaccacgggact

SEQ ID NO: 8098586 - DNA, 22 bp, Homo sapiens
gtccaaaagagccagccgggcg

SEQ ID NO: 8098587 - DNA, 22 bp, Homo sapiens
gtccaaggatgcaggatgctgt

SEQ ID NO: 8098588 - DNA, 22 bp, Homo sapiens
gtcattttctagaattatttga

SEQ ID NO: 8098589 - DNA, 19 bp, Homo sapiens
gtatttcaggacaagacgt

SEQ ID NO: 8098590 - DNA, 23 bp, Homo sapiens
gtatttcagcattctcagttaaa

SEQ ID NO: 8098591 - DNA, 22 bp, Homo sapiens
gtcatttttttcgtaatagtgg

SEQ ID NO: 8098592 - DNA, 22 bp, Homo sapiens
gtcatttttgactttgaagtga

SEQ ID NO: 8098593 - DNA, 22 bp, Homo sapiens
gtcattttgctgcatatttaga

SEQ ID NO: 8098594 - DNA, 22 bp, Homo sapiens
gtccacattttaaacttatgga

SEQ ID NO: 8098595 - DNA, 22 bp, Homo sapiens
gtccacattattatatgtctgt

SEQ ID NO: 8098596 - DNA, 22 bp, Homo sapiens
gtcccatttcaagaaattcatg

SEQ ID NO: 8098597 - DNA, 22 bp, Homo sapiens
gtcccattttctactatggaat

SEQ ID NO: 8098598 - DNA, 22 bp, Homo sapiens
gtgaaagagatgcagcataatg

SEQ ID NO: 8098599 - DNA, 18 bp, Homo sapiens
gtgaaagagacagggcag

SEQ ID NO: 8098600 - DNA, 22 bp, Homo sapiens
gtgaaatattttgtttatgtca

SEQ ID NO: 8098601 - DNA, 22 bp, Homo sapiens
gtgaagcagggaaggaaaggat

SEQ ID NO: 8098602 - DNA, 22 bp, Homo sapiens
gtgaagcatatgcttctctgcc

SEQ ID NO: 8098603 - DNA, 22 bp, Homo sapiens
gtgaagcagttgcgtgggttcc

SEQ ID NO: 8098604 - DNA, 22 bp, Homo sapiens
gtgaagcataactgaaggattt

SEQ ID NO: 8098605 - DNA, 22 bp, Homo sapiens
gtgaagcacatgggcgttgggt

SEQ ID NO: 8098606 - DNA, 22 bp, Homo sapiens
gtgaagcacgctgccgcactgg

SEQ ID NO: 8098607 - DNA, 22 bp, Homo sapiens
gtgaagcagagtgtggaagcaa

SEQ ID NO: 8098608 - DNA, 22 bp, Homo sapiens
gtgaagagctgttgcagagatt

SEQ ID NO: 8098609 - DNA, 22 bp, Homo sapiens
gtcctggggatacagaagtgaa

SEQ ID NO: 8098610 - DNA, 22 bp, Homo sapiens
gtcctggggattatagagtgtt

SEQ ID NO: 8098611 - DNA, 22 bp, Homo sapiens
gtctgctgcagagcatggcttt

SEQ ID NO: 8098612 - DNA, 22 bp, Homo sapiens
gtgcagtgaaaaaagaatgtcc

SEQ ID NO: 8098613 - DNA, 22 bp, Homo sapiens
gtgcaggtggcttctagcttct

SEQ ID NO: 8098614 - DNA, 22 bp, Homo sapiens
gtgcagattcccgggcctctcc

SEQ ID NO: 8098615 - DNA, 22 bp, Homo sapiens
gtgcatatatgcacatatgtgt

SEQ ID NO: 8098616 - DNA, 22 bp, Homo sapiens
gtgcacttgatctagacagatt

SEQ ID NO: 8098617 - DNA, 19 bp, Homo sapiens
gtgcactgtcactttgctc

SEQ ID NO: 8098618 - DNA, 22 bp, Homo sapiens
gtgagcaggatttcatggtgta

SEQ ID NO: 8098619 - DNA, 21 bp, Homo sapiens
gtgcacagtcctgcacacagg

SEQ ID NO: 8098620 - DNA, 22 bp, Homo sapiens
gtgcacatcgtgcaggtttgtt

SEQ ID NO: 8098621 - DNA, 22 bp, Homo sapiens
gtgactcttaaagcaaatcttg

SEQ ID NO: 8098622 - DNA, 22 bp, Homo sapiens
gagaggccatggctgtgcagtg

SEQ ID NO: 8098623 - DNA, 22 bp, Homo sapiens
gagaggccaaaatccctgcccc

SEQ ID NO: 8098624 - DNA, 18 bp, Homo sapiens
gagaggcccggctgtgcc

SEQ ID NO: 8098625 - DNA, 22 bp, Homo sapiens
gagatgctgcctgatttattca

SEQ ID NO: 8098626 - DNA, 17 bp, Homo sapiens
gagatgctaatctgatc

SEQ ID NO: 8098627 - DNA, 22 bp, Homo sapiens
gagaggctgggttggagatcga

SEQ ID NO: 8098628 - DNA, 22 bp, Homo sapiens
gagaggcttaagggctgtgaag

SEQ ID NO: 8098629 - DNA, 22 bp, Homo sapiens
gagccagggctgtgagctgagc

SEQ ID NO: 8098630 - DNA, 22 bp, Homo sapiens
gagccaggttggaggctgcagt

SEQ ID NO: 8098631 - DNA, 22 bp, Homo sapiens
gagccagaaaagctgcctgact

SEQ ID NO: 8098632 - DNA, 22 bp, Homo sapiens
gagccaagggcgtgctggagag

SEQ ID NO: 8098633 - DNA, 22 bp, Homo sapiens
gagcagcctgaggagcgtgggc

SEQ ID NO: 8098634 - DNA, 22 bp, Homo sapiens
gagcagcagttgttacaatgat

SEQ ID NO: 8098635 - DNA, 18 bp, Homo sapiens
gagcagcaggatcaagaa

SEQ ID NO: 8098636 - DNA, 22 bp, Homo sapiens
gagatggagtctttttctgtca

SEQ ID NO: 8098637 - DNA, 21 bp, Homo sapiens
gagatgctttttattcaaccc

SEQ ID NO: 8098638 - DNA, 22 bp, Homo sapiens
gagatgctttgtgtatagacaa

SEQ ID NO: 8098639 - DNA, 22 bp, Homo sapiens
gaggaggctatcagcaatcagg

SEQ ID NO: 8098640 - DNA, 22 bp, Homo sapiens
gaggaggcagcctatcccttag

SEQ ID NO: 8098641 - DNA, 22 bp, Homo sapiens
gaggaggcacttgagcagatgt

SEQ ID NO: 8098642 - DNA, 22 bp, Homo sapiens
gaggaggaagttctctgtaggc

SEQ ID NO: 8098643 - DNA, 19 bp, Homo sapiens
gaggaggaaaactagtgta

SEQ ID NO: 8098644 - DNA, 22 bp, Homo sapiens
gaggaggaaaccctgttcctct

SEQ ID NO: 8098645 - DNA, 18 bp, Homo sapiens
gaggagccgtccctacta

SEQ ID NO: 8098646 - DNA, 22 bp, Homo sapiens
gaggagcctggccccacatcca

SEQ ID NO: 8098647 - DNA, 22 bp, Homo sapiens
gaggagcttgtgagaagatgtc

SEQ ID NO: 8098648 - DNA, 22 bp, Homo sapiens
gaggaaaatgcaacaggaatgc

SEQ ID NO: 8098649 - DNA, 22 bp, Homo sapiens
gaggcagaggaaggtggtctct

SEQ ID NO: 8098650 - DNA, 22 bp, Homo sapiens
gaggcagaagttgcagtgagca

SEQ ID NO: 8098651 - DNA, 22 bp, Homo sapiens
gaggcagagaccttcaggacct

SEQ ID NO: 8098652 - DNA, 22 bp, Homo sapiens
gagctcagactcgggcctgggg

SEQ ID NO: 8098653 - DNA, 18 bp, Homo sapiens
gagctgagaagaggatgc

SEQ ID NO: 8098654 - DNA, 22 bp, Homo sapiens
gagctcttttgatgaaggtagt

SEQ ID NO: 8098655 - DNA, 20 bp, Homo sapiens
gaagacacagagttcatctc

SEQ ID NO: 8098656 - DNA, 22 bp, Homo sapiens
gaagacactctgcagagttatc

SEQ ID NO: 8098657 - DNA, 22 bp, Homo sapiens
gaagacacctactgtcatttct

SEQ ID NO: 8098658 - DNA, 22 bp, Homo sapiens
gaagagtatatttagtgaaatc

SEQ ID NO: 8098659 - DNA, 22 bp, Homo sapiens
gaaatgcaggcttggattcagc

SEQ ID NO: 8098660 - DNA, 22 bp, Homo sapiens
gaaatctacgattagtgaaaat

SEQ ID NO: 8098661 - DNA, 22 bp, Homo sapiens
ctttcacagtcctgactgagcg

SEQ ID NO: 8098662 - DNA, 22 bp, Homo sapiens
ctttcagaagccggaagggcag

SEQ ID NO: 8098663 - DNA, 22 bp, Homo sapiens
ctttcagaagtatattctggaa

SEQ ID NO: 8098664 - DNA, 22 bp, Homo sapiens
ctttcagaagtatattctggaa

SEQ ID NO: 8098665 - DNA, 22 bp, Homo sapiens
ctttcagaggggcgtacacagc

SEQ ID NO: 8098666 - DNA, 22 bp, Homo sapiens
ctttcacaagatttgagatgct

SEQ ID NO: 8098667 - DNA, 22 bp, Homo sapiens
ctttcagaagaggacctttcca

SEQ ID NO: 8098668 - DNA, 22 bp, Homo sapiens
ctttcacataattgaccttgaa

SEQ ID NO: 8098669 - DNA, 22 bp, Homo sapiens
ctttcacacacatacatttgga

SEQ ID NO: 8098670 - DNA, 22 bp, Homo sapiens
ctttcacagccttcgttctgaa

SEQ ID NO: 8098671 - DNA, 23 bp, Homo sapiens
ctttcattgtggtttcacagagc

SEQ ID NO: 8098672 - DNA, 22 bp, Homo sapiens
ctttccaactctagtgaaattt

SEQ ID NO: 8098673 - DNA, 22 bp, Homo sapiens
ctttcatccgcagatgagcctc

SEQ ID NO: 8098674 - DNA, 22 bp, Homo sapiens
gaaatcagttctgaaatttaca

SEQ ID NO: 8098675 - DNA, 22 bp, Homo sapiens
gaatacaagccaggcacaaggc

SEQ ID NO: 8098676 - DNA, 22 bp, Homo sapiens
gaaggaaaggtctcatgccttt

SEQ ID NO: 8098677 - DNA, 22 bp, Homo sapiens
gaaggaagattctgttggaatc

SEQ ID NO: 8098678 - DNA, 22 bp, Homo sapiens
gaaggaagactggtttaaatgt

SEQ ID NO: 8098679 - DNA, 22 bp, Homo sapiens
gaatattagtatcagttatacc

SEQ ID NO: 8098680 - DNA, 22 bp, Homo sapiens
gaatatcccgctatgcaaagta

SEQ ID NO: 8098681 - DNA, 21 bp, Homo sapiens
gacaggggaagaagcaaggag

SEQ ID NO: 8098682 - DNA, 22 bp, Homo sapiens
gacagggacacagccagtgagg

SEQ ID NO: 8098683 - DNA, 22 bp, Homo sapiens
gacaagttgtggagaagagggt

SEQ ID NO: 8098684 - DNA, 22 bp, Homo sapiens
gacaagttacacctgtgcttga

SEQ ID NO: 8098685 - DNA, 22 bp, Homo sapiens
gaccctgtttctacaaataatt

SEQ ID NO: 8098686 - DNA, 22 bp, Homo sapiens
gacaggtgtgtgtatattaggg

SEQ ID NO: 8098687 - DNA, 22 bp, Homo sapiens
cttgccagcacttggccagctg

SEQ ID NO: 8098688 - DNA, 22 bp, Homo sapiens
cttgccagcaggcgctgtgtac

SEQ ID NO: 8098689 - DNA, 22 bp, Homo sapiens
cttgccagcatttatagggatt

SEQ ID NO: 8098690 - DNA, 21 bp, Homo sapiens
cttgccaggccaggtgtcctc

SEQ ID NO: 8098691 - DNA, 22 bp, Homo sapiens
cttgccaggatcagagtcacag

SEQ ID NO: 8098692 - DNA, 22 bp, Homo sapiens
cttgccagggactcagtcaggg

SEQ ID NO: 8098693 - DNA, 22 bp, Homo sapiens
cttgccagtgttgcagaagctc

SEQ ID NO: 8098694 - DNA, 22 bp, Homo sapiens
cttgcagtgtggccttgaagag

SEQ ID NO: 8098695 - DNA, 22 bp, Homo sapiens
cttgggtcaatcttgggtgtag

SEQ ID NO: 8098696 - DNA, 20 bp, Homo sapiens
cttgccagttccctggcaga

SEQ ID NO: 8098697 - DNA, 22 bp, Homo sapiens
cttgtcaggtaggtgtcatttc

SEQ ID NO: 8098698 - DNA, 22 bp, Homo sapiens
cttgtcagccaattgtggattt

SEQ ID NO: 8098699 - DNA, 22 bp, Homo sapiens
ctttatggaatcaaagactgga

SEQ ID NO: 8098700 - DNA, 22 bp, Homo sapiens
ctttatggtaagtatagatgac

SEQ ID NO: 8098701 - DNA, 22 bp, Homo sapiens
ctttatggagtgacacaatggg

SEQ ID NO: 8098702 - DNA, 22 bp, Homo sapiens
cttgtattcttccacttaagat

SEQ ID NO: 8098703 - DNA, 22 bp, Homo sapiens
cttgtattgctgttttgcatct

SEQ ID NO: 8098704 - DNA, 22 bp, Homo sapiens
cttgcacagaactcttagaggt

SEQ ID NO: 8098705 - DNA, 22 bp, Homo sapiens
cttcagggtgacgcaggctgca

SEQ ID NO: 8098706 - DNA, 19 bp, Homo sapiens
cttcagggaggggccaggc

SEQ ID NO: 8098707 - DNA, 22 bp, Homo sapiens
cttcagggaggagcatgggttc

SEQ ID NO: 8098708 - DNA, 18 bp, Homo sapiens
cttcagtggctgctctgc

SEQ ID NO: 8098709 - DNA, 22 bp, Homo sapiens
cttcagtgttcccatctgtaaa

SEQ ID NO: 8098710 - DNA, 22 bp, Homo sapiens
cttattgttcctggaccctgag

SEQ ID NO: 8098711 - DNA, 22 bp, Homo sapiens
cttattgtgataccatgcagta

SEQ ID NO: 8098712 - DNA, 22 bp, Homo sapiens
cttattctactccacaagctct

SEQ ID NO: 8098713 - DNA, 22 bp, Homo sapiens
ctgttgtgaaatgtccatcaac

SEQ ID NO: 8098714 - DNA, 22 bp, Homo sapiens
ctgttgttccgggagctgcagc

SEQ ID NO: 8098715 - DNA, 22 bp, Homo sapiens
cttattttgctgatgacccagg

SEQ ID NO: 8098716 - DNA, 22 bp, Homo sapiens
cttattttaagtcagtttgggt

SEQ ID NO: 8098717 - DNA, 22 bp, Homo sapiens
ctgttcaatttgtttcagttat

SEQ ID NO: 8098718 - DNA, 22 bp, Homo sapiens
ctgttcatgctgattctgtatg

SEQ ID NO: 8098719 - DNA, 22 bp, Homo sapiens
ctgttcatgctgattctgtatg

SEQ ID NO: 8098720 - DNA, 22 bp, Homo sapiens
ctgttcatgttgaggcataggg

SEQ ID NO: 8098721 - DNA, 22 bp, Homo sapiens
ctgttctgaactgcctgcatgc

SEQ ID NO: 8098722 - DNA, 18 bp, Homo sapiens
ctgttctagaactcctgt

SEQ ID NO: 8098723 - DNA, 22 bp, Homo sapiens
ctgttcttatcgtcttaatatc

SEQ ID NO: 8098724 - DNA, 22 bp, Homo sapiens
ctgttgattagaatttcacatc

SEQ ID NO: 8098725 - DNA, 22 bp, Homo sapiens
ctgttacacggaccttcaaatc

SEQ ID NO: 8098726 - DNA, 23 bp, Homo sapiens
ctgtgtctatgcagccatatcca

SEQ ID NO: 8098727 - DNA, 22 bp, Homo sapiens
ctgtgtctctccttacaagact

SEQ ID NO: 8098728 - DNA, 22 bp, Homo sapiens
ctgtggctgtatttggccagag

SEQ ID NO: 8098729 - DNA, 22 bp, Homo sapiens
ctgtgtagcctcatgtgggctt

SEQ ID NO: 8098730 - DNA, 22 bp, Homo sapiens
ctgtgtctaatcaggtcagtca

SEQ ID NO: 8098731 - DNA, 22 bp, Homo sapiens
ctgtgtcctgtctcctaaggtg

SEQ ID NO: 8098732 - DNA, 22 bp, Homo sapiens
ctgtgtcctgcgtcaagccaat

SEQ ID NO: 8098733 - DNA, 19 bp, Homo sapiens
ctgtggctgacctctggcc

SEQ ID NO: 8098734 - DNA, 22 bp, Homo sapiens
ctgtggctgcagccttggtcct

SEQ ID NO: 8098735 - DNA, 22 bp, Homo sapiens
ctgtggctctctgcagggtccc

SEQ ID NO: 8098736 - DNA, 22 bp, Homo sapiens
ctgtggctctcagaggctgctg

SEQ ID NO: 8098737 - DNA, 22 bp, Homo sapiens
ctgggtgcttactttgtgctag

SEQ ID NO: 8098738 - DNA, 19 bp, Homo sapiens
ctgtcctggtttggtccct

SEQ ID NO: 8098739 - DNA, 22 bp, Homo sapiens
ctgtcctgggggtggtccttgc

SEQ ID NO: 8098740 - DNA, 22 bp, Homo sapiens
ctgtcctggccgcccttgtgag

SEQ ID NO: 8098741 - DNA, 22 bp, Homo sapiens
ctgtcctgcccaccctgcaggg

SEQ ID NO: 8098742 - DNA, 22 bp, Homo sapiens
ctgtcctgccagtcctggactc

SEQ ID NO: 8098743 - DNA, 22 bp, Homo sapiens
ctgtcctgtggacctgaggacg

SEQ ID NO: 8098744 - DNA, 22 bp, Homo sapiens
ctgtgcagtggcagcgtgtggg

SEQ ID NO: 8098745 - DNA, 22 bp, Homo sapiens
ctgtgcagtccagccctggaca

SEQ ID NO: 8098746 - DNA, 22 bp, Homo sapiens
ctgtgagggtcacagccatgcc

SEQ ID NO: 8098747 - DNA, 22 bp, Homo sapiens
ctgtgcagtggggctctgggtt

SEQ ID NO: 8098748 - DNA, 22 bp, Homo sapiens
ctgtgcagtgtggggtaggcct

SEQ ID NO: 8098749 - DNA, 22 bp, Homo sapiens
ctgtgcccagctccctgactgc

SEQ ID NO: 8098750 - DNA, 22 bp, Homo sapiens
ctgtgcccacctggctctgagg

SEQ ID NO: 8098751 - DNA, 23 bp, Homo sapiens
ctgtgcccggggctccacctgat

SEQ ID NO: 8098752 - DNA, 22 bp, Homo sapiens
ctgtgcccataatctggtattt

SEQ ID NO: 8098753 - DNA, 22 bp, Homo sapiens
ctgtggccagatggtgccagtt

SEQ ID NO: 8098754 - DNA, 22 bp, Homo sapiens
ctgtggccagtcccacacctcc

SEQ ID NO: 8098755 - DNA, 22 bp, Homo sapiens
ctgggccaagaagttgtgtatg

SEQ ID NO: 8098756 - DNA, 22 bp, Homo sapiens
ctgggcatgaaaaggatgccag

SEQ ID NO: 8098757 - DNA, 22 bp, Homo sapiens
ctgggccacaagcctgtgtgat

SEQ ID NO: 8098758 - DNA, 22 bp, Homo sapiens
ctgggcaggagaggtggttgga

SEQ ID NO: 8098759 - DNA, 22 bp, Homo sapiens
ctgggcaggagaggtggttgga

SEQ ID NO: 8098760 - DNA, 22 bp, Homo sapiens
ctgggaggcggagcttgcagtg

SEQ ID NO: 8098761 - DNA, 22 bp, Homo sapiens
ctgggaggcccacgttgggaag

SEQ ID NO: 8098762 - DNA, 22 bp, Homo sapiens
ctgggaggcagtctctctagaa

SEQ ID NO: 8098763 - DNA, 22 bp, Homo sapiens
ctgggaggcagaggttgcagtg

SEQ ID NO: 8098764 - DNA, 22 bp, Homo sapiens
ctgggaggcactattcaggagg

SEQ ID NO: 8098765 - DNA, 22 bp, Homo sapiens
ctgggaggcagaggttgtagtg

SEQ ID NO: 8098766 - DNA, 22 bp, Homo sapiens
ctgggaaagcaaggttgtggat

SEQ ID NO: 8098767 - DNA, 22 bp, Homo sapiens
ctgggaggattcattgaggtga

SEQ ID NO: 8098768 - DNA, 22 bp, Homo sapiens
ctgggagctgaggctgacgctg

SEQ ID NO: 8098769 - DNA, 22 bp, Homo sapiens
ctgggaggcaccgcgtcgtgct

SEQ ID NO: 8098770 - DNA, 22 bp, Homo sapiens
ctgggagctagctctgagctga

SEQ ID NO: 8098771 - DNA, 22 bp, Homo sapiens
ctgggaagaaattgtgggaggc

SEQ ID NO: 8098772 - DNA, 22 bp, Homo sapiens
ctggggccctgggtctgccctc

SEQ ID NO: 8098773 - DNA, 22 bp, Homo sapiens
ctggggctcactccagccctgg

SEQ ID NO: 8098774 - DNA, 22 bp, Homo sapiens
ctggggcccgagccttgggcca

SEQ ID NO: 8098775 - DNA, 22 bp, Homo sapiens
ctggggctctctggaatgcttg

SEQ ID NO: 8098776 - DNA, 22 bp, Homo sapiens
ctggggctcactttggtcaggc

SEQ ID NO: 8098777 - DNA, 23 bp, Homo sapiens
ctggggctcattgcagtagccat

SEQ ID NO: 8098778 - DNA, 20 bp, Homo sapiens
ctggggaggaggatgtgttc

SEQ ID NO: 8098779 - DNA, 22 bp, Homo sapiens
ctggggccacaacggcgcacgc

SEQ ID NO: 8098780 - DNA, 22 bp, Homo sapiens
ctggggcccatcgagggctgag

SEQ ID NO: 8098781 - DNA, 22 bp, Homo sapiens
ctggggccagtgaggaggcttt

SEQ ID NO: 8098782 - DNA, 22 bp, Homo sapiens
ctggggctgcggtggaggagcc

SEQ ID NO: 8098783 - DNA, 22 bp, Homo sapiens
ctggggctggtgaggcaggctc

SEQ ID NO: 8098784 - DNA, 22 bp, Homo sapiens
ctgggccagaccttgtggtctt

SEQ ID NO: 8098785 - DNA, 22 bp, Homo sapiens
ctgggccagatccagcctcaca

SEQ ID NO: 8098786 - DNA, 22 bp, Homo sapiens
ctgggctctgcagttgatgttt

SEQ ID NO: 8098787 - DNA, 19 bp, Homo sapiens
ctgggccagagctgtcctc

SEQ ID NO: 8098788 - DNA, 22 bp, Homo sapiens
ctgggctgcaggagtggggcaa

SEQ ID NO: 8098789 - DNA, 22 bp, Homo sapiens
ctgggctgcagttcctggtcct

SEQ ID NO: 8098790 - DNA, 23 bp, Homo sapiens
ctgggctgcttgagtccctggct

SEQ ID NO: 8098791 - DNA, 22 bp, Homo sapiens
ctggcaggaagttagatggtaa

SEQ ID NO: 8098792 - DNA, 22 bp, Homo sapiens
ctggcaggaagaggaaaggtca

SEQ ID NO: 8098793 - DNA, 22 bp, Homo sapiens
ctggcaggaaggcatttagaca

SEQ ID NO: 8098794 - DNA, 22 bp, Homo sapiens
ctgccagctcaccggctcagac

SEQ ID NO: 8098795 - DNA, 22 bp, Homo sapiens
ctgccagctcaaagcgcagcta

SEQ ID NO: 8098796 - DNA, 22 bp, Homo sapiens
ctgccagcagaggccagcgctg

SEQ ID NO: 8098797 - DNA, 22 bp, Homo sapiens
ctgccagccaggccaggtaggc

SEQ ID NO: 8098798 - DNA, 22 bp, Homo sapiens
ctgccagctagctcctagttga

SEQ ID NO: 8098799 - DNA, 22 bp, Homo sapiens
ctgccaccatgccccagcagag

SEQ ID NO: 8098800 - DNA, 22 bp, Homo sapiens
ctgcatccatgttgctgcaaag

SEQ ID NO: 8098801 - DNA, 22 bp, Homo sapiens
ctgccacaagctggccctgtgt

SEQ ID NO: 8098802 - DNA, 22 bp, Homo sapiens
ctgcatcaggccaattaagaat

SEQ ID NO: 8098803 - DNA, 20 bp, Homo sapiens
ctgcatcatggttaagaaca

SEQ ID NO: 8098804 - DNA, 22 bp, Homo sapiens
ctgccagaaggttcctgctgca

SEQ ID NO: 8098805 - DNA, 22 bp, Homo sapiens
ctgccagatcattggattcaca

SEQ ID NO: 8098806 - DNA, 22 bp, Homo sapiens
ctgccagcaagctaccctggca

SEQ ID NO: 8098807 - DNA, 22 bp, Homo sapiens
ctgccagagatttggtgaacaa

SEQ ID NO: 8098808 - DNA, 22 bp, Homo sapiens
ctgccagagaaaagtggatctt

SEQ ID NO: 8098809 - DNA, 22 bp, Homo sapiens
ctggcaggctctctggtcggtt

SEQ ID NO: 8098810 - DNA, 22 bp, Homo sapiens
ctggcaggcggaggttgcagtg

SEQ ID NO: 8098811 - DNA, 22 bp, Homo sapiens
ctggcaggcggcagagcccagg

SEQ ID NO: 8098812 - DNA, 22 bp, Homo sapiens
ctggcaggatctaaccagggaa

SEQ ID NO: 8098813 - DNA, 22 bp, Homo sapiens
ctggcaggcaaattggtgggag

SEQ ID NO: 8098814 - DNA, 22 bp, Homo sapiens
ctggcaggatctaaccagggaa

SEQ ID NO: 8098815 - DNA, 22 bp, Homo sapiens
ctggccagcctgtcgatgccct

SEQ ID NO: 8098816 - DNA, 22 bp, Homo sapiens
ctggccagctgacagcagggct

SEQ ID NO: 8098817 - DNA, 22 bp, Homo sapiens
ctggccagagttggagggtgtg

SEQ ID NO: 8098818 - DNA, 22 bp, Homo sapiens
ctggccagatgttacgtccaat

SEQ ID NO: 8098819 - DNA, 22 bp, Homo sapiens
ctggctgcaggaaggagtgggc

SEQ ID NO: 8098820 - DNA, 22 bp, Homo sapiens
ctggctggagctgttgtaggct

SEQ ID NO: 8098821 - DNA, 22 bp, Homo sapiens
ctggccctcggagtccagctgc

SEQ ID NO: 8098822 - DNA, 22 bp, Homo sapiens
ctggccctcggagtccagctgc

SEQ ID NO: 8098823 - DNA, 19 bp, Homo sapiens
ctggccaggccaggggccc

SEQ ID NO: 8098824 - DNA, 22 bp, Homo sapiens
ctggccctgtggaggcaggaac

SEQ ID NO: 8098825 - DNA, 22 bp, Homo sapiens
ttcaagtcttccatggtattct

SEQ ID NO: 8098826 - DNA, 22 bp, Homo sapiens
ttcaagtgaggctgtctttaga

SEQ ID NO: 8098827 - DNA, 22 bp, Homo sapiens
ttcaagtctgtttcattgcatg

SEQ ID NO: 8098828 - DNA, 22 bp, Homo sapiens
ttcaagtctgcccagagtcagc

SEQ ID NO: 8098829 - DNA, 22 bp, Homo sapiens
cgcccctcagcgacccaccagc

SEQ ID NO: 8098830 - DNA, 18 bp, Homo sapiens
cgccctgctataaatgac

SEQ ID NO: 8098831 - DNA, 18 bp, Homo sapiens
cgccctgctataaatgac

SEQ ID NO: 8098832 - DNA, 22 bp, Homo sapiens
ttcacacagaatctgaggagct

SEQ ID NO: 8098833 - DNA, 22 bp, Homo sapiens
ttcacacacagcttcctattgt

SEQ ID NO: 8098834 - DNA, 22 bp, Homo sapiens
ttcacacacagcttcctattgt

SEQ ID NO: 8098835 - DNA, 22 bp, Homo sapiens
ttcaagttacctttaaacagct

SEQ ID NO: 8098836 - DNA, 22 bp, Homo sapiens
ttaggcatatggcacatgatag

SEQ ID NO: 8098837 - DNA, 22 bp, Homo sapiens
ttaggcctttgattggggtgct

SEQ ID NO: 8098838 - DNA, 22 bp, Homo sapiens
cctttctctttgctgatcatgt

SEQ ID NO: 8098839 - DNA, 22 bp, Homo sapiens
cctttcaaaacagaacactagc

SEQ ID NO: 8098840 - DNA, 22 bp, Homo sapiens
cctttcaaaacagaacactagc

SEQ ID NO: 8098841 - DNA, 22 bp, Homo sapiens
cctttcaaagttttgccatgct

SEQ ID NO: 8098842 - DNA, 22 bp, Homo sapiens
ttcaggatatgtgatatctgaa

SEQ ID NO: 8098843 - DNA, 22 bp, Homo sapiens
ttcagatatcattaatttagta

SEQ ID NO: 8098844 - DNA, 22 bp, Homo sapiens
ttcaggcatccctacagttagg

SEQ ID NO: 8098845 - DNA, 22 bp, Homo sapiens
ttcaggatgctcagagtagtct

SEQ ID NO: 8098846 - DNA, 22 bp, Homo sapiens
ttcaggatgcagaggttgtagt

SEQ ID NO: 8098847 - DNA, 22 bp, Homo sapiens
ttcaggatgaaagtgtgcaaca

SEQ ID NO: 8098848 - DNA, 22 bp, Homo sapiens
ttcagaggctctgccaatgtgt

SEQ ID NO: 8098849 - DNA, 22 bp, Homo sapiens
ttcagaaagtgaatcttgttat

SEQ ID NO: 8098850 - DNA, 22 bp, Homo sapiens
ttcagaaataaaatatcccaac

SEQ ID NO: 8098851 - DNA, 22 bp, Homo sapiens
ttcagaggggctaagtacttgc

SEQ ID NO: 8098852 - DNA, 22 bp, Homo sapiens
ttcagagtaggatactagctta

SEQ ID NO: 8098853 - DNA, 22 bp, Homo sapiens
ctaaataatccctctggtctta

SEQ ID NO: 8098854 - DNA, 22 bp, Homo sapiens
ctaaataatccctctggtctta

SEQ ID NO: 8098855 - DNA, 22 bp, Homo sapiens
cgtattcactcaggacacatag

SEQ ID NO: 8098856 - DNA, 22 bp, Homo sapiens
cgtcacttcttagtctattttc

SEQ ID NO: 8098857 - DNA, 22 bp, Homo sapiens
ctcaagtctattgataagtgca

SEQ ID NO: 8098858 - DNA, 22 bp, Homo sapiens
ctcaagtcagaaataaaagcat

SEQ ID NO: 8098859 - DNA, 22 bp, Homo sapiens
ctcaagtaattagcaacaaata

SEQ ID NO: 8098860 - DNA, 22 bp, Homo sapiens
ctcaagaatctagggaggattc

SEQ ID NO: 8098861 - DNA, 22 bp, Homo sapiens
ctcacagctgcttcaggatcca

SEQ ID NO: 8098862 - DNA, 22 bp, Homo sapiens
ctcacagcacttgtgtcattgg

SEQ ID NO: 8098863 - DNA, 22 bp, Homo sapiens
ctcacagcacttgtgtcattgg

SEQ ID NO: 8098864 - DNA, 22 bp, Homo sapiens
ctcacagcagctctgcgagata

SEQ ID NO: 8098865 - DNA, 22 bp, Homo sapiens
ctcacagatgctgtgggtcagg

SEQ ID NO: 8098866 - DNA, 22 bp, Homo sapiens
ctagccataggaagacacagaa

SEQ ID NO: 8098867 - DNA, 22 bp, Homo sapiens
ctatgtatgcgattagaatttt

SEQ ID NO: 8098868 - DNA, 22 bp, Homo sapiens
ctaccgggttctcagccaggca

SEQ ID NO: 8098869 - DNA, 22 bp, Homo sapiens
ctacctaataatttgatattca

SEQ ID NO: 8098870 - DNA, 22 bp, Homo sapiens
ctactttaattttctgcagaga

SEQ ID NO: 8098871 - DNA, 20 bp, Homo sapiens
ctactttaggcactgagaat

SEQ ID NO: 8098872 - DNA, 22 bp, Homo sapiens
ctactttacctccatcagactg

SEQ ID NO: 8098873 - DNA, 22 bp, Homo sapiens
ctaaatcaggccttacagcttc

SEQ ID NO: 8098874 - DNA, 22 bp, Homo sapiens
ccttcctggagcccatgcagat

SEQ ID NO: 8098875 - DNA, 22 bp, Homo sapiens
ccttcatgtcattggacacctt

SEQ ID NO: 8098876 - DNA, 22 bp, Homo sapiens
ccttcatgatggaaagggttca

SEQ ID NO: 8098877 - DNA, 22 bp, Homo sapiens
cctgtgtgtctgtcactgcaca

SEQ ID NO: 8098878 - DNA, 22 bp, Homo sapiens
ttactaagttttatgcaactta

SEQ ID NO: 8098879 - DNA, 22 bp, Homo sapiens
ttactacaagattctgttttat

SEQ ID NO: 8098880 - DNA, 21 bp, Homo sapiens
ttacttttgcaccaacctaat

SEQ ID NO: 8098881 - DNA, 22 bp, Homo sapiens
ttagaaaaaacgtcttctagtg

SEQ ID NO: 8098882 - DNA, 21 bp, Homo sapiens
ttacttttgcagcaacctaat

SEQ ID NO: 8098883 - DNA, 22 bp, Homo sapiens
cctttacatctgacttctttca

SEQ ID NO: 8098884 - DNA, 20 bp, Homo sapiens
cctttagaaactcatatgta

SEQ ID NO: 8098885 - DNA, 22 bp, Homo sapiens
ttagaaaatttgcttctttgga

SEQ ID NO: 8098886 - DNA, 22 bp, Homo sapiens
ttagaaaaaggctgtggtctta

SEQ ID NO: 8098887 - DNA, 18 bp, Homo sapiens
cctgtgctccagcatctg

SEQ ID NO: 8098888 - DNA, 22 bp, Homo sapiens
ttaaagctgctgaatcctattt

SEQ ID NO: 8098889 - DNA, 22 bp, Homo sapiens
cctgtgctggctttattctcag

SEQ ID NO: 8098890 - DNA, 22 bp, Homo sapiens
cctgtgcttcagctggaggagg

SEQ ID NO: 8098891 - DNA, 20 bp, Homo sapiens
cctgtgcttatcacttgctg

SEQ ID NO: 8098892 - DNA, 22 bp, Homo sapiens
ttaaaggcgataaggcagtgtt

SEQ ID NO: 8098893 - DNA, 22 bp, Homo sapiens
ttaaagtccctgccttaattcc

SEQ ID NO: 8098894 - DNA, 22 bp, Homo sapiens
cctgtgtcagcccctgcctcca

SEQ ID NO: 8098895 - DNA, 22 bp, Homo sapiens
cctgtgtcctaatccatcaggc

SEQ ID NO: 8098896 - DNA, 22 bp, Homo sapiens
tgtttacttttaattacctgtc

SEQ ID NO: 8098897 - DNA, 22 bp, Homo sapiens
tgtttactttccttctcacagg

SEQ ID NO: 8098898 - DNA, 22 bp, Homo sapiens
cctgtctgagccagggtgggca

SEQ ID NO: 8098899 - DNA, 22 bp, Homo sapiens
cctgtctgcaaggggtggatcc

SEQ ID NO: 8098900 - DNA, 20 bp, Homo sapiens
cctgtctgcaatggaggtca

SEQ ID NO: 8098901 - DNA, 22 bp, Homo sapiens
cctgtctgaggaggtgctcttt

SEQ ID NO: 8098902 - DNA, 22 bp, Homo sapiens
cctgtctgcagatatctcaggt

SEQ ID NO: 8098903 - DNA, 22 bp, Homo sapiens
cctgtctggaacatggcctgtt

SEQ ID NO: 8098904 - DNA, 22 bp, Homo sapiens
cctgtctgcatgatccctgcca

SEQ ID NO: 8098905 - DNA, 22 bp, Homo sapiens
cctgtctgttctgactggtcag

SEQ ID NO: 8098906 - DNA, 22 bp, Homo sapiens
cctgtctgtttcattccttgtt

SEQ ID NO: 8098907 - DNA, 22 bp, Homo sapiens
cctgtctgtcctttgcattctt

SEQ ID NO: 8098908 - DNA, 22 bp, Homo sapiens
cctgtctggggactccctgggt

SEQ ID NO: 8098909 - DNA, 22 bp, Homo sapiens
cctgtctggccaccagggcgat

SEQ ID NO: 8098910 - DNA, 22 bp, Homo sapiens
cctgtctgtcctctcatgagcc

SEQ ID NO: 8098911 - DNA, 22 bp, Homo sapiens
cctgtctgtattggtttgctat

SEQ ID NO: 8098912 - DNA, 22 bp, Homo sapiens
cctgtctggtgagggggttgca

SEQ ID NO: 8098913 - DNA, 22 bp, Homo sapiens
cctgtctggggactccctgggt

SEQ ID NO: 8098914 - DNA, 22 bp, Homo sapiens
cctgtctgtattggtttgctat

SEQ ID NO: 8098915 - DNA, 18 bp, Homo sapiens
cctgtctggggtccccac

SEQ ID NO: 8098916 - DNA, 22 bp, Homo sapiens
cctgggctggagtacagcagtg

SEQ ID NO: 8098917 - DNA, 22 bp, Homo sapiens
cctgggctgctcatggggatga

SEQ ID NO: 8098918 - DNA, 22 bp, Homo sapiens
cctgggctctatcctgacccag

SEQ ID NO: 8098919 - DNA, 22 bp, Homo sapiens
cctgggctctgaggagggagtc

SEQ ID NO: 8098920 - DNA, 22 bp, Homo sapiens
cctgggcttacgacctctgact

SEQ ID NO: 8098921 - DNA, 22 bp, Homo sapiens
cctgggctgggcgtctcatggg

SEQ ID NO: 8098922 - DNA, 22 bp, Homo sapiens
cctgggctgtacctgtgcgcgg

SEQ ID NO: 8098923 - DNA, 22 bp, Homo sapiens
tgtttactggaccagggagggg

SEQ ID NO: 8098924 - DNA, 22 bp, Homo sapiens
tgtttactggctcctgtggttc

SEQ ID NO: 8098925 - DNA, 22 bp, Homo sapiens
tgtttacttaaatgttttcata

SEQ ID NO: 8098926 - DNA, 22 bp, Homo sapiens
tgtttacttgaggtggaaacaa

SEQ ID NO: 8098927 - DNA, 22 bp, Homo sapiens
tgtttacttctttccatggctt

SEQ ID NO: 8098928 - DNA, 22 bp, Homo sapiens
tgtttacttatgtgggtcacat

SEQ ID NO: 8098929 - DNA, 22 bp, Homo sapiens
tgtttacttcatcgagtacttc

SEQ ID NO: 8098930 - DNA, 22 bp, Homo sapiens
tgttcattgccccctgtgtaaa

SEQ ID NO: 8098931 - DNA, 22 bp, Homo sapiens
tgttcattctgtgacctggttc

SEQ ID NO: 8098932 - DNA, 22 bp, Homo sapiens
tgttcatttggcccttttgtat

SEQ ID NO: 8098933 - DNA, 20 bp, Homo sapiens
tgttccaagctaatgaatga

SEQ ID NO: 8098934 - DNA, 22 bp, Homo sapiens
tgttcattttgaagtacttcaa

SEQ ID NO: 8098935 - DNA, 22 bp, Homo sapiens
tgttcattattcttcatctgcc

SEQ ID NO: 8098936 - DNA, 22 bp, Homo sapiens
tgttcattcgctattgtctatg

SEQ ID NO: 8098937 - DNA, 22 bp, Homo sapiens
tgttccaataaggagttgaaat

SEQ ID NO: 8098938 - DNA, 18 bp, Homo sapiens
tgttccaaggaaggaatc

SEQ ID NO: 8098939 - DNA, 22 bp, Homo sapiens
tgttcatctggcaggcatagcc

SEQ ID NO: 8098940 - DNA, 22 bp, Homo sapiens
tgttcattaaactactgtgtgg

SEQ ID NO: 8098941 - DNA, 22 bp, Homo sapiens
tgttacagtcattgttttctga

SEQ ID NO: 8098942 - DNA, 22 bp, Homo sapiens
tgttacagtactacaattctgc

SEQ ID NO: 8098943 - DNA, 22 bp, Homo sapiens
tgttacagaaatattgcttctt

SEQ ID NO: 8098944 - DNA, 22 bp, Homo sapiens
tgttacaatattatcaactgag

SEQ ID NO: 8098945 - DNA, 22 bp, Homo sapiens
cctgggcaaattatgttactca

SEQ ID NO: 8098946 - DNA, 22 bp, Homo sapiens
cctgggcaacatagggagaccc

SEQ ID NO: 8098947 - DNA, 22 bp, Homo sapiens
cctgggcaatatagtgaggccc

SEQ ID NO: 8098948 - DNA, 22 bp, Homo sapiens
cctgggagtgtgccatctctgt

SEQ ID NO: 8098949 - DNA, 23 bp, Homo sapiens
tggggccaagtgaggaagggtct

SEQ ID NO: 8098950 - DNA, 22 bp, Homo sapiens
tggggcttctcctgtaggctca

SEQ ID NO: 8098951 - DNA, 22 bp, Homo sapiens
ctgagccatgagcctgcgccca

SEQ ID NO: 8098952 - DNA, 23 bp, Homo sapiens
ctgactcatcccaccacctcctc

SEQ ID NO: 8098953 - DNA, 22 bp, Homo sapiens
ctgactctcctcaagcataaat

SEQ ID NO: 8098954 - DNA, 20 bp, Homo sapiens
ctgagcccccagcctgcagg

SEQ ID NO: 8098955 - DNA, 22 bp, Homo sapiens
ctgagcccattgggtgctgtta

SEQ ID NO: 8098956 - DNA, 20 bp, Homo sapiens
ctgagcccttcctgtgaacc

SEQ ID NO: 8098957 - DNA, 22 bp, Homo sapiens
ctgagcctgtgtttctctggca

SEQ ID NO: 8098958 - DNA, 22 bp, Homo sapiens
ctgagcctcctgcttctatttc

SEQ ID NO: 8098959 - DNA, 22 bp, Homo sapiens
ctgaccagtccttagcacctgg

SEQ ID NO: 8098960 - DNA, 20 bp, Homo sapiens
ctgaccagcagcctgtctcc

SEQ ID NO: 8098961 - DNA, 22 bp, Homo sapiens
ctgacagatgctgctggcagta

SEQ ID NO: 8098962 - DNA, 22 bp, Homo sapiens
ctgacagctgttgcagtgaatg

SEQ ID NO: 8098963 - DNA, 22 bp, Homo sapiens
ctgacagctgaattgcttgcat

SEQ ID NO: 8098964 - DNA, 22 bp, Homo sapiens
ctgacagctgctgccgccgcat

SEQ ID NO: 8098965 - DNA, 22 bp, Homo sapiens
ctgacagcaaaggccagtggct

SEQ ID NO: 8098966 - DNA, 22 bp, Homo sapiens
ctgacagcgagagagttgcccc

SEQ ID NO: 8098967 - DNA, 22 bp, Homo sapiens
ctgacagccatgttttagagaa

SEQ ID NO: 8098968 - DNA, 22 bp, Homo sapiens
ctgacagcagcaaatggagata

SEQ ID NO: 8098969 - DNA, 22 bp, Homo sapiens
ctgacagctcctagtgctcact

SEQ ID NO: 8098970 - DNA, 22 bp, Homo sapiens
ctgacagctatttttgtagata

SEQ ID NO: 8098971 - DNA, 19 bp, Homo sapiens
ctgacagcgcctgataaga

SEQ ID NO: 8098972 - DNA, 22 bp, Homo sapiens
ctgacagctctggctagtagaa

SEQ ID NO: 8098973 - DNA, 22 bp, Homo sapiens
ctgacagctgaagggtcccaga

SEQ ID NO: 8098974 - DNA, 22 bp, Homo sapiens
ctctttctggaaggcagagtgg

SEQ ID NO: 8098975 - DNA, 21 bp, Homo sapiens
ctctttatatagtaaagatat

SEQ ID NO: 8098976 - DNA, 17 bp, Homo sapiens
ctctttataaagagtta

SEQ ID NO: 8098977 - DNA, 19 bp, Homo sapiens
ctgcagggatgtgcagagt

SEQ ID NO: 8098978 - DNA, 22 bp, Homo sapiens
ctgcacatgttcatcatgacaa

SEQ ID NO: 8098979 - DNA, 22 bp, Homo sapiens
ctgcacagtgttggaagctgcc

SEQ ID NO: 8098980 - DNA, 22 bp, Homo sapiens
ctgcactgagcatctaacctta

SEQ ID NO: 8098981 - DNA, 22 bp, Homo sapiens
ctgcactgacttccccggctgc

SEQ ID NO: 8098982 - DNA, 20 bp, Homo sapiens
ctgcactgaacatgtctgag

SEQ ID NO: 8098983 - DNA, 18 bp, Homo sapiens
ctgaggcccagagagggc

SEQ ID NO: 8098984 - DNA, 17 bp, Homo sapiens
ctgaggcccagggccca

SEQ ID NO: 8098985 - DNA, 22 bp, Homo sapiens
ctgaggccagctgcagagctct

SEQ ID NO: 8098986 - DNA, 22 bp, Homo sapiens
ctgaggcccctcttgtgagcat

SEQ ID NO: 8098987 - DNA, 19 bp, Homo sapiens
ctgaggcccatgtaccatg

SEQ ID NO: 8098988 - DNA, 22 bp, Homo sapiens
ctgaggcccctctcttgagctt

SEQ ID NO: 8098989 - DNA, 22 bp, Homo sapiens
ctgaggccagctgcagagctct

SEQ ID NO: 8098990 - DNA, 18 bp, Homo sapiens
ctgaggccaactacactg

SEQ ID NO: 8098991 - DNA, 22 bp, Homo sapiens
ctgaggcatgggaagttgggtg

SEQ ID NO: 8098992 - DNA, 22 bp, Homo sapiens
ctgcacagctgggcaagatata

SEQ ID NO: 8098993 - DNA, 22 bp, Homo sapiens
ctgcacagtaagcttcagagat

SEQ ID NO: 8098994 - DNA, 22 bp, Homo sapiens
ctgaggccggagcactgaagag

SEQ ID NO: 8098995 - DNA, 22 bp, Homo sapiens
ctgcacagagcagggcagacac

SEQ ID NO: 8098996 - DNA, 22 bp, Homo sapiens
ctgcacagccctcaagagcctg

SEQ ID NO: 8098997 - DNA, 22 bp, Homo sapiens
ctgcacagaggtcggtctgcca

SEQ ID NO: 8098998 - DNA, 19 bp, Homo sapiens
ctctgcctccctcctgggt

SEQ ID NO: 8098999 - DNA, 22 bp, Homo sapiens
tttgccaggcttgcatgaattt

SEQ ID NO: 8099000 - DNA, 22 bp, Homo sapiens
ctctgccatttatcagaactgt

SEQ ID NO: 8099001 - DNA, 22 bp, Homo sapiens
ctctgccagccaaagtcatcac

SEQ ID NO: 8099002 - DNA, 22 bp, Homo sapiens
ctctgccaggcagaacggcttt

SEQ ID NO: 8099003 - DNA, 22 bp, Homo sapiens
ctctgccactcgaagtcaagga

SEQ ID NO: 8099004 - DNA, 22 bp, Homo sapiens
ctctgccagtttctggcctcag

SEQ ID NO: 8099005 - DNA, 22 bp, Homo sapiens
tttcctttccaaaattctgcct

SEQ ID NO: 8099006 - DNA, 22 bp, Homo sapiens
tttgccaggtaagtactatgct

SEQ ID NO: 8099007 - DNA, 22 bp, Homo sapiens
tttgccaggcttgcatgaattt

SEQ ID NO: 8099008 - DNA, 22 bp, Homo sapiens
tttgccagtattttattgatga

SEQ ID NO: 8099009 - DNA, 22 bp, Homo sapiens
ttttaatactgctattgtagga

SEQ ID NO: 8099010 - DNA, 22 bp, Homo sapiens
ttttaagttaatataattgagg

SEQ ID NO: 8099011 - DNA, 22 bp, Homo sapiens
ttttagatagtttaactgcact

SEQ ID NO: 8099012 - DNA, 22 bp, Homo sapiens
tttgtacacaggtcattcaggg

SEQ ID NO: 8099013 - DNA, 20 bp, Homo sapiens
ctcttattgcattagtttct

SEQ ID NO: 8099014 - DNA, 22 bp, Homo sapiens
ctcttcaaaagtctaatcctta

SEQ ID NO: 8099015 - DNA, 20 bp, Homo sapiens
ctcttattgcattagtttct

SEQ ID NO: 8099016 - DNA, 22 bp, Homo sapiens
ctctgtttctcagcctatttcc

SEQ ID NO: 8099017 - DNA, 22 bp, Homo sapiens
ctcttcaactgccaggcagtct

SEQ ID NO: 8099018 - DNA, 22 bp, Homo sapiens
ctcttcaaatgatttccttagg

SEQ ID NO: 8099019 - DNA, 22 bp, Homo sapiens
ctcttccatttctacttcacag

SEQ ID NO: 8099020 - DNA, 22 bp, Homo sapiens
ctcttccatattactcagggta

SEQ ID NO: 8099021 - DNA, 22 bp, Homo sapiens
ttttcagttactgtttatgtga

SEQ ID NO: 8099022 - DNA, 22 bp, Homo sapiens
ctcttcttggaatgctgactgt

SEQ ID NO: 8099023 - DNA, 21 bp, Homo sapiens
ctcttgtctttgctcagtagc

SEQ ID NO: 8099024 - DNA, 22 bp, Homo sapiens
ctcttgtggtttataaagatat

SEQ ID NO: 8099025 - DNA, 21 bp, Homo sapiens
ctcttgtgtcagagccagagg

SEQ ID NO: 8099026 - DNA, 22 bp, Homo sapiens
ttttcagaggcctaagaggttt

SEQ ID NO: 8099027 - DNA, 22 bp, Homo sapiens
ttttcaggccagaagatagacc

SEQ ID NO: 8099028 - DNA, 22 bp, Homo sapiens
ttttcaggtacatcacatactg

SEQ ID NO: 8099029 - DNA, 22 bp, Homo sapiens
ttttcagtgggcaatgatgtga

SEQ ID NO: 8099030 - DNA, 22 bp, Homo sapiens
ttttcagtaatgtctacataat

SEQ ID NO: 8099031 - DNA, 22 bp, Homo sapiens
ttttcagaattagcataccatt

SEQ ID NO: 8099032 - DNA, 22 bp, Homo sapiens
ttttcagagagcttttatgtcc

SEQ ID NO: 8099033 - DNA, 22 bp, Homo sapiens
ttttcagagagcttttatgtcc

SEQ ID NO: 8099034 - DNA, 22 bp, Homo sapiens
tttcacaggtaagcaatacagg

SEQ ID NO: 8099035 - DNA, 22 bp, Homo sapiens
tttcacaggtaagcaatacagg

SEQ ID NO: 8099036 - DNA, 22 bp, Homo sapiens
tttcacaggtacaaacactcct

SEQ ID NO: 8099037 - DNA, 22 bp, Homo sapiens
tttcacaggtatccacgggtct

SEQ ID NO: 8099038 - DNA, 22 bp, Homo sapiens
tttcacaaagcatagcacttta

SEQ ID NO: 8099039 - DNA, 19 bp, Homo sapiens
tttcacaaagagagcgtga

SEQ ID NO: 8099040 - DNA, 22 bp, Homo sapiens
tttcaatttccaggctagaatt

SEQ ID NO: 8099041 - DNA, 22 bp, Homo sapiens
tttcaattccaccaaagcgccc

SEQ ID NO: 8099042 - DNA, 22 bp, Homo sapiens
tttcctacccttccaggcagag

SEQ ID NO: 8099043 - DNA, 20 bp, Homo sapiens
tttcacagtccctgtttcct

SEQ ID NO: 8099044 - DNA, 22 bp, Homo sapiens
tttcacagtcaatttggagtca

SEQ ID NO: 8099045 - DNA, 22 bp, Homo sapiens
tttcacagtagaaatcattatg

SEQ ID NO: 8099046 - DNA, 22 bp, Homo sapiens
tttcacagtgctctgtaagtat

SEQ ID NO: 8099047 - DNA, 22 bp, Homo sapiens
tttcacagttagcatgaggact

SEQ ID NO: 8099048 - DNA, 22 bp, Homo sapiens
tttcacagttagcatgaggact

SEQ ID NO: 8099049 - DNA, 22 bp, Homo sapiens
tttcacataaatggagtaaaga

SEQ ID NO: 8099050 - DNA, 22 bp, Homo sapiens
ctcctccagtgggtccctcagg

SEQ ID NO: 8099051 - DNA, 22 bp, Homo sapiens
tttattccagtgtttctcaaat

SEQ ID NO: 8099052 - DNA, 22 bp, Homo sapiens
tttattccatgtgtctatgacc

SEQ ID NO: 8099053 - DNA, 22 bp, Homo sapiens
tttatttaaagtcgtgtgttaa

SEQ ID NO: 8099054 - DNA, 22 bp, Homo sapiens
ctccctcacaaagcattctctt

SEQ ID NO: 8099055 - DNA, 22 bp, Homo sapiens
ctcccctgagcatagactctgt

SEQ ID NO: 8099056 - DNA, 22 bp, Homo sapiens
tttagtattctctatttccatc

SEQ ID NO: 8099057 - DNA, 18 bp, Homo sapiens
ctcctccacagcccctgc

SEQ ID NO: 8099058 - DNA, 22 bp, Homo sapiens
tttaatatctcacacttccatg

SEQ ID NO: 8099059 - DNA, 22 bp, Homo sapiens
tttaatatccagtggatacaaa

SEQ ID NO: 8099060 - DNA, 22 bp, Homo sapiens
tttaatactatggggatgaaca

SEQ ID NO: 8099061 - DNA, 22 bp, Homo sapiens
ctcccactcctggctcaccaca

SEQ ID NO: 8099062 - DNA, 20 bp, Homo sapiens
ctccagcccctgccctggtc

SEQ ID NO: 8099063 - DNA, 22 bp, Homo sapiens
ctccagccagagtgcctctgtt

SEQ ID NO: 8099064 - DNA, 22 bp, Homo sapiens
ttgtcttagagtgaaaacttta

SEQ ID NO: 8099065 - DNA, 22 bp, Homo sapiens
ttgtctttggaaatttaatgtt

SEQ ID NO: 8099066 - DNA, 22 bp, Homo sapiens
ttgtctttcccagcttctagag

SEQ ID NO: 8099067 - DNA, 22 bp, Homo sapiens
ttgaaatagatgcgtcagagat

SEQ ID NO: 8099068 - DNA, 22 bp, Homo sapiens
ttcttttcctacacagcgattt

SEQ ID NO: 8099069 - DNA, 18 bp, Homo sapiens
ttcttttcatgtgatctc

SEQ ID NO: 8099070 - DNA, 22 bp, Homo sapiens
ttcttttcccaatattttgctg

SEQ ID NO: 8099071 - DNA, 22 bp, Homo sapiens
ttcttttcctgtggctcatcca

SEQ ID NO: 8099072 - DNA, 22 bp, Homo sapiens
ttcttttcggcctgtgagaagg

SEQ ID NO: 8099073 - DNA, 22 bp, Homo sapiens
ttgaaagggttaaagtggtaaa

SEQ ID NO: 8099074 - DNA, 22 bp, Homo sapiens
ttcttttcaagaggggcaagga

SEQ ID NO: 8099075 - DNA, 22 bp, Homo sapiens
ttctttcttagcaatctatggt

SEQ ID NO: 8099076 - DNA, 22 bp, Homo sapiens
ttgtacaaataggaacctctga

SEQ ID NO: 8099077 - DNA, 22 bp, Homo sapiens
ctccagattccgtttattcagg

SEQ ID NO: 8099078 - DNA, 22 bp, Homo sapiens
ttgtacaaagatttcacagctc

SEQ ID NO: 8099079 - DNA, 23 bp, Homo sapiens
ctccaaggcccaactgtctaggc

SEQ ID NO: 8099080 - DNA, 18 bp, Homo sapiens
ctccaaggtctctggctt

SEQ ID NO: 8099081 - DNA, 22 bp, Homo sapiens
tcctgggactttcaaggctagg

SEQ ID NO: 8099082 - DNA, 22 bp, Homo sapiens
tcctgggagacccagctgtgga

SEQ ID NO: 8099083 - DNA, 22 bp, Homo sapiens
tcctgggagagtgggactgtat

SEQ ID NO: 8099084 - DNA, 22 bp, Homo sapiens
tcctgggactctttatcagaga

SEQ ID NO: 8099085 - DNA, 22 bp, Homo sapiens
tcctgggagcacatggtcctgc

SEQ ID NO: 8099086 - DNA, 22 bp, Homo sapiens
tcctgggagagtttgattcatt

SEQ ID NO: 8099087 - DNA, 22 bp, Homo sapiens
tcctgggagcatgaagagggat

SEQ ID NO: 8099088 - DNA, 22 bp, Homo sapiens
tcctgggagcatggtgccgtga

SEQ ID NO: 8099089 - DNA, 22 bp, Homo sapiens
tcctgggagcccttgctccacc

SEQ ID NO: 8099090 - DNA, 22 bp, Homo sapiens
ccacactttgagatgactagga

SEQ ID NO: 8099091 - DNA, 18 bp, Homo sapiens
tcctggcagtcagagagg

SEQ ID NO: 8099092 - DNA, 22 bp, Homo sapiens
ccaaggctgaggtttccagttg

SEQ ID NO: 8099093 - DNA, 22 bp, Homo sapiens
tcctaagatagaagatagtgaa

SEQ ID NO: 8099094 - DNA, 22 bp, Homo sapiens
tccttcatgatgcttagcagag

SEQ ID NO: 8099095 - DNA, 22 bp, Homo sapiens
tccttaaagtgcacctcctcat

SEQ ID NO: 8099096 - DNA, 22 bp, Homo sapiens
tcctgggcttcacagactctgt

SEQ ID NO: 8099097 - DNA, 22 bp, Homo sapiens
ccactgtgcccagcctcatggg

SEQ ID NO: 8099098 - DNA, 22 bp, Homo sapiens
ccactgtttttcagttaacttt

SEQ ID NO: 8099099 - DNA, 22 bp, Homo sapiens
ccactgtttttcagttaacttt

SEQ ID NO: 8099100 - DNA, 22 bp, Homo sapiens
tctaaggccttcatgtcagtat

SEQ ID NO: 8099101 - DNA, 22 bp, Homo sapiens
catgggctacagaagcatgctg

SEQ ID NO: 8099102 - DNA, 22 bp, Homo sapiens
catgggccagagctcctctggg

SEQ ID NO: 8099103 - DNA, 22 bp, Homo sapiens
tccatcaccacagaggacagag

SEQ ID NO: 8099104 - DNA, 22 bp, Homo sapiens
tccattttcatctcatgtataa

SEQ ID NO: 8099105 - DNA, 22 bp, Homo sapiens
catgggaggtctgcaaggtgct

SEQ ID NO: 8099106 - DNA, 22 bp, Homo sapiens
catgggaggttggcttggcatg

SEQ ID NO: 8099107 - DNA, 22 bp, Homo sapiens
cattctgagctaatatgcttat

SEQ ID NO: 8099108 - DNA, 22 bp, Homo sapiens
cattctgaccctatgatttaag

SEQ ID NO: 8099109 - DNA, 22 bp, Homo sapiens
tcccacccatcctgcatctctt

SEQ ID NO: 8099110 - DNA, 22 bp, Homo sapiens
tcccaccccggtcaagggctga

SEQ ID NO: 8099111 - DNA, 22 bp, Homo sapiens
cattctcaatagtagatgagta

SEQ ID NO: 8099112 - DNA, 21 bp, Homo sapiens
cattagggcagaagcaggaag

SEQ ID NO: 8099113 - DNA, 22 bp, Homo sapiens
cattgttaattggtatcttaca

SEQ ID NO: 8099114 - DNA, 22 bp, Homo sapiens
tcccactattatcctatgtggg

SEQ ID NO: 8099115 - DNA, 22 bp, Homo sapiens
catttaatctggctcatgagca

SEQ ID NO: 8099116 - DNA, 22 bp, Homo sapiens
catttaatcctcacaagcctat

SEQ ID NO: 8099117 - DNA, 22 bp, Homo sapiens
catttattcatgatctgtagct

SEQ ID NO: 8099118 - DNA, 22 bp, Homo sapiens
tcagatcacaaaagtttctatt

SEQ ID NO: 8099119 - DNA, 22 bp, Homo sapiens
tcagatcatttgtggattcact

SEQ ID NO: 8099120 - DNA, 22 bp, Homo sapiens
tcagatcatcagctgctttata

SEQ ID NO: 8099121 - DNA, 17 bp, Homo sapiens
cataaaacagttctatt

SEQ ID NO: 8099122 - DNA, 22 bp, Homo sapiens
cataaaaggtagcagtttgaaa

SEQ ID NO: 8099123 - DNA, 22 bp, Homo sapiens
tcagaggagatggttaccaggg

SEQ ID NO: 8099124 - DNA, 22 bp, Homo sapiens
tcagaggagctgcagaacgctg

SEQ ID NO: 8099125 - DNA, 22 bp, Homo sapiens
tcagaggagccaaagttctgag

SEQ ID NO: 8099126 - DNA, 22 bp, Homo sapiens
tcagaggagcaaaagaggggat

SEQ ID NO: 8099127 - DNA, 22 bp, Homo sapiens
tcagaggatcatgtccctactc

SEQ ID NO: 8099128 - DNA, 23 bp, Homo sapiens
tcagaggatcatcaaacgttttc

SEQ ID NO: 8099129 - DNA, 22 bp, Homo sapiens
tcagaggatagaaatacttatt

SEQ ID NO: 8099130 - DNA, 22 bp, Homo sapiens
tcagaggaggcatttaaacaga

SEQ ID NO: 8099131 - DNA, 22 bp, Homo sapiens
tcagaggagggactcagaccca

SEQ ID NO: 8099132 - DNA, 21 bp, Homo sapiens
tcagataccagactcaagggg

SEQ ID NO: 8099133 - DNA, 22 bp, Homo sapiens
tcagaggatgctgttctttaat

SEQ ID NO: 8099134 - DNA, 22 bp, Homo sapiens
tcagaggattgcctcagcgagc

SEQ ID NO: 8099135 - DNA, 22 bp, Homo sapiens
cagttagaggaggtaaagatgc

SEQ ID NO: 8099136 - DNA, 22 bp, Homo sapiens
tcaatatagcagtgtacttgag

SEQ ID NO: 8099137 - DNA, 22 bp, Homo sapiens
tcaatctagagattaaaatagg

SEQ ID NO: 8099138 - DNA, 18 bp, Homo sapiens
tcagagcaaacagaagcc

SEQ ID NO: 8099139 - DNA, 22 bp, Homo sapiens
tcagagagttacacaaattgtt

SEQ ID NO: 8099140 - DNA, 22 bp, Homo sapiens
tcagagagttggaaagaattaa

SEQ ID NO: 8099141 - DNA, 22 bp, Homo sapiens
tcagagaggttggtgataagaa

SEQ ID NO: 8099142 - DNA, 21 bp, Homo sapiens
tcagagagtcacagtgaactg

SEQ ID NO: 8099143 - DNA, 22 bp, Homo sapiens
tcagagagtgcaaaatatagct

SEQ ID NO: 8099144 - DNA, 22 bp, Homo sapiens
tcagcagtcaaagagaatctct

SEQ ID NO: 8099145 - DNA, 22 bp, Homo sapiens
cataatatctccgattacttgc

SEQ ID NO: 8099146 - DNA, 18 bp, Homo sapiens
cataattttctttcttta

SEQ ID NO: 8099147 - DNA, 22 bp, Homo sapiens
cataattactgatatgctgatt

SEQ ID NO: 8099148 - DNA, 22 bp, Homo sapiens
tcaggcctcagcagcccacagg

SEQ ID NO: 8099149 - DNA, 22 bp, Homo sapiens
catagaaactgagacaaggatt

SEQ ID NO: 8099150 - DNA, 22 bp, Homo sapiens
catagaaatcaggtgagaatct

SEQ ID NO: 8099151 - DNA, 17 bp, Homo sapiens
tcaggctgtgcctggta

SEQ ID NO: 8099152 - DNA, 22 bp, Homo sapiens
tcaggctgtgggcactggccat

SEQ ID NO: 8099153 - DNA, 23 bp, Homo sapiens
catggcagcaagagctcatggcc

SEQ ID NO: 8099154 - DNA, 22 bp, Homo sapiens
catgcattacaattgcatagta

SEQ ID NO: 8099155 - DNA, 22 bp, Homo sapiens
catggcaggaggctgctggcag

SEQ ID NO: 8099156 - DNA, 22 bp, Homo sapiens
catggcaggtgcagattctgtg

SEQ ID NO: 8099157 - DNA, 22 bp, Homo sapiens
catggcagggctgtgggcaggt

SEQ ID NO: 8099158 - DNA, 22 bp, Homo sapiens
catgcaggcctatggagcagtg

SEQ ID NO: 8099159 - DNA, 20 bp, Homo sapiens
catgacactgttcctctgcc

SEQ ID NO: 8099160 - DNA, 22 bp, Homo sapiens
catgcagtgatgcactgcatca

SEQ ID NO: 8099161 - DNA, 22 bp, Homo sapiens
catgcagtgcctctggattctt

SEQ ID NO: 8099162 - DNA, 22 bp, Homo sapiens
catgcagtgtgtatctacttaa

SEQ ID NO: 8099163 - DNA, 22 bp, Homo sapiens
catgcagtttctctatgcgtag

SEQ ID NO: 8099164 - DNA, 22 bp, Homo sapiens
catgaacagctaacattttggg

SEQ ID NO: 8099165 - DNA, 22 bp, Homo sapiens
catgaacatttgtttacatctg

SEQ ID NO: 8099166 - DNA, 22 bp, Homo sapiens
catgaactccaagcttccttcc

SEQ ID NO: 8099167 - DNA, 22 bp, Homo sapiens
catcttaaaatgtgtcataact

SEQ ID NO: 8099168 - DNA, 22 bp, Homo sapiens
catctgaatttgccttagtttc

SEQ ID NO: 8099169 - DNA, 22 bp, Homo sapiens
tcagtatttctaaacattggct

SEQ ID NO: 8099170 - DNA, 22 bp, Homo sapiens
tcagggattgcaaaattcatcc

SEQ ID NO: 8099171 - DNA, 22 bp, Homo sapiens
tcagtcattgtccttaaaacac

SEQ ID NO: 8099172 - DNA, 22 bp, Homo sapiens
tcagtcaggttctgatttctgg

SEQ ID NO: 8099173 - DNA, 22 bp, Homo sapiens
tcagtccctcgcaccctgccat

SEQ ID NO: 8099174 - DNA, 22 bp, Homo sapiens
tattttacagactactttagat

SEQ ID NO: 8099175 - DNA, 22 bp, Homo sapiens
cagtcagaggtcttctaaaaca

SEQ ID NO: 8099176 - DNA, 22 bp, Homo sapiens
cagtcacttacaaaaatataat

SEQ ID NO: 8099177 - DNA, 22 bp, Homo sapiens
cagtcagagtcacagtaatttg

SEQ ID NO: 8099178 - DNA, 22 bp, Homo sapiens
cagtcattttatttgaaaatta

SEQ ID NO: 8099179 - DNA, 22 bp, Homo sapiens
cagtcattcctaaccaagaaca

SEQ ID NO: 8099180 - DNA, 22 bp, Homo sapiens
cagtcagtcaatactctttgag

SEQ ID NO: 8099181 - DNA, 22 bp, Homo sapiens
cagtcacatttcgacataacta

SEQ ID NO: 8099182 - DNA, 22 bp, Homo sapiens
cagtcaaacttataggcacatt

SEQ ID NO: 8099183 - DNA, 22 bp, Homo sapiens
cagtcaacagagagcccgtcag

SEQ ID NO: 8099184 - DNA, 22 bp, Homo sapiens
tcaaaaattttctgaggatgag

SEQ ID NO: 8099185 - DNA, 22 bp, Homo sapiens
tcaaaacaatcattggatgtgc

SEQ ID NO: 8099186 - DNA, 22 bp, Homo sapiens
tcaaaacactattacctttaat

SEQ ID NO: 8099187 - DNA, 22 bp, Homo sapiens
tcaaaaatgttttatattggta

SEQ ID NO: 8099188 - DNA, 22 bp, Homo sapiens
tattttaggtaatatccattgt

SEQ ID NO: 8099189 - DNA, 22 bp, Homo sapiens
tcaagcagagtcaaaagtacca

SEQ ID NO: 8099190 - DNA, 22 bp, Homo sapiens
tcaagctacaaccatattcatt

SEQ ID NO: 8099191 - DNA, 22 bp, Homo sapiens
caggtaaaggttaactattaga

SEQ ID NO: 8099192 - DNA, 19 bp, Homo sapiens
caggtaacatatgcacaaa

SEQ ID NO: 8099193 - DNA, 22 bp, Homo sapiens
caggtcagaggtagatgagatg

SEQ ID NO: 8099194 - DNA, 22 bp, Homo sapiens
caggtgccgggaatgcagcaat

SEQ ID NO: 8099195 - DNA, 23 bp, Homo sapiens
caggtggctccacgaggggtggg

SEQ ID NO: 8099196 - DNA, 22 bp, Homo sapiens
caggtggctaacggcctcatag

SEQ ID NO: 8099197 - DNA, 22 bp, Homo sapiens
caggtgggtacatcacagagac

SEQ ID NO: 8099198 - DNA, 18 bp, Homo sapiens
caggtgggtctcctgccc

SEQ ID NO: 8099199 - DNA, 22 bp, Homo sapiens
cagggcctcatggccggggtgc

SEQ ID NO: 8099200 - DNA, 22 bp, Homo sapiens
cagggcccagtccctgctgtca

SEQ ID NO: 8099201 - DNA, 22 bp, Homo sapiens
tagctttaaaaatcatcaaagc

SEQ ID NO: 8099202 - DNA, 22 bp, Homo sapiens
tagcttgttacacagcaatgtt

SEQ ID NO: 8099203 - DNA, 22 bp, Homo sapiens
tagcttgtcagtgaatagctgt

SEQ ID NO: 8099204 - DNA, 22 bp, Homo sapiens
tagcttgtactgcagtagagaa

SEQ ID NO: 8099205 - DNA, 21 bp, Homo sapiens
tagcttcttgaggcttggccg

SEQ ID NO: 8099206 - DNA, 22 bp, Homo sapiens
tagcttatcccacagtgcccag

SEQ ID NO: 8099207 - DNA, 22 bp, Homo sapiens
caggggtgtttttggccaggag

SEQ ID NO: 8099208 - DNA, 22 bp, Homo sapiens
cagggctgtctccaaaggcccc

SEQ ID NO: 8099209 - DNA, 22 bp, Homo sapiens
taggctgggcctgccttccagg

SEQ ID NO: 8099210 - DNA, 18 bp, Homo sapiens
taggctgggggctgtagt

SEQ ID NO: 8099211 - DNA, 22 bp, Homo sapiens
taggctgggctgagctggacgg

SEQ ID NO: 8099212 - DNA, 22 bp, Homo sapiens
caggctttactttctctctgaa

SEQ ID NO: 8099213 - DNA, 22 bp, Homo sapiens
cagggaagagccgatgctgcag

SEQ ID NO: 8099214 - DNA, 22 bp, Homo sapiens
cagggacagacagatatatttg

SEQ ID NO: 8099215 - DNA, 22 bp, Homo sapiens
tagattcagatatttaggacaa

SEQ ID NO: 8099216 - DNA, 22 bp, Homo sapiens
tagattctgtttcctctggttt

SEQ ID NO: 8099217 - DNA, 22 bp, Homo sapiens
tagaaacaaagacctgggtgct

SEQ ID NO: 8099218 - DNA, 22 bp, Homo sapiens
caggctggagttcagtggtgtg

SEQ ID NO: 8099219 - DNA, 22 bp, Homo sapiens
caggctggagtgcagtggtgcc

SEQ ID NO: 8099220 - DNA, 22 bp, Homo sapiens
caggctgccaaggctggggagg

SEQ ID NO: 8099221 - DNA, 22 bp, Homo sapiens
caggctgccgtgaagcaggcct

SEQ ID NO: 8099222 - DNA, 22 bp, Homo sapiens
tacattgttcatgcatgagaaa

SEQ ID NO: 8099223 - DNA, 20 bp, Homo sapiens
tacattgtgagactaatgga

SEQ ID NO: 8099224 - DNA, 22 bp, Homo sapiens
tacattgtgataggaagtcacc

SEQ ID NO: 8099225 - DNA, 22 bp, Homo sapiens
tacattgtgatgtttcaataca

SEQ ID NO: 8099226 - DNA, 22 bp, Homo sapiens
tactttatcagcgtcaaaggta

SEQ ID NO: 8099227 - DNA, 22 bp, Homo sapiens
caggcccaggccagtggttccc

SEQ ID NO: 8099228 - DNA, 22 bp, Homo sapiens
caggcctctatggtcagctgag

SEQ ID NO: 8099229 - DNA, 22 bp, Homo sapiens
caggcctgcttcttacccttca

SEQ ID NO: 8099230 - DNA, 22 bp, Homo sapiens
caggcagggagctggaaaggat

SEQ ID NO: 8099231 - DNA, 22 bp, Homo sapiens
taatgtaggggtgtaacacaca

SEQ ID NO: 8099232 - DNA, 22 bp, Homo sapiens
caggcccactgcttgtctagtc

SEQ ID NO: 8099233 - DNA, 22 bp, Homo sapiens
caggcccaaatgcaaccttctt

SEQ ID NO: 8099234 - DNA, 22 bp, Homo sapiens
tacaaaagtaattacggttttt

SEQ ID NO: 8099235 - DNA, 22 bp, Homo sapiens
taatacaatggagttgggcccc

SEQ ID NO: 8099236 - DNA, 22 bp, Homo sapiens
taatacaaggcaggaagcagta

SEQ ID NO: 8099237 - DNA, 21 bp, Homo sapiens
taataattccactacagagta

SEQ ID NO: 8099238 - DNA, 22 bp, Homo sapiens
taagtcataagtcatgatgtta

SEQ ID NO: 8099239 - DNA, 22 bp, Homo sapiens
taagtcatagattaatggccac

SEQ ID NO: 8099240 - DNA, 22 bp, Homo sapiens
taagtcatcacattgcagagat

SEQ ID NO: 8099241 - DNA, 22 bp, Homo sapiens
taagtcatgattctgtgttact

SEQ ID NO: 8099242 - DNA, 22 bp, Homo sapiens
taagtcataagtcaacaaagga

SEQ ID NO: 8099243 - DNA, 22 bp, Homo sapiens
taagtcagtagaactgtggtca

SEQ ID NO: 8099244 - DNA, 22 bp, Homo sapiens
taagtcaggaggtctcctgaca

SEQ ID NO: 8099245 - DNA, 18 bp, Homo sapiens
taagtcattttgccagca

SEQ ID NO: 8099246 - DNA, 22 bp, Homo sapiens
taagtcatggagctgggattga

SEQ ID NO: 8099247 - DNA, 22 bp, Homo sapiens
taagtcatcccataacagtgct

SEQ ID NO: 8099248 - DNA, 18 bp, Homo sapiens
taagtcatttgaaatgcc

SEQ ID NO: 8099249 - DNA, 22 bp, Homo sapiens
taagtcatttggagccactgga

SEQ ID NO: 8099250 - DNA, 22 bp, Homo sapiens
taagtcattaggctgagttcaa

SEQ ID NO: 8099251 - DNA, 22 bp, Homo sapiens
cagctattggtccacaggtatg

SEQ ID NO: 8099252 - DNA, 22 bp, Homo sapiens
tgagacgaagtcttgctctgtt

SEQ ID NO: 8099253 - DNA, 22 bp, Homo sapiens
tgagacagttctgcagctgggt

SEQ ID NO: 8099254 - DNA, 22 bp, Homo sapiens
tgagaatattgttttagtgagg

SEQ ID NO: 8099255 - DNA, 22 bp, Homo sapiens
tgagaatagaaagagctgtcat

SEQ ID NO: 8099256 - DNA, 22 bp, Homo sapiens
tgagaatagcaaaagctgtcag

SEQ ID NO: 8099257 - DNA, 22 bp, Homo sapiens
ccaggggttggaggttgcagtg

SEQ ID NO: 8099258 - DNA, 22 bp, Homo sapiens
ccaggctggagtgcagtggcac

SEQ ID NO: 8099259 - DNA, 22 bp, Homo sapiens
tgacaaattcatatttcagagg

SEQ ID NO: 8099260 - DNA, 22 bp, Homo sapiens
tgaatgcaagtcacacatttct

SEQ ID NO: 8099261 - DNA, 22 bp, Homo sapiens
tgagaaaagtacatggagaagc

SEQ ID NO: 8099262 - DNA, 22 bp, Homo sapiens
tgacatcattggccattgggga

SEQ ID NO: 8099263 - DNA, 22 bp, Homo sapiens
tgacaatgaggccctccacaaa

SEQ ID NO: 8099264 - DNA, 17 bp, Homo sapiens
tgacaatgacaagcact

SEQ ID NO: 8099265 - DNA, 22 bp, Homo sapiens
cccactgttgcctcaaatatca

SEQ ID NO: 8099266 - DNA, 22 bp, Homo sapiens
cccaccctcaagggtgtctata

SEQ ID NO: 8099267 - DNA, 22 bp, Homo sapiens
tgcaaaggaggatgggaaagaa

SEQ ID NO: 8099268 - DNA, 22 bp, Homo sapiens
tgattttacttagcatgatgtt

SEQ ID NO: 8099269 - DNA, 22 bp, Homo sapiens
ccattaaaatggaatgtagtga

SEQ ID NO: 8099270 - DNA, 22 bp, Homo sapiens
ccattaaaatggaatgtagtga

SEQ ID NO: 8099271 - DNA, 22 bp, Homo sapiens
ccattaagtattattaatgatt

SEQ ID NO: 8099272 - DNA, 22 bp, Homo sapiens
tgagggctgcttccagagctag

SEQ ID NO: 8099273 - DNA, 22 bp, Homo sapiens
ccagtgttccatggagtgatta

SEQ ID NO: 8099274 - DNA, 22 bp, Homo sapiens
ccagtctcagttcacgttggta

SEQ ID NO: 8099275 - DNA, 22 bp, Homo sapiens
tgaggtatgagtgtgccaggtg

SEQ ID NO: 8099276 - DNA, 22 bp, Homo sapiens
ccatgcccttgtcatctccagg

SEQ ID NO: 8099277 - DNA, 22 bp, Homo sapiens
tgaggggaactgatgcccattg

SEQ ID NO: 8099278 - DNA, 22 bp, Homo sapiens
ccatgccccaatacaggacacc

SEQ ID NO: 8099279 - DNA, 22 bp, Homo sapiens
tctgggagccatgccttggagt

SEQ ID NO: 8099280 - DNA, 22 bp, Homo sapiens
tctgggagcacacgcagtgatc

SEQ ID NO: 8099281 - DNA, 22 bp, Homo sapiens
tctggtccccattccaggtggg

SEQ ID NO: 8099282 - DNA, 22 bp, Homo sapiens
ccaggagaataatggcagatta

SEQ ID NO: 8099283 - DNA, 22 bp, Homo sapiens
ccaggacaggagttggcttcgc

SEQ ID NO: 8099284 - DNA, 22 bp, Homo sapiens
tctggcctatttctgtcagatc

SEQ ID NO: 8099285 - DNA, 22 bp, Homo sapiens
tctggccttatctgtccaagcc

SEQ ID NO: 8099286 - DNA, 22 bp, Homo sapiens
tctggcaggaccatgaagcgta

SEQ ID NO: 8099287 - DNA, 22 bp, Homo sapiens
tctggcagctcagttcaggtct

SEQ ID NO: 8099288 - DNA, 22 bp, Homo sapiens
ccagctgcaggggagcagtgga

SEQ ID NO: 8099289 - DNA, 22 bp, Homo sapiens
ccagctgctgtgcagggaggct

SEQ ID NO: 8099290 - DNA, 22 bp, Homo sapiens
tctggcagcagcatcagtggct

SEQ ID NO: 8099291 - DNA, 22 bp, Homo sapiens
ccagctgctgcaccgtgcatgg

SEQ ID NO: 8099292 - DNA, 22 bp, Homo sapiens
ccaggccagtgtttggtccagg

SEQ ID NO: 8099293 - DNA, 22 bp, Homo sapiens
ccaggccagtgtttggtccagg

SEQ ID NO: 8099294 - DNA, 22 bp, Homo sapiens
ccaggccccagggctggctttc

SEQ ID NO: 8099295 - DNA, 22 bp, Homo sapiens
tctttcaagggccctagtttgg

SEQ ID NO: 8099296 - DNA, 22 bp, Homo sapiens
tctttcaaatgcttgaattgga

SEQ ID NO: 8099297 - DNA, 22 bp, Homo sapiens
tctttcaatccattcatatgtc

SEQ ID NO: 8099298 - DNA, 22 bp, Homo sapiens
tctttcttgtgggtgccctttt

SEQ ID NO: 8099299 - DNA, 22 bp, Homo sapiens
tctttcttgtgggtgccctttt

SEQ ID NO: 8099300 - DNA, 22 bp, Homo sapiens
tctttctttatcacctgatatg

SEQ ID NO: 8099301 - DNA, 22 bp, Homo sapiens
ccaggctggagtgcaatggcgt

SEQ ID NO: 8099302 - DNA, 22 bp, Homo sapiens
tctttggtcagaaagattacac

SEQ ID NO: 8099303 - DNA, 22 bp, Homo sapiens
ccaggccagcaggcacacctgc

SEQ ID NO: 8099304 - DNA, 22 bp, Homo sapiens
ccaggccagcctggagcatggc

SEQ ID NO: 8099305 - DNA, 22 bp, Homo sapiens
tcttcccagctgctgcgatgcc

SEQ ID NO: 8099306 - DNA, 22 bp, Homo sapiens
tcttcagagatgtaacatatgg

SEQ ID NO: 8099307 - DNA, 22 bp, Homo sapiens
ccaggaggttgaggctgcagtg

SEQ ID NO: 8099308 - DNA, 22 bp, Homo sapiens
ccaggatggggagcagatagaa

SEQ ID NO: 8099309 - DNA, 22 bp, Homo sapiens
tggctggctgtccagctgggca

SEQ ID NO: 8099310 - DNA, 22 bp, Homo sapiens
tggctgggagctggaactgggc

SEQ ID NO: 8099311 - DNA, 19 bp, Homo sapiens
cctctgtgggagtcagtga

SEQ ID NO: 8099312 - DNA, 22 bp, Homo sapiens
tgggaaggcagtcactgtccta

SEQ ID NO: 8099313 - DNA, 22 bp, Homo sapiens
tgggaaggatacgttacaagat

SEQ ID NO: 8099314 - DNA, 22 bp, Homo sapiens
tgggaaggataccttggaacat

SEQ ID NO: 8099315 - DNA, 22 bp, Homo sapiens
tgggaagctgcattttaacaag

SEQ ID NO: 8099316 - DNA, 22 bp, Homo sapiens
tgggaaggaactgcctttagct

SEQ ID NO: 8099317 - DNA, 22 bp, Homo sapiens
tgggaagctttaaatgggtgtc

SEQ ID NO: 8099318 - DNA, 22 bp, Homo sapiens
tgggaaggacgtgtcagtggca

SEQ ID NO: 8099319 - DNA, 20 bp, Homo sapiens
cctctgccccggggctgcta

SEQ ID NO: 8099320 - DNA, 22 bp, Homo sapiens
cctctgctgctgttgagcaccg

SEQ ID NO: 8099321 - DNA, 22 bp, Homo sapiens
tgggccccagcacgtctgggga

SEQ ID NO: 8099322 - DNA, 22 bp, Homo sapiens
tgggctgcggataggcctcgga

SEQ ID NO: 8099323 - DNA, 22 bp, Homo sapiens
tgggctccttgggagcaagtga

SEQ ID NO: 8099324 - DNA, 22 bp, Homo sapiens
tgggctgctgcggtgctcttgg

SEQ ID NO: 8099325 - DNA, 22 bp, Homo sapiens
tgggctgctgtctgcacatgct

SEQ ID NO: 8099326 - DNA, 22 bp, Homo sapiens
cctgagctcaaagggtgcctgg

SEQ ID NO: 8099327 - DNA, 22 bp, Homo sapiens
tgggctggagcttgttgcttcc

SEQ ID NO: 8099328 - DNA, 22 bp, Homo sapiens
cctgagccaagagtcagaatct

SEQ ID NO: 8099329 - DNA, 22 bp, Homo sapiens
cctgagcatcagcgcctcctta

SEQ ID NO: 8099330 - DNA, 22 bp, Homo sapiens
cctgagatgtgtaacagatggt

SEQ ID NO: 8099331 - DNA, 22 bp, Homo sapiens
cctgagagagaagcgacctggt

SEQ ID NO: 8099332 - DNA, 22 bp, Homo sapiens
cctcaggctctgggtgcctacc

SEQ ID NO: 8099333 - DNA, 22 bp, Homo sapiens
tggcccagagcactgctgggca

SEQ ID NO: 8099334 - DNA, 20 bp, Homo sapiens
tggcccagcacgacgaggac

SEQ ID NO: 8099335 - DNA, 22 bp, Homo sapiens
tggcccagatctctgaccttga

SEQ ID NO: 8099336 - DNA, 20 bp, Homo sapiens
cctcagtgtcctggactggg

SEQ ID NO: 8099337 - DNA, 22 bp, Homo sapiens
cctcagtgcgtactgaacagtg

SEQ ID NO: 8099338 - DNA, 22 bp, Homo sapiens
cctcagtgttaggataagagaa

SEQ ID NO: 8099339 - DNA, 21 bp, Homo sapiens
cctcatcaaactttcacttgc

SEQ ID NO: 8099340 - DNA, 22 bp, Homo sapiens
cctcattctcgcgtgtgtttct

SEQ ID NO: 8099341 - DNA, 22 bp, Homo sapiens
cctcatgctgcatctctgaggt

SEQ ID NO: 8099342 - DNA, 22 bp, Homo sapiens
cctcagtgttaggataagagaa

SEQ ID NO: 8099343 - DNA, 22 bp, Homo sapiens
tggcctggctgccctgtctgga

SEQ ID NO: 8099344 - DNA, 19 bp, Homo sapiens
tggcagaggacaaggactt

SEQ ID NO: 8099345 - DNA, 22 bp, Homo sapiens
cccttccttgtgactggtgggg

SEQ ID NO: 8099346 - DNA, 22 bp, Homo sapiens
cccttctgtaaatgctgactgg

SEQ ID NO: 8099347 - DNA, 21 bp, Homo sapiens
ccctgcaggccagggctgagc

SEQ ID NO: 8099348 - DNA, 19 bp, Homo sapiens
cctagagggaaggcaggac

SEQ ID NO: 8099349 - DNA, 22 bp, Homo sapiens
cctagaggctgcaaggagaggc

SEQ ID NO: 8099350 - DNA, 22 bp, Homo sapiens
cctagagtctctctgcaggagt

SEQ ID NO: 8099351 - DNA, 22 bp, Homo sapiens
tggcagaggagaattaagatta

SEQ ID NO: 8099352 - DNA, 22 bp, Homo sapiens
tggcagaggaggctcagattga

SEQ ID NO: 8099353 - DNA, 19 bp, Homo sapiens
tggcagaggcagtttgtac

SEQ ID NO: 8099354 - DNA, 22 bp, Homo sapiens
tggcagaggctctgtgatgttg

SEQ ID NO: 8099355 - DNA, 22 bp, Homo sapiens
tggcagaggtaattcaaatccc

SEQ ID NO: 8099356 - DNA, 22 bp, Homo sapiens
tggcagggtggcaacttttggt

SEQ ID NO: 8099357 - DNA, 22 bp, Homo sapiens
tgccctggttacactggagtcc

SEQ ID NO: 8099358 - DNA, 22 bp, Homo sapiens
tgccttcaagacccatcctcca

SEQ ID NO: 8099359 - DNA, 22 bp, Homo sapiens
tgccttaatttccctgttttgt

SEQ ID NO: 8099360 - DNA, 22 bp, Homo sapiens
tgcctgtgtggtctgcgcatta

SEQ ID NO: 8099361 - DNA, 22 bp, Homo sapiens
tgcctgtgtggtctgcgcatta

SEQ ID NO: 8099362 - DNA, 22 bp, Homo sapiens
tgcctgtgtggggtctgccgcc

SEQ ID NO: 8099363 - DNA, 21 bp, Homo sapiens
tgccctggggctcttccctca

SEQ ID NO: 8099364 - DNA, 22 bp, Homo sapiens
tgccctggggagcccagccagg

SEQ ID NO: 8099365 - DNA, 22 bp, Homo sapiens
tgcccagcttcttacttttaaa

SEQ ID NO: 8099366 - DNA, 22 bp, Homo sapiens
tgcccagctgtcaaagtagata

SEQ ID NO: 8099367 - DNA, 22 bp, Homo sapiens
tgcccagcccctatccctggga

SEQ ID NO: 8099368 - DNA, 22 bp, Homo sapiens
tgcccagcctaaacttggcaag

SEQ ID NO: 8099369 - DNA, 22 bp, Homo sapiens
tgcccagcgcccacattctgtc

SEQ ID NO: 8099370 - DNA, 22 bp, Homo sapiens
tgcccagctattcctttcttag

SEQ ID NO: 8099371 - DNA, 22 bp, Homo sapiens
tgcccagccagtttatggtaat

SEQ ID NO: 8099372 - DNA, 22 bp, Homo sapiens
tgccagtgtctgctatctgaga

SEQ ID NO: 8099373 - DNA, 22 bp, Homo sapiens
tgcacagacatacacatatatg

SEQ ID NO: 8099374 - DNA, 22 bp, Homo sapiens
tgcacagagagatgagacacgt

SEQ ID NO: 8099375 - DNA, 22 bp, Homo sapiens
tgcacagatagtgatagatagc

SEQ ID NO: 8099376 - DNA, 22 bp, Homo sapiens
tgcacagagggaggcataaaat

SEQ ID NO: 8099377 - DNA, 22 bp, Homo sapiens
tgcacagagggaggcataaaat

SEQ ID NO: 8099378 - DNA, 22 bp, Homo sapiens
tgcacagagcaggcaccagcgg

SEQ ID NO: 8099379 - DNA, 22 bp, Homo sapiens
tgcacagagctggactccgcgg

SEQ ID NO: 8099380 - DNA, 22 bp, Homo sapiens
tgccagtctcaccctgggtcct

SEQ ID NO: 8099381 - DNA, 22 bp, Homo sapiens
tgctgtgctggcggcagaggcc

SEQ ID NO: 8099382 - DNA, 22 bp, Homo sapiens
tggaagggagctggaatttgga

SEQ ID NO: 8099383 - DNA, 22 bp, Homo sapiens
ccctcctggaggcggatgccca

SEQ ID NO: 8099384 - DNA, 22 bp, Homo sapiens
ccctctacagggaagcgctttc

SEQ ID NO: 8099385 - DNA, 20 bp, Homo sapiens
ccctgagacgactgagctcc

SEQ ID NO: 8099386 - DNA, 22 bp, Homo sapiens
ccctgaccccacggctggagaa

SEQ ID NO: 8099387 - DNA, 22 bp, Homo sapiens
ccctgagcattcatgtgagctt

SEQ ID NO: 8099388 - DNA, 18 bp, Homo sapiens
ccctgagatgatgctgtg

SEQ ID NO: 8099389 - DNA, 22 bp, Homo sapiens
ccctgagatgcctcaccctagt

SEQ ID NO: 8099390 - DNA, 22 bp, Homo sapiens
ccctgagcacacctggcagaca

SEQ ID NO: 8099391 - DNA, 22 bp, Homo sapiens
ccctgagctcaggcccttgggg

SEQ ID NO: 8099392 - DNA, 22 bp, Homo sapiens
ccccacaactcatgttgaaact

SEQ ID NO: 8099393 - DNA, 22 bp, Homo sapiens
tgctggctttgcgagatgcatt

SEQ ID NO: 8099394 - DNA, 22 bp, Homo sapiens
tgctggctacattattgctgtc

SEQ ID NO: 8099395 - DNA, 23 bp, Homo sapiens
cccctctggtggctcagctcctg

SEQ ID NO: 8099396 - DNA, 22 bp, Homo sapiens
tgctggctttttgtgtcaaaga

SEQ ID NO: 8099397 - DNA, 22 bp, Homo sapiens
cccggaggcagaggttgcagtg

SEQ ID NO: 8099398 - DNA, 22 bp, Homo sapiens
tcccctgagacccctcagcact

SEQ ID NO: 8099399 - DNA, 18 bp, Homo sapiens
tcccctgctctggtgctc

SEQ ID NO: 8099400 - DNA, 22 bp, Homo sapiens
tcccctgcagatgagggcagtg

SEQ ID NO: 8099401 - DNA, 22 bp, Homo sapiens
tccccatgggtggggacacata

SEQ ID NO: 8099402 - DNA, 22 bp, Homo sapiens
tgtggcagagtaaggacccagt

SEQ ID NO: 8099403 - DNA, 22 bp, Homo sapiens
tgtggcagaggaggcagcgtcc

SEQ ID NO: 8099404 - DNA, 21 bp, Homo sapiens
tgtggcagagacaatgctagt

SEQ ID NO: 8099405 - DNA, 21 bp, Homo sapiens
tgtggcagatgttgggaggca

SEQ ID NO: 8099406 - DNA, 22 bp, Homo sapiens
tgtggcagatacagaagatcaa

SEQ ID NO: 8099407 - DNA, 22 bp, Homo sapiens
tgtggcagctgctgcaggagct

SEQ ID NO: 8099408 - DNA, 22 bp, Homo sapiens
tgtggcagaactgggactcaaa

SEQ ID NO: 8099409 - DNA, 22 bp, Homo sapiens
tgtggcagaaagcatgtggaca

SEQ ID NO: 8099410 - DNA, 22 bp, Homo sapiens
tgtggaggattctgatgccagc

SEQ ID NO: 8099411 - DNA, 22 bp, Homo sapiens
tgtggcagtaaaattgggcaac

SEQ ID NO: 8099412 - DNA, 22 bp, Homo sapiens
tgtggcagtataagagctagaa

SEQ ID NO: 8099413 - DNA, 22 bp, Homo sapiens
tgtggcagtataagagctagaa

SEQ ID NO: 8099414 - DNA, 22 bp, Homo sapiens
tgtggcagtctcactggagggc

SEQ ID NO: 8099415 - DNA, 17 bp, Homo sapiens
tgtggccttctgagctt

SEQ ID NO: 8099416 - DNA, 22 bp, Homo sapiens
tgtggcctcaaggctgccctca

SEQ ID NO: 8099417 - DNA, 22 bp, Homo sapiens
tgtggcctcaaggctgccctca

SEQ ID NO: 8099418 - DNA, 22 bp, Homo sapiens
tgtggcctccccacttctgggg

SEQ ID NO: 8099419 - DNA, 22 bp, Homo sapiens
tgtggcctggaaggggctgctc

SEQ ID NO: 8099420 - DNA, 22 bp, Homo sapiens
tgtggcctgggagctgaggtct

SEQ ID NO: 8099421 - DNA, 22 bp, Homo sapiens
tgtggcctctcaggcttgatca

SEQ ID NO: 8099422 - DNA, 23 bp, Homo sapiens
tgtggcctgcagctctggtttgg

SEQ ID NO: 8099423 - DNA, 22 bp, Homo sapiens
tgtgtacaaactaacaacatat

SEQ ID NO: 8099424 - DNA, 22 bp, Homo sapiens
tgtggtggggtctggtattcca

SEQ ID NO: 8099425 - DNA, 22 bp, Homo sapiens
tgtggtggctattctggtctca

SEQ ID NO: 8099426 - DNA, 22 bp, Homo sapiens
tgtgtcctcatgaggtttgcag

SEQ ID NO: 8099427 - DNA, 22 bp, Homo sapiens
tgtttgaataacttggatatat

SEQ ID NO: 8099428 - DNA, 22 bp, Homo sapiens
tgtttctttgtagatattcttt

SEQ ID NO: 8099429 - DNA, 22 bp, Homo sapiens
tgtttactagccaacatggaga

SEQ ID NO: 8099430 - DNA, 22 bp, Homo sapiens
tgtttactcactgtatccacaa

SEQ ID NO: 8099431 - DNA, 22 bp, Homo sapiens
tgtttactccagctgatggaac

SEQ ID NO: 8099432 - DNA, 22 bp, Homo sapiens
tgtttactatgatgtaacctat

SEQ ID NO: 8099433 - DNA, 22 bp, Homo sapiens
tgtttcaagtttgctcaaagga

SEQ ID NO: 8099434 - DNA, 22 bp, Homo sapiens
tgtttacagcactgcacactgc

SEQ ID NO: 8099435 - DNA, 22 bp, Homo sapiens
tgtttacaaggagtttatattg

SEQ ID NO: 8099436 - DNA, 22 bp, Homo sapiens
tgtttacaaggagaatttgagg

SEQ ID NO: 8099437 - DNA, 22 bp, Homo sapiens
tgtttaattcaccatcatgttc

SEQ ID NO: 8099438 - DNA, 22 bp, Homo sapiens
tgtttaattcaccatcatgttc

SEQ ID NO: 8099439 - DNA, 22 bp, Homo sapiens
tgttctcactggatgcttcaca

SEQ ID NO: 8099440 - DNA, 22 bp, Homo sapiens
tgttctcatctggatctcagga

SEQ ID NO: 8099441 - DNA, 22 bp, Homo sapiens
tgttctaaatttgcatggtcca

SEQ ID NO: 8099442 - DNA, 22 bp, Homo sapiens
tgttctaagtgttttgttcatg

SEQ ID NO: 8099443 - DNA, 22 bp, Homo sapiens
tgttctctctggctgccagtac

SEQ ID NO: 8099444 - DNA, 22 bp, Homo sapiens
tgtgttggctgccggcacagga

SEQ ID NO: 8099445 - DNA, 22 bp, Homo sapiens
tgtgttttccagaatggtgttt

SEQ ID NO: 8099446 - DNA, 22 bp, Homo sapiens
tgtgttttatctattgtatctt

SEQ ID NO: 8099447 - DNA, 22 bp, Homo sapiens
tgtgttttatctattgtatctt

SEQ ID NO: 8099448 - DNA, 21 bp, Homo sapiens
tgtgttttaatgatattctgt

SEQ ID NO: 8099449 - DNA, 22 bp, Homo sapiens
tgtgtttgaggcatgttgcaga

SEQ ID NO: 8099450 - DNA, 22 bp, Homo sapiens
tgttatataacttacaacctgt

SEQ ID NO: 8099451 - DNA, 22 bp, Homo sapiens
tgttatcacttagacatgctag

SEQ ID NO: 8099452 - DNA, 22 bp, Homo sapiens
tgttatcacttgtaaaagcaat

SEQ ID NO: 8099453 - DNA, 22 bp, Homo sapiens
tgttatttgggaaagttgtaca

SEQ ID NO: 8099454 - DNA, 22 bp, Homo sapiens
tgttccctggtaaactgactcc

SEQ ID NO: 8099455 - DNA, 22 bp, Homo sapiens
tgttcccattttctgcataatc

SEQ ID NO: 8099456 - DNA, 22 bp, Homo sapiens
tgttccctcctccccactgggt

SEQ ID NO: 8099457 - DNA, 22 bp, Homo sapiens
tgttcagaacaaaggtaaatga

SEQ ID NO: 8099458 - DNA, 22 bp, Homo sapiens
tgttcctctgaacttcttccaa

SEQ ID NO: 8099459 - DNA, 22 bp, Homo sapiens
ttactgaggagcatatctgagt

SEQ ID NO: 8099460 - DNA, 22 bp, Homo sapiens
ttactgagggtgtatcttagtg

SEQ ID NO: 8099461 - DNA, 22 bp, Homo sapiens
ttactcttccaaatgaatttca

SEQ ID NO: 8099462 - DNA, 22 bp, Homo sapiens
ttactctttggtgttaagttca

SEQ ID NO: 8099463 - DNA, 22 bp, Homo sapiens
ttactatatgcgtggcaggtgc

SEQ ID NO: 8099464 - DNA, 22 bp, Homo sapiens
ttaccaaatcccgtgcacattc

SEQ ID NO: 8099465 - DNA, 22 bp, Homo sapiens
ttactacattgtaacacagtac

SEQ ID NO: 8099466 - DNA, 23 bp, Homo sapiens
ttactacacaagtaacgattccc

SEQ ID NO: 8099467 - DNA, 22 bp, Homo sapiens
ttactgtatgagtgtggtagtc

SEQ ID NO: 8099468 - DNA, 22 bp, Homo sapiens
ttactgtttgaaaaatgaatgt

SEQ ID NO: 8099469 - DNA, 22 bp, Homo sapiens
ttactttagaaatagtcatcaa

SEQ ID NO: 8099470 - DNA, 20 bp, Homo sapiens
ttacttgtctcagcatggag

SEQ ID NO: 8099471 - DNA, 22 bp, Homo sapiens
ttactttagatcatactgtgtg

SEQ ID NO: 8099472 - DNA, 22 bp, Homo sapiens
ttacttgacataaatgagttta

SEQ ID NO: 8099473 - DNA, 22 bp, Homo sapiens
ttagaaagaactttagatatca

SEQ ID NO: 8099474 - DNA, 22 bp, Homo sapiens
ttagaaagaatagcctggctgc

SEQ ID NO: 8099475 - DNA, 22 bp, Homo sapiens
ttacagtacagaaaataacaga

SEQ ID NO: 8099476 - DNA, 22 bp, Homo sapiens
ttacatattatccaaaactgct

SEQ ID NO: 8099477 - DNA, 22 bp, Homo sapiens
ttacatcagcaagagtgtatgt

SEQ ID NO: 8099478 - DNA, 22 bp, Homo sapiens
ttacatcattgagacatacata

SEQ ID NO: 8099479 - DNA, 22 bp, Homo sapiens
ttacatattatccaaaactgct

SEQ ID NO: 8099480 - DNA, 22 bp, Homo sapiens
ttacagtgagggtgacatttac

SEQ ID NO: 8099481 - DNA, 22 bp, Homo sapiens
ttacacaacatctgtattatta

SEQ ID NO: 8099482 - DNA, 22 bp, Homo sapiens
ttacacaagttctttaacctat

SEQ ID NO: 8099483 - DNA, 22 bp, Homo sapiens
ttacacaacagtgcatcagcag

SEQ ID NO: 8099484 - DNA, 22 bp, Homo sapiens
ttacaaacaagatcttattctt

SEQ ID NO: 8099485 - DNA, 22 bp, Homo sapiens
ttacaaactgtcatatagtatt

SEQ ID NO: 8099486 - DNA, 22 bp, Homo sapiens
ttacacaaacacattccagata

SEQ ID NO: 8099487 - DNA, 22 bp, Homo sapiens
ttacaaagaaaattaggcattt

SEQ ID NO: 8099488 - DNA, 22 bp, Homo sapiens
ttaatttttatgtatagtgtgt

SEQ ID NO: 8099489 - DNA, 21 bp, Homo sapiens
ttaatttattcatgatagcta

SEQ ID NO: 8099490 - DNA, 22 bp, Homo sapiens
ttacacattgcagatcaaaatg

SEQ ID NO: 8099491 - DNA, 22 bp, Homo sapiens
ttacacagtggttaagtctggg

SEQ ID NO: 8099492 - DNA, 22 bp, Homo sapiens
ttacacatgctcacttatttgt

SEQ ID NO: 8099493 - DNA, 22 bp, Homo sapiens
ttacacatgctttgtgtgtatg

SEQ ID NO: 8099494 - DNA, 22 bp, Homo sapiens
ttacacagaaacactgttcaga

SEQ ID NO: 8099495 - DNA, 22 bp, Homo sapiens
ttacacagtatccaaggttctt

SEQ ID NO: 8099496 - DNA, 22 bp, Homo sapiens
ttacacagtgaatttactcaag

SEQ ID NO: 8099497 - DNA, 22 bp, Homo sapiens
ttacacagacatggcatcatga

SEQ ID NO: 8099498 - DNA, 22 bp, Homo sapiens
ttaaatgaacgagatatgcaac

SEQ ID NO: 8099499 - DNA, 22 bp, Homo sapiens
ttaaatgagatgttcagatatt

SEQ ID NO: 8099500 - DNA, 22 bp, Homo sapiens
ttaacacatatttatcaattgc

SEQ ID NO: 8099501 - DNA, 22 bp, Homo sapiens
ttaaatgtgatttcatttatgt

SEQ ID NO: 8099502 - DNA, 22 bp, Homo sapiens
ttaaatattttcagcagggtca

SEQ ID NO: 8099503 - DNA, 22 bp, Homo sapiens
ttaaagcatcacactattaatt

SEQ ID NO: 8099504 - DNA, 22 bp, Homo sapiens
tgtttttcaaatattgctctgt

SEQ ID NO: 8099505 - DNA, 22 bp, Homo sapiens
ttaaagcatcctgtcagtctgt

SEQ ID NO: 8099506 - DNA, 22 bp, Homo sapiens
ttaaagcatgttgcttaacagg

SEQ ID NO: 8099507 - DNA, 22 bp, Homo sapiens
tgttttctgatggttaatgagt

SEQ ID NO: 8099508 - DNA, 22 bp, Homo sapiens
ttaataaacaggtgcagctgaa

SEQ ID NO: 8099509 - DNA, 22 bp, Homo sapiens
ttaattctagtttaacacttag

SEQ ID NO: 8099510 - DNA, 22 bp, Homo sapiens
ttaatttatacataatcacagg

SEQ ID NO: 8099511 - DNA, 22 bp, Homo sapiens
ttaaggctgtggggattactgc

SEQ ID NO: 8099512 - DNA, 22 bp, Homo sapiens
ttaaggctgataagtcagatat

SEQ ID NO: 8099513 - DNA, 22 bp, Homo sapiens
ttaaggcacagagaggttaagt

SEQ ID NO: 8099514 - DNA, 22 bp, Homo sapiens
ttaaggcattctcctactaata

SEQ ID NO: 8099515 - DNA, 22 bp, Homo sapiens
ttaaggaatttatagttgtact

SEQ ID NO: 8099516 - DNA, 22 bp, Homo sapiens
ttaaggaatgtgcagtttatat

SEQ ID NO: 8099517 - DNA, 22 bp, Homo sapiens
ttaagtcacttatctaaagaca

SEQ ID NO: 8099518 - DNA, 22 bp, Homo sapiens
ttaagtcactggacttgcctag

SEQ ID NO: 8099519 - DNA, 22 bp, Homo sapiens
ttaagtcatttctgattataga

SEQ ID NO: 8099520 - DNA, 22 bp, Homo sapiens
ttaagtcaatatcaatctcagc

SEQ ID NO: 8099521 - DNA, 23 bp, Homo sapiens
ttaactctatacacaccagaatg

SEQ ID NO: 8099522 - DNA, 22 bp, Homo sapiens
ttaacagagaacatagaagtag

SEQ ID NO: 8099523 - DNA, 20 bp, Homo sapiens
ttaagaaaagcacatcctgc

SEQ ID NO: 8099524 - DNA, 22 bp, Homo sapiens
ttaagacattcagatatttcta

SEQ ID NO: 8099525 - DNA, 22 bp, Homo sapiens
ttaagagatttaggaacattat

SEQ ID NO: 8099526 - DNA, 21 bp, Homo sapiens
ttaagacctgcatcatcatta

SEQ ID NO: 8099527 - DNA, 22 bp, Homo sapiens
ttaagagaagagtatctagaac

SEQ ID NO: 8099528 - DNA, 22 bp, Homo sapiens
ttaaggaaagattagcatttgt

SEQ ID NO: 8099529 - DNA, 22 bp, Homo sapiens
ttgatcatctaagagtaatagt

SEQ ID NO: 8099530 - DNA, 22 bp, Homo sapiens
ttgatcatttttctggtaaaat

SEQ ID NO: 8099531 - DNA, 22 bp, Homo sapiens
ttgatctcttgtgtatggtaga

SEQ ID NO: 8099532 - DNA, 22 bp, Homo sapiens
ttgatcttgtgatagttcaact

SEQ ID NO: 8099533 - DNA, 22 bp, Homo sapiens
ttgatgttgctcttaacagtat

SEQ ID NO: 8099534 - DNA, 22 bp, Homo sapiens
ttgattcaaccacttaataatc

SEQ ID NO: 8099535 - DNA, 22 bp, Homo sapiens
ttgattaaaatgagacatcatt

SEQ ID NO: 8099536 - DNA, 22 bp, Homo sapiens
ttgattatagactcactaatct

SEQ ID NO: 8099537 - DNA, 22 bp, Homo sapiens
ttgatttatagaatgttcaagc

SEQ ID NO: 8099538 - DNA, 22 bp, Homo sapiens
ttgattttaaaatagtgacact

SEQ ID NO: 8099539 - DNA, 22 bp, Homo sapiens
ttgatttgattgtaatggctct

SEQ ID NO: 8099540 - DNA, 22 bp, Homo sapiens
ttgatttgattgtaatggctct

SEQ ID NO: 8099541 - DNA, 22 bp, Homo sapiens
ttgcaaagagtcatgtaagtca

SEQ ID NO: 8099542 - DNA, 22 bp, Homo sapiens
ttctttattgagacttcattgt

SEQ ID NO: 8099543 - DNA, 22 bp, Homo sapiens
ttctttcagaacacaagtgatt

SEQ ID NO: 8099544 - DNA, 19 bp, Homo sapiens
ttctttccacatcttctct

SEQ ID NO: 8099545 - DNA, 22 bp, Homo sapiens
ttctttatcagttactcatagg

SEQ ID NO: 8099546 - DNA, 22 bp, Homo sapiens
ttctttatgcttctgtttaggc

SEQ ID NO: 8099547 - DNA, 22 bp, Homo sapiens
ttctttattgagacttcattgt

SEQ ID NO: 8099548 - DNA, 22 bp, Homo sapiens
ttctttctcaacatgaatgttt

SEQ ID NO: 8099549 - DNA, 22 bp, Homo sapiens
ttgaattagactttgctacagg

SEQ ID NO: 8099550 - DNA, 22 bp, Homo sapiens
ttgaagcagagaaatacttgaa

SEQ ID NO: 8099551 - DNA, 22 bp, Homo sapiens
ttgaagcagctcaggaggctta

SEQ ID NO: 8099552 - DNA, 22 bp, Homo sapiens
ttgaagcaaggcgaatcttgtg

SEQ ID NO: 8099553 - DNA, 21 bp, Homo sapiens
ttgaagcaagggtggctctga

SEQ ID NO: 8099554 - DNA, 22 bp, Homo sapiens
ttgagctcagtgactcgacttt

SEQ ID NO: 8099555 - DNA, 23 bp, Homo sapiens
ttgagctcagtagctctgctggt

SEQ ID NO: 8099556 - DNA, 22 bp, Homo sapiens
ttctgccttacgatattttcaa

SEQ ID NO: 8099557 - DNA, 22 bp, Homo sapiens
ttctgagattgttaggcactaa

SEQ ID NO: 8099558 - DNA, 17 bp, Homo sapiens
ttctgagccacttcctt

SEQ ID NO: 8099559 - DNA, 22 bp, Homo sapiens
ttctgagattgttaggcactaa

SEQ ID NO: 8099560 - DNA, 22 bp, Homo sapiens
ttctgccttcagtcctctgact

SEQ ID NO: 8099561 - DNA, 22 bp, Homo sapiens
ttctgggcatgttacattctgt

SEQ ID NO: 8099562 - DNA, 22 bp, Homo sapiens
ttctgggcagttggaaatttca

SEQ ID NO: 8099563 - DNA, 22 bp, Homo sapiens
ttctgagaaggctgtggacaca

SEQ ID NO: 8099564 - DNA, 22 bp, Homo sapiens
ttctgagaggcagagcttgtga

SEQ ID NO: 8099565 - DNA, 22 bp, Homo sapiens
ttctgagacaattgagagtcta

SEQ ID NO: 8099566 - DNA, 22 bp, Homo sapiens
ttctgaatcctcgaaacatagc

SEQ ID NO: 8099567 - DNA, 22 bp, Homo sapiens
ttctgttttgcacagacttgaa

SEQ ID NO: 8099568 - DNA, 22 bp, Homo sapiens
ttctgtttgccatatatagtag

SEQ ID NO: 8099569 - DNA, 22 bp, Homo sapiens
ttctgtttactcagaaatacaa

SEQ ID NO: 8099570 - DNA, 22 bp, Homo sapiens
ttctgtttataatttgcagttg

SEQ ID NO: 8099571 - DNA, 22 bp, Homo sapiens
ttctgggcctcctaggacaggc

SEQ ID NO: 8099572 - DNA, 22 bp, Homo sapiens
ttcttctttcctataattaatt

SEQ ID NO: 8099573 - DNA, 22 bp, Homo sapiens
ttcttgaaaatagccatgtaca

SEQ ID NO: 8099574 - DNA, 22 bp, Homo sapiens
ttcttctttccaattacatggt

SEQ ID NO: 8099575 - DNA, 20 bp, Homo sapiens
ttcttgaatacccaacccca

SEQ ID NO: 8099576 - DNA, 22 bp, Homo sapiens
ttcttgaaggggatataaatag

SEQ ID NO: 8099577 - DNA, 20 bp, Homo sapiens
ttcttgagccaaaaggcata

SEQ ID NO: 8099578 - DNA, 22 bp, Homo sapiens
ttcttgaatcactttagagata

SEQ ID NO: 8099579 - DNA, 21 bp, Homo sapiens
ttcttcttggactgttttggc

SEQ ID NO: 8099580 - DNA, 21 bp, Homo sapiens
ttcttcttggactgttttggc

SEQ ID NO: 8099581 - DNA, 22 bp, Homo sapiens
ttcttacatcagtttattttgt

SEQ ID NO: 8099582 - DNA, 22 bp, Homo sapiens
ttcttacatattttcatatggt

SEQ ID NO: 8099583 - DNA, 22 bp, Homo sapiens
ttcttacagccctattactaaa

SEQ ID NO: 8099584 - DNA, 18 bp, Homo sapiens
ttctttaattcagtttga

SEQ ID NO: 8099585 - DNA, 22 bp, Homo sapiens
ttcttgatgtaccaacttggga

SEQ ID NO: 8099586 - DNA, 22 bp, Homo sapiens
ttcttgattcttccttgaagga

SEQ ID NO: 8099587 - DNA, 22 bp, Homo sapiens
ttcaggtagacgcagcagaaca

SEQ ID NO: 8099588 - DNA, 22 bp, Homo sapiens
ttcagtatacattatctaattg

SEQ ID NO: 8099589 - DNA, 22 bp, Homo sapiens
ttcagtatattactcttgtcaa

SEQ ID NO: 8099590 - DNA, 22 bp, Homo sapiens
ttcagtatctgcaaaatgggga

SEQ ID NO: 8099591 - DNA, 22 bp, Homo sapiens
ttcagtatacttcataacattt

SEQ ID NO: 8099592 - DNA, 22 bp, Homo sapiens
ttcagtatgacagacgcattgg

SEQ ID NO: 8099593 - DNA, 22 bp, Homo sapiens
ttcagtatgacagacgcattgg

SEQ ID NO: 8099594 - DNA, 22 bp, Homo sapiens
ttcagtatgctgaatgattttt

SEQ ID NO: 8099595 - DNA, 22 bp, Homo sapiens
ttcagtattcaaatatgtctta

SEQ ID NO: 8099596 - DNA, 22 bp, Homo sapiens
ttcagtatgttggacgttatgt

SEQ ID NO: 8099597 - DNA, 22 bp, Homo sapiens
ttcagtatgtgtaaactacttt

SEQ ID NO: 8099598 - DNA, 22 bp, Homo sapiens
ttcagtatgttggacgttatgt

SEQ ID NO: 8099599 - DNA, 22 bp, Homo sapiens
ttcagtatttgaaaccataggc

SEQ ID NO: 8099600 - DNA, 22 bp, Homo sapiens
ttcagtatttcatgactttctt

SEQ ID NO: 8099601 - DNA, 22 bp, Homo sapiens
ttcacagtggccctctctgagt

SEQ ID NO: 8099602 - DNA, 22 bp, Homo sapiens
ttcagtgtcaatttttaaatat

SEQ ID NO: 8099603 - DNA, 22 bp, Homo sapiens
ttcatcatctacaaccaggacc

SEQ ID NO: 8099604 - DNA, 22 bp, Homo sapiens
ttcatgatggcagcatttatag

SEQ ID NO: 8099605 - DNA, 22 bp, Homo sapiens
ttcatgattgactatcaagagc

SEQ ID NO: 8099606 - DNA, 22 bp, Homo sapiens
ttcaattcaattctaaatatat

SEQ ID NO: 8099607 - DNA, 22 bp, Homo sapiens
ttcaattctgatgaaggcaata

SEQ ID NO: 8099608 - DNA, 22 bp, Homo sapiens
ttcacaaaatggtttgttgatg

SEQ ID NO: 8099609 - DNA, 22 bp, Homo sapiens
ttcacaaaacactattttctgg

SEQ ID NO: 8099610 - DNA, 22 bp, Homo sapiens
ttcacaaaaatgctgaacagtt

SEQ ID NO: 8099611 - DNA, 22 bp, Homo sapiens
ttcaatttgtgctaaggcaccg

SEQ ID NO: 8099612 - DNA, 22 bp, Homo sapiens
ttcacaaagctggagcatttcc

SEQ ID NO: 8099613 - DNA, 22 bp, Homo sapiens
ttcacaaagctggagcatttcc

SEQ ID NO: 8099614 - DNA, 22 bp, Homo sapiens
ttcacagtaagtaggatagttg

SEQ ID NO: 8099615 - DNA, 22 bp, Homo sapiens
ttcaactttatgcatatgtatt

SEQ ID NO: 8099616 - DNA, 22 bp, Homo sapiens
ttcaactagaggtgattttgcc

SEQ ID NO: 8099617 - DNA, 22 bp, Homo sapiens
ttcaacaattaagtatcagcct

SEQ ID NO: 8099618 - DNA, 22 bp, Homo sapiens
ttcaacaatgcacttgagtata

SEQ ID NO: 8099619 - DNA, 22 bp, Homo sapiens
ttagagttgagtttctatgaga

SEQ ID NO: 8099620 - DNA, 22 bp, Homo sapiens
ttagataaaagtgttcaataaa

SEQ ID NO: 8099621 - DNA, 22 bp, Homo sapiens
ttagataaaagtgttcaataaa

SEQ ID NO: 8099622 - DNA, 22 bp, Homo sapiens
ttcaacaagtatttattgagca

SEQ ID NO: 8099623 - DNA, 22 bp, Homo sapiens
ttcaacaacttggttcaaatgg

SEQ ID NO: 8099624 - DNA, 22 bp, Homo sapiens
ttcaacaaatatttattgagct

SEQ ID NO: 8099625 - DNA, 22 bp, Homo sapiens
ttcaaagtaaaaatgtgttcac

SEQ ID NO: 8099626 - DNA, 22 bp, Homo sapiens
ttcaaaggaaaggcagtgtcaa

SEQ ID NO: 8099627 - DNA, 22 bp, Homo sapiens
ttcaacaaaatatatttttcca

SEQ ID NO: 8099628 - DNA, 22 bp, Homo sapiens
ttcaacaaactgttcacgaatg

SEQ ID NO: 8099629 - DNA, 22 bp, Homo sapiens
ttcaacaaaatatatttttcca

SEQ ID NO: 8099630 - DNA, 21 bp, Homo sapiens
ttcaacaaagggaataagttt

SEQ ID NO: 8099631 - DNA, 22 bp, Homo sapiens
ttctacaaatatttactgttcc

SEQ ID NO: 8099632 - DNA, 22 bp, Homo sapiens
ttctacaatatgaataatgaag

SEQ ID NO: 8099633 - DNA, 22 bp, Homo sapiens
ttctaagtcctacctgaaagca

SEQ ID NO: 8099634 - DNA, 22 bp, Homo sapiens
ttctaagtgattctagctggac

SEQ ID NO: 8099635 - DNA, 22 bp, Homo sapiens
ttctaagtttctcagtttcagt

SEQ ID NO: 8099636 - DNA, 22 bp, Homo sapiens
ttcctctttctctgtgctatgt

SEQ ID NO: 8099637 - DNA, 22 bp, Homo sapiens
ttcctgtgtgctctcatttagt

SEQ ID NO: 8099638 - DNA, 23 bp, Homo sapiens
ttcctgtggtatattttataggg

SEQ ID NO: 8099639 - DNA, 22 bp, Homo sapiens
ttcctgtgcctcaggtctcagc

SEQ ID NO: 8099640 - DNA, 19 bp, Homo sapiens
ttcctgtgctgctgtgtcc

SEQ ID NO: 8099641 - DNA, 22 bp, Homo sapiens
ttcctgtgaagccggtggtctc

SEQ ID NO: 8099642 - DNA, 22 bp, Homo sapiens
ttccttaatatcccttttggaa

SEQ ID NO: 8099643 - DNA, 22 bp, Homo sapiens
ttcctacagccctgaatctcta

SEQ ID NO: 8099644 - DNA, 22 bp, Homo sapiens
ttcctcagagagacagaaacta

SEQ ID NO: 8099645 - DNA, 22 bp, Homo sapiens
ttccacaggtttcagactgttc

SEQ ID NO: 8099646 - DNA, 20 bp, Homo sapiens
ttccacatctttgcacatgc

SEQ ID NO: 8099647 - DNA, 22 bp, Homo sapiens
ttccacatagatcacaggtgtt

SEQ ID NO: 8099648 - DNA, 19 bp, Homo sapiens
tttatttgagacatgcctt

SEQ ID NO: 8099649 - DNA, 22 bp, Homo sapiens
tttcaaaattttgcagtggtaa

SEQ ID NO: 8099650 - DNA, 22 bp, Homo sapiens
tttcaaacatatcttcattact

SEQ ID NO: 8099651 - DNA, 22 bp, Homo sapiens
tttcaaacatagatctgaatat

SEQ ID NO: 8099652 - DNA, 22 bp, Homo sapiens
tttattatccagtgttgtcatg

SEQ ID NO: 8099653 - DNA, 22 bp, Homo sapiens
tttattagtgcttgtatcactg

SEQ ID NO: 8099654 - DNA, 22 bp, Homo sapiens
tttattagattatcaaagaggt

SEQ ID NO: 8099655 - DNA, 23 bp, Homo sapiens
tttatacaagaaaccgctggcct

SEQ ID NO: 8099656 - DNA, 22 bp, Homo sapiens
tttatacatggagaatttttgc

SEQ ID NO: 8099657 - DNA, 22 bp, Homo sapiens
tttatataacagagactgctat

SEQ ID NO: 8099658 - DNA, 22 bp, Homo sapiens
tttatgtttgcattttcaaaga

SEQ ID NO: 8099659 - DNA, 22 bp, Homo sapiens
tttacctagtataatgcaacct

SEQ ID NO: 8099660 - DNA, 22 bp, Homo sapiens
tttaccagaattgccaccagaa

SEQ ID NO: 8099661 - DNA, 22 bp, Homo sapiens
tttacaagtacacctaacagct

SEQ ID NO: 8099662 - DNA, 22 bp, Homo sapiens
tttacaaggcagaactgattaa

SEQ ID NO: 8099663 - DNA, 22 bp, Homo sapiens
tttagaaattcatctatggcct

SEQ ID NO: 8099664 - DNA, 22 bp, Homo sapiens
tttactgtgtccatctgtgact

SEQ ID NO: 8099665 - DNA, 22 bp, Homo sapiens
tttactgtttacagctaatgca

SEQ ID NO: 8099666 - DNA, 22 bp, Homo sapiens
tttaattttctgggcccagcag

SEQ ID NO: 8099667 - DNA, 22 bp, Homo sapiens
tttaatttgtatttctagaggg

SEQ ID NO: 8099668 - DNA, 22 bp, Homo sapiens
tttaatttgtatttctagaggg

SEQ ID NO: 8099669 - DNA, 22 bp, Homo sapiens
tttaattctggcataatagctc

SEQ ID NO: 8099670 - DNA, 22 bp, Homo sapiens
ttgtttttatgaacatccagga

SEQ ID NO: 8099671 - DNA, 22 bp, Homo sapiens
ttgtttttagagaagccctgaa

SEQ ID NO: 8099672 - DNA, 22 bp, Homo sapiens
tttaatgtttgagtcagtatat

SEQ ID NO: 8099673 - DNA, 22 bp, Homo sapiens
ttgtttctgagttttcatgtat

SEQ ID NO: 8099674 - DNA, 20 bp, Homo sapiens
ttgtttctgctattttctaa

SEQ ID NO: 8099675 - DNA, 23 bp, Homo sapiens
ttgtttctttgtattgtctctat

SEQ ID NO: 8099676 - DNA, 22 bp, Homo sapiens
ttgtttctttgaagtttctaga

SEQ ID NO: 8099677 - DNA, 17 bp, Homo sapiens
ttgtttcttctctgtgg

SEQ ID NO: 8099678 - DNA, 18 bp, Homo sapiens
ttgttttaagactctgtc

SEQ ID NO: 8099679 - DNA, 22 bp, Homo sapiens
ttgttttaacctagtgtttatg

SEQ ID NO: 8099680 - DNA, 20 bp, Homo sapiens
ttgttttaaatcctggatga

SEQ ID NO: 8099681 - DNA, 22 bp, Homo sapiens
ttgtttttaaacatgtgactga

SEQ ID NO: 8099682 - DNA, 22 bp, Homo sapiens
ttgtgacaatacagcatggaga

SEQ ID NO: 8099683 - DNA, 22 bp, Homo sapiens
ttgtgacagagatcacgtggcc

SEQ ID NO: 8099684 - DNA, 22 bp, Homo sapiens
ttgtgttggcgaaagcatgtca

SEQ ID NO: 8099685 - DNA, 22 bp, Homo sapiens
ttgtgtttctggccaagatgga

SEQ ID NO: 8099686 - DNA, 22 bp, Homo sapiens
ttggtgacttgcagaaacagct

SEQ ID NO: 8099687 - DNA, 22 bp, Homo sapiens
ttggtgaacacatacacatttt

SEQ ID NO: 8099688 - DNA, 22 bp, Homo sapiens
ttggtgtcttttttatacatgt

SEQ ID NO: 8099689 - DNA, 22 bp, Homo sapiens
ttgtgaaatgtttcaaaatagt

SEQ ID NO: 8099690 - DNA, 22 bp, Homo sapiens
ttgtctctaagtgtgatcttca

SEQ ID NO: 8099691 - DNA, 22 bp, Homo sapiens
ttgtctatttgttcaggtaagg

SEQ ID NO: 8099692 - DNA, 22 bp, Homo sapiens
ttgtccttccagactcttccac

SEQ ID NO: 8099693 - DNA, 22 bp, Homo sapiens
ttggttttctcagctggaccat

SEQ ID NO: 8099694 - DNA, 22 bp, Homo sapiens
ttgtctaatgagctccacttca

SEQ ID NO: 8099695 - DNA, 22 bp, Homo sapiens
ttgtctactaagaaagacaatt

SEQ ID NO: 8099696 - DNA, 22 bp, Homo sapiens
ttggttcacattagatttcctt

SEQ ID NO: 8099697 - DNA, 22 bp, Homo sapiens
ttggttcaggacatatttgagt

SEQ ID NO: 8099698 - DNA, 22 bp, Homo sapiens
ttggttcagtaggcatgcctgg

SEQ ID NO: 8099699 - DNA, 22 bp, Homo sapiens
ttggttcagatgggatctgcga

SEQ ID NO: 8099700 - DNA, 22 bp, Homo sapiens
ttggttcaatactaacttgaac

SEQ ID NO: 8099701 - DNA, 22 bp, Homo sapiens
ttggttcaacttttctaagtag

SEQ ID NO: 8099702 - DNA, 22 bp, Homo sapiens
ttggttcaaagggattcaattt

SEQ ID NO: 8099703 - DNA, 22 bp, Homo sapiens
ttggttcaaaacatggaagggt

SEQ ID NO: 8099704 - DNA, 22 bp, Homo sapiens
ttggttcattttctcatctaga

SEQ ID NO: 8099705 - DNA, 22 bp, Homo sapiens
ttggttcattgcaggcgccggg

SEQ ID NO: 8099706 - DNA, 19 bp, Homo sapiens
ttggttcatggatgcccaa

SEQ ID NO: 8099707 - DNA, 22 bp, Homo sapiens
ttggttcattattgaatgtgct

SEQ ID NO: 8099708 - DNA, 22 bp, Homo sapiens
tttcagagtcagctcctctcta

SEQ ID NO: 8099709 - DNA, 22 bp, Homo sapiens
tttcagaggagagctggaccaa

SEQ ID NO: 8099710 - DNA, 22 bp, Homo sapiens
tttcaaagggaagttatgaagt

SEQ ID NO: 8099711 - DNA, 22 bp, Homo sapiens
tttcaaagggaagttatgaagt

SEQ ID NO: 8099712 - DNA, 22 bp, Homo sapiens
tttcagaggaaatctcattgag

SEQ ID NO: 8099713 - DNA, 22 bp, Homo sapiens
tttcaaagagttgtaaattact

SEQ ID NO: 8099714 - DNA, 22 bp, Homo sapiens
tttcaaagagttgtaaattact

SEQ ID NO: 8099715 - DNA, 20 bp, Homo sapiens
tttcaaaggcacctatgaag

SEQ ID NO: 8099716 - DNA, 17 bp, Homo sapiens
tttcaaagcagtcagga

SEQ ID NO: 8099717 - DNA, 22 bp, Homo sapiens
tttcaaagaccattaactatca

SEQ ID NO: 8099718 - DNA, 22 bp, Homo sapiens
tttcaaagaccattaactatca

SEQ ID NO: 8099719 - DNA, 23 bp, Homo sapiens
tttcaaagactttcccttagagt

SEQ ID NO: 8099720 - DNA, 22 bp, Homo sapiens
tttcaaagacagccatatttgt

SEQ ID NO: 8099721 - DNA, 22 bp, Homo sapiens
tttcaaactttactcttgaatc

SEQ ID NO: 8099722 - DNA, 22 bp, Homo sapiens
tttcaaactttactcttgaatc

SEQ ID NO: 8099723 - DNA, 22 bp, Homo sapiens
tttcaggtaagaaaactaagaa

SEQ ID NO: 8099724 - DNA, 22 bp, Homo sapiens
tttcaggaatacacacacatct

SEQ ID NO: 8099725 - DNA, 20 bp, Homo sapiens
tttcagatttacagaaatgt

SEQ ID NO: 8099726 - DNA, 22 bp, Homo sapiens
tttcagattatctcaactttgg

SEQ ID NO: 8099727 - DNA, 17 bp, Homo sapiens
tttcagattcactttct

SEQ ID NO: 8099728 - DNA, 22 bp, Homo sapiens
tttcagatgcaattaattttca

SEQ ID NO: 8099729 - DNA, 22 bp, Homo sapiens
tttcagatgaaatgtgtatatt

SEQ ID NO: 8099730 - DNA, 22 bp, Homo sapiens
tttcagatcttctttgggttaa

SEQ ID NO: 8099731 - DNA, 22 bp, Homo sapiens
tttcagagttatgtaagaaaat

SEQ ID NO: 8099732 - DNA, 22 bp, Homo sapiens
tttcagataaatatgggactaa

SEQ ID NO: 8099733 - DNA, 22 bp, Homo sapiens
tttccaaaggaggaaccagttt

SEQ ID NO: 8099734 - DNA, 22 bp, Homo sapiens
tttccaaaggctaaactcagtt

SEQ ID NO: 8099735 - DNA, 22 bp, Homo sapiens
tttccaaaggtggcaggaacaa

SEQ ID NO: 8099736 - DNA, 22 bp, Homo sapiens
tttccaaaggtggcaggaacaa

SEQ ID NO: 8099737 - DNA, 22 bp, Homo sapiens
tttcctcttctggcaggcaggg

SEQ ID NO: 8099738 - DNA, 22 bp, Homo sapiens
tttcattggctccctgatgaat

SEQ ID NO: 8099739 - DNA, 22 bp, Homo sapiens
tttccaaaatgaatctaatgca

SEQ ID NO: 8099740 - DNA, 22 bp, Homo sapiens
tttccaaagctgagttgagcaa

SEQ ID NO: 8099741 - DNA, 22 bp, Homo sapiens
tttccttaaatctgtttctagt

SEQ ID NO: 8099742 - DNA, 22 bp, Homo sapiens
tttccttaaatctgtttctagt

SEQ ID NO: 8099743 - DNA, 22 bp, Homo sapiens
tttctaagtgtattgagcttgg

SEQ ID NO: 8099744 - DNA, 22 bp, Homo sapiens
tttctaagtgtgattttagatt

SEQ ID NO: 8099745 - DNA, 22 bp, Homo sapiens
tttctcatggcccttggctttt

SEQ ID NO: 8099746 - DNA, 22 bp, Homo sapiens
tttctccaatgtatcagcacac

SEQ ID NO: 8099747 - DNA, 22 bp, Homo sapiens
tttctcccccatgataatttct

SEQ ID NO: 8099748 - DNA, 22 bp, Homo sapiens
tttctccccagtctaatctgga

SEQ ID NO: 8099749 - DNA, 22 bp, Homo sapiens
tttctcagctgtggagcctatc

SEQ ID NO: 8099750 - DNA, 22 bp, Homo sapiens
tttctattgtaagtctcctata

SEQ ID NO: 8099751 - DNA, 20 bp, Homo sapiens
tttctgtaaggcattaatct

SEQ ID NO: 8099752 - DNA, 22 bp, Homo sapiens
tttctgtaagtggcaaataatg

SEQ ID NO: 8099753 - DNA, 22 bp, Homo sapiens
tttctgctgtgctttcttgcgt

SEQ ID NO: 8099754 - DNA, 17 bp, Homo sapiens
tttctccttccatctca

SEQ ID NO: 8099755 - DNA, 22 bp, Homo sapiens
tttctccttgtgtctcctttga

SEQ ID NO: 8099756 - DNA, 22 bp, Homo sapiens
tttctctagctattcattaaat

SEQ ID NO: 8099757 - DNA, 22 bp, Homo sapiens
tttctcttaatgtctctgtgct

SEQ ID NO: 8099758 - DNA, 22 bp, Homo sapiens
tttctgaaaactgaagtagtgc

SEQ ID NO: 8099759 - DNA, 22 bp, Homo sapiens
tttctcttgcgatatgctacac

SEQ ID NO: 8099760 - DNA, 22 bp, Homo sapiens
tttctcttcactgtgtgcctca

SEQ ID NO: 8099761 - DNA, 22 bp, Homo sapiens
tttcttcaattgctaacaagga

SEQ ID NO: 8099762 - DNA, 22 bp, Homo sapiens
tttcttcagccttcacaacctg

SEQ ID NO: 8099763 - DNA, 19 bp, Homo sapiens
tttcttccaaagactatgg

SEQ ID NO: 8099764 - DNA, 22 bp, Homo sapiens
tttcttcattgatgtcaggtgg

SEQ ID NO: 8099765 - DNA, 19 bp, Homo sapiens
tttcttccaaagactatgg

SEQ ID NO: 8099766 - DNA, 22 bp, Homo sapiens
tttctgtattttgtcataacct

SEQ ID NO: 8099767 - DNA, 22 bp, Homo sapiens
tttctgttaggcatcattttaa

SEQ ID NO: 8099768 - DNA, 22 bp, Homo sapiens
tttctgttaggcatcattttaa

SEQ ID NO: 8099769 - DNA, 22 bp, Homo sapiens
tttctttatcatagcatctttg

SEQ ID NO: 8099770 - DNA, 22 bp, Homo sapiens
tttctttaggctgtgttgccaa

SEQ ID NO: 8099771 - DNA, 22 bp, Homo sapiens
tttcttgtaagatgtttattaa

SEQ ID NO: 8099772 - DNA, 22 bp, Homo sapiens
tttcttctaagatttcaaacta

SEQ ID NO: 8099773 - DNA, 22 bp, Homo sapiens
tttcttctaagatttcaaacta

SEQ ID NO: 8099774 - DNA, 22 bp, Homo sapiens
tttcttctaggactaataagag

SEQ ID NO: 8099775 - DNA, 22 bp, Homo sapiens
tttcttcctaaatatgatttcc

SEQ ID NO: 8099776 - DNA, 22 bp, Homo sapiens
tttcttctcatccctgaaatca

SEQ ID NO: 8099777 - DNA, 22 bp, Homo sapiens
tttcttctcgacaccttatccc

SEQ ID NO: 8099778 - DNA, 22 bp, Homo sapiens
tttcttctatgtgtgatatttt

SEQ ID NO: 8099779 - DNA, 22 bp, Homo sapiens
ttttctaactttacactcgaaa

SEQ ID NO: 8099780 - DNA, 22 bp, Homo sapiens
ttttctttaatctggtggggtg

SEQ ID NO: 8099781 - DNA, 22 bp, Homo sapiens
ttttcttctacctgctgtccaa

SEQ ID NO: 8099782 - DNA, 22 bp, Homo sapiens
ttttctattaactcattttgca

SEQ ID NO: 8099783 - DNA, 22 bp, Homo sapiens
ttttctaacatctagtaatttg

SEQ ID NO: 8099784 - DNA, 22 bp, Homo sapiens
ttttcctttgaaaggtgagggc

SEQ ID NO: 8099785 - DNA, 23 bp, Homo sapiens
ttttcctttggacaggctgtatt

SEQ ID NO: 8099786 - DNA, 22 bp, Homo sapiens
ttttctaaaagaagtcactgat

SEQ ID NO: 8099787 - DNA, 20 bp, Homo sapiens
ttttccttctgagtatgttg

SEQ ID NO: 8099788 - DNA, 22 bp, Homo sapiens
ttttccttctgatactccattt

SEQ ID NO: 8099789 - DNA, 20 bp, Homo sapiens
ttttccttgttgccgctgct

SEQ ID NO: 8099790 - DNA, 22 bp, Homo sapiens
ttttcctttcatcaggacaaag

SEQ ID NO: 8099791 - DNA, 20 bp, Homo sapiens
ttttgcagagaaggcgactg

SEQ ID NO: 8099792 - DNA, 22 bp, Homo sapiens
ttttgaaagccaggtttgtatg

SEQ ID NO: 8099793 - DNA, 22 bp, Homo sapiens
tttttcctagtgctttctggta

SEQ ID NO: 8099794 - DNA, 22 bp, Homo sapiens
tttttccttaggggttactcac

SEQ ID NO: 8099795 - DNA, 22 bp, Homo sapiens
tttttcctagcgatttgtcagc

SEQ ID NO: 8099796 - DNA, 22 bp, Homo sapiens
tttttcctagcgatttgtcagc

SEQ ID NO: 8099797 - DNA, 22 bp, Homo sapiens
tttttccagggttagatgttta

SEQ ID NO: 8099798 - DNA, 22 bp, Homo sapiens
ttttggcagccacatgcacttg

SEQ ID NO: 8099799 - DNA, 22 bp, Homo sapiens
tttttgggtccaggctgtatct

SEQ ID NO: 8099800 - DNA, 22 bp, Homo sapiens
tttgttcacatgtcatgtacaa

SEQ ID NO: 8099801 - DNA, 22 bp, Homo sapiens
tttgttcactatatccctcagt

SEQ ID NO: 8099802 - DNA, 22 bp, Homo sapiens
tttgttcactgatgtatcccaa

SEQ ID NO: 8099803 - DNA, 22 bp, Homo sapiens
tttgttcagagatgttcaagct

SEQ ID NO: 8099804 - DNA, 16 bp, Homo sapiens
tttgttcactccatgg

SEQ ID NO: 8099805 - DNA, 22 bp, Homo sapiens
tttgtcagggatcagatcggta

SEQ ID NO: 8099806 - DNA, 22 bp, Homo sapiens
tttgtcagagaactccagcaaa

SEQ ID NO: 8099807 - DNA, 22 bp, Homo sapiens
tttgtataagaacattctagca

SEQ ID NO: 8099808 - DNA, 22 bp, Homo sapiens
ttttataagcaagaaagggaaa

SEQ ID NO: 8099809 - DNA, 22 bp, Homo sapiens
tttgtttagatggtaaatcagt

SEQ ID NO: 8099810 - DNA, 22 bp, Homo sapiens
tttgttttcaatgtgtcattca

SEQ ID NO: 8099811 - DNA, 22 bp, Homo sapiens
tttgttttcaatgtgtcattca

SEQ ID NO: 8099812 - DNA, 22 bp, Homo sapiens
tttgcagatgagaaaactgtgg

SEQ ID NO: 8099813 - DNA, 22 bp, Homo sapiens
tttgcaatgtgaaattaaagaa

SEQ ID NO: 8099814 - DNA, 22 bp, Homo sapiens
tttgcaaatgctctgcagagct

SEQ ID NO: 8099815 - DNA, 22 bp, Homo sapiens
tttgcaaaatgaggtgaagagt

SEQ ID NO: 8099816 - DNA, 22 bp, Homo sapiens
tttgattttcagcaatagtggc

SEQ ID NO: 8099817 - DNA, 20 bp, Homo sapiens
tttgatttcacaaggccagt

SEQ ID NO: 8099818 - DNA, 22 bp, Homo sapiens
tttctttccatacatattgcta

SEQ ID NO: 8099819 - DNA, 22 bp, Homo sapiens
tttctttctcgtaaacttagtt

SEQ ID NO: 8099820 - DNA, 22 bp, Homo sapiens
tttctttatcctcctttgcaca

SEQ ID NO: 8099821 - DNA, 22 bp, Homo sapiens
cactgcaacctccacctcctgg

SEQ ID NO: 8099822 - DNA, 22 bp, Homo sapiens
cactgcactccagcctgggaga

SEQ ID NO: 8099823 - DNA, 22 bp, Homo sapiens
cactgcactccagcctgggaga

SEQ ID NO: 8099824 - DNA, 22 bp, Homo sapiens
cactccctctagttgcattctg

SEQ ID NO: 8099825 - DNA, 22 bp, Homo sapiens
cactctcagcataatgaatgtg

SEQ ID NO: 8099826 - DNA, 23 bp, Homo sapiens
cactcctgtttctaagccagcat

SEQ ID NO: 8099827 - DNA, 22 bp, Homo sapiens
cactatgcttacatgcttatat

SEQ ID NO: 8099828 - DNA, 22 bp, Homo sapiens
ggccagggccaaggctttccca

SEQ ID NO: 8099829 - DNA, 22 bp, Homo sapiens
ggccaggctggtctcagacttc

SEQ ID NO: 8099830 - DNA, 22 bp, Homo sapiens
cacctgggctaaactatgcagg

SEQ ID NO: 8099831 - DNA, 22 bp, Homo sapiens
cacctgcctggtccttagggct

SEQ ID NO: 8099832 - DNA, 22 bp, Homo sapiens
cacctgctgagctgctgggggt

SEQ ID NO: 8099833 - DNA, 22 bp, Homo sapiens
cacctggcagctgttggccacg

SEQ ID NO: 8099834 - DNA, 22 bp, Homo sapiens
cacctgcctcatttgtccctgc

SEQ ID NO: 8099835 - DNA, 22 bp, Homo sapiens
cacctgccccagtcttggagct

SEQ ID NO: 8099836 - DNA, 22 bp, Homo sapiens
cacctgcccagcacctgggatc

SEQ ID NO: 8099837 - DNA, 22 bp, Homo sapiens
cactgcactccagcctgggtga

SEQ ID NO: 8099838 - DNA, 22 bp, Homo sapiens
cactgcactccagcctgggtga

SEQ ID NO: 8099839 - DNA, 22 bp, Homo sapiens
cactgcactccagcttgggtga

SEQ ID NO: 8099840 - DNA, 22 bp, Homo sapiens
cactgcactccagcctgggtca

SEQ ID NO: 8099841 - DNA, 22 bp, Homo sapiens
cactgcactccagcctgggtca

SEQ ID NO: 8099842 - DNA, 22 bp, Homo sapiens
cactgggcaattctgagcctaa

SEQ ID NO: 8099843 - DNA, 22 bp, Homo sapiens
cactggtgtctgagcagggtga

SEQ ID NO: 8099844 - DNA, 22 bp, Homo sapiens
cactggtgtattagagctagaa

SEQ ID NO: 8099845 - DNA, 22 bp, Homo sapiens
cacttactgtttattgactggc

SEQ ID NO: 8099846 - DNA, 22 bp, Homo sapiens
cacttctgttgccttgtgcaat

SEQ ID NO: 8099847 - DNA, 22 bp, Homo sapiens
cacttgttggtggtgaaatcac

SEQ ID NO: 8099848 - DNA, 22 bp, Homo sapiens
ggctggcaagtcagtgctgatg

SEQ ID NO: 8099849 - DNA, 22 bp, Homo sapiens
cacattcaggtggcatgttaga

SEQ ID NO: 8099850 - DNA, 22 bp, Homo sapiens
cacattccttacattcatagag

SEQ ID NO: 8099851 - DNA, 22 bp, Homo sapiens
cacattcaattacacagatagg

SEQ ID NO: 8099852 - DNA, 22 bp, Homo sapiens
cacatgagagcccccaagagca

SEQ ID NO: 8099853 - DNA, 22 bp, Homo sapiens
cacatgactctggctacccaga

SEQ ID NO: 8099854 - DNA, 16 bp, Homo sapiens
cacatatatttatatg

SEQ ID NO: 8099855 - DNA, 22 bp, Homo sapiens
cacatgaaggctggggtcgtga

SEQ ID NO: 8099856 - DNA, 22 bp, Homo sapiens
cacatatatgaaatgaggaatt

SEQ ID NO: 8099857 - DNA, 22 bp, Homo sapiens
ggcagatggaagaggctgggtc

SEQ ID NO: 8099858 - DNA, 22 bp, Homo sapiens
ggcagagttggtggagtcagtt

SEQ ID NO: 8099859 - DNA, 22 bp, Homo sapiens
ggcagagtgctctgggcagggg

SEQ ID NO: 8099860 - DNA, 22 bp, Homo sapiens
cacaggggcaaactgtagggga

SEQ ID NO: 8099861 - DNA, 22 bp, Homo sapiens
ggagagctagtgcctgccagta

SEQ ID NO: 8099862 - DNA, 22 bp, Homo sapiens
cacagtgactggcacatagtaa

SEQ ID NO: 8099863 - DNA, 22 bp, Homo sapiens
cacagtgacctctttaaaaggg

SEQ ID NO: 8099864 - DNA, 22 bp, Homo sapiens
cacagtgattgatttttacttt

SEQ ID NO: 8099865 - DNA, 18 bp, Homo sapiens
cacagtgacttctgatac

SEQ ID NO: 8099866 - DNA, 22 bp, Homo sapiens
ggcaaggggtcaggctgagaca

SEQ ID NO: 8099867 - DNA, 22 bp, Homo sapiens
ggcaaggggtcaggctgagaca

SEQ ID NO: 8099868 - DNA, 22 bp, Homo sapiens
cacagtacccagcactactgag

SEQ ID NO: 8099869 - DNA, 22 bp, Homo sapiens
cacagtgaagcatgcagacatc

SEQ ID NO: 8099870 - DNA, 22 bp, Homo sapiens
cacagtaactggcgtgtagtaa

SEQ ID NO: 8099871 - DNA, 22 bp, Homo sapiens
ggagaagggtatgtgtggcgga

SEQ ID NO: 8099872 - DNA, 22 bp, Homo sapiens
cacacagggagaaagaaagcct

SEQ ID NO: 8099873 - DNA, 22 bp, Homo sapiens
cacacaggtaagcctctttcaa

SEQ ID NO: 8099874 - DNA, 22 bp, Homo sapiens
cacacaggatgaagcagcagaa

SEQ ID NO: 8099875 - DNA, 22 bp, Homo sapiens
cacacaggcaggatcccttccc

SEQ ID NO: 8099876 - DNA, 22 bp, Homo sapiens
ggaccagagaagtgagcacctg

SEQ ID NO: 8099877 - DNA, 22 bp, Homo sapiens
cacacaggtatatatatgtaca

SEQ ID NO: 8099878 - DNA, 17 bp, Homo sapiens
cacaactggctgattga

SEQ ID NO: 8099879 - DNA, 22 bp, Homo sapiens
cacaaatggccgtgttcaaaga

SEQ ID NO: 8099880 - DNA, 19 bp, Homo sapiens
cacaaatgatgaggacctg

SEQ ID NO: 8099881 - DNA, 22 bp, Homo sapiens
ggacatttagaacagagtattt

SEQ ID NO: 8099882 - DNA, 22 bp, Homo sapiens
ggacatgttccttttcatcttt

SEQ ID NO: 8099883 - DNA, 22 bp, Homo sapiens
ggaccaaaattacagtcgctcc

SEQ ID NO: 8099884 - DNA, 22 bp, Homo sapiens
ggaccaaatgctttttaattga

SEQ ID NO: 8099885 - DNA, 22 bp, Homo sapiens
ggaagctgccagtccaccagct

SEQ ID NO: 8099886 - DNA, 20 bp, Homo sapiens
ggaagctgtgggtccccagg

SEQ ID NO: 8099887 - DNA, 22 bp, Homo sapiens
caatatataggaacaacttagg

SEQ ID NO: 8099888 - DNA, 22 bp, Homo sapiens
caatatataggaacaacttagg

SEQ ID NO: 8099889 - DNA, 22 bp, Homo sapiens
caatagaaaactcaatacttaa

SEQ ID NO: 8099890 - DNA, 22 bp, Homo sapiens
caaggctggagtgtaatggcat

SEQ ID NO: 8099891 - DNA, 22 bp, Homo sapiens
caaggcttatcagccaggagcc

SEQ ID NO: 8099892 - DNA, 22 bp, Homo sapiens
caaggctgtgttagctgccctc

SEQ ID NO: 8099893 - DNA, 22 bp, Homo sapiens
caatcaatgctgctagttcctt

SEQ ID NO: 8099894 - DNA, 21 bp, Homo sapiens
caatcacttttgcaccaagct

SEQ ID NO: 8099895 - DNA, 22 bp, Homo sapiens
gctggacaggccacatggagga

SEQ ID NO: 8099896 - DNA, 22 bp, Homo sapiens
caagaattaagaattttgatgt

SEQ ID NO: 8099897 - DNA, 22 bp, Homo sapiens
gctgctggcgctgggcgtccgg

SEQ ID NO: 8099898 - DNA, 22 bp, Homo sapiens
gctgctggccgcccagcttctc

SEQ ID NO: 8099899 - DNA, 22 bp, Homo sapiens
gctgcctgcctgcatttaatcc

SEQ ID NO: 8099900 - DNA, 18 bp, Homo sapiens
gctgcctgcattcctcac

SEQ ID NO: 8099901 - DNA, 22 bp, Homo sapiens
gctgcctgcagtgttttcccag

SEQ ID NO: 8099902 - DNA, 22 bp, Homo sapiens
gctgggcttgtggccagctggg

SEQ ID NO: 8099903 - DNA, 22 bp, Homo sapiens
gctgggctcagacctagtgaac

SEQ ID NO: 8099904 - DNA, 22 bp, Homo sapiens
caagctactcaggcaagatgtg

SEQ ID NO: 8099905 - DNA, 17 bp, Homo sapiens
gctggctgacccatgcc

SEQ ID NO: 8099906 - DNA, 22 bp, Homo sapiens
caaattttgtgtgttctctagt

SEQ ID NO: 8099907 - DNA, 22 bp, Homo sapiens
caacaacatgggattcatttct

SEQ ID NO: 8099908 - DNA, 22 bp, Homo sapiens
caactatagggagagtggttaa

SEQ ID NO: 8099909 - DNA, 22 bp, Homo sapiens
caactatagatcaaatgagttt

SEQ ID NO: 8099910 - DNA, 22 bp, Homo sapiens
caactactggtgctcaggaaat

SEQ ID NO: 8099911 - DNA, 22 bp, Homo sapiens
caactacatccacactttgtta

SEQ ID NO: 8099912 - DNA, 22 bp, Homo sapiens
caacaatgaatgtttgagtgcc

SEQ ID NO: 8099913 - DNA, 22 bp, Homo sapiens
caacacaggggttatgccatgg

SEQ ID NO: 8099914 - DNA, 22 bp, Homo sapiens
caacacattgaagctatgatga

SEQ ID NO: 8099915 - DNA, 22 bp, Homo sapiens
caagaaatttcttaagaactaa

SEQ ID NO: 8099916 - DNA, 22 bp, Homo sapiens
caagaaattctgttcagatagc

SEQ ID NO: 8099917 - DNA, 22 bp, Homo sapiens
caaagtcagctgccagtcccaa

SEQ ID NO: 8099918 - DNA, 22 bp, Homo sapiens
caaagtcagccagctagtaggt

SEQ ID NO: 8099919 - DNA, 22 bp, Homo sapiens
caaagtcatggggatgcaggtc

SEQ ID NO: 8099920 - DNA, 22 bp, Homo sapiens
caaagtcatggggatgcaggtc

SEQ ID NO: 8099921 - DNA, 22 bp, Homo sapiens
caaagtcagggaagagtggctg

SEQ ID NO: 8099922 - DNA, 22 bp, Homo sapiens
caaagtcataaaacttgtaagt

SEQ ID NO: 8099923 - DNA, 22 bp, Homo sapiens
caaagtcttcagttgattctga

SEQ ID NO: 8099924 - DNA, 22 bp, Homo sapiens
caaagtcttcagttgattctga

SEQ ID NO: 8099925 - DNA, 22 bp, Homo sapiens
caaagtgagttataaacatctt

SEQ ID NO: 8099926 - DNA, 22 bp, Homo sapiens
caaagtcttggtgatcaacttt

SEQ ID NO: 8099927 - DNA, 22 bp, Homo sapiens
gctgccctgcatctgtgccttc

SEQ ID NO: 8099928 - DNA, 22 bp, Homo sapiens
ggggccttggatctgtgccccg

SEQ ID NO: 8099929 - DNA, 22 bp, Homo sapiens
ggggcctgtagagcttcaggga

SEQ ID NO: 8099930 - DNA, 22 bp, Homo sapiens
ggggccttttctgaatgtggaa

SEQ ID NO: 8099931 - DNA, 22 bp, Homo sapiens
ggggcctctgggaacccctgtg

SEQ ID NO: 8099932 - DNA, 21 bp, Homo sapiens
ggggcctctccacacagccgg

SEQ ID NO: 8099933 - DNA, 22 bp, Homo sapiens
ggggcctctgcagtcacgctgg

SEQ ID NO: 8099934 - DNA, 22 bp, Homo sapiens
ggggcagatggaacagagcaca

SEQ ID NO: 8099935 - DNA, 22 bp, Homo sapiens
ggggcagagagaaggaagcttg

SEQ ID NO: 8099936 - DNA, 22 bp, Homo sapiens
ggggaggaagctctcagttcca

SEQ ID NO: 8099937 - DNA, 21 bp, Homo sapiens
ggggcagagctaggccctgca

SEQ ID NO: 8099938 - DNA, 22 bp, Homo sapiens
gggctgtcacgcccctgcacct

SEQ ID NO: 8099939 - DNA, 22 bp, Homo sapiens
gggctggagttgggaagacaaa

SEQ ID NO: 8099940 - DNA, 22 bp, Homo sapiens
cagagccactgtctgccaggca

SEQ ID NO: 8099941 - DNA, 22 bp, Homo sapiens
cagagccagcccactgttcccg

SEQ ID NO: 8099942 - DNA, 22 bp, Homo sapiens
gggctggaggagatccagaggc

SEQ ID NO: 8099943 - DNA, 21 bp, Homo sapiens
gggctggaggatgggaagccc

SEQ ID NO: 8099944 - DNA, 22 bp, Homo sapiens
gggctggaggcctgcctggtta

SEQ ID NO: 8099945 - DNA, 22 bp, Homo sapiens
gggctggaggtgagcaggacag

SEQ ID NO: 8099946 - DNA, 19 bp, Homo sapiens
gggctggagggatagagcc

SEQ ID NO: 8099947 - DNA, 22 bp, Homo sapiens
gggctggaggtgagcaggacag

SEQ ID NO: 8099948 - DNA, 22 bp, Homo sapiens
gggtacttaatatttacggggt

SEQ ID NO: 8099949 - DNA, 22 bp, Homo sapiens
gggtagcagcagggttcctatg

SEQ ID NO: 8099950 - DNA, 18 bp, Homo sapiens
gggtcctgttcttggaag

SEQ ID NO: 8099951 - DNA, 22 bp, Homo sapiens
gggtcctggaatctgcatttta

SEQ ID NO: 8099952 - DNA, 18 bp, Homo sapiens
gggtcctgtgggagacag

SEQ ID NO: 8099953 - DNA, 21 bp, Homo sapiens
gggtcctgggatgggatccag

SEQ ID NO: 8099954 - DNA, 22 bp, Homo sapiens
gggtcctgcgtgggcccaggac

SEQ ID NO: 8099955 - DNA, 22 bp, Homo sapiens
gggtcctatccacttttctatt

SEQ ID NO: 8099956 - DNA, 22 bp, Homo sapiens
ggtcacaccccaagtacattcg

SEQ ID NO: 8099957 - DNA, 21 bp, Homo sapiens
ggtcacacagctggtaaatag

SEQ ID NO: 8099958 - DNA, 22 bp, Homo sapiens
ggctggcacccttggggatagg

SEQ ID NO: 8099959 - DNA, 22 bp, Homo sapiens
ggctggcactgaggagagctct

SEQ ID NO: 8099960 - DNA, 22 bp, Homo sapiens
ggctggcaagtgtctgctcatg

SEQ ID NO: 8099961 - DNA, 22 bp, Homo sapiens
ggctggcacagagggctggtgt

SEQ ID NO: 8099962 - DNA, 22 bp, Homo sapiens
ggctggcacaaagctccaaatc

SEQ ID NO: 8099963 - DNA, 22 bp, Homo sapiens
cagaattcgaatgagcagaatc

SEQ ID NO: 8099964 - DNA, 21 bp, Homo sapiens
gggagctggaaactgggtgac

SEQ ID NO: 8099965 - DNA, 22 bp, Homo sapiens
gggaggcagtgctggaggctgg

SEQ ID NO: 8099966 - DNA, 22 bp, Homo sapiens
gggaggcacgaggcgcgcagtg

SEQ ID NO: 8099967 - DNA, 22 bp, Homo sapiens
gggaggagtgaagattcacctg

SEQ ID NO: 8099968 - DNA, 22 bp, Homo sapiens
gggagctgatgatgtaagtccc

SEQ ID NO: 8099969 - DNA, 22 bp, Homo sapiens
cagacacttattgagcaagtac

SEQ ID NO: 8099970 - DNA, 22 bp, Homo sapiens
cagacactgcagcagtctccca

SEQ ID NO: 8099971 - DNA, 22 bp, Homo sapiens
cagagcagaagcggtcctcaca

SEQ ID NO: 8099972 - DNA, 22 bp, Homo sapiens
cagagcagaaacctgggtgatt

SEQ ID NO: 8099973 - DNA, 22 bp, Homo sapiens
cagagaggaggctatatgcaaa

SEQ ID NO: 8099974 - DNA, 22 bp, Homo sapiens
cagagcagtggagagtaggtct

SEQ ID NO: 8099975 - DNA, 20 bp, Homo sapiens
cagagcagtgcccaggcggc

SEQ ID NO: 8099976 - DNA, 19 bp, Homo sapiens
cagagcagtggttcctgaa

SEQ ID NO: 8099977 - DNA, 22 bp, Homo sapiens
cagagcagtggggttggtcaga

SEQ ID NO: 8099978 - DNA, 22 bp, Homo sapiens
cagagccaaaaccgtaacagcc

SEQ ID NO: 8099979 - DNA, 22 bp, Homo sapiens
cagagccaacgccacctgccca

SEQ ID NO: 8099980 - DNA, 20 bp, Homo sapiens
cagagccaagagcagcatct

SEQ ID NO: 8099981 - DNA, 22 bp, Homo sapiens
gggcaggggtcagtggccccaa

SEQ ID NO: 8099982 - DNA, 22 bp, Homo sapiens
cagagcaggggtttcccaggtt

SEQ ID NO: 8099983 - DNA, 22 bp, Homo sapiens
cagagcagtgaggagttgtgta

SEQ ID NO: 8099984 - DNA, 22 bp, Homo sapiens
gggcaggggtagcattccaagt

SEQ ID NO: 8099985 - DNA, 18 bp, Homo sapiens
cagagcagaggtggagcg

SEQ ID NO: 8099986 - DNA, 22 bp, Homo sapiens
cagagcagacgttgagattaag

SEQ ID NO: 8099987 - DNA, 22 bp, Homo sapiens
cagagcagaaggtccaagcctg

SEQ ID NO: 8099988 - DNA, 22 bp, Homo sapiens
gtgagagctcagctgccctggg

SEQ ID NO: 8099989 - DNA, 22 bp, Homo sapiens
gtgagagggctgggctcatgat

SEQ ID NO: 8099990 - DNA, 22 bp, Homo sapiens
gtgagagcctgtctggatgtcg

SEQ ID NO: 8099991 - DNA, 22 bp, Homo sapiens
cagccctcatctcagcttcttt

SEQ ID NO: 8099992 - DNA, 22 bp, Homo sapiens
cagccctctgaagaggcgcttg

SEQ ID NO: 8099993 - DNA, 22 bp, Homo sapiens
cagccctctctgggccccaagg

SEQ ID NO: 8099994 - DNA, 22 bp, Homo sapiens
cagccctcctttcactcccagg

SEQ ID NO: 8099995 - DNA, 22 bp, Homo sapiens
cagccctgtccaatgtctgctc

SEQ ID NO: 8099996 - DNA, 22 bp, Homo sapiens
cagccctgaaacaacctcctct

SEQ ID NO: 8099997 - DNA, 22 bp, Homo sapiens
gtattttacttacgcatgactt

SEQ ID NO: 8099998 - DNA, 22 bp, Homo sapiens
gtattttacttacgcatgactt

SEQ ID NO: 8099999 - DNA, 22 bp, Homo sapiens
gtcacacaggttgaaatgcagt

SEQ ID NO: 8100000 - DNA, 22 bp, Homo sapiens
gtcacacaatagtaagtggtcc

SEQ ID NO: 8100001 - DNA, 22 bp, Homo sapiens
gtcacacagagccctgtgctca

SEQ ID NO: 8100002 - DNA, 22 bp, Homo sapiens
gtcacacagggcctccaaatca

SEQ ID NO: 8100003 - DNA, 22 bp, Homo sapiens
gtcagatctttggggatgctgt

SEQ ID NO: 8100004 - DNA, 21 bp, Homo sapiens
gtcagcagatccagcacttgt

SEQ ID NO: 8100005 - DNA, 22 bp, Homo sapiens
gtcagcagaaacgccacatgca

SEQ ID NO: 8100006 - DNA, 22 bp, Homo sapiens
gtcagcagggctccctggcagg

SEQ ID NO: 8100007 - DNA, 17 bp, Homo sapiens
gtcagcagcttgcttgt

SEQ ID NO: 8100008 - DNA, 22 bp, Homo sapiens
gtcagcagcatgtttaatcaaa

SEQ ID NO: 8100009 - DNA, 22 bp, Homo sapiens
gtcagcagggtccccttgagtg

SEQ ID NO: 8100010 - DNA, 22 bp, Homo sapiens
gtcagcagtgtcagctctgggg

SEQ ID NO: 8100011 - DNA, 22 bp, Homo sapiens
gtcagcagtggcagctcccggg

SEQ ID NO: 8100012 - DNA, 22 bp, Homo sapiens
cagccagctggtgcggcagagc

SEQ ID NO: 8100013 - DNA, 22 bp, Homo sapiens
gtactcagtaatataacatatt

SEQ ID NO: 8100014 - DNA, 22 bp, Homo sapiens
gtactagatgagacagcgtggg

SEQ ID NO: 8100015 - DNA, 22 bp, Homo sapiens
gtactaaacagagaaccaatat

SEQ ID NO: 8100016 - DNA, 22 bp, Homo sapiens
cagcagccactagagggctcac

SEQ ID NO: 8100017 - DNA, 22 bp, Homo sapiens
cagcagcccacgcgtgctgtcc

SEQ ID NO: 8100018 - DNA, 22 bp, Homo sapiens
cagattcactaatagctggcct

SEQ ID NO: 8100019 - DNA, 22 bp, Homo sapiens
cagattcaacctaagacaatct

SEQ ID NO: 8100020 - DNA, 22 bp, Homo sapiens
ctttcaaaacgctctgtatgca

SEQ ID NO: 8100021 - DNA, 22 bp, Homo sapiens
ctttattgtccttcttaggtgg

SEQ ID NO: 8100022 - DNA, 22 bp, Homo sapiens
ctttacttctcaaaataaagca

SEQ ID NO: 8100023 - DNA, 22 bp, Homo sapiens
ctttacatcctgtttcccgttt

SEQ ID NO: 8100024 - DNA, 22 bp, Homo sapiens
ctttacattaatttctactgat

SEQ ID NO: 8100025 - DNA, 22 bp, Homo sapiens
ctttacataaggataaacctgg

SEQ ID NO: 8100026 - DNA, 22 bp, Homo sapiens
atctttcatctctattatttga

SEQ ID NO: 8100027 - DNA, 21 bp, Homo sapiens
atctttattacgcagagaaga

SEQ ID NO: 8100028 - DNA, 22 bp, Homo sapiens
ctttgccatgggcttgataggt

SEQ ID NO: 8100029 - DNA, 22 bp, Homo sapiens
ctttgccatgttgcctgcagaa

SEQ ID NO: 8100030 - DNA, 22 bp, Homo sapiens
ctttcaaaacgctctgtatgca

SEQ ID NO: 8100031 - DNA, 23 bp, Homo sapiens
ctttgccacccagagcctgacag

SEQ ID NO: 8100032 - DNA, 19 bp, Homo sapiens
ctttgccactgataggagt

SEQ ID NO: 8100033 - DNA, 22 bp, Homo sapiens
ctttgccagagaggctggcaca

SEQ ID NO: 8100034 - DNA, 22 bp, Homo sapiens
ctttttcaagtcaaagagggta

SEQ ID NO: 8100035 - DNA, 19 bp, Homo sapiens
atgagcaatagttttaatc

SEQ ID NO: 8100036 - DNA, 22 bp, Homo sapiens
atgagcagatgctcctgcctct

SEQ ID NO: 8100037 - DNA, 22 bp, Homo sapiens
atgagcaggtttaagagaggcc

SEQ ID NO: 8100038 - DNA, 19 bp, Homo sapiens
atgagcaggcaagacaagc

SEQ ID NO: 8100039 - DNA, 22 bp, Homo sapiens
atgagcagtttttaagtagcaa

SEQ ID NO: 8100040 - DNA, 22 bp, Homo sapiens
atgagcagtaggttcatggctg

SEQ ID NO: 8100041 - DNA, 22 bp, Homo sapiens
gaagagagcagcaaactggagt

SEQ ID NO: 8100042 - DNA, 22 bp, Homo sapiens
gaaggagggtgcggatctgagc

SEQ ID NO: 8100043 - DNA, 22 bp, Homo sapiens
gaaggagggagcggcgcggatt

SEQ ID NO: 8100044 - DNA, 22 bp, Homo sapiens
gaaggaggtgtcagttggactg

SEQ ID NO: 8100045 - DNA, 22 bp, Homo sapiens
atgcagttagtatacttccagt

SEQ ID NO: 8100046 - DNA, 22 bp, Homo sapiens
gaaggaggctccccaaagtctg

SEQ ID NO: 8100047 - DNA, 22 bp, Homo sapiens
gaatttgaaaagtgatgggaat

SEQ ID NO: 8100048 - DNA, 22 bp, Homo sapiens
gaatttcctctaaacccctgag

SEQ ID NO: 8100049 - DNA, 22 bp, Homo sapiens
atgctaaggcccaggagaaaat

SEQ ID NO: 8100050 - DNA, 22 bp, Homo sapiens
gacaggaaacaagaaggcagga

SEQ ID NO: 8100051 - DNA, 22 bp, Homo sapiens
atgccactgcacttcagcctgg

SEQ ID NO: 8100052 - DNA, 22 bp, Homo sapiens
atgccactgcacttcagcctgg

SEQ ID NO: 8100053 - DNA, 22 bp, Homo sapiens
atgccactgcacttcagcttgg

SEQ ID NO: 8100054 - DNA, 22 bp, Homo sapiens
atgccactgcacttcagcttgg

SEQ ID NO: 8100055 - DNA, 22 bp, Homo sapiens
atgccactgcactccagcctgg

SEQ ID NO: 8100056 - DNA, 22 bp, Homo sapiens
atgccactgcactccagcctgg

SEQ ID NO: 8100057 - DNA, 22 bp, Homo sapiens
atgccactgcactccagcctag

SEQ ID NO: 8100058 - DNA, 22 bp, Homo sapiens
atgccactgcactccagcctag

SEQ ID NO: 8100059 - DNA, 22 bp, Homo sapiens
gaagtataggagacaaacaaga

SEQ ID NO: 8100060 - DNA, 22 bp, Homo sapiens
gaagtccagaatactgctctga

SEQ ID NO: 8100061 - DNA, 22 bp, Homo sapiens
gaagtcagtcatctcctgtctc

SEQ ID NO: 8100062 - DNA, 22 bp, Homo sapiens
atgtcagattcctaaatatctt

SEQ ID NO: 8100063 - DNA, 22 bp, Homo sapiens
atgtcagagcttccacaatagt

SEQ ID NO: 8100064 - DNA, 22 bp, Homo sapiens
atgtcagaatctacattctact

SEQ ID NO: 8100065 - DNA, 22 bp, Homo sapiens
atgtcagatcctcagaaagtct

SEQ ID NO: 8100066 - DNA, 22 bp, Homo sapiens
atgtggcccagcggtcaggctg

SEQ ID NO: 8100067 - DNA, 21 bp, Homo sapiens
atgtggccattgtagtccacg

SEQ ID NO: 8100068 - DNA, 22 bp, Homo sapiens
atgtgctttccaatgctgtagg

SEQ ID NO: 8100069 - DNA, 22 bp, Homo sapiens
atgtgctttaggtttgtttaca

SEQ ID NO: 8100070 - DNA, 22 bp, Homo sapiens
atgtgcttgagggaaatcagtt

SEQ ID NO: 8100071 - DNA, 22 bp, Homo sapiens
gaggtgtggtcctcagccccca

SEQ ID NO: 8100072 - DNA, 22 bp, Homo sapiens
gaggtgtgctgcggcccggtgc

SEQ ID NO: 8100073 - DNA, 22 bp, Homo sapiens
gaggtgttgggtgaggtgcctg

SEQ ID NO: 8100074 - DNA, 22 bp, Homo sapiens
gaggtgtgcacagcgtgctgac

SEQ ID NO: 8100075 - DNA, 22 bp, Homo sapiens
atgttacagggagagaaggcca

SEQ ID NO: 8100076 - DNA, 22 bp, Homo sapiens
atgttactgtgatcatgatact

SEQ ID NO: 8100077 - DNA, 22 bp, Homo sapiens
atgtggccttaatgacagcagc

SEQ ID NO: 8100078 - DNA, 22 bp, Homo sapiens
gaggagctgggtcagggagaca

SEQ ID NO: 8100079 - DNA, 22 bp, Homo sapiens
atgggcaggcaaggtggcgagt

SEQ ID NO: 8100080 - DNA, 22 bp, Homo sapiens
gaggagggcagttcctctttta

SEQ ID NO: 8100081 - DNA, 22 bp, Homo sapiens
gaggcacagagtaggtgcacac

SEQ ID NO: 8100082 - DNA, 22 bp, Homo sapiens
gaggaggggacagtacttgtgc

SEQ ID NO: 8100083 - DNA, 22 bp, Homo sapiens
gaggcacagtcccgaggcaagg

SEQ ID NO: 8100084 - DNA, 22 bp, Homo sapiens
gaggcctgggttggaggtgcat

SEQ ID NO: 8100085 - DNA, 22 bp, Homo sapiens
gaggctccctttaggtccagat

SEQ ID NO: 8100086 - DNA, 22 bp, Homo sapiens
atggctgaggctggaggtggca

SEQ ID NO: 8100087 - DNA, 22 bp, Homo sapiens
atggcagagaaagcgagccaca

SEQ ID NO: 8100088 - DNA, 22 bp, Homo sapiens
atggcagacctgggctggagaa

SEQ ID NO: 8100089 - DNA, 22 bp, Homo sapiens
atggcagacgaggcagcagggg

SEQ ID NO: 8100090 - DNA, 22 bp, Homo sapiens
atgggaggaagagaagatgtct

SEQ ID NO: 8100091 - DNA, 22 bp, Homo sapiens
atgggagggtggaaaggctctg

SEQ ID NO: 8100092 - DNA, 21 bp, Homo sapiens
atgggcagaggcagagaggct

SEQ ID NO: 8100093 - DNA, 22 bp, Homo sapiens
gagctgcatagctgggatcctc

SEQ ID NO: 8100094 - DNA, 20 bp, Homo sapiens
gagctgagtgtggtcatggg

SEQ ID NO: 8100095 - DNA, 22 bp, Homo sapiens
gagccccaggacagctctagtt

SEQ ID NO: 8100096 - DNA, 22 bp, Homo sapiens
atgggcagagctggtgggaggc

SEQ ID NO: 8100097 - DNA, 22 bp, Homo sapiens
atgggcagacagggagctcacg

SEQ ID NO: 8100098 - DNA, 22 bp, Homo sapiens
atgctggggcctcagaccagaa

SEQ ID NO: 8100099 - DNA, 22 bp, Homo sapiens
atgcttaaccttggtgtacaat

SEQ ID NO: 8100100 - DNA, 22 bp, Homo sapiens
gagaatatcttggcagtctctg

SEQ ID NO: 8100101 - DNA, 22 bp, Homo sapiens
atggcagaaagaatagaggcta

SEQ ID NO: 8100102 - DNA, 22 bp, Homo sapiens
atggcagacacaggcaggcaga

SEQ ID NO: 8100103 - DNA, 22 bp, Homo sapiens
atggcagaattaggatttcaag

SEQ ID NO: 8100104 - DNA, 22 bp, Homo sapiens
gccagccacttcccagactggc

SEQ ID NO: 8100105 - DNA, 22 bp, Homo sapiens
gccagccagagtccatctgaga

SEQ ID NO: 8100106 - DNA, 22 bp, Homo sapiens
gccagagtgatgtaacatatat

SEQ ID NO: 8100107 - DNA, 22 bp, Homo sapiens
gccagagtcttctgaccctgtg

SEQ ID NO: 8100108 - DNA, 22 bp, Homo sapiens
gccagagttgaggcagtttatt

SEQ ID NO: 8100109 - DNA, 20 bp, Homo sapiens
gccagagttatgatgagagg

SEQ ID NO: 8100110 - DNA, 22 bp, Homo sapiens
gccagagtgccatcagtgccat

SEQ ID NO: 8100111 - DNA, 22 bp, Homo sapiens
atttattacctcggagtttctg

SEQ ID NO: 8100112 - DNA, 22 bp, Homo sapiens
gccagctggaaatctgcttgaa

SEQ ID NO: 8100113 - DNA, 22 bp, Homo sapiens
atttcttatgaatattgactgt

SEQ ID NO: 8100114 - DNA, 22 bp, Homo sapiens
atttcttcaggttcttctagga

SEQ ID NO: 8100115 - DNA, 22 bp, Homo sapiens
atttcttcaggtcagaaataga

SEQ ID NO: 8100116 - DNA, 22 bp, Homo sapiens
atttcttacataacaaattgtt

SEQ ID NO: 8100117 - DNA, 22 bp, Homo sapiens
atttcttatctgaggtctacat

SEQ ID NO: 8100118 - DNA, 22 bp, Homo sapiens
atttcttaaaacttcagggaga

SEQ ID NO: 8100119 - DNA, 22 bp, Homo sapiens
gccctgtgccagtcacgctgtg

SEQ ID NO: 8100120 - DNA, 17 bp, Homo sapiens
atttcccagcagtgcta

SEQ ID NO: 8100121 - DNA, 17 bp, Homo sapiens
gccctgcctgctgccct

SEQ ID NO: 8100122 - DNA, 23 bp, Homo sapiens
atttcccattgtgtcagcagagc

SEQ ID NO: 8100123 - DNA, 22 bp, Homo sapiens
atttattggtttgcatggtgaa

SEQ ID NO: 8100124 - DNA, 19 bp, Homo sapiens
atttattgtatgattccat

SEQ ID NO: 8100125 - DNA, 22 bp, Homo sapiens
atttcaaggactacttttcaat

SEQ ID NO: 8100126 - DNA, 22 bp, Homo sapiens
attttcaggttttgccattgta

SEQ ID NO: 8100127 - DNA, 22 bp, Homo sapiens
attttcagcccccactcgtggc

SEQ ID NO: 8100128 - DNA, 22 bp, Homo sapiens
atttgtcagtggaagtgattca

SEQ ID NO: 8100129 - DNA, 22 bp, Homo sapiens
atttgtatcaatctcaatatat

SEQ ID NO: 8100130 - DNA, 22 bp, Homo sapiens
atttcttccattgcctcttcaa

SEQ ID NO: 8100131 - DNA, 22 bp, Homo sapiens
atttcttcctctgtcagtaact

SEQ ID NO: 8100132 - DNA, 22 bp, Homo sapiens
atttggggctcaccagggctga

SEQ ID NO: 8100133 - DNA, 22 bp, Homo sapiens
attttcagtgatcatagcacac

SEQ ID NO: 8100134 - DNA, 22 bp, Homo sapiens
attttcagtgtaaatgttttat

SEQ ID NO: 8100135 - DNA, 22 bp, Homo sapiens
attttcagttgaaaaagttggt

SEQ ID NO: 8100136 - DNA, 22 bp, Homo sapiens
attttcatcatgggtttaacat

SEQ ID NO: 8100137 - DNA, 21 bp, Homo sapiens
attttcattaattcagtgtgg

SEQ ID NO: 8100138 - DNA, 22 bp, Homo sapiens
attttcattttgcagggtgaga

SEQ ID NO: 8100139 - DNA, 22 bp, Homo sapiens
attttccagcctttctagaact

SEQ ID NO: 8100140 - DNA, 22 bp, Homo sapiens
attttccaaaataattgttact

SEQ ID NO: 8100141 - DNA, 22 bp, Homo sapiens
attttccatctccacaccaggg

SEQ ID NO: 8100142 - DNA, 22 bp, Homo sapiens
attttcctagtcatgtgcttct

SEQ ID NO: 8100143 - DNA, 22 bp, Homo sapiens
gcctgtgctgttccctctgcca

SEQ ID NO: 8100144 - DNA, 22 bp, Homo sapiens
attttgctggtctgaattactt

SEQ ID NO: 8100145 - DNA, 22 bp, Homo sapiens
attttgctgctatgccttgcaa

SEQ ID NO: 8100146 - DNA, 22 bp, Homo sapiens
caaaagaagctcttggggctag

SEQ ID NO: 8100147 - DNA, 22 bp, Homo sapiens
caaaagatacttgcatctaact

SEQ ID NO: 8100148 - DNA, 22 bp, Homo sapiens
gctcccaggttcttgggccttg

SEQ ID NO: 8100149 - DNA, 22 bp, Homo sapiens
gctcccagggcagcgcagaaga

SEQ ID NO: 8100150 - DNA, 22 bp, Homo sapiens
gctcccagttcccaaagtgacc

SEQ ID NO: 8100151 - DNA, 22 bp, Homo sapiens
gctcccagtctgatggaggaga

SEQ ID NO: 8100152 - DNA, 22 bp, Homo sapiens
gctcccagggacactggccact

SEQ ID NO: 8100153 - DNA, 22 bp, Homo sapiens
gctcccaggcatggaggtaatt

SEQ ID NO: 8100154 - DNA, 22 bp, Homo sapiens
gctcccagggaccgcagggcag

SEQ ID NO: 8100155 - DNA, 22 bp, Homo sapiens
caaagaggtgagaggagccttt

SEQ ID NO: 8100156 - DNA, 22 bp, Homo sapiens
gctctgctgtcttcttgcaggc

SEQ ID NO: 8100157 - DNA, 22 bp, Homo sapiens
caaagaatagtgagaagatgta

SEQ ID NO: 8100158 - DNA, 22 bp, Homo sapiens
caaagaatgagtgagtacataa

SEQ ID NO: 8100159 - DNA, 22 bp, Homo sapiens
caaagaatagcatggcatttgt

SEQ ID NO: 8100160 - DNA, 22 bp, Homo sapiens
attgcactccggcctgggtgac

SEQ ID NO: 8100161 - DNA, 22 bp, Homo sapiens
attgcactccagcctgggggac

SEQ ID NO: 8100162 - DNA, 22 bp, Homo sapiens
attgcactccagcctgggtgac

SEQ ID NO: 8100163 - DNA, 19 bp, Homo sapiens
gcatgcttggtggcttctg

SEQ ID NO: 8100164 - DNA, 22 bp, Homo sapiens
gcatggcagtgaggatggtgct

SEQ ID NO: 8100165 - DNA, 22 bp, Homo sapiens
gcatggcaagaccctgtctcta

SEQ ID NO: 8100166 - DNA, 22 bp, Homo sapiens
attcttttttaaggaatagaac

SEQ ID NO: 8100167 - DNA, 20 bp, Homo sapiens
attctgctttgaaaataagg

SEQ ID NO: 8100168 - DNA, 16 bp, Homo sapiens
attctgctgcctgctc

SEQ ID NO: 8100169 - DNA, 22 bp, Homo sapiens
gcagggcatccctgagcgggtg

SEQ ID NO: 8100170 - DNA, 22 bp, Homo sapiens
gcagggcatagaggcacggagg

SEQ ID NO: 8100171 - DNA, 22 bp, Homo sapiens
gcagggcagtgtgtctgtgggg

SEQ ID NO: 8100172 - DNA, 22 bp, Homo sapiens
attcttttaagccccagggatt

SEQ ID NO: 8100173 - DNA, 22 bp, Homo sapiens
attcttttcccaactgctttaa

SEQ ID NO: 8100174 - DNA, 22 bp, Homo sapiens
attcttttgtcctagcttgata

SEQ ID NO: 8100175 - DNA, 22 bp, Homo sapiens
attcttttaaatggcagtagta

SEQ ID NO: 8100176 - DNA, 22 bp, Homo sapiens
gcagcttcaagatactttttct

SEQ ID NO: 8100177 - DNA, 22 bp, Homo sapiens
attctctgtttccaagatgaaa

SEQ ID NO: 8100178 - DNA, 17 bp, Homo sapiens
attctcagtgtacagtg

SEQ ID NO: 8100179 - DNA, 22 bp, Homo sapiens
attctcatttgctggctatatg

SEQ ID NO: 8100180 - DNA, 22 bp, Homo sapiens
attctcagttcactagtttctt

SEQ ID NO: 8100181 - DNA, 22 bp, Homo sapiens
attctgaggacagagtctagca

SEQ ID NO: 8100182 - DNA, 22 bp, Homo sapiens
attccaaagcacatcagaacta

SEQ ID NO: 8100183 - DNA, 22 bp, Homo sapiens
attcacaaaatgatatagatac

SEQ ID NO: 8100184 - DNA, 22 bp, Homo sapiens
attcacaaagaagggaagtaca

SEQ ID NO: 8100185 - DNA, 22 bp, Homo sapiens
attcatgaatctacattgtggt

SEQ ID NO: 8100186 - DNA, 19 bp, Homo sapiens
attcatgaaggcttgaagg

SEQ ID NO: 8100187 - DNA, 17 bp, Homo sapiens
attcatgaacatgtcct

SEQ ID NO: 8100188 - DNA, 22 bp, Homo sapiens
attcatgaaatgattgagaagt

SEQ ID NO: 8100189 - DNA, 22 bp, Homo sapiens
gagtgggcaccgtgggcacact

SEQ ID NO: 8100190 - DNA, 21 bp, Homo sapiens
gagtgggctgagatggggctg

SEQ ID NO: 8100191 - DNA, 21 bp, Homo sapiens
gagtgggctgagatggggctg

SEQ ID NO: 8100192 - DNA, 22 bp, Homo sapiens
gatgtctttttccaggctcttt

SEQ ID NO: 8100193 - DNA, 23 bp, Homo sapiens
gatgtgtagggaaagtcagactc

SEQ ID NO: 8100194 - DNA, 22 bp, Homo sapiens
gatgtgtatttggaagacaaaa

SEQ ID NO: 8100195 - DNA, 22 bp, Homo sapiens
gattcagtgggctttgggacag

SEQ ID NO: 8100196 - DNA, 22 bp, Homo sapiens
attaacactttggagtctgctc

SEQ ID NO: 8100197 - DNA, 20 bp, Homo sapiens
attaacactgagctatgggt

SEQ ID NO: 8100198 - DNA, 20 bp, Homo sapiens
gattcctctgagaactggag

SEQ ID NO: 8100199 - DNA, 22 bp, Homo sapiens
gattccttggctctgtctcagg

SEQ ID NO: 8100200 - DNA, 22 bp, Homo sapiens
gattcccatgtctgaggaggtg

SEQ ID NO: 8100201 - DNA, 22 bp, Homo sapiens
gcaccatgatggagcctcatta

SEQ ID NO: 8100202 - DNA, 22 bp, Homo sapiens
gcagagaccccgcagtgaggcc

SEQ ID NO: 8100203 - DNA, 22 bp, Homo sapiens
gcagagaggaatgaagccatcc

SEQ ID NO: 8100204 - DNA, 22 bp, Homo sapiens
attataggcttgagccaccgtg

SEQ ID NO: 8100205 - DNA, 22 bp, Homo sapiens
attatataaaattctggaagct

SEQ ID NO: 8100206 - DNA, 22 bp, Homo sapiens
attaagactattgatatttaca

SEQ ID NO: 8100207 - DNA, 22 bp, Homo sapiens
attaagactgcccatgttttta

SEQ ID NO: 8100208 - DNA, 22 bp, Homo sapiens
attatataggacttgcccttcc

SEQ ID NO: 8100209 - DNA, 22 bp, Homo sapiens
attatattgagtataaccagag

SEQ ID NO: 8100210 - DNA, 22 bp, Homo sapiens
attatcaagtttactgtgtgga

SEQ ID NO: 8100211 - DNA, 22 bp, Homo sapiens
gcacacagattaggaaacagaa

SEQ ID NO: 8100212 - DNA, 22 bp, Homo sapiens
aggtctggaaacagcagggaga

SEQ ID NO: 8100213 - DNA, 22 bp, Homo sapiens
aggtgaggtttgggaggtgtca

SEQ ID NO: 8100214 - DNA, 22 bp, Homo sapiens
aggtgagggtgccagtgcatgg

SEQ ID NO: 8100215 - DNA, 22 bp, Homo sapiens
aggtctggtgagagcaggtgct

SEQ ID NO: 8100216 - DNA, 23 bp, Homo sapiens
aggtggagctgtgcagccggggc

SEQ ID NO: 8100217 - DNA, 22 bp, Homo sapiens
aggtggagtgaaggaaaggcag

SEQ ID NO: 8100218 - DNA, 22 bp, Homo sapiens
aggtggagtgtgcagggagagc

SEQ ID NO: 8100219 - DNA, 22 bp, Homo sapiens
aggtggatctgacagaaatgaa

SEQ ID NO: 8100220 - DNA, 22 bp, Homo sapiens
aggtggatcatatactagacca

SEQ ID NO: 8100221 - DNA, 22 bp, Homo sapiens
aggtggagttggctgtagttca

SEQ ID NO: 8100222 - DNA, 22 bp, Homo sapiens
aggtggatcacctgacgtcagg

SEQ ID NO: 8100223 - DNA, 22 bp, Homo sapiens
aggtggagttaagtgtgaactg

SEQ ID NO: 8100224 - DNA, 22 bp, Homo sapiens
cctggtcacccctctctctgca

SEQ ID NO: 8100225 - DNA, 21 bp, Homo sapiens
aggtgcagagccagggaccag

SEQ ID NO: 8100226 - DNA, 22 bp, Homo sapiens
cctgggcaggatgggcccggtg

SEQ ID NO: 8100227 - DNA, 22 bp, Homo sapiens
cctgggcaggatgggcccggtg

SEQ ID NO: 8100228 - DNA, 22 bp, Homo sapiens
cctgggcaggccggacgctggg

SEQ ID NO: 8100229 - DNA, 22 bp, Homo sapiens
cctgggcagggagaccaggctc

SEQ ID NO: 8100230 - DNA, 22 bp, Homo sapiens
cctgggcagggctggactctca

SEQ ID NO: 8100231 - DNA, 22 bp, Homo sapiens
cctgggcagggctggactctca

SEQ ID NO: 8100232 - DNA, 22 bp, Homo sapiens
cctggccagccagggctggggt

SEQ ID NO: 8100233 - DNA, 22 bp, Homo sapiens
cctggccagccagggctggggt

SEQ ID NO: 8100234 - DNA, 22 bp, Homo sapiens
cctggccagcagccccttcctc

SEQ ID NO: 8100235 - DNA, 22 bp, Homo sapiens
cctggctcattatgtgccccca

SEQ ID NO: 8100236 - DNA, 18 bp, Homo sapiens
cctggacctgtctccttt

SEQ ID NO: 8100237 - DNA, 22 bp, Homo sapiens
cctgcctggcccaccttgccac

SEQ ID NO: 8100238 - DNA, 22 bp, Homo sapiens
cctgcctggatcagccatcctg

SEQ ID NO: 8100239 - DNA, 22 bp, Homo sapiens
cctgcctgcgtcctctgagggc

SEQ ID NO: 8100240 - DNA, 22 bp, Homo sapiens
aggttattgctctccaagttca

SEQ ID NO: 8100241 - DNA, 22 bp, Homo sapiens
aggttacagtgattataggttt

SEQ ID NO: 8100242 - DNA, 22 bp, Homo sapiens
aggtgtgagaaacgtgaccagt

SEQ ID NO: 8100243 - DNA, 22 bp, Homo sapiens
aggtggggttcagtctcagccg

SEQ ID NO: 8100244 - DNA, 22 bp, Homo sapiens
cctggtccccatcggcccagcg

SEQ ID NO: 8100245 - DNA, 22 bp, Homo sapiens
aggtttctatgctgtttatctt

SEQ ID NO: 8100246 - DNA, 21 bp, Homo sapiens
cctttagatttctatgcagtt

SEQ ID NO: 8100247 - DNA, 22 bp, Homo sapiens
cgcctgctgatcttgttctctt

SEQ ID NO: 8100248 - DNA, 22 bp, Homo sapiens
cgcctgctctgtttccatgtgg

SEQ ID NO: 8100249 - DNA, 22 bp, Homo sapiens
agtacaaatgcagccagagtag

SEQ ID NO: 8100250 - DNA, 22 bp, Homo sapiens
agtacaaatgcagccagagtag

SEQ ID NO: 8100251 - DNA, 22 bp, Homo sapiens
agtacaaactgtttcaaagtag

SEQ ID NO: 8100252 - DNA, 22 bp, Homo sapiens
agtacaaaggcccttgattact

SEQ ID NO: 8100253 - DNA, 22 bp, Homo sapiens
agtacaaaggcccttgattact

SEQ ID NO: 8100254 - DNA, 22 bp, Homo sapiens
agtacaaaggcccttgattact

SEQ ID NO: 8100255 - DNA, 22 bp, Homo sapiens
agtacaaactgtttcaaagtag

SEQ ID NO: 8100256 - DNA, 22 bp, Homo sapiens
agtaatgaggatgtttgcaaaa

SEQ ID NO: 8100257 - DNA, 22 bp, Homo sapiens
agtaatgaagatttgttgcaca

SEQ ID NO: 8100258 - DNA, 22 bp, Homo sapiens
agtaatgaatacggtatttgaa

SEQ ID NO: 8100259 - DNA, 22 bp, Homo sapiens
agtaatcaaattaagctaattg

SEQ ID NO: 8100260 - DNA, 22 bp, Homo sapiens
agtaatagtgaatcgactatga

SEQ ID NO: 8100261 - DNA, 22 bp, Homo sapiens
agtcagtgtcaacaggaagtag

SEQ ID NO: 8100262 - DNA, 22 bp, Homo sapiens
agtcagggcctggcctgctgaa

SEQ ID NO: 8100263 - DNA, 22 bp, Homo sapiens
agtcagggcctggcctgctgaa

SEQ ID NO: 8100264 - DNA, 22 bp, Homo sapiens
agtcagttttaccaatctcagt

SEQ ID NO: 8100265 - DNA, 22 bp, Homo sapiens
ctacagaagaaactatcactat

SEQ ID NO: 8100266 - DNA, 22 bp, Homo sapiens
ctacagaagaaactatcactat

SEQ ID NO: 8100267 - DNA, 22 bp, Homo sapiens
ctacagaaaatcagccacaggc

SEQ ID NO: 8100268 - DNA, 22 bp, Homo sapiens
ctacacagttctgcctaatggc

SEQ ID NO: 8100269 - DNA, 22 bp, Homo sapiens
agtcagaagccggcctaaggga

SEQ ID NO: 8100270 - DNA, 22 bp, Homo sapiens
agtcactttctacttggtttct

SEQ ID NO: 8100271 - DNA, 22 bp, Homo sapiens
agtcagagtctattgctgtggt

SEQ ID NO: 8100272 - DNA, 22 bp, Homo sapiens
agtcagatttaaagctgtttga

SEQ ID NO: 8100273 - DNA, 23 bp, Homo sapiens
ctacaagagcaagcatggacaag

SEQ ID NO: 8100274 - DNA, 22 bp, Homo sapiens
cgcgctgcagacagcggaggcc

SEQ ID NO: 8100275 - DNA, 22 bp, Homo sapiens
cgcctgggagtccacacctgct

SEQ ID NO: 8100276 - DNA, 22 bp, Homo sapiens
cgtgccctgcgcaagtgctgct

SEQ ID NO: 8100277 - DNA, 22 bp, Homo sapiens
cgtgccactgcactctagcctg

SEQ ID NO: 8100278 - DNA, 22 bp, Homo sapiens
cggtcagctgcgcccggcctga

SEQ ID NO: 8100279 - DNA, 22 bp, Homo sapiens
cgtggccagcacaaggcagtga

SEQ ID NO: 8100280 - DNA, 22 bp, Homo sapiens
agtggctggcataggaacagac

SEQ ID NO: 8100281 - DNA, 19 bp, Homo sapiens
agtggctgggcagaagcaa

SEQ ID NO: 8100282 - DNA, 22 bp, Homo sapiens
agtgcaggccccaggccaggcc

SEQ ID NO: 8100283 - DNA, 22 bp, Homo sapiens
agtgcaggctcgcttgtgaggc

SEQ ID NO: 8100284 - DNA, 22 bp, Homo sapiens
agtgcaggctcgcttgtgaggc

SEQ ID NO: 8100285 - DNA, 22 bp, Homo sapiens
agtgggccaaatggaggcaagt

SEQ ID NO: 8100286 - DNA, 22 bp, Homo sapiens
agtgggccttagaaggttccct

SEQ ID NO: 8100287 - DNA, 22 bp, Homo sapiens
agtgggctgagcttgctgggtg

SEQ ID NO: 8100288 - DNA, 22 bp, Homo sapiens
agtgggctggtggcagggagaa

SEQ ID NO: 8100289 - DNA, 22 bp, Homo sapiens
agtgggcttactgagggagtgt

SEQ ID NO: 8100290 - DNA, 22 bp, Homo sapiens
agtgggcttttttccgttccat

SEQ ID NO: 8100291 - DNA, 22 bp, Homo sapiens
agtggctggtctaaggtcacag

SEQ ID NO: 8100292 - DNA, 22 bp, Homo sapiens
agtggctggtctaaggtcacag

SEQ ID NO: 8100293 - DNA, 22 bp, Homo sapiens
ctctgacaggtggcattatctc

SEQ ID NO: 8100294 - DNA, 22 bp, Homo sapiens
agtggggacttatgccagcatt

SEQ ID NO: 8100295 - DNA, 22 bp, Homo sapiens
agtggggacaatgagagcaggt

SEQ ID NO: 8100296 - DNA, 22 bp, Homo sapiens
ctcttacaagctcccgatataa

SEQ ID NO: 8100297 - DNA, 19 bp, Homo sapiens
ctcttacagaatagacaca

SEQ ID NO: 8100298 - DNA, 19 bp, Homo sapiens
ctcttacagaatagacaca

SEQ ID NO: 8100299 - DNA, 22 bp, Homo sapiens
ctgagaggatgctgcagtggag

SEQ ID NO: 8100300 - DNA, 22 bp, Homo sapiens
ctgagaggatgctgcagtggag

SEQ ID NO: 8100301 - DNA, 22 bp, Homo sapiens
ctgaagcaggcctacttcattg

SEQ ID NO: 8100302 - DNA, 22 bp, Homo sapiens
ctgaagcagggagtgatgaagt

SEQ ID NO: 8100303 - DNA, 22 bp, Homo sapiens
ctgaagcatgcgtttgtaaact

SEQ ID NO: 8100304 - DNA, 22 bp, Homo sapiens
ctgaagcaattgagagatgttt

SEQ ID NO: 8100305 - DNA, 22 bp, Homo sapiens
ctgaagcaggaacagcgagatt

SEQ ID NO: 8100306 - DNA, 22 bp, Homo sapiens
ctgaagcaaatgaaacagctct

SEQ ID NO: 8100307 - DNA, 22 bp, Homo sapiens
agtctctttaatcacagtgtct

SEQ ID NO: 8100308 - DNA, 22 bp, Homo sapiens
agtctctttgtataaataggca

SEQ ID NO: 8100309 - DNA, 22 bp, Homo sapiens
agtctctttctaaataaggtca

SEQ ID NO: 8100310 - DNA, 22 bp, Homo sapiens
agtctcttttgcgaagagtgtt

SEQ ID NO: 8100311 - DNA, 22 bp, Homo sapiens
agtcataattataaacatcagt

SEQ ID NO: 8100312 - DNA, 22 bp, Homo sapiens
agtcataattataaacatcagt

SEQ ID NO: 8100313 - DNA, 17 bp, Homo sapiens
agtcatattgtgcagtt

SEQ ID NO: 8100314 - DNA, 22 bp, Homo sapiens
agtcatatgtggcattttctaa

SEQ ID NO: 8100315 - DNA, 22 bp, Homo sapiens
agtcatatggctatttagtggg

SEQ ID NO: 8100316 - DNA, 22 bp, Homo sapiens
agtcatcatctgccctcactgg

SEQ ID NO: 8100317 - DNA, 22 bp, Homo sapiens
agtcatatttatataatttccc

SEQ ID NO: 8100318 - DNA, 22 bp, Homo sapiens
agtcatcatgtacagagagcaa

SEQ ID NO: 8100319 - DNA, 22 bp, Homo sapiens
agtcatctttatccaaaacact

SEQ ID NO: 8100320 - DNA, 22 bp, Homo sapiens
agtcatgtaatcacaatgacct

SEQ ID NO: 8100321 - DNA, 22 bp, Homo sapiens
agtcatctgacctcttctcaga

SEQ ID NO: 8100322 - DNA, 22 bp, Homo sapiens
agtcatctccaatatacaaagc

SEQ ID NO: 8100323 - DNA, 22 bp, Homo sapiens
agtcatctcttctacaatatgg

SEQ ID NO: 8100324 - DNA, 22 bp, Homo sapiens
agtcatctctgagatagaagct

SEQ ID NO: 8100325 - DNA, 20 bp, Homo sapiens
agtcatctcctctactgctt

SEQ ID NO: 8100326 - DNA, 23 bp, Homo sapiens
agtcattaagaagttcaggaact

SEQ ID NO: 8100327 - DNA, 22 bp, Homo sapiens
agtcattaaatgctgtcatggc

SEQ ID NO: 8100328 - DNA, 22 bp, Homo sapiens
agtcatgtgttcatctttcatt

SEQ ID NO: 8100329 - DNA, 22 bp, Homo sapiens
agtcattatgggtaaagttttt

SEQ ID NO: 8100330 - DNA, 18 bp, Homo sapiens
agtcatttacttttgtga

SEQ ID NO: 8100331 - DNA, 22 bp, Homo sapiens
agtcatttcccattcttcatat

SEQ ID NO: 8100332 - DNA, 22 bp, Homo sapiens
agtctgtctctgctaatcacta

SEQ ID NO: 8100333 - DNA, 22 bp, Homo sapiens
ctcctcctggacacaggctgtg

SEQ ID NO: 8100334 - DNA, 22 bp, Homo sapiens
ctcctcctcaaattagcttttg

SEQ ID NO: 8100335 - DNA, 22 bp, Homo sapiens
ctcctccctctttgccacacat

SEQ ID NO: 8100336 - DNA, 22 bp, Homo sapiens
ctccagttggccccagttggtt

SEQ ID NO: 8100337 - DNA, 22 bp, Homo sapiens
agtgacagtttcaggcattttt

SEQ ID NO: 8100338 - DNA, 20 bp, Homo sapiens
agtgactgggagaatggatt

SEQ ID NO: 8100339 - DNA, 22 bp, Homo sapiens
cttcagaatgggactgtgtttg

SEQ ID NO: 8100340 - DNA, 22 bp, Homo sapiens
cttcacagaataaactcattat

SEQ ID NO: 8100341 - DNA, 22 bp, Homo sapiens
cttcagagcatcacttcagctg

SEQ ID NO: 8100342 - DNA, 22 bp, Homo sapiens
ctgtttcacgtgtttaagccca

SEQ ID NO: 8100343 - DNA, 22 bp, Homo sapiens
atccttaatttcctgggcctca

SEQ ID NO: 8100344 - DNA, 22 bp, Homo sapiens
atccttaatttacttgcatctt

SEQ ID NO: 8100345 - DNA, 22 bp, Homo sapiens
atccttctaagagggacgtatg

SEQ ID NO: 8100346 - DNA, 22 bp, Homo sapiens
cttcattaaccaaaatgcaata

SEQ ID NO: 8100347 - DNA, 22 bp, Homo sapiens
atctcagtcaggttgaatttgg

SEQ ID NO: 8100348 - DNA, 22 bp, Homo sapiens
atctatttctgctaataacaat

SEQ ID NO: 8100349 - DNA, 22 bp, Homo sapiens
atctatttctgctaataacaat

SEQ ID NO: 8100350 - DNA, 22 bp, Homo sapiens
atctccagctcgcagagctcct

SEQ ID NO: 8100351 - DNA, 22 bp, Homo sapiens
ctgtgtccaatggccttagcag

SEQ ID NO: 8100352 - DNA, 22 bp, Homo sapiens
ctgtgcctccaagtggtctctg

SEQ ID NO: 8100353 - DNA, 22 bp, Homo sapiens
ctgtgcctttgtagctgtgcct

SEQ ID NO: 8100354 - DNA, 22 bp, Homo sapiens
ctgtgccttggcgctgtgccac

SEQ ID NO: 8100355 - DNA, 22 bp, Homo sapiens
ctgtgccttggcgctgtgccac

SEQ ID NO: 8100356 - DNA, 22 bp, Homo sapiens
ctgtgcctccagtctcgcttct

SEQ ID NO: 8100357 - DNA, 22 bp, Homo sapiens
ctgttatttggaggatgcttgg

SEQ ID NO: 8100358 - DNA, 22 bp, Homo sapiens
ctgttattcaagacaaaggcag

SEQ ID NO: 8100359 - DNA, 22 bp, Homo sapiens
ctgttatattggtatatttaca

SEQ ID NO: 8100360 - DNA, 22 bp, Homo sapiens
ctgttattccccttgctgtggt

SEQ ID NO: 8100361 - DNA, 22 bp, Homo sapiens
ctgttatttagaacatggaatc

SEQ ID NO: 8100362 - DNA, 22 bp, Homo sapiens
ctgtgtcctccccatcacttct

SEQ ID NO: 8100363 - DNA, 22 bp, Homo sapiens
ctgtgtccccctcagccaggtg

SEQ ID NO: 8100364 - DNA, 22 bp, Homo sapiens
atatattttttgagacagagtc

SEQ ID NO: 8100365 - DNA, 22 bp, Homo sapiens
atatcaaacgaagttattttaa

SEQ ID NO: 8100366 - DNA, 22 bp, Homo sapiens
atatcaaacgaagttattttaa

SEQ ID NO: 8100367 - DNA, 22 bp, Homo sapiens
atatcaaacgaagttattttaa

SEQ ID NO: 8100368 - DNA, 22 bp, Homo sapiens
atatcaaaataaacagcatgca

SEQ ID NO: 8100369 - DNA, 22 bp, Homo sapiens
atatcaaagctagtggaaattt

SEQ ID NO: 8100370 - DNA, 21 bp, Homo sapiens
atatcaatacagcaggacttc

SEQ ID NO: 8100371 - DNA, 22 bp, Homo sapiens
atatcaagattattagggtcat

SEQ ID NO: 8100372 - DNA, 18 bp, Homo sapiens
atatcagctacttcatgg

SEQ ID NO: 8100373 - DNA, 22 bp, Homo sapiens
ctgggccatctcctttgtgtgg

SEQ ID NO: 8100374 - DNA, 22 bp, Homo sapiens
ctgggccagttatgtctcatct

SEQ ID NO: 8100375 - DNA, 22 bp, Homo sapiens
ctgggccagtctcggccgctct

SEQ ID NO: 8100376 - DNA, 22 bp, Homo sapiens
ctgggccagggaggtgtctgta

SEQ ID NO: 8100377 - DNA, 17 bp, Homo sapiens
ctgggcctctgcccttt

SEQ ID NO: 8100378 - DNA, 17 bp, Homo sapiens
ctgggcctctgcccttt

SEQ ID NO: 8100379 - DNA, 22 bp, Homo sapiens
ctgggcctctcagctcccgcgg

SEQ ID NO: 8100380 - DNA, 22 bp, Homo sapiens
ctgggccatggaagtctctgcc

SEQ ID NO: 8100381 - DNA, 22 bp, Homo sapiens
ctgggcctggcgttccaggctg

SEQ ID NO: 8100382 - DNA, 22 bp, Homo sapiens
ctgggcctggagcccacgagcc

SEQ ID NO: 8100383 - DNA, 22 bp, Homo sapiens
ctgggcctggagcccacgagcc

SEQ ID NO: 8100384 - DNA, 22 bp, Homo sapiens
ctgggcctgggaggccaggtct

SEQ ID NO: 8100385 - DNA, 22 bp, Homo sapiens
ctgggcctgggaggccaggtct

SEQ ID NO: 8100386 - DNA, 22 bp, Homo sapiens
ctgggcctgagctctgaagagt

SEQ ID NO: 8100387 - DNA, 19 bp, Homo sapiens
ctgggcctgcatggttgtt

SEQ ID NO: 8100388 - DNA, 22 bp, Homo sapiens
ctgggcctggacgggcagatct

SEQ ID NO: 8100389 - DNA, 22 bp, Homo sapiens
ctgggcctgccaccatcttagg

SEQ ID NO: 8100390 - DNA, 22 bp, Homo sapiens
ctgggcctggggctgttgagag

SEQ ID NO: 8100391 - DNA, 22 bp, Homo sapiens
ctgggctgcagcgggagcgacg

SEQ ID NO: 8100392 - DNA, 22 bp, Homo sapiens
ctgggctgtaatgtggcactga

SEQ ID NO: 8100393 - DNA, 22 bp, Homo sapiens
ctggtgctgtagcctgattgag

SEQ ID NO: 8100394 - DNA, 22 bp, Homo sapiens
ctggtggggagtcctggtctcc

SEQ ID NO: 8100395 - DNA, 22 bp, Homo sapiens
ctgggctgtcccagggcggcag

SEQ ID NO: 8100396 - DNA, 22 bp, Homo sapiens
atattttcactgaaccaaagta

SEQ ID NO: 8100397 - DNA, 22 bp, Homo sapiens
atattttgaagttaataatgtg

SEQ ID NO: 8100398 - DNA, 22 bp, Homo sapiens
ctgtccagcttggctcctgggg

SEQ ID NO: 8100399 - DNA, 22 bp, Homo sapiens
ctgtccagctgaccagagcagc

SEQ ID NO: 8100400 - DNA, 22 bp, Homo sapiens
agtttcatattaccatgtcacc

SEQ ID NO: 8100401 - DNA, 22 bp, Homo sapiens
agtttcatgagacagattttca

SEQ ID NO: 8100402 - DNA, 22 bp, Homo sapiens
agtttcttgaagactgatgttt

SEQ ID NO: 8100403 - DNA, 22 bp, Homo sapiens
agtttctttagatagaaagttc

SEQ ID NO: 8100404 - DNA, 22 bp, Homo sapiens
agtttcttattcttagttatgt

SEQ ID NO: 8100405 - DNA, 22 bp, Homo sapiens
agtttcttcatccaaaaaatgg

SEQ ID NO: 8100406 - DNA, 22 bp, Homo sapiens
agttttcaatatatgatagtga

SEQ ID NO: 8100407 - DNA, 22 bp, Homo sapiens
ctgagtttccagataagacctt

SEQ ID NO: 8100408 - DNA, 19 bp, Homo sapiens
agtttattataggtgattc

SEQ ID NO: 8100409 - DNA, 22 bp, Homo sapiens
agtgttcatttattcattcact

SEQ ID NO: 8100410 - DNA, 22 bp, Homo sapiens
agtttacaacagtagctatgga

SEQ ID NO: 8100411 - DNA, 22 bp, Homo sapiens
agtttcaattcttttcacaaag

SEQ ID NO: 8100412 - DNA, 22 bp, Homo sapiens
ctgccctgactgaccttttgaa

SEQ ID NO: 8100413 - DNA, 22 bp, Homo sapiens
ctgccctggtcccatggctgat

SEQ ID NO: 8100414 - DNA, 18 bp, Homo sapiens
ctgccccttctctgagat

SEQ ID NO: 8100415 - DNA, 22 bp, Homo sapiens
agttttctgatgtgtagtgaga

SEQ ID NO: 8100416 - DNA, 21 bp, Homo sapiens
agttttctgagttataaaata

SEQ ID NO: 8100417 - DNA, 21 bp, Homo sapiens
agttttctgagttataaaata

SEQ ID NO: 8100418 - DNA, 22 bp, Homo sapiens
agttttctgcctctggatgcgt

SEQ ID NO: 8100419 - DNA, 22 bp, Homo sapiens
ctgcctgcttaccatgcatcag

SEQ ID NO: 8100420 - DNA, 22 bp, Homo sapiens
ctgcctgcttttctgggagccg

SEQ ID NO: 8100421 - DNA, 22 bp, Homo sapiens
ctgcctgctgcctgtggagggt

SEQ ID NO: 8100422 - DNA, 22 bp, Homo sapiens
ctgcctgctgacattctttata

SEQ ID NO: 8100423 - DNA, 22 bp, Homo sapiens
ctgcctgctgacattctttata

SEQ ID NO: 8100424 - DNA, 22 bp, Homo sapiens
ataataacacctgaataggaaa

SEQ ID NO: 8100425 - DNA, 22 bp, Homo sapiens
ataataaaccaggatgggtctg

SEQ ID NO: 8100426 - DNA, 22 bp, Homo sapiens
ataataaaccaggatgggtctg

SEQ ID NO: 8100427 - DNA, 22 bp, Homo sapiens
ctgccctgtctgcagcctggct

SEQ ID NO: 8100428 - DNA, 22 bp, Homo sapiens
ctgccctgtctttttctgatga

SEQ ID NO: 8100429 - DNA, 22 bp, Homo sapiens
ctgccctgtggctctgagtcat

SEQ ID NO: 8100430 - DNA, 22 bp, Homo sapiens
ctgccctgtggctctgagtcat

SEQ ID NO: 8100431 - DNA, 22 bp, Homo sapiens
ctgccctgtgagggtccttggg

SEQ ID NO: 8100432 - DNA, 22 bp, Homo sapiens
ctgccctgtttggacagcccgg

SEQ ID NO: 8100433 - DNA, 22 bp, Homo sapiens
ataggcagaaatgctccctatt

SEQ ID NO: 8100434 - DNA, 22 bp, Homo sapiens
atagacacatgttattatactt

SEQ ID NO: 8100435 - DNA, 22 bp, Homo sapiens
atagacaatggtttgccaagaa

SEQ ID NO: 8100436 - DNA, 22 bp, Homo sapiens
atagacatggtcttttgtcatt

SEQ ID NO: 8100437 - DNA, 22 bp, Homo sapiens
atagacatatggctttgtttct

SEQ ID NO: 8100438 - DNA, 22 bp, Homo sapiens
atagacaaacacgaagatgaca

SEQ ID NO: 8100439 - DNA, 22 bp, Homo sapiens
atagaattctttgaaatttatg

SEQ ID NO: 8100440 - DNA, 22 bp, Homo sapiens
atagaattatggaaagcatctt

SEQ ID NO: 8100441 - DNA, 22 bp, Homo sapiens
atagaattacagtgtgtttgga

SEQ ID NO: 8100442 - DNA, 22 bp, Homo sapiens
ctggccagtgcctgtgggcccc

SEQ ID NO: 8100443 - DNA, 22 bp, Homo sapiens
ctggccagggtgcgatcgtggt

SEQ ID NO: 8100444 - DNA, 22 bp, Homo sapiens
ctggccagaggttcctctgccc

SEQ ID NO: 8100445 - DNA, 22 bp, Homo sapiens
ctggccaggcttgggacagaca

SEQ ID NO: 8100446 - DNA, 22 bp, Homo sapiens
atagaaatggcagctggtgcta

SEQ ID NO: 8100447 - DNA, 22 bp, Homo sapiens
atagaatatgacttttagatcc

SEQ ID NO: 8100448 - DNA, 22 bp, Homo sapiens
atactttggtcactattattgg

SEQ ID NO: 8100449 - DNA, 22 bp, Homo sapiens
atactttgctacattgtacatt

SEQ ID NO: 8100450 - DNA, 22 bp, Homo sapiens
atactttgggggttagtgtaga

SEQ ID NO: 8100451 - DNA, 22 bp, Homo sapiens
atagaaacagggaagcaaagca

SEQ ID NO: 8100452 - DNA, 22 bp, Homo sapiens
atacagaaaatgatgcagagtt

SEQ ID NO: 8100453 - DNA, 22 bp, Homo sapiens
atacagaagaactatagccact

SEQ ID NO: 8100454 - DNA, 22 bp, Homo sapiens
atacagaactctcagttgtata

SEQ ID NO: 8100455 - DNA, 22 bp, Homo sapiens
atacagaactctcagttgtata

SEQ ID NO: 8100456 - DNA, 22 bp, Homo sapiens
ataatttaattttcacagtggt

SEQ ID NO: 8100457 - DNA, 22 bp, Homo sapiens
ataattaatttcagtaatctcc

SEQ ID NO: 8100458 - DNA, 22 bp, Homo sapiens
ataattctccaatttttgttgt

SEQ ID NO: 8100459 - DNA, 22 bp, Homo sapiens
ataatgtacaactgcttttaat

SEQ ID NO: 8100460 - DNA, 22 bp, Homo sapiens
ataatgtttttgtataagcatg

SEQ ID NO: 8100461 - DNA, 22 bp, Homo sapiens
atacagaagcctgtatttctgg

SEQ ID NO: 8100462 - DNA, 21 bp, Homo sapiens
atacagaaggtggcaaagtac

SEQ ID NO: 8100463 - DNA, 22 bp, Homo sapiens
ccatgggaattgggaggtccca

SEQ ID NO: 8100464 - DNA, 22 bp, Homo sapiens
ccatgggcgcacaggcctggag

SEQ ID NO: 8100465 - DNA, 22 bp, Homo sapiens
ccatgggctggctgccttatca

SEQ ID NO: 8100466 - DNA, 22 bp, Homo sapiens
ccatgtggctagcgtgcctgca

SEQ ID NO: 8100467 - DNA, 17 bp, Homo sapiens
aggctggctcacaggga

SEQ ID NO: 8100468 - DNA, 22 bp, Homo sapiens
aggctctgtgatgtgccaggca

SEQ ID NO: 8100469 - DNA, 22 bp, Homo sapiens
aggctgagtcgggaggatcact

SEQ ID NO: 8100470 - DNA, 22 bp, Homo sapiens
aggctcagttctgtggtgagcc

SEQ ID NO: 8100471 - DNA, 22 bp, Homo sapiens
ccagggaatgtgggatgactct

SEQ ID NO: 8100472 - DNA, 22 bp, Homo sapiens
ccagggaagtcacattgtctag

SEQ ID NO: 8100473 - DNA, 22 bp, Homo sapiens
ccagggaaggctgctggctgtg

SEQ ID NO: 8100474 - DNA, 22 bp, Homo sapiens
aggccctgggcagttctgtagc

SEQ ID NO: 8100475 - DNA, 22 bp, Homo sapiens
aggccctggcactgcctgggag

SEQ ID NO: 8100476 - DNA, 22 bp, Homo sapiens
ccagctttcctgcgagttgatt

SEQ ID NO: 8100477 - DNA, 22 bp, Homo sapiens
ccaggagagcattgcacagagg

SEQ ID NO: 8100478 - DNA, 22 bp, Homo sapiens
ccagcctcatcgcctgcctgtc

SEQ ID NO: 8100479 - DNA, 23 bp, Homo sapiens
ccagcctctgggtcttcatccag

SEQ ID NO: 8100480 - DNA, 22 bp, Homo sapiens
aggcccagagagccagttagtg

SEQ ID NO: 8100481 - DNA, 22 bp, Homo sapiens
aggcccagagcaggaaagggtt

SEQ ID NO: 8100482 - DNA, 19 bp, Homo sapiens
ccagctggcctgggacctc

SEQ ID NO: 8100483 - DNA, 22 bp, Homo sapiens
ccagctttatcaagtctgagct

SEQ ID NO: 8100484 - DNA, 22 bp, Homo sapiens
aggcatggacatttcggcagct

SEQ ID NO: 8100485 - DNA, 19 bp, Homo sapiens
ccagcagacacagctgccc

SEQ ID NO: 8100486 - DNA, 22 bp, Homo sapiens
ccagcactgttctaaggaaaca

SEQ ID NO: 8100487 - DNA, 22 bp, Homo sapiens
aggccagagaggggaccagcct

SEQ ID NO: 8100488 - DNA, 22 bp, Homo sapiens
ccctctggctcttctcaggccg

SEQ ID NO: 8100489 - DNA, 22 bp, Homo sapiens
ccctctggtttgcccttgggtg

SEQ ID NO: 8100490 - DNA, 22 bp, Homo sapiens
agggagtggttaagaaggtgca

SEQ ID NO: 8100491 - DNA, 22 bp, Homo sapiens
agggatggaagctcgtctgcaa

SEQ ID NO: 8100492 - DNA, 22 bp, Homo sapiens
agggatgcagtaaaaactgtag

SEQ ID NO: 8100493 - DNA, 22 bp, Homo sapiens
agggagaaggtccatgcctgtc

SEQ ID NO: 8100494 - DNA, 22 bp, Homo sapiens
aggctggctgagctgcagcctg

SEQ ID NO: 8100495 - DNA, 22 bp, Homo sapiens
aggcttctggaatccagtttct

SEQ ID NO: 8100496 - DNA, 22 bp, Homo sapiens
ccgaggtcctggacttggccct

SEQ ID NO: 8100497 - DNA, 22 bp, Homo sapiens
ccgagcccggagaggagctctt

SEQ ID NO: 8100498 - DNA, 22 bp, Homo sapiens
agggctcattgacatggaaaag

SEQ ID NO: 8100499 - DNA, 22 bp, Homo sapiens
agggccctagggaatgagacat

SEQ ID NO: 8100500 - DNA, 23 bp, Homo sapiens
agggcctcaggagggctgcatgg

SEQ ID NO: 8100501 - DNA, 18 bp, Homo sapiens
agggctctctgctgggtt

SEQ ID NO: 8100502 - DNA, 22 bp, Homo sapiens
aggggacacggcttctccaggg

SEQ ID NO: 8100503 - DNA, 22 bp, Homo sapiens
cctgagctttaaaagccatgta

SEQ ID NO: 8100504 - DNA, 22 bp, Homo sapiens
cctgagagtgcgtgcctcctta

SEQ ID NO: 8100505 - DNA, 22 bp, Homo sapiens
cctgaggatgccagcatgggtg

SEQ ID NO: 8100506 - DNA, 22 bp, Homo sapiens
cctgaggagattgtggctgggg

SEQ ID NO: 8100507 - DNA, 22 bp, Homo sapiens
aggggctgggacagagccaagc

SEQ ID NO: 8100508 - DNA, 22 bp, Homo sapiens
aggggctgggacagagccaagc

SEQ ID NO: 8100509 - DNA, 18 bp, Homo sapiens
cctctgccatagccagca

SEQ ID NO: 8100510 - DNA, 22 bp, Homo sapiens
cctctgggccagcctggaccct

SEQ ID NO: 8100511 - DNA, 22 bp, Homo sapiens
cctctgggcaggtagcagcagc

SEQ ID NO: 8100512 - DNA, 19 bp, Homo sapiens
cctcctgctagatatgcaa

SEQ ID NO: 8100513 - DNA, 22 bp, Homo sapiens
cctcctgcggcgtccgcgctct

SEQ ID NO: 8100514 - DNA, 21 bp, Homo sapiens
cctcctgcccgcaagctaggg

SEQ ID NO: 8100515 - DNA, 22 bp, Homo sapiens
cctcctgcacttgctttccttc

SEQ ID NO: 8100516 - DNA, 22 bp, Homo sapiens
cctcctgcacttgctttccttc

SEQ ID NO: 8100517 - DNA, 22 bp, Homo sapiens
cctcctgcactgcaagcttgag

SEQ ID NO: 8100518 - DNA, 22 bp, Homo sapiens
cctcctgcacctccaggaactc

SEQ ID NO: 8100519 - DNA, 22 bp, Homo sapiens
agctgccacagagcctggccag

SEQ ID NO: 8100520 - DNA, 22 bp, Homo sapiens
caggaaggcgcggctgtgcctg

SEQ ID NO: 8100521 - DNA, 22 bp, Homo sapiens
caggaaggggctcactctggcc

SEQ ID NO: 8100522 - DNA, 22 bp, Homo sapiens
agctgcagattctatctagaag

SEQ ID NO: 8100523 - DNA, 22 bp, Homo sapiens
caggaagagaacatggaggctg

SEQ ID NO: 8100524 - DNA, 22 bp, Homo sapiens
cagctgagaaaggcaggctcac

SEQ ID NO: 8100525 - DNA, 22 bp, Homo sapiens
cagctgacactttgacctagag

SEQ ID NO: 8100526 - DNA, 22 bp, Homo sapiens
cagctctgggtgacaggagggc

SEQ ID NO: 8100527 - DNA, 22 bp, Homo sapiens
agctgctgagccatgtcctgct

SEQ ID NO: 8100528 - DNA, 22 bp, Homo sapiens
caggaggagggtacaccatcag

SEQ ID NO: 8100529 - DNA, 22 bp, Homo sapiens
caggaggagggcagccgcctcc

SEQ ID NO: 8100530 - DNA, 22 bp, Homo sapiens
caggaggagctggccgcctcat

SEQ ID NO: 8100531 - DNA, 22 bp, Homo sapiens
caggaggagccagcgcccttca

SEQ ID NO: 8100532 - DNA, 22 bp, Homo sapiens
caggaggacatactggctcaca

SEQ ID NO: 8100533 - DNA, 22 bp, Homo sapiens
agctgccacatggtgtcactgt

SEQ ID NO: 8100534 - DNA, 22 bp, Homo sapiens
agctgccactgagggtgcacag

SEQ ID NO: 8100535 - DNA, 22 bp, Homo sapiens
agctgctgcggaaagatgccac

SEQ ID NO: 8100536 - DNA, 22 bp, Homo sapiens
agctgctgcctcactggtctgt

SEQ ID NO: 8100537 - DNA, 22 bp, Homo sapiens
caggcactggccagtcagcaca

SEQ ID NO: 8100538 - DNA, 22 bp, Homo sapiens
caggcactgtgttaggcactgt

SEQ ID NO: 8100539 - DNA, 19 bp, Homo sapiens
agctgggctgtcacagtga

SEQ ID NO: 8100540 - DNA, 22 bp, Homo sapiens
agctgggcttggccaggtcgct

SEQ ID NO: 8100541 - DNA, 22 bp, Homo sapiens
agctgggcttggccaggtcgct

SEQ ID NO: 8100542 - DNA, 22 bp, Homo sapiens
agctgggctgggctgagctgag

SEQ ID NO: 8100543 - DNA, 22 bp, Homo sapiens
agctgggctggagctccaagcg

SEQ ID NO: 8100544 - DNA, 22 bp, Homo sapiens
cagggatggttgagaattggta

SEQ ID NO: 8100545 - DNA, 22 bp, Homo sapiens
cagggatgtctctggaagggag

SEQ ID NO: 8100546 - DNA, 22 bp, Homo sapiens
cagggatgtgatgagctgagcc

SEQ ID NO: 8100547 - DNA, 22 bp, Homo sapiens
cagggcctctcatcccacgggc

SEQ ID NO: 8100548 - DNA, 22 bp, Homo sapiens
cagggcctcgaagcctctgggc

SEQ ID NO: 8100549 - DNA, 22 bp, Homo sapiens
cagggcctgagggctgctctgc

SEQ ID NO: 8100550 - DNA, 22 bp, Homo sapiens
cagggctccccagagagcctct

SEQ ID NO: 8100551 - DNA, 22 bp, Homo sapiens
caggcctgtctgcacatgaggc

SEQ ID NO: 8100552 - DNA, 18 bp, Homo sapiens
agctggggcctctggtcc

SEQ ID NO: 8100553 - DNA, 22 bp, Homo sapiens
caggctcagatgccctgcgctg

SEQ ID NO: 8100554 - DNA, 22 bp, Homo sapiens
agctgtgaattttatgctagtg

SEQ ID NO: 8100555 - DNA, 22 bp, Homo sapiens
agctgtgattatccactggaat

SEQ ID NO: 8100556 - DNA, 22 bp, Homo sapiens
agctgtgcacactgtgaagtag

SEQ ID NO: 8100557 - DNA, 22 bp, Homo sapiens
caggctgcgtttgtgaaaggta

SEQ ID NO: 8100558 - DNA, 22 bp, Homo sapiens
cagggatgggatggagtcagtt

SEQ ID NO: 8100559 - DNA, 22 bp, Homo sapiens
catataaatacaacatgtgtta

SEQ ID NO: 8100560 - DNA, 22 bp, Homo sapiens
cataggtcactaaatcagcaaa

SEQ ID NO: 8100561 - DNA, 22 bp, Homo sapiens
cataggaaaagcattcttcttg

SEQ ID NO: 8100562 - DNA, 22 bp, Homo sapiens
cagttttatgtcgaatgtatac

SEQ ID NO: 8100563 - DNA, 22 bp, Homo sapiens
catagattttaggttagatcga

SEQ ID NO: 8100564 - DNA, 22 bp, Homo sapiens
catattgtaaaaggttgaatcc

SEQ ID NO: 8100565 - DNA, 22 bp, Homo sapiens
catattctgttggtcacataga

SEQ ID NO: 8100566 - DNA, 21 bp, Homo sapiens
catattaaatcggtgccttta

SEQ ID NO: 8100567 - DNA, 19 bp, Homo sapiens
catattgtgcttgcatttt

SEQ ID NO: 8100568 - DNA, 22 bp, Homo sapiens
catattgtgtgatgagtataat

SEQ ID NO: 8100569 - DNA, 22 bp, Homo sapiens
aggagggagcactatatgggga

SEQ ID NO: 8100570 - DNA, 22 bp, Homo sapiens
catatttcagtctaagatgtgt

SEQ ID NO: 8100571 - DNA, 22 bp, Homo sapiens
catattgtctattgctgttttt

SEQ ID NO: 8100572 - DNA, 22 bp, Homo sapiens
aggagggagcttaagccaggca

SEQ ID NO: 8100573 - DNA, 22 bp, Homo sapiens
cagtggtggaatgaggaattgt

SEQ ID NO: 8100574 - DNA, 18 bp, Homo sapiens
cagtggtgctgggatgtg

SEQ ID NO: 8100575 - DNA, 17 bp, Homo sapiens
cagtggtctgaggtatg

SEQ ID NO: 8100576 - DNA, 22 bp, Homo sapiens
cagttctggaggatagaagtct

SEQ ID NO: 8100577 - DNA, 22 bp, Homo sapiens
cagttttagggcaatgtgaaga

SEQ ID NO: 8100578 - DNA, 22 bp, Homo sapiens
cagttttaaattttgaatgtct

SEQ ID NO: 8100579 - DNA, 22 bp, Homo sapiens
cagtttctctcaataagcatcg

SEQ ID NO: 8100580 - DNA, 22 bp, Homo sapiens
cagtttctccaaacgcaggctg

SEQ ID NO: 8100581 - DNA, 22 bp, Homo sapiens
cagtttctatggctgggctctg

SEQ ID NO: 8100582 - DNA, 22 bp, Homo sapiens
cagtttctacgacttaagcaca

SEQ ID NO: 8100583 - DNA, 22 bp, Homo sapiens
caggtggcttctctgcagcctt

SEQ ID NO: 8100584 - DNA, 22 bp, Homo sapiens
caggtgggagcgaggagctact

SEQ ID NO: 8100585 - DNA, 22 bp, Homo sapiens
cagtggccaacttcctgcctct

SEQ ID NO: 8100586 - DNA, 22 bp, Homo sapiens
cagtggccttgatgcctcattc

SEQ ID NO: 8100587 - DNA, 22 bp, Homo sapiens
aggagaaggaggcccctcacac

SEQ ID NO: 8100588 - DNA, 22 bp, Homo sapiens
cagtgctagggcagagcactcc

SEQ ID NO: 8100589 - DNA, 21 bp, Homo sapiens
aggagggcacaaggccaggaa

SEQ ID NO: 8100590 - DNA, 22 bp, Homo sapiens
aggagggcaggctggctgccta

SEQ ID NO: 8100591 - DNA, 22 bp, Homo sapiens
aggagggctaggaaaaccagga

SEQ ID NO: 8100592 - DNA, 22 bp, Homo sapiens
catggaggaccctcagggagct

SEQ ID NO: 8100593 - DNA, 22 bp, Homo sapiens
catggattcgggaaggtcagta

SEQ ID NO: 8100594 - DNA, 22 bp, Homo sapiens
catggaggccaggaaacagcct

SEQ ID NO: 8100595 - DNA, 22 bp, Homo sapiens
catggcagaaacctgagctgct

SEQ ID NO: 8100596 - DNA, 22 bp, Homo sapiens
catggggcccatgtgctccaag

SEQ ID NO: 8100597 - DNA, 22 bp, Homo sapiens
catgggctttggaggctggagg

SEQ ID NO: 8100598 - DNA, 22 bp, Homo sapiens
catgggcttgctctctgagctc

SEQ ID NO: 8100599 - DNA, 22 bp, Homo sapiens
catgggctgctgacaggggctc

SEQ ID NO: 8100600 - DNA, 22 bp, Homo sapiens
catgggctgtgaacccaggctg

SEQ ID NO: 8100601 - DNA, 22 bp, Homo sapiens
catgggctgaaaatctgcaaac

SEQ ID NO: 8100602 - DNA, 22 bp, Homo sapiens
aggattgtgcctccagtcagaa

SEQ ID NO: 8100603 - DNA, 19 bp, Homo sapiens
catggtgaaaccccgtctc

SEQ ID NO: 8100604 - DNA, 22 bp, Homo sapiens
ccaaggactggacacacaggtt

SEQ ID NO: 8100605 - DNA, 22 bp, Homo sapiens
ccaagggctgagatacatctag

SEQ ID NO: 8100606 - DNA, 22 bp, Homo sapiens
ccaagcaaggctaattcacttg

SEQ ID NO: 8100607 - DNA, 22 bp, Homo sapiens
ccaagctacttaggagtctgag

SEQ ID NO: 8100608 - DNA, 22 bp, Homo sapiens
catttgttctgatttcaaaagg

SEQ ID NO: 8100609 - DNA, 22 bp, Homo sapiens
acatagcaagtgctcaataaat

SEQ ID NO: 8100610 - DNA, 21 bp, Homo sapiens
acataggcgaatgttcgggag

SEQ ID NO: 8100611 - DNA, 19 bp, Homo sapiens
acatagctggctacactgt

SEQ ID NO: 8100612 - DNA, 22 bp, Homo sapiens
acatagcttaaatgagaagata

SEQ ID NO: 8100613 - DNA, 22 bp, Homo sapiens
acatagctcagtatcacttact

SEQ ID NO: 8100614 - DNA, 20 bp, Homo sapiens
acatagctatagaaagtcga

SEQ ID NO: 8100615 - DNA, 22 bp, Homo sapiens
acatagcacgtctcaatttgga

SEQ ID NO: 8100616 - DNA, 22 bp, Homo sapiens
acatagcataaagaatgactct

SEQ ID NO: 8100617 - DNA, 22 bp, Homo sapiens
acatattgaggctttgatttaa

SEQ ID NO: 8100618 - DNA, 22 bp, Homo sapiens
acatattccattgttgggatcc

SEQ ID NO: 8100619 - DNA, 22 bp, Homo sapiens
acatattggcttagctctgtga

SEQ ID NO: 8100620 - DNA, 22 bp, Homo sapiens
acagtttaggatgagagaacac

SEQ ID NO: 8100621 - DNA, 22 bp, Homo sapiens
acagttcagacaagtgttccat

SEQ ID NO: 8100622 - DNA, 22 bp, Homo sapiens
aggatgccttcattgcatggcc

SEQ ID NO: 8100623 - DNA, 22 bp, Homo sapiens
acagtcatagcagcctttgtta

SEQ ID NO: 8100624 - DNA, 19 bp, Homo sapiens
acagtcagggaataaagac

SEQ ID NO: 8100625 - DNA, 22 bp, Homo sapiens
acagtcaatcagaacagcatgt

SEQ ID NO: 8100626 - DNA, 22 bp, Homo sapiens
acagtcaggaatttgtaaaacg

SEQ ID NO: 8100627 - DNA, 22 bp, Homo sapiens
acagtcagacagttaataacct

SEQ ID NO: 8100628 - DNA, 23 bp, Homo sapiens
acagtcgtaggtatccttttcct

SEQ ID NO: 8100629 - DNA, 22 bp, Homo sapiens
acagtctgagaattactgctct

SEQ ID NO: 8100630 - DNA, 18 bp, Homo sapiens
acagtaaagaaaggaatt

SEQ ID NO: 8100631 - DNA, 22 bp, Homo sapiens
aggagcaccattgtgctggtgt

SEQ ID NO: 8100632 - DNA, 22 bp, Homo sapiens
acagtaaatcaacagaatatct

SEQ ID NO: 8100633 - DNA, 20 bp, Homo sapiens
aggagcacagggtttagtgg

SEQ ID NO: 8100634 - DNA, 23 bp, Homo sapiens
aggagcactttcagtttgtaaag

SEQ ID NO: 8100635 - DNA, 22 bp, Homo sapiens
acaggggcaggcaggacccttt

SEQ ID NO: 8100636 - DNA, 23 bp, Homo sapiens
aggaagagagagtgcctctttct

SEQ ID NO: 8100637 - DNA, 22 bp, Homo sapiens
aggaagagcatctttgggtctg

SEQ ID NO: 8100638 - DNA, 22 bp, Homo sapiens
acagggacctgtgagctccata

SEQ ID NO: 8100639 - DNA, 22 bp, Homo sapiens
agctggcaatgtaagtccctgg

SEQ ID NO: 8100640 - DNA, 21 bp, Homo sapiens
agctggcaatgttgtcctctt

SEQ ID NO: 8100641 - DNA, 23 bp, Homo sapiens
acaggaggggacaggtggccgtg

SEQ ID NO: 8100642 - DNA, 22 bp, Homo sapiens
acaggatcgccctgttgcccag

SEQ ID NO: 8100643 - DNA, 22 bp, Homo sapiens
acagctgggtgctgctcagagc

SEQ ID NO: 8100644 - DNA, 22 bp, Homo sapiens
acagctgtattcaagttgcaag

SEQ ID NO: 8100645 - DNA, 22 bp, Homo sapiens
acagctgtatccccagagctca

SEQ ID NO: 8100646 - DNA, 22 bp, Homo sapiens
agctgacaggatggcattatta

SEQ ID NO: 8100647 - DNA, 22 bp, Homo sapiens
agctgacataagcactttctaa

SEQ ID NO: 8100648 - DNA, 22 bp, Homo sapiens
agctctggttattgaagcaggg

SEQ ID NO: 8100649 - DNA, 22 bp, Homo sapiens
aggccagggtagggcccattgt

SEQ ID NO: 8100650 - DNA, 22 bp, Homo sapiens
acatgtgttttcctacttatga

SEQ ID NO: 8100651 - DNA, 22 bp, Homo sapiens
acatgttcatgcatgcacaggt

SEQ ID NO: 8100652 - DNA, 22 bp, Homo sapiens
acatgtttaagtttaatgaaaa

SEQ ID NO: 8100653 - DNA, 22 bp, Homo sapiens
acatcatgagagacttaaattg

SEQ ID NO: 8100654 - DNA, 22 bp, Homo sapiens
acatcagagggctcacatgatc

SEQ ID NO: 8100655 - DNA, 22 bp, Homo sapiens
acatattttgaaagctttctaa

SEQ ID NO: 8100656 - DNA, 22 bp, Homo sapiens
acatgctttgatgtattttgca

SEQ ID NO: 8100657 - DNA, 22 bp, Homo sapiens
acatgctttaacttattttgat

SEQ ID NO: 8100658 - DNA, 22 bp, Homo sapiens
acatgctggatgaattacctac

SEQ ID NO: 8100659 - DNA, 22 bp, Homo sapiens
acatgctgggtttctttaatgg

SEQ ID NO: 8100660 - DNA, 22 bp, Homo sapiens
acatgctagactttctttatga

SEQ ID NO: 8100661 - DNA, 22 bp, Homo sapiens
acatgcgttggagattattagt

SEQ ID NO: 8100662 - DNA, 22 bp, Homo sapiens
acatttgaggatgttaagaatg

SEQ ID NO: 8100663 - DNA, 20 bp, Homo sapiens
acatttgagtatcatctact

SEQ ID NO: 8100664 - DNA, 22 bp, Homo sapiens
acatttgagtcatatttgctta

SEQ ID NO: 8100665 - DNA, 22 bp, Homo sapiens
acatttgactctgttcatatta

SEQ ID NO: 8100666 - DNA, 22 bp, Homo sapiens
acatttgagcatctactaagtg

SEQ ID NO: 8100667 - DNA, 22 bp, Homo sapiens
acatttgagcatatttcttgtc

SEQ ID NO: 8100668 - DNA, 22 bp, Homo sapiens
acatttgaaataaactcaagtg

SEQ ID NO: 8100669 - DNA, 22 bp, Homo sapiens
acatttgaaataaactcaagtg

SEQ ID NO: 8100670 - DNA, 22 bp, Homo sapiens
acatttcttttcatctctatat

SEQ ID NO: 8100671 - DNA, 22 bp, Homo sapiens
acatttgacatttagtatcagc

SEQ ID NO: 8100672 - DNA, 22 bp, Homo sapiens
aggctgagctggtagtgagtac

SEQ ID NO: 8100673 - DNA, 22 bp, Homo sapiens
aggctgaggagggatgttgctt

SEQ ID NO: 8100674 - DNA, 22 bp, Homo sapiens
aggctcttcttttattaactga

SEQ ID NO: 8100675 - DNA, 22 bp, Homo sapiens
aggcctgcagcaggagcaaacc

SEQ ID NO: 8100676 - DNA, 17 bp, Homo sapiens
acatttcctaactgaag

SEQ ID NO: 8100677 - DNA, 22 bp, Homo sapiens
acatttctagttgttcatctcc

SEQ ID NO: 8100678 - DNA, 22 bp, Homo sapiens
agggagaggagggtcttgttga

SEQ ID NO: 8100679 - DNA, 22 bp, Homo sapiens
accagccctcaggtcagatact

SEQ ID NO: 8100680 - DNA, 22 bp, Homo sapiens
accagcctgtctgagtcgtggg

SEQ ID NO: 8100681 - DNA, 19 bp, Homo sapiens
accagcccactcccagttt

SEQ ID NO: 8100682 - DNA, 22 bp, Homo sapiens
accagccaccaccaggagatcg

SEQ ID NO: 8100683 - DNA, 22 bp, Homo sapiens
accagccagccacagtggctcc

SEQ ID NO: 8100684 - DNA, 21 bp, Homo sapiens
accagcaggagatcagaagga

SEQ ID NO: 8100685 - DNA, 22 bp, Homo sapiens
accagccccaccgggactgcag

SEQ ID NO: 8100686 - DNA, 22 bp, Homo sapiens
agggacagtctactgttcactg

SEQ ID NO: 8100687 - DNA, 22 bp, Homo sapiens
aggggcctggcactgagctggc

SEQ ID NO: 8100688 - DNA, 19 bp, Homo sapiens
agggctgctctggcctggg

SEQ ID NO: 8100689 - DNA, 22 bp, Homo sapiens
actctgtgtttagtgctgccat

SEQ ID NO: 8100690 - DNA, 22 bp, Homo sapiens
actctgtgtgagtagagcctgt

SEQ ID NO: 8100691 - DNA, 22 bp, Homo sapiens
actctgtgggtgagcctggaca

SEQ ID NO: 8100692 - DNA, 22 bp, Homo sapiens
actctgtgaactctatcagata

SEQ ID NO: 8100693 - DNA, 22 bp, Homo sapiens
actcttcacttcccctgccagc

SEQ ID NO: 8100694 - DNA, 22 bp, Homo sapiens
actcttcacacatgctgccctc

SEQ ID NO: 8100695 - DNA, 22 bp, Homo sapiens
actcttcacacttgtctccagg

SEQ ID NO: 8100696 - DNA, 22 bp, Homo sapiens
agtgcagggggaaagggtgtct

SEQ ID NO: 8100697 - DNA, 22 bp, Homo sapiens
actgaggcccgaggatctcctg

SEQ ID NO: 8100698 - DNA, 22 bp, Homo sapiens
agtgcaggttaaggaactggcc

SEQ ID NO: 8100699 - DNA, 22 bp, Homo sapiens
agtgcatgaaagcatacaaggc

SEQ ID NO: 8100700 - DNA, 22 bp, Homo sapiens
agtcttctgtttttcagcagct

SEQ ID NO: 8100701 - DNA, 22 bp, Homo sapiens
agtcttcttgatcttttcagtg

SEQ ID NO: 8100702 - DNA, 22 bp, Homo sapiens
agtctgtcacttcaggggggga

SEQ ID NO: 8100703 - DNA, 22 bp, Homo sapiens
agtctgtctaatattattcagg

SEQ ID NO: 8100704 - DNA, 22 bp, Homo sapiens
agtctgtcagtcattctaacaa

SEQ ID NO: 8100705 - DNA, 22 bp, Homo sapiens
actctaaaatgctatgagatct

SEQ ID NO: 8100706 - DNA, 20 bp, Homo sapiens
agtctgtcaatttacagtgg

SEQ ID NO: 8100707 - DNA, 18 bp, Homo sapiens
agtcccatcttcagctct

SEQ ID NO: 8100708 - DNA, 22 bp, Homo sapiens
actgcacttcagcctgggtgac

SEQ ID NO: 8100709 - DNA, 22 bp, Homo sapiens
actgcacttcagcctgggtgac

SEQ ID NO: 8100710 - DNA, 22 bp, Homo sapiens
actgcacttcagcctgggtgtc

SEQ ID NO: 8100711 - DNA, 22 bp, Homo sapiens
actgcacttcagcctgggtgtc

SEQ ID NO: 8100712 - DNA, 22 bp, Homo sapiens
agtgtttaccccaatcagttta

SEQ ID NO: 8100713 - DNA, 22 bp, Homo sapiens
agtgttcttcctatctgctgtt

SEQ ID NO: 8100714 - DNA, 22 bp, Homo sapiens
actggaagtatctgcttgtttt

SEQ ID NO: 8100715 - DNA, 22 bp, Homo sapiens
agtgtatctaggtatctatagt

SEQ ID NO: 8100716 - DNA, 22 bp, Homo sapiens
agtgtatcatggttggcagaca

SEQ ID NO: 8100717 - DNA, 22 bp, Homo sapiens
agtgtatatgtgctgagaaacg

SEQ ID NO: 8100718 - DNA, 22 bp, Homo sapiens
agtgtagggtggtcagagcaga

SEQ ID NO: 8100719 - DNA, 22 bp, Homo sapiens
agtgtatacttttagtagaatt

SEQ ID NO: 8100720 - DNA, 22 bp, Homo sapiens
acggaatgagtcttgaaaagtg

SEQ ID NO: 8100721 - DNA, 22 bp, Homo sapiens
acgcagtttgtggacatttttt

SEQ ID NO: 8100722 - DNA, 22 bp, Homo sapiens
acgcctgtaatcccagcacttt

SEQ ID NO: 8100723 - DNA, 22 bp, Homo sapiens
agtaaaattgtattggaaaaca

SEQ ID NO: 8100724 - DNA, 22 bp, Homo sapiens
agtaaaatttctgctgaggaga

SEQ ID NO: 8100725 - DNA, 22 bp, Homo sapiens
agtaaaacagagaaatcactca

SEQ ID NO: 8100726 - DNA, 21 bp, Homo sapiens
actagcaaaagcctattatcc

SEQ ID NO: 8100727 - DNA, 22 bp, Homo sapiens
actagcagggatgttattactt

SEQ ID NO: 8100728 - DNA, 22 bp, Homo sapiens
actagcagggatgttattactt

SEQ ID NO: 8100729 - DNA, 22 bp, Homo sapiens
actagcagggatattatataag

SEQ ID NO: 8100730 - DNA, 22 bp, Homo sapiens
actagacatcgagctacagagt

SEQ ID NO: 8100731 - DNA, 22 bp, Homo sapiens
actagacatcgagctacagagt

SEQ ID NO: 8100732 - DNA, 22 bp, Homo sapiens
agtatttgatcagatgatagta

SEQ ID NO: 8100733 - DNA, 21 bp, Homo sapiens
agtatttcttcatgtccttgc

SEQ ID NO: 8100734 - DNA, 22 bp, Homo sapiens
agtatttgttgattgatatgaa

SEQ ID NO: 8100735 - DNA, 22 bp, Homo sapiens
agtcaaaacatgtactttcctt

SEQ ID NO: 8100736 - DNA, 22 bp, Homo sapiens
agtattttcgccatcacaagaa

SEQ ID NO: 8100737 - DNA, 21 bp, Homo sapiens
actagctttctggagaagtgt

SEQ ID NO: 8100738 - DNA, 22 bp, Homo sapiens
agtatactgaaagtaaatatga

SEQ ID NO: 8100739 - DNA, 22 bp, Homo sapiens
agtatactccccatcctagaaa

SEQ ID NO: 8100740 - DNA, 22 bp, Homo sapiens
actagtctgcattacaaaatag

SEQ ID NO: 8100741 - DNA, 22 bp, Homo sapiens
agtcaacatttgagatgcaatg

SEQ ID NO: 8100742 - DNA, 22 bp, Homo sapiens
agtcaacagtttttgatgtaaa

SEQ ID NO: 8100743 - DNA, 22 bp, Homo sapiens
agtcaaatgagtaaatatataa

SEQ ID NO: 8100744 - DNA, 22 bp, Homo sapiens
acctggcacacactggggagtg

SEQ ID NO: 8100745 - DNA, 22 bp, Homo sapiens
acctggccccactgtgctgctg

SEQ ID NO: 8100746 - DNA, 22 bp, Homo sapiens
acctggccatccagctggcatc

SEQ ID NO: 8100747 - DNA, 22 bp, Homo sapiens
aggtggcatgcctgagacataa

SEQ ID NO: 8100748 - DNA, 22 bp, Homo sapiens
acctggcataagggcttgagtc

SEQ ID NO: 8100749 - DNA, 22 bp, Homo sapiens
acctctgtatagttgcctgtgg

SEQ ID NO: 8100750 - DNA, 22 bp, Homo sapiens
acctgaaaccaacttgtgtact

SEQ ID NO: 8100751 - DNA, 22 bp, Homo sapiens
acctgagaatgggggcatgtgt

SEQ ID NO: 8100752 - DNA, 22 bp, Homo sapiens
acctgagagctataaggtttta

SEQ ID NO: 8100753 - DNA, 22 bp, Homo sapiens
acctgagacctaatctgactgt

SEQ ID NO: 8100754 - DNA, 22 bp, Homo sapiens
acctgcaagcattacacttcta

SEQ ID NO: 8100755 - DNA, 22 bp, Homo sapiens
acctgcaagcattacacttcta

SEQ ID NO: 8100756 - DNA, 19 bp, Homo sapiens
acctgccatgacagcctga

SEQ ID NO: 8100757 - DNA, 22 bp, Homo sapiens
acctgccaagcatcagtggcag

SEQ ID NO: 8100758 - DNA, 20 bp, Homo sapiens
acctgccacagagaaaggta

SEQ ID NO: 8100759 - DNA, 21 bp, Homo sapiens
acctgccacattgcagacttg

SEQ ID NO: 8100760 - DNA, 22 bp, Homo sapiens
actttctatggcttattatgag

SEQ ID NO: 8100761 - DNA, 22 bp, Homo sapiens
actttcaagcaagaacactttg

SEQ ID NO: 8100762 - DNA, 22 bp, Homo sapiens
actttcaagaacttctttaatg

SEQ ID NO: 8100763 - DNA, 22 bp, Homo sapiens
actttcaatttgcactaaccta

SEQ ID NO: 8100764 - DNA, 22 bp, Homo sapiens
actttcaagccctctagagaca

SEQ ID NO: 8100765 - DNA, 22 bp, Homo sapiens
atattcttccaaaacatcattt

SEQ ID NO: 8100766 - DNA, 21 bp, Homo sapiens
atatttctcataaggttatgg

SEQ ID NO: 8100767 - DNA, 21 bp, Homo sapiens
atatttcagatttccgtaatc

SEQ ID NO: 8100768 - DNA, 22 bp, Homo sapiens
atattcctgtttttaacacttt

SEQ ID NO: 8100769 - DNA, 22 bp, Homo sapiens
agaaagtacagatgagacactt

SEQ ID NO: 8100770 - DNA, 22 bp, Homo sapiens
atctaaactatagtacctagtc

SEQ ID NO: 8100771 - DNA, 22 bp, Homo sapiens
atctaaaaggagctctttatct

SEQ ID NO: 8100772 - DNA, 20 bp, Homo sapiens
atcggcttgcctggaaacaa

SEQ ID NO: 8100773 - DNA, 22 bp, Homo sapiens
atctaactgggctattttattg

SEQ ID NO: 8100774 - DNA, 22 bp, Homo sapiens
atctcaactaagcctaactttt

SEQ ID NO: 8100775 - DNA, 22 bp, Homo sapiens
atcgaacagtgtatacacttag

SEQ ID NO: 8100776 - DNA, 22 bp, Homo sapiens
actttcaaaagagaagtcatga

SEQ ID NO: 8100777 - DNA, 22 bp, Homo sapiens
atactgaaagggtgttacctaa

SEQ ID NO: 8100778 - DNA, 22 bp, Homo sapiens
atacatgttgagaaaatatctg

SEQ ID NO: 8100779 - DNA, 22 bp, Homo sapiens
acttacaagctagggaagcttg

SEQ ID NO: 8100780 - DNA, 20 bp, Homo sapiens
atacacttgcccagcttgtg

SEQ ID NO: 8100781 - DNA, 22 bp, Homo sapiens
actgtcaaaagagattatatta

SEQ ID NO: 8100782 - DNA, 22 bp, Homo sapiens
actgtcaatagtgctgagcttg

SEQ ID NO: 8100783 - DNA, 22 bp, Homo sapiens
actgtcaaatttatggaaagag

SEQ ID NO: 8100784 - DNA, 21 bp, Homo sapiens
actgggagaacgagcctttcc

SEQ ID NO: 8100785 - DNA, 22 bp, Homo sapiens
actgggaatggagcctgggcct

SEQ ID NO: 8100786 - DNA, 23 bp, Homo sapiens
actgggaagtttggagagacgca

SEQ ID NO: 8100787 - DNA, 22 bp, Homo sapiens
actgggaaaagctatggcaaat

SEQ ID NO: 8100788 - DNA, 19 bp, Homo sapiens
actgggaaaaaggcactgg

SEQ ID NO: 8100789 - DNA, 22 bp, Homo sapiens
actgggaagatggaggcaagca

SEQ ID NO: 8100790 - DNA, 22 bp, Homo sapiens
actgtacttacgcatatacagg

SEQ ID NO: 8100791 - DNA, 22 bp, Homo sapiens
actgtgatgttctctatcttgg

SEQ ID NO: 8100792 - DNA, 22 bp, Homo sapiens
ataaaatttgctactgttaaat

SEQ ID NO: 8100793 - DNA, 22 bp, Homo sapiens
agcagggggcatccttgccctt

SEQ ID NO: 8100794 - DNA, 22 bp, Homo sapiens
agcagggggccacagtcacagc

SEQ ID NO: 8100795 - DNA, 22 bp, Homo sapiens
agcaggggctcctccacagcca

SEQ ID NO: 8100796 - DNA, 22 bp, Homo sapiens
agcaggggtggaaggtagcttt

SEQ ID NO: 8100797 - DNA, 22 bp, Homo sapiens
agcaggggtctctgctaatgaa

SEQ ID NO: 8100798 - DNA, 22 bp, Homo sapiens
cactgctacctctgcctcccgg

SEQ ID NO: 8100799 - DNA, 22 bp, Homo sapiens
agcaggctccaggctggccatc

SEQ ID NO: 8100800 - DNA, 17 bp, Homo sapiens
agcaggctgcagaggcc

SEQ ID NO: 8100801 - DNA, 22 bp, Homo sapiens
cacagttcctgaatatatcaca

SEQ ID NO: 8100802 - DNA, 22 bp, Homo sapiens
cacaattttcctttaagtgtat

SEQ ID NO: 8100803 - DNA, 22 bp, Homo sapiens
caaaataccacgacttgtttta

SEQ ID NO: 8100804 - DNA, 23 bp, Homo sapiens
caaaagttagcccttcccatctc

SEQ ID NO: 8100805 - DNA, 22 bp, Homo sapiens
agcacaggtgaaacagtcaggt

SEQ ID NO: 8100806 - DNA, 22 bp, Homo sapiens
agcacagttggtaaaattgtta

SEQ ID NO: 8100807 - DNA, 22 bp, Homo sapiens
caaatatctttggcaaagagaa

SEQ ID NO: 8100808 - DNA, 22 bp, Homo sapiens
caacagctgatctttgatgaag

SEQ ID NO: 8100809 - DNA, 22 bp, Homo sapiens
caacagaggagtggcctgatcc

SEQ ID NO: 8100810 - DNA, 20 bp, Homo sapiens
caacagaggggtctggagta

SEQ ID NO: 8100811 - DNA, 22 bp, Homo sapiens
agcaccaagcctagagtgatgt

SEQ ID NO: 8100812 - DNA, 22 bp, Homo sapiens
agcaccaggctgttggaagccc

SEQ ID NO: 8100813 - DNA, 22 bp, Homo sapiens
agcagccacccagctgctcatt

SEQ ID NO: 8100814 - DNA, 22 bp, Homo sapiens
agcagccacacgcctccttctc

SEQ ID NO: 8100815 - DNA, 21 bp, Homo sapiens
agcagcagggaagcctcatcc

SEQ ID NO: 8100816 - DNA, 22 bp, Homo sapiens
agcagcagggacaaaggaacag

SEQ ID NO: 8100817 - DNA, 22 bp, Homo sapiens
agcagcagggtcattgctcttt

SEQ ID NO: 8100818 - DNA, 22 bp, Homo sapiens
caattttttccatgctcttaca

SEQ ID NO: 8100819 - DNA, 22 bp, Homo sapiens
agcagcaggctgggatgagtct

SEQ ID NO: 8100820 - DNA, 22 bp, Homo sapiens
agcagcaggctgtgtggactga

SEQ ID NO: 8100821 - DNA, 22 bp, Homo sapiens
agcagcaggctagggaactgct

SEQ ID NO: 8100822 - DNA, 22 bp, Homo sapiens
agcagcaggaggctgtccacca

SEQ ID NO: 8100823 - DNA, 22 bp, Homo sapiens
agcagcaggagccgtggggtga

SEQ ID NO: 8100824 - DNA, 22 bp, Homo sapiens
agcagcaggaggccattgtctt

SEQ ID NO: 8100825 - DNA, 22 bp, Homo sapiens
caagagagatgcagctcactca

SEQ ID NO: 8100826 - DNA, 22 bp, Homo sapiens
caagatttggcaactttgtcat

SEQ ID NO: 8100827 - DNA, 19 bp, Homo sapiens
caagatttgttcacacatg

SEQ ID NO: 8100828 - DNA, 22 bp, Homo sapiens
caagcaacgactttcaagctgt

SEQ ID NO: 8100829 - DNA, 22 bp, Homo sapiens
agcctctgtgactcacaggtca

SEQ ID NO: 8100830 - DNA, 22 bp, Homo sapiens
agcctctgtagaaagcagtgtg

SEQ ID NO: 8100831 - DNA, 22 bp, Homo sapiens
agcctctgggggagctgggagc

SEQ ID NO: 8100832 - DNA, 22 bp, Homo sapiens
agcctctggtcctccctcagct

SEQ ID NO: 8100833 - DNA, 20 bp, Homo sapiens
agcctctgcccttcccactg

SEQ ID NO: 8100834 - DNA, 22 bp, Homo sapiens
agcctctgcacgggcacgggtg

SEQ ID NO: 8100835 - DNA, 22 bp, Homo sapiens
agcctctgcttatgcaaaggta

SEQ ID NO: 8100836 - DNA, 21 bp, Homo sapiens
cagagggccggcatgtggtct

SEQ ID NO: 8100837 - DNA, 22 bp, Homo sapiens
cagagggccatctctatcttca

SEQ ID NO: 8100838 - DNA, 22 bp, Homo sapiens
cagaggtagggttggcccagga

SEQ ID NO: 8100839 - DNA, 22 bp, Homo sapiens
cagcagctgaggcgctggcgtg

SEQ ID NO: 8100840 - DNA, 22 bp, Homo sapiens
cagcagcattgctctggattcc

SEQ ID NO: 8100841 - DNA, 20 bp, Homo sapiens
cagcagccaaacttctattc

SEQ ID NO: 8100842 - DNA, 22 bp, Homo sapiens
agcctgagagccaagctgtgca

SEQ ID NO: 8100843 - DNA, 22 bp, Homo sapiens
cagcagctcctctgcggctatg

SEQ ID NO: 8100844 - DNA, 22 bp, Homo sapiens
cagcatagctgattaaggcaaa

SEQ ID NO: 8100845 - DNA, 22 bp, Homo sapiens
cagcagggggcagcgcagatca

SEQ ID NO: 8100846 - DNA, 22 bp, Homo sapiens
cagcagggtatacagggaattt

SEQ ID NO: 8100847 - DNA, 22 bp, Homo sapiens
cagccctgcacgctgcctccgc

SEQ ID NO: 8100848 - DNA, 22 bp, Homo sapiens
cagccctgagttagcccacgga

SEQ ID NO: 8100849 - DNA, 22 bp, Homo sapiens
cagcatcaacattctcagctct

SEQ ID NO: 8100850 - DNA, 22 bp, Homo sapiens
agctcagccctcctgtgcagct

SEQ ID NO: 8100851 - DNA, 22 bp, Homo sapiens
agctcagcttcctctccatgct

SEQ ID NO: 8100852 - DNA, 22 bp, Homo sapiens
agctcagcgggcttctggtaag

SEQ ID NO: 8100853 - DNA, 22 bp, Homo sapiens
agctcaggcaactctgggcccc

SEQ ID NO: 8100854 - DNA, 22 bp, Homo sapiens
cagctcaggcactggcgcggga

SEQ ID NO: 8100855 - DNA, 22 bp, Homo sapiens
agctcctgatacatgcaggaat

SEQ ID NO: 8100856 - DNA, 22 bp, Homo sapiens
agcatataaatggacatatttg

SEQ ID NO: 8100857 - DNA, 22 bp, Homo sapiens
agccacctcacctgctgccgtt

SEQ ID NO: 8100858 - DNA, 22 bp, Homo sapiens
agccactggcctgggcagctct

SEQ ID NO: 8100859 - DNA, 22 bp, Homo sapiens
agccacatttttctgctcctga

SEQ ID NO: 8100860 - DNA, 22 bp, Homo sapiens
agccactgtaaggggaattgcc

SEQ ID NO: 8100861 - DNA, 22 bp, Homo sapiens
cagaaatctccatgtcagacat

SEQ ID NO: 8100862 - DNA, 22 bp, Homo sapiens
agccactttactttcatatttt

SEQ ID NO: 8100863 - DNA, 22 bp, Homo sapiens
agccactgtgagaggaccaggg

SEQ ID NO: 8100864 - DNA, 22 bp, Homo sapiens
cagaatgggaaggactgcagtt

SEQ ID NO: 8100865 - DNA, 20 bp, Homo sapiens
cagaatgctgtaatcaagaa

SEQ ID NO: 8100866 - DNA, 22 bp, Homo sapiens
cagaatcagtgacacatgtata

SEQ ID NO: 8100867 - DNA, 22 bp, Homo sapiens
cagaatctctgggagtggatca

SEQ ID NO: 8100868 - DNA, 22 bp, Homo sapiens
cagaatctgagtcgtgattgta

SEQ ID NO: 8100869 - DNA, 22 bp, Homo sapiens
cagacagtttatcctaaataac

SEQ ID NO: 8100870 - DNA, 22 bp, Homo sapiens
agccagacatggctcctgctcc

SEQ ID NO: 8100871 - DNA, 23 bp, Homo sapiens
cagaggcatcggattcaacatca

SEQ ID NO: 8100872 - DNA, 22 bp, Homo sapiens
cagaggctcttcctcactgccc

SEQ ID NO: 8100873 - DNA, 22 bp, Homo sapiens
agcccagcaaagggaggttcag

SEQ ID NO: 8100874 - DNA, 23 bp, Homo sapiens
agcccagcagagaacctaggtcc

SEQ ID NO: 8100875 - DNA, 22 bp, Homo sapiens
agcccagcccgggctgcgcttt

SEQ ID NO: 8100876 - DNA, 22 bp, Homo sapiens
agcccagcagtaagattagaga

SEQ ID NO: 8100877 - DNA, 22 bp, Homo sapiens
cagagaaagggtgaattccttc

SEQ ID NO: 8100878 - DNA, 22 bp, Homo sapiens
agagcctgttcggaggcgcccc

SEQ ID NO: 8100879 - DNA, 22 bp, Homo sapiens
atgtggttgaagaattacatct

SEQ ID NO: 8100880 - DNA, 22 bp, Homo sapiens
agagccagcaactctagccctg

SEQ ID NO: 8100881 - DNA, 22 bp, Homo sapiens
agagcagtcattaatacatgta

SEQ ID NO: 8100882 - DNA, 22 bp, Homo sapiens
agagccaagttgtcaaggcact

SEQ ID NO: 8100883 - DNA, 22 bp, Homo sapiens
atggctaatacgccactggaca

SEQ ID NO: 8100884 - DNA, 22 bp, Homo sapiens
agaccactggcctcctgcagac

SEQ ID NO: 8100885 - DNA, 22 bp, Homo sapiens
agaccaaagaaaacacatctgg

SEQ ID NO: 8100886 - DNA, 22 bp, Homo sapiens
atgaaagatgatttaaagtact

SEQ ID NO: 8100887 - DNA, 22 bp, Homo sapiens
atgaaattttaattatacctct

SEQ ID NO: 8100888 - DNA, 22 bp, Homo sapiens
agacaaatggagtatgagcaac

SEQ ID NO: 8100889 - DNA, 22 bp, Homo sapiens
agaattgctaactctcctcctg

SEQ ID NO: 8100890 - DNA, 20 bp, Homo sapiens
agaagtcagctcagaagtga

SEQ ID NO: 8100891 - DNA, 19 bp, Homo sapiens
agaagttagacattgcaat

SEQ ID NO: 8100892 - DNA, 22 bp, Homo sapiens
agaagttatccaccttagatgc

SEQ ID NO: 8100893 - DNA, 22 bp, Homo sapiens
agaagttaattcctgaaattct

SEQ ID NO: 8100894 - DNA, 22 bp, Homo sapiens
agaagttaccacatacttctct

SEQ ID NO: 8100895 - DNA, 22 bp, Homo sapiens
atgacaagagtgttcagggaga

SEQ ID NO: 8100896 - DNA, 22 bp, Homo sapiens
atgcacttaaataacataactt

SEQ ID NO: 8100897 - DNA, 22 bp, Homo sapiens
agacatcaatgatcagaggtag

SEQ ID NO: 8100898 - DNA, 22 bp, Homo sapiens
agacatatggtgaaacatttta

SEQ ID NO: 8100899 - DNA, 21 bp, Homo sapiens
agacagctttaaagacacagg

SEQ ID NO: 8100900 - DNA, 22 bp, Homo sapiens
agacaggcagaggctgcagagg

SEQ ID NO: 8100901 - DNA, 22 bp, Homo sapiens
agacagacttgaaaatgttctt

SEQ ID NO: 8100902 - DNA, 22 bp, Homo sapiens
agacagctatcaacaactttct

SEQ ID NO: 8100903 - DNA, 22 bp, Homo sapiens
atgtttacaattcagtattaca

SEQ ID NO: 8100904 - DNA, 19 bp, Homo sapiens
atgtttacactcaggggct

SEQ ID NO: 8100905 - DNA, 21 bp, Homo sapiens
atgtttacactgactactgtg

SEQ ID NO: 8100906 - DNA, 22 bp, Homo sapiens
atgtttacagaggaagtgcctc

SEQ ID NO: 8100907 - DNA, 22 bp, Homo sapiens
atgtttactgaaaagatttcaa

SEQ ID NO: 8100908 - DNA, 22 bp, Homo sapiens
atgtttactggtttatagaata

SEQ ID NO: 8100909 - DNA, 22 bp, Homo sapiens
atgtttatgcaaacatgtgagt

SEQ ID NO: 8100910 - DNA, 22 bp, Homo sapiens
atgtttatgcaaacatgtgagt

SEQ ID NO: 8100911 - DNA, 22 bp, Homo sapiens
atgtttatgttgggctatattt

SEQ ID NO: 8100912 - DNA, 22 bp, Homo sapiens
agaggaagctgagatgcctctt

SEQ ID NO: 8100913 - DNA, 22 bp, Homo sapiens
agagctgttcagcagccaggtt

SEQ ID NO: 8100914 - DNA, 22 bp, Homo sapiens
agagctgtcacatagagccaga

SEQ ID NO: 8100915 - DNA, 22 bp, Homo sapiens
agagctggtttactcaggaatt

SEQ ID NO: 8100916 - DNA, 22 bp, Homo sapiens
atgtgtagaactgtaatgccca

SEQ ID NO: 8100917 - DNA, 22 bp, Homo sapiens
agaggaggctgggtccagataa

SEQ ID NO: 8100918 - DNA, 22 bp, Homo sapiens
agaggaggctctgggatcgtcc

SEQ ID NO: 8100919 - DNA, 22 bp, Homo sapiens
agaggaggccaggcccacacct

SEQ ID NO: 8100920 - DNA, 22 bp, Homo sapiens
agaggagcctcagtttgcagcc

SEQ ID NO: 8100921 - DNA, 22 bp, Homo sapiens
agaggacaggttttccatgggc

SEQ ID NO: 8100922 - DNA, 22 bp, Homo sapiens
agaggagctgggaggccctcgt

SEQ ID NO: 8100923 - DNA, 22 bp, Homo sapiens
attattcaaattcccactatac

SEQ ID NO: 8100924 - DNA, 22 bp, Homo sapiens
attattcaacacttgagaaatt

SEQ ID NO: 8100925 - DNA, 22 bp, Homo sapiens
attattcaacacttgagaaatt

SEQ ID NO: 8100926 - DNA, 22 bp, Homo sapiens
attattcaacacttgagaaatt

SEQ ID NO: 8100927 - DNA, 22 bp, Homo sapiens
attattaggactactggggttg

SEQ ID NO: 8100928 - DNA, 22 bp, Homo sapiens
attattaaagcttaggtcttat

SEQ ID NO: 8100929 - DNA, 22 bp, Homo sapiens
attccagtccaaatgttttcct

SEQ ID NO: 8100930 - DNA, 22 bp, Homo sapiens
attccagttgggttctaataca

SEQ ID NO: 8100931 - DNA, 22 bp, Homo sapiens
attccagtgtgcatggtacaca

SEQ ID NO: 8100932 - DNA, 22 bp, Homo sapiens
attccagtgtcatgctctcagg

SEQ ID NO: 8100933 - DNA, 22 bp, Homo sapiens
attgataaattgcaatggggct

SEQ ID NO: 8100934 - DNA, 17 bp, Homo sapiens
agagggaaaatgcggtt

SEQ ID NO: 8100935 - DNA, 22 bp, Homo sapiens
agaggctgtgcagagggagtgc

SEQ ID NO: 8100936 - DNA, 22 bp, Homo sapiens
agagggagaaaagaatcagttg

SEQ ID NO: 8100937 - DNA, 22 bp, Homo sapiens
agagggaatgtgattgcaccat

SEQ ID NO: 8100938 - DNA, 21 bp, Homo sapiens
agagggagagtggcccttcca

SEQ ID NO: 8100939 - DNA, 22 bp, Homo sapiens
agaggctagagatctgtcctac

SEQ ID NO: 8100940 - DNA, 16 bp, Homo sapiens
agaggccttgaggaag

SEQ ID NO: 8100941 - DNA, 22 bp, Homo sapiens
agaggcggagcttgcagtgagc

SEQ ID NO: 8100942 - DNA, 22 bp, Homo sapiens
agaggcggaggttgcagtgagc

SEQ ID NO: 8100943 - DNA, 22 bp, Homo sapiens
attcatttaggtattcacttac

SEQ ID NO: 8100944 - DNA, 22 bp, Homo sapiens
attcatttagagggattaagca

SEQ ID NO: 8100945 - DNA, 22 bp, Homo sapiens
attcatttgctattgtgtatgg

SEQ ID NO: 8100946 - DNA, 22 bp, Homo sapiens
attcagtaggtgtgaacttatt

SEQ ID NO: 8100947 - DNA, 22 bp, Homo sapiens
agaggcaggaggttgacttgag

SEQ ID NO: 8100948 - DNA, 22 bp, Homo sapiens
agagtgggtgatctctgttgtc

SEQ ID NO: 8100949 - DNA, 22 bp, Homo sapiens
agagtgggtgatctctgttgtc

SEQ ID NO: 8100950 - DNA, 22 bp, Homo sapiens
attgccaggagggttgagaata

SEQ ID NO: 8100951 - DNA, 22 bp, Homo sapiens
attgccaggatgtggtttgtag

SEQ ID NO: 8100952 - DNA, 23 bp, Homo sapiens
attgccaggatgctgaagcttac

SEQ ID NO: 8100953 - DNA, 23 bp, Homo sapiens
attgccagacggcccctgctcgc

SEQ ID NO: 8100954 - DNA, 22 bp, Homo sapiens
agatacatggaacgtcaaacct

SEQ ID NO: 8100955 - DNA, 22 bp, Homo sapiens
agatacattagtagttacttgt

SEQ ID NO: 8100956 - DNA, 22 bp, Homo sapiens
atttcacatctatctcagattt

SEQ ID NO: 8100957 - DNA, 22 bp, Homo sapiens
atttattgaagcttattacgtt

SEQ ID NO: 8100958 - DNA, 22 bp, Homo sapiens
atttcacaaagaacagatgcag

SEQ ID NO: 8100959 - DNA, 23 bp, Homo sapiens
agagttttctgttttctgtaggg

SEQ ID NO: 8100960 - DNA, 22 bp, Homo sapiens
atttgtgggactataatgcagg

SEQ ID NO: 8100961 - DNA, 22 bp, Homo sapiens
caaaagggagttctctggaagg

SEQ ID NO: 8100962 - DNA, 22 bp, Homo sapiens
caaaagtaattgcagtttttgc

SEQ ID NO: 8100963 - DNA, 22 bp, Homo sapiens
attttttgttaactcaggatag

SEQ ID NO: 8100964 - DNA, 22 bp, Homo sapiens
agatacattgttctaagcattg

SEQ ID NO: 8100965 - DNA, 22 bp, Homo sapiens
agatacatttgtgtgcatgtat

SEQ ID NO: 8100966 - DNA, 22 bp, Homo sapiens
atttccttcagtgtttaatact

SEQ ID NO: 8100967 - DNA, 22 bp, Homo sapiens
atttctctcattgttagctagg

SEQ ID NO: 8100968 - DNA, 22 bp, Homo sapiens
atttctctcattgttagctagg

SEQ ID NO: 8100969 - DNA, 22 bp, Homo sapiens
atttctctaagcatccgtttgc

SEQ ID NO: 8100970 - DNA, 22 bp, Homo sapiens
atttctctgcctcagcttctgc

SEQ ID NO: 8100971 - DNA, 22 bp, Homo sapiens
atttctctgcagtgttcggaat

SEQ ID NO: 8100972 - DNA, 18 bp, Homo sapiens
atttctctggggtgattc

SEQ ID NO: 8100973 - DNA, 22 bp, Homo sapiens
atttctcttagcaagacattac

SEQ ID NO: 8100974 - DNA, 22 bp, Homo sapiens
acagcagctaaaggtgtctcct

SEQ ID NO: 8100975 - DNA, 22 bp, Homo sapiens
agctatggtaatcatccaccaa

SEQ ID NO: 8100976 - DNA, 22 bp, Homo sapiens
agctagttcactgaagcctatg

SEQ ID NO: 8100977 - DNA, 22 bp, Homo sapiens
agcctgccaggcgctgcctgga

SEQ ID NO: 8100978 - DNA, 20 bp, Homo sapiens
agcctgccagctggcccaga

SEQ ID NO: 8100979 - DNA, 17 bp, Homo sapiens
agcctgccccatgctgc

SEQ ID NO: 8100980 - DNA, 21 bp, Homo sapiens
agcctgcctgaactctgtggc

SEQ ID NO: 8100981 - DNA, 22 bp, Homo sapiens
agcctgccttgggctgcttgag

SEQ ID NO: 8100982 - DNA, 17 bp, Homo sapiens
agcctgctgatctcaca

SEQ ID NO: 8100983 - DNA, 22 bp, Homo sapiens
acagcaactcctgcttctgagt

SEQ ID NO: 8100984 - DNA, 22 bp, Homo sapiens
agcccagctgcctgcctgctgt

SEQ ID NO: 8100985 - DNA, 22 bp, Homo sapiens
agcccagctgctatgtacctgg

SEQ ID NO: 8100986 - DNA, 22 bp, Homo sapiens
agcccagcttccttctgtctct

SEQ ID NO: 8100987 - DNA, 22 bp, Homo sapiens
agcccagctttcacccctctgg

SEQ ID NO: 8100988 - DNA, 22 bp, Homo sapiens
agccattagtcattttagaata

SEQ ID NO: 8100989 - DNA, 22 bp, Homo sapiens
agccagggtgggtgaatgctat

SEQ ID NO: 8100990 - DNA, 22 bp, Homo sapiens
agccacagtctgatgcctgaga

SEQ ID NO: 8100991 - DNA, 22 bp, Homo sapiens
acagagcatataaagtgctttg

SEQ ID NO: 8100992 - DNA, 22 bp, Homo sapiens
agcccctctgtggctctgcctc

SEQ ID NO: 8100993 - DNA, 22 bp, Homo sapiens
agcccctgggagtagctgctgc

SEQ ID NO: 8100994 - DNA, 22 bp, Homo sapiens
acagagtcctagctgcaaagaa

SEQ ID NO: 8100995 - DNA, 19 bp, Homo sapiens
acagagtccagaggaaagg

SEQ ID NO: 8100996 - DNA, 22 bp, Homo sapiens
acagagtcattcattgtccagt

SEQ ID NO: 8100997 - DNA, 22 bp, Homo sapiens
acagaggtggacctcagcaggc

SEQ ID NO: 8100998 - DNA, 22 bp, Homo sapiens
acagagtctcaaacctacaaag

SEQ ID NO: 8100999 - DNA, 22 bp, Homo sapiens
acagagtcgccttgtagctggc

SEQ ID NO: 8101000 - DNA, 22 bp, Homo sapiens
acagagtctcagggatgaaagc

SEQ ID NO: 8101001 - DNA, 22 bp, Homo sapiens
acagagtctgacaggtaggcgc

SEQ ID NO: 8101002 - DNA, 22 bp, Homo sapiens
acagagtcttacgtggtgataa

SEQ ID NO: 8101003 - DNA, 22 bp, Homo sapiens
acaatttatccattgtatagtt

SEQ ID NO: 8101004 - DNA, 22 bp, Homo sapiens
acaattctgggtatttatatag

SEQ ID NO: 8101005 - DNA, 22 bp, Homo sapiens
agcacctgcacagtggaggaaa

SEQ ID NO: 8101006 - DNA, 23 bp, Homo sapiens
agcagcagtgagaggtgtcttac

SEQ ID NO: 8101007 - DNA, 22 bp, Homo sapiens
agcagcagtgacagccgaaagc

SEQ ID NO: 8101008 - DNA, 22 bp, Homo sapiens
acacataagaaactacaaagag

SEQ ID NO: 8101009 - DNA, 22 bp, Homo sapiens
agcagcagtgtgtggtcatgtt

SEQ ID NO: 8101010 - DNA, 22 bp, Homo sapiens
acacataagaaactacaaagag

SEQ ID NO: 8101011 - DNA, 22 bp, Homo sapiens
agcagcaggtgacctcgatgcc

SEQ ID NO: 8101012 - DNA, 22 bp, Homo sapiens
agcagcaggtgcttctggatct

SEQ ID NO: 8101013 - DNA, 22 bp, Homo sapiens
agcagctttaagtcactggtta

SEQ ID NO: 8101014 - DNA, 18 bp, Homo sapiens
agcagctttgtgcttgat

SEQ ID NO: 8101015 - DNA, 20 bp, Homo sapiens
agcaggaaaagtgccagtct

SEQ ID NO: 8101016 - DNA, 22 bp, Homo sapiens
acactgcagatgtaatttgagt

SEQ ID NO: 8101017 - DNA, 22 bp, Homo sapiens
acacattatctcattaaatact

SEQ ID NO: 8101018 - DNA, 22 bp, Homo sapiens
acacattatctcattaaatact

SEQ ID NO: 8101019 - DNA, 22 bp, Homo sapiens
acacatttgggctcctacataa

SEQ ID NO: 8101020 - DNA, 22 bp, Homo sapiens
acaccacaagtaactcttttcc

SEQ ID NO: 8101021 - DNA, 22 bp, Homo sapiens
acaccaaagtagaattaatgta

SEQ ID NO: 8101022 - DNA, 22 bp, Homo sapiens
acacattttgttaaaccctgtg

SEQ ID NO: 8101023 - DNA, 22 bp, Homo sapiens
agcagtgttcaatgatacactg

SEQ ID NO: 8101024 - DNA, 22 bp, Homo sapiens
agcagtgttctaatctggctag

SEQ ID NO: 8101025 - DNA, 20 bp, Homo sapiens
agcagtgtttcttgactcta

SEQ ID NO: 8101026 - DNA, 22 bp, Homo sapiens
aatgcaatgcagcacctccttg

SEQ ID NO: 8101027 - DNA, 22 bp, Homo sapiens
aatgcaatacctttttatgctg

SEQ ID NO: 8101028 - DNA, 22 bp, Homo sapiens
agaaggggcccaaggatgtcag

SEQ ID NO: 8101029 - DNA, 22 bp, Homo sapiens
agacagggtgatcgcttgagcc

SEQ ID NO: 8101030 - DNA, 22 bp, Homo sapiens
agacagggtcttgatcagagct

SEQ ID NO: 8101031 - DNA, 22 bp, Homo sapiens
aatgtctcaccgtaaatgtaac

SEQ ID NO: 8101032 - DNA, 22 bp, Homo sapiens
aatgtcttcagtgtatacatgg

SEQ ID NO: 8101033 - DNA, 22 bp, Homo sapiens
aatgtctacattctgaattcgt

SEQ ID NO: 8101034 - DNA, 22 bp, Homo sapiens
aatgttctgggagagaagctgt

SEQ ID NO: 8101035 - DNA, 22 bp, Homo sapiens
aatgttctgatgtagggtttag

SEQ ID NO: 8101036 - DNA, 22 bp, Homo sapiens
aatgttctgtgctggttctggg

SEQ ID NO: 8101037 - DNA, 22 bp, Homo sapiens
aatgttgatgttttcagtgagc

SEQ ID NO: 8101038 - DNA, 20 bp, Homo sapiens
aatgttcagtaattgtttta

SEQ ID NO: 8101039 - DNA, 22 bp, Homo sapiens
aattaccaggatttttcagtat

SEQ ID NO: 8101040 - DNA, 23 bp, Homo sapiens
aattaccatgcaacttgtgaaac

SEQ ID NO: 8101041 - DNA, 23 bp, Homo sapiens
aattaccatgcaacttgtgaaac

SEQ ID NO: 8101042 - DNA, 22 bp, Homo sapiens
aatgtttaatgttagtggtaat

SEQ ID NO: 8101043 - DNA, 19 bp, Homo sapiens
aatgtttaagagaaaaagg

SEQ ID NO: 8101044 - DNA, 22 bp, Homo sapiens
aattatattgtggtgtgaatgt

SEQ ID NO: 8101045 - DNA, 22 bp, Homo sapiens
aattatgattggtctaaaccag

SEQ ID NO: 8101046 - DNA, 22 bp, Homo sapiens
aattatgaggtagatatcacat

SEQ ID NO: 8101047 - DNA, 22 bp, Homo sapiens
aattatgaggtagatatcacat

SEQ ID NO: 8101048 - DNA, 22 bp, Homo sapiens
aattatattgaagttgaatgtc

SEQ ID NO: 8101049 - DNA, 22 bp, Homo sapiens
aattatatgttaatcttcaatt

SEQ ID NO: 8101050 - DNA, 22 bp, Homo sapiens
aattatatgttaatcttcaatt

SEQ ID NO: 8101051 - DNA, 20 bp, Homo sapiens
aattatataactccaacatt

SEQ ID NO: 8101052 - DNA, 22 bp, Homo sapiens
aattatacaattgtcaagttct

SEQ ID NO: 8101053 - DNA, 22 bp, Homo sapiens
aattatacaattgtcaagttct

SEQ ID NO: 8101054 - DNA, 22 bp, Homo sapiens
aattatacattgaacaatctag

SEQ ID NO: 8101055 - DNA, 22 bp, Homo sapiens
aattatacattgaacaatctag

SEQ ID NO: 8101056 - DNA, 22 bp, Homo sapiens
aatttacagttgctgatggtac

SEQ ID NO: 8101057 - DNA, 22 bp, Homo sapiens
acaaatgactcaaacaccactt

SEQ ID NO: 8101058 - DNA, 22 bp, Homo sapiens
acaaacttcccagacaagctcc

SEQ ID NO: 8101059 - DNA, 22 bp, Homo sapiens
acaaacttcccagacaagctcc

SEQ ID NO: 8101060 - DNA, 22 bp, Homo sapiens
acaaacttccatcatgaatttt

SEQ ID NO: 8101061 - DNA, 22 bp, Homo sapiens
acaaaattgtgttaaactttat

SEQ ID NO: 8101062 - DNA, 22 bp, Homo sapiens
acaaaattgtgttaaactttat

SEQ ID NO: 8101063 - DNA, 22 bp, Homo sapiens
acaaaattgtgttaaactttat

SEQ ID NO: 8101064 - DNA, 22 bp, Homo sapiens
acaaaatttttagacaaggctt

SEQ ID NO: 8101065 - DNA, 22 bp, Homo sapiens
acaaaatttttagacaaggctt

SEQ ID NO: 8101066 - DNA, 22 bp, Homo sapiens
acaaaattacctagttattttc

SEQ ID NO: 8101067 - DNA, 22 bp, Homo sapiens
acaaaattacctagttattttc

SEQ ID NO: 8101068 - DNA, 22 bp, Homo sapiens
acaaaattatgaagaggccttg

SEQ ID NO: 8101069 - DNA, 22 bp, Homo sapiens
acaaaatcaaaggagtgattca

SEQ ID NO: 8101070 - DNA, 21 bp, Homo sapiens
agaggccctcggactgggcgt

SEQ ID NO: 8101071 - DNA, 22 bp, Homo sapiens
agaggccccatgggatggcggt

SEQ ID NO: 8101072 - DNA, 22 bp, Homo sapiens
agaggccccaggtgagcatgcc

SEQ ID NO: 8101073 - DNA, 20 bp, Homo sapiens
agaggccagttaggagtcta

SEQ ID NO: 8101074 - DNA, 22 bp, Homo sapiens
agcaagattttccttgaatgtt

SEQ ID NO: 8101075 - DNA, 22 bp, Homo sapiens
acaattcaagcaagagagacaa

SEQ ID NO: 8101076 - DNA, 22 bp, Homo sapiens
acaattcaagatgagattcagg

SEQ ID NO: 8101077 - DNA, 22 bp, Homo sapiens
acaaattatagaaaattgagct

SEQ ID NO: 8101078 - DNA, 22 bp, Homo sapiens
acaaattaccatggaatttggg

SEQ ID NO: 8101079 - DNA, 22 bp, Homo sapiens
acaaggaacaagcatgtagttt

SEQ ID NO: 8101080 - DNA, 22 bp, Homo sapiens
acaaattaccatggaatttggg

SEQ ID NO: 8101081 - DNA, 22 bp, Homo sapiens
acaagttctgggaattaggaca

SEQ ID NO: 8101082 - DNA, 22 bp, Homo sapiens
acaagttccactacagagttgt

SEQ ID NO: 8101083 - DNA, 22 bp, Homo sapiens
acaagtcagtggaattaatatt

SEQ ID NO: 8101084 - DNA, 22 bp, Homo sapiens
acaagttaccaaaaaagattca

SEQ ID NO: 8101085 - DNA, 22 bp, Homo sapiens
acaagtatttaaggttagtata

SEQ ID NO: 8101086 - DNA, 22 bp, Homo sapiens
acaaggtatccacattaaatgt

SEQ ID NO: 8101087 - DNA, 22 bp, Homo sapiens
acatgtgtacatatatatgtgc

SEQ ID NO: 8101088 - DNA, 22 bp, Homo sapiens
aaggcatagtctttaagttctg

SEQ ID NO: 8101089 - DNA, 22 bp, Homo sapiens
aaggcatatgctgtgtacagtt

SEQ ID NO: 8101090 - DNA, 22 bp, Homo sapiens
aaggcatatattctaaacagga

SEQ ID NO: 8101091 - DNA, 22 bp, Homo sapiens
aaggcatgaaagcgaaatgaga

SEQ ID NO: 8101092 - DNA, 22 bp, Homo sapiens
aaggctgtcttttcctcttccc

SEQ ID NO: 8101093 - DNA, 22 bp, Homo sapiens
aaggcttcttatgcaattgttt

SEQ ID NO: 8101094 - DNA, 22 bp, Homo sapiens
aagtcacaagcatatatgcatt

SEQ ID NO: 8101095 - DNA, 22 bp, Homo sapiens
aagtatctttctagcaactaaa

SEQ ID NO: 8101096 - DNA, 22 bp, Homo sapiens
aagtatctgggagatttgcttt

SEQ ID NO: 8101097 - DNA, 22 bp, Homo sapiens
aaggtggaggttgcagtgagct

SEQ ID NO: 8101098 - DNA, 22 bp, Homo sapiens
aaggtagattctggatcgaagg

SEQ ID NO: 8101099 - DNA, 22 bp, Homo sapiens
aaggtgaggattttgttctgct

SEQ ID NO: 8101100 - DNA, 22 bp, Homo sapiens
aaggcacttgcccagagctgca

SEQ ID NO: 8101101 - DNA, 22 bp, Homo sapiens
aaggaagaagactctttactcc

SEQ ID NO: 8101102 - DNA, 22 bp, Homo sapiens
aaggaacctgggaacctatcat

SEQ ID NO: 8101103 - DNA, 22 bp, Homo sapiens
aaggaagaaatgaataggtgga

SEQ ID NO: 8101104 - DNA, 22 bp, Homo sapiens
aaggaacctctaagcctctgtt

SEQ ID NO: 8101105 - DNA, 19 bp, Homo sapiens
aaggaaccctgggttgctc

SEQ ID NO: 8101106 - DNA, 22 bp, Homo sapiens
aaggaacctggagtagagggag

SEQ ID NO: 8101107 - DNA, 22 bp, Homo sapiens
aaggaaccatttgtgtgcatgg

SEQ ID NO: 8101108 - DNA, 22 bp, Homo sapiens
aaggaacctgagggaccccaaa

SEQ ID NO: 8101109 - DNA, 22 bp, Homo sapiens
acagtagatggctcagagacag

SEQ ID NO: 8101110 - DNA, 22 bp, Homo sapiens
aaggcaggtattgatgccacag

SEQ ID NO: 8101111 - DNA, 22 bp, Homo sapiens
aaggcagtaggtgtttcaaact

SEQ ID NO: 8101112 - DNA, 22 bp, Homo sapiens
aaggcagtggttgtgatactgt

SEQ ID NO: 8101113 - DNA, 22 bp, Homo sapiens
aaggcagtctggtttcaaagca

SEQ ID NO: 8101114 - DNA, 22 bp, Homo sapiens
acagttctttgtttatagcttg

SEQ ID NO: 8101115 - DNA, 22 bp, Homo sapiens
acagttgttttccagatatgtt

SEQ ID NO: 8101116 - DNA, 22 bp, Homo sapiens
acaggcaggtcctgtcccagct

SEQ ID NO: 8101117 - DNA, 22 bp, Homo sapiens
aagctgcagatgtgcctgtgga

SEQ ID NO: 8101118 - DNA, 22 bp, Homo sapiens
aagccagggtttgtggatctat

SEQ ID NO: 8101119 - DNA, 22 bp, Homo sapiens
aagccaggggttggtatgctat

SEQ ID NO: 8101120 - DNA, 22 bp, Homo sapiens
aaggaaatacttctgcagagca

SEQ ID NO: 8101121 - DNA, 22 bp, Homo sapiens
aaggaaaggatgagcatgcatt

SEQ ID NO: 8101122 - DNA, 22 bp, Homo sapiens
aaggaaagacatataaatgact

SEQ ID NO: 8101123 - DNA, 22 bp, Homo sapiens
acaggcattgggatggaggttg

SEQ ID NO: 8101124 - DNA, 22 bp, Homo sapiens
acaggcatatttctagattaca

SEQ ID NO: 8101125 - DNA, 22 bp, Homo sapiens
aatgaaactagtagaatctttg

SEQ ID NO: 8101126 - DNA, 22 bp, Homo sapiens
agaaaacattacataggtgtgt

SEQ ID NO: 8101127 - DNA, 22 bp, Homo sapiens
agaaaacagaaagtcattggtg

SEQ ID NO: 8101128 - DNA, 22 bp, Homo sapiens
aatgaactccgaacatttacat

SEQ ID NO: 8101129 - DNA, 22 bp, Homo sapiens
aatgaacaggtgaatgtcagat

SEQ ID NO: 8101130 - DNA, 22 bp, Homo sapiens
agaaatactaggaatattcata

SEQ ID NO: 8101131 - DNA, 22 bp, Homo sapiens
agaaatacaaagtactaagata

SEQ ID NO: 8101132 - DNA, 22 bp, Homo sapiens
aatgagaaccttgaaaggaact

SEQ ID NO: 8101133 - DNA, 22 bp, Homo sapiens
aatgagaatgtaagtgaagaga

SEQ ID NO: 8101134 - DNA, 22 bp, Homo sapiens
aatgaggtacagggccttggaa

SEQ ID NO: 8101135 - DNA, 22 bp, Homo sapiens
aatgaggtgaggaaggcctcag

SEQ ID NO: 8101136 - DNA, 22 bp, Homo sapiens
aatgaggttcgcagttgtttta

SEQ ID NO: 8101137 - DNA, 22 bp, Homo sapiens
aatgaggtcattaatggtggga

SEQ ID NO: 8101138 - DNA, 20 bp, Homo sapiens
aatgaggtcccactgaggag

SEQ ID NO: 8101139 - DNA, 22 bp, Homo sapiens
aatcaacattgttttaagtcaa

SEQ ID NO: 8101140 - DNA, 22 bp, Homo sapiens
aatcaacattgttttaagtcaa

SEQ ID NO: 8101141 - DNA, 22 bp, Homo sapiens
aatcaagaaaatgaggattctt

SEQ ID NO: 8101142 - DNA, 22 bp, Homo sapiens
aatcaactgtttccacagggag

SEQ ID NO: 8101143 - DNA, 21 bp, Homo sapiens
aatcaaatgtcatatccccag

SEQ ID NO: 8101144 - DNA, 22 bp, Homo sapiens
aatcaacaggatgtgcattgta

SEQ ID NO: 8101145 - DNA, 22 bp, Homo sapiens
aatcaaagaatgggctagttgg

SEQ ID NO: 8101146 - DNA, 22 bp, Homo sapiens
aatcaaaacctacagaggtaat

SEQ ID NO: 8101147 - DNA, 22 bp, Homo sapiens
aatattttaggctttccaggct

SEQ ID NO: 8101148 - DNA, 22 bp, Homo sapiens
aatcataattgtatacattcat

SEQ ID NO: 8101149 - DNA, 22 bp, Homo sapiens
acttgtttctattgattccagt

SEQ ID NO: 8101150 - DNA, 22 bp, Homo sapiens
aatccaggtggcggaggttgtg

SEQ ID NO: 8101151 - DNA, 22 bp, Homo sapiens
aatcctcagtttaagaatctgt

SEQ ID NO: 8101152 - DNA, 22 bp, Homo sapiens
aatacaagatttatagttgttt

SEQ ID NO: 8101153 - DNA, 22 bp, Homo sapiens
aatacaatcaaattcactagca

SEQ ID NO: 8101154 - DNA, 22 bp, Homo sapiens
aatacaatcaaattcactagca

SEQ ID NO: 8101155 - DNA, 22 bp, Homo sapiens
aatacaatcaaattcactagca

SEQ ID NO: 8101156 - DNA, 22 bp, Homo sapiens
acttgaaaccttggcaaacaat

SEQ ID NO: 8101157 - DNA, 22 bp, Homo sapiens
acttgaaaccctgagatgataa

SEQ ID NO: 8101158 - DNA, 22 bp, Homo sapiens
acttgaaaagctcagcagtagt

SEQ ID NO: 8101159 - DNA, 22 bp, Homo sapiens
acttgaaaggaagctctaaaac

SEQ ID NO: 8101160 - DNA, 19 bp, Homo sapiens
acttgaaagcagagagttt

SEQ ID NO: 8101161 - DNA, 23 bp, Homo sapiens
aatatatgtgtttttctgcttca

SEQ ID NO: 8101162 - DNA, 22 bp, Homo sapiens
aatatcagattatgacgtttca

SEQ ID NO: 8101163 - DNA, 22 bp, Homo sapiens
aatatcagaatgtaatggtcct

SEQ ID NO: 8101164 - DNA, 22 bp, Homo sapiens
aatatcagaatgtaatggtcct

SEQ ID NO: 8101165 - DNA, 22 bp, Homo sapiens
aatatatgagggagctatttga

SEQ ID NO: 8101166 - DNA, 22 bp, Homo sapiens
actaaatttgtcaatgacactt

SEQ ID NO: 8101167 - DNA, 23 bp, Homo sapiens
aagtcagagccaagtcaatgaga

SEQ ID NO: 8101168 - DNA, 22 bp, Homo sapiens
aagtcagacagctgagctgcct

SEQ ID NO: 8101169 - DNA, 22 bp, Homo sapiens
aagtcagaaattattcaggaat

SEQ ID NO: 8101170 - DNA, 22 bp, Homo sapiens
aagtcagagatcaaggtgtcta

SEQ ID NO: 8101171 - DNA, 22 bp, Homo sapiens
aagttcaaggcaggtcctgagg

SEQ ID NO: 8101172 - DNA, 22 bp, Homo sapiens
aagttcaagagtgacatattag

SEQ ID NO: 8101173 - DNA, 22 bp, Homo sapiens
actccagttaccttggctgagg

SEQ ID NO: 8101174 - DNA, 22 bp, Homo sapiens
aagttagaaataagggctctcc

SEQ ID NO: 8101175 - DNA, 22 bp, Homo sapiens
aagttagagattccatcatgct

SEQ ID NO: 8101176 - DNA, 22 bp, Homo sapiens
aagttatctgatatctttgagg

SEQ ID NO: 8101177 - DNA, 22 bp, Homo sapiens
aagttattgcagcaatccaagt

SEQ ID NO: 8101178 - DNA, 22 bp, Homo sapiens
aataagaattgccagatttgaa

SEQ ID NO: 8101179 - DNA, 22 bp, Homo sapiens
aataagaatttacttgtcaaga

SEQ ID NO: 8101180 - DNA, 22 bp, Homo sapiens
aagtttctattattacattcgt

SEQ ID NO: 8101181 - DNA, 22 bp, Homo sapiens
aagtttcatttctggatgctga

SEQ ID NO: 8101182 - DNA, 22 bp, Homo sapiens
aagtttcaaatataaaattaca

SEQ ID NO: 8101183 - DNA, 22 bp, Homo sapiens
aagtttcaaatataaaattaca

SEQ ID NO: 8101184 - DNA, 22 bp, Homo sapiens
aagtttatgttggtaagatatc

SEQ ID NO: 8101185 - DNA, 22 bp, Homo sapiens
aagtttatccctctcacagtta

SEQ ID NO: 8101186 - DNA, 22 bp, Homo sapiens
aagttctagaggttgatttggt

SEQ ID NO: 8101187 - DNA, 22 bp, Homo sapiens
aataattacccatctttttgta

SEQ ID NO: 8101188 - DNA, 22 bp, Homo sapiens
aataattttagctcagagttgt

SEQ ID NO: 8101189 - DNA, 22 bp, Homo sapiens
aatacaagatttatagttgttt

SEQ ID NO: 8101190 - DNA, 22 bp, Homo sapiens
aataattttgagagcctggaaa

SEQ ID NO: 8101191 - DNA, 23 bp, Homo sapiens
actgcctgtgccgatctctctca

SEQ ID NO: 8101192 - DNA, 22 bp, Homo sapiens
actgcctgtttggcatggcccc

SEQ ID NO: 8101193 - DNA, 22 bp, Homo sapiens
actgcctgtgtcccttcagtgc

SEQ ID NO: 8101194 - DNA, 22 bp, Homo sapiens
actgcctgtttggcatggcccc

SEQ ID NO: 8101195 - DNA, 22 bp, Homo sapiens
aataagatgtgcttgagtttgg

SEQ ID NO: 8101196 - DNA, 22 bp, Homo sapiens
aaggtctggatgatgggtgtgc

SEQ ID NO: 8101197 - DNA, 22 bp, Homo sapiens
aacagcagggaaattccaagtc

SEQ ID NO: 8101198 - DNA, 22 bp, Homo sapiens
aagtccagctctaaatatctga

SEQ ID NO: 8101199 - DNA, 22 bp, Homo sapiens
aacaggaatgaggagaaaaggt

SEQ ID NO: 8101200 - DNA, 22 bp, Homo sapiens
aagtcattcctgcttgttgccc

SEQ ID NO: 8101201 - DNA, 22 bp, Homo sapiens
aagtcattctatttctctatgt

SEQ ID NO: 8101202 - DNA, 22 bp, Homo sapiens
aagtcattcctgcttgttgccc

SEQ ID NO: 8101203 - DNA, 22 bp, Homo sapiens
aagtcattatctcttctaatct

SEQ ID NO: 8101204 - DNA, 22 bp, Homo sapiens
aacacatagacgtttgatatca

SEQ ID NO: 8101205 - DNA, 22 bp, Homo sapiens
aacaaagtttcaggaagataga

SEQ ID NO: 8101206 - DNA, 22 bp, Homo sapiens
aacaaatgacctgatttcttcc

SEQ ID NO: 8101207 - DNA, 22 bp, Homo sapiens
aacaaatcttaaagtaattcaa

SEQ ID NO: 8101208 - DNA, 22 bp, Homo sapiens
aacaaatggaacacaaatcttt

SEQ ID NO: 8101209 - DNA, 22 bp, Homo sapiens
aacaaatgataccagttctcaa

SEQ ID NO: 8101210 - DNA, 22 bp, Homo sapiens
aaattcctgtcatttgcacttt

SEQ ID NO: 8101211 - DNA, 22 bp, Homo sapiens
aaattctaaggtcacaatgttg

SEQ ID NO: 8101212 - DNA, 22 bp, Homo sapiens
aaatgttcatttctcactcaca

SEQ ID NO: 8101213 - DNA, 22 bp, Homo sapiens
aaatgtgtatatgaaacatgat

SEQ ID NO: 8101214 - DNA, 22 bp, Homo sapiens
aaatgtgtgcacaaagacagct

SEQ ID NO: 8101215 - DNA, 22 bp, Homo sapiens
aacaaacattacctggtgctgg

SEQ ID NO: 8101216 - DNA, 22 bp, Homo sapiens
aaattctaaggtcacaatgttg

SEQ ID NO: 8101217 - DNA, 22 bp, Homo sapiens
aaattctatgtcaatgtttatt

SEQ ID NO: 8101218 - DNA, 22 bp, Homo sapiens
aaattctctaaagaaaacatga

SEQ ID NO: 8101219 - DNA, 22 bp, Homo sapiens
aaattgagacttttttcctcca

SEQ ID NO: 8101220 - DNA, 22 bp, Homo sapiens
aaattgcacaatatagacatga

SEQ ID NO: 8101221 - DNA, 22 bp, Homo sapiens
aaattctttcatggctaataag

SEQ ID NO: 8101222 - DNA, 22 bp, Homo sapiens
aacaggcaacagttgactctga

SEQ ID NO: 8101223 - DNA, 20 bp, Homo sapiens
aacagggggctgcagagggc

SEQ ID NO: 8101224 - DNA, 22 bp, Homo sapiens
aacaggggattagatagcaggc

SEQ ID NO: 8101225 - DNA, 18 bp, Homo sapiens
aacatgcattagaactgc

SEQ ID NO: 8101226 - DNA, 22 bp, Homo sapiens
aacatgcttgcttagaatcagc

SEQ ID NO: 8101227 - DNA, 22 bp, Homo sapiens
aacatgctctggattgctgtga

SEQ ID NO: 8101228 - DNA, 22 bp, Homo sapiens
aataagaactccatttactcgt

SEQ ID NO: 8101229 - DNA, 22 bp, Homo sapiens
aataagaacaactaaggtttat

SEQ ID NO: 8101230 - DNA, 22 bp, Homo sapiens
aataagaaagagtcagcttcag

SEQ ID NO: 8101231 - DNA, 22 bp, Homo sapiens
aatataaattcctgggcccagc

SEQ ID NO: 8101232 - DNA, 22 bp, Homo sapiens
aaccaacataggaatgcagaga

SEQ ID NO: 8101233 - DNA, 22 bp, Homo sapiens
aactggttctggaggctgcagg

SEQ ID NO: 8101234 - DNA, 22 bp, Homo sapiens
aactgttcacactgatgtgacg

SEQ ID NO: 8101235 - DNA, 22 bp, Homo sapiens
aactgttccttaagatgttaat

SEQ ID NO: 8101236 - DNA, 22 bp, Homo sapiens
aactgttcttgtgtttgctatg

SEQ ID NO: 8101237 - DNA, 22 bp, Homo sapiens
aacttacaatgttagagtctca

SEQ ID NO: 8101238 - DNA, 22 bp, Homo sapiens
aactggttatgttacctatgtc

SEQ ID NO: 8101239 - DNA, 22 bp, Homo sapiens
aatgatatagcagacatagcct

SEQ ID NO: 8101240 - DNA, 22 bp, Homo sapiens
aatataatgctgttttatgcca

SEQ ID NO: 8101241 - DNA, 22 bp, Homo sapiens
aatataatgctgttttatgcca

SEQ ID NO: 8101242 - DNA, 22 bp, Homo sapiens
aacgtcattgattgatggtagt

SEQ ID NO: 8101243 - DNA, 22 bp, Homo sapiens
aactacagaaaaggtaagctct

SEQ ID NO: 8101244 - DNA, 22 bp, Homo sapiens
aatcataattttgtgaatgtag

SEQ ID NO: 8101245 - DNA, 22 bp, Homo sapiens
aactacattttacagaagatga

SEQ ID NO: 8101246 - DNA, 22 bp, Homo sapiens
aagcacaggggaaataagttgt

SEQ ID NO: 8101247 - DNA, 21 bp, Homo sapiens
acactgcaggtgaagtgcact

SEQ ID NO: 8101248 - DNA, 22 bp, Homo sapiens
acactgcatttcaacaaggccc

SEQ ID NO: 8101249 - DNA, 22 bp, Homo sapiens
aagatttactagcataatagct

SEQ ID NO: 8101250 - DNA, 20 bp, Homo sapiens
aagattctgatttgtagcgt

SEQ ID NO: 8101251 - DNA, 22 bp, Homo sapiens
aagattctgtatttctaacaat

SEQ ID NO: 8101252 - DNA, 22 bp, Homo sapiens
aagatttaccactttattcaag

SEQ ID NO: 8101253 - DNA, 22 bp, Homo sapiens
aagattctttgaggattttact

SEQ ID NO: 8101254 - DNA, 22 bp, Homo sapiens
acacagtagtgtggaaaaacat

SEQ ID NO: 8101255 - DNA, 22 bp, Homo sapiens
acacagggggcattctaggagt

SEQ ID NO: 8101256 - DNA, 17 bp, Homo sapiens
acagaggttatacagac

SEQ ID NO: 8101257 - DNA, 22 bp, Homo sapiens
acagaattgatggaaatctcag

SEQ ID NO: 8101258 - DNA, 22 bp, Homo sapiens
acagaattgaagctgagtaaat

SEQ ID NO: 8101259 - DNA, 22 bp, Homo sapiens
acagaattatcaggaaatgtta

SEQ ID NO: 8101260 - DNA, 22 bp, Homo sapiens
acagaatttacacatctctaaa

SEQ ID NO: 8101261 - DNA, 22 bp, Homo sapiens
aagcagcatcctgggcagacct

SEQ ID NO: 8101262 - DNA, 22 bp, Homo sapiens
aagcagcatgctatgctggtgg

SEQ ID NO: 8101263 - DNA, 22 bp, Homo sapiens
aagccaggaccaaactcatcct

SEQ ID NO: 8101264 - DNA, 22 bp, Homo sapiens
acagcagcttcctgactgtact

SEQ ID NO: 8101265 - DNA, 22 bp, Homo sapiens
acagcagctgccttcaggctct

SEQ ID NO: 8101266 - DNA, 22 bp, Homo sapiens
aagcatgtcccttgtgattcaa

SEQ ID NO: 8101267 - DNA, 22 bp, Homo sapiens
aagaaatattgggccttataaa

SEQ ID NO: 8101268 - DNA, 22 bp, Homo sapiens
aagaaagcattagacaggcatt

SEQ ID NO: 8101269 - DNA, 22 bp, Homo sapiens
aatgttttagattactgctggg

SEQ ID NO: 8101270 - DNA, 18 bp, Homo sapiens
aagaagttggccaaagag

SEQ ID NO: 8101271 - DNA, 22 bp, Homo sapiens
acaaggctgttggtcacaaacc

SEQ ID NO: 8101272 - DNA, 22 bp, Homo sapiens
acaaggatttgttcctaatgtt

SEQ ID NO: 8101273 - DNA, 22 bp, Homo sapiens
acaaggctggctgggaaaaact

SEQ ID NO: 8101274 - DNA, 22 bp, Homo sapiens
aagagctggaagtgaagataac

SEQ ID NO: 8101275 - DNA, 22 bp, Homo sapiens
aagagctggagtttgcagccct

SEQ ID NO: 8101276 - DNA, 22 bp, Homo sapiens
aagagctggatgaagaaatcaa

SEQ ID NO: 8101277 - DNA, 22 bp, Homo sapiens
acaaagatcttgctttcctact

SEQ ID NO: 8101278 - DNA, 22 bp, Homo sapiens
acaaagatcttgctttcctact

SEQ ID NO: 8101279 - DNA, 22 bp, Homo sapiens
acaaagattcatttgcattatt

SEQ ID NO: 8101280 - DNA, 22 bp, Homo sapiens
aagagagaacacagcttgggca

SEQ ID NO: 8101281 - DNA, 22 bp, Homo sapiens
aagacatgcaattagcaaggaa

SEQ ID NO: 8101282 - DNA, 22 bp, Homo sapiens
acaaggacataggaaactacaa

SEQ ID NO: 8101283 - DNA, 18 bp, Homo sapiens
acaaggacgcgctgtgtg

SEQ ID NO: 8101284 - DNA, 22 bp, Homo sapiens
acaaggaccatgaggcagaccc

SEQ ID NO: 8101285 - DNA, 22 bp, Homo sapiens
aagagatgtggaatcatttaca

SEQ ID NO: 8101286 - DNA, 22 bp, Homo sapiens
aagagagtcagtctgagcacca

SEQ ID NO: 8101287 - DNA, 22 bp, Homo sapiens
aaatgcagacagcttcacacac

SEQ ID NO: 8101288 - DNA, 22 bp, Homo sapiens
aaatgcagaatgatttcatcta

SEQ ID NO: 8101289 - DNA, 22 bp, Homo sapiens
aaatgcagacagcttcacacac

SEQ ID NO: 8101290 - DNA, 22 bp, Homo sapiens
aaatgcagcagctaattgaaaa

SEQ ID NO: 8101291 - DNA, 22 bp, Homo sapiens
aaattgtgagactgaaccaaat

SEQ ID NO: 8101292 - DNA, 22 bp, Homo sapiens
aaactcttcctttctttaaagt

SEQ ID NO: 8101293 - DNA, 22 bp, Homo sapiens
aaactgaaacatcatcatgttg

SEQ ID NO: 8101294 - DNA, 17 bp, Homo sapiens
aaactgaaaaattcact

SEQ ID NO: 8101295 - DNA, 22 bp, Homo sapiens
aaactcttttgcatattagagg

SEQ ID NO: 8101296 - DNA, 21 bp, Homo sapiens
aaactgaccttgcctgagaca

SEQ ID NO: 8101297 - DNA, 22 bp, Homo sapiens
aaactgaattcccaagggcatg

SEQ ID NO: 8101298 - DNA, 22 bp, Homo sapiens
aaactgaagtagattctgaaat

SEQ ID NO: 8101299 - DNA, 22 bp, Homo sapiens
aaactgaggagttagactaggg

SEQ ID NO: 8101300 - DNA, 22 bp, Homo sapiens
aaactgaggaatgacagcatta

SEQ ID NO: 8101301 - DNA, 22 bp, Homo sapiens
aaactgaggaacaaggaaggat

SEQ ID NO: 8101302 - DNA, 22 bp, Homo sapiens
aaactgagaccgaaaggggtag

SEQ ID NO: 8101303 - DNA, 22 bp, Homo sapiens
aaactgaggcaggggatgatta

SEQ ID NO: 8101304 - DNA, 22 bp, Homo sapiens
aaagaatactccttttgccttg

SEQ ID NO: 8101305 - DNA, 22 bp, Homo sapiens
aaagaagtgttgaatttgcaag

SEQ ID NO: 8101306 - DNA, 23 bp, Homo sapiens
aaactgaggcttgatgaggcggt

SEQ ID NO: 8101307 - DNA, 22 bp, Homo sapiens
aaagaactaatgtgcaaggttt

SEQ ID NO: 8101308 - DNA, 18 bp, Homo sapiens
aaacagtgcctaagtgtc

SEQ ID NO: 8101309 - DNA, 22 bp, Homo sapiens
aaacaatgtacatttataatgc

SEQ ID NO: 8101310 - DNA, 22 bp, Homo sapiens
aaacaatgaaatatttttatgg

SEQ ID NO: 8101311 - DNA, 22 bp, Homo sapiens
aaacagtgactggtacataata

SEQ ID NO: 8101312 - DNA, 21 bp, Homo sapiens
aaagttcatgctttaatattc

SEQ ID NO: 8101313 - DNA, 22 bp, Homo sapiens
aaagttcagattagactcaaga

SEQ ID NO: 8101314 - DNA, 22 bp, Homo sapiens
aaagttcatggtgttatagaaa

SEQ ID NO: 8101315 - DNA, 22 bp, Homo sapiens
aaagttcactgaccagcactgg

SEQ ID NO: 8101316 - DNA, 22 bp, Homo sapiens
aaagttcagtgccttctataca

SEQ ID NO: 8101317 - DNA, 19 bp, Homo sapiens
aaacctgttagtagagcac

SEQ ID NO: 8101318 - DNA, 22 bp, Homo sapiens
aaacctgttaatagagcgatgc

SEQ ID NO: 8101319 - DNA, 22 bp, Homo sapiens
aaacctatatagtcttagaagc

SEQ ID NO: 8101320 - DNA, 22 bp, Homo sapiens
aaaagtactattttaacaaagt

SEQ ID NO: 8101321 - DNA, 22 bp, Homo sapiens
aaaagtatagggtttggagtca

SEQ ID NO: 8101322 - DNA, 22 bp, Homo sapiens
aaaagtattggccaccatttct

SEQ ID NO: 8101323 - DNA, 22 bp, Homo sapiens
aaagacatggaactagagatgg

SEQ ID NO: 8101324 - DNA, 22 bp, Homo sapiens
aaaagtatttatggctatgtaa

SEQ ID NO: 8101325 - DNA, 22 bp, Homo sapiens
aaaagagaatcctgtacagaga

SEQ ID NO: 8101326 - DNA, 22 bp, Homo sapiens
aaactcaagtttcttaatgtca

SEQ ID NO: 8101327 - DNA, 19 bp, Homo sapiens
aaactcatagactcatatt

SEQ ID NO: 8101328 - DNA, 22 bp, Homo sapiens
aaactcaaagtcagatcagaga

SEQ ID NO: 8101329 - DNA, 22 bp, Homo sapiens
aaactagccacacagaatacac

SEQ ID NO: 8101330 - DNA, 22 bp, Homo sapiens
aaactcaagtctatgaacaagg

SEQ ID NO: 8101331 - DNA, 22 bp, Homo sapiens
aaactcaagtctatgaacaagg

SEQ ID NO: 8101332 - DNA, 22 bp, Homo sapiens
aaactcaaggatttagacgaag

SEQ ID NO: 8101333 - DNA, 22 bp, Homo sapiens
aaactcaaattaaactagctta

SEQ ID NO: 8101334 - DNA, 22 bp, Homo sapiens
aaacaagtcactttatcttgaa

SEQ ID NO: 8101335 - DNA, 20 bp, Homo sapiens
aaaatctcccagaaacttat

SEQ ID NO: 8101336 - DNA, 22 bp, Homo sapiens
aaaatctcattatcaggaaggg

SEQ ID NO: 8101337 - DNA, 22 bp, Homo sapiens
aaaatctaagtagcgagtaagg

SEQ ID NO: 8101338 - DNA, 22 bp, Homo sapiens
aaacaagctgcagacaagccat

SEQ ID NO: 8101339 - DNA, 22 bp, Homo sapiens
aaaatctgcttccttttacaga

SEQ ID NO: 8101340 - DNA, 22 bp, Homo sapiens
aaaatcacacaagtagatgggg

SEQ ID NO: 8101341 - DNA, 22 bp, Homo sapiens
aaaatcctctaattctagaata

SEQ ID NO: 8101342 - DNA, 22 bp, Homo sapiens
aaaatcctctaattctagaata

SEQ ID NO: 8101343 - DNA, 22 bp, Homo sapiens
aaagacctgaaatataatctag

SEQ ID NO: 8101344 - DNA, 22 bp, Homo sapiens
aaagacctgtggtagctctaaa

SEQ ID NO: 8101345 - DNA, 22 bp, Homo sapiens
aaagacattagattaacgtaca

SEQ ID NO: 8101346 - DNA, 22 bp, Homo sapiens
aaaaatagcttctcttgtccct

SEQ ID NO: 8101347 - DNA, 22 bp, Homo sapiens
aaaaatctatgactgcttctcc

SEQ ID NO: 8101348 - DNA, 22 bp, Homo sapiens
aaaaatcacttttataggcagc

SEQ ID NO: 8101349 - DNA, 22 bp, Homo sapiens
aaaaatcacttttataggcagc

SEQ ID NO: 8101350 - DNA, 22 bp, Homo sapiens
aaacactttaagtgaggaggat

SEQ ID NO: 8101351 - DNA, 22 bp, Homo sapiens
aaacacttcttaggtcttaagt

SEQ ID NO: 8101352 - DNA, 22 bp, Homo sapiens
aaacacttcaaggacttctgtc

SEQ ID NO: 8101353 - DNA, 20 bp, Homo sapiens
aaaaacagtaatgctgaaga

SEQ ID NO: 8101354 - DNA, 22 bp, Homo sapiens
aaaaaattccattctgtgcctt

SEQ ID NO: 8101355 - DNA, 22 bp, Homo sapiens
aaaaaattatcatagttcctga

SEQ ID NO: 8101356 - DNA, 23 bp, Homo sapiens
aaaatcttctgcctatgaagaaa

SEQ ID NO: 8101357 - DNA, 23 bp, Homo sapiens
aaaatcttctgcctatgaagaaa

SEQ ID NO: 8101358 - DNA, 22 bp, Homo sapiens
aaaaacctttcccatactaaga

SEQ ID NO: 8101359 - DNA, 22 bp, Homo sapiens
aaaaacctttcattgcaaatgt

SEQ ID NO: 8101360 - DNA, 22 bp, Homo sapiens
aaaaacctcaattacttttgca

SEQ ID NO: 8101361 - DNA, 23 bp, Homo sapiens
aaatgcacagtattgatttttaa

SEQ ID NO: 8101362 - DNA, 22 bp, Homo sapiens
aaatgcagtggttctacttctc

SEQ ID NO: 8101363 - DNA, 22 bp, Homo sapiens
aaatgcaggtagtatttatttt

SEQ ID NO: 8101364 - DNA, 23 bp, Homo sapiens
aaatgcagggtcgcaggttacag

SEQ ID NO: 8101365 - DNA, 22 bp, Homo sapiens
aaatcgcttgaacccaggaagt

SEQ ID NO: 8101366 - DNA, 22 bp, Homo sapiens
aaatcctaataatgcactagtg

SEQ ID NO: 8101367 - DNA, 22 bp, Homo sapiens
aagcacagagaggtaaagtaac

SEQ ID NO: 8101368 - DNA, 22 bp, Homo sapiens
aagcacagaccagatctccagg

SEQ ID NO: 8101369 - DNA, 22 bp, Homo sapiens
aagcacagacacaaaaggcttt

SEQ ID NO: 8101370 - DNA, 22 bp, Homo sapiens
aaatgtattgcataggatattt

SEQ ID NO: 8101371 - DNA, 22 bp, Homo sapiens
aaatgtactgatacttatttta

SEQ ID NO: 8101372 - DNA, 22 bp, Homo sapiens
aaatgtaagtctttgtttctta

SEQ ID NO: 8101373 - DNA, 22 bp, Homo sapiens
aagcatgcaatctgtgataagg

SEQ ID NO: 8101374 - DNA, 22 bp, Homo sapiens
aaataagaaattcttctttgca

SEQ ID NO: 8101375 - DNA, 22 bp, Homo sapiens
aaataagaggacagatgtttgg

SEQ ID NO: 8101376 - DNA, 22 bp, Homo sapiens
aaatcagatcttacacaattgt

SEQ ID NO: 8101377 - DNA, 22 bp, Homo sapiens
aaatcagagtggttggtcatcc

SEQ ID NO: 8101378 - DNA, 22 bp, Homo sapiens
aaatagatttaacatccatccc

SEQ ID NO: 8101379 - DNA, 22 bp, Homo sapiens
aaagcgtaagttatattctgta

SEQ ID NO: 8101380 - DNA, 22 bp, Homo sapiens
aaagccttttctgtttaacaca

SEQ ID NO: 8101381 - DNA, 22 bp, Homo sapiens
aacagatataggcagaactttg

SEQ ID NO: 8101382 - DNA, 22 bp, Homo sapiens
aaagatatgtctccaaagagat

SEQ ID NO: 8101383 - DNA, 20 bp, Homo sapiens
aaagatactttttgtaatgg

SEQ ID NO: 8101384 - DNA, 22 bp, Homo sapiens
aaattttcagagcactagagaa

SEQ ID NO: 8101385 - DNA, 22 bp, Homo sapiens
aaattttcctggtaaagatgga

SEQ ID NO: 8101386 - DNA, 22 bp, Homo sapiens
aacaaacaaacattttgtcatc

SEQ ID NO: 8101387 - DNA, 22 bp, Homo sapiens
aactaaagtaaccaaggatatc

SEQ ID NO: 8101388 - DNA, 22 bp, Homo sapiens
aactaaaactggtttgttctct

SEQ ID NO: 8101389 - DNA, 22 bp, Homo sapiens
aactaaaactggtttgttctct

SEQ ID NO: 8101390 - DNA, 22 bp, Homo sapiens
aactaaaagtgtgtctcttgta

SEQ ID NO: 8101391 - DNA, 22 bp, Homo sapiens
aactaacagtcattaaaagaac

SEQ ID NO: 8101392 - DNA, 22 bp, Homo sapiens
aaaggaagatctatacacccca

SEQ ID NO: 8101393 - DNA, 22 bp, Homo sapiens
aaaggaagatgccaggactctg

SEQ ID NO: 8101394 - DNA, 22 bp, Homo sapiens
aaagtatatttacttactgtga

SEQ ID NO: 8101395 - DNA, 22 bp, Homo sapiens
aaagtatctgaccgattataaa

SEQ ID NO: 8101396 - DNA, 22 bp, Homo sapiens
aaagtatttgtgatttttacca

SEQ ID NO: 8101397 - DNA, 22 bp, Homo sapiens
aaagtattcaaaaatatttggt

SEQ ID NO: 8101398 - DNA, 18 bp, Homo sapiens
ggcctctggactggcagc

SEQ ID NO: 8101399 - DNA, 22 bp, Homo sapiens
ggcctctggcaggcaggccctc

SEQ ID NO: 8101400 - DNA, 22 bp, Homo sapiens
ggcctctggttcacagggagga

SEQ ID NO: 8101401 - DNA, 22 bp, Homo sapiens
ggcctctggggtcctgagccca

SEQ ID NO: 8101402 - DNA, 22 bp, Homo sapiens
ggctcactgcaaactgtgcctc

SEQ ID NO: 8101403 - DNA, 22 bp, Homo sapiens
ggctagggactcctcctcaggg

SEQ ID NO: 8101404 - DNA, 22 bp, Homo sapiens
ggctagggaaaatgattggata

SEQ ID NO: 8101405 - DNA, 22 bp, Homo sapiens
ggcctctctggcatggctgccc

SEQ ID NO: 8101406 - DNA, 22 bp, Homo sapiens
ggcctctgcctcatctgggcac

SEQ ID NO: 8101407 - DNA, 22 bp, Homo sapiens
ggcctctgcaggcctcgacaag

SEQ ID NO: 8101408 - DNA, 22 bp, Homo sapiens
ggcctctgcaactggctgtggc

SEQ ID NO: 8101409 - DNA, 19 bp, Homo sapiens
ggcctctgcaggccgcccc

SEQ ID NO: 8101410 - DNA, 22 bp, Homo sapiens
ggctcactgcaacttccgcctc

SEQ ID NO: 8101411 - DNA, 22 bp, Homo sapiens
ggctctgaaggagacagctgct

SEQ ID NO: 8101412 - DNA, 17 bp, Homo sapiens
ggctctcttccagactt

SEQ ID NO: 8101413 - DNA, 22 bp, Homo sapiens
ggctcagcacagggctggcatc

SEQ ID NO: 8101414 - DNA, 22 bp, Homo sapiens
ggctctgaagggtgacaggttt

SEQ ID NO: 8101415 - DNA, 22 bp, Homo sapiens
ggctctgacctcccaggcagtt

SEQ ID NO: 8101416 - DNA, 22 bp, Homo sapiens
ggctctgcatgtgagtgggtgg

SEQ ID NO: 8101417 - DNA, 22 bp, Homo sapiens
ggctctgccacttcttggctgt

SEQ ID NO: 8101418 - DNA, 22 bp, Homo sapiens
ggcccaggtccagcgagtacct

SEQ ID NO: 8101419 - DNA, 22 bp, Homo sapiens
ggcccatgcatcctgtgcagcc

SEQ ID NO: 8101420 - DNA, 22 bp, Homo sapiens
ggcccaggatgcaagaactgaa

SEQ ID NO: 8101421 - DNA, 22 bp, Homo sapiens
ggccagcccagtggtcctctct

SEQ ID NO: 8101422 - DNA, 19 bp, Homo sapiens
ggccagccacctcgcctgg

SEQ ID NO: 8101423 - DNA, 22 bp, Homo sapiens
ggccagcagtcacagggtcaga

SEQ ID NO: 8101424 - DNA, 22 bp, Homo sapiens
ggccacctctgccctaccgagt

SEQ ID NO: 8101425 - DNA, 22 bp, Homo sapiens
ggccacagcaatgctgtgatgt

SEQ ID NO: 8101426 - DNA, 22 bp, Homo sapiens
ggccacagcaatgctgtgatgt

SEQ ID NO: 8101427 - DNA, 22 bp, Homo sapiens
ggcagtgggtggatctcaggga

SEQ ID NO: 8101428 - DNA, 22 bp, Homo sapiens
ggcaggggtcctggtgttgact

SEQ ID NO: 8101429 - DNA, 18 bp, Homo sapiens
ggcagtgcagtctcaggg

SEQ ID NO: 8101430 - DNA, 22 bp, Homo sapiens
ggcagtgccactaagctctgct

SEQ ID NO: 8101431 - DNA, 19 bp, Homo sapiens
ggcagtgagaagactcctg

SEQ ID NO: 8101432 - DNA, 22 bp, Homo sapiens
ggcaggctgttcacctgctttt

SEQ ID NO: 8101433 - DNA, 20 bp, Homo sapiens
ggcaggctttatatggaggg

SEQ ID NO: 8101434 - DNA, 22 bp, Homo sapiens
ggcagcccaccagcccacgtct

SEQ ID NO: 8101435 - DNA, 22 bp, Homo sapiens
ggcagccctttctggccagctc

SEQ ID NO: 8101436 - DNA, 22 bp, Homo sapiens
ggaggatgagctacgaggagct

SEQ ID NO: 8101437 - DNA, 22 bp, Homo sapiens
ggaggatgccaagctgtgcaca

SEQ ID NO: 8101438 - DNA, 22 bp, Homo sapiens
ggaggaggggtttacattggaa

SEQ ID NO: 8101439 - DNA, 22 bp, Homo sapiens
ggaggagtcagttgggctgctt

SEQ ID NO: 8101440 - DNA, 22 bp, Homo sapiens
ggcagcagaactggccctgtat

SEQ ID NO: 8101441 - DNA, 22 bp, Homo sapiens
ggcagcactgcagcttgttggg

SEQ ID NO: 8101442 - DNA, 22 bp, Homo sapiens
ggcagaggtgaagttcacaagg

SEQ ID NO: 8101443 - DNA, 22 bp, Homo sapiens
ggcagaggtgacagtgtctttt

SEQ ID NO: 8101444 - DNA, 22 bp, Homo sapiens
ggcagatggaatgagctgtcta

SEQ ID NO: 8101445 - DNA, 22 bp, Homo sapiens
gggcagaggctctggcccatcc

SEQ ID NO: 8101446 - DNA, 21 bp, Homo sapiens
gggcagaggggcctcctgggt

SEQ ID NO: 8101447 - DNA, 20 bp, Homo sapiens
gggcagagccagccagtccc

SEQ ID NO: 8101448 - DNA, 22 bp, Homo sapiens
gggcagagactcagaaacagaa

SEQ ID NO: 8101449 - DNA, 22 bp, Homo sapiens
gggcagagagctggaactcctt

SEQ ID NO: 8101450 - DNA, 22 bp, Homo sapiens
gggcactggtgctgccatcttg

SEQ ID NO: 8101451 - DNA, 22 bp, Homo sapiens
gggagtggggcttaccttgaag

SEQ ID NO: 8101452 - DNA, 20 bp, Homo sapiens
gggagtggtggtagcctgtg

SEQ ID NO: 8101453 - DNA, 22 bp, Homo sapiens
gggagtggtcctttcctatctg

SEQ ID NO: 8101454 - DNA, 22 bp, Homo sapiens
gggataggagattgggagtgtt

SEQ ID NO: 8101455 - DNA, 22 bp, Homo sapiens
gggagctctccctgaggcctgg

SEQ ID NO: 8101456 - DNA, 22 bp, Homo sapiens
gggagctgaactgctgaagttg

SEQ ID NO: 8101457 - DNA, 22 bp, Homo sapiens
gggagctgaaggagccggcggg

SEQ ID NO: 8101458 - DNA, 22 bp, Homo sapiens
gggccctgtgatttcttgagga

SEQ ID NO: 8101459 - DNA, 22 bp, Homo sapiens
gggccctgtgatttcttgagga

SEQ ID NO: 8101460 - DNA, 22 bp, Homo sapiens
gggctcagacatccctcctgga

SEQ ID NO: 8101461 - DNA, 18 bp, Homo sapiens
gggctcacacaggtcatc

SEQ ID NO: 8101462 - DNA, 22 bp, Homo sapiens
gggcctcactatgtggtccagg

SEQ ID NO: 8101463 - DNA, 22 bp, Homo sapiens
gggcctcaaatctcccgcttat

SEQ ID NO: 8101464 - DNA, 19 bp, Homo sapiens
gggcctcacccacacctcc

SEQ ID NO: 8101465 - DNA, 22 bp, Homo sapiens
gggcctcacctctccaccgcct

SEQ ID NO: 8101466 - DNA, 22 bp, Homo sapiens
gggccctgccccgtggctctga

SEQ ID NO: 8101467 - DNA, 22 bp, Homo sapiens
gggccctgcctaaggaacacac

SEQ ID NO: 8101468 - DNA, 22 bp, Homo sapiens
gggccctgcctaaggaacacac

SEQ ID NO: 8101469 - DNA, 22 bp, Homo sapiens
gggccctgcgactcgcggcgga

SEQ ID NO: 8101470 - DNA, 22 bp, Homo sapiens
gggccctggggatgtggacgcg

SEQ ID NO: 8101471 - DNA, 22 bp, Homo sapiens
gggccctggggcctgatttgca

SEQ ID NO: 8101472 - DNA, 22 bp, Homo sapiens
gggccctggggatgtggacgcg

SEQ ID NO: 8101473 - DNA, 22 bp, Homo sapiens
gggccctgatctgtgagcgcag

SEQ ID NO: 8101474 - DNA, 22 bp, Homo sapiens
gggccctgatctgtgagcgcag

SEQ ID NO: 8101475 - DNA, 22 bp, Homo sapiens
gggccctgccccgtggctctga

SEQ ID NO: 8101476 - DNA, 22 bp, Homo sapiens
gggccccttgtatctctggctc

SEQ ID NO: 8101477 - DNA, 22 bp, Homo sapiens
gggctcagagcatttgggttgg

SEQ ID NO: 8101478 - DNA, 23 bp, Homo sapiens
gggctcagatttcattctgtgcc

SEQ ID NO: 8101479 - DNA, 22 bp, Homo sapiens
gggctcagttctgcttcatgct

SEQ ID NO: 8101480 - DNA, 22 bp, Homo sapiens
gggctcagctgggcgtgctggt

SEQ ID NO: 8101481 - DNA, 22 bp, Homo sapiens
gggctcattcatctgggcttgg

SEQ ID NO: 8101482 - DNA, 22 bp, Homo sapiens
gggctctggaaatgggagctcc

SEQ ID NO: 8101483 - DNA, 22 bp, Homo sapiens
ggctgtggccagcggggctgag

SEQ ID NO: 8101484 - DNA, 22 bp, Homo sapiens
ggctgtgggatgcataggagct

SEQ ID NO: 8101485 - DNA, 22 bp, Homo sapiens
ggctgtggggaccaacaggact

SEQ ID NO: 8101486 - DNA, 22 bp, Homo sapiens
ggctgtggggccgggtacagtg

SEQ ID NO: 8101487 - DNA, 22 bp, Homo sapiens
ggctgtggtcattaggaggttg

SEQ ID NO: 8101488 - DNA, 22 bp, Homo sapiens
ggctgtggtcattaggaggttg

SEQ ID NO: 8101489 - DNA, 22 bp, Homo sapiens
ggctgtggtctcatctagcctt

SEQ ID NO: 8101490 - DNA, 22 bp, Homo sapiens
gggaagagggagctggaatgat

SEQ ID NO: 8101491 - DNA, 22 bp, Homo sapiens
gggaagagggagctggaatgat

SEQ ID NO: 8101492 - DNA, 22 bp, Homo sapiens
ggctgtggcattaggtgaggcc

SEQ ID NO: 8101493 - DNA, 22 bp, Homo sapiens
ggctgtggcagctggaagtggt

SEQ ID NO: 8101494 - DNA, 18 bp, Homo sapiens
ggctgtgcgtggaggctg

SEQ ID NO: 8101495 - DNA, 18 bp, Homo sapiens
ggctgtgcgtggaggctg

SEQ ID NO: 8101496 - DNA, 22 bp, Homo sapiens
ggctgtggacactgagctcaga

SEQ ID NO: 8101497 - DNA, 22 bp, Homo sapiens
ggctgtgcttggtgtccttgga

SEQ ID NO: 8101498 - DNA, 22 bp, Homo sapiens
gggaaggcatacctgagggaga

SEQ ID NO: 8101499 - DNA, 22 bp, Homo sapiens
gggaaggcaggattctctggtg

SEQ ID NO: 8101500 - DNA, 22 bp, Homo sapiens
gggaaggcagtgggaggaactg

SEQ ID NO: 8101501 - DNA, 22 bp, Homo sapiens
gggaaggcaggcctctgttgga

SEQ ID NO: 8101502 - DNA, 22 bp, Homo sapiens
gggaaggcaccatggtgttcca

SEQ ID NO: 8101503 - DNA, 22 bp, Homo sapiens
gggaagccatgctcagaggtac

SEQ ID NO: 8101504 - DNA, 22 bp, Homo sapiens
gggaagagtgtcggttgaagtg

SEQ ID NO: 8101505 - DNA, 22 bp, Homo sapiens
gggaaggccggtccagtcaggt

SEQ ID NO: 8101506 - DNA, 22 bp, Homo sapiens
gggaaggccttgtcagcggatt

SEQ ID NO: 8101507 - DNA, 22 bp, Homo sapiens
gggagatggctcagaggccgcg

SEQ ID NO: 8101508 - DNA, 23 bp, Homo sapiens
gggagatgggaaatgaaggctct

SEQ ID NO: 8101509 - DNA, 22 bp, Homo sapiens
ggctggcagaggggagtctgtg

SEQ ID NO: 8101510 - DNA, 22 bp, Homo sapiens
ggctggcaggggatgtcagatg

SEQ ID NO: 8101511 - DNA, 22 bp, Homo sapiens
ggctggcagaagtgtgctggct

SEQ ID NO: 8101512 - DNA, 19 bp, Homo sapiens
ggctggagtggccatctgt

SEQ ID NO: 8101513 - DNA, 17 bp, Homo sapiens
ggctggaggggacccgg

SEQ ID NO: 8101514 - DNA, 17 bp, Homo sapiens
ggctggagcagctcccc

SEQ ID NO: 8101515 - DNA, 22 bp, Homo sapiens
ggctggagacaacgtcctgccc

SEQ ID NO: 8101516 - DNA, 22 bp, Homo sapiens
ggctgcaggcagggtatccact

SEQ ID NO: 8101517 - DNA, 22 bp, Homo sapiens
ggctgcaggcttccctccagca

SEQ ID NO: 8101518 - DNA, 21 bp, Homo sapiens
ggctgcagggagccctggggt

SEQ ID NO: 8101519 - DNA, 22 bp, Homo sapiens
ggctgcaggttggttggcagct

SEQ ID NO: 8101520 - DNA, 22 bp, Homo sapiens
ggctgcaggttggttggcagct

SEQ ID NO: 8101521 - DNA, 22 bp, Homo sapiens
ggctgcagttgtgtgaaggccg

SEQ ID NO: 8101522 - DNA, 22 bp, Homo sapiens
ggctgccaggagggaggccagt

SEQ ID NO: 8101523 - DNA, 22 bp, Homo sapiens
gtccaggctgacccctagagga

SEQ ID NO: 8101524 - DNA, 22 bp, Homo sapiens
gtccaggctaagtcccttctgc

SEQ ID NO: 8101525 - DNA, 22 bp, Homo sapiens
gtctaaacctcaaatcagtgtc

SEQ ID NO: 8101526 - DNA, 22 bp, Homo sapiens
gtctaaacacaatgcaagaagt

SEQ ID NO: 8101527 - DNA, 22 bp, Homo sapiens
gtcctgctggcttcaggagatt

SEQ ID NO: 8101528 - DNA, 22 bp, Homo sapiens
gtcagaaaccagtcaaacaaga

SEQ ID NO: 8101529 - DNA, 22 bp, Homo sapiens
gtcagaaaacttccctttgagt

SEQ ID NO: 8101530 - DNA, 22 bp, Homo sapiens
gtcactttggcctctacagcca

SEQ ID NO: 8101531 - DNA, 19 bp, Homo sapiens
gtcaccatttccaaatgcc

SEQ ID NO: 8101532 - DNA, 22 bp, Homo sapiens
gtcagagaactggattttccaa

SEQ ID NO: 8101533 - DNA, 22 bp, Homo sapiens
gtcagagacaaacttcctctct

SEQ ID NO: 8101534 - DNA, 22 bp, Homo sapiens
gtcagagatggcatgaaagatt

SEQ ID NO: 8101535 - DNA, 22 bp, Homo sapiens
gtcaaatatactaagaggtaaa

SEQ ID NO: 8101536 - DNA, 22 bp, Homo sapiens
gtcaaatattatgcagcttgga

SEQ ID NO: 8101537 - DNA, 22 bp, Homo sapiens
gtcaaatatatgcaaaactatt

SEQ ID NO: 8101538 - DNA, 22 bp, Homo sapiens
gtcaccatggataagaatcact

SEQ ID NO: 8101539 - DNA, 22 bp, Homo sapiens
gtcaccattgcccactccatgg

SEQ ID NO: 8101540 - DNA, 22 bp, Homo sapiens
gtcaaataattttctcaatagt

SEQ ID NO: 8101541 - DNA, 22 bp, Homo sapiens
gtcaaaacaaagttaagaattc

SEQ ID NO: 8101542 - DNA, 22 bp, Homo sapiens
gtcaaacagcctcctgttctaa

SEQ ID NO: 8101543 - DNA, 22 bp, Homo sapiens
gtcaaacagcctcctgttctaa

SEQ ID NO: 8101544 - DNA, 22 bp, Homo sapiens
gtatttttcagttaggagctta

SEQ ID NO: 8101545 - DNA, 22 bp, Homo sapiens
gtattttcaagagcagtagtat

SEQ ID NO: 8101546 - DNA, 22 bp, Homo sapiens
gtattttatggcctggggccta

SEQ ID NO: 8101547 - DNA, 22 bp, Homo sapiens
gtatttttaggtaaggaaagta

SEQ ID NO: 8101548 - DNA, 22 bp, Homo sapiens
gtattttatggcatgcagtggc

SEQ ID NO: 8101549 - DNA, 22 bp, Homo sapiens
gtatacatacttctagattaaa

SEQ ID NO: 8101550 - DNA, 22 bp, Homo sapiens
gtatacatagatgatgaacaag

SEQ ID NO: 8101551 - DNA, 22 bp, Homo sapiens
gtatacatagatgatgaacaag

SEQ ID NO: 8101552 - DNA, 22 bp, Homo sapiens
gtagttttctgaaaattacttt

SEQ ID NO: 8101553 - DNA, 22 bp, Homo sapiens
gtagttctgcagtgtcacctga

SEQ ID NO: 8101554 - DNA, 22 bp, Homo sapiens
gtagggttggagagcacaacca

SEQ ID NO: 8101555 - DNA, 22 bp, Homo sapiens
gtaggtgagtgatgctcagatt

SEQ ID NO: 8101556 - DNA, 22 bp, Homo sapiens
gtacaaaagttattgcggtttt

SEQ ID NO: 8101557 - DNA, 22 bp, Homo sapiens
gtacaaaagttattgcggtttt

SEQ ID NO: 8101558 - DNA, 22 bp, Homo sapiens
gtacaagtgtatttggcttgat

SEQ ID NO: 8101559 - DNA, 22 bp, Homo sapiens
gtacaagttgcctaccttaagt

SEQ ID NO: 8101560 - DNA, 22 bp, Homo sapiens
gtacaataactagtcttatagt

SEQ ID NO: 8101561 - DNA, 22 bp, Homo sapiens
gtctacaaagcatataaaagag

SEQ ID NO: 8101562 - DNA, 22 bp, Homo sapiens
gtctaaacttagggatcgaaca

SEQ ID NO: 8101563 - DNA, 22 bp, Homo sapiens
gtctaaactttacagagtcaag

SEQ ID NO: 8101564 - DNA, 22 bp, Homo sapiens
gtctttatggtatgaaaactga

SEQ ID NO: 8101565 - DNA, 22 bp, Homo sapiens
gtctttatatttactaaagaat

SEQ ID NO: 8101566 - DNA, 22 bp, Homo sapiens
gtcttgttaagattttggaata

SEQ ID NO: 8101567 - DNA, 21 bp, Homo sapiens
gtctttaaaaaaggctgatac

SEQ ID NO: 8101568 - DNA, 22 bp, Homo sapiens
gtcttttttacaccttacatca

SEQ ID NO: 8101569 - DNA, 22 bp, Homo sapiens
gtctttttattatagagtggag

SEQ ID NO: 8101570 - DNA, 22 bp, Homo sapiens
gtctttttgtctggcagaggtc

SEQ ID NO: 8101571 - DNA, 22 bp, Homo sapiens
gtctttttctacgatagcgcct

SEQ ID NO: 8101572 - DNA, 21 bp, Homo sapiens
gtctttttaattgcgatttcc

SEQ ID NO: 8101573 - DNA, 18 bp, Homo sapiens
gtcttttctcccttcctc

SEQ ID NO: 8101574 - DNA, 22 bp, Homo sapiens
gtctttgtggtagtcctcagcc

SEQ ID NO: 8101575 - DNA, 21 bp, Homo sapiens
gtctttctacctctatgtggc

SEQ ID NO: 8101576 - DNA, 20 bp, Homo sapiens
gtctttatgttttatgacct

SEQ ID NO: 8101577 - DNA, 22 bp, Homo sapiens
gtctttatttgagattgtcatt

SEQ ID NO: 8101578 - DNA, 22 bp, Homo sapiens
gtgaggagggctggtcccaggc

SEQ ID NO: 8101579 - DNA, 22 bp, Homo sapiens
gtgagcagtttgttccagaatc

SEQ ID NO: 8101580 - DNA, 22 bp, Homo sapiens
gtgcccagctccacctcacaga

SEQ ID NO: 8101581 - DNA, 22 bp, Homo sapiens
gtgcccaggcccaaggcaccac

SEQ ID NO: 8101582 - DNA, 22 bp, Homo sapiens
gtgctgagtgcagagtgcagag

SEQ ID NO: 8101583 - DNA, 22 bp, Homo sapiens
gtgctgcttgggggcagagcag

SEQ ID NO: 8101584 - DNA, 22 bp, Homo sapiens
gtgctgctgccagcaggatcct

SEQ ID NO: 8101585 - DNA, 22 bp, Homo sapiens
gtgctgctgaaaaacaaagtct

SEQ ID NO: 8101586 - DNA, 22 bp, Homo sapiens
gtgcagggtagcgacggcagga

SEQ ID NO: 8101587 - DNA, 20 bp, Homo sapiens
gtgcagcacttgggggtagg

SEQ ID NO: 8101588 - DNA, 22 bp, Homo sapiens
gtgcagcaaagtttgagatata

SEQ ID NO: 8101589 - DNA, 22 bp, Homo sapiens
gtgcagcaaagtttgagatata

SEQ ID NO: 8101590 - DNA, 22 bp, Homo sapiens
gtgcagcaaactagtgcgaggg

SEQ ID NO: 8101591 - DNA, 22 bp, Homo sapiens
ggtggggcccaggcatctgatg

SEQ ID NO: 8101592 - DNA, 22 bp, Homo sapiens
ggtggggccctggcactggtat

SEQ ID NO: 8101593 - DNA, 22 bp, Homo sapiens
ggtggggccagggctccaacct

SEQ ID NO: 8101594 - DNA, 22 bp, Homo sapiens
ggtggggcctgctccagcggcc

SEQ ID NO: 8101595 - DNA, 22 bp, Homo sapiens
ggtggggctaggacctcaggat

SEQ ID NO: 8101596 - DNA, 19 bp, Homo sapiens
ggtggcagaacgtgggtcc

SEQ ID NO: 8101597 - DNA, 22 bp, Homo sapiens
ggtggatgctgactgttctgct

SEQ ID NO: 8101598 - DNA, 22 bp, Homo sapiens
ggttggggcgagctggaggccc

SEQ ID NO: 8101599 - DNA, 22 bp, Homo sapiens
ggttcagtttacattaaaatct

SEQ ID NO: 8101600 - DNA, 22 bp, Homo sapiens
ggtggtggagccagctgggagt

SEQ ID NO: 8101601 - DNA, 22 bp, Homo sapiens
ggtccccgtggaggctggagcg

SEQ ID NO: 8101602 - DNA, 22 bp, Homo sapiens
ggtccctgaagaggcctggggt

SEQ ID NO: 8101603 - DNA, 22 bp, Homo sapiens
ggtccctgaagatgcctgagga

SEQ ID NO: 8101604 - DNA, 20 bp, Homo sapiens
ggtccctgccctctgtcatc

SEQ ID NO: 8101605 - DNA, 22 bp, Homo sapiens
ggtccctgcccacctgggagct

SEQ ID NO: 8101606 - DNA, 22 bp, Homo sapiens
ggtccccccatggtgagcactg

SEQ ID NO: 8101607 - DNA, 22 bp, Homo sapiens
ggtgagaggcctgagagctgga

SEQ ID NO: 8101608 - DNA, 22 bp, Homo sapiens
ggtgacagccgcttggcgctag

SEQ ID NO: 8101609 - DNA, 22 bp, Homo sapiens
ggtgacagcgggtcaagaggag

SEQ ID NO: 8101610 - DNA, 22 bp, Homo sapiens
ggtgagaggcagtgctgtggaa

SEQ ID NO: 8101611 - DNA, 22 bp, Homo sapiens
ggtgacagccgcttgccctgta

SEQ ID NO: 8101612 - DNA, 22 bp, Homo sapiens
ggtccctgctgaagccttggtg

SEQ ID NO: 8101613 - DNA, 22 bp, Homo sapiens
ggtgaggcaggtggctgctgag

SEQ ID NO: 8101614 - DNA, 22 bp, Homo sapiens
ggtgaggcgtccccaccatggg

SEQ ID NO: 8101615 - DNA, 22 bp, Homo sapiens
ggtgaggctggcttgccttctt

SEQ ID NO: 8101616 - DNA, 22 bp, Homo sapiens
gggtggagaggctaagtccagt

SEQ ID NO: 8101617 - DNA, 22 bp, Homo sapiens
ggggccagcaatgttgaggaat

SEQ ID NO: 8101618 - DNA, 22 bp, Homo sapiens
ggggccaggtccagcttccaaa

SEQ ID NO: 8101619 - DNA, 22 bp, Homo sapiens
ggggcccttgtggctgcaggcc

SEQ ID NO: 8101620 - DNA, 22 bp, Homo sapiens
ggggtggatcaggcaggcccag

SEQ ID NO: 8101621 - DNA, 22 bp, Homo sapiens
ggggtggatttcaggcggtgtc

SEQ ID NO: 8101622 - DNA, 22 bp, Homo sapiens
gggctggtgaggctgccctgca

SEQ ID NO: 8101623 - DNA, 22 bp, Homo sapiens
gggctctgggatgctcttagag

SEQ ID NO: 8101624 - DNA, 19 bp, Homo sapiens
gggctctggcctcagtggg

SEQ ID NO: 8101625 - DNA, 22 bp, Homo sapiens
gggctctgggattcagagcaag

SEQ ID NO: 8101626 - DNA, 22 bp, Homo sapiens
ggggaggctgatgtgggcaaag

SEQ ID NO: 8101627 - DNA, 22 bp, Homo sapiens
ggggaggcaagatgaagtgagg

SEQ ID NO: 8101628 - DNA, 22 bp, Homo sapiens
ggggcattgtgtctgggttcct

SEQ ID NO: 8101629 - DNA, 22 bp, Homo sapiens
ggggagtggttgcctgtgatcc

SEQ ID NO: 8101630 - DNA, 22 bp, Homo sapiens
gcctggcaccacagcctttcag

SEQ ID NO: 8101631 - DNA, 22 bp, Homo sapiens
gcctggcagcctccaaccttca

SEQ ID NO: 8101632 - DNA, 22 bp, Homo sapiens
gcctggcactgggctcctggcc

SEQ ID NO: 8101633 - DNA, 22 bp, Homo sapiens
gcctggcactcaatcatctgct

SEQ ID NO: 8101634 - DNA, 22 bp, Homo sapiens
gctcccagactgaccagaggtg

SEQ ID NO: 8101635 - DNA, 23 bp, Homo sapiens
gctcatcaggcttagagtcaagg

SEQ ID NO: 8101636 - DNA, 22 bp, Homo sapiens
gctcccagcaattgaggcagcc

SEQ ID NO: 8101637 - DNA, 22 bp, Homo sapiens
gctcccagatttcagccttgtg

SEQ ID NO: 8101638 - DNA, 22 bp, Homo sapiens
gctagtttcttgaatactctaa

SEQ ID NO: 8101639 - DNA, 22 bp, Homo sapiens
gctccctcccaccagcctgcag

SEQ ID NO: 8101640 - DNA, 22 bp, Homo sapiens
gctccccattgatctgcaggct

SEQ ID NO: 8101641 - DNA, 22 bp, Homo sapiens
gctccccttggtcctcctggga

SEQ ID NO: 8101642 - DNA, 20 bp, Homo sapiens
gctccccttctctgggcctc

SEQ ID NO: 8101643 - DNA, 20 bp, Homo sapiens
gctcccagcctgcagtcccc

SEQ ID NO: 8101644 - DNA, 22 bp, Homo sapiens
gctcccagcattgcttcccagg

SEQ ID NO: 8101645 - DNA, 22 bp, Homo sapiens
gctcccagcattgctgctgaat

SEQ ID NO: 8101646 - DNA, 22 bp, Homo sapiens
gctcccagctggagcctcaaca

SEQ ID NO: 8101647 - DNA, 22 bp, Homo sapiens
gctcccaggaagagaagggcca

SEQ ID NO: 8101648 - DNA, 22 bp, Homo sapiens
gctcccaggatgaggagccagg

SEQ ID NO: 8101649 - DNA, 22 bp, Homo sapiens
gctctgtacctgcggagatgag

SEQ ID NO: 8101650 - DNA, 22 bp, Homo sapiens
gctctgtatgagggtgagagat

SEQ ID NO: 8101651 - DNA, 22 bp, Homo sapiens
gctggaggggtaataggatggg

SEQ ID NO: 8101652 - DNA, 22 bp, Homo sapiens
gctgctgggtccctctgtgcca

SEQ ID NO: 8101653 - DNA, 22 bp, Homo sapiens
gctgctggggtggagaaacgct

SEQ ID NO: 8101654 - DNA, 22 bp, Homo sapiens
gctgctggtcctcagagctcat

SEQ ID NO: 8101655 - DNA, 22 bp, Homo sapiens
gctgctggtcctcagagctcat

SEQ ID NO: 8101656 - DNA, 18 bp, Homo sapiens
gctgctggtggagggagc

SEQ ID NO: 8101657 - DNA, 22 bp, Homo sapiens
gctgcctgaaatgttgcctagc

SEQ ID NO: 8101658 - DNA, 23 bp, Homo sapiens
gctgcctctgttggtcttcagtt

SEQ ID NO: 8101659 - DNA, 22 bp, Homo sapiens
gctgctggaacaaatcacccca

SEQ ID NO: 8101660 - DNA, 22 bp, Homo sapiens
gctgctggaagcatgcgatgaa

SEQ ID NO: 8101661 - DNA, 22 bp, Homo sapiens
gctgctgggggaacagttaaaa

SEQ ID NO: 8101662 - DNA, 22 bp, Homo sapiens
gctgctggggccttccctcggg

SEQ ID NO: 8101663 - DNA, 22 bp, Homo sapiens
gctgctggggtcacatggtaag

SEQ ID NO: 8101664 - DNA, 22 bp, Homo sapiens
gctgctgggcaccccctgagct

SEQ ID NO: 8101665 - DNA, 22 bp, Homo sapiens
gctgctggcttcctgctgtttt

SEQ ID NO: 8101666 - DNA, 19 bp, Homo sapiens
gctgctggctctggctgga

SEQ ID NO: 8101667 - DNA, 22 bp, Homo sapiens
gctgctgggaatgaacagtgtt

SEQ ID NO: 8101668 - DNA, 22 bp, Homo sapiens
gctgctgggagggatcgtaaat

SEQ ID NO: 8101669 - DNA, 22 bp, Homo sapiens
gctgctgggatcctgggtctca

SEQ ID NO: 8101670 - DNA, 22 bp, Homo sapiens
gctggcaggtaaagccccgggg

SEQ ID NO: 8101671 - DNA, 22 bp, Homo sapiens
gctggcagggttctcactgaaa

SEQ ID NO: 8101672 - DNA, 19 bp, Homo sapiens
gctggatggatcctggagt

SEQ ID NO: 8101673 - DNA, 22 bp, Homo sapiens
gctggcagggtggttgagagag

SEQ ID NO: 8101674 - DNA, 22 bp, Homo sapiens
gctggagttggcaaggcatgta

SEQ ID NO: 8101675 - DNA, 22 bp, Homo sapiens
gctggcagtcccatcagctggg

SEQ ID NO: 8101676 - DNA, 22 bp, Homo sapiens
gctggcagtgtattgttagctg

SEQ ID NO: 8101677 - DNA, 22 bp, Homo sapiens
gctggcagtgtattgttagctg

SEQ ID NO: 8101678 - DNA, 22 bp, Homo sapiens
gctggcagtaaagggtttggca

SEQ ID NO: 8101679 - DNA, 22 bp, Homo sapiens
gctggcagtgtgaatgacaagc

SEQ ID NO: 8101680 - DNA, 22 bp, Homo sapiens
gctggagtgctgaggtgcagtg

SEQ ID NO: 8101681 - DNA, 22 bp, Homo sapiens
gctggagtgctggagtgcagtg

SEQ ID NO: 8101682 - DNA, 22 bp, Homo sapiens
gctggagtccagtggcatgatc

SEQ ID NO: 8101683 - DNA, 22 bp, Homo sapiens
gctgcctctgcgactctgggcg

SEQ ID NO: 8101684 - DNA, 22 bp, Homo sapiens
gctgcctcctgaaagcgctctg

SEQ ID NO: 8101685 - DNA, 22 bp, Homo sapiens
gctgcagggctctcacaggggg

SEQ ID NO: 8101686 - DNA, 22 bp, Homo sapiens
gctgtctggaggctctgaggga

SEQ ID NO: 8101687 - DNA, 22 bp, Homo sapiens
gctgtctggatatcttggaatt

SEQ ID NO: 8101688 - DNA, 22 bp, Homo sapiens
gctgtctggcatggcgtggctg

SEQ ID NO: 8101689 - DNA, 22 bp, Homo sapiens
gctgtctgtggtgtcagctgac

SEQ ID NO: 8101690 - DNA, 23 bp, Homo sapiens
gctgtctgtcatctctgcgggag

SEQ ID NO: 8101691 - DNA, 22 bp, Homo sapiens
gctgtccagagcatgggagcaa

SEQ ID NO: 8101692 - DNA, 22 bp, Homo sapiens
gctggccacagatccccaggga

SEQ ID NO: 8101693 - DNA, 22 bp, Homo sapiens
gctggccacattgtgccgtcct

SEQ ID NO: 8101694 - DNA, 19 bp, Homo sapiens
gctggccacgccccagttg

SEQ ID NO: 8101695 - DNA, 22 bp, Homo sapiens
gctgtcaaggtagaaaacagag

SEQ ID NO: 8101696 - DNA, 22 bp, Homo sapiens
gctttacattttggaaaggtga

SEQ ID NO: 8101697 - DNA, 22 bp, Homo sapiens
gctttatagccctattacatga

SEQ ID NO: 8101698 - DNA, 23 bp, Homo sapiens
gctttatagttctcccaacatta

SEQ ID NO: 8101699 - DNA, 22 bp, Homo sapiens
gcttttcttcagcagcctgatg

SEQ ID NO: 8101700 - DNA, 22 bp, Homo sapiens
gcttttttgctattgaagtggt

SEQ ID NO: 8101701 - DNA, 22 bp, Homo sapiens
gcttttttgggatgcctgcctt

SEQ ID NO: 8101702 - DNA, 22 bp, Homo sapiens
gcttttttaggtaagacccagg

SEQ ID NO: 8101703 - DNA, 22 bp, Homo sapiens
gcttttctataagaactttcaa

SEQ ID NO: 8101704 - DNA, 22 bp, Homo sapiens
gcttttctagctagaacatccg

SEQ ID NO: 8101705 - DNA, 19 bp, Homo sapiens
gcttttctccttcaagcca

SEQ ID NO: 8101706 - DNA, 22 bp, Homo sapiens
gcttttctccttagtgtccctg

SEQ ID NO: 8101707 - DNA, 22 bp, Homo sapiens
gcttttcatagataaaattcta

SEQ ID NO: 8101708 - DNA, 21 bp, Homo sapiens
gcttggttttggttacttgcc

SEQ ID NO: 8101709 - DNA, 22 bp, Homo sapiens
gctttaaacctctactctgtcc

SEQ ID NO: 8101710 - DNA, 22 bp, Homo sapiens
gctttacacagctggttcttgt

SEQ ID NO: 8101711 - DNA, 22 bp, Homo sapiens
gctttacagggcacaaagggag

SEQ ID NO: 8101712 - DNA, 22 bp, Homo sapiens
gctttacagagaaagtttgcct

SEQ ID NO: 8101713 - DNA, 22 bp, Homo sapiens
gctgtgttttatgttaggttaa

SEQ ID NO: 8101714 - DNA, 22 bp, Homo sapiens
ggagcctgggcctcctgccctt

SEQ ID NO: 8101715 - DNA, 22 bp, Homo sapiens
ggagcctggcctggctctgtgt

SEQ ID NO: 8101716 - DNA, 18 bp, Homo sapiens
ggagctgggcctggttcc

SEQ ID NO: 8101717 - DNA, 18 bp, Homo sapiens
ggagctgggcctggttcc

SEQ ID NO: 8101718 - DNA, 18 bp, Homo sapiens
ggagctgggccccactcc

SEQ ID NO: 8101719 - DNA, 22 bp, Homo sapiens
ggagctgggaattggatcatct

SEQ ID NO: 8101720 - DNA, 21 bp, Homo sapiens
ggagctggggagctggcccca

SEQ ID NO: 8101721 - DNA, 22 bp, Homo sapiens
ggaggaggggcgctttgtctat

SEQ ID NO: 8101722 - DNA, 22 bp, Homo sapiens
ggagcctggagtttctgatggg

SEQ ID NO: 8101723 - DNA, 18 bp, Homo sapiens
ggagccagtctgtctctg

SEQ ID NO: 8101724 - DNA, 22 bp, Homo sapiens
ggagccagtgccctctggtgga

SEQ ID NO: 8101725 - DNA, 22 bp, Homo sapiens
ggagccaggcatatcggggcac

SEQ ID NO: 8101726 - DNA, 22 bp, Homo sapiens
ggagccagggaagctgcttcct

SEQ ID NO: 8101727 - DNA, 22 bp, Homo sapiens
ggagccaggggaccttcacaga

SEQ ID NO: 8101728 - DNA, 22 bp, Homo sapiens
ggagccaggcaatctgtacttt

SEQ ID NO: 8101729 - DNA, 22 bp, Homo sapiens
ggaaggaattccaagactaaag

SEQ ID NO: 8101730 - DNA, 22 bp, Homo sapiens
ggaaggaggggcaaagcagttc

SEQ ID NO: 8101731 - DNA, 22 bp, Homo sapiens
ggaagggaaaattcattcggct

SEQ ID NO: 8101732 - DNA, 19 bp, Homo sapiens
ggaaggccacggcaggctt

SEQ ID NO: 8101733 - DNA, 22 bp, Homo sapiens
ggaaggctttgaggggtgctgg

SEQ ID NO: 8101734 - DNA, 22 bp, Homo sapiens
ggaaggctgtgccagaagaact

SEQ ID NO: 8101735 - DNA, 22 bp, Homo sapiens
ggagaaaggataggaatgtgct

SEQ ID NO: 8101736 - DNA, 22 bp, Homo sapiens
ggactgtgaggtctgggtgagg

SEQ ID NO: 8101737 - DNA, 22 bp, Homo sapiens
ggactgggaatcagggagatgc

SEQ ID NO: 8101738 - DNA, 22 bp, Homo sapiens
gcagttctatattattcttggg

SEQ ID NO: 8101739 - DNA, 22 bp, Homo sapiens
gcagttatggtttttattgcag

SEQ ID NO: 8101740 - DNA, 21 bp, Homo sapiens
gcagttaatagcagagcacac

SEQ ID NO: 8101741 - DNA, 22 bp, Homo sapiens
gccacctctagcaaagctcagc

SEQ ID NO: 8101742 - DNA, 20 bp, Homo sapiens
gccacctctctagcagtaga

SEQ ID NO: 8101743 - DNA, 21 bp, Homo sapiens
gccacctcgtctcggagcagc

SEQ ID NO: 8101744 - DNA, 21 bp, Homo sapiens
gccacctcaatcttctagcgc

SEQ ID NO: 8101745 - DNA, 22 bp, Homo sapiens
gccacctccttattccacctgt

SEQ ID NO: 8101746 - DNA, 22 bp, Homo sapiens
gccacttctgcctggcagggcc

SEQ ID NO: 8101747 - DNA, 23 bp, Homo sapiens
gccaggctccggtctgtggccac

SEQ ID NO: 8101748 - DNA, 22 bp, Homo sapiens
gccaggcgggtctcaaactcct

SEQ ID NO: 8101749 - DNA, 22 bp, Homo sapiens
gccaggcgggtctcaaactcct

SEQ ID NO: 8101750 - DNA, 22 bp, Homo sapiens
gcctggagaaaggaaggtggga

SEQ ID NO: 8101751 - DNA, 22 bp, Homo sapiens
gcctggagcccagtgtggggct

SEQ ID NO: 8101752 - DNA, 22 bp, Homo sapiens
gcctgcagctgcttccacacac

SEQ ID NO: 8101753 - DNA, 22 bp, Homo sapiens
gcctgcagggcctgggcctacc

SEQ ID NO: 8101754 - DNA, 22 bp, Homo sapiens
gcctccctgtttcctgctccaa

SEQ ID NO: 8101755 - DNA, 18 bp, Homo sapiens
gcctccctggctacactt

SEQ ID NO: 8101756 - DNA, 22 bp, Homo sapiens
gcctccctgtagaggccagcct

SEQ ID NO: 8101757 - DNA, 22 bp, Homo sapiens
gcctccctccaccactgcaggt

SEQ ID NO: 8101758 - DNA, 22 bp, Homo sapiens
gcccgcagagatctttaacaaa

SEQ ID NO: 8101759 - DNA, 22 bp, Homo sapiens
gccctagccatcctgtgctctg

SEQ ID NO: 8101760 - DNA, 22 bp, Homo sapiens
gccctagcccgggccacctgtt

SEQ ID NO: 8101761 - DNA, 22 bp, Homo sapiens
gccctgagtggtacctgtgggt

SEQ ID NO: 8101762 - DNA, 22 bp, Homo sapiens
gcccacagaggcaccaccaggc

SEQ ID NO: 8101763 - DNA, 22 bp, Homo sapiens
gcccctctcccttgaggcaggc

SEQ ID NO: 8101764 - DNA, 22 bp, Homo sapiens
gcccctctccttgtgcacctgc

SEQ ID NO: 8101765 - DNA, 22 bp, Homo sapiens
gccctgctctgttggtcacctg

SEQ ID NO: 8101766 - DNA, 23 bp, Homo sapiens
gccctgctcctggctgggaggga

SEQ ID NO: 8101767 - DNA, 22 bp, Homo sapiens
gccctgctcctccgtcccacga

SEQ ID NO: 8101768 - DNA, 22 bp, Homo sapiens
gccctgctcatttcacgtgttt

SEQ ID NO: 8101769 - DNA, 23 bp, Homo sapiens
gccctgctactcacaagctgtgt

SEQ ID NO: 8101770 - DNA, 22 bp, Homo sapiens
gccctgcctgtctgctgggagg

SEQ ID NO: 8101771 - DNA, 22 bp, Homo sapiens
gccctgcttctggcatgcagaa

SEQ ID NO: 8101772 - DNA, 22 bp, Homo sapiens
gccctgctgtcttcagagtata

SEQ ID NO: 8101773 - DNA, 22 bp, Homo sapiens
gccctgctgctggcagaggcgc

SEQ ID NO: 8101774 - DNA, 22 bp, Homo sapiens
gccctgctgcgcagcacgcatg

SEQ ID NO: 8101775 - DNA, 23 bp, Homo sapiens
gccctgctgggacctcctgctac

SEQ ID NO: 8101776 - DNA, 22 bp, Homo sapiens
gccctgctctggtctctgcccg

SEQ ID NO: 8101777 - DNA, 22 bp, Homo sapiens
gccctgctcttttgcccaccca

SEQ ID NO: 8101778 - DNA, 22 bp, Homo sapiens
gccctgcttggtcatggccttc

SEQ ID NO: 8101779 - DNA, 22 bp, Homo sapiens
gcctcatgagggatctgccctc

SEQ ID NO: 8101780 - DNA, 22 bp, Homo sapiens
gcagctggggaggtcgtgggga

SEQ ID NO: 8101781 - DNA, 22 bp, Homo sapiens
gcagcccaatggactgagacag

SEQ ID NO: 8101782 - DNA, 22 bp, Homo sapiens
gcagcccaagcctgagcatcct

SEQ ID NO: 8101783 - DNA, 22 bp, Homo sapiens
gcagccagcccctctgacctct

SEQ ID NO: 8101784 - DNA, 21 bp, Homo sapiens
gcagccacagccaccaagcta

SEQ ID NO: 8101785 - DNA, 22 bp, Homo sapiens
gcagcagatgtgggcccagagc

SEQ ID NO: 8101786 - DNA, 22 bp, Homo sapiens
gcagcacacggtggtgccctgg

SEQ ID NO: 8101787 - DNA, 19 bp, Homo sapiens
gcagggtgttgactgtccc

SEQ ID NO: 8101788 - DNA, 22 bp, Homo sapiens
gcagggcagctgaagctaggtg

SEQ ID NO: 8101789 - DNA, 22 bp, Homo sapiens
gcagggcagctcactgtggttc

SEQ ID NO: 8101790 - DNA, 22 bp, Homo sapiens
gcagctgtcactttcacaatgc

SEQ ID NO: 8101791 - DNA, 22 bp, Homo sapiens
gcagctgtaaagcagaaatagt

SEQ ID NO: 8101792 - DNA, 22 bp, Homo sapiens
gcacagagggcagtgagcctct

SEQ ID NO: 8101793 - DNA, 22 bp, Homo sapiens
gcacagagtcactagctaagca

SEQ ID NO: 8101794 - DNA, 22 bp, Homo sapiens
gcacagcagacttggtggggct

SEQ ID NO: 8101795 - DNA, 22 bp, Homo sapiens
gagtattcctcagtcattttgt

SEQ ID NO: 8101796 - DNA, 22 bp, Homo sapiens
gcaaggaagcagagttgctatc

SEQ ID NO: 8101797 - DNA, 22 bp, Homo sapiens
gcagagtcccagcaggtggtgg

SEQ ID NO: 8101798 - DNA, 22 bp, Homo sapiens
gcagagtctgggcagcctccat

SEQ ID NO: 8101799 - DNA, 22 bp, Homo sapiens
gcagagtcattatttatgcaat

SEQ ID NO: 8101800 - DNA, 22 bp, Homo sapiens
gcagagtcaggtccaaggactg

SEQ ID NO: 8101801 - DNA, 22 bp, Homo sapiens
gcagagtctggtaggtgctggt

SEQ ID NO: 8101802 - DNA, 22 bp, Homo sapiens
gcagagtctgggctacctcttg

SEQ ID NO: 8101803 - DNA, 23 bp, Homo sapiens
gcagagtcaagtagtcatgagtg

SEQ ID NO: 8101804 - DNA, 22 bp, Homo sapiens
gcagagtcagcctccgagacag

SEQ ID NO: 8101805 - DNA, 22 bp, Homo sapiens
gcagagtcaggattccatccca

SEQ ID NO: 8101806 - DNA, 22 bp, Homo sapiens
gcagaggttggattggtgactt

SEQ ID NO: 8101807 - DNA, 19 bp, Homo sapiens
gcagagtcaagagctgctg

SEQ ID NO: 8101808 - DNA, 22 bp, Homo sapiens
gcagacagggctacagaggtac

SEQ ID NO: 8101809 - DNA, 22 bp, Homo sapiens
gcagaggtgagtttctcagctg

SEQ ID NO: 8101810 - DNA, 22 bp, Homo sapiens
gcagaggtgtagccccctccat

SEQ ID NO: 8101811 - DNA, 22 bp, Homo sapiens
gcagaggtgtgggaggggccac

SEQ ID NO: 8101812 - DNA, 22 bp, Homo sapiens
gcagaggtgtcaccttccagga

SEQ ID NO: 8101813 - DNA, 22 bp, Homo sapiens
gcagaggtggatgcaattgggg

SEQ ID NO: 8101814 - DNA, 22 bp, Homo sapiens
gcagaggtgctcagtggcagaa

SEQ ID NO: 8101815 - DNA, 22 bp, Homo sapiens
gcagaggtggcatctgggctct

SEQ ID NO: 8101816 - DNA, 22 bp, Homo sapiens
gcagagtgaggaagagcttcca

SEQ ID NO: 8101817 - DNA, 22 bp, Homo sapiens
gcacatttctcaaagaattgtc

SEQ ID NO: 8101818 - DNA, 22 bp, Homo sapiens
gcagaaggatccgcaggtgcaa

SEQ ID NO: 8101819 - DNA, 23 bp, Homo sapiens
gcagacagagcagactaagacaa

SEQ ID NO: 8101820 - DNA, 22 bp, Homo sapiens
gcagacaggcccagtggaggga

SEQ ID NO: 8101821 - DNA, 22 bp, Homo sapiens
gcagacagaagctaagtagaca

SEQ ID NO: 8101822 - DNA, 22 bp, Homo sapiens
tccaggctacttggattcctgg

SEQ ID NO: 8101823 - DNA, 22 bp, Homo sapiens
tccaggccttgacaggtcagtt

SEQ ID NO: 8101824 - DNA, 20 bp, Homo sapiens
tccaggccttgttctcagat

SEQ ID NO: 8101825 - DNA, 21 bp, Homo sapiens
tccacaagttagaaggaaatt

SEQ ID NO: 8101826 - DNA, 22 bp, Homo sapiens
tccacaagatgataaagagagg

SEQ ID NO: 8101827 - DNA, 18 bp, Homo sapiens
tccaggcctgaagtgtcc

SEQ ID NO: 8101828 - DNA, 22 bp, Homo sapiens
tcccagccttatctcccctggc

SEQ ID NO: 8101829 - DNA, 22 bp, Homo sapiens
tcccagcctggaccctgccagt

SEQ ID NO: 8101830 - DNA, 22 bp, Homo sapiens
tcccagcctttctttctccagc

SEQ ID NO: 8101831 - DNA, 22 bp, Homo sapiens
tcccagccacaggtgtagccct

SEQ ID NO: 8101832 - DNA, 23 bp, Homo sapiens
tcccagcctcttctcttgcatac

SEQ ID NO: 8101833 - DNA, 22 bp, Homo sapiens
tcccaagattaggttggaaagg

SEQ ID NO: 8101834 - DNA, 22 bp, Homo sapiens
tcccaagagcaagaacttgctg

SEQ ID NO: 8101835 - DNA, 22 bp, Homo sapiens
tcccaagagctctgggataagg

SEQ ID NO: 8101836 - DNA, 22 bp, Homo sapiens
tcccaagaggggttattatgcc

SEQ ID NO: 8101837 - DNA, 22 bp, Homo sapiens
tcccaagatacgctgtaagaag

SEQ ID NO: 8101838 - DNA, 21 bp, Homo sapiens
tcccaagaatatgcataagtt

SEQ ID NO: 8101839 - DNA, 22 bp, Homo sapiens
tcccaagacctggcatccaagt

SEQ ID NO: 8101840 - DNA, 22 bp, Homo sapiens
tcccaagagctactcaatggaa

SEQ ID NO: 8101841 - DNA, 22 bp, Homo sapiens
tcccaagagacagaatggtatc

SEQ ID NO: 8101842 - DNA, 22 bp, Homo sapiens
tcccaagacgatgtgcttggcc

SEQ ID NO: 8101843 - DNA, 22 bp, Homo sapiens
tcccaagactatgttctgtgtg

SEQ ID NO: 8101844 - DNA, 22 bp, Homo sapiens
tccattaaacctggatggagtt

SEQ ID NO: 8101845 - DNA, 22 bp, Homo sapiens
tccattaacacctgtacgtggc

SEQ ID NO: 8101846 - DNA, 22 bp, Homo sapiens
tccattatacttctgattcaaa

SEQ ID NO: 8101847 - DNA, 22 bp, Homo sapiens
tccattatacttctgattcaaa

SEQ ID NO: 8101848 - DNA, 18 bp, Homo sapiens
tccatggcttaacctcag

SEQ ID NO: 8101849 - DNA, 22 bp, Homo sapiens
tccattggtctctgtgcccagg

SEQ ID NO: 8101850 - DNA, 22 bp, Homo sapiens
tccctgccctgccttcatggtt

SEQ ID NO: 8101851 - DNA, 22 bp, Homo sapiens
tccctgccctgccttcatggtt

SEQ ID NO: 8101852 - DNA, 22 bp, Homo sapiens
tccctgcctcctggcagtgcca

SEQ ID NO: 8101853 - DNA, 23 bp, Homo sapiens
tcccagggaaggtgagcgaggct

SEQ ID NO: 8101854 - DNA, 22 bp, Homo sapiens
tcccctggcacctagtcctact

SEQ ID NO: 8101855 - DNA, 22 bp, Homo sapiens
tcctcaggtcaaagcaggagaa

SEQ ID NO: 8101856 - DNA, 22 bp, Homo sapiens
tcctcacagagtggcaggcaat

SEQ ID NO: 8101857 - DNA, 22 bp, Homo sapiens
tcctcacatggtgagccacaca

SEQ ID NO: 8101858 - DNA, 22 bp, Homo sapiens
tcctagcctggtgagaaactgt

SEQ ID NO: 8101859 - DNA, 19 bp, Homo sapiens
tccctggcgcctctcgggc

SEQ ID NO: 8101860 - DNA, 22 bp, Homo sapiens
tccctggccattcctctaggcc

SEQ ID NO: 8101861 - DNA, 22 bp, Homo sapiens
tccctgcctctcagacttcctt

SEQ ID NO: 8101862 - DNA, 22 bp, Homo sapiens
tcctcttgggaatacctttcta

SEQ ID NO: 8101863 - DNA, 22 bp, Homo sapiens
tcctctttaaatgcttttatct

SEQ ID NO: 8101864 - DNA, 22 bp, Homo sapiens
tcctgagaatagagttgcatgt

SEQ ID NO: 8101865 - DNA, 22 bp, Homo sapiens
tcctgagatgagacagtgctgc

SEQ ID NO: 8101866 - DNA, 23 bp, Homo sapiens
tcctgagatgagacagtgctgcc

SEQ ID NO: 8101867 - DNA, 22 bp, Homo sapiens
tcctgagatgctgatttcgggg

SEQ ID NO: 8101868 - DNA, 22 bp, Homo sapiens
tcctgagataggagttgaaggc

SEQ ID NO: 8101869 - DNA, 22 bp, Homo sapiens
tcctgagaggtgtgaggtgcag

SEQ ID NO: 8101870 - DNA, 22 bp, Homo sapiens
tcctgagaggtttataacgcag

SEQ ID NO: 8101871 - DNA, 22 bp, Homo sapiens
tcctgagagtcaagaatgcagg

SEQ ID NO: 8101872 - DNA, 22 bp, Homo sapiens
tcctgagcacctatgccatggc

SEQ ID NO: 8101873 - DNA, 20 bp, Homo sapiens
tcctgagatttaaggggttc

SEQ ID NO: 8101874 - DNA, 22 bp, Homo sapiens
tcctgcctgagcgtggaggagg

SEQ ID NO: 8101875 - DNA, 22 bp, Homo sapiens
tcctgcctgcaatcccagcact

SEQ ID NO: 8101876 - DNA, 22 bp, Homo sapiens
tcctgcctcaggctctggagta

SEQ ID NO: 8101877 - DNA, 22 bp, Homo sapiens
tcagatttgaatattcctttcg

SEQ ID NO: 8101878 - DNA, 22 bp, Homo sapiens
tcagatgtccttccagagattt

SEQ ID NO: 8101879 - DNA, 22 bp, Homo sapiens
tcagacaagttgatgtacctgg

SEQ ID NO: 8101880 - DNA, 22 bp, Homo sapiens
tcagacaagtaaaataatgtaa

SEQ ID NO: 8101881 - DNA, 18 bp, Homo sapiens
tcagacaagttagacagg

SEQ ID NO: 8101882 - DNA, 22 bp, Homo sapiens
tcagaattttggtttggttggt

SEQ ID NO: 8101883 - DNA, 22 bp, Homo sapiens
tcagaattttctggaatggagc

SEQ ID NO: 8101884 - DNA, 22 bp, Homo sapiens
tcagaattttaaaccaaggaaa

SEQ ID NO: 8101885 - DNA, 22 bp, Homo sapiens
tcagaatttaaaatgtgtagat

SEQ ID NO: 8101886 - DNA, 22 bp, Homo sapiens
tcagaattgtggagaaagggga

SEQ ID NO: 8101887 - DNA, 22 bp, Homo sapiens
tcagaattgtctggggaatgtt

SEQ ID NO: 8101888 - DNA, 22 bp, Homo sapiens
tcagaattggacaatagaagca

SEQ ID NO: 8101889 - DNA, 22 bp, Homo sapiens
tcagaattggaacgtgaagatt

SEQ ID NO: 8101890 - DNA, 22 bp, Homo sapiens
tcagaattcagagggagtgggg

SEQ ID NO: 8101891 - DNA, 22 bp, Homo sapiens
tcagaattctgaagggcacaaa

SEQ ID NO: 8101892 - DNA, 22 bp, Homo sapiens
tcagaattctagctcttccctt

SEQ ID NO: 8101893 - DNA, 22 bp, Homo sapiens
tcagcaactatttatcaaattc

SEQ ID NO: 8101894 - DNA, 22 bp, Homo sapiens
tcagcaactatttatcaaattc

SEQ ID NO: 8101895 - DNA, 22 bp, Homo sapiens
tcagcaaaggaccagcacaggc

SEQ ID NO: 8101896 - DNA, 22 bp, Homo sapiens
tcaggaattttgttctgtatcc

SEQ ID NO: 8101897 - DNA, 22 bp, Homo sapiens
tcaggaagtataatcagattca

SEQ ID NO: 8101898 - DNA, 22 bp, Homo sapiens
tcagctgggtgagtgttctgca

SEQ ID NO: 8101899 - DNA, 22 bp, Homo sapiens
tcagctggcagttcagaggctg

SEQ ID NO: 8101900 - DNA, 18 bp, Homo sapiens
tcagctggggctgcagcc

SEQ ID NO: 8101901 - DNA, 22 bp, Homo sapiens
tcagcattgtggcagagaatgg

SEQ ID NO: 8101902 - DNA, 22 bp, Homo sapiens
tcagcatatcttgagcttcatg

SEQ ID NO: 8101903 - DNA, 22 bp, Homo sapiens
tcagcagttttatatgcagctt

SEQ ID NO: 8101904 - DNA, 22 bp, Homo sapiens
tcagcagtgtcagttcccagag

SEQ ID NO: 8101905 - DNA, 22 bp, Homo sapiens
tcagcagtgtgcccagaggctg

SEQ ID NO: 8101906 - DNA, 22 bp, Homo sapiens
tcagcagtgtgcttggaatgga

SEQ ID NO: 8101907 - DNA, 22 bp, Homo sapiens
tcagctgcttcatgttctgaat

SEQ ID NO: 8101908 - DNA, 23 bp, Homo sapiens
tcagctgcttcctcctgcctgcc

SEQ ID NO: 8101909 - DNA, 22 bp, Homo sapiens
tcactgcaacctccacctcctg

SEQ ID NO: 8101910 - DNA, 22 bp, Homo sapiens
tcactgcaacctccacctcctg

SEQ ID NO: 8101911 - DNA, 22 bp, Homo sapiens
tcactgcaacctccacctcccg

SEQ ID NO: 8101912 - DNA, 22 bp, Homo sapiens
tcactgcaacctccacctcccg

SEQ ID NO: 8101913 - DNA, 22 bp, Homo sapiens
tcagaacagcgagaatattcac

SEQ ID NO: 8101914 - DNA, 22 bp, Homo sapiens
tcagaatatgctaatgacattt

SEQ ID NO: 8101915 - DNA, 22 bp, Homo sapiens
tcagaatctgcatttaacaaaa

SEQ ID NO: 8101916 - DNA, 22 bp, Homo sapiens
tcagaaacagaaactaagaacc

SEQ ID NO: 8101917 - DNA, 22 bp, Homo sapiens
tcagaaaccagctctctcaatt

SEQ ID NO: 8101918 - DNA, 22 bp, Homo sapiens
tcagaaagctgattcttgatac

SEQ ID NO: 8101919 - DNA, 22 bp, Homo sapiens
tcagaaagacgaaacagatggg

SEQ ID NO: 8101920 - DNA, 22 bp, Homo sapiens
tcagaaagctgattcttgatac

SEQ ID NO: 8101921 - DNA, 22 bp, Homo sapiens
tcagaaagcttagtgtcttgca

SEQ ID NO: 8101922 - DNA, 22 bp, Homo sapiens
tcagaaagcttttacttaaaca

SEQ ID NO: 8101923 - DNA, 22 bp, Homo sapiens
tcagaaagctatatggtgtgtc

SEQ ID NO: 8101924 - DNA, 22 bp, Homo sapiens
tcagaaaggccacatggtgcag

SEQ ID NO: 8101925 - DNA, 22 bp, Homo sapiens
tcagaacagaagaaggaacacg

SEQ ID NO: 8101926 - DNA, 22 bp, Homo sapiens
tcaacactggctacagttatgc

SEQ ID NO: 8101927 - DNA, 22 bp, Homo sapiens
tcaacactctttggcacagtta

SEQ ID NO: 8101928 - DNA, 22 bp, Homo sapiens
tcaacagttgcactggagaggt

SEQ ID NO: 8101929 - DNA, 22 bp, Homo sapiens
tcaagaaatgtgcttggatata

SEQ ID NO: 8101930 - DNA, 22 bp, Homo sapiens
tcaagaaagggcttcaccagga

SEQ ID NO: 8101931 - DNA, 22 bp, Homo sapiens
tcacagtatcacacaaggatta

SEQ ID NO: 8101932 - DNA, 22 bp, Homo sapiens
tcaagaaactgtgctacagagt

SEQ ID NO: 8101933 - DNA, 22 bp, Homo sapiens
tcaagaaactgtgctacagagt

SEQ ID NO: 8101934 - DNA, 22 bp, Homo sapiens
tcaactcacaagaatgagcaag

SEQ ID NO: 8101935 - DNA, 22 bp, Homo sapiens
tcacataaattatacaatttca

SEQ ID NO: 8101936 - DNA, 22 bp, Homo sapiens
tcacataaattatacaatttca

SEQ ID NO: 8101937 - DNA, 23 bp, Homo sapiens
tcacataatccttcatccacagg

SEQ ID NO: 8101938 - DNA, 18 bp, Homo sapiens
tcagtattacctcaggca

SEQ ID NO: 8101939 - DNA, 22 bp, Homo sapiens
tcagtattcctggaaatacaag

SEQ ID NO: 8101940 - DNA, 22 bp, Homo sapiens
tcataaatcatactccatttgc

SEQ ID NO: 8101941 - DNA, 23 bp, Homo sapiens
tcataaatattagcacagtagga

SEQ ID NO: 8101942 - DNA, 22 bp, Homo sapiens
tcataaagttacccaaatttta

SEQ ID NO: 8101943 - DNA, 22 bp, Homo sapiens
tcataaagttacccaaatttta

SEQ ID NO: 8101944 - DNA, 22 bp, Homo sapiens
tcataaattgattatgtgcttt

SEQ ID NO: 8101945 - DNA, 22 bp, Homo sapiens
tcatacatcttgtatatctatc

SEQ ID NO: 8101946 - DNA, 22 bp, Homo sapiens
tcataaattgattatgtgcttt

SEQ ID NO: 8101947 - DNA, 22 bp, Homo sapiens
tcataaatgcagtgtcataaat

SEQ ID NO: 8101948 - DNA, 22 bp, Homo sapiens
tcatacattcagcagatatttg

SEQ ID NO: 8101949 - DNA, 18 bp, Homo sapiens
tcatagaagtgaatcaga

SEQ ID NO: 8101950 - DNA, 22 bp, Homo sapiens
tcatagaatgagttaatgaact

SEQ ID NO: 8101951 - DNA, 22 bp, Homo sapiens
tcatctttcctcaaaagatcca

SEQ ID NO: 8101952 - DNA, 22 bp, Homo sapiens
tcatgaaaatagatcagaaatt

SEQ ID NO: 8101953 - DNA, 17 bp, Homo sapiens
tcaggctgggtgcagtg

SEQ ID NO: 8101954 - DNA, 22 bp, Homo sapiens
tcagggccgccggggatctcgc

SEQ ID NO: 8101955 - DNA, 22 bp, Homo sapiens
tcagtaaaacctgcttttagtg

SEQ ID NO: 8101956 - DNA, 22 bp, Homo sapiens
tcagtaaaattacagatctaca

SEQ ID NO: 8101957 - DNA, 22 bp, Homo sapiens
tcagtaaatgagcaaaaatttc

SEQ ID NO: 8101958 - DNA, 22 bp, Homo sapiens
tcagtaaatgaatgaatatatg

SEQ ID NO: 8101959 - DNA, 22 bp, Homo sapiens
tcatttttagcgcgcaaaagtt

SEQ ID NO: 8101960 - DNA, 22 bp, Homo sapiens
tcatttttagcgcgcaaaagtt

SEQ ID NO: 8101961 - DNA, 22 bp, Homo sapiens
tcatttgtgctgtcagcatgca

SEQ ID NO: 8101962 - DNA, 22 bp, Homo sapiens
tcatttgttacagccacatacc

SEQ ID NO: 8101963 - DNA, 18 bp, Homo sapiens
tccaaaatcatgtatttt

SEQ ID NO: 8101964 - DNA, 22 bp, Homo sapiens
tcattttttgcatacctgtgtc

SEQ ID NO: 8101965 - DNA, 22 bp, Homo sapiens
tccaaatataggatgtgatata

SEQ ID NO: 8101966 - DNA, 22 bp, Homo sapiens
tccaaacgggagccaaatgagc

SEQ ID NO: 8101967 - DNA, 22 bp, Homo sapiens
tccaaagaggttaagaacgaga

SEQ ID NO: 8101968 - DNA, 22 bp, Homo sapiens
tccaaagaatagaggtgacatt

SEQ ID NO: 8101969 - DNA, 22 bp, Homo sapiens
tccaaagaagtcacaaacgaag

SEQ ID NO: 8101970 - DNA, 22 bp, Homo sapiens
tccaaagaacattgctgagacc

SEQ ID NO: 8101971 - DNA, 22 bp, Homo sapiens
tccaactttctcctccggcttg

SEQ ID NO: 8101972 - DNA, 22 bp, Homo sapiens
tccaacttctgcaatcagtttg

SEQ ID NO: 8101973 - DNA, 21 bp, Homo sapiens
tccaagctcaactcccttcct

SEQ ID NO: 8101974 - DNA, 22 bp, Homo sapiens
tccaagctttccatgccctcac

SEQ ID NO: 8101975 - DNA, 22 bp, Homo sapiens
tcatttcatgtctcaggcactg

SEQ ID NO: 8101976 - DNA, 22 bp, Homo sapiens
tcatttctatctatgcagcttc

SEQ ID NO: 8101977 - DNA, 23 bp, Homo sapiens
tcatttcaggttgcatggtacca

SEQ ID NO: 8101978 - DNA, 23 bp, Homo sapiens
tcatttcaggttgcatggtacca

SEQ ID NO: 8101979 - DNA, 22 bp, Homo sapiens
tcatttatattgtattctgtag

SEQ ID NO: 8101980 - DNA, 22 bp, Homo sapiens
tcatttatcatttgtgctgtag

SEQ ID NO: 8101981 - DNA, 22 bp, Homo sapiens
tcatttctgttgtgcatcactg

SEQ ID NO: 8101982 - DNA, 22 bp, Homo sapiens
tcatttcttaactagagtgaac

SEQ ID NO: 8101983 - DNA, 22 bp, Homo sapiens
tcatttctattgctactgtctg

SEQ ID NO: 8101984 - DNA, 22 bp, Homo sapiens
tcatttctccgacctgctgtcc

SEQ ID NO: 8101985 - DNA, 22 bp, Homo sapiens
tcatttacacttcacaaatgga

SEQ ID NO: 8101986 - DNA, 22 bp, Homo sapiens
tcatttacttctatgacaacat

SEQ ID NO: 8101987 - DNA, 22 bp, Homo sapiens
tcattgccatggcatttgcaga

SEQ ID NO: 8101988 - DNA, 22 bp, Homo sapiens
gtttattaactgtcaagtgatt

SEQ ID NO: 8101989 - DNA, 22 bp, Homo sapiens
gtttattagagttttctgtctg

SEQ ID NO: 8101990 - DNA, 22 bp, Homo sapiens
gtttattatacaacaaaagcta

SEQ ID NO: 8101991 - DNA, 22 bp, Homo sapiens
gtttcaaaggtgtcaggcagtt

SEQ ID NO: 8101992 - DNA, 22 bp, Homo sapiens
gtttcaaagtcagaaaaggagg

SEQ ID NO: 8101993 - DNA, 22 bp, Homo sapiens
gtttcaaagtcagaaaaggagg

SEQ ID NO: 8101994 - DNA, 22 bp, Homo sapiens
gtttcaaagggaagacgctgga

SEQ ID NO: 8101995 - DNA, 22 bp, Homo sapiens
gtttcaaagcacagctcacatt

SEQ ID NO: 8101996 - DNA, 22 bp, Homo sapiens
gtttcaaagggaagacgctgga

SEQ ID NO: 8101997 - DNA, 19 bp, Homo sapiens
gttcttttcacctctgtgc

SEQ ID NO: 8101998 - DNA, 19 bp, Homo sapiens
gttcttttcacctctgtgc

SEQ ID NO: 8101999 - DNA, 22 bp, Homo sapiens
gttcttttggtagagtgtgcat

SEQ ID NO: 8102000 - DNA, 21 bp, Homo sapiens
gttcttgcaggatttccttcc

SEQ ID NO: 8102001 - DNA, 22 bp, Homo sapiens
gtttcaaataggtttcagcaaa

SEQ ID NO: 8102002 - DNA, 22 bp, Homo sapiens
gtttcaagtagctgctgattat

SEQ ID NO: 8102003 - DNA, 22 bp, Homo sapiens
gtttcacagggccatggaggaa

SEQ ID NO: 8102004 - DNA, 22 bp, Homo sapiens
gtttcttagacagacattatct

SEQ ID NO: 8102005 - DNA, 22 bp, Homo sapiens
gtttcagaaatggtttatgcaa

SEQ ID NO: 8102006 - DNA, 22 bp, Homo sapiens
gtttcttagacagacattatct

SEQ ID NO: 8102007 - DNA, 22 bp, Homo sapiens
gtttcttatttcaactggaaca

SEQ ID NO: 8102008 - DNA, 22 bp, Homo sapiens
gtttcttagacatatgccatga

SEQ ID NO: 8102009 - DNA, 22 bp, Homo sapiens
gtttcttaggtaaattctttga

SEQ ID NO: 8102010 - DNA, 22 bp, Homo sapiens
gtttcttatttgcaggttgctt

SEQ ID NO: 8102011 - DNA, 22 bp, Homo sapiens
gtttctttctattgactgaaca

SEQ ID NO: 8102012 - DNA, 22 bp, Homo sapiens
gtttcttttgtgatcaccaacc

SEQ ID NO: 8102013 - DNA, 22 bp, Homo sapiens
gtttcttttaaaatatgtagac

SEQ ID NO: 8102014 - DNA, 22 bp, Homo sapiens
gttatgaagtcattcacaaata

SEQ ID NO: 8102015 - DNA, 22 bp, Homo sapiens
gttatatatagtatttctctga

SEQ ID NO: 8102016 - DNA, 22 bp, Homo sapiens
gttatataagacaaatcagagt

SEQ ID NO: 8102017 - DNA, 22 bp, Homo sapiens
gttatataattcctgtggtagt

SEQ ID NO: 8102018 - DNA, 22 bp, Homo sapiens
gttatacatatgtgttaacaaa

SEQ ID NO: 8102019 - DNA, 22 bp, Homo sapiens
gttatacagttttgggtctgct

SEQ ID NO: 8102020 - DNA, 21 bp, Homo sapiens
gttatacattctatggatttg

SEQ ID NO: 8102021 - DNA, 22 bp, Homo sapiens
gttataaatgactgcaaaagtt

SEQ ID NO: 8102022 - DNA, 22 bp, Homo sapiens
gttatacacattcctggtgagg

SEQ ID NO: 8102023 - DNA, 22 bp, Homo sapiens
gttcttcatcttaaccatctgt

SEQ ID NO: 8102024 - DNA, 22 bp, Homo sapiens
gttcttcatcattaacactctg

SEQ ID NO: 8102025 - DNA, 22 bp, Homo sapiens
gttcttcaggctgtgctctaga

SEQ ID NO: 8102026 - DNA, 22 bp, Homo sapiens
gtgtttaataggtagctgaatc

SEQ ID NO: 8102027 - DNA, 22 bp, Homo sapiens
gtgtttctggggcattcatagt

SEQ ID NO: 8102028 - DNA, 22 bp, Homo sapiens
gttaaataacctcatgtccgtt

SEQ ID NO: 8102029 - DNA, 22 bp, Homo sapiens
gttataaatacctaataggatt

SEQ ID NO: 8102030 - DNA, 22 bp, Homo sapiens
gttaacacaggactctctgcct

SEQ ID NO: 8102031 - DNA, 22 bp, Homo sapiens
gttaacacatgcaattgcactt

SEQ ID NO: 8102032 - DNA, 22 bp, Homo sapiens
gtgctggcctcagagggtcatg

SEQ ID NO: 8102033 - DNA, 22 bp, Homo sapiens
gtgttcatggatgtcaatttga

SEQ ID NO: 8102034 - DNA, 22 bp, Homo sapiens
gtgttgatgacattttagaaac

SEQ ID NO: 8102035 - DNA, 22 bp, Homo sapiens
gtgttctttatttagtgatgct

SEQ ID NO: 8102036 - DNA, 22 bp, Homo sapiens
gtgtttaacatctggtttatac

SEQ ID NO: 8102037 - DNA, 20 bp, Homo sapiens
taaatgcatctgttcaactg

SEQ ID NO: 8102038 - DNA, 19 bp, Homo sapiens
taaagagaataccggtggc

SEQ ID NO: 8102039 - DNA, 20 bp, Homo sapiens
gttttaaggcacaggccttt

SEQ ID NO: 8102040 - DNA, 21 bp, Homo sapiens
gttttaagggagaaaacctag

SEQ ID NO: 8102041 - DNA, 22 bp, Homo sapiens
taaaagaagcttcaaggccggc

SEQ ID NO: 8102042 - DNA, 22 bp, Homo sapiens
taaaagaagcttcaaggccggc

SEQ ID NO: 8102043 - DNA, 22 bp, Homo sapiens
taaaagtatactttcaaaggag

SEQ ID NO: 8102044 - DNA, 22 bp, Homo sapiens
taaatgtttagtcttatttggg

SEQ ID NO: 8102045 - DNA, 22 bp, Homo sapiens
taacagcagtcctcttctcatg

SEQ ID NO: 8102046 - DNA, 22 bp, Homo sapiens
taagaccagtatgcattttcac

SEQ ID NO: 8102047 - DNA, 22 bp, Homo sapiens
taagaccaaagttctgtaggga

SEQ ID NO: 8102048 - DNA, 22 bp, Homo sapiens
taagaccaatcctgtgtacctc

SEQ ID NO: 8102049 - DNA, 22 bp, Homo sapiens
taagacatggttgatctagtgt

SEQ ID NO: 8102050 - DNA, 22 bp, Homo sapiens
taagacatcctggatgttcaaa

SEQ ID NO: 8102051 - DNA, 22 bp, Homo sapiens
taacatgttaagaaattagata

SEQ ID NO: 8102052 - DNA, 22 bp, Homo sapiens
taacatgtttgtacactgaaac

SEQ ID NO: 8102053 - DNA, 18 bp, Homo sapiens
taacatgttttcattaag

SEQ ID NO: 8102054 - DNA, 22 bp, Homo sapiens
taagacagggagggctctcagc

SEQ ID NO: 8102055 - DNA, 22 bp, Homo sapiens
taagacagggtctattcttagt

SEQ ID NO: 8102056 - DNA, 22 bp, Homo sapiens
taagagctgagcctcgtattca

SEQ ID NO: 8102057 - DNA, 22 bp, Homo sapiens
tacacacttactggagatgaag

SEQ ID NO: 8102058 - DNA, 22 bp, Homo sapiens
tacacatacattgcttacaagg

SEQ ID NO: 8102059 - DNA, 22 bp, Homo sapiens
tacacatacaccaatgtggtca

SEQ ID NO: 8102060 - DNA, 22 bp, Homo sapiens
tacacatacaccaatgtggtca

SEQ ID NO: 8102061 - DNA, 22 bp, Homo sapiens
tacacagtatatgggatcacag

SEQ ID NO: 8102062 - DNA, 22 bp, Homo sapiens
tacacactgtgataatgaagca

SEQ ID NO: 8102063 - DNA, 22 bp, Homo sapiens
tacacagaaattgtgtagggat

SEQ ID NO: 8102064 - DNA, 22 bp, Homo sapiens
tacagaatgtgtatcattacca

SEQ ID NO: 8102065 - DNA, 22 bp, Homo sapiens
tacagaatgttatgaagcatag

SEQ ID NO: 8102066 - DNA, 22 bp, Homo sapiens
tacagaattagattattagaga

SEQ ID NO: 8102067 - DNA, 22 bp, Homo sapiens
tacacatacattgcttacaagg

SEQ ID NO: 8102068 - DNA, 22 bp, Homo sapiens
tacacataggagggtaataaaa

SEQ ID NO: 8102069 - DNA, 22 bp, Homo sapiens
tacacataggtctgaataaaaa

SEQ ID NO: 8102070 - DNA, 22 bp, Homo sapiens
tacacataggtctgaataaaaa

SEQ ID NO: 8102071 - DNA, 22 bp, Homo sapiens
tacagaataaagcgtgaagctt

SEQ ID NO: 8102072 - DNA, 22 bp, Homo sapiens
tacaagaaatttctgcatatat

SEQ ID NO: 8102073 - DNA, 22 bp, Homo sapiens
taatttatttcaactgccaagg

SEQ ID NO: 8102074 - DNA, 22 bp, Homo sapiens
tacaacataacgggcattcagt

SEQ ID NO: 8102075 - DNA, 22 bp, Homo sapiens
tacaagaaggaaaactagcaat

SEQ ID NO: 8102076 - DNA, 22 bp, Homo sapiens
tacaagaaggatggagcccact

SEQ ID NO: 8102077 - DNA, 22 bp, Homo sapiens
tacaagatgtactaaaaattat

SEQ ID NO: 8102078 - DNA, 22 bp, Homo sapiens
tacaagataagaattggcaagg

SEQ ID NO: 8102079 - DNA, 22 bp, Homo sapiens
tacaagagtgagattatcatgt

SEQ ID NO: 8102080 - DNA, 22 bp, Homo sapiens
taagctctccaggtgatcatga

SEQ ID NO: 8102081 - DNA, 21 bp, Homo sapiens
taaggaagagcattttaggtc

SEQ ID NO: 8102082 - DNA, 22 bp, Homo sapiens
taaggaagagcttggtaatagg

SEQ ID NO: 8102083 - DNA, 22 bp, Homo sapiens
taaggaaggggaaagacatgtc

SEQ ID NO: 8102084 - DNA, 22 bp, Homo sapiens
taaggaagtacccattcttagg

SEQ ID NO: 8102085 - DNA, 22 bp, Homo sapiens
taaggaagtcacaagaatcgct

SEQ ID NO: 8102086 - DNA, 18 bp, Homo sapiens
taaggaagggggtgaaga

SEQ ID NO: 8102087 - DNA, 22 bp, Homo sapiens
taatataccaaactgtaatttt

SEQ ID NO: 8102088 - DNA, 22 bp, Homo sapiens
taatatacttcccatagtttga

SEQ ID NO: 8102089 - DNA, 22 bp, Homo sapiens
taaggaggctgctgtgaagaaa

SEQ ID NO: 8102090 - DNA, 22 bp, Homo sapiens
taaggaggcgaggtggtgagca

SEQ ID NO: 8102091 - DNA, 22 bp, Homo sapiens
taaggaggttggtgggttggat

SEQ ID NO: 8102092 - DNA, 22 bp, Homo sapiens
taattcctagaaattattctca

SEQ ID NO: 8102093 - DNA, 22 bp, Homo sapiens
taattctagattgacattttga

SEQ ID NO: 8102094 - DNA, 22 bp, Homo sapiens
taattatttgaagacattagag

SEQ ID NO: 8102095 - DNA, 22 bp, Homo sapiens
taattattgtctgaagagttat

SEQ ID NO: 8102096 - DNA, 22 bp, Homo sapiens
taatttatgatgcaaagaaaag

SEQ ID NO: 8102097 - DNA, 22 bp, Homo sapiens
taatttatgatgcaaagaaaag

SEQ ID NO: 8102098 - DNA, 22 bp, Homo sapiens
taattattctagtcacatagca

SEQ ID NO: 8102099 - DNA, 22 bp, Homo sapiens
taattattgtctgaagagttat

SEQ ID NO: 8102100 - DNA, 22 bp, Homo sapiens
taattattatgacaacaattgc

SEQ ID NO: 8102101 - DNA, 22 bp, Homo sapiens
taatgaacaatatatcaatagc

SEQ ID NO: 8102102 - DNA, 22 bp, Homo sapiens
taatgaacacagaatttcactt

SEQ ID NO: 8102103 - DNA, 22 bp, Homo sapiens
taattattatgacaacaattgc

SEQ ID NO: 8102104 - DNA, 22 bp, Homo sapiens
taattattatgacaacaattgc

SEQ ID NO: 8102105 - DNA, 23 bp, Homo sapiens
taatatcctgcaatgcacagaac

SEQ ID NO: 8102106 - DNA, 22 bp, Homo sapiens
taatctctctaagtttccattt

SEQ ID NO: 8102107 - DNA, 22 bp, Homo sapiens
tacagttaaaaagttcaatggt

SEQ ID NO: 8102108 - DNA, 22 bp, Homo sapiens
tacagtgtctggatatcaaagg

SEQ ID NO: 8102109 - DNA, 22 bp, Homo sapiens
tacatgcatgtcacagaatgaa

SEQ ID NO: 8102110 - DNA, 22 bp, Homo sapiens
taccaaatgtaatcattctaat

SEQ ID NO: 8102111 - DNA, 22 bp, Homo sapiens
taccaaggtagtggagacagaa

SEQ ID NO: 8102112 - DNA, 22 bp, Homo sapiens
taccaagtgtattatgctttgt

SEQ ID NO: 8102113 - DNA, 22 bp, Homo sapiens
tacagagatactctagatcaaa

SEQ ID NO: 8102114 - DNA, 22 bp, Homo sapiens
tacagagatactctagatcaaa

SEQ ID NO: 8102115 - DNA, 22 bp, Homo sapiens
tacagtgtccctttttcagaca

SEQ ID NO: 8102116 - DNA, 22 bp, Homo sapiens
tacagtgtctgcaactgcacac

SEQ ID NO: 8102117 - DNA, 20 bp, Homo sapiens
tacagtgtatgtatttaggc

SEQ ID NO: 8102118 - DNA, 22 bp, Homo sapiens
tacagtgaatgaatggctgtgc

SEQ ID NO: 8102119 - DNA, 19 bp, Homo sapiens
tacagtgaaccaggaggag

SEQ ID NO: 8102120 - DNA, 22 bp, Homo sapiens
tactgttcatgccttcataaag

SEQ ID NO: 8102121 - DNA, 22 bp, Homo sapiens
tacttaaaaattatcaaagtgg

SEQ ID NO: 8102122 - DNA, 22 bp, Homo sapiens
tacttacagagcttataagtta

SEQ ID NO: 8102123 - DNA, 22 bp, Homo sapiens
tactccaggactccatttgaaa

SEQ ID NO: 8102124 - DNA, 22 bp, Homo sapiens
tactccagacattctgtcctcg

SEQ ID NO: 8102125 - DNA, 22 bp, Homo sapiens
tactgttaatgttaaattcagg

SEQ ID NO: 8102126 - DNA, 22 bp, Homo sapiens
tactataacttcgaagtcctgg

SEQ ID NO: 8102127 - DNA, 22 bp, Homo sapiens
tactaggaagcagctgcattgg

SEQ ID NO: 8102128 - DNA, 22 bp, Homo sapiens
tactacatacagaatttagaga

SEQ ID NO: 8102129 - DNA, 22 bp, Homo sapiens
tactacattaataaaacattca

SEQ ID NO: 8102130 - DNA, 22 bp, Homo sapiens
tactactttcccccacatattt

SEQ ID NO: 8102131 - DNA, 22 bp, Homo sapiens
tactacaaggccgaagctctca

SEQ ID NO: 8102132 - DNA, 22 bp, Homo sapiens
taccacagacagatttcagtaa

SEQ ID NO: 8102133 - DNA, 22 bp, Homo sapiens
taccacaggccaaatttgaggt

SEQ ID NO: 8102134 - DNA, 22 bp, Homo sapiens
taccacagtttatctattcagc

SEQ ID NO: 8102135 - DNA, 22 bp, Homo sapiens
taccagggaacagggatattaa

SEQ ID NO: 8102136 - DNA, 22 bp, Homo sapiens
tagtttcatatgcaaaatagta

SEQ ID NO: 8102137 - DNA, 22 bp, Homo sapiens
tagttcttcatgaattcagctt

SEQ ID NO: 8102138 - DNA, 22 bp, Homo sapiens
tagttatggagtaattttaagc

SEQ ID NO: 8102139 - DNA, 22 bp, Homo sapiens
tagttatgtcagctctgcagag

SEQ ID NO: 8102140 - DNA, 22 bp, Homo sapiens
tagttatgtctgcatgcatatt

SEQ ID NO: 8102141 - DNA, 22 bp, Homo sapiens
taggggtcccactctcagagtt

SEQ ID NO: 8102142 - DNA, 22 bp, Homo sapiens
taggggtcttgttggcatcacg

SEQ ID NO: 8102143 - DNA, 22 bp, Homo sapiens
taggggaggggatcatgtgctg

SEQ ID NO: 8102144 - DNA, 22 bp, Homo sapiens
tagtgccctcccctttgggata

SEQ ID NO: 8102145 - DNA, 21 bp, Homo sapiens
taggcagaggagcaggtatct

SEQ ID NO: 8102146 - DNA, 22 bp, Homo sapiens
tagctgtgtagacactcagagc

SEQ ID NO: 8102147 - DNA, 20 bp, Homo sapiens
taggcagagctgtgcagcct

SEQ ID NO: 8102148 - DNA, 22 bp, Homo sapiens
taggccattccttctcttgatc

SEQ ID NO: 8102149 - DNA, 22 bp, Homo sapiens
tagcaaactaccacaaactggg

SEQ ID NO: 8102150 - DNA, 22 bp, Homo sapiens
tagatgaagcaacatgtgtaat

SEQ ID NO: 8102151 - DNA, 22 bp, Homo sapiens
tagatctgatacaattcatctg

SEQ ID NO: 8102152 - DNA, 23 bp, Homo sapiens
tagatcctatggctgtgtgcaga

SEQ ID NO: 8102153 - DNA, 22 bp, Homo sapiens
tagcaaatgggcttgttttcca

SEQ ID NO: 8102154 - DNA, 22 bp, Homo sapiens
tagcaaatgtaaaatgcctaca

SEQ ID NO: 8102155 - DNA, 22 bp, Homo sapiens
tagcaaatgtgttatgctatgc

SEQ ID NO: 8102156 - DNA, 22 bp, Homo sapiens
tagaactaaagaacaactttga

SEQ ID NO: 8102157 - DNA, 22 bp, Homo sapiens
tagaactagaacaaggatttga

SEQ ID NO: 8102158 - DNA, 22 bp, Homo sapiens
tagaagaacatgtcaaactata

SEQ ID NO: 8102159 - DNA, 22 bp, Homo sapiens
tagaccaggggagtcaacaggt

SEQ ID NO: 8102160 - DNA, 22 bp, Homo sapiens
tagagtcagagaatcattacag

SEQ ID NO: 8102161 - DNA, 22 bp, Homo sapiens
tagagtcagagaatcattacag

SEQ ID NO: 8102162 - DNA, 22 bp, Homo sapiens
tagagaatggccttgaagtagt

SEQ ID NO: 8102163 - DNA, 22 bp, Homo sapiens
tagagagagatatatacacaca

SEQ ID NO: 8102164 - DNA, 22 bp, Homo sapiens
tagagagagctgtggtggctct

SEQ ID NO: 8102165 - DNA, 20 bp, Homo sapiens
tagagagatatgggggttcc

SEQ ID NO: 8102166 - DNA, 20 bp, Homo sapiens
tagagagaggatattaaagt

SEQ ID NO: 8102167 - DNA, 22 bp, Homo sapiens
tagagtcctgtgtgctctgtgg

SEQ ID NO: 8102168 - DNA, 22 bp, Homo sapiens
tagagtccttcattctgtgcag

SEQ ID NO: 8102169 - DNA, 22 bp, Homo sapiens
tattacaatttacattgcactt

SEQ ID NO: 8102170 - DNA, 23 bp, Homo sapiens
tattacaattggtcttattaaga

SEQ ID NO: 8102171 - DNA, 22 bp, Homo sapiens
tatttaataaaactatggcatg

SEQ ID NO: 8102172 - DNA, 22 bp, Homo sapiens
tatttgcaggacatagatatgg

SEQ ID NO: 8102173 - DNA, 22 bp, Homo sapiens
tatttcttgttattctcgttga

SEQ ID NO: 8102174 - DNA, 22 bp, Homo sapiens
tatttcttgttattctcgttga

SEQ ID NO: 8102175 - DNA, 22 bp, Homo sapiens
tatttcttgttattctcgttga

SEQ ID NO: 8102176 - DNA, 22 bp, Homo sapiens
tatttgaagggagaaagtgcca

SEQ ID NO: 8102177 - DNA, 22 bp, Homo sapiens
tatttgaagggagaaagtgcca

SEQ ID NO: 8102178 - DNA, 22 bp, Homo sapiens
tcaaagatgggttttgtttgat

SEQ ID NO: 8102179 - DNA, 22 bp, Homo sapiens
tcaaagattgaaactaaggaga

SEQ ID NO: 8102180 - DNA, 22 bp, Homo sapiens
tcaaagatgataggaaatcata

SEQ ID NO: 8102181 - DNA, 22 bp, Homo sapiens
tcaaagatgataggaaatcata

SEQ ID NO: 8102182 - DNA, 22 bp, Homo sapiens
tcaaagatcagatggttgtagg

SEQ ID NO: 8102183 - DNA, 22 bp, Homo sapiens
tcaaagactatatattttattt

SEQ ID NO: 8102184 - DNA, 22 bp, Homo sapiens
tcaaagactatatattttattt

SEQ ID NO: 8102185 - DNA, 22 bp, Homo sapiens
tattttgaggtatttttgagct

SEQ ID NO: 8102186 - DNA, 22 bp, Homo sapiens
tcaaaaataagatattctggac

SEQ ID NO: 8102187 - DNA, 22 bp, Homo sapiens
tcaaaaataagatattctggac

SEQ ID NO: 8102188 - DNA, 22 bp, Homo sapiens
tatttttgcctctcagataaaa

SEQ ID NO: 8102189 - DNA, 22 bp, Homo sapiens
tcaaatctcactctgcatttct

SEQ ID NO: 8102190 - DNA, 22 bp, Homo sapiens
tcaaatctcactctgcatttct

SEQ ID NO: 8102191 - DNA, 22 bp, Homo sapiens
tcaaatctttgaccacttatgt

SEQ ID NO: 8102192 - DNA, 22 bp, Homo sapiens
tcaaatctttaacatgtgcaaa

SEQ ID NO: 8102193 - DNA, 22 bp, Homo sapiens
tcaaatatgtgatagaagctaa

SEQ ID NO: 8102194 - DNA, 22 bp, Homo sapiens
tcaaatattggctatttcacat

SEQ ID NO: 8102195 - DNA, 22 bp, Homo sapiens
tcaaatattggctatttcacat

SEQ ID NO: 8102196 - DNA, 22 bp, Homo sapiens
tcaaataccagcaatttcatgt

SEQ ID NO: 8102197 - DNA, 22 bp, Homo sapiens
tcaaatacatggtcaatcaact

SEQ ID NO: 8102198 - DNA, 22 bp, Homo sapiens
tcaaataatgccattcatcatc

SEQ ID NO: 8102199 - DNA, 22 bp, Homo sapiens
tcaaatagttgacattaacttg

SEQ ID NO: 8102200 - DNA, 22 bp, Homo sapiens
tcaaatatgtgatagaagctaa

SEQ ID NO: 8102201 - DNA, 22 bp, Homo sapiens
tcaaataatgccattcatcatc

SEQ ID NO: 8102202 - DNA, 22 bp, Homo sapiens
tcaaataatgccattcatcatc

SEQ ID NO: 8102203 - DNA, 18 bp, Homo sapiens
tcaaagtctggctccact

SEQ ID NO: 8102204 - DNA, 22 bp, Homo sapiens
tcaaagtcacaactctctaatt

SEQ ID NO: 8102205 - DNA, 22 bp, Homo sapiens
tcaaagtatctcatggagagca

SEQ ID NO: 8102206 - DNA, 17 bp, Homo sapiens
tcaaagtattctgatgc

SEQ ID NO: 8102207 - DNA, 22 bp, Homo sapiens
tcaaagtattttaactgtatcc

SEQ ID NO: 8102208 - DNA, 22 bp, Homo sapiens
tcaaagtataattgcttttttg

SEQ ID NO: 8102209 - DNA, 22 bp, Homo sapiens
tcaaagtatatcccttcgaaac

SEQ ID NO: 8102210 - DNA, 22 bp, Homo sapiens
tcaaagtaagattgttgaagct

SEQ ID NO: 8102211 - DNA, 22 bp, Homo sapiens
tcaaagtaagaatttattacaa

SEQ ID NO: 8102212 - DNA, 22 bp, Homo sapiens
tcaaagtactactcagttcagc

SEQ ID NO: 8102213 - DNA, 22 bp, Homo sapiens
tcaaagtaccagagtgaactga

SEQ ID NO: 8102214 - DNA, 22 bp, Homo sapiens
tcaaagtaccattatcagtgga

SEQ ID NO: 8102215 - DNA, 22 bp, Homo sapiens
tcaaagtagagttcagtgcagc

SEQ ID NO: 8102216 - DNA, 22 bp, Homo sapiens
tcaaagtagccggatggaattt

SEQ ID NO: 8102217 - DNA, 22 bp, Homo sapiens
tcaaagtactactcagttcagc

SEQ ID NO: 8102218 - DNA, 22 bp, Homo sapiens
tcaaagtagagttcagtgcagc

SEQ ID NO: 8102219 - DNA, 22 bp, Homo sapiens
tcaaagtaaaagtatagagttt

SEQ ID NO: 8102220 - DNA, 22 bp, Homo sapiens
tcaaagtaagaatttattacaa

SEQ ID NO: 8102221 - DNA, 22 bp, Homo sapiens
tcaaagtaaaagtatagagttt

SEQ ID NO: 8102222 - DNA, 18 bp, Homo sapiens
tataaacacacttaggtt

SEQ ID NO: 8102223 - DNA, 22 bp, Homo sapiens
tataaaacagaaagcactacct

SEQ ID NO: 8102224 - DNA, 22 bp, Homo sapiens
tataaagctgactcatgaaact

SEQ ID NO: 8102225 - DNA, 22 bp, Homo sapiens
tataaagaatccagaagagaca

SEQ ID NO: 8102226 - DNA, 22 bp, Homo sapiens
tatcaccagagggatagtctct

SEQ ID NO: 8102227 - DNA, 22 bp, Homo sapiens
tatcacatttggagatttatga

SEQ ID NO: 8102228 - DNA, 22 bp, Homo sapiens
tatcagaaatgccttaaattgg

SEQ ID NO: 8102229 - DNA, 22 bp, Homo sapiens
tatcagaaatgccttaaattgg

SEQ ID NO: 8102230 - DNA, 22 bp, Homo sapiens
tatcagaaagatattactgggg

SEQ ID NO: 8102231 - DNA, 22 bp, Homo sapiens
tatcagaaggcacatggagtct

SEQ ID NO: 8102232 - DNA, 21 bp, Homo sapiens
tatcagaagagaaagaatgat

SEQ ID NO: 8102233 - DNA, 21 bp, Homo sapiens
tatcagaagagaaagaatgat

SEQ ID NO: 8102234 - DNA, 17 bp, Homo sapiens
tatcagaatgtgtttac

SEQ ID NO: 8102235 - DNA, 22 bp, Homo sapiens
tatcagcaggccaaagctgcaa

SEQ ID NO: 8102236 - DNA, 22 bp, Homo sapiens
tatcagcaggccaaagctgcaa

SEQ ID NO: 8102237 - DNA, 22 bp, Homo sapiens
tatcagcatctcctcaaagata

SEQ ID NO: 8102238 - DNA, 22 bp, Homo sapiens
tatgaaaaggtggccaatgtag

SEQ ID NO: 8102239 - DNA, 18 bp, Homo sapiens
tatcttttccagtggtat

SEQ ID NO: 8102240 - DNA, 22 bp, Homo sapiens
tatccaaaggaacaatcacagc

SEQ ID NO: 8102241 - DNA, 22 bp, Homo sapiens
tatccaaagagattcatgttct

SEQ ID NO: 8102242 - DNA, 22 bp, Homo sapiens
tatgacaagaaatacagaggta

SEQ ID NO: 8102243 - DNA, 22 bp, Homo sapiens
tatgacaaggtggagtatgagt

SEQ ID NO: 8102244 - DNA, 22 bp, Homo sapiens
tatgaagtgtctgttgtatctg

SEQ ID NO: 8102245 - DNA, 22 bp, Homo sapiens
tatgaagtgagttatggttgct

SEQ ID NO: 8102246 - DNA, 22 bp, Homo sapiens
tatgaaatttctagttctgctt

SEQ ID NO: 8102247 - DNA, 22 bp, Homo sapiens
tatgaaattgccatttttatgg

SEQ ID NO: 8102248 - DNA, 22 bp, Homo sapiens
tattaacattttatgaaaataa

SEQ ID NO: 8102249 - DNA, 22 bp, Homo sapiens
tattaattcttgccaattctcc

SEQ ID NO: 8102250 - DNA, 22 bp, Homo sapiens
tattaatatgtgtgtgcatgta

SEQ ID NO: 8102251 - DNA, 22 bp, Homo sapiens
tattaacacgtataaagtgttt

SEQ ID NO: 8102252 - DNA, 22 bp, Homo sapiens
tatgtcactcggctcggcccac

SEQ ID NO: 8102253 - DNA, 19 bp, Homo sapiens
tatgtccctttcccccatt

SEQ ID NO: 8102254 - DNA, 22 bp, Homo sapiens
tatggcttcttttgcaactact

SEQ ID NO: 8102255 - DNA, 22 bp, Homo sapiens
tatgggtctggaaaatggcttg

SEQ ID NO: 8102256 - DNA, 22 bp, Homo sapiens
tatggtcaaagatatgaagccc

SEQ ID NO: 8102257 - DNA, 22 bp, Homo sapiens
tatggtcatttgttagtgcttt

SEQ ID NO: 8102258 - DNA, 22 bp, Homo sapiens
gagagctgtaatagtcatgtct

SEQ ID NO: 8102259 - DNA, 22 bp, Homo sapiens
gagagctgtccggctgagcagc

SEQ ID NO: 8102260 - DNA, 22 bp, Homo sapiens
gagagctgtcagcgtagcaccg

SEQ ID NO: 8102261 - DNA, 22 bp, Homo sapiens
gagagctgtccggctgagcagc

SEQ ID NO: 8102262 - DNA, 22 bp, Homo sapiens
gagaggagtccctatcacagtt

SEQ ID NO: 8102263 - DNA, 22 bp, Homo sapiens
gagaggagtagacactttggtt

SEQ ID NO: 8102264 - DNA, 18 bp, Homo sapiens
gagaggagccagaatttt

SEQ ID NO: 8102265 - DNA, 22 bp, Homo sapiens
gagagagaaccccgtgcccttc

SEQ ID NO: 8102266 - DNA, 22 bp, Homo sapiens
gagagagaaggcctgtgggtgt

SEQ ID NO: 8102267 - DNA, 22 bp, Homo sapiens
gagagagaaaatgactccggac

SEQ ID NO: 8102268 - DNA, 22 bp, Homo sapiens
gagagcaggctctcgggggcca

SEQ ID NO: 8102269 - DNA, 22 bp, Homo sapiens
gagagcaggaggcagcgggacg

SEQ ID NO: 8102270 - DNA, 22 bp, Homo sapiens
gagaaagggaacttacagagtg

SEQ ID NO: 8102271 - DNA, 19 bp, Homo sapiens
gactcacaccttccgctgt

SEQ ID NO: 8102272 - DNA, 22 bp, Homo sapiens
gactccagagtgactatttgtc

SEQ ID NO: 8102273 - DNA, 22 bp, Homo sapiens
gactccagaatctggacggtcc

SEQ ID NO: 8102274 - DNA, 22 bp, Homo sapiens
gagcaggaaggccagaagggtc

SEQ ID NO: 8102275 - DNA, 23 bp, Homo sapiens
gagcagagcgggcgggggtcctg

SEQ ID NO: 8102276 - DNA, 22 bp, Homo sapiens
gagcagagacagtacaactggc

SEQ ID NO: 8102277 - DNA, 22 bp, Homo sapiens
gagcacgttgaagcgcactgtc

SEQ ID NO: 8102278 - DNA, 22 bp, Homo sapiens
gagcagagaatccagctaagtg

SEQ ID NO: 8102279 - DNA, 22 bp, Homo sapiens
gagaggcaggcgctgcaatggt

SEQ ID NO: 8102280 - DNA, 22 bp, Homo sapiens
gacagctgaaaaatgtaaggta

SEQ ID NO: 8102281 - DNA, 22 bp, Homo sapiens
gacagccaactggggagggcat

SEQ ID NO: 8102282 - DNA, 22 bp, Homo sapiens
gacagcagtcctggagttccca

SEQ ID NO: 8102283 - DNA, 22 bp, Homo sapiens
gacagtgattagttactataaa

SEQ ID NO: 8102284 - DNA, 22 bp, Homo sapiens
gacatcaattcagcattttaag

SEQ ID NO: 8102285 - DNA, 22 bp, Homo sapiens
gacatctgaatattagagagaa

SEQ ID NO: 8102286 - DNA, 22 bp, Homo sapiens
gacatctgaggccctcagagcc

SEQ ID NO: 8102287 - DNA, 22 bp, Homo sapiens
gacctggattcaaattcagact

SEQ ID NO: 8102288 - DNA, 22 bp, Homo sapiens
gaccttgtgatccacccgcctt

SEQ ID NO: 8102289 - DNA, 22 bp, Homo sapiens
gaccttcttgctgtgtcctaac

SEQ ID NO: 8102290 - DNA, 22 bp, Homo sapiens
gactatttagtttcagattagt

SEQ ID NO: 8102291 - DNA, 22 bp, Homo sapiens
gacctggtgcaggtggacagag

SEQ ID NO: 8102292 - DNA, 22 bp, Homo sapiens
gaatttatctacgttaagtatg

SEQ ID NO: 8102293 - DNA, 20 bp, Homo sapiens
gacaacacagcttcaggtcc

SEQ ID NO: 8102294 - DNA, 22 bp, Homo sapiens
gacagcagccacagggagaggg

SEQ ID NO: 8102295 - DNA, 22 bp, Homo sapiens
gacagcagggaaagtccagacc

SEQ ID NO: 8102296 - DNA, 22 bp, Homo sapiens
gacagcaggagatcatgataga

SEQ ID NO: 8102297 - DNA, 22 bp, Homo sapiens
gacaaataggtcaacaggaggg

SEQ ID NO: 8102298 - DNA, 22 bp, Homo sapiens
gacaaagtgctaaaccacagag

SEQ ID NO: 8102299 - DNA, 22 bp, Homo sapiens
gaatgcacttccaacatctatt

SEQ ID NO: 8102300 - DNA, 22 bp, Homo sapiens
gaatgcacacgtgtgtgcatgc

SEQ ID NO: 8102301 - DNA, 22 bp, Homo sapiens
gaatggaaactgggagatggcc

SEQ ID NO: 8102302 - DNA, 22 bp, Homo sapiens
gaattaactggcagttagtgct

SEQ ID NO: 8102303 - DNA, 22 bp, Homo sapiens
gaatttaaggaccaagcatttt

SEQ ID NO: 8102304 - DNA, 22 bp, Homo sapiens
gagggtggtggcttaaggtgct

SEQ ID NO: 8102305 - DNA, 22 bp, Homo sapiens
gagggtgggtacaccagccctc

SEQ ID NO: 8102306 - DNA, 22 bp, Homo sapiens
gagggtgggtttcttgcacgtc

SEQ ID NO: 8102307 - DNA, 22 bp, Homo sapiens
gagggtggggaatagactgcta

SEQ ID NO: 8102308 - DNA, 22 bp, Homo sapiens
gagggtggcctttagagcccat

SEQ ID NO: 8102309 - DNA, 22 bp, Homo sapiens
gagggtgggctcctatctgggt

SEQ ID NO: 8102310 - DNA, 22 bp, Homo sapiens
gagggtgggctttgttcctcca

SEQ ID NO: 8102311 - DNA, 22 bp, Homo sapiens
gagggtgggctttgttcctcca

SEQ ID NO: 8102312 - DNA, 20 bp, Homo sapiens
gagggtgggacttcctaggc

SEQ ID NO: 8102313 - DNA, 22 bp, Homo sapiens
gagggtggctcctccctgggcc

SEQ ID NO: 8102314 - DNA, 22 bp, Homo sapiens
gagggtggcctttagagcccat

SEQ ID NO: 8102315 - DNA, 22 bp, Homo sapiens
gagggtggagctccagaatctg

SEQ ID NO: 8102316 - DNA, 22 bp, Homo sapiens
gagggtggaagagctgctgaga

SEQ ID NO: 8102317 - DNA, 22 bp, Homo sapiens
gagggtggaaagggtgtacctg

SEQ ID NO: 8102318 - DNA, 22 bp, Homo sapiens
gagggtggaaagggtgtacctg

SEQ ID NO: 8102319 - DNA, 22 bp, Homo sapiens
gaggtgagtggatcacgaggtc

SEQ ID NO: 8102320 - DNA, 22 bp, Homo sapiens
gaggtggctgcttgctgggaaa

SEQ ID NO: 8102321 - DNA, 22 bp, Homo sapiens
gaggtggctccttcagggaata

SEQ ID NO: 8102322 - DNA, 22 bp, Homo sapiens
gaggtggctgggagtagggaat

SEQ ID NO: 8102323 - DNA, 18 bp, Homo sapiens
gaggtggctgggccatct

SEQ ID NO: 8102324 - DNA, 22 bp, Homo sapiens
gaggtggctggctcagagccag

SEQ ID NO: 8102325 - DNA, 22 bp, Homo sapiens
gaggtggctggctcagagccag

SEQ ID NO: 8102326 - DNA, 22 bp, Homo sapiens
gaggtggcttagtctctggaca

SEQ ID NO: 8102327 - DNA, 22 bp, Homo sapiens
gaggtgggagggcagtccctaa

SEQ ID NO: 8102328 - DNA, 22 bp, Homo sapiens
gaggtgggagggcagtccctaa

SEQ ID NO: 8102329 - DNA, 22 bp, Homo sapiens
gagtacatagagccaggcgtgt

SEQ ID NO: 8102330 - DNA, 22 bp, Homo sapiens
gaggcctgtcgctaggcctctg

SEQ ID NO: 8102331 - DNA, 22 bp, Homo sapiens
gaggcctggtttccagcatcct

SEQ ID NO: 8102332 - DNA, 22 bp, Homo sapiens
gaggcctggtgctgtgtccaca

SEQ ID NO: 8102333 - DNA, 22 bp, Homo sapiens
gaggcggaggttgcagtgagct

SEQ ID NO: 8102334 - DNA, 22 bp, Homo sapiens
gaggcggaggttgcagtgagcc

SEQ ID NO: 8102335 - DNA, 22 bp, Homo sapiens
gaggcgggcagatcacctgagg

SEQ ID NO: 8102336 - DNA, 22 bp, Homo sapiens
gaggctggtggttagttccatt

SEQ ID NO: 8102337 - DNA, 22 bp, Homo sapiens
gagggccacgttcagggctctc

SEQ ID NO: 8102338 - DNA, 22 bp, Homo sapiens
gagggaagattccccatatggg

SEQ ID NO: 8102339 - DNA, 22 bp, Homo sapiens
gagggaagtcataatgttctag

SEQ ID NO: 8102340 - DNA, 21 bp, Homo sapiens
gaggctgtctgctgctggcct

SEQ ID NO: 8102341 - DNA, 22 bp, Homo sapiens
gagggccagatcccaggaggaa

SEQ ID NO: 8102342 - DNA, 22 bp, Homo sapiens
gagggccaggcggagacaggcg

SEQ ID NO: 8102343 - DNA, 22 bp, Homo sapiens
gagggctgataaatgcgcatgg

SEQ ID NO: 8102344 - DNA, 22 bp, Homo sapiens
gaggactgcagatgggtgcatc

SEQ ID NO: 8102345 - DNA, 22 bp, Homo sapiens
gaggaccacagatgagcctgca

SEQ ID NO: 8102346 - DNA, 22 bp, Homo sapiens
gaggagagagggactgtctgca

SEQ ID NO: 8102347 - DNA, 22 bp, Homo sapiens
gaggaggttgacggcactgtga

SEQ ID NO: 8102348 - DNA, 22 bp, Homo sapiens
gaggatgctgcagtgcaggaca

SEQ ID NO: 8102349 - DNA, 22 bp, Homo sapiens
gaggcctggaattccagcctgg

SEQ ID NO: 8102350 - DNA, 22 bp, Homo sapiens
gaggccacggaagggagctgtg

SEQ ID NO: 8102351 - DNA, 22 bp, Homo sapiens
gaggcatgcagagctggagcag

SEQ ID NO: 8102352 - DNA, 22 bp, Homo sapiens
gagctcagcccaaagagcagtg

SEQ ID NO: 8102353 - DNA, 22 bp, Homo sapiens
gagctcagcccaaagagcagtg

SEQ ID NO: 8102354 - DNA, 22 bp, Homo sapiens
gagctcagcactaaaatcatgt

SEQ ID NO: 8102355 - DNA, 22 bp, Homo sapiens
gagctcagattctggtgtcaga

SEQ ID NO: 8102356 - DNA, 22 bp, Homo sapiens
gagctcagcaaaggtctgtgtg

SEQ ID NO: 8102357 - DNA, 18 bp, Homo sapiens
gagctcagcgtgtttcta

SEQ ID NO: 8102358 - DNA, 22 bp, Homo sapiens
gagctcaggagcatcagaagaa

SEQ ID NO: 8102359 - DNA, 22 bp, Homo sapiens
gagctcagcctgaggcctggct

SEQ ID NO: 8102360 - DNA, 22 bp, Homo sapiens
gagctcagcctgaggcctggct

SEQ ID NO: 8102361 - DNA, 22 bp, Homo sapiens
gagctccaccaccttcaggcag

SEQ ID NO: 8102362 - DNA, 22 bp, Homo sapiens
gagctcagggcattgagcaaga

SEQ ID NO: 8102363 - DNA, 22 bp, Homo sapiens
gagctcaggtggtcaaaacaat

SEQ ID NO: 8102364 - DNA, 23 bp, Homo sapiens
gagctcaggtagggctcgcccgc

SEQ ID NO: 8102365 - DNA, 22 bp, Homo sapiens
gagctcagtgtagtcatggctt

SEQ ID NO: 8102366 - DNA, 22 bp, Homo sapiens
gagcaggcaaagatgaaaggag

SEQ ID NO: 8102367 - DNA, 22 bp, Homo sapiens
gagcaggcaactctgcagtgcc

SEQ ID NO: 8102368 - DNA, 22 bp, Homo sapiens
gagcaggcattctagtggctga

SEQ ID NO: 8102369 - DNA, 22 bp, Homo sapiens
gagcaggctctgcctgtgtgtc

SEQ ID NO: 8102370 - DNA, 22 bp, Homo sapiens
gagctcagactcgggcctgggg

SEQ ID NO: 8102371 - DNA, 22 bp, Homo sapiens
gagctcagagcctatagttggt

SEQ ID NO: 8102372 - DNA, 22 bp, Homo sapiens
gagctcagaggattctggggag

SEQ ID NO: 8102373 - DNA, 22 bp, Homo sapiens
gagctcagaggcgtctttgtcc

SEQ ID NO: 8102374 - DNA, 22 bp, Homo sapiens
gagctgggcacacgccacttga

SEQ ID NO: 8102375 - DNA, 22 bp, Homo sapiens
gagctgggtctccaccttggca

SEQ ID NO: 8102376 - DNA, 22 bp, Homo sapiens
gagctgggtctccaccttggca

SEQ ID NO: 8102377 - DNA, 17 bp, Homo sapiens
gaggacagggaagtagg

SEQ ID NO: 8102378 - DNA, 22 bp, Homo sapiens
cttgctttatctggtttctcat

SEQ ID NO: 8102379 - DNA, 22 bp, Homo sapiens
cttcttcatgtattgatagtct

SEQ ID NO: 8102380 - DNA, 20 bp, Homo sapiens
cttcttcattaaccctactg

SEQ ID NO: 8102381 - DNA, 22 bp, Homo sapiens
cttcttccagttataagagctt

SEQ ID NO: 8102382 - DNA, 22 bp, Homo sapiens
cttcttctctacatcctttgat

SEQ ID NO: 8102383 - DNA, 22 bp, Homo sapiens
ctttccaatgtcactatgaatc

SEQ ID NO: 8102384 - DNA, 22 bp, Homo sapiens
ctttccagacctccttgtagct

SEQ ID NO: 8102385 - DNA, 22 bp, Homo sapiens
cttggaggaggtggtgcttgat

SEQ ID NO: 8102386 - DNA, 22 bp, Homo sapiens
cttggaggaaaggcagggagac

SEQ ID NO: 8102387 - DNA, 22 bp, Homo sapiens
ctttccttctcgtggttctcac

SEQ ID NO: 8102388 - DNA, 22 bp, Homo sapiens
ctttccttaataagcaggtata

SEQ ID NO: 8102389 - DNA, 23 bp, Homo sapiens
ctttcctttctttgacacccagc

SEQ ID NO: 8102390 - DNA, 22 bp, Homo sapiens
ctttctcttacccaaggatctg

SEQ ID NO: 8102391 - DNA, 22 bp, Homo sapiens
ctttctctgtgtttcacatgct

SEQ ID NO: 8102392 - DNA, 22 bp, Homo sapiens
ctttctcttcactgtcatgatc

SEQ ID NO: 8102393 - DNA, 22 bp, Homo sapiens
ctttgcatgggtctgaaggctt

SEQ ID NO: 8102394 - DNA, 20 bp, Homo sapiens
ctttctctaatttataagta

SEQ ID NO: 8102395 - DNA, 22 bp, Homo sapiens
ctttctctgtgtggtaaagggc

SEQ ID NO: 8102396 - DNA, 22 bp, Homo sapiens
ctttctctgtggtgaggagggt

SEQ ID NO: 8102397 - DNA, 22 bp, Homo sapiens
ctttctctggaggggagtggtt

SEQ ID NO: 8102398 - DNA, 19 bp, Homo sapiens
cttctgtgatacatcagtc

SEQ ID NO: 8102399 - DNA, 22 bp, Homo sapiens
cttctgtgaatgaagtgtggga

SEQ ID NO: 8102400 - DNA, 22 bp, Homo sapiens
cttctgtgaccaccagcagccc

SEQ ID NO: 8102401 - DNA, 22 bp, Homo sapiens
cttcttcagcacaatattgatg

SEQ ID NO: 8102402 - DNA, 20 bp, Homo sapiens
cttcttcagcctatgcttca

SEQ ID NO: 8102403 - DNA, 20 bp, Homo sapiens
cttcttcagtagtttgttct

SEQ ID NO: 8102404 - DNA, 22 bp, Homo sapiens
cttcccagacggggtggcagcc

SEQ ID NO: 8102405 - DNA, 22 bp, Homo sapiens
cttccaggtccttcttgagaag

SEQ ID NO: 8102406 - DNA, 22 bp, Homo sapiens
cttcactgtttggttcacagca

SEQ ID NO: 8102407 - DNA, 22 bp, Homo sapiens
cttcactgatgggacagctcaa

SEQ ID NO: 8102408 - DNA, 22 bp, Homo sapiens
cttcacagtctttatttcctcc

SEQ ID NO: 8102409 - DNA, 20 bp, Homo sapiens
cttcaaaggcagtaacagcc

SEQ ID NO: 8102410 - DNA, 22 bp, Homo sapiens
cttcaaagggtcactatttatc

SEQ ID NO: 8102411 - DNA, 20 bp, Homo sapiens
ctgttaaaaggtatgaattc

SEQ ID NO: 8102412 - DNA, 16 bp, Homo sapiens
cttcacagaggagagt

SEQ ID NO: 8102413 - DNA, 22 bp, Homo sapiens
cttcacagagtccctgattgtt

SEQ ID NO: 8102414 - DNA, 22 bp, Homo sapiens
cttcacagcatgagctttggag

SEQ ID NO: 8102415 - DNA, 22 bp, Homo sapiens
cttcacagatgctgagagggct

SEQ ID NO: 8102416 - DNA, 23 bp, Homo sapiens
cttcacaggttcaggggattaag

SEQ ID NO: 8102417 - DNA, 22 bp, Homo sapiens
cttcacaggcaagtctgttttt

SEQ ID NO: 8102418 - DNA, 22 bp, Homo sapiens
cttcacagccaacatgggcaca

SEQ ID NO: 8102419 - DNA, 22 bp, Homo sapiens
cttcacagtaaatccagaagaa

SEQ ID NO: 8102420 - DNA, 22 bp, Homo sapiens
cttcacagtataggtccctgag

SEQ ID NO: 8102421 - DNA, 22 bp, Homo sapiens
cttcacagtcaccctgctgtgt

SEQ ID NO: 8102422 - DNA, 22 bp, Homo sapiens
gaaagactcttgatgtctttgg

SEQ ID NO: 8102423 - DNA, 22 bp, Homo sapiens
gaaatacagaaagggctgaatg

SEQ ID NO: 8102424 - DNA, 22 bp, Homo sapiens
gaaagagaacctgggcctagat

SEQ ID NO: 8102425 - DNA, 22 bp, Homo sapiens
gaaatacaggaatgccacacag

SEQ ID NO: 8102426 - DNA, 22 bp, Homo sapiens
gaaatatacattgcaggaagag

SEQ ID NO: 8102427 - DNA, 22 bp, Homo sapiens
gaaaccagctagaggcagaggg

SEQ ID NO: 8102428 - DNA, 22 bp, Homo sapiens
gaaaaagtgaccttggtagcta

SEQ ID NO: 8102429 - DNA, 22 bp, Homo sapiens
cttttttcctaaggcaacatga

SEQ ID NO: 8102430 - DNA, 22 bp, Homo sapiens
gaaacttacttactcacatttc

SEQ ID NO: 8102431 - DNA, 22 bp, Homo sapiens
gaaactgagtaggctagagcac

SEQ ID NO: 8102432 - DNA, 22 bp, Homo sapiens
gaaacgaagctctagattagaa

SEQ ID NO: 8102433 - DNA, 22 bp, Homo sapiens
ctttttcttctaggtgtgcctg

SEQ ID NO: 8102434 - DNA, 16 bp, Homo sapiens
ctttttctcccctctt

SEQ ID NO: 8102435 - DNA, 22 bp, Homo sapiens
ctttttctgatgttccatgatt

SEQ ID NO: 8102436 - DNA, 22 bp, Homo sapiens
ctttttctaatcataattgtct

SEQ ID NO: 8102437 - DNA, 22 bp, Homo sapiens
ctttttctaatcataattgtct

SEQ ID NO: 8102438 - DNA, 20 bp, Homo sapiens
ctttttctccagctctgagc

SEQ ID NO: 8102439 - DNA, 22 bp, Homo sapiens
ctgggagttgacgaggcttgta

SEQ ID NO: 8102440 - DNA, 22 bp, Homo sapiens
ctgggccaggaccagggttgaa

SEQ ID NO: 8102441 - DNA, 22 bp, Homo sapiens
ctgggcccaggcggctctcgga

SEQ ID NO: 8102442 - DNA, 22 bp, Homo sapiens
ctgggaggcggaggttgcagtg

SEQ ID NO: 8102443 - DNA, 22 bp, Homo sapiens
ctgggagtactgggggatgtca

SEQ ID NO: 8102444 - DNA, 22 bp, Homo sapiens
ctgggagtcaccaggagcaagg

SEQ ID NO: 8102445 - DNA, 22 bp, Homo sapiens
ctgggagtgaaaggagggctgc

SEQ ID NO: 8102446 - DNA, 22 bp, Homo sapiens
ctgggagtcagtataagaagca

SEQ ID NO: 8102447 - DNA, 22 bp, Homo sapiens
ctgggcctccagctctgccagc

SEQ ID NO: 8102448 - DNA, 22 bp, Homo sapiens
ctgggcctccagctctgccagc

SEQ ID NO: 8102449 - DNA, 22 bp, Homo sapiens
ctgggcctccacgggccatcac

SEQ ID NO: 8102450 - DNA, 22 bp, Homo sapiens
ctgggctcaagaagtcttccct

SEQ ID NO: 8102451 - DNA, 22 bp, Homo sapiens
ctgggctcaaatcctggccctg

SEQ ID NO: 8102452 - DNA, 22 bp, Homo sapiens
ctgggctcagcccatgctgtcc

SEQ ID NO: 8102453 - DNA, 22 bp, Homo sapiens
ctgggctccactacttgctaac

SEQ ID NO: 8102454 - DNA, 22 bp, Homo sapiens
ctgggctcagtggctcatggct

SEQ ID NO: 8102455 - DNA, 22 bp, Homo sapiens
ctgggcctagcaacagaggagt

SEQ ID NO: 8102456 - DNA, 22 bp, Homo sapiens
ctgggcctaacccacagcgttt

SEQ ID NO: 8102457 - DNA, 22 bp, Homo sapiens
ctgggcctagaggaagctgaca

SEQ ID NO: 8102458 - DNA, 22 bp, Homo sapiens
ctgggcctcaatctcagagttt

SEQ ID NO: 8102459 - DNA, 22 bp, Homo sapiens
ctgggcctcaagctcagatttc

SEQ ID NO: 8102460 - DNA, 22 bp, Homo sapiens
ctgggcctcatgcacagagatg

SEQ ID NO: 8102461 - DNA, 22 bp, Homo sapiens
ctgggcctcatcctcagagttt

SEQ ID NO: 8102462 - DNA, 22 bp, Homo sapiens
ctgggcctcatccccagagttt

SEQ ID NO: 8102463 - DNA, 22 bp, Homo sapiens
ctgggcctcatccagccacaac

SEQ ID NO: 8102464 - DNA, 22 bp, Homo sapiens
ctggttcaagtcctggctctgt

SEQ ID NO: 8102465 - DNA, 22 bp, Homo sapiens
ctggtgcctcctccctgtgctt

SEQ ID NO: 8102466 - DNA, 22 bp, Homo sapiens
ctggtagctcctgaatatccct

SEQ ID NO: 8102467 - DNA, 22 bp, Homo sapiens
ctggggggctactgacagagga

SEQ ID NO: 8102468 - DNA, 22 bp, Homo sapiens
ctggggtctcaattctagcggg

SEQ ID NO: 8102469 - DNA, 22 bp, Homo sapiens
ctggggtccttgccatgtgtca

SEQ ID NO: 8102470 - DNA, 22 bp, Homo sapiens
ctggggtcagggatcagagagc

SEQ ID NO: 8102471 - DNA, 22 bp, Homo sapiens
ctggggctgtaggaggacttat

SEQ ID NO: 8102472 - DNA, 20 bp, Homo sapiens
ctgggctcggtggccctggc

SEQ ID NO: 8102473 - DNA, 22 bp, Homo sapiens
ctgggctccctcatgtgtctgc

SEQ ID NO: 8102474 - DNA, 22 bp, Homo sapiens
ctgtggggaagatagaaccgac

SEQ ID NO: 8102475 - DNA, 22 bp, Homo sapiens
ctgtggggagctgatcagatca

SEQ ID NO: 8102476 - DNA, 22 bp, Homo sapiens
ctgtgtttgctatgcaaagaca

SEQ ID NO: 8102477 - DNA, 22 bp, Homo sapiens
ctgtgttttgattaaaaagcaa

SEQ ID NO: 8102478 - DNA, 22 bp, Homo sapiens
ctgtgtttctaagtaaaggagc

SEQ ID NO: 8102479 - DNA, 22 bp, Homo sapiens
ctgtgggagggtgagagaacca

SEQ ID NO: 8102480 - DNA, 22 bp, Homo sapiens
ctgtggagtttgtggcgctgac

SEQ ID NO: 8102481 - DNA, 22 bp, Homo sapiens
ctgtgaggcgggtggagtggag

SEQ ID NO: 8102482 - DNA, 22 bp, Homo sapiens
ctgtgaggccctgggtgctgga

SEQ ID NO: 8102483 - DNA, 22 bp, Homo sapiens
ctgtctgttcagattcattact

SEQ ID NO: 8102484 - DNA, 22 bp, Homo sapiens
ctgtgaaatgctttgcgatggt

SEQ ID NO: 8102485 - DNA, 22 bp, Homo sapiens
ctgtgaacaatagcagcatctt

SEQ ID NO: 8102486 - DNA, 22 bp, Homo sapiens
ctgtgacagtttctcagaattt

SEQ ID NO: 8102487 - DNA, 22 bp, Homo sapiens
ctgtgacagtttctcagacttt

SEQ ID NO: 8102488 - DNA, 23 bp, Homo sapiens
ctggttcatagtcaagagattga

SEQ ID NO: 8102489 - DNA, 22 bp, Homo sapiens
ctggttcacatctgtttatctg

SEQ ID NO: 8102490 - DNA, 22 bp, Homo sapiens
ctggttcaatactaaacttctt

SEQ ID NO: 8102491 - DNA, 22 bp, Homo sapiens
ctggttcagtgaaaggcatggg

SEQ ID NO: 8102492 - DNA, 22 bp, Homo sapiens
ctggttcaatggggctgagccc

SEQ ID NO: 8102493 - DNA, 22 bp, Homo sapiens
ctggttcattaggtattagtgg

SEQ ID NO: 8102494 - DNA, 22 bp, Homo sapiens
ctggttcatccccttccaggaa

SEQ ID NO: 8102495 - DNA, 22 bp, Homo sapiens
ctggttcatggtggaatgacat

SEQ ID NO: 8102496 - DNA, 22 bp, Homo sapiens
ctggttcatataggcaagttta

SEQ ID NO: 8102497 - DNA, 22 bp, Homo sapiens
ctggttcatcgcggccacttat

SEQ ID NO: 8102498 - DNA, 22 bp, Homo sapiens
ctgtccatattcaaggggtagg

SEQ ID NO: 8102499 - DNA, 22 bp, Homo sapiens
ctatacactttttgaaaataga

SEQ ID NO: 8102500 - DNA, 22 bp, Homo sapiens
ctataattatgctcaaaatgta

SEQ ID NO: 8102501 - DNA, 22 bp, Homo sapiens
ttctggctcatatgctaagaag

SEQ ID NO: 8102502 - DNA, 22 bp, Homo sapiens
ttctggcatctgggggaggcct

SEQ ID NO: 8102503 - DNA, 22 bp, Homo sapiens
ttctggctctcccctgctgggt

SEQ ID NO: 8102504 - DNA, 22 bp, Homo sapiens
ctatacatcccaatttcagaga

SEQ ID NO: 8102505 - DNA, 19 bp, Homo sapiens
ctcacctctgtgcgccccc

SEQ ID NO: 8102506 - DNA, 22 bp, Homo sapiens
ctcactgcaacctctgcctccc

SEQ ID NO: 8102507 - DNA, 21 bp, Homo sapiens
ctcagagcagttcagagggat

SEQ ID NO: 8102508 - DNA, 22 bp, Homo sapiens
ctcagagagttaagtgaattac

SEQ ID NO: 8102509 - DNA, 22 bp, Homo sapiens
ctcagagatatagtccctgctt

SEQ ID NO: 8102510 - DNA, 22 bp, Homo sapiens
ctcagagagacaatgtgggaca

SEQ ID NO: 8102511 - DNA, 22 bp, Homo sapiens
ctcagagaggttgaacaacttg

SEQ ID NO: 8102512 - DNA, 19 bp, Homo sapiens
ctcagagaggggcagtgcc

SEQ ID NO: 8102513 - DNA, 22 bp, Homo sapiens
ctcactgcaagctcagcctccc

SEQ ID NO: 8102514 - DNA, 22 bp, Homo sapiens
ttctttctgaatacagttgagt

SEQ ID NO: 8102515 - DNA, 22 bp, Homo sapiens
ttctttctggggtccttcggct

SEQ ID NO: 8102516 - DNA, 22 bp, Homo sapiens
ttctttctgtcatggtgtactg

SEQ ID NO: 8102517 - DNA, 22 bp, Homo sapiens
ttctttctgtccataatgagac

SEQ ID NO: 8102518 - DNA, 22 bp, Homo sapiens
ctcagagaaatgtcacaacaat

SEQ ID NO: 8102519 - DNA, 22 bp, Homo sapiens
ctagagagcttttaaaaatact

SEQ ID NO: 8102520 - DNA, 22 bp, Homo sapiens
ctagataaggatttctcaactt

SEQ ID NO: 8102521 - DNA, 22 bp, Homo sapiens
ctagataacttattttcaagga

SEQ ID NO: 8102522 - DNA, 22 bp, Homo sapiens
ttctatgccatgttcagctact

SEQ ID NO: 8102523 - DNA, 23 bp, Homo sapiens
cgttttttcctcagatgttctgg

SEQ ID NO: 8102524 - DNA, 20 bp, Homo sapiens
ttctatggaccagtatattt

SEQ ID NO: 8102525 - DNA, 22 bp, Homo sapiens
ttctgcatctcacagccagtgc

SEQ ID NO: 8102526 - DNA, 22 bp, Homo sapiens
ttggaagggtttcagttagtct

SEQ ID NO: 8102527 - DNA, 22 bp, Homo sapiens
ttggaaggggcagagtggctgc

SEQ ID NO: 8102528 - DNA, 22 bp, Homo sapiens
ttggaagggaaccgagtttgct

SEQ ID NO: 8102529 - DNA, 22 bp, Homo sapiens
ttggaagggatattggcatatg

SEQ ID NO: 8102530 - DNA, 22 bp, Homo sapiens
ttggaaggttctggtcatggtt

SEQ ID NO: 8102531 - DNA, 22 bp, Homo sapiens
ttggaaggtgagtccctgggtt

SEQ ID NO: 8102532 - DNA, 20 bp, Homo sapiens
ttggaaggtggagaagagga

SEQ ID NO: 8102533 - DNA, 23 bp, Homo sapiens
ttggaagggaagagcatttgaga

SEQ ID NO: 8102534 - DNA, 22 bp, Homo sapiens
ttggaaggccagcaccttgagt

SEQ ID NO: 8102535 - DNA, 22 bp, Homo sapiens
ttggaaggccctgcctagcagg

SEQ ID NO: 8102536 - DNA, 22 bp, Homo sapiens
ttggaagggaacaccatttgac

SEQ ID NO: 8102537 - DNA, 22 bp, Homo sapiens
ttggaaggctgaatggcctctc

SEQ ID NO: 8102538 - DNA, 22 bp, Homo sapiens
ttggaaaagtgaaactagatgc

SEQ ID NO: 8102539 - DNA, 22 bp, Homo sapiens
ctcagtgaattggaggatggcc

SEQ ID NO: 8102540 - DNA, 22 bp, Homo sapiens
ctcagtcatgacgctcaggacc

SEQ ID NO: 8102541 - DNA, 22 bp, Homo sapiens
ttggaaggagcctaaaagagac

SEQ ID NO: 8102542 - DNA, 22 bp, Homo sapiens
ttggaaggaagaaccgcggtag

SEQ ID NO: 8102543 - DNA, 22 bp, Homo sapiens
ttggaaggaattaaggtcatga

SEQ ID NO: 8102544 - DNA, 22 bp, Homo sapiens
ttggaaggaccaggccttgatt

SEQ ID NO: 8102545 - DNA, 19 bp, Homo sapiens
ttggaaggagccagagtgg

SEQ ID NO: 8102546 - DNA, 22 bp, Homo sapiens
ttggaaggcagcatttgtccat

SEQ ID NO: 8102547 - DNA, 22 bp, Homo sapiens
ttggaaggagtcaaccagctga

SEQ ID NO: 8102548 - DNA, 22 bp, Homo sapiens
ttggaaggagtctttggggatg

SEQ ID NO: 8102549 - DNA, 22 bp, Homo sapiens
ttggaaggatttagagatgtct

SEQ ID NO: 8102550 - DNA, 22 bp, Homo sapiens
ctccagaggatgcaggtgaggg

SEQ ID NO: 8102551 - DNA, 22 bp, Homo sapiens
ctccagcctcatctcctggctg

SEQ ID NO: 8102552 - DNA, 22 bp, Homo sapiens
ttgccctgaagaacgtcccaga

SEQ ID NO: 8102553 - DNA, 22 bp, Homo sapiens
ttgccctgcctccctgaggtga

SEQ ID NO: 8102554 - DNA, 22 bp, Homo sapiens
ttgccctggggctggcctggca

SEQ ID NO: 8102555 - DNA, 22 bp, Homo sapiens
ttgccctgcgggtcctgcgcaa

SEQ ID NO: 8102556 - DNA, 22 bp, Homo sapiens
ttgccctgcgttaccatctctt

SEQ ID NO: 8102557 - DNA, 22 bp, Homo sapiens
ttgccctgtcttaagctggcaa

SEQ ID NO: 8102558 - DNA, 22 bp, Homo sapiens
ttgccctgtggggcctccagcc

SEQ ID NO: 8102559 - DNA, 22 bp, Homo sapiens
ttgcatcagtcctcaataaaat

SEQ ID NO: 8102560 - DNA, 22 bp, Homo sapiens
ttgcccagagtccacagcgtac

SEQ ID NO: 8102561 - DNA, 22 bp, Homo sapiens
ctcagggcttgagtgtccagga

SEQ ID NO: 8102562 - DNA, 22 bp, Homo sapiens
ctcaggaggccattctcaaggt

SEQ ID NO: 8102563 - DNA, 22 bp, Homo sapiens
ctcaggagacagtgtccacatg

SEQ ID NO: 8102564 - DNA, 22 bp, Homo sapiens
ctcagccccaatttgccctctt

SEQ ID NO: 8102565 - DNA, 22 bp, Homo sapiens
cggcagagacggcgctttgaac

SEQ ID NO: 8102566 - DNA, 22 bp, Homo sapiens
cggcagagccctgagtcagcct

SEQ ID NO: 8102567 - DNA, 22 bp, Homo sapiens
cggcagagcttcctgctcagcg

SEQ ID NO: 8102568 - DNA, 22 bp, Homo sapiens
cggcagagcggcgagcccctcc

SEQ ID NO: 8102569 - DNA, 22 bp, Homo sapiens
cggcagagtgtgtgcgtgcatg

SEQ ID NO: 8102570 - DNA, 18 bp, Homo sapiens
cggcagagtgcttctagc

SEQ ID NO: 8102571 - DNA, 22 bp, Homo sapiens
cggagtcttgctatgttgccca

SEQ ID NO: 8102572 - DNA, 20 bp, Homo sapiens
cggactttcttctcagggca

SEQ ID NO: 8102573 - DNA, 22 bp, Homo sapiens
ttcaaatgcaagttactacttt

SEQ ID NO: 8102574 - DNA, 22 bp, Homo sapiens
ttcaaatggttagactgttagc

SEQ ID NO: 8102575 - DNA, 22 bp, Homo sapiens
ttcaaattaccacatttgctta

SEQ ID NO: 8102576 - DNA, 22 bp, Homo sapiens
ttcaaatacattctttgccact

SEQ ID NO: 8102577 - DNA, 21 bp, Homo sapiens
ttcaaagtttgcctaaagatt

SEQ ID NO: 8102578 - DNA, 22 bp, Homo sapiens
ttcaaagtttcaatctgtatca

SEQ ID NO: 8102579 - DNA, 22 bp, Homo sapiens
ttcaaatgatggcagtcctggc

SEQ ID NO: 8102580 - DNA, 22 bp, Homo sapiens
ttcaaatctctcctaatccact

SEQ ID NO: 8102581 - DNA, 22 bp, Homo sapiens
ttcaaagtgcatgttcctcaga

SEQ ID NO: 8102582 - DNA, 22 bp, Homo sapiens
ttcaaagtgctgttcaaagtag

SEQ ID NO: 8102583 - DNA, 22 bp, Homo sapiens
ttcaaagtgctgttcaaagtag

SEQ ID NO: 8102584 - DNA, 22 bp, Homo sapiens
ttcaaagtgcttttaaccttta

SEQ ID NO: 8102585 - DNA, 22 bp, Homo sapiens
ttcaaagtgcttttaaccttta

SEQ ID NO: 8102586 - DNA, 20 bp, Homo sapiens
ttcaaagtgtatgatatgca

SEQ ID NO: 8102587 - DNA, 22 bp, Homo sapiens
ttcaaagtgtgacctgacaagc

SEQ ID NO: 8102588 - DNA, 22 bp, Homo sapiens
ttcaaagttgcatgacagctta

SEQ ID NO: 8102589 - DNA, 22 bp, Homo sapiens
ttcaaagttgcatgacagctta

SEQ ID NO: 8102590 - DNA, 22 bp, Homo sapiens
cggggagggcagaggctccctc

SEQ ID NO: 8102591 - DNA, 22 bp, Homo sapiens
cggggaggcttcggattaaagc

SEQ ID NO: 8102592 - DNA, 22 bp, Homo sapiens
cgtgggccccagccactccctc

SEQ ID NO: 8102593 - DNA, 22 bp, Homo sapiens
cgtgggaggaaaaatgggcttc

SEQ ID NO: 8102594 - DNA, 22 bp, Homo sapiens
cgtggggcgggtggacacttgc

SEQ ID NO: 8102595 - DNA, 22 bp, Homo sapiens
cgtggggacccacgtgcagcac

SEQ ID NO: 8102596 - DNA, 22 bp, Homo sapiens
cgtgggctgcgcccagttcttc

SEQ ID NO: 8102597 - DNA, 22 bp, Homo sapiens
cggggctggcacaggtgaccac

SEQ ID NO: 8102598 - DNA, 22 bp, Homo sapiens
cgtgagcaaaatggacactccc

SEQ ID NO: 8102599 - DNA, 22 bp, Homo sapiens
cggggctgctcgtcctcctgtg

SEQ ID NO: 8102600 - DNA, 22 bp, Homo sapiens
cggggcctaccgctgcgtggcc

SEQ ID NO: 8102601 - DNA, 22 bp, Homo sapiens
cggggcctcagtttccccacct

SEQ ID NO: 8102602 - DNA, 22 bp, Homo sapiens
cggggcctagctgcacaccctc

SEQ ID NO: 8102603 - DNA, 22 bp, Homo sapiens
cggggcctagtctacctcggca

SEQ ID NO: 8102604 - DNA, 22 bp, Homo sapiens
ttcaaagtcagccatctggcta

SEQ ID NO: 8102605 - DNA, 22 bp, Homo sapiens
ttcaaagtcctgtcaggtagcc

SEQ ID NO: 8102606 - DNA, 22 bp, Homo sapiens
ttcaaagtagggtagggggtcc

SEQ ID NO: 8102607 - DNA, 22 bp, Homo sapiens
cgctgccaggatcccctgccgg

SEQ ID NO: 8102608 - DNA, 22 bp, Homo sapiens
cgctgccaggtcaccaggggta

SEQ ID NO: 8102609 - DNA, 22 bp, Homo sapiens
ttatttcatgtaaaatttatgt

SEQ ID NO: 8102610 - DNA, 22 bp, Homo sapiens
cgcctcagccgtggtcatcttc

SEQ ID NO: 8102611 - DNA, 21 bp, Homo sapiens
ttatttcacatggacttccag

SEQ ID NO: 8102612 - DNA, 20 bp, Homo sapiens
ttatttcagttgctagattg

SEQ ID NO: 8102613 - DNA, 22 bp, Homo sapiens
ttattgcatagattatgccata

SEQ ID NO: 8102614 - DNA, 22 bp, Homo sapiens
ttattgcagatggtgtgagaga

SEQ ID NO: 8102615 - DNA, 22 bp, Homo sapiens
ccttttctaggatgctttatag

SEQ ID NO: 8102616 - DNA, 22 bp, Homo sapiens
ccttttctagaaagggaggcaa

SEQ ID NO: 8102617 - DNA, 22 bp, Homo sapiens
ccttttctacaagcaaatgtgc

SEQ ID NO: 8102618 - DNA, 22 bp, Homo sapiens
ccttttctaatcttaagaatgt

SEQ ID NO: 8102619 - DNA, 22 bp, Homo sapiens
ccttttctatgtaccagcagtg

SEQ ID NO: 8102620 - DNA, 16 bp, Homo sapiens
ccttttctcatctcta

SEQ ID NO: 8102621 - DNA, 22 bp, Homo sapiens
ccttttctatccttctaggttc

SEQ ID NO: 8102622 - DNA, 22 bp, Homo sapiens
ccttttctgtgtgggtaattta

SEQ ID NO: 8102623 - DNA, 22 bp, Homo sapiens
ccttttctgtttcctgtcactg

SEQ ID NO: 8102624 - DNA, 22 bp, Homo sapiens
ccttttctgaaccacttaaata

SEQ ID NO: 8102625 - DNA, 22 bp, Homo sapiens
ccttttctggccaccaagcgct

SEQ ID NO: 8102626 - DNA, 22 bp, Homo sapiens
ccttttcttgccactgactcgg

SEQ ID NO: 8102627 - DNA, 22 bp, Homo sapiens
ttattgagtttacagctttaga

SEQ ID NO: 8102628 - DNA, 19 bp, Homo sapiens
ccttttttaacttcagcaa

SEQ ID NO: 8102629 - DNA, 22 bp, Homo sapiens
ccttttttctatgccaactctg

SEQ ID NO: 8102630 - DNA, 22 bp, Homo sapiens
cgagagatgggttggcaggggc

SEQ ID NO: 8102631 - DNA, 22 bp, Homo sapiens
cgagaggctggacagggctggg

SEQ ID NO: 8102632 - DNA, 22 bp, Homo sapiens
ttatcacttatgagctttttgc

SEQ ID NO: 8102633 - DNA, 22 bp, Homo sapiens
ttatcataagtaattgaaataa

SEQ ID NO: 8102634 - DNA, 22 bp, Homo sapiens
ttatcaagggagaaacaggagg

SEQ ID NO: 8102635 - DNA, 22 bp, Homo sapiens
ttatatttctggtagccttcag

SEQ ID NO: 8102636 - DNA, 22 bp, Homo sapiens
ttatattgggtctggtatcagg

SEQ ID NO: 8102637 - DNA, 22 bp, Homo sapiens
ttataacatcaatcagagttaa

SEQ ID NO: 8102638 - DNA, 22 bp, Homo sapiens
ttataaaggtttgtgcatattt

SEQ ID NO: 8102639 - DNA, 22 bp, Homo sapiens
ttataaaggtttgtgcatattt

SEQ ID NO: 8102640 - DNA, 22 bp, Homo sapiens
ttataaagtgagaagtgctatg

SEQ ID NO: 8102641 - DNA, 23 bp, Homo sapiens
ttataaatattttcaggtgtgtt

SEQ ID NO: 8102642 - DNA, 22 bp, Homo sapiens
ttataaagattgttatgtatct

SEQ ID NO: 8102643 - DNA, 22 bp, Homo sapiens
ttataaagattgttatgtatct

SEQ ID NO: 8102644 - DNA, 22 bp, Homo sapiens
ccttgcccgctgcctctgagtt

SEQ ID NO: 8102645 - DNA, 22 bp, Homo sapiens
ccttgaaatgttctcactgggg

SEQ ID NO: 8102646 - DNA, 22 bp, Homo sapiens
ccttgaatctctgctctagaac

SEQ ID NO: 8102647 - DNA, 22 bp, Homo sapiens
ccttgaggagtccatagtatca

SEQ ID NO: 8102648 - DNA, 22 bp, Homo sapiens
ccttcaaagtacacatctttat

SEQ ID NO: 8102649 - DNA, 22 bp, Homo sapiens
ttacatacctcatagactcagg

SEQ ID NO: 8102650 - DNA, 22 bp, Homo sapiens
ttacataaaagttcacgtaggc

SEQ ID NO: 8102651 - DNA, 22 bp, Homo sapiens
ttacataaaagttcacgtaggc

SEQ ID NO: 8102652 - DNA, 22 bp, Homo sapiens
ttacataacggtatgaaaaatg

SEQ ID NO: 8102653 - DNA, 22 bp, Homo sapiens
ttacataacggtatgaaaaatg

SEQ ID NO: 8102654 - DNA, 22 bp, Homo sapiens
ccttcaaatttagaacaagtga

SEQ ID NO: 8102655 - DNA, 18 bp, Homo sapiens
ccttcagctctgccagta

SEQ ID NO: 8102656 - DNA, 22 bp, Homo sapiens
ccttcagccttcatccttcctt

SEQ ID NO: 8102657 - DNA, 22 bp, Homo sapiens
ccttaaaagaactatctcttct

SEQ ID NO: 8102658 - DNA, 22 bp, Homo sapiens
ccttaaattctccatttgaaag

SEQ ID NO: 8102659 - DNA, 22 bp, Homo sapiens
ccttagactggagctatgccgt

SEQ ID NO: 8102660 - DNA, 22 bp, Homo sapiens
ccttacctgattgctggcatcc

SEQ ID NO: 8102661 - DNA, 22 bp, Homo sapiens
ccttacacctaaaatgagagtt

SEQ ID NO: 8102662 - DNA, 22 bp, Homo sapiens
ttacaaagagtgccagagtgtg

SEQ ID NO: 8102663 - DNA, 22 bp, Homo sapiens
ttacaaagagtgccagagtgtg

SEQ ID NO: 8102664 - DNA, 22 bp, Homo sapiens
ttacagaagtttcagcgtttta

SEQ ID NO: 8102665 - DNA, 22 bp, Homo sapiens
ttacagtggtcatttgggaaaa

SEQ ID NO: 8102666 - DNA, 22 bp, Homo sapiens
ttacaaagcgctttacctctga

SEQ ID NO: 8102667 - DNA, 22 bp, Homo sapiens
ttacaaagcgctttacctctga

SEQ ID NO: 8102668 - DNA, 22 bp, Homo sapiens
ttacaaagcaggtcagctgaaa

SEQ ID NO: 8102669 - DNA, 22 bp, Homo sapiens
ttacaaagagtgttcttttcca

SEQ ID NO: 8102670 - DNA, 21 bp, Homo sapiens
ttacaaagcaagtgctgtgtc

SEQ ID NO: 8102671 - DNA, 21 bp, Homo sapiens
ttacaaagcaagtgctgtgtc

SEQ ID NO: 8102672 - DNA, 22 bp, Homo sapiens
ttaagattttcttcagtattat

SEQ ID NO: 8102673 - DNA, 22 bp, Homo sapiens
ttaaattccagcctcataatag

SEQ ID NO: 8102674 - DNA, 22 bp, Homo sapiens
ttaaattattgagggattgtca

SEQ ID NO: 8102675 - DNA, 22 bp, Homo sapiens
tgtcagcatgaaccctgaatta

SEQ ID NO: 8102676 - DNA, 22 bp, Homo sapiens
tgtcagcattgcgtcactgagc

SEQ ID NO: 8102677 - DNA, 22 bp, Homo sapiens
tgtcagcagtatctctatctca

SEQ ID NO: 8102678 - DNA, 22 bp, Homo sapiens
tgtcagcaagacatcagagtga

SEQ ID NO: 8102679 - DNA, 21 bp, Homo sapiens
tgtcagcacgcatgaggccag

SEQ ID NO: 8102680 - DNA, 22 bp, Homo sapiens
ctctgaatactttaagaattgt

SEQ ID NO: 8102681 - DNA, 22 bp, Homo sapiens
tttgaaacccgtcactttgagt

SEQ ID NO: 8102682 - DNA, 22 bp, Homo sapiens
tttgaaacaggtgattcagcta

SEQ ID NO: 8102683 - DNA, 19 bp, Homo sapiens
tttgaaagagttttattgg

SEQ ID NO: 8102684 - DNA, 22 bp, Homo sapiens
ctctgatttatattataaagtg

SEQ ID NO: 8102685 - DNA, 22 bp, Homo sapiens
tttgacattttctcactgtgtt

SEQ ID NO: 8102686 - DNA, 22 bp, Homo sapiens
tttgcaaagtgcttgcagagta

SEQ ID NO: 8102687 - DNA, 22 bp, Homo sapiens
tttgcaaagaaattattgctgt

SEQ ID NO: 8102688 - DNA, 22 bp, Homo sapiens
tttgacttctatctagtaagaa

SEQ ID NO: 8102689 - DNA, 17 bp, Homo sapiens
tttgttcattgaagaga

SEQ ID NO: 8102690 - DNA, 22 bp, Homo sapiens
tttgttcattttgagctcatca

SEQ ID NO: 8102691 - DNA, 22 bp, Homo sapiens
ttttgcttaatctagattttgc

SEQ ID NO: 8102692 - DNA, 17 bp, Homo sapiens
ttttctctcttggattc

SEQ ID NO: 8102693 - DNA, 22 bp, Homo sapiens
ttttctcttccctctggacctg

SEQ ID NO: 8102694 - DNA, 22 bp, Homo sapiens
tttgttcataatggcaaagaga

SEQ ID NO: 8102695 - DNA, 21 bp, Homo sapiens
tttgttcatagctcactcttt

SEQ ID NO: 8102696 - DNA, 18 bp, Homo sapiens
tttccaagaagagagctc

SEQ ID NO: 8102697 - DNA, 22 bp, Homo sapiens
tttcatgttacatttaaaatgt

SEQ ID NO: 8102698 - DNA, 22 bp, Homo sapiens
tttctacagaagatacactgct

SEQ ID NO: 8102699 - DNA, 18 bp, Homo sapiens
tttctcaaggctgacatt

SEQ ID NO: 8102700 - DNA, 22 bp, Homo sapiens
tttatgattaatccaattctgt

SEQ ID NO: 8102701 - DNA, 19 bp, Homo sapiens
tttattcacctttaccttg

SEQ ID NO: 8102702 - DNA, 22 bp, Homo sapiens
tttattcactcattcagccagt

SEQ ID NO: 8102703 - DNA, 22 bp, Homo sapiens
tttattcacttcagtgccaaag

SEQ ID NO: 8102704 - DNA, 22 bp, Homo sapiens
tttattcactcattcagccagt

SEQ ID NO: 8102705 - DNA, 22 bp, Homo sapiens
tttattcactggggtctgcccg

SEQ ID NO: 8102706 - DNA, 22 bp, Homo sapiens
tttatggcacacaaatatcaaa

SEQ ID NO: 8102707 - DNA, 22 bp, Homo sapiens
tttattcatcatctgttcatat

SEQ ID NO: 8102708 - DNA, 22 bp, Homo sapiens
tttattcagcagcagcagtggt

SEQ ID NO: 8102709 - DNA, 20 bp, Homo sapiens
tttattcagcctaccctctt

SEQ ID NO: 8102710 - DNA, 22 bp, Homo sapiens
tttattcattgtttcgtcgcag

SEQ ID NO: 8102711 - DNA, 22 bp, Homo sapiens
tttattccaaagcttgcacttt

SEQ ID NO: 8102712 - DNA, 22 bp, Homo sapiens
tttcagaaccaagagagacatc

SEQ ID NO: 8102713 - DNA, 22 bp, Homo sapiens
tttcagaaattgttattattct

SEQ ID NO: 8102714 - DNA, 22 bp, Homo sapiens
ctccttaaagggagcagcagct

SEQ ID NO: 8102715 - DNA, 22 bp, Homo sapiens
ctccttcaaaagtcatagtaaa

SEQ ID NO: 8102716 - DNA, 22 bp, Homo sapiens
ctccttaagtatgggctgtgca

SEQ ID NO: 8102717 - DNA, 22 bp, Homo sapiens
ctccttaaagggagcagcagct

SEQ ID NO: 8102718 - DNA, 22 bp, Homo sapiens
ctccttcagctgaatccctgct

SEQ ID NO: 8102719 - DNA, 22 bp, Homo sapiens
ctgcagctgtgagtgctggatg

SEQ ID NO: 8102720 - DNA, 22 bp, Homo sapiens
ctgcagcttatttgctgtgtga

SEQ ID NO: 8102721 - DNA, 22 bp, Homo sapiens
ctgcagcctaggtgcagctggg

SEQ ID NO: 8102722 - DNA, 22 bp, Homo sapiens
ctgcccagattttaccacctgc

SEQ ID NO: 8102723 - DNA, 22 bp, Homo sapiens
ctgcccaggaaccagaggggca

SEQ ID NO: 8102724 - DNA, 22 bp, Homo sapiens
ctgcccaggctgaaggaacatc

SEQ ID NO: 8102725 - DNA, 22 bp, Homo sapiens
ctgcccaggaaccagaggggca

SEQ ID NO: 8102726 - DNA, 22 bp, Homo sapiens
ctgcccaggaaggagaggatgg

SEQ ID NO: 8102727 - DNA, 18 bp, Homo sapiens
ctgaggctggcaggagcc

SEQ ID NO: 8102728 - DNA, 18 bp, Homo sapiens
ctgaggctggcaggagcc

SEQ ID NO: 8102729 - DNA, 22 bp, Homo sapiens
ctgaggctggagtgcagtggtg

SEQ ID NO: 8102730 - DNA, 22 bp, Homo sapiens
ctgaggctctgggtgtcactgt

SEQ ID NO: 8102731 - DNA, 22 bp, Homo sapiens
ctgaggcctggtgaggtggtga

SEQ ID NO: 8102732 - DNA, 22 bp, Homo sapiens
ctgaggcctggtgaggtggtga

SEQ ID NO: 8102733 - DNA, 22 bp, Homo sapiens
ctgaggctcaagggcaggtggg

SEQ ID NO: 8102734 - DNA, 22 bp, Homo sapiens
ctcttcctctcatgcggtcata

SEQ ID NO: 8102735 - DNA, 22 bp, Homo sapiens
ttttgcttgagtgcacaaaatg

SEQ ID NO: 8102736 - DNA, 22 bp, Homo sapiens
ctgagcagtgctttgcagtggg

SEQ ID NO: 8102737 - DNA, 19 bp, Homo sapiens
ctgagcaggcaggtaggat

SEQ ID NO: 8102738 - DNA, 22 bp, Homo sapiens
ctgagcaggcggtggagcggct

SEQ ID NO: 8102739 - DNA, 22 bp, Homo sapiens
ctgagcagtagagggtctcttt

SEQ ID NO: 8102740 - DNA, 22 bp, Homo sapiens
ctgagcagtctagccaggtgtt

SEQ ID NO: 8102741 - DNA, 22 bp, Homo sapiens
ctgagcagtctagccaggtgtt

SEQ ID NO: 8102742 - DNA, 22 bp, Homo sapiens
ctgagcagcgtggggagctggc

SEQ ID NO: 8102743 - DNA, 22 bp, Homo sapiens
ctgagcagcgtggggagctggc

SEQ ID NO: 8102744 - DNA, 22 bp, Homo sapiens
ctgagcaggacagtgggagacc

SEQ ID NO: 8102745 - DNA, 22 bp, Homo sapiens
ctgagcagaccatggcagaggt

SEQ ID NO: 8102746 - DNA, 22 bp, Homo sapiens
ctgagcagaccatggcagaggt

SEQ ID NO: 8102747 - DNA, 22 bp, Homo sapiens
ctgagcagaccatggcagaggt

SEQ ID NO: 8102748 - DNA, 19 bp, Homo sapiens
ctgagcagcggcagcactt

SEQ ID NO: 8102749 - DNA, 22 bp, Homo sapiens
ctggagcaggtttaggagtccc

SEQ ID NO: 8102750 - DNA, 22 bp, Homo sapiens
ctggagagttggaagatggact

SEQ ID NO: 8102751 - DNA, 22 bp, Homo sapiens
ctggagaggctgggaacaggtt

SEQ ID NO: 8102752 - DNA, 22 bp, Homo sapiens
ctgctgtgagtttggaggtcta

SEQ ID NO: 8102753 - DNA, 22 bp, Homo sapiens
ctggaaggagaaggaggctgtg

SEQ ID NO: 8102754 - DNA, 22 bp, Homo sapiens
ctggaagggaaatctcttggca

SEQ ID NO: 8102755 - DNA, 22 bp, Homo sapiens
ctggaagggagcactgtagaga

SEQ ID NO: 8102756 - DNA, 22 bp, Homo sapiens
ctggaagggtacataggaaact

SEQ ID NO: 8102757 - DNA, 22 bp, Homo sapiens
ctggaagggggacagccacaca

SEQ ID NO: 8102758 - DNA, 22 bp, Homo sapiens
ctggaaggggcagtctttgggc

SEQ ID NO: 8102759 - DNA, 22 bp, Homo sapiens
ctggaaggctctgctgcctgtc

SEQ ID NO: 8102760 - DNA, 22 bp, Homo sapiens
ctggaaggcggaggttgtagtg

SEQ ID NO: 8102761 - DNA, 22 bp, Homo sapiens
ctggaaggcagaggttgcagtg

SEQ ID NO: 8102762 - DNA, 22 bp, Homo sapiens
ctggaaggagcccgggcggatc

SEQ ID NO: 8102763 - DNA, 19 bp, Homo sapiens
ctggaaggagggactgttc

SEQ ID NO: 8102764 - DNA, 22 bp, Homo sapiens
ctggaaggtgactgtcttgaat

SEQ ID NO: 8102765 - DNA, 22 bp, Homo sapiens
ctggaaggtctgtccccactgc

SEQ ID NO: 8102766 - DNA, 22 bp, Homo sapiens
ctggaaggtggatggcgaggcc

SEQ ID NO: 8102767 - DNA, 22 bp, Homo sapiens
ctggaaggtaacaaggccatta

SEQ ID NO: 8102768 - DNA, 22 bp, Homo sapiens
ctggaagggtctacttagcaga

SEQ ID NO: 8102769 - DNA, 22 bp, Homo sapiens
ctggaagggtcagagtgatgag

SEQ ID NO: 8102770 - DNA, 22 bp, Homo sapiens
ctggaaggttcctcccagctcc

SEQ ID NO: 8102771 - DNA, 19 bp, Homo sapiens
ctgctgggtgctgagggag

SEQ ID NO: 8102772 - DNA, 22 bp, Homo sapiens
ctgctgggtttgcctttcacca

SEQ ID NO: 8102773 - DNA, 22 bp, Homo sapiens
ctgctgagcatcagggctgccc

SEQ ID NO: 8102774 - DNA, 20 bp, Homo sapiens
ctgctgagagcctggcttgc

SEQ ID NO: 8102775 - DNA, 22 bp, Homo sapiens
ctgctgagagctgaaggctgta

SEQ ID NO: 8102776 - DNA, 22 bp, Homo sapiens
ctgctgagatgccaggagctct

SEQ ID NO: 8102777 - DNA, 22 bp, Homo sapiens
ctgctgagaaaagactgaggga

SEQ ID NO: 8102778 - DNA, 22 bp, Homo sapiens
ctgctctgtttcttagctgggt

SEQ ID NO: 8102779 - DNA, 22 bp, Homo sapiens
ctgcggctggggacagctgttg

SEQ ID NO: 8102780 - DNA, 22 bp, Homo sapiens
ctgcggctctgcgggcagctgg

SEQ ID NO: 8102781 - DNA, 22 bp, Homo sapiens
ctgcctgtttcctcttgctccc

SEQ ID NO: 8102782 - DNA, 22 bp, Homo sapiens
ctgcctgtggacaccctggagg

SEQ ID NO: 8102783 - DNA, 22 bp, Homo sapiens
ctgcctgtgtctattccttttt

SEQ ID NO: 8102784 - DNA, 22 bp, Homo sapiens
ctgcctgtgtgtgcctgcagaa

SEQ ID NO: 8102785 - DNA, 22 bp, Homo sapiens
cctccctgcgctcctgcggcgg

SEQ ID NO: 8102786 - DNA, 22 bp, Homo sapiens
cctccctgccggctggactagt

SEQ ID NO: 8102787 - DNA, 22 bp, Homo sapiens
cctccctgctcctcaactggca

SEQ ID NO: 8102788 - DNA, 22 bp, Homo sapiens
tgggccactaccttctctggat

SEQ ID NO: 8102789 - DNA, 22 bp, Homo sapiens
tgggccactgagggtggtcatt

SEQ ID NO: 8102790 - DNA, 22 bp, Homo sapiens
cctcttgccaatcagctacaga

SEQ ID NO: 8102791 - DNA, 22 bp, Homo sapiens
cctgagggtcaaggagccctag

SEQ ID NO: 8102792 - DNA, 22 bp, Homo sapiens
cctgagacatgaaccaggctcc

SEQ ID NO: 8102793 - DNA, 19 bp, Homo sapiens
cctgaccacacaggccttg

SEQ ID NO: 8102794 - DNA, 22 bp, Homo sapiens
cctgaataatttgtgaaaagat

SEQ ID NO: 8102795 - DNA, 22 bp, Homo sapiens
cctgaccctccttagagtccag

SEQ ID NO: 8102796 - DNA, 23 bp, Homo sapiens
cctgaccctgtctccctcacatg

SEQ ID NO: 8102797 - DNA, 22 bp, Homo sapiens
cctgcacagccggacccctgct

SEQ ID NO: 8102798 - DNA, 22 bp, Homo sapiens
cctgcacatgtgtgcgcctgta

SEQ ID NO: 8102799 - DNA, 22 bp, Homo sapiens
cctgcacaggccaggcatctga

SEQ ID NO: 8102800 - DNA, 22 bp, Homo sapiens
cctgccaggagctggtgctgca

SEQ ID NO: 8102801 - DNA, 22 bp, Homo sapiens
cctgcagaagagtccagctcat

SEQ ID NO: 8102802 - DNA, 22 bp, Homo sapiens
cctgcactacctggggctgctg

SEQ ID NO: 8102803 - DNA, 22 bp, Homo sapiens
cctgcaccaggcccagcatggt

SEQ ID NO: 8102804 - DNA, 19 bp, Homo sapiens
tggggtcaagagaggcttc

SEQ ID NO: 8102805 - DNA, 22 bp, Homo sapiens
cctgctgtcagtggggcaggca

SEQ ID NO: 8102806 - DNA, 22 bp, Homo sapiens
cctgctgtccctctgggctcca

SEQ ID NO: 8102807 - DNA, 22 bp, Homo sapiens
cctgctgtagggcccctggggc

SEQ ID NO: 8102808 - DNA, 22 bp, Homo sapiens
cctgctggtttttacaaagatg

SEQ ID NO: 8102809 - DNA, 22 bp, Homo sapiens
cctgctggtgtccaggctttgg

SEQ ID NO: 8102810 - DNA, 22 bp, Homo sapiens
cctgctggtgtccaggctttgg

SEQ ID NO: 8102811 - DNA, 22 bp, Homo sapiens
cctgctggccactgctccacct

SEQ ID NO: 8102812 - DNA, 22 bp, Homo sapiens
cctgctggccagtggagggctg

SEQ ID NO: 8102813 - DNA, 22 bp, Homo sapiens
cctgctggcattcttgctccct

SEQ ID NO: 8102814 - DNA, 22 bp, Homo sapiens
cctgctggcattcttgctccct

SEQ ID NO: 8102815 - DNA, 22 bp, Homo sapiens
cctgctggcagagggggttact

SEQ ID NO: 8102816 - DNA, 22 bp, Homo sapiens
cctgctggcggggacccagtga

SEQ ID NO: 8102817 - DNA, 22 bp, Homo sapiens
cctgctggcgcttgtctgggag

SEQ ID NO: 8102818 - DNA, 22 bp, Homo sapiens
cctgctgggcctgagcaatgag

SEQ ID NO: 8102819 - DNA, 22 bp, Homo sapiens
cctgctgggacgtgtggttgcc

SEQ ID NO: 8102820 - DNA, 20 bp, Homo sapiens
cctgctgggaaccctctgaa

SEQ ID NO: 8102821 - DNA, 20 bp, Homo sapiens
cctgctgggaaccctctgaa

SEQ ID NO: 8102822 - DNA, 22 bp, Homo sapiens
cctgctggctctgttgctcggc

SEQ ID NO: 8102823 - DNA, 22 bp, Homo sapiens
cctgctggctctgttgctcggc

SEQ ID NO: 8102824 - DNA, 22 bp, Homo sapiens
cctgctggctggtagagttccg

SEQ ID NO: 8102825 - DNA, 22 bp, Homo sapiens
cctgctggcgtggctggcgccc

SEQ ID NO: 8102826 - DNA, 22 bp, Homo sapiens
cctgctggacgtggaggagggg

SEQ ID NO: 8102827 - DNA, 22 bp, Homo sapiens
cctgctggacctcaacacattt

SEQ ID NO: 8102828 - DNA, 22 bp, Homo sapiens
cctgctgcttaggccatatttc

SEQ ID NO: 8102829 - DNA, 22 bp, Homo sapiens
cctgctggacaggggtgttcat

SEQ ID NO: 8102830 - DNA, 22 bp, Homo sapiens
tggtcttagctggaaggaggga

SEQ ID NO: 8102831 - DNA, 22 bp, Homo sapiens
tggtctgataccggattccagt

SEQ ID NO: 8102832 - DNA, 22 bp, Homo sapiens
tggtctgagcaactgccctatc

SEQ ID NO: 8102833 - DNA, 22 bp, Homo sapiens
tggtctgattccacctaactga

SEQ ID NO: 8102834 - DNA, 22 bp, Homo sapiens
tggtctgatggtcccaccaccg

SEQ ID NO: 8102835 - DNA, 22 bp, Homo sapiens
tggtctgcctggatcacagccc

SEQ ID NO: 8102836 - DNA, 22 bp, Homo sapiens
tggtctgattcttgctccccaa

SEQ ID NO: 8102837 - DNA, 22 bp, Homo sapiens
tgggtcagaatcagagagttgc

SEQ ID NO: 8102838 - DNA, 22 bp, Homo sapiens
cctgccagtcactatgtcacct

SEQ ID NO: 8102839 - DNA, 18 bp, Homo sapiens
cctgccagtctggagcag

SEQ ID NO: 8102840 - DNA, 22 bp, Homo sapiens
cctgccagggccttggaagaaa

SEQ ID NO: 8102841 - DNA, 22 bp, Homo sapiens
cctgccagggccagaggccagc

SEQ ID NO: 8102842 - DNA, 22 bp, Homo sapiens
cctgccaggctttgggcttctg

SEQ ID NO: 8102843 - DNA, 22 bp, Homo sapiens
cctgccaggccagtgagcttcc

SEQ ID NO: 8102844 - DNA, 22 bp, Homo sapiens
cctgccaggcgagtctaggcca

SEQ ID NO: 8102845 - DNA, 22 bp, Homo sapiens
cctgcctgtactagagacccag

SEQ ID NO: 8102846 - DNA, 22 bp, Homo sapiens
cctgcctgtaagatgggtacaa

SEQ ID NO: 8102847 - DNA, 22 bp, Homo sapiens
cctgcctgtactagagacccag

SEQ ID NO: 8102848 - DNA, 22 bp, Homo sapiens
cctgcctgtcatcgcctgcgcc

SEQ ID NO: 8102849 - DNA, 22 bp, Homo sapiens
cctgcctgtcatcgcctgcgcc

SEQ ID NO: 8102850 - DNA, 22 bp, Homo sapiens
cctgcctgtccctcagtccaca

SEQ ID NO: 8102851 - DNA, 23 bp, Homo sapiens
cctgcctgttctaactccatttc

SEQ ID NO: 8102852 - DNA, 22 bp, Homo sapiens
cctgcctgtctttatcccctgt

SEQ ID NO: 8102853 - DNA, 20 bp, Homo sapiens
cctgcctgcctcggctcatt

SEQ ID NO: 8102854 - DNA, 23 bp, Homo sapiens
tgggtcagctgcctccaggacaa

SEQ ID NO: 8102855 - DNA, 22 bp, Homo sapiens
cctgcctgcctgctggccggga

SEQ ID NO: 8102856 - DNA, 22 bp, Homo sapiens
tgtaataccactgttggacatt

SEQ ID NO: 8102857 - DNA, 20 bp, Homo sapiens
cctgctgtgctttccatgga

SEQ ID NO: 8102858 - DNA, 22 bp, Homo sapiens
cctgcttaacattgccatgaca

SEQ ID NO: 8102859 - DNA, 20 bp, Homo sapiens
cctgctgtttccatggggcc

SEQ ID NO: 8102860 - DNA, 22 bp, Homo sapiens
cctgctgttttcttcacttcag

SEQ ID NO: 8102861 - DNA, 22 bp, Homo sapiens
tgtacatacatagatatacaca

SEQ ID NO: 8102862 - DNA, 22 bp, Homo sapiens
cctggagggcgccgcacagtcc

SEQ ID NO: 8102863 - DNA, 22 bp, Homo sapiens
cctcacagcttttcaaagtgga

SEQ ID NO: 8102864 - DNA, 22 bp, Homo sapiens
cctcacagtttggctaactgtg

SEQ ID NO: 8102865 - DNA, 22 bp, Homo sapiens
cctcacagcctcatgcccagcc

SEQ ID NO: 8102866 - DNA, 22 bp, Homo sapiens
ccctgtgccagagaggcaggag

SEQ ID NO: 8102867 - DNA, 22 bp, Homo sapiens
ccctgtgcagatggcagctggg

SEQ ID NO: 8102868 - DNA, 22 bp, Homo sapiens
ccctgtgagcggctggatgcct

SEQ ID NO: 8102869 - DNA, 22 bp, Homo sapiens
ccctgtctgtaccgtgatgagc

SEQ ID NO: 8102870 - DNA, 22 bp, Homo sapiens
ccctgtcacaatggatgacatt

SEQ ID NO: 8102871 - DNA, 22 bp, Homo sapiens
ccctgggataccagacaccaga

SEQ ID NO: 8102872 - DNA, 22 bp, Homo sapiens
ccctgggatggattggcaggaa

SEQ ID NO: 8102873 - DNA, 22 bp, Homo sapiens
tggctcagcctggccctttcat

SEQ ID NO: 8102874 - DNA, 22 bp, Homo sapiens
tggctcagccattcgtgttgcc

SEQ ID NO: 8102875 - DNA, 22 bp, Homo sapiens
tggctaggctccaagagctgga

SEQ ID NO: 8102876 - DNA, 22 bp, Homo sapiens
tggctaggacctctgcggagca

SEQ ID NO: 8102877 - DNA, 23 bp, Homo sapiens
tggctcagctagttttccatttc

SEQ ID NO: 8102878 - DNA, 23 bp, Homo sapiens
tggcctctccccacctggcagaa

SEQ ID NO: 8102879 - DNA, 22 bp, Homo sapiens
tggcctcggcatccagcaagag

SEQ ID NO: 8102880 - DNA, 22 bp, Homo sapiens
tggcctcctcgggctgaccctg

SEQ ID NO: 8102881 - DNA, 22 bp, Homo sapiens
tggctaacaaggtgaaaccccg

SEQ ID NO: 8102882 - DNA, 22 bp, Homo sapiens
tggcctcaagtctgagggcctt

SEQ ID NO: 8102883 - DNA, 21 bp, Homo sapiens
tggccctggccacggctgcca

SEQ ID NO: 8102884 - DNA, 21 bp, Homo sapiens
tggccctggccacggctgcca

SEQ ID NO: 8102885 - DNA, 22 bp, Homo sapiens
tggaagggaaagtttggggtcc

SEQ ID NO: 8102886 - DNA, 22 bp, Homo sapiens
tggaaggctttgctgtccttgc

SEQ ID NO: 8102887 - DNA, 22 bp, Homo sapiens
tggaaggcatttcacacaggat

SEQ ID NO: 8102888 - DNA, 22 bp, Homo sapiens
tggaaggctaggtgctaggccc

SEQ ID NO: 8102889 - DNA, 22 bp, Homo sapiens
tggaaggcaggacctgccttgg

SEQ ID NO: 8102890 - DNA, 22 bp, Homo sapiens
tggaaggcactgggagaagact

SEQ ID NO: 8102891 - DNA, 22 bp, Homo sapiens
tgcctcattaactgtccttaat

SEQ ID NO: 8102892 - DNA, 22 bp, Homo sapiens
tgcctgccttgctgctggacag

SEQ ID NO: 8102893 - DNA, 22 bp, Homo sapiens
tgcctgcctctggcagccctgc

SEQ ID NO: 8102894 - DNA, 21 bp, Homo sapiens
tgcctgcctcctttggctagg

SEQ ID NO: 8102895 - DNA, 22 bp, Homo sapiens
tgcctgcctctggagcccatcc

SEQ ID NO: 8102896 - DNA, 18 bp, Homo sapiens
tgcctgccccgtaagggt

SEQ ID NO: 8102897 - DNA, 22 bp, Homo sapiens
tgcctgcctaggaagctgtgaa

SEQ ID NO: 8102898 - DNA, 22 bp, Homo sapiens
tgcctgccgctgtctagtactg

SEQ ID NO: 8102899 - DNA, 22 bp, Homo sapiens
tgctttatttataaaatagcaa

SEQ ID NO: 8102900 - DNA, 22 bp, Homo sapiens
tgcctgctccagtcctgtccac

SEQ ID NO: 8102901 - DNA, 22 bp, Homo sapiens
tgcctgctaggccctgctgggt

SEQ ID NO: 8102902 - DNA, 22 bp, Homo sapiens
tgcctgctaggcactttcaaac

SEQ ID NO: 8102903 - DNA, 19 bp, Homo sapiens
tgcctgctcctggcttcca

SEQ ID NO: 8102904 - DNA, 22 bp, Homo sapiens
tggaggtcgcgcgggtgctgca

SEQ ID NO: 8102905 - DNA, 22 bp, Homo sapiens
tggaggtggagttggaaactga

SEQ ID NO: 8102906 - DNA, 22 bp, Homo sapiens
tggaggtgaaatgagattttgt

SEQ ID NO: 8102907 - DNA, 22 bp, Homo sapiens
tggaggccaggaaggcagcgag

SEQ ID NO: 8102908 - DNA, 22 bp, Homo sapiens
ccctgctgaatcccatggagtc

SEQ ID NO: 8102909 - DNA, 22 bp, Homo sapiens
ccctgctagtccttccttggct

SEQ ID NO: 8102910 - DNA, 22 bp, Homo sapiens
ccctgctgaagaacgttcatac

SEQ ID NO: 8102911 - DNA, 22 bp, Homo sapiens
ccctgctgaatcccatggagtc

SEQ ID NO: 8102912 - DNA, 22 bp, Homo sapiens
ccctgccttggggtccacaccg

SEQ ID NO: 8102913 - DNA, 22 bp, Homo sapiens
ccctgcagtcctttcttggctc

SEQ ID NO: 8102914 - DNA, 22 bp, Homo sapiens
ccctgcctgtgggcatcaacat

SEQ ID NO: 8102915 - DNA, 20 bp, Homo sapiens
ccctgcagccatgggagtgg

SEQ ID NO: 8102916 - DNA, 22 bp, Homo sapiens
ccctgcagatctagggtccttc

SEQ ID NO: 8102917 - DNA, 22 bp, Homo sapiens
ccctgcagagggatgggggcag

SEQ ID NO: 8102918 - DNA, 22 bp, Homo sapiens
ccctgcagagccagccctgacc

SEQ ID NO: 8102919 - DNA, 21 bp, Homo sapiens
tggaagggaagtcttggttgt

SEQ ID NO: 8102920 - DNA, 22 bp, Homo sapiens
tggaagggaacaggtgggtgtt

SEQ ID NO: 8102921 - DNA, 22 bp, Homo sapiens
ccctgaggagagcgcttcccga

SEQ ID NO: 8102922 - DNA, 17 bp, Homo sapiens
ccctgcaccctactctc

SEQ ID NO: 8102923 - DNA, 22 bp, Homo sapiens
tgatacagtcagctcacaattg

SEQ ID NO: 8102924 - DNA, 22 bp, Homo sapiens
ccatggccaggaaagccaaggt

SEQ ID NO: 8102925 - DNA, 23 bp, Homo sapiens
ccatggccaatgtcaagctacta

SEQ ID NO: 8102926 - DNA, 22 bp, Homo sapiens
ccatggccgccgctgctcagga

SEQ ID NO: 8102927 - DNA, 22 bp, Homo sapiens
cccaagatctaggacagaaaga

SEQ ID NO: 8102928 - DNA, 22 bp, Homo sapiens
cccaaccagaaattgacagaca

SEQ ID NO: 8102929 - DNA, 22 bp, Homo sapiens
cccaaccagaaattgacagaga

SEQ ID NO: 8102930 - DNA, 22 bp, Homo sapiens
tgattatattctaacttcataa

SEQ ID NO: 8102931 - DNA, 22 bp, Homo sapiens
tgattagtccactataatccta

SEQ ID NO: 8102932 - DNA, 22 bp, Homo sapiens
tgcagaggtgttgctgagataa

SEQ ID NO: 8102933 - DNA, 22 bp, Homo sapiens
tgcagaggtgtgcattcttaag

SEQ ID NO: 8102934 - DNA, 22 bp, Homo sapiens
tgcagaggtttccaggcaagtt

SEQ ID NO: 8102935 - DNA, 22 bp, Homo sapiens
tgcagaggtgaaagactagcaa

SEQ ID NO: 8102936 - DNA, 15 bp, Homo sapiens
tgcagaggtacctgg

SEQ ID NO: 8102937 - DNA, 22 bp, Homo sapiens
tgcagcaggtgacaacgagtgg

SEQ ID NO: 8102938 - DNA, 22 bp, Homo sapiens
cccagaggtgaaggaggtggga

SEQ ID NO: 8102939 - DNA, 22 bp, Homo sapiens
cccagagagcacaggtggtggg

SEQ ID NO: 8102940 - DNA, 22 bp, Homo sapiens
tgcagaggtttgtggtgttgct

SEQ ID NO: 8102941 - DNA, 22 bp, Homo sapiens
tgcagaggtttttaatacattt

SEQ ID NO: 8102942 - DNA, 22 bp, Homo sapiens
tgcagtggaaagactcagactt

SEQ ID NO: 8102943 - DNA, 22 bp, Homo sapiens
tgcagtgatgcttctggctcag

SEQ ID NO: 8102944 - DNA, 22 bp, Homo sapiens
tgcagtgaggcagttgggttgg

SEQ ID NO: 8102945 - DNA, 22 bp, Homo sapiens
tgcagtgcctcggcagtgcagc

SEQ ID NO: 8102946 - DNA, 22 bp, Homo sapiens
tgcagtgattaaagtgttaaat

SEQ ID NO: 8102947 - DNA, 22 bp, Homo sapiens
tgcagtctttcctcgagtttgt

SEQ ID NO: 8102948 - DNA, 22 bp, Homo sapiens
tgcagtgagaagcagttatgat

SEQ ID NO: 8102949 - DNA, 22 bp, Homo sapiens
cccagctcccatgttctccaat

SEQ ID NO: 8102950 - DNA, 22 bp, Homo sapiens
cccagcccacggtcctgggtgg

SEQ ID NO: 8102951 - DNA, 22 bp, Homo sapiens
cccagcccatctcaaaggtcta

SEQ ID NO: 8102952 - DNA, 22 bp, Homo sapiens
cccagcccagcgttcgaggggt

SEQ ID NO: 8102953 - DNA, 18 bp, Homo sapiens
cccagcccaccatttctc

SEQ ID NO: 8102954 - DNA, 18 bp, Homo sapiens
cccagcccaccatttctc

SEQ ID NO: 8102955 - DNA, 20 bp, Homo sapiens
cccagcccgggccgcgctcg

SEQ ID NO: 8102956 - DNA, 20 bp, Homo sapiens
cccagcccctacctgttgcc

SEQ ID NO: 8102957 - DNA, 22 bp, Homo sapiens
cccagccctgacctattggaaa

SEQ ID NO: 8102958 - DNA, 22 bp, Homo sapiens
cccagcccccgagtgtctggaa

SEQ ID NO: 8102959 - DNA, 22 bp, Homo sapiens
cccagcagtaaccagtggaaat

SEQ ID NO: 8102960 - DNA, 22 bp, Homo sapiens
cccagcaggtgccatcactctg

SEQ ID NO: 8102961 - DNA, 22 bp, Homo sapiens
cccagccaaggtgctggtgttg

SEQ ID NO: 8102962 - DNA, 22 bp, Homo sapiens
cccagcatttctgggctgcact

SEQ ID NO: 8102963 - DNA, 22 bp, Homo sapiens
tgcagcattgaaatagctaggc

SEQ ID NO: 8102964 - DNA, 22 bp, Homo sapiens
tgcagcagtttaatgcagggtt

SEQ ID NO: 8102965 - DNA, 22 bp, Homo sapiens
tgcagcatgtgtgcaattagtt

SEQ ID NO: 8102966 - DNA, 21 bp, Homo sapiens
tgcatatataagtgcatacac

SEQ ID NO: 8102967 - DNA, 22 bp, Homo sapiens
tgccctcattataagaggctca

SEQ ID NO: 8102968 - DNA, 22 bp, Homo sapiens
tgccctcagcagcagctcctgc

SEQ ID NO: 8102969 - DNA, 19 bp, Homo sapiens
tgccctgcacgctgtcctg

SEQ ID NO: 8102970 - DNA, 19 bp, Homo sapiens
tgccctgcacgctgtcctg

SEQ ID NO: 8102971 - DNA, 22 bp, Homo sapiens
tgcctcagtttcatctgcagaa

SEQ ID NO: 8102972 - DNA, 22 bp, Homo sapiens
tgccctgtcgctcactcccacc

SEQ ID NO: 8102973 - DNA, 22 bp, Homo sapiens
tgaccaaaggtggtttatttgg

SEQ ID NO: 8102974 - DNA, 22 bp, Homo sapiens
tgaccaaagactttagatgttc

SEQ ID NO: 8102975 - DNA, 22 bp, Homo sapiens
tgaccaaagagttgcttgtatt

SEQ ID NO: 8102976 - DNA, 22 bp, Homo sapiens
tgaccaaaaaattccctgtgag

SEQ ID NO: 8102977 - DNA, 23 bp, Homo sapiens
ccagggcccctacaccactgtcc

SEQ ID NO: 8102978 - DNA, 22 bp, Homo sapiens
tgagaaaacagtttgtaataat

SEQ ID NO: 8102979 - DNA, 22 bp, Homo sapiens
ccagggaaactttggagtggag

SEQ ID NO: 8102980 - DNA, 22 bp, Homo sapiens
ccagggaaaggaggttgacttg

SEQ ID NO: 8102981 - DNA, 21 bp, Homo sapiens
ccagggaagaaatgagggcag

SEQ ID NO: 8102982 - DNA, 22 bp, Homo sapiens
tgagagtgccttgtaaacctgc

SEQ ID NO: 8102983 - DNA, 22 bp, Homo sapiens
tgagagtggttcagctcagaag

SEQ ID NO: 8102984 - DNA, 18 bp, Homo sapiens
tgagagtgtgtgctcttg

SEQ ID NO: 8102985 - DNA, 22 bp, Homo sapiens
tgagagtgaaatgtcacatgtc

SEQ ID NO: 8102986 - DNA, 22 bp, Homo sapiens
tgagagttcctcctctttccac

SEQ ID NO: 8102987 - DNA, 23 bp, Homo sapiens
tgagctgggcctgcaggggtctc

SEQ ID NO: 8102988 - DNA, 22 bp, Homo sapiens
tgaggaagttgtttctcttcta

SEQ ID NO: 8102989 - DNA, 22 bp, Homo sapiens
tgaggacaatccctaactcaga

SEQ ID NO: 8102990 - DNA, 22 bp, Homo sapiens
ccagtgggaacactggcattgc

SEQ ID NO: 8102991 - DNA, 22 bp, Homo sapiens
tgagcagaagccctcctggact

SEQ ID NO: 8102992 - DNA, 22 bp, Homo sapiens
tgagctggcacttttcctggga

SEQ ID NO: 8102993 - DNA, 22 bp, Homo sapiens
tgagcccaggagttggaggctg

SEQ ID NO: 8102994 - DNA, 22 bp, Homo sapiens
tctttcaaagctgtagtagatt

SEQ ID NO: 8102995 - DNA, 22 bp, Homo sapiens
tctttcaaagctgtagtagatt

SEQ ID NO: 8102996 - DNA, 22 bp, Homo sapiens
tctttcaaagctgtagtagatt

SEQ ID NO: 8102997 - DNA, 22 bp, Homo sapiens
tctttatttaagtctgttgtaa

SEQ ID NO: 8102998 - DNA, 22 bp, Homo sapiens
tctttaaagttggagcttgcaa

SEQ ID NO: 8102999 - DNA, 21 bp, Homo sapiens
tcttgtgtgctgccctgctac

SEQ ID NO: 8103000 - DNA, 22 bp, Homo sapiens
tcttgtgtggaactgcttttct

SEQ ID NO: 8103001 - DNA, 21 bp, Homo sapiens
ccagcctcagatcagggagct

SEQ ID NO: 8103002 - DNA, 22 bp, Homo sapiens
tcttggtctttcatccttcaac

SEQ ID NO: 8103003 - DNA, 22 bp, Homo sapiens
ccagcctcactggcatcaccta

SEQ ID NO: 8103004 - DNA, 22 bp, Homo sapiens
ccagcccttgaggtctgtccat

SEQ ID NO: 8103005 - DNA, 22 bp, Homo sapiens
ccagcccttgaggtctgtccat

SEQ ID NO: 8103006 - DNA, 22 bp, Homo sapiens
tctgcagacaggaagctgaggc

SEQ ID NO: 8103007 - DNA, 22 bp, Homo sapiens
tctgcagagcctcaggagaaca

SEQ ID NO: 8103008 - DNA, 22 bp, Homo sapiens
tgaaggaatggaggatcagagc

SEQ ID NO: 8103009 - DNA, 22 bp, Homo sapiens
tgaaggaaatgacggcagaaga

SEQ ID NO: 8103010 - DNA, 22 bp, Homo sapiens
tgaaggaaagagggaacatccc

SEQ ID NO: 8103011 - DNA, 22 bp, Homo sapiens
tgaaagcagcaccaataccatt

SEQ ID NO: 8103012 - DNA, 22 bp, Homo sapiens
tgaaaggaaagtacagtgatgc

SEQ ID NO: 8103013 - DNA, 22 bp, Homo sapiens
tgaaaggaagagggctactcct

SEQ ID NO: 8103014 - DNA, 21 bp, Homo sapiens
tctctgtgttcaaggtgccag

SEQ ID NO: 8103015 - DNA, 22 bp, Homo sapiens
tctgaagttcttaaattagttt

SEQ ID NO: 8103016 - DNA, 22 bp, Homo sapiens
tctgaagtgatcatcatttctc

SEQ ID NO: 8103017 - DNA, 22 bp, Homo sapiens
ccagcatcgacttcctgcctga

SEQ ID NO: 8103018 - DNA, 22 bp, Homo sapiens
tctgagagtacgggctgcgcgc

SEQ ID NO: 8103019 - DNA, 22 bp, Homo sapiens
tctgagagtagagctgcctctt

SEQ ID NO: 8103020 - DNA, 22 bp, Homo sapiens
tctgagagtccatctccaagcc

SEQ ID NO: 8103021 - DNA, 22 bp, Homo sapiens
tctgagagtctctgaggcagat

SEQ ID NO: 8103022 - DNA, 21 bp, Homo sapiens
tctgagagcaactgcccttta

SEQ ID NO: 8103023 - DNA, 22 bp, Homo sapiens
tctgagagcaaggcattagcag

SEQ ID NO: 8103024 - DNA, 22 bp, Homo sapiens
tctgagagcatcactggggtac

SEQ ID NO: 8103025 - DNA, 22 bp, Homo sapiens
tctgagagcctctagcctaagt

SEQ ID NO: 8103026 - DNA, 22 bp, Homo sapiens
tctgagagcaggaggagctgct

SEQ ID NO: 8103027 - DNA, 22 bp, Homo sapiens
tctgagagctctggggcccctt

SEQ ID NO: 8103028 - DNA, 22 bp, Homo sapiens
tctgagagctgtagaagcctat

SEQ ID NO: 8103029 - DNA, 22 bp, Homo sapiens
tctgagaggattcctgtcccga

SEQ ID NO: 8103030 - DNA, 22 bp, Homo sapiens
ccagccacagcttccagctcct

SEQ ID NO: 8103031 - DNA, 22 bp, Homo sapiens
ccagccctgcctctcagggccc

SEQ ID NO: 8103032 - DNA, 22 bp, Homo sapiens
ccagcccttagataaacctggc

SEQ ID NO: 8103033 - DNA, 22 bp, Homo sapiens
ccagcccttcccaactggccag

SEQ ID NO: 8103034 - DNA, 22 bp, Homo sapiens
ccagccctgtcaccaactggag

SEQ ID NO: 8103035 - DNA, 19 bp, Homo sapiens
ccagccctgtcacttcttg

SEQ ID NO: 8103036 - DNA, 22 bp, Homo sapiens
tctctgccaccatgagatgggc

SEQ ID NO: 8103037 - DNA, 23 bp, Homo sapiens
tctcctggctgcactgtggccac

SEQ ID NO: 8103038 - DNA, 22 bp, Homo sapiens
ccagcagagttggtttctggta

SEQ ID NO: 8103039 - DNA, 22 bp, Homo sapiens
ccacatttactggatgctcagg

SEQ ID NO: 8103040 - DNA, 22 bp, Homo sapiens
ccacatttactgatgtatgtat

SEQ ID NO: 8103041 - DNA, 21 bp, Homo sapiens
tcctctgcagtgaggtggcct

SEQ ID NO: 8103042 - DNA, 22 bp, Homo sapiens
ccaccctgtgcaggcgtgggta

SEQ ID NO: 8103043 - DNA, 19 bp, Homo sapiens
ccaccctgggagctcactc

SEQ ID NO: 8103044 - DNA, 22 bp, Homo sapiens
tcgggctcctgcacttggagac

SEQ ID NO: 8103045 - DNA, 22 bp, Homo sapiens
tcgcttgaacccaggaagtgga

SEQ ID NO: 8103046 - DNA, 20 bp, Homo sapiens
ccacattttactgtttgcca

SEQ ID NO: 8103047 - DNA, 22 bp, Homo sapiens
ccacatttttgatactctcact

SEQ ID NO: 8103048 - DNA, 22 bp, Homo sapiens
tctatattccagatacagatta

SEQ ID NO: 8103049 - DNA, 22 bp, Homo sapiens
tctcaaatttgttagataaaat

SEQ ID NO: 8103050 - DNA, 22 bp, Homo sapiens
ccactttctgagggaacagcag

SEQ ID NO: 8103051 - DNA, 23 bp, Homo sapiens
tctccctgaggttgttagcatta

SEQ ID NO: 8103052 - DNA, 22 bp, Homo sapiens
tctccctctttgtctgctttgg

SEQ ID NO: 8103053 - DNA, 22 bp, Homo sapiens
tctccctctgtaagatcagggg

SEQ ID NO: 8103054 - DNA, 22 bp, Homo sapiens
tcatgaggatttactagactag

SEQ ID NO: 8103055 - DNA, 22 bp, Homo sapiens
tcatgaggatgactgacccctt

SEQ ID NO: 8103056 - DNA, 22 bp, Homo sapiens
tcatgatttcctggttaaggac

SEQ ID NO: 8103057 - DNA, 22 bp, Homo sapiens
catgaaaaatttactgttaaca

SEQ ID NO: 8103058 - DNA, 22 bp, Homo sapiens
catctttgtaacttccacataa

SEQ ID NO: 8103059 - DNA, 22 bp, Homo sapiens
tcatgcaatctcttgttcagga

SEQ ID NO: 8103060 - DNA, 22 bp, Homo sapiens
tcattcttgatcactagttagt

SEQ ID NO: 8103061 - DNA, 22 bp, Homo sapiens
tcattctcagactcttggcctc

SEQ ID NO: 8103062 - DNA, 22 bp, Homo sapiens
tcatttatcatttgtgctgtag

SEQ ID NO: 8103063 - DNA, 22 bp, Homo sapiens
tccaggcccatggagcagagct

SEQ ID NO: 8103064 - DNA, 22 bp, Homo sapiens
tccaggccccactgaagcccct

SEQ ID NO: 8103065 - DNA, 22 bp, Homo sapiens
tccaggcccgagatgggctgga

SEQ ID NO: 8103066 - DNA, 22 bp, Homo sapiens
tccaggcccctgcctgggcctg

SEQ ID NO: 8103067 - DNA, 22 bp, Homo sapiens
catgttaaaatatacattctga

SEQ ID NO: 8103068 - DNA, 22 bp, Homo sapiens
tccagccctgtggcttccaccc

SEQ ID NO: 8103069 - DNA, 22 bp, Homo sapiens
tccagcccaggctggagtgtag

SEQ ID NO: 8103070 - DNA, 22 bp, Homo sapiens
tccagcccagctgtccccttca

SEQ ID NO: 8103071 - DNA, 22 bp, Homo sapiens
tccagccctgtgtctgggagag

SEQ ID NO: 8103072 - DNA, 19 bp, Homo sapiens
tccagccctgttccctttt

SEQ ID NO: 8103073 - DNA, 17 bp, Homo sapiens
tccagcctcctctgctg

SEQ ID NO: 8103074 - DNA, 22 bp, Homo sapiens
tccagcctcatttctcctgctt

SEQ ID NO: 8103075 - DNA, 22 bp, Homo sapiens
tcctcaggcggtgaggaggggc

SEQ ID NO: 8103076 - DNA, 22 bp, Homo sapiens
catttgtatctgggctgctgtg

SEQ ID NO: 8103077 - DNA, 22 bp, Homo sapiens
catttgtaatactgacttgcag

SEQ ID NO: 8103078 - DNA, 22 bp, Homo sapiens
catttgtagctatttactgtat

SEQ ID NO: 8103079 - DNA, 22 bp, Homo sapiens
catttgtactgttcaatgtcat

SEQ ID NO: 8103080 - DNA, 22 bp, Homo sapiens
tcccagggtcctcttctggaat

SEQ ID NO: 8103081 - DNA, 22 bp, Homo sapiens
cattcatatttgcagtatacct

SEQ ID NO: 8103082 - DNA, 22 bp, Homo sapiens
cattcataggaagaaaatgggc

SEQ ID NO: 8103083 - DNA, 22 bp, Homo sapiens
cattcacattcttcttactgtt

SEQ ID NO: 8103084 - DNA, 22 bp, Homo sapiens
cattcacatcttgttccatcac

SEQ ID NO: 8103085 - DNA, 22 bp, Homo sapiens
cattcacagcaggtcagctgaa

SEQ ID NO: 8103086 - DNA, 21 bp, Homo sapiens
cattcacagtctggctcttga

SEQ ID NO: 8103087 - DNA, 22 bp, Homo sapiens
cattcaaatgtgccactgtcct

SEQ ID NO: 8103088 - DNA, 22 bp, Homo sapiens
cattcaaattaagattttgtta

SEQ ID NO: 8103089 - DNA, 22 bp, Homo sapiens
cattcacaaaaccacatgccat

SEQ ID NO: 8103090 - DNA, 22 bp, Homo sapiens
cattcacaatggattgcttcaa

SEQ ID NO: 8103091 - DNA, 22 bp, Homo sapiens
cattcacaaagctgattgatgg

SEQ ID NO: 8103092 - DNA, 22 bp, Homo sapiens
cattcacaactgagcattgttg

SEQ ID NO: 8103093 - DNA, 22 bp, Homo sapiens
catgttaatgaatttttgcagt

SEQ ID NO: 8103094 - DNA, 22 bp, Homo sapiens
catgttctaacaatgagaaacc

SEQ ID NO: 8103095 - DNA, 22 bp, Homo sapiens
catgttcatcagatcaattgta

SEQ ID NO: 8103096 - DNA, 22 bp, Homo sapiens
cattatattacagcactgttaa

SEQ ID NO: 8103097 - DNA, 22 bp, Homo sapiens
tcccagccacagtttccacctg

SEQ ID NO: 8103098 - DNA, 22 bp, Homo sapiens
tcccagcccagacttctccagt

SEQ ID NO: 8103099 - DNA, 22 bp, Homo sapiens
tcacagctttgagcagagacca

SEQ ID NO: 8103100 - DNA, 22 bp, Homo sapiens
tcacagctttcagattgttccc

SEQ ID NO: 8103101 - DNA, 22 bp, Homo sapiens
tcacagactggtcagtcaactt

SEQ ID NO: 8103102 - DNA, 22 bp, Homo sapiens
tcacaagaatttgtagatgaaa

SEQ ID NO: 8103103 - DNA, 22 bp, Homo sapiens
tcacaaatcattttatctgtgt

SEQ ID NO: 8103104 - DNA, 22 bp, Homo sapiens
tcacaaatgtttgcatgtgtct

SEQ ID NO: 8103105 - DNA, 22 bp, Homo sapiens
tatttcttttcgtgacttattg

SEQ ID NO: 8103106 - DNA, 22 bp, Homo sapiens
tatttcttttcgtgacttattg

SEQ ID NO: 8103107 - DNA, 22 bp, Homo sapiens
tatttcttttcgtgacttattg

SEQ ID NO: 8103108 - DNA, 22 bp, Homo sapiens
tcacaaatattttaacagtagg

SEQ ID NO: 8103109 - DNA, 22 bp, Homo sapiens
cagtgagataccacagagcaaa

SEQ ID NO: 8103110 - DNA, 22 bp, Homo sapiens
tcacagacgcctcccctcgcct

SEQ ID NO: 8103111 - DNA, 22 bp, Homo sapiens
cagtgaagttctactgaatggt

SEQ ID NO: 8103112 - DNA, 22 bp, Homo sapiens
cagtgaagtgtggacgtcacca

SEQ ID NO: 8103113 - DNA, 19 bp, Homo sapiens
tcacaagagagataaagtg

SEQ ID NO: 8103114 - DNA, 22 bp, Homo sapiens
cagtgagagtatttgtgctaag

SEQ ID NO: 8103115 - DNA, 22 bp, Homo sapiens
cagtgagaattcagtaggtact

SEQ ID NO: 8103116 - DNA, 22 bp, Homo sapiens
tatttcttgttccctccaagtt

SEQ ID NO: 8103117 - DNA, 22 bp, Homo sapiens
tatttcttgttccctccaagtt

SEQ ID NO: 8103118 - DNA, 22 bp, Homo sapiens
cagtcccagacccagaaggtgg

SEQ ID NO: 8103119 - DNA, 22 bp, Homo sapiens
cagtcccagacatagtaaggga

SEQ ID NO: 8103120 - DNA, 22 bp, Homo sapiens
tatttctttcaggtatgtgttg

SEQ ID NO: 8103121 - DNA, 22 bp, Homo sapiens
tatttctttcaggtatgtgttg

SEQ ID NO: 8103122 - DNA, 21 bp, Homo sapiens
tatttctttgactctctccct

SEQ ID NO: 8103123 - DNA, 21 bp, Homo sapiens
tatttctttgactctctccct

SEQ ID NO: 8103124 - DNA, 22 bp, Homo sapiens
cagggtggccctgtggtctcat

SEQ ID NO: 8103125 - DNA, 22 bp, Homo sapiens
cagggtgggcacccagcctcca

SEQ ID NO: 8103126 - DNA, 22 bp, Homo sapiens
cagggtggggaaatagcgccct

SEQ ID NO: 8103127 - DNA, 22 bp, Homo sapiens
tatttcatgtgcaccataattc

SEQ ID NO: 8103128 - DNA, 22 bp, Homo sapiens
tatttcatctggaacaaggtaa

SEQ ID NO: 8103129 - DNA, 21 bp, Homo sapiens
cagtgggctgctgcgctccag

SEQ ID NO: 8103130 - DNA, 22 bp, Homo sapiens
cagtggctgtgaccagggacct

SEQ ID NO: 8103131 - DNA, 22 bp, Homo sapiens
cagtgccacaggaatggccaat

SEQ ID NO: 8103132 - DNA, 22 bp, Homo sapiens
cagtgtttagcacagtgcttgg

SEQ ID NO: 8103133 - DNA, 22 bp, Homo sapiens
cagttaaaatgtgctataagaa

SEQ ID NO: 8103134 - DNA, 23 bp, Homo sapiens
tcagaagtgggatacaaagctga

SEQ ID NO: 8103135 - DNA, 22 bp, Homo sapiens
tcagagaaatgacaatatatag

SEQ ID NO: 8103136 - DNA, 22 bp, Homo sapiens
cagtttacctatatgtaaattt

SEQ ID NO: 8103137 - DNA, 22 bp, Homo sapiens
cataaattcagttctgcctctt

SEQ ID NO: 8103138 - DNA, 22 bp, Homo sapiens
cataaattgtacccattccaac

SEQ ID NO: 8103139 - DNA, 22 bp, Homo sapiens
tcagcagcagctcagcatgttt

SEQ ID NO: 8103140 - DNA, 21 bp, Homo sapiens
tcagcagcatctgcctagagt

SEQ ID NO: 8103141 - DNA, 22 bp, Homo sapiens
tcagcagccgcagctgactcag

SEQ ID NO: 8103142 - DNA, 22 bp, Homo sapiens
tcagcagatgatttccatacaa

SEQ ID NO: 8103143 - DNA, 22 bp, Homo sapiens
tcagcagactaggcagattact

SEQ ID NO: 8103144 - DNA, 22 bp, Homo sapiens
tcagcagacagttagctatatt

SEQ ID NO: 8103145 - DNA, 22 bp, Homo sapiens
tcagcagaggagtgtcttgccc

SEQ ID NO: 8103146 - DNA, 20 bp, Homo sapiens
cagttaatgactaggcatca

SEQ ID NO: 8103147 - DNA, 22 bp, Homo sapiens
cagttacattaataatgcacat

SEQ ID NO: 8103148 - DNA, 21 bp, Homo sapiens
cagttacagccaggacaaggc

SEQ ID NO: 8103149 - DNA, 22 bp, Homo sapiens
cagttacataaatgataaaatg

SEQ ID NO: 8103150 - DNA, 19 bp, Homo sapiens
cagttacagcagctaagac

SEQ ID NO: 8103151 - DNA, 22 bp, Homo sapiens
cagttaatgtgggccaagttct

SEQ ID NO: 8103152 - DNA, 22 bp, Homo sapiens
cagttaatgtcctatacaatag

SEQ ID NO: 8103153 - DNA, 18 bp, Homo sapiens
cagttacaccttcattca

SEQ ID NO: 8103154 - DNA, 18 bp, Homo sapiens
taggaggatactgagatg

SEQ ID NO: 8103155 - DNA, 22 bp, Homo sapiens
taggaggagggcatttgaagta

SEQ ID NO: 8103156 - DNA, 22 bp, Homo sapiens
cagggcctggagctgggcctgc

SEQ ID NO: 8103157 - DNA, 22 bp, Homo sapiens
cagggctcaccactgggatcct

SEQ ID NO: 8103158 - DNA, 22 bp, Homo sapiens
cagggcctgtcacgacgctcat

SEQ ID NO: 8103159 - DNA, 22 bp, Homo sapiens
cagggcaggaatttgacattgc

SEQ ID NO: 8103160 - DNA, 22 bp, Homo sapiens
taggaaattctcttgctaagtt

SEQ ID NO: 8103161 - DNA, 22 bp, Homo sapiens
taggaaccagagcactctgggc

SEQ ID NO: 8103162 - DNA, 18 bp, Homo sapiens
taggaaccacttgcagag

SEQ ID NO: 8103163 - DNA, 22 bp, Homo sapiens
taggaacagtcctagaaatctg

SEQ ID NO: 8103164 - DNA, 22 bp, Homo sapiens
taggaacagtttcaggatgttt

SEQ ID NO: 8103165 - DNA, 22 bp, Homo sapiens
taggaaatttgaaatatgtggg

SEQ ID NO: 8103166 - DNA, 22 bp, Homo sapiens
tagctatttggaaaattccaat

SEQ ID NO: 8103167 - DNA, 22 bp, Homo sapiens
caggggcaagaatgctgtcagc

SEQ ID NO: 8103168 - DNA, 22 bp, Homo sapiens
caggctggagtgcaatggtgct

SEQ ID NO: 8103169 - DNA, 22 bp, Homo sapiens
tagaataagttgatgatatatg

SEQ ID NO: 8103170 - DNA, 22 bp, Homo sapiens
tagaatacagtttaagaactac

SEQ ID NO: 8103171 - DNA, 17 bp, Homo sapiens
gtgagggcagaggatgg

SEQ ID NO: 8103172 - DNA, 20 bp, Homo sapiens
cagccctgtgacctggccct

SEQ ID NO: 8103173 - DNA, 22 bp, Homo sapiens
tagataaattagaaagtttact

SEQ ID NO: 8103174 - DNA, 22 bp, Homo sapiens
tagataaattagaaagtttact

SEQ ID NO: 8103175 - DNA, 20 bp, Homo sapiens
tagcattccagaaaactcag

SEQ ID NO: 8103176 - DNA, 22 bp, Homo sapiens
tagcaaggcttccaatgaacag

SEQ ID NO: 8103177 - DNA, 22 bp, Homo sapiens
tagcaaggcgtggcactcaaat

SEQ ID NO: 8103178 - DNA, 22 bp, Homo sapiens
tagataaaagggcaaagggcat

SEQ ID NO: 8103179 - DNA, 22 bp, Homo sapiens
tagaatatgattaattttctta

SEQ ID NO: 8103180 - DNA, 22 bp, Homo sapiens
tttcagagatgtctagcctatt

SEQ ID NO: 8103181 - DNA, 22 bp, Homo sapiens
tttcagagcctgcaatcccaat

SEQ ID NO: 8103182 - DNA, 22 bp, Homo sapiens
tttcagagagatcaacatagct

SEQ ID NO: 8103183 - DNA, 22 bp, Homo sapiens
tttcagagaactgagtccttgc

SEQ ID NO: 8103184 - DNA, 22 bp, Homo sapiens
tttcagaaagctgaacatatga

SEQ ID NO: 8103185 - DNA, 22 bp, Homo sapiens
tttcactgttaggagtatgcta

SEQ ID NO: 8103186 - DNA, 22 bp, Homo sapiens
tttcagaaaacttatcatcagt

SEQ ID NO: 8103187 - DNA, 22 bp, Homo sapiens
tttcactcagctctcattgtct

SEQ ID NO: 8103188 - DNA, 22 bp, Homo sapiens
tttcacatttgttttaagaagt

SEQ ID NO: 8103189 - DNA, 22 bp, Homo sapiens
tttcacagcttccacttaagga

SEQ ID NO: 8103190 - DNA, 22 bp, Homo sapiens
tttcacagctgatacctcttcc

SEQ ID NO: 8103191 - DNA, 22 bp, Homo sapiens
tttcacagctgggaagagatat

SEQ ID NO: 8103192 - DNA, 22 bp, Homo sapiens
tttcacagctagtgagcttcta

SEQ ID NO: 8103193 - DNA, 22 bp, Homo sapiens
tttcacagctgggtggcagagt

SEQ ID NO: 8103194 - DNA, 22 bp, Homo sapiens
tttcacagctgtcttccgtctc

SEQ ID NO: 8103195 - DNA, 22 bp, Homo sapiens
tttcacagcagtgtgctgcttt

SEQ ID NO: 8103196 - DNA, 22 bp, Homo sapiens
tttcacagcgtctttctcttgc

SEQ ID NO: 8103197 - DNA, 22 bp, Homo sapiens
tttcacagcatataggtgtact

SEQ ID NO: 8103198 - DNA, 22 bp, Homo sapiens
tttcacagcaacactgtctgca

SEQ ID NO: 8103199 - DNA, 18 bp, Homo sapiens
tttcacagattcatgact

SEQ ID NO: 8103200 - DNA, 22 bp, Homo sapiens
tttcacagcagaatttctgagg

SEQ ID NO: 8103201 - DNA, 22 bp, Homo sapiens
tttcagagctctaggctctcag

SEQ ID NO: 8103202 - DNA, 22 bp, Homo sapiens
tttcatgctcatggaacacagc

SEQ ID NO: 8103203 - DNA, 19 bp, Homo sapiens
tttcccagcccttgctgtg

SEQ ID NO: 8103204 - DNA, 22 bp, Homo sapiens
tttcccaggctggaatgcagtg

SEQ ID NO: 8103205 - DNA, 22 bp, Homo sapiens
tttcccaggccctcagggctgc

SEQ ID NO: 8103206 - DNA, 22 bp, Homo sapiens
tttcattgatgggtgatagaaa

SEQ ID NO: 8103207 - DNA, 22 bp, Homo sapiens
tttcattcatgtgttaaaggtg

SEQ ID NO: 8103208 - DNA, 22 bp, Homo sapiens
tttcattattcatgctagttat

SEQ ID NO: 8103209 - DNA, 22 bp, Homo sapiens
tttcattgagactatagacatc

SEQ ID NO: 8103210 - DNA, 22 bp, Homo sapiens
tttattctagctcagaatagtt

SEQ ID NO: 8103211 - DNA, 22 bp, Homo sapiens
tttattcaagatgaggttcatg

SEQ ID NO: 8103212 - DNA, 20 bp, Homo sapiens
tttattcacagagaagagtt

SEQ ID NO: 8103213 - DNA, 22 bp, Homo sapiens
tttattctgtgctacatgaaga

SEQ ID NO: 8103214 - DNA, 22 bp, Homo sapiens
tttattcttgagagtgagaaga

SEQ ID NO: 8103215 - DNA, 22 bp, Homo sapiens
tttattgaacacttgcactggc

SEQ ID NO: 8103216 - DNA, 22 bp, Homo sapiens
tttcaaaggttttgtcatgtct

SEQ ID NO: 8103217 - DNA, 23 bp, Homo sapiens
tttcaacaatgcttagagaaaac

SEQ ID NO: 8103218 - DNA, 22 bp, Homo sapiens
tttcaaagtaaggattttcatc

SEQ ID NO: 8103219 - DNA, 19 bp, Homo sapiens
tttcaaagggcataagcct

SEQ ID NO: 8103220 - DNA, 19 bp, Homo sapiens
tttcaaagggcataagcct

SEQ ID NO: 8103221 - DNA, 19 bp, Homo sapiens
tttcaaagggcataagcct

SEQ ID NO: 8103222 - DNA, 20 bp, Homo sapiens
tttattgagcacgtactgtg

SEQ ID NO: 8103223 - DNA, 22 bp, Homo sapiens
tttattgaattgtaaccctatt

SEQ ID NO: 8103224 - DNA, 22 bp, Homo sapiens
tttattgacccaaagcgagagt

SEQ ID NO: 8103225 - DNA, 22 bp, Homo sapiens
tttattgacttcagtgagtctt

SEQ ID NO: 8103226 - DNA, 22 bp, Homo sapiens
tttcacagaaaggataacatta

SEQ ID NO: 8103227 - DNA, 22 bp, Homo sapiens
tttcacagaactcactaaggag

SEQ ID NO: 8103228 - DNA, 23 bp, Homo sapiens
tttcacagaaggattgtagggcc

SEQ ID NO: 8103229 - DNA, 22 bp, Homo sapiens
tttcacagaaagacaacagata

SEQ ID NO: 8103230 - DNA, 22 bp, Homo sapiens
tttcacagaaagacaacagata

SEQ ID NO: 8103231 - DNA, 22 bp, Homo sapiens
tttcacagaaagaagctagttt

SEQ ID NO: 8103232 - DNA, 22 bp, Homo sapiens
tttcacagagaatattgccttg

SEQ ID NO: 8103233 - DNA, 22 bp, Homo sapiens
tttcacagaggaggaagctgag

SEQ ID NO: 8103234 - DNA, 22 bp, Homo sapiens
tttcacagaggaggaagctgag

SEQ ID NO: 8103235 - DNA, 22 bp, Homo sapiens
tttcacagagaaatataacagg

SEQ ID NO: 8103236 - DNA, 22 bp, Homo sapiens
tttcacagatgttttggagtct

SEQ ID NO: 8103237 - DNA, 22 bp, Homo sapiens
tttcacagatcctacagcttgt

SEQ ID NO: 8103238 - DNA, 22 bp, Homo sapiens
tttcacagatataagatttcac

SEQ ID NO: 8103239 - DNA, 22 bp, Homo sapiens
tttcaagagggaactgaacaca

SEQ ID NO: 8103240 - DNA, 22 bp, Homo sapiens
tttatatagagatttgtgcatg

SEQ ID NO: 8103241 - DNA, 22 bp, Homo sapiens
tttatatatggctggtctggat

SEQ ID NO: 8103242 - DNA, 22 bp, Homo sapiens
tttatattgggagtcgttttga

SEQ ID NO: 8103243 - DNA, 22 bp, Homo sapiens
tttatattgggagtcgttttga

SEQ ID NO: 8103244 - DNA, 22 bp, Homo sapiens
tttatattgtaaaaatggttct

SEQ ID NO: 8103245 - DNA, 22 bp, Homo sapiens
tttattcaagatgaggttcatg

SEQ ID NO: 8103246 - DNA, 22 bp, Homo sapiens
tttatctgacctcacttcttaa

SEQ ID NO: 8103247 - DNA, 22 bp, Homo sapiens
tttatctgagctgatagatagt

SEQ ID NO: 8103248 - DNA, 22 bp, Homo sapiens
tttatctgaaaaaactcttgga

SEQ ID NO: 8103249 - DNA, 22 bp, Homo sapiens
tttatcatcttgtttttaaagc

SEQ ID NO: 8103250 - DNA, 22 bp, Homo sapiens
tttagattgtgacctcccccca

SEQ ID NO: 8103251 - DNA, 22 bp, Homo sapiens
tttagataatgctcaagcaatt

SEQ ID NO: 8103252 - DNA, 22 bp, Homo sapiens
tttaatgatagtcttacgaaaa

SEQ ID NO: 8103253 - DNA, 22 bp, Homo sapiens
tttaatgtgagtccctttcaag

SEQ ID NO: 8103254 - DNA, 22 bp, Homo sapiens
tttacagcttctatactatgtg

SEQ ID NO: 8103255 - DNA, 22 bp, Homo sapiens
tttacagtctctatagtcaaaa

SEQ ID NO: 8103256 - DNA, 22 bp, Homo sapiens
tttacagtctctatagtcaaaa

SEQ ID NO: 8103257 - DNA, 22 bp, Homo sapiens
tttaaggattgtccatagtgtt

SEQ ID NO: 8103258 - DNA, 22 bp, Homo sapiens
tttaaggtggacatctaagtca

SEQ ID NO: 8103259 - DNA, 22 bp, Homo sapiens
tttaaggcttcactggagtggg

SEQ ID NO: 8103260 - DNA, 21 bp, Homo sapiens
tttaaggccagcaggaggtga

SEQ ID NO: 8103261 - DNA, 22 bp, Homo sapiens
tttaaggaggggctcacgtggg

SEQ ID NO: 8103262 - DNA, 22 bp, Homo sapiens
tttaaatgcagacgttgattca

SEQ ID NO: 8103263 - DNA, 22 bp, Homo sapiens
tttaaataggactcctgggggt

SEQ ID NO: 8103264 - DNA, 22 bp, Homo sapiens
tttaaacctatctaagaaatag

SEQ ID NO: 8103265 - DNA, 22 bp, Homo sapiens
tttaaagaaattcctcatcttt

SEQ ID NO: 8103266 - DNA, 21 bp, Homo sapiens
tttaaagaataggaagggagg

SEQ ID NO: 8103267 - DNA, 22 bp, Homo sapiens
ttggcagtagtctcggctaccc

SEQ ID NO: 8103268 - DNA, 22 bp, Homo sapiens
ttggcataccttagtggtggag

SEQ ID NO: 8103269 - DNA, 22 bp, Homo sapiens
ttgggaaggcgtggaagcagaa

SEQ ID NO: 8103270 - DNA, 22 bp, Homo sapiens
ttgggagattcattgagccaag

SEQ ID NO: 8103271 - DNA, 22 bp, Homo sapiens
ttgggaggtaatggagccaagt

SEQ ID NO: 8103272 - DNA, 22 bp, Homo sapiens
ttgtcaggaaatctatttctta

SEQ ID NO: 8103273 - DNA, 22 bp, Homo sapiens
ttgtcaggaactatgattatgc

SEQ ID NO: 8103274 - DNA, 22 bp, Homo sapiens
ttgtccaaagtaacacatctag

SEQ ID NO: 8103275 - DNA, 22 bp, Homo sapiens
ttgtccaagtggatgttctcag

SEQ ID NO: 8103276 - DNA, 22 bp, Homo sapiens
ttgtcaaggcttttaatattct

SEQ ID NO: 8103277 - DNA, 22 bp, Homo sapiens
ttgtcacaggaaagggtgcaag

SEQ ID NO: 8103278 - DNA, 20 bp, Homo sapiens
ttgtcagattttgcttgatg

SEQ ID NO: 8103279 - DNA, 22 bp, Homo sapiens
ttgtccagcagctcagtctacg

SEQ ID NO: 8103280 - DNA, 22 bp, Homo sapiens
ttgtccagtttctagaggcctc

SEQ ID NO: 8103281 - DNA, 22 bp, Homo sapiens
ttgtcccattgcgaatgtgagt

SEQ ID NO: 8103282 - DNA, 22 bp, Homo sapiens
ttgtcccaggacttgcatagat

SEQ ID NO: 8103283 - DNA, 22 bp, Homo sapiens
ttgtaaagctgattagaaagcc

SEQ ID NO: 8103284 - DNA, 21 bp, Homo sapiens
ttgtaaaggtttagaagaatg

SEQ ID NO: 8103285 - DNA, 22 bp, Homo sapiens
ttgggcctcactctagaaggca

SEQ ID NO: 8103286 - DNA, 22 bp, Homo sapiens
ttgggcctcactctagaaggca

SEQ ID NO: 8103287 - DNA, 22 bp, Homo sapiens
ttgggcctcggccaaggacggg

SEQ ID NO: 8103288 - DNA, 22 bp, Homo sapiens
ttgggcctcggccaaggacggg

SEQ ID NO: 8103289 - DNA, 22 bp, Homo sapiens
ttgggcctctcaaagtgctggg

SEQ ID NO: 8103290 - DNA, 20 bp, Homo sapiens
ttgggcctgtcagcactccc

SEQ ID NO: 8103291 - DNA, 22 bp, Homo sapiens
ttgtaaacttgtttgaaggtat

SEQ ID NO: 8103292 - DNA, 22 bp, Homo sapiens
ttgtaacaatctgtcataaatg

SEQ ID NO: 8103293 - DNA, 22 bp, Homo sapiens
ttgtaacatcaccatcaaaatc

SEQ ID NO: 8103294 - DNA, 22 bp, Homo sapiens
ttgtaacaggtactaaataact

SEQ ID NO: 8103295 - DNA, 22 bp, Homo sapiens
ttgtcaaatccttgtcatctgc

SEQ ID NO: 8103296 - DNA, 22 bp, Homo sapiens
ttgtacagaccctgaaaagctc

SEQ ID NO: 8103297 - DNA, 22 bp, Homo sapiens
ttgctctgtccagccagcaggt

SEQ ID NO: 8103298 - DNA, 22 bp, Homo sapiens
ttgcattatttaatgagactct

SEQ ID NO: 8103299 - DNA, 21 bp, Homo sapiens
ttgcattaaatccagactcaa

SEQ ID NO: 8103300 - DNA, 22 bp, Homo sapiens
ttgctgaaaacaggtcatcagg

SEQ ID NO: 8103301 - DNA, 22 bp, Homo sapiens
ttggaaagcccattatttggac

SEQ ID NO: 8103302 - DNA, 22 bp, Homo sapiens
ttgacacagatcaatattcaac

SEQ ID NO: 8103303 - DNA, 22 bp, Homo sapiens
ttgacacaggaaagttgtaact

SEQ ID NO: 8103304 - DNA, 22 bp, Homo sapiens
ttgacaaaaacctcatttcacc

SEQ ID NO: 8103305 - DNA, 22 bp, Homo sapiens
ttgacacattagagcttgtaaa

SEQ ID NO: 8103306 - DNA, 22 bp, Homo sapiens
ttgacagctacggagcagctgt

SEQ ID NO: 8103307 - DNA, 22 bp, Homo sapiens
ttgacagcaaagattgtgccta

SEQ ID NO: 8103308 - DNA, 22 bp, Homo sapiens
ttgacagctacctacatggtgg

SEQ ID NO: 8103309 - DNA, 22 bp, Homo sapiens
ttgacagctattttgctttgat

SEQ ID NO: 8103310 - DNA, 21 bp, Homo sapiens
ttgcacagaaaaccatagaga

SEQ ID NO: 8103311 - DNA, 21 bp, Homo sapiens
ttgcacagaaaaccatagaga

SEQ ID NO: 8103312 - DNA, 22 bp, Homo sapiens
ttgcagttaaaaatcattagtt

SEQ ID NO: 8103313 - DNA, 22 bp, Homo sapiens
ttgcatggtgtgctctgaatca

SEQ ID NO: 8103314 - DNA, 22 bp, Homo sapiens
ttgcagctagaagattcactgt

SEQ ID NO: 8103315 - DNA, 22 bp, Homo sapiens
ttgcagcttcttgcatcagaaa

SEQ ID NO: 8103316 - DNA, 22 bp, Homo sapiens
ttgcagctccattttaatggct

SEQ ID NO: 8103317 - DNA, 22 bp, Homo sapiens
ttgcagcatgcatagacactgc

SEQ ID NO: 8103318 - DNA, 22 bp, Homo sapiens
ttgcagcatattgatctcctgt

SEQ ID NO: 8103319 - DNA, 20 bp, Homo sapiens
ttgcagcagtgaggtgaagg

SEQ ID NO: 8103320 - DNA, 22 bp, Homo sapiens
ttgcagcaaggtcatgaaatgt

SEQ ID NO: 8103321 - DNA, 22 bp, Homo sapiens
ttgcagcagctctttgaatgtt

SEQ ID NO: 8103322 - DNA, 22 bp, Homo sapiens
ttgcagcagggtgaattcactc

SEQ ID NO: 8103323 - DNA, 22 bp, Homo sapiens
ttgcagattcggctgctcagga

SEQ ID NO: 8103324 - DNA, 19 bp, Homo sapiens
ttgcagcaaagttaggacc

SEQ ID NO: 8103325 - DNA, 22 bp, Homo sapiens
ttgcagcttcgagtctatctgt

SEQ ID NO: 8103326 - DNA, 22 bp, Homo sapiens
ttgcagcttagtgatgttatct

SEQ ID NO: 8103327 - DNA, 22 bp, Homo sapiens
ttgcagctgctgttcctcatgg

SEQ ID NO: 8103328 - DNA, 22 bp, Homo sapiens
ttgcagctgttactgatagata

SEQ ID NO: 8103329 - DNA, 22 bp, Homo sapiens
ttcagcagatccctaagtcctg

SEQ ID NO: 8103330 - DNA, 18 bp, Homo sapiens
ttcagcagcagacacact

SEQ ID NO: 8103331 - DNA, 22 bp, Homo sapiens
ttcagcagagaaattacataat

SEQ ID NO: 8103332 - DNA, 22 bp, Homo sapiens
ttcagagccagcaacactaggc

SEQ ID NO: 8103333 - DNA, 22 bp, Homo sapiens
ttcagcaatgacagcctatata

SEQ ID NO: 8103334 - DNA, 22 bp, Homo sapiens
ttcagagagtccagtatgcagt

SEQ ID NO: 8103335 - DNA, 22 bp, Homo sapiens
ttcagagagtttgtgagtcctt

SEQ ID NO: 8103336 - DNA, 22 bp, Homo sapiens
ttcagagacatgttctagatca

SEQ ID NO: 8103337 - DNA, 22 bp, Homo sapiens
ttcagagaagtgcacaaaatca

SEQ ID NO: 8103338 - DNA, 22 bp, Homo sapiens
ttcagagaattggataattcgt

SEQ ID NO: 8103339 - DNA, 22 bp, Homo sapiens
ttcacaggaatgtaggggtctt

SEQ ID NO: 8103340 - DNA, 22 bp, Homo sapiens
ttcagagaagcaaaggcagatt

SEQ ID NO: 8103341 - DNA, 22 bp, Homo sapiens
ttcaaagattagcatacgcaat

SEQ ID NO: 8103342 - DNA, 23 bp, Homo sapiens
ttcaaagatcttctgaaatctgt

SEQ ID NO: 8103343 - DNA, 22 bp, Homo sapiens
ttcaaagattttcccaaagctc

SEQ ID NO: 8103344 - DNA, 22 bp, Homo sapiens
ttcaaagagaaattgtattttc

SEQ ID NO: 8103345 - DNA, 22 bp, Homo sapiens
ttcaaagataatgtagcatttt

SEQ ID NO: 8103346 - DNA, 22 bp, Homo sapiens
ttcaaagataattaccaaacat

SEQ ID NO: 8103347 - DNA, 22 bp, Homo sapiens
ttcaaagataattaccaaacat

SEQ ID NO: 8103348 - DNA, 22 bp, Homo sapiens
ttcaaagagaaattgtattttc

SEQ ID NO: 8103349 - DNA, 21 bp, Homo sapiens
ttcaaagacttgatgctgacc

SEQ ID NO: 8103350 - DNA, 22 bp, Homo sapiens
ttcaaagaccttacttggcaaa

SEQ ID NO: 8103351 - DNA, 22 bp, Homo sapiens
ttcaaagaattttgagacctga

SEQ ID NO: 8103352 - DNA, 22 bp, Homo sapiens
ttcaaagaccttacttggcaaa

SEQ ID NO: 8103353 - DNA, 22 bp, Homo sapiens
ttcaaagaattttgagacctga

SEQ ID NO: 8103354 - DNA, 22 bp, Homo sapiens
ttcaaacttaaggagcagcaga

SEQ ID NO: 8103355 - DNA, 22 bp, Homo sapiens
ttcaaactgtgtaatttataaa

SEQ ID NO: 8103356 - DNA, 22 bp, Homo sapiens
ttcacagctccttttactcaac

SEQ ID NO: 8103357 - DNA, 22 bp, Homo sapiens
ttcacagctaagagctaagtaa

SEQ ID NO: 8103358 - DNA, 23 bp, Homo sapiens
ttcacagattaaatatttcttct

SEQ ID NO: 8103359 - DNA, 22 bp, Homo sapiens
ttcacagatttccctgcacatg

SEQ ID NO: 8103360 - DNA, 22 bp, Homo sapiens
ttcacagcctctgccccaggca

SEQ ID NO: 8103361 - DNA, 18 bp, Homo sapiens
ttcacagatccacaggaa

SEQ ID NO: 8103362 - DNA, 22 bp, Homo sapiens
ttcacagagagtatgcagagaa

SEQ ID NO: 8103363 - DNA, 22 bp, Homo sapiens
ttcacagagagtatgcagagaa

SEQ ID NO: 8103364 - DNA, 22 bp, Homo sapiens
ttccagtgaaacatgaggtgtg

SEQ ID NO: 8103365 - DNA, 22 bp, Homo sapiens
ttccaggtgttgctgtcttcct

SEQ ID NO: 8103366 - DNA, 23 bp, Homo sapiens
ttccagtgagactgagaggtctt

SEQ ID NO: 8103367 - DNA, 22 bp, Homo sapiens
ttccagtgggaaagcatagcca

SEQ ID NO: 8103368 - DNA, 22 bp, Homo sapiens
ttccagtgatatattagtgcaa

SEQ ID NO: 8103369 - DNA, 22 bp, Homo sapiens
ttccagttcagatgcaacaggg

SEQ ID NO: 8103370 - DNA, 22 bp, Homo sapiens
ttccaggggcagcagtgatggt

SEQ ID NO: 8103371 - DNA, 22 bp, Homo sapiens
ttccaggtcgccataggtttga

SEQ ID NO: 8103372 - DNA, 22 bp, Homo sapiens
ttccaggaagtgactatgtcat

SEQ ID NO: 8103373 - DNA, 20 bp, Homo sapiens
ttcatttgttgagcaccttc

SEQ ID NO: 8103374 - DNA, 22 bp, Homo sapiens
ttcatttgtgtgcctgatgcaa

SEQ ID NO: 8103375 - DNA, 21 bp, Homo sapiens
ttcatttgttatagacaaagt

SEQ ID NO: 8103376 - DNA, 19 bp, Homo sapiens
ttcatttgtatctgctcac

SEQ ID NO: 8103377 - DNA, 22 bp, Homo sapiens
ttcatttgtaactctgttaggg

SEQ ID NO: 8103378 - DNA, 22 bp, Homo sapiens
ttcatttgggatgagtcagaag

SEQ ID NO: 8103379 - DNA, 20 bp, Homo sapiens
ttcatttgggaaaatctgcg

SEQ ID NO: 8103380 - DNA, 22 bp, Homo sapiens
ttcatttggcctctgcttaaaa

SEQ ID NO: 8103381 - DNA, 22 bp, Homo sapiens
ttcataaacaaattaaggcctg

SEQ ID NO: 8103382 - DNA, 22 bp, Homo sapiens
ttcatttaatcagaatctctaa

SEQ ID NO: 8103383 - DNA, 22 bp, Homo sapiens
ttcatttgagtttatagttgct

SEQ ID NO: 8103384 - DNA, 22 bp, Homo sapiens
ttcatacaatgggatattatga

SEQ ID NO: 8103385 - DNA, 22 bp, Homo sapiens
ttcataatgaggtcctagaggc

SEQ ID NO: 8103386 - DNA, 22 bp, Homo sapiens
ttcattgtgaacacattctgcc

SEQ ID NO: 8103387 - DNA, 22 bp, Homo sapiens
ttatatgagtatcatatcactt

SEQ ID NO: 8103388 - DNA, 22 bp, Homo sapiens
ttatatatatgtagaggtcacg

SEQ ID NO: 8103389 - DNA, 22 bp, Homo sapiens
ttattaatgagtacaagttatt

SEQ ID NO: 8103390 - DNA, 22 bp, Homo sapiens
ttattatagattatgcaagatt

SEQ ID NO: 8103391 - DNA, 22 bp, Homo sapiens
ttattatagattatgcaagatt

SEQ ID NO: 8103392 - DNA, 22 bp, Homo sapiens
ttattacactgaaagaattgcg

SEQ ID NO: 8103393 - DNA, 22 bp, Homo sapiens
ttattacactgaaagaattgcg

SEQ ID NO: 8103394 - DNA, 22 bp, Homo sapiens
ttcaaacaggggtcagggagat

SEQ ID NO: 8103395 - DNA, 22 bp, Homo sapiens
ttcaaacagtgtagaatatatg

SEQ ID NO: 8103396 - DNA, 22 bp, Homo sapiens
ttcaaacagttgcacaacttat

SEQ ID NO: 8103397 - DNA, 22 bp, Homo sapiens
ttcaaacagttgcacaacttat

SEQ ID NO: 8103398 - DNA, 22 bp, Homo sapiens
ttcaaacattcaaataaaccgg

SEQ ID NO: 8103399 - DNA, 22 bp, Homo sapiens
ttcaaactctgagtagttctgc

SEQ ID NO: 8103400 - DNA, 22 bp, Homo sapiens
ttcaaactcttgctctgctagt

SEQ ID NO: 8103401 - DNA, 22 bp, Homo sapiens
ttcaaactcttgctctgctagt

SEQ ID NO: 8103402 - DNA, 22 bp, Homo sapiens
ttcaaacactgctttgagaggg

SEQ ID NO: 8103403 - DNA, 22 bp, Homo sapiens
ttcaaacaggggtcagggagat

SEQ ID NO: 8103404 - DNA, 22 bp, Homo sapiens
ttcaaacagatgactctgctct

SEQ ID NO: 8103405 - DNA, 22 bp, Homo sapiens
ttattgctttggaaaacactca

SEQ ID NO: 8103406 - DNA, 22 bp, Homo sapiens
ttatactaaaacgcattgaatt

SEQ ID NO: 8103407 - DNA, 22 bp, Homo sapiens
ttatagaaggagcattcactta

SEQ ID NO: 8103408 - DNA, 23 bp, Homo sapiens
ttatagagcagatgcaatgtgaa

SEQ ID NO: 8103409 - DNA, 22 bp, Homo sapiens
ttatagaatgtttccaatgcct

SEQ ID NO: 8103410 - DNA, 22 bp, Homo sapiens
ttatataactcaggtgggctca

SEQ ID NO: 8103411 - DNA, 22 bp, Homo sapiens
ttatatactgtggtagtactgt

SEQ ID NO: 8103412 - DNA, 22 bp, Homo sapiens
ttatataaagataacttttctt

SEQ ID NO: 8103413 - DNA, 22 bp, Homo sapiens
ttatataaagataacttttctt

SEQ ID NO: 8103414 - DNA, 21 bp, Homo sapiens
ttataggctggggtttgcttt

SEQ ID NO: 8103415 - DNA, 22 bp, Homo sapiens
ttataggcttagttctgtgtgt

SEQ ID NO: 8103416 - DNA, 22 bp, Homo sapiens
ttaggaaatcactttgctcacc

SEQ ID NO: 8103417 - DNA, 22 bp, Homo sapiens
ttaggaaacaaatacacccagt

SEQ ID NO: 8103418 - DNA, 22 bp, Homo sapiens
ttaggaaaatggagtcctttta

SEQ ID NO: 8103419 - DNA, 21 bp, Homo sapiens
ttagctttctagaatctttgt

SEQ ID NO: 8103420 - DNA, 22 bp, Homo sapiens
tcctgctggaaacttcctcttg

SEQ ID NO: 8103421 - DNA, 22 bp, Homo sapiens
tcctgctgctcttgggaaacct

SEQ ID NO: 8103422 - DNA, 21 bp, Homo sapiens
tcctgctgctcctgtcgtgtt

SEQ ID NO: 8103423 - DNA, 22 bp, Homo sapiens
tcctgctgctcacctttttgtc

SEQ ID NO: 8103424 - DNA, 22 bp, Homo sapiens
tcctgctggaagtagggaatga

SEQ ID NO: 8103425 - DNA, 22 bp, Homo sapiens
tcctgctggaatggaaaatgaa

SEQ ID NO: 8103426 - DNA, 22 bp, Homo sapiens
tcctgctggactctgagtacaa

SEQ ID NO: 8103427 - DNA, 22 bp, Homo sapiens
ttagctgtcaaggtggctgcag

SEQ ID NO: 8103428 - DNA, 22 bp, Homo sapiens
tcctgctgccatttcaagtgct

SEQ ID NO: 8103429 - DNA, 22 bp, Homo sapiens
tcctgctgctacctggcccacg

SEQ ID NO: 8103430 - DNA, 22 bp, Homo sapiens
tcctgctgagcgtctgtcattt

SEQ ID NO: 8103431 - DNA, 22 bp, Homo sapiens
tcctgctgagcatgttctgccc

SEQ ID NO: 8103432 - DNA, 20 bp, Homo sapiens
tcctgctgccacctcttctt

SEQ ID NO: 8103433 - DNA, 21 bp, Homo sapiens
tcctgctgagaaacagatggt

SEQ ID NO: 8103434 - DNA, 20 bp, Homo sapiens
tcctgctgaccttcacaagc

SEQ ID NO: 8103435 - DNA, 22 bp, Homo sapiens
tcctgctgacaaggaaagcatg

SEQ ID NO: 8103436 - DNA, 22 bp, Homo sapiens
tcctgctgaccagtaaatgaat

SEQ ID NO: 8103437 - DNA, 18 bp, Homo sapiens
tcctgcctgcgggctccc

SEQ ID NO: 8103438 - DNA, 19 bp, Homo sapiens
tcctgcctggggccgcctg

SEQ ID NO: 8103439 - DNA, 22 bp, Homo sapiens
ttcttttctttaggcattgtgt

SEQ ID NO: 8103440 - DNA, 22 bp, Homo sapiens
ttcttttcttggcaggagtaga

SEQ ID NO: 8103441 - DNA, 22 bp, Homo sapiens
ttctttttaaagtgtgtatgca

SEQ ID NO: 8103442 - DNA, 22 bp, Homo sapiens
ttgaaatatttgggagtgtttg

SEQ ID NO: 8103443 - DNA, 22 bp, Homo sapiens
ttgaacaatcaaaagaattcat

SEQ ID NO: 8103444 - DNA, 22 bp, Homo sapiens
ttgaacaatttggtatacaaac

SEQ ID NO: 8103445 - DNA, 18 bp, Homo sapiens
ttgaattcttctacatgt

SEQ ID NO: 8103446 - DNA, 22 bp, Homo sapiens
ttcttcaataaattcccataag

SEQ ID NO: 8103447 - DNA, 22 bp, Homo sapiens
ttcttcaatgtgccctgttttc

SEQ ID NO: 8103448 - DNA, 22 bp, Homo sapiens
ttcttcaacaaggacactgtta

SEQ ID NO: 8103449 - DNA, 22 bp, Homo sapiens
ttcttcaaagtccttattcctt

SEQ ID NO: 8103450 - DNA, 22 bp, Homo sapiens
ttcttatttcccccttcatcat

SEQ ID NO: 8103451 - DNA, 22 bp, Homo sapiens
ttcttatttcccccttcatcat

SEQ ID NO: 8103452 - DNA, 22 bp, Homo sapiens
ttcttattgggagaccttttct

SEQ ID NO: 8103453 - DNA, 22 bp, Homo sapiens
ttcttttctgcagctggtattt

SEQ ID NO: 8103454 - DNA, 17 bp, Homo sapiens
ttcttttctgagccttg

SEQ ID NO: 8103455 - DNA, 17 bp, Homo sapiens
ttcttttctgagccttg

SEQ ID NO: 8103456 - DNA, 22 bp, Homo sapiens
ttctttgtggcagtgagctggg

SEQ ID NO: 8103457 - DNA, 23 bp, Homo sapiens
ttctttgtggataatctccagtg

SEQ ID NO: 8103458 - DNA, 22 bp, Homo sapiens
ttctttgtgcatccaattttct

SEQ ID NO: 8103459 - DNA, 22 bp, Homo sapiens
ttctttgttgtactttcctaca

SEQ ID NO: 8103460 - DNA, 20 bp, Homo sapiens
ttctttgttccttacatttg

SEQ ID NO: 8103461 - DNA, 20 bp, Homo sapiens
ttctttgttccttacatttg

SEQ ID NO: 8103462 - DNA, 22 bp, Homo sapiens
ttctgtgcccattttaaaatgg

SEQ ID NO: 8103463 - DNA, 19 bp, Homo sapiens
ttctgtaaggacattaatc

SEQ ID NO: 8103464 - DNA, 22 bp, Homo sapiens
ttcttataagttaatatttcca

SEQ ID NO: 8103465 - DNA, 22 bp, Homo sapiens
ttcttacattactttacatgtg

SEQ ID NO: 8103466 - DNA, 22 bp, Homo sapiens
ttctggagatgacttttagaaa

SEQ ID NO: 8103467 - DNA, 20 bp, Homo sapiens
ttcctgattgtcatttctgc

SEQ ID NO: 8103468 - DNA, 22 bp, Homo sapiens
ttcctgaggtgattctaatgtg

SEQ ID NO: 8103469 - DNA, 22 bp, Homo sapiens
ttccttgaggtattcagtttta

SEQ ID NO: 8103470 - DNA, 22 bp, Homo sapiens
ttccttgaccactgcataatga

SEQ ID NO: 8103471 - DNA, 22 bp, Homo sapiens
ttctccagaccttgtgactatg

SEQ ID NO: 8103472 - DNA, 22 bp, Homo sapiens
ttctcagggtctggatggcctg

SEQ ID NO: 8103473 - DNA, 22 bp, Homo sapiens
ttctctctgtgtcattatggac

SEQ ID NO: 8103474 - DNA, 22 bp, Homo sapiens
ttctctatgtgtgttgtagttt

SEQ ID NO: 8103475 - DNA, 22 bp, Homo sapiens
tttgtaaggctaaataatattc

SEQ ID NO: 8103476 - DNA, 22 bp, Homo sapiens
tttgtaagtggtagatctaaga

SEQ ID NO: 8103477 - DNA, 22 bp, Homo sapiens
tttgtgttttagctggtgaggc

SEQ ID NO: 8103478 - DNA, 22 bp, Homo sapiens
tttgtgttctgatccaaaggcc

SEQ ID NO: 8103479 - DNA, 22 bp, Homo sapiens
tttgtgtttaatacaaggacct

SEQ ID NO: 8103480 - DNA, 22 bp, Homo sapiens
tttgttaattcttatgttagag

SEQ ID NO: 8103481 - DNA, 22 bp, Homo sapiens
tttgttacaaagaaagaagagc

SEQ ID NO: 8103482 - DNA, 22 bp, Homo sapiens
tttgttcaacatcacttccacc

SEQ ID NO: 8103483 - DNA, 22 bp, Homo sapiens
tttgttcaaggaatagtaaatg

SEQ ID NO: 8103484 - DNA, 22 bp, Homo sapiens
tttgttcaaattttcctatctg

SEQ ID NO: 8103485 - DNA, 22 bp, Homo sapiens
tttgttcaaaaattataagata

SEQ ID NO: 8103486 - DNA, 22 bp, Homo sapiens
ttttaaatctccagttgacccc

SEQ ID NO: 8103487 - DNA, 22 bp, Homo sapiens
ttttaaaggctgtatgaccaag

SEQ ID NO: 8103488 - DNA, 22 bp, Homo sapiens
tttgttcaatccagacaatagc

SEQ ID NO: 8103489 - DNA, 22 bp, Homo sapiens
ttttaaagagatgctgtgcata

SEQ ID NO: 8103490 - DNA, 22 bp, Homo sapiens
ttttaaaggatactcttgtcta

SEQ ID NO: 8103491 - DNA, 22 bp, Homo sapiens
ttttaatgggcgactattatgg

SEQ ID NO: 8103492 - DNA, 22 bp, Homo sapiens
ttttaatcctcttggtatctta

SEQ ID NO: 8103493 - DNA, 22 bp, Homo sapiens
ttttaatcatgcttctatgtcc

SEQ ID NO: 8103494 - DNA, 22 bp, Homo sapiens
ttttaattgcaattatggtccc

SEQ ID NO: 8103495 - DNA, 19 bp, Homo sapiens
ttttcacatactggatcct

SEQ ID NO: 8103496 - DNA, 22 bp, Homo sapiens
ttttcacatgcttggggactta

SEQ ID NO: 8103497 - DNA, 22 bp, Homo sapiens
ttttattggagtgataccaagc

SEQ ID NO: 8103498 - DNA, 22 bp, Homo sapiens
ttttcatgttccttgttaagtg

SEQ ID NO: 8103499 - DNA, 22 bp, Homo sapiens
ttttcattgtaaatcaggaaac

SEQ ID NO: 8103500 - DNA, 22 bp, Homo sapiens
ttttattgcaataaagtgtgta

SEQ ID NO: 8103501 - DNA, 22 bp, Homo sapiens
ttttattggagtgataccaagc

SEQ ID NO: 8103502 - DNA, 22 bp, Homo sapiens
ttttattgcaataaagtgtgta

SEQ ID NO: 8103503 - DNA, 22 bp, Homo sapiens
ttttatgttcctgaagctatct

SEQ ID NO: 8103504 - DNA, 22 bp, Homo sapiens
ttttatgttcctgaagctatct

SEQ ID NO: 8103505 - DNA, 22 bp, Homo sapiens
ttttcttatggtgaagcacaaa

SEQ ID NO: 8103506 - DNA, 22 bp, Homo sapiens
ttttcttatagagcttaaagtt

SEQ ID NO: 8103507 - DNA, 22 bp, Homo sapiens
ttttcttatgtgcagctatatg

SEQ ID NO: 8103508 - DNA, 22 bp, Homo sapiens
ttttcttaggtgctccaagtag

SEQ ID NO: 8103509 - DNA, 22 bp, Homo sapiens
ttttcttactgtctgtgatcct

SEQ ID NO: 8103510 - DNA, 22 bp, Homo sapiens
ttttctgtattattgtgcttca

SEQ ID NO: 8103511 - DNA, 22 bp, Homo sapiens
ttttctcttgttaatgtactga

SEQ ID NO: 8103512 - DNA, 22 bp, Homo sapiens
ttttcatttttgtagatgcaag

SEQ ID NO: 8103513 - DNA, 22 bp, Homo sapiens
tttgaattattccttgagttga

SEQ ID NO: 8103514 - DNA, 22 bp, Homo sapiens
tttgaatatacttcaaacaaag

SEQ ID NO: 8103515 - DNA, 19 bp, Homo sapiens
tttgaatataatgcagcta

SEQ ID NO: 8103516 - DNA, 19 bp, Homo sapiens
tttgaatataatgcagcta

SEQ ID NO: 8103517 - DNA, 22 bp, Homo sapiens
tttcctctaaacgcatttgctt

SEQ ID NO: 8103518 - DNA, 22 bp, Homo sapiens
tttcttttccaatatccctact

SEQ ID NO: 8103519 - DNA, 19 bp, Homo sapiens
tttcttttcccctcagcac

SEQ ID NO: 8103520 - DNA, 22 bp, Homo sapiens
tttcttttgaatagtgtgtggt

SEQ ID NO: 8103521 - DNA, 22 bp, Homo sapiens
tttcttttgctgagaggggcac

SEQ ID NO: 8103522 - DNA, 22 bp, Homo sapiens
tttcttttgccctgtgggttag

SEQ ID NO: 8103523 - DNA, 22 bp, Homo sapiens
tttcttttacagtgtggctatt

SEQ ID NO: 8103524 - DNA, 21 bp, Homo sapiens
tttctttctggctctcacagt

SEQ ID NO: 8103525 - DNA, 22 bp, Homo sapiens
tttgatatcttggtatacagat

SEQ ID NO: 8103526 - DNA, 22 bp, Homo sapiens
tttgatctcccagactaaggag

SEQ ID NO: 8103527 - DNA, 22 bp, Homo sapiens
tttgaggttagctagcagatca

SEQ ID NO: 8103528 - DNA, 22 bp, Homo sapiens
tttgctttgggaggttgtctgg

SEQ ID NO: 8103529 - DNA, 18 bp, Homo sapiens
tttgctttccttcttcag

SEQ ID NO: 8103530 - DNA, 22 bp, Homo sapiens
tttttcatctgattgataactc

SEQ ID NO: 8103531 - DNA, 22 bp, Homo sapiens
tttttcaagacaacctgcatgt

SEQ ID NO: 8103532 - DNA, 22 bp, Homo sapiens
tttttcaagacaacctgcatgt

SEQ ID NO: 8103533 - DNA, 22 bp, Homo sapiens
tttttatcttgtatgtgtctct

SEQ ID NO: 8103534 - DNA, 22 bp, Homo sapiens
tttttagagtgttaccagtata

SEQ ID NO: 8103535 - DNA, 22 bp, Homo sapiens
tttttagattactcagccacca

SEQ ID NO: 8103536 - DNA, 22 bp, Homo sapiens
ttttgtttgtgtccactgcagt

SEQ ID NO: 8103537 - DNA, 22 bp, Homo sapiens
ttttcttcctggattttggcat

SEQ ID NO: 8103538 - DNA, 22 bp, Homo sapiens
cacagccctgcgccccagtttg

SEQ ID NO: 8103539 - DNA, 22 bp, Homo sapiens
cacagcaggcagaacgtgggca

SEQ ID NO: 8103540 - DNA, 21 bp, Homo sapiens
cacagcagggttcctgggctc

SEQ ID NO: 8103541 - DNA, 22 bp, Homo sapiens
cacagcataatgaaatatactt

SEQ ID NO: 8103542 - DNA, 22 bp, Homo sapiens
ggaggagaccctgtgtcagttt

SEQ ID NO: 8103543 - DNA, 22 bp, Homo sapiens
ggaggagcacttctgagctcag

SEQ ID NO: 8103544 - DNA, 22 bp, Homo sapiens
ggaggagcacttgacggggtct

SEQ ID NO: 8103545 - DNA, 22 bp, Homo sapiens
ggaggggatggtttgaccctgg

SEQ ID NO: 8103546 - DNA, 22 bp, Homo sapiens
ggaggggatttagtagatgcta

SEQ ID NO: 8103547 - DNA, 22 bp, Homo sapiens
cacagctatgagcagcctagct

SEQ ID NO: 8103548 - DNA, 22 bp, Homo sapiens
cacagctaggaggaaagcagag

SEQ ID NO: 8103549 - DNA, 22 bp, Homo sapiens
cacagctagatggatagataga

SEQ ID NO: 8103550 - DNA, 22 bp, Homo sapiens
cacagctacctgcatgcctgct

SEQ ID NO: 8103551 - DNA, 22 bp, Homo sapiens
ggagagtgggagcaactgttgc

SEQ ID NO: 8103552 - DNA, 22 bp, Homo sapiens
ggagagtggattccagctgtat

SEQ ID NO: 8103553 - DNA, 17 bp, Homo sapiens
ggagagtgggaatggcc

SEQ ID NO: 8103554 - DNA, 18 bp, Homo sapiens
ggagagtgagatcaaaca

SEQ ID NO: 8103555 - DNA, 18 bp, Homo sapiens
ggagagtgacagagtcgt

SEQ ID NO: 8103556 - DNA, 22 bp, Homo sapiens
ggacagcattcctagttccaaa

SEQ ID NO: 8103557 - DNA, 22 bp, Homo sapiens
ggacagcgtggctggtggaggg

SEQ ID NO: 8103558 - DNA, 22 bp, Homo sapiens
ggacaaatctcattatttctga

SEQ ID NO: 8103559 - DNA, 22 bp, Homo sapiens
ggaaggggtcacctcctgatga

SEQ ID NO: 8103560 - DNA, 22 bp, Homo sapiens
gctgggaggaatttggggaata

SEQ ID NO: 8103561 - DNA, 22 bp, Homo sapiens
gctgggaggaatttggggaata

SEQ ID NO: 8103562 - DNA, 22 bp, Homo sapiens
gctgggcccagatcccaggatc

SEQ ID NO: 8103563 - DNA, 22 bp, Homo sapiens
gctgggccttccgattctcaag

SEQ ID NO: 8103564 - DNA, 21 bp, Homo sapiens
gctgggcctgtacttgccctg

SEQ ID NO: 8103565 - DNA, 22 bp, Homo sapiens
gctgggccttccgattctcaag

SEQ ID NO: 8103566 - DNA, 20 bp, Homo sapiens
gctgggctaccactggccct

SEQ ID NO: 8103567 - DNA, 22 bp, Homo sapiens
gctgggccctgggtgccctagc

SEQ ID NO: 8103568 - DNA, 22 bp, Homo sapiens
gctgggccgacctgggctgcag

SEQ ID NO: 8103569 - DNA, 22 bp, Homo sapiens
gctgggagcaagtactcatctt

SEQ ID NO: 8103570 - DNA, 22 bp, Homo sapiens
gctgggagcaagtactcatctt

SEQ ID NO: 8103571 - DNA, 19 bp, Homo sapiens
gctgggagcagaccctccc

SEQ ID NO: 8103572 - DNA, 22 bp, Homo sapiens
gctgggagccccgagccagcgc

SEQ ID NO: 8103573 - DNA, 22 bp, Homo sapiens
gctgggagccccgagccagcgc

SEQ ID NO: 8103574 - DNA, 22 bp, Homo sapiens
gctgggagccctggtctgctcc

SEQ ID NO: 8103575 - DNA, 22 bp, Homo sapiens
gctggccatggcctgcgccatc

SEQ ID NO: 8103576 - DNA, 22 bp, Homo sapiens
gctggccagtgtggtgaccacc

SEQ ID NO: 8103577 - DNA, 22 bp, Homo sapiens
gctggcagccaagtgaagaggg

SEQ ID NO: 8103578 - DNA, 20 bp, Homo sapiens
gctggcagatgtcttgagat

SEQ ID NO: 8103579 - DNA, 20 bp, Homo sapiens
gctggcagatgtcttgagat

SEQ ID NO: 8103580 - DNA, 22 bp, Homo sapiens
gctggcagcattagaccctggg

SEQ ID NO: 8103581 - DNA, 22 bp, Homo sapiens
gctggcagagctctgggctggg

SEQ ID NO: 8103582 - DNA, 22 bp, Homo sapiens
gctggcagagagctggtgagga

SEQ ID NO: 8103583 - DNA, 22 bp, Homo sapiens
gctggcagagagctggtgagga

SEQ ID NO: 8103584 - DNA, 16 bp, Homo sapiens
gctggagggaggggtt

SEQ ID NO: 8103585 - DNA, 22 bp, Homo sapiens
caaattctcttactgtttgaca

SEQ ID NO: 8103586 - DNA, 22 bp, Homo sapiens
caaattctcaccctgtttgatt

SEQ ID NO: 8103587 - DNA, 18 bp, Homo sapiens
caaattctcattgatttc

SEQ ID NO: 8103588 - DNA, 18 bp, Homo sapiens
caaattcagtgctggaag

SEQ ID NO: 8103589 - DNA, 23 bp, Homo sapiens
caaattctaggcaggctcttttg

SEQ ID NO: 8103590 - DNA, 18 bp, Homo sapiens
caaattcagtgctggaag

SEQ ID NO: 8103591 - DNA, 22 bp, Homo sapiens
caaattcagaaaattggtagag

SEQ ID NO: 8103592 - DNA, 22 bp, Homo sapiens
caaatttaagttagaaagcaat

SEQ ID NO: 8103593 - DNA, 20 bp, Homo sapiens
caaattctgttgaatacacc

SEQ ID NO: 8103594 - DNA, 22 bp, Homo sapiens
caaatttaggtaacagtctgta

SEQ ID NO: 8103595 - DNA, 22 bp, Homo sapiens
ggaacacagtgccttacaaact

SEQ ID NO: 8103596 - DNA, 22 bp, Homo sapiens
caatgtactacaaagattgtca

SEQ ID NO: 8103597 - DNA, 22 bp, Homo sapiens
caatgtatcaaccagaaagttc

SEQ ID NO: 8103598 - DNA, 22 bp, Homo sapiens
gctggtggtgggccagttctgt

SEQ ID NO: 8103599 - DNA, 22 bp, Homo sapiens
gctggtctccgccgctccctga

SEQ ID NO: 8103600 - DNA, 19 bp, Homo sapiens
caagttaaaatgaggtcat

SEQ ID NO: 8103601 - DNA, 22 bp, Homo sapiens
caagttacaaaagaaccacggt

SEQ ID NO: 8103602 - DNA, 22 bp, Homo sapiens
caagtgtctatatcagtgcttg

SEQ ID NO: 8103603 - DNA, 22 bp, Homo sapiens
gctgggctcaccaggccactag

SEQ ID NO: 8103604 - DNA, 22 bp, Homo sapiens
caagtgatcctcccatcttggc

SEQ ID NO: 8103605 - DNA, 22 bp, Homo sapiens
caagttgtacagattgtattag

SEQ ID NO: 8103606 - DNA, 22 bp, Homo sapiens
caagttagttattcttgtgagc

SEQ ID NO: 8103607 - DNA, 22 bp, Homo sapiens
ggctcctgtcccctcagctgct

SEQ ID NO: 8103608 - DNA, 22 bp, Homo sapiens
ggctgcagcggattggggattg

SEQ ID NO: 8103609 - DNA, 22 bp, Homo sapiens
ggctgcggatctaaggctggga

SEQ ID NO: 8103610 - DNA, 23 bp, Homo sapiens
ggctgggagctccgggtgcacgt

SEQ ID NO: 8103611 - DNA, 22 bp, Homo sapiens
cagaaatgtgatgtacacacac

SEQ ID NO: 8103612 - DNA, 19 bp, Homo sapiens
ggctgctggttacagaggc

SEQ ID NO: 8103613 - DNA, 22 bp, Homo sapiens
ggctgctggtggaatggtaggc

SEQ ID NO: 8103614 - DNA, 22 bp, Homo sapiens
ggctgctggtaggggtaggaag

SEQ ID NO: 8103615 - DNA, 22 bp, Homo sapiens
ggcttcaggggcccagtcagca

SEQ ID NO: 8103616 - DNA, 19 bp, Homo sapiens
cacattttgagtctgagat

SEQ ID NO: 8103617 - DNA, 22 bp, Homo sapiens
cacatttttactgccaacttaa

SEQ ID NO: 8103618 - DNA, 22 bp, Homo sapiens
ggccagcctggggctcccagac

SEQ ID NO: 8103619 - DNA, 22 bp, Homo sapiens
ggcccagaagccagaagcctcc

SEQ ID NO: 8103620 - DNA, 22 bp, Homo sapiens
ggcccagacccaagagtggtgg

SEQ ID NO: 8103621 - DNA, 22 bp, Homo sapiens
ggcccagagacgtgcaatgtac

SEQ ID NO: 8103622 - DNA, 22 bp, Homo sapiens
ggcgagggagcagtgcggtggg

SEQ ID NO: 8103623 - DNA, 22 bp, Homo sapiens
ggccccaggcctttggtctggc

SEQ ID NO: 8103624 - DNA, 22 bp, Homo sapiens
ggccccagcctcagtcccctga

SEQ ID NO: 8103625 - DNA, 22 bp, Homo sapiens
ggaggtggaggttgcagtgagc

SEQ ID NO: 8103626 - DNA, 22 bp, Homo sapiens
ggagtgactctcggggccacta

SEQ ID NO: 8103627 - DNA, 22 bp, Homo sapiens
ggagtgactcacagctgggaca

SEQ ID NO: 8103628 - DNA, 22 bp, Homo sapiens
ggcagtagccagggactggcag

SEQ ID NO: 8103629 - DNA, 22 bp, Homo sapiens
cacatttctaggaaattaaatg

SEQ ID NO: 8103630 - DNA, 22 bp, Homo sapiens
cacatgctcattggcactgttc

SEQ ID NO: 8103631 - DNA, 22 bp, Homo sapiens
cagcagtcaggcctgtgggaga

SEQ ID NO: 8103632 - DNA, 22 bp, Homo sapiens
cagcagtccctgcagtggggaa

SEQ ID NO: 8103633 - DNA, 22 bp, Homo sapiens
cagcagtctgtttcaacaggtc

SEQ ID NO: 8103634 - DNA, 22 bp, Homo sapiens
cagcagggaagctgtgctgttt

SEQ ID NO: 8103635 - DNA, 22 bp, Homo sapiens
cagcagagcatttggtaggagg

SEQ ID NO: 8103636 - DNA, 22 bp, Homo sapiens
gtcctgagaatactaggcacaa

SEQ ID NO: 8103637 - DNA, 22 bp, Homo sapiens
cagcatgcaagtccagatgtgg

SEQ ID NO: 8103638 - DNA, 22 bp, Homo sapiens
gtctcagtaagaaaggctcctg

SEQ ID NO: 8103639 - DNA, 22 bp, Homo sapiens
gtctcagttttccaaactgtca

SEQ ID NO: 8103640 - DNA, 20 bp, Homo sapiens
gtctccactgggggttaacc

SEQ ID NO: 8103641 - DNA, 22 bp, Homo sapiens
gtctctgtgtctgagagagccc

SEQ ID NO: 8103642 - DNA, 19 bp, Homo sapiens
gtcttacaggcaacatgag

SEQ ID NO: 8103643 - DNA, 22 bp, Homo sapiens
gtgcaaaagtaattacagtttt

SEQ ID NO: 8103644 - DNA, 22 bp, Homo sapiens
gtgcaaaagtaattgcagtact

SEQ ID NO: 8103645 - DNA, 22 bp, Homo sapiens
gtgaatactgtatctcaggaca

SEQ ID NO: 8103646 - DNA, 22 bp, Homo sapiens
gtgcaaaatttggccaataaca

SEQ ID NO: 8103647 - DNA, 22 bp, Homo sapiens
gtgcagcagggggaagacagtg

SEQ ID NO: 8103648 - DNA, 23 bp, Homo sapiens
gtgcagcagtgtctgcagtcatg

SEQ ID NO: 8103649 - DNA, 22 bp, Homo sapiens
gtgcagcaggggccctctcacc

SEQ ID NO: 8103650 - DNA, 22 bp, Homo sapiens
cagctcccagtggcagctcctt

SEQ ID NO: 8103651 - DNA, 22 bp, Homo sapiens
cagctcagcttcctgggtgtgt

SEQ ID NO: 8103652 - DNA, 22 bp, Homo sapiens
cagctcagcttcctgggtgtgt

SEQ ID NO: 8103653 - DNA, 22 bp, Homo sapiens
gtgcctggtttggggaatgttc

SEQ ID NO: 8103654 - DNA, 22 bp, Homo sapiens
gtgcctggtatgtaggtagcgg

SEQ ID NO: 8103655 - DNA, 22 bp, Homo sapiens
gtgccctgacacacctggtgtg

SEQ ID NO: 8103656 - DNA, 22 bp, Homo sapiens
gtgcctgggggtaatgtaggat

SEQ ID NO: 8103657 - DNA, 22 bp, Homo sapiens
cagccctgttgcgcttccggcg

SEQ ID NO: 8103658 - DNA, 22 bp, Homo sapiens
cagccctgtgctaagcaccctc

SEQ ID NO: 8103659 - DNA, 22 bp, Homo sapiens
cagctcctagatcggcgaagtg

SEQ ID NO: 8103660 - DNA, 22 bp, Homo sapiens
ggtggcagtggtctctgacaga

SEQ ID NO: 8103661 - DNA, 22 bp, Homo sapiens
ggtggcagtagcactgggcctg

SEQ ID NO: 8103662 - DNA, 22 bp, Homo sapiens
cagatggcaacagctctgtgac

SEQ ID NO: 8103663 - DNA, 22 bp, Homo sapiens
ggtggcagggagtgtccctggg

SEQ ID NO: 8103664 - DNA, 22 bp, Homo sapiens
cagatgcttttgattctggggt

SEQ ID NO: 8103665 - DNA, 17 bp, Homo sapiens
gtaaggcttgcagatgc

SEQ ID NO: 8103666 - DNA, 18 bp, Homo sapiens
gtaagcaaagactttata

SEQ ID NO: 8103667 - DNA, 22 bp, Homo sapiens
gtaaacatcgacccaacagggg

SEQ ID NO: 8103668 - DNA, 22 bp, Homo sapiens
ggtgagaggcagaggacagctt

SEQ ID NO: 8103669 - DNA, 22 bp, Homo sapiens
cagatacagctagctccgtggc

SEQ ID NO: 8103670 - DNA, 22 bp, Homo sapiens
cagataactgaaatatcatacc

SEQ ID NO: 8103671 - DNA, 22 bp, Homo sapiens
cagataaatagatagataaact

SEQ ID NO: 8103672 - DNA, 20 bp, Homo sapiens
cagataaacgggaaagaagc

SEQ ID NO: 8103673 - DNA, 22 bp, Homo sapiens
cagatgctatgtattatgtatg

SEQ ID NO: 8103674 - DNA, 22 bp, Homo sapiens
ggtgcagagcagtgtcagagca

SEQ ID NO: 8103675 - DNA, 22 bp, Homo sapiens
ggtgcagaagaaagcagtcatt

SEQ ID NO: 8103676 - DNA, 22 bp, Homo sapiens
ggggtcctggaggccagctgga

SEQ ID NO: 8103677 - DNA, 22 bp, Homo sapiens
ggggtagggtgattgtgaagta

SEQ ID NO: 8103678 - DNA, 22 bp, Homo sapiens
cagaggcaggataagaactgcg

SEQ ID NO: 8103679 - DNA, 22 bp, Homo sapiens
gggctcaggagtttgaggctgc

SEQ ID NO: 8103680 - DNA, 22 bp, Homo sapiens
gggctcagggacacatgtgtgt

SEQ ID NO: 8103681 - DNA, 22 bp, Homo sapiens
gggctcagtcggcaagcccctt

SEQ ID NO: 8103682 - DNA, 21 bp, Homo sapiens
gggctcagtggaaaagagtgt

SEQ ID NO: 8103683 - DNA, 21 bp, Homo sapiens
gggctctgccctcctggagct

SEQ ID NO: 8103684 - DNA, 22 bp, Homo sapiens
gggggatgctcaggaggctgct

SEQ ID NO: 8103685 - DNA, 22 bp, Homo sapiens
cagaggcagccgggggagaacg

SEQ ID NO: 8103686 - DNA, 22 bp, Homo sapiens
cagaggaagcagacacatcttg

SEQ ID NO: 8103687 - DNA, 22 bp, Homo sapiens
gggggaggtgaatgcaataagg

SEQ ID NO: 8103688 - DNA, 22 bp, Homo sapiens
gggggagctgttattggcaggg

SEQ ID NO: 8103689 - DNA, 22 bp, Homo sapiens
cagagcaggcccactgccctcc

SEQ ID NO: 8103690 - DNA, 22 bp, Homo sapiens
cagagcaggaatagggtgttga

SEQ ID NO: 8103691 - DNA, 22 bp, Homo sapiens
cagagcagcctccagggggagc

SEQ ID NO: 8103692 - DNA, 22 bp, Homo sapiens
cagagcagcagagcttccatgg

SEQ ID NO: 8103693 - DNA, 22 bp, Homo sapiens
cagagcagagtgattgttctgg

SEQ ID NO: 8103694 - DNA, 22 bp, Homo sapiens
gggccctgggattcagagcaag

SEQ ID NO: 8103695 - DNA, 22 bp, Homo sapiens
gggccctgggattcagagcaag

SEQ ID NO: 8103696 - DNA, 20 bp, Homo sapiens
gggccctgggattcagagca

SEQ ID NO: 8103697 - DNA, 20 bp, Homo sapiens
gggccctgggattcagagca

SEQ ID NO: 8103698 - DNA, 18 bp, Homo sapiens
gggccctggcgtccgccc

SEQ ID NO: 8103699 - DNA, 22 bp, Homo sapiens
gggccctggctttcctgttctt

SEQ ID NO: 8103700 - DNA, 22 bp, Homo sapiens
gggccctggctttcctgttctt

SEQ ID NO: 8103701 - DNA, 22 bp, Homo sapiens
cagagagcacataggatacttt

SEQ ID NO: 8103702 - DNA, 22 bp, Homo sapiens
cagagagagtctgtccctgaag

SEQ ID NO: 8103703 - DNA, 22 bp, Homo sapiens
cagagagagtggggtgtggatt

SEQ ID NO: 8103704 - DNA, 22 bp, Homo sapiens
gggccctggatttaagcatgga

SEQ ID NO: 8103705 - DNA, 22 bp, Homo sapiens
gggccctggccgaatccctctg

SEQ ID NO: 8103706 - DNA, 22 bp, Homo sapiens
gggccctggccgaatccctctg

SEQ ID NO: 8103707 - DNA, 22 bp, Homo sapiens
gggccctgcgtccggaagtctg

SEQ ID NO: 8103708 - DNA, 22 bp, Homo sapiens
gggccctggacgtggcggcaga

SEQ ID NO: 8103709 - DNA, 22 bp, Homo sapiens
gggccctgcgtccggaagtctg

SEQ ID NO: 8103710 - DNA, 22 bp, Homo sapiens
cagagagaggggctgcctggcc

SEQ ID NO: 8103711 - DNA, 22 bp, Homo sapiens
cagagagagtcaaatctttgct

SEQ ID NO: 8103712 - DNA, 22 bp, Homo sapiens
cagagagaggtgccgataatgg

SEQ ID NO: 8103713 - DNA, 19 bp, Homo sapiens
cagagagaccaaggcgcca

SEQ ID NO: 8103714 - DNA, 22 bp, Homo sapiens
cagagagaggccactgctatta

SEQ ID NO: 8103715 - DNA, 22 bp, Homo sapiens
cagagagagcaggaaacctccg

SEQ ID NO: 8103716 - DNA, 22 bp, Homo sapiens
cagagagaatcttggcagctga

SEQ ID NO: 8103717 - DNA, 22 bp, Homo sapiens
cagagagaatatgtagtatgga

SEQ ID NO: 8103718 - DNA, 22 bp, Homo sapiens
gagaggctctgaggactggggt

SEQ ID NO: 8103719 - DNA, 22 bp, Homo sapiens
gagaggtggaggttgcagtgag

SEQ ID NO: 8103720 - DNA, 22 bp, Homo sapiens
gagaggtgaatgtggatgccac

SEQ ID NO: 8103721 - DNA, 22 bp, Homo sapiens
gagaggtggaggttgcagtgag

SEQ ID NO: 8103722 - DNA, 22 bp, Homo sapiens
gagaggtggtgaggacttgtct

SEQ ID NO: 8103723 - DNA, 22 bp, Homo sapiens
gagaggtgaaatagttgtccgg

SEQ ID NO: 8103724 - DNA, 22 bp, Homo sapiens
gagaggtgaaggctgccctggg

SEQ ID NO: 8103725 - DNA, 22 bp, Homo sapiens
gagaggtgaatgtggatgccac

SEQ ID NO: 8103726 - DNA, 22 bp, Homo sapiens
gagcctgtgtttcctgtagcca

SEQ ID NO: 8103727 - DNA, 22 bp, Homo sapiens
gaggaagcagggcttggctgag

SEQ ID NO: 8103728 - DNA, 22 bp, Homo sapiens
gagcttttataccttctctcag

SEQ ID NO: 8103729 - DNA, 20 bp, Homo sapiens
atggttcaggccagctgtct

SEQ ID NO: 8103730 - DNA, 22 bp, Homo sapiens
atggttcatattatgcatctga

SEQ ID NO: 8103731 - DNA, 22 bp, Homo sapiens
gaggaagcttttgatcgcccag

SEQ ID NO: 8103732 - DNA, 18 bp, Homo sapiens
atgtcacagagggctgaa

SEQ ID NO: 8103733 - DNA, 22 bp, Homo sapiens
atgtaaagtataaagtaagggg

SEQ ID NO: 8103734 - DNA, 17 bp, Homo sapiens
gaggccaaggcaggcgg

SEQ ID NO: 8103735 - DNA, 22 bp, Homo sapiens
gaggctgtgtgtccctctggac

SEQ ID NO: 8103736 - DNA, 22 bp, Homo sapiens
gaggctgttagggcctgaggta

SEQ ID NO: 8103737 - DNA, 22 bp, Homo sapiens
gaggctgttcagtgtccagctt

SEQ ID NO: 8103738 - DNA, 22 bp, Homo sapiens
gagggatgtgcctgaaggcagg

SEQ ID NO: 8103739 - DNA, 22 bp, Homo sapiens
gagggatggtgtgagaggctca

SEQ ID NO: 8103740 - DNA, 22 bp, Homo sapiens
gagggggctccctgaagccagt

SEQ ID NO: 8103741 - DNA, 19 bp, Homo sapiens
gaggggaggaattgacaag

SEQ ID NO: 8103742 - DNA, 22 bp, Homo sapiens
gagggggcgtgcaaggctccgc

SEQ ID NO: 8103743 - DNA, 22 bp, Homo sapiens
gaggtagctcttactctctccg

SEQ ID NO: 8103744 - DNA, 22 bp, Homo sapiens
gaggttggggctgcagtgagct

SEQ ID NO: 8103745 - DNA, 22 bp, Homo sapiens
gatcgggtgggttctgccatca

SEQ ID NO: 8103746 - DNA, 22 bp, Homo sapiens
gatcctgggcccttctgggtca

SEQ ID NO: 8103747 - DNA, 22 bp, Homo sapiens
gatcctggagctccatcactat

SEQ ID NO: 8103748 - DNA, 22 bp, Homo sapiens
gagttaattcgaatattctagc

SEQ ID NO: 8103749 - DNA, 22 bp, Homo sapiens
gagttaattcgaatattctagc

SEQ ID NO: 8103750 - DNA, 22 bp, Homo sapiens
gagttaatactgagtttattaa

SEQ ID NO: 8103751 - DNA, 22 bp, Homo sapiens
gagttaatgtgtacacaaaggg

SEQ ID NO: 8103752 - DNA, 22 bp, Homo sapiens
gagttaatgaggccaagggcag

SEQ ID NO: 8103753 - DNA, 22 bp, Homo sapiens
gagttaatgtgtacacaaaggg

SEQ ID NO: 8103754 - DNA, 22 bp, Homo sapiens
gagttaatactgagtttattaa

SEQ ID NO: 8103755 - DNA, 22 bp, Homo sapiens
gagttaatagggttctttgtga

SEQ ID NO: 8103756 - DNA, 21 bp, Homo sapiens
gagttaatttgacccctgcct

SEQ ID NO: 8103757 - DNA, 22 bp, Homo sapiens
gagttagaagacagaatgtaaa

SEQ ID NO: 8103758 - DNA, 22 bp, Homo sapiens
gatctcaaagcagtgtgggttg

SEQ ID NO: 8103759 - DNA, 22 bp, Homo sapiens
gatctgaagatatgaaatattt

SEQ ID NO: 8103760 - DNA, 22 bp, Homo sapiens
atgtttctaaaacttgcatggc

SEQ ID NO: 8103761 - DNA, 21 bp, Homo sapiens
gagtgcaggtctgatgccatc

SEQ ID NO: 8103762 - DNA, 22 bp, Homo sapiens
gagtccagttagtgaggctggg

SEQ ID NO: 8103763 - DNA, 22 bp, Homo sapiens
atgtttacaaaaaggaggcttg

SEQ ID NO: 8103764 - DNA, 22 bp, Homo sapiens
atgtttcaggcgaactaacatg

SEQ ID NO: 8103765 - DNA, 22 bp, Homo sapiens
atgtttcagttctaaagttaga

SEQ ID NO: 8103766 - DNA, 22 bp, Homo sapiens
gacagtggagggctgatgttaa

SEQ ID NO: 8103767 - DNA, 20 bp, Homo sapiens
atgcttaagtgttcattatt

SEQ ID NO: 8103768 - DNA, 22 bp, Homo sapiens
atgctttattggagacagtcat

SEQ ID NO: 8103769 - DNA, 22 bp, Homo sapiens
gactttctgagtcaaagaaagg

SEQ ID NO: 8103770 - DNA, 22 bp, Homo sapiens
gactttctgatgtaaacattta

SEQ ID NO: 8103771 - DNA, 22 bp, Homo sapiens
gaccctctagatggaagcactg

SEQ ID NO: 8103772 - DNA, 22 bp, Homo sapiens
gactttcttgcagaaatattcc

SEQ ID NO: 8103773 - DNA, 22 bp, Homo sapiens
gaatcaggattcaagatcagct

SEQ ID NO: 8103774 - DNA, 22 bp, Homo sapiens
atgcctgagactgttaattggc

SEQ ID NO: 8103775 - DNA, 23 bp, Homo sapiens
atgccctgtgcagaaatgtggaa

SEQ ID NO: 8103776 - DNA, 22 bp, Homo sapiens
atgccctgtggcagtacatatt

SEQ ID NO: 8103777 - DNA, 22 bp, Homo sapiens
atgccctgtgactctcctggac

SEQ ID NO: 8103778 - DNA, 22 bp, Homo sapiens
atgccctgtgactctcctggac

SEQ ID NO: 8103779 - DNA, 23 bp, Homo sapiens
atgccctgtagaggctgctgacc

SEQ ID NO: 8103780 - DNA, 20 bp, Homo sapiens
atgccctgtcctcttctgtt

SEQ ID NO: 8103781 - DNA, 22 bp, Homo sapiens
atgccctggacttctagtattc

SEQ ID NO: 8103782 - DNA, 22 bp, Homo sapiens
atgccctgggagtgctgtacca

SEQ ID NO: 8103783 - DNA, 23 bp, Homo sapiens
atgccctgtagaggctgctgacc

SEQ ID NO: 8103784 - DNA, 22 bp, Homo sapiens
atgccctggggctacctctgag

SEQ ID NO: 8103785 - DNA, 18 bp, Homo sapiens
atgccctgttgacttcag

SEQ ID NO: 8103786 - DNA, 22 bp, Homo sapiens
atgccctgtggttcatgtgaga

SEQ ID NO: 8103787 - DNA, 22 bp, Homo sapiens
atgccctgtggttcatgtgaga

SEQ ID NO: 8103788 - DNA, 22 bp, Homo sapiens
atgccctgaaagattcaaaggc

SEQ ID NO: 8103789 - DNA, 22 bp, Homo sapiens
atgccctgagcaggccttcaag

SEQ ID NO: 8103790 - DNA, 22 bp, Homo sapiens
atgcccaggcccatacctagat

SEQ ID NO: 8103791 - DNA, 22 bp, Homo sapiens
atgcccaggcccatacctagat

SEQ ID NO: 8103792 - DNA, 22 bp, Homo sapiens
atgcccagggctggtgaggtcc

SEQ ID NO: 8103793 - DNA, 22 bp, Homo sapiens
atgccctgctctcgggaaggga

SEQ ID NO: 8103794 - DNA, 22 bp, Homo sapiens
atgccctgcatcaagtgacact

SEQ ID NO: 8103795 - DNA, 22 bp, Homo sapiens
atgccctgctgccatctggccg

SEQ ID NO: 8103796 - DNA, 22 bp, Homo sapiens
atgccctgctgctggggcagtg

SEQ ID NO: 8103797 - DNA, 22 bp, Homo sapiens
atgccacttcattccagcctcg

SEQ ID NO: 8103798 - DNA, 22 bp, Homo sapiens
gaacattattgtacaaatgtct

SEQ ID NO: 8103799 - DNA, 22 bp, Homo sapiens
gaacatgatggctgttattttg

SEQ ID NO: 8103800 - DNA, 22 bp, Homo sapiens
atgcaagacccagaaatcatta

SEQ ID NO: 8103801 - DNA, 22 bp, Homo sapiens
atgcaataaatactttccagct

SEQ ID NO: 8103802 - DNA, 22 bp, Homo sapiens
atgcaatggtatatggtcacct

SEQ ID NO: 8103803 - DNA, 22 bp, Homo sapiens
gaaatatacatgaagtcggctg

SEQ ID NO: 8103804 - DNA, 23 bp, Homo sapiens
gaaatctagtcatttttagtctg

SEQ ID NO: 8103805 - DNA, 23 bp, Homo sapiens
gaaatctagtcatttttagtctg

SEQ ID NO: 8103806 - DNA, 22 bp, Homo sapiens
gaaatatacatgaagtcggctg

SEQ ID NO: 8103807 - DNA, 22 bp, Homo sapiens
gaaaagaactgcatgggattaa

SEQ ID NO: 8103808 - DNA, 22 bp, Homo sapiens
gaaaatctgcttatattatttt

SEQ ID NO: 8103809 - DNA, 22 bp, Homo sapiens
gaaaatagttcatcacaatgat

SEQ ID NO: 8103810 - DNA, 22 bp, Homo sapiens
atgaattaaggataactggtct

SEQ ID NO: 8103811 - DNA, 22 bp, Homo sapiens
cttgagagccactcctggggcc

SEQ ID NO: 8103812 - DNA, 22 bp, Homo sapiens
atcttccaggtgccgggggtca

SEQ ID NO: 8103813 - DNA, 22 bp, Homo sapiens
atcttcatcaagttcacagtgg

SEQ ID NO: 8103814 - DNA, 18 bp, Homo sapiens
cttgagctaagggacccc

SEQ ID NO: 8103815 - DNA, 22 bp, Homo sapiens
cttgaggctgcactccagggcc

SEQ ID NO: 8103816 - DNA, 22 bp, Homo sapiens
atgaagcaggcacagcttcagg

SEQ ID NO: 8103817 - DNA, 22 bp, Homo sapiens
atgaatacgcggtcatacacat

SEQ ID NO: 8103818 - DNA, 22 bp, Homo sapiens
gccactggacccagaaagggaa

SEQ ID NO: 8103819 - DNA, 22 bp, Homo sapiens
gccactgcactccagcccaggc

SEQ ID NO: 8103820 - DNA, 22 bp, Homo sapiens
gcattcactgggtgttcatggg

SEQ ID NO: 8103821 - DNA, 22 bp, Homo sapiens
gccactggcgctgtgcagagtg

SEQ ID NO: 8103822 - DNA, 22 bp, Homo sapiens
attgttttgtttcccagtgact

SEQ ID NO: 8103823 - DNA, 22 bp, Homo sapiens
atttaaatgcttaagagggttt

SEQ ID NO: 8103824 - DNA, 22 bp, Homo sapiens
attgttcctggaaaagaacagg

SEQ ID NO: 8103825 - DNA, 22 bp, Homo sapiens
attgttccatgttatatcacga

SEQ ID NO: 8103826 - DNA, 22 bp, Homo sapiens
attgttcaaagtgctttgcatg

SEQ ID NO: 8103827 - DNA, 22 bp, Homo sapiens
attgttcatgtatgaataaata

SEQ ID NO: 8103828 - DNA, 22 bp, Homo sapiens
attgttcattgtacacctagta

SEQ ID NO: 8103829 - DNA, 20 bp, Homo sapiens
attgtgcagcccttggcaga

SEQ ID NO: 8103830 - DNA, 21 bp, Homo sapiens
gcagtgcagcttggagggtag

SEQ ID NO: 8103831 - DNA, 22 bp, Homo sapiens
gcagtgattggatcagagatgg

SEQ ID NO: 8103832 - DNA, 20 bp, Homo sapiens
gcagtgatttgtctatgttt

SEQ ID NO: 8103833 - DNA, 22 bp, Homo sapiens
attgtacaatgcctggaacatt

SEQ ID NO: 8103834 - DNA, 22 bp, Homo sapiens
gcaggtggatcacctgaggtca

SEQ ID NO: 8103835 - DNA, 22 bp, Homo sapiens
gcaggtggatcaccacgtcagg

SEQ ID NO: 8103836 - DNA, 17 bp, Homo sapiens
gcacagaggccaaagga

SEQ ID NO: 8103837 - DNA, 22 bp, Homo sapiens
gcacagggagacagccgtggcc

SEQ ID NO: 8103838 - DNA, 22 bp, Homo sapiens
gcacagggaggctggcctggcc

SEQ ID NO: 8103839 - DNA, 22 bp, Homo sapiens
gcacagggccctgtgcgtaggt

SEQ ID NO: 8103840 - DNA, 21 bp, Homo sapiens
gcaaatgttcaggaaaaaaga

SEQ ID NO: 8103841 - DNA, 22 bp, Homo sapiens
gcaacaagtgtaaacatgcatt

SEQ ID NO: 8103842 - DNA, 22 bp, Homo sapiens
gcaaacaaggacatacatcctg

SEQ ID NO: 8103843 - DNA, 22 bp, Homo sapiens
gcaactgaacatgtgtgtggcc

SEQ ID NO: 8103844 - DNA, 23 bp, Homo sapiens
gcaacagagaagtaggagatggc

SEQ ID NO: 8103845 - DNA, 22 bp, Homo sapiens
gcaacagcattctcattgacat

SEQ ID NO: 8103846 - DNA, 22 bp, Homo sapiens
gcaacatcggtattggaggagt

SEQ ID NO: 8103847 - DNA, 22 bp, Homo sapiens
atgtttctagttgtatgtcact

SEQ ID NO: 8103848 - DNA, 22 bp, Homo sapiens
gcaaaattaaacttagcatcat

SEQ ID NO: 8103849 - DNA, 22 bp, Homo sapiens
gcaaaatttacactccttcttc

SEQ ID NO: 8103850 - DNA, 22 bp, Homo sapiens
gcaaacaagctgcctgaagatt

SEQ ID NO: 8103851 - DNA, 22 bp, Homo sapiens
gcaaaaattccagggacgactc

SEQ ID NO: 8103852 - DNA, 22 bp, Homo sapiens
gcagaaggtcaaagcaagatgt

SEQ ID NO: 8103853 - DNA, 22 bp, Homo sapiens
gcactgtgacccagagcaggtg

SEQ ID NO: 8103854 - DNA, 16 bp, Homo sapiens
gcagaggaaaggggag

SEQ ID NO: 8103855 - DNA, 22 bp, Homo sapiens
gcagaggctgtagggaaggttg

SEQ ID NO: 8103856 - DNA, 22 bp, Homo sapiens
gcagaggggaagctgaggaatt

SEQ ID NO: 8103857 - DNA, 19 bp, Homo sapiens
gcagccaggtgctctacct

SEQ ID NO: 8103858 - DNA, 22 bp, Homo sapiens
gcagatgcctgaaggagctggg

SEQ ID NO: 8103859 - DNA, 22 bp, Homo sapiens
gcagatgccagatcatgcaggg

SEQ ID NO: 8103860 - DNA, 22 bp, Homo sapiens
gcagcctgggcaacagagtgag

SEQ ID NO: 8103861 - DNA, 22 bp, Homo sapiens
gcagcctgatgatctgggttgt

SEQ ID NO: 8103862 - DNA, 22 bp, Homo sapiens
gcagccttggttgtgagatgaa

SEQ ID NO: 8103863 - DNA, 22 bp, Homo sapiens
gcagccttccgtggacctggac

SEQ ID NO: 8103864 - DNA, 22 bp, Homo sapiens
gcagccttatcattagagtgtt

SEQ ID NO: 8103865 - DNA, 18 bp, Homo sapiens
attttgaacaatgctgta

SEQ ID NO: 8103866 - DNA, 22 bp, Homo sapiens
attttgaagggaattgaagttc

SEQ ID NO: 8103867 - DNA, 22 bp, Homo sapiens
attttgaaaccaagttatttcc

SEQ ID NO: 8103868 - DNA, 22 bp, Homo sapiens
attttcttctctccctggctgc

SEQ ID NO: 8103869 - DNA, 22 bp, Homo sapiens
attttcttctctccctggctgc

SEQ ID NO: 8103870 - DNA, 22 bp, Homo sapiens
attttgaaaagcatttgagtaa

SEQ ID NO: 8103871 - DNA, 22 bp, Homo sapiens
attttacataaggaaggtttaa

SEQ ID NO: 8103872 - DNA, 18 bp, Homo sapiens
gcctgccatccccacagc

SEQ ID NO: 8103873 - DNA, 22 bp, Homo sapiens
gcctgccccttcctgggcaggg

SEQ ID NO: 8103874 - DNA, 22 bp, Homo sapiens
gcctgccctgaaagaggtgaag

SEQ ID NO: 8103875 - DNA, 23 bp, Homo sapiens
atttgacagagcatagcatttct

SEQ ID NO: 8103876 - DNA, 22 bp, Homo sapiens
atttgacattgacacacctatg

SEQ ID NO: 8103877 - DNA, 22 bp, Homo sapiens
atttgcagggaagggcagaagg

SEQ ID NO: 8103878 - DNA, 22 bp, Homo sapiens
attttaataagattcccaagta

SEQ ID NO: 8103879 - DNA, 23 bp, Homo sapiens
attttaaccttgactaacatgca

SEQ ID NO: 8103880 - DNA, 22 bp, Homo sapiens
atttgcatttagaaagatcact

SEQ ID NO: 8103881 - DNA, 19 bp, Homo sapiens
gccctgcaggaggtggggc

SEQ ID NO: 8103882 - DNA, 19 bp, Homo sapiens
gccctgcaggaggtggggc

SEQ ID NO: 8103883 - DNA, 22 bp, Homo sapiens
gccctgcagtgcggaggtggca

SEQ ID NO: 8103884 - DNA, 22 bp, Homo sapiens
gccctgccctctcggcactcgc

SEQ ID NO: 8103885 - DNA, 22 bp, Homo sapiens
gccctgccctctcggcactcgc

SEQ ID NO: 8103886 - DNA, 22 bp, Homo sapiens
gccctgcctgccggtgtgggtc

SEQ ID NO: 8103887 - DNA, 22 bp, Homo sapiens
gccctgccgggtattttgtgct

SEQ ID NO: 8103888 - DNA, 23 bp, Homo sapiens
gccctgcccttagcacactcaca

SEQ ID NO: 8103889 - DNA, 22 bp, Homo sapiens
gccctgccctgttgaaactaga

SEQ ID NO: 8103890 - DNA, 22 bp, Homo sapiens
gccctgccctgagccgtagacc

SEQ ID NO: 8103891 - DNA, 22 bp, Homo sapiens
gcccagcaggggatggcagctc

SEQ ID NO: 8103892 - DNA, 22 bp, Homo sapiens
gcccagcaggacagagtggttt

SEQ ID NO: 8103893 - DNA, 18 bp, Homo sapiens
gccagagggcccaaggtc

SEQ ID NO: 8103894 - DNA, 22 bp, Homo sapiens
atttacattccatggtggttac

SEQ ID NO: 8103895 - DNA, 22 bp, Homo sapiens
atttaccatatgtactgagtat

SEQ ID NO: 8103896 - DNA, 17 bp, Homo sapiens
atttacattgtcaccga

SEQ ID NO: 8103897 - DNA, 22 bp, Homo sapiens
atttacatttatttgagaaggt

SEQ ID NO: 8103898 - DNA, 22 bp, Homo sapiens
caaatctatatgttgatattct

SEQ ID NO: 8103899 - DNA, 22 bp, Homo sapiens
caaatctgagtctacaatttta

SEQ ID NO: 8103900 - DNA, 22 bp, Homo sapiens
caaatctaggatgcatgtagtg

SEQ ID NO: 8103901 - DNA, 22 bp, Homo sapiens
caaatcatggaataactagaga

SEQ ID NO: 8103902 - DNA, 22 bp, Homo sapiens
gctctgggtgaatggcagattg

SEQ ID NO: 8103903 - DNA, 22 bp, Homo sapiens
gctgaggaaaccaatgctcaga

SEQ ID NO: 8103904 - DNA, 22 bp, Homo sapiens
gctacagactgagcatggctct

SEQ ID NO: 8103905 - DNA, 22 bp, Homo sapiens
gcctggctctgagggagctcct

SEQ ID NO: 8103906 - DNA, 21 bp, Homo sapiens
gcctggctctcactggcctgg

SEQ ID NO: 8103907 - DNA, 22 bp, Homo sapiens
gcctggctcctaaggactggct

SEQ ID NO: 8103908 - DNA, 20 bp, Homo sapiens
gctcaggtttgggctttgtg

SEQ ID NO: 8103909 - DNA, 17 bp, Homo sapiens
ccctcactcctgccggg

SEQ ID NO: 8103910 - DNA, 22 bp, Homo sapiens
cccatgagacctggtttaaggc

SEQ ID NO: 8103911 - DNA, 22 bp, Homo sapiens
cccatgactctcattcacagtc

SEQ ID NO: 8103912 - DNA, 17 bp, Homo sapiens
cccatgagcccactccc

SEQ ID NO: 8103913 - DNA, 22 bp, Homo sapiens
cccatgaggtggaggttgcagt

SEQ ID NO: 8103914 - DNA, 22 bp, Homo sapiens
cccatgcaccctctaagaagga

SEQ ID NO: 8103915 - DNA, 22 bp, Homo sapiens
cccatggggacaccatgaagga

SEQ ID NO: 8103916 - DNA, 22 bp, Homo sapiens
cccatgggttttcctccctgcc

SEQ ID NO: 8103917 - DNA, 22 bp, Homo sapiens
cccatggagtgcctgagggcca

SEQ ID NO: 8103918 - DNA, 22 bp, Homo sapiens
cccatgccttctgactcacagg

SEQ ID NO: 8103919 - DNA, 22 bp, Homo sapiens
ccctgcacactcgtgtcttgac

SEQ ID NO: 8103920 - DNA, 22 bp, Homo sapiens
ccctgcacagcctggctctctt

SEQ ID NO: 8103921 - DNA, 22 bp, Homo sapiens
ccctgccaatcccgtctctctg

SEQ ID NO: 8103922 - DNA, 18 bp, Homo sapiens
ccctgccagctcccagca

SEQ ID NO: 8103923 - DNA, 22 bp, Homo sapiens
ccctgccagatgtgcttcagtt

SEQ ID NO: 8103924 - DNA, 22 bp, Homo sapiens
ccctcagctccaccctcagcag

SEQ ID NO: 8103925 - DNA, 22 bp, Homo sapiens
ccctcagctcaagcccctgtgc

SEQ ID NO: 8103926 - DNA, 22 bp, Homo sapiens
ccctgccccaggcggcttcact

SEQ ID NO: 8103927 - DNA, 23 bp, Homo sapiens
ccctgcccattgagcaggacgtc

SEQ ID NO: 8103928 - DNA, 22 bp, Homo sapiens
ccctgcccatcggggcggcctg

SEQ ID NO: 8103929 - DNA, 22 bp, Homo sapiens
ccctgccagggtcctgacagac

SEQ ID NO: 8103930 - DNA, 22 bp, Homo sapiens
ccctgctgcaggcttcaggagg

SEQ ID NO: 8103931 - DNA, 22 bp, Homo sapiens
ccctgctgcatggcctccacga

SEQ ID NO: 8103932 - DNA, 22 bp, Homo sapiens
ccctgctgtcaggtgctgggag

SEQ ID NO: 8103933 - DNA, 22 bp, Homo sapiens
ccctgctgtcaggtgctgggag

SEQ ID NO: 8103934 - DNA, 22 bp, Homo sapiens
ccctgctgccttcacccaggac

SEQ ID NO: 8103935 - DNA, 22 bp, Homo sapiens
ccctgctgtgtcccacctggaa

SEQ ID NO: 8103936 - DNA, 22 bp, Homo sapiens
ccctgctgtgcctgactgccat

SEQ ID NO: 8103937 - DNA, 22 bp, Homo sapiens
ccctgctgtgcctgactgccat

SEQ ID NO: 8103938 - DNA, 22 bp, Homo sapiens
ccctgctgtgtagcggaggaac

SEQ ID NO: 8103939 - DNA, 22 bp, Homo sapiens
ccctgctgtccctcagtcctgc

SEQ ID NO: 8103940 - DNA, 22 bp, Homo sapiens
cccaggctggaattccaggcct

SEQ ID NO: 8103941 - DNA, 22 bp, Homo sapiens
cccagtttcaactttccagtgg

SEQ ID NO: 8103942 - DNA, 22 bp, Homo sapiens
cccatctcagtcgtgctaaggg

SEQ ID NO: 8103943 - DNA, 22 bp, Homo sapiens
aggctgtgacagggtcatggag

SEQ ID NO: 8103944 - DNA, 22 bp, Homo sapiens
aggctggtgcttcctagggcag

SEQ ID NO: 8103945 - DNA, 22 bp, Homo sapiens
aggggatggagctggaaggcag

SEQ ID NO: 8103946 - DNA, 22 bp, Homo sapiens
aggggatgcctgaggatctgta

SEQ ID NO: 8103947 - DNA, 22 bp, Homo sapiens
aggggcagcctcacaatcctct

SEQ ID NO: 8103948 - DNA, 22 bp, Homo sapiens
aggggatgcctagtggagtctc

SEQ ID NO: 8103949 - DNA, 22 bp, Homo sapiens
aggggatgcctagtggagtctc

SEQ ID NO: 8103950 - DNA, 22 bp, Homo sapiens
aggggaggtgtccccaaatctc

SEQ ID NO: 8103951 - DNA, 22 bp, Homo sapiens
aggggaggcagcgataaacctg

SEQ ID NO: 8103952 - DNA, 22 bp, Homo sapiens
aggggagcaacatagtcactct

SEQ ID NO: 8103953 - DNA, 22 bp, Homo sapiens
cctgagagccctagccaggcgc

SEQ ID NO: 8103954 - DNA, 22 bp, Homo sapiens
cctgagagccagtgcctgccca

SEQ ID NO: 8103955 - DNA, 22 bp, Homo sapiens
cctgagagagtgagccctgaca

SEQ ID NO: 8103956 - DNA, 22 bp, Homo sapiens
agggtagggccgtagggccatg

SEQ ID NO: 8103957 - DNA, 22 bp, Homo sapiens
agggtagggtaaatgatgcatc

SEQ ID NO: 8103958 - DNA, 22 bp, Homo sapiens
agggtcaacaggagtcaagatg

SEQ ID NO: 8103959 - DNA, 22 bp, Homo sapiens
agggtcaagtcactggttcacg

SEQ ID NO: 8103960 - DNA, 22 bp, Homo sapiens
cctgagagtgagggcctcctta

SEQ ID NO: 8103961 - DNA, 22 bp, Homo sapiens
cctgagagtgagtgcctcctta

SEQ ID NO: 8103962 - DNA, 22 bp, Homo sapiens
cctgagagtgagtgccacctta

SEQ ID NO: 8103963 - DNA, 22 bp, Homo sapiens
agggtaggaactgagtggaagg

SEQ ID NO: 8103964 - DNA, 22 bp, Homo sapiens
agggtagggcccggagacagac

SEQ ID NO: 8103965 - DNA, 22 bp, Homo sapiens
ccctgctgtgtcccacctggaa

SEQ ID NO: 8103966 - DNA, 22 bp, Homo sapiens
ccctgctttcaaccttctagct

SEQ ID NO: 8103967 - DNA, 22 bp, Homo sapiens
ccctgcttagcacccttgcacc

SEQ ID NO: 8103968 - DNA, 22 bp, Homo sapiens
agggcctcagtgttctcatctg

SEQ ID NO: 8103969 - DNA, 18 bp, Homo sapiens
agggcctccatcccctcc

SEQ ID NO: 8103970 - DNA, 22 bp, Homo sapiens
agggcctccagggcagcagtgg

SEQ ID NO: 8103971 - DNA, 22 bp, Homo sapiens
agggcctgaggctgacggggag

SEQ ID NO: 8103972 - DNA, 22 bp, Homo sapiens
agggcctgaggctgacggggag

SEQ ID NO: 8103973 - DNA, 23 bp, Homo sapiens
agggcctgatggctcccgctggc

SEQ ID NO: 8103974 - DNA, 22 bp, Homo sapiens
agggcctgagctggctgacctc

SEQ ID NO: 8103975 - DNA, 22 bp, Homo sapiens
agggcctgagctggctgacctc

SEQ ID NO: 8103976 - DNA, 22 bp, Homo sapiens
agggcctgcatcaggagcttgg

SEQ ID NO: 8103977 - DNA, 19 bp, Homo sapiens
agggcctgcagctcaagct

SEQ ID NO: 8103978 - DNA, 22 bp, Homo sapiens
agggcctggactaattggatcc

SEQ ID NO: 8103979 - DNA, 22 bp, Homo sapiens
agggcctggcgcgtggccgccg

SEQ ID NO: 8103980 - DNA, 22 bp, Homo sapiens
agggcctggcgcgtggccgccg

SEQ ID NO: 8103981 - DNA, 23 bp, Homo sapiens
agggcctggcgtggagtgtgtgc

SEQ ID NO: 8103982 - DNA, 22 bp, Homo sapiens
agggcctggaactgtgggcagg

SEQ ID NO: 8103983 - DNA, 22 bp, Homo sapiens
agggcctgctctatcactctca

SEQ ID NO: 8103984 - DNA, 20 bp, Homo sapiens
agggcctgctctgtggtgtc

SEQ ID NO: 8103985 - DNA, 20 bp, Homo sapiens
agggcctgctctgtggtgtc

SEQ ID NO: 8103986 - DNA, 22 bp, Homo sapiens
cctcaggatacaggagccacag

SEQ ID NO: 8103987 - DNA, 22 bp, Homo sapiens
agggctggagccacagctggga

SEQ ID NO: 8103988 - DNA, 22 bp, Homo sapiens
agggcgtggtggtgctggagca

SEQ ID NO: 8103989 - DNA, 22 bp, Homo sapiens
agggctggcatctctaatgctg

SEQ ID NO: 8103990 - DNA, 22 bp, Homo sapiens
ccagctggcccagctgtgctcc

SEQ ID NO: 8103991 - DNA, 22 bp, Homo sapiens
aggcctgccttgagcaaccagc

SEQ ID NO: 8103992 - DNA, 22 bp, Homo sapiens
ccagctggcactgtggctgccc

SEQ ID NO: 8103993 - DNA, 23 bp, Homo sapiens
ccagctccgtgagcctcgggctc

SEQ ID NO: 8103994 - DNA, 22 bp, Homo sapiens
ccagctctgtaagctgtgaaat

SEQ ID NO: 8103995 - DNA, 22 bp, Homo sapiens
aggcgctgcgctggggccagaa

SEQ ID NO: 8103996 - DNA, 22 bp, Homo sapiens
aggcgctgcatgtgaaggagtt

SEQ ID NO: 8103997 - DNA, 22 bp, Homo sapiens
aggcgctgtgcttggggctgga

SEQ ID NO: 8103998 - DNA, 22 bp, Homo sapiens
aggcgctgtctggggtcgcggc

SEQ ID NO: 8103999 - DNA, 22 bp, Homo sapiens
aggcggagctcagtgtgtccaa

SEQ ID NO: 8104000 - DNA, 22 bp, Homo sapiens
aggcctgtctggggctcagcca

SEQ ID NO: 8104001 - DNA, 22 bp, Homo sapiens
ccaggaaggcctggatgccccc

SEQ ID NO: 8104002 - DNA, 22 bp, Homo sapiens
aggcctgctgtgtagcctgttg

SEQ ID NO: 8104003 - DNA, 22 bp, Homo sapiens
ccagacttttagtagtgagtta

SEQ ID NO: 8104004 - DNA, 22 bp, Homo sapiens
ccagaccctccattcaagctcc

SEQ ID NO: 8104005 - DNA, 22 bp, Homo sapiens
ccagaccaccctggccatgcac

SEQ ID NO: 8104006 - DNA, 22 bp, Homo sapiens
ccagaaagaatgaactgaaccc

SEQ ID NO: 8104007 - DNA, 22 bp, Homo sapiens
ccagagctccagggctacagaa

SEQ ID NO: 8104008 - DNA, 21 bp, Homo sapiens
ccagagcctgctgagccccct

SEQ ID NO: 8104009 - DNA, 20 bp, Homo sapiens
aggccactgaatgccaatca

SEQ ID NO: 8104010 - DNA, 22 bp, Homo sapiens
aggccacatagcttgcatgtag

SEQ ID NO: 8104011 - DNA, 22 bp, Homo sapiens
ccaggctggagtatagtggcgc

SEQ ID NO: 8104012 - DNA, 22 bp, Homo sapiens
ccaggctggagtgcaatggcat

SEQ ID NO: 8104013 - DNA, 22 bp, Homo sapiens
ccaggctgcttagccttatctt

SEQ ID NO: 8104014 - DNA, 22 bp, Homo sapiens
aggctacagcctcaagagtgca

SEQ ID NO: 8104015 - DNA, 22 bp, Homo sapiens
ccagggcctgccacttagcaag

SEQ ID NO: 8104016 - DNA, 22 bp, Homo sapiens
ccagggcctgagggcgacgccc

SEQ ID NO: 8104017 - DNA, 22 bp, Homo sapiens
ccagggctgggtttgtcggtgt

SEQ ID NO: 8104018 - DNA, 22 bp, Homo sapiens
aggctgaggcaagaggatcact

SEQ ID NO: 8104019 - DNA, 22 bp, Homo sapiens
aggctgggctccgcccaactcc

SEQ ID NO: 8104020 - DNA, 22 bp, Homo sapiens
aggctggccctactggctgcct

SEQ ID NO: 8104021 - DNA, 17 bp, Homo sapiens
aggctggccttcacagt

SEQ ID NO: 8104022 - DNA, 22 bp, Homo sapiens
ccatttggctcttaaactgagc

SEQ ID NO: 8104023 - DNA, 22 bp, Homo sapiens
aggctggcgtcaggggctgtac

SEQ ID NO: 8104024 - DNA, 22 bp, Homo sapiens
aggctggagtgtagcagtgcag

SEQ ID NO: 8104025 - DNA, 22 bp, Homo sapiens
agctttatatttaatgaattct

SEQ ID NO: 8104026 - DNA, 22 bp, Homo sapiens
agctttattcatgatttcaggg

SEQ ID NO: 8104027 - DNA, 22 bp, Homo sapiens
agctttatttgtcattcacggc

SEQ ID NO: 8104028 - DNA, 22 bp, Homo sapiens
agctttcactgatatgctttga

SEQ ID NO: 8104029 - DNA, 22 bp, Homo sapiens
agcttctggaagcctggcagca

SEQ ID NO: 8104030 - DNA, 22 bp, Homo sapiens
aggaaacagaggtgccacaata

SEQ ID NO: 8104031 - DNA, 22 bp, Homo sapiens
aggaaggggagaagttaaagct

SEQ ID NO: 8104032 - DNA, 22 bp, Homo sapiens
aggaagggtggatagtaacgtg

SEQ ID NO: 8104033 - DNA, 22 bp, Homo sapiens
aggaagggttctttctgtttat

SEQ ID NO: 8104034 - DNA, 22 bp, Homo sapiens
aggaagggtgtcatgagccctt

SEQ ID NO: 8104035 - DNA, 22 bp, Homo sapiens
aggaagggttctttgtgaaaga

SEQ ID NO: 8104036 - DNA, 22 bp, Homo sapiens
cagggtttcaccatgttagcag

SEQ ID NO: 8104037 - DNA, 22 bp, Homo sapiens
aggaagaggtagctgtcaaggg

SEQ ID NO: 8104038 - DNA, 22 bp, Homo sapiens
aggaagagggtggcagataatc

SEQ ID NO: 8104039 - DNA, 22 bp, Homo sapiens
aggaagaggtgtgcaatggtgt

SEQ ID NO: 8104040 - DNA, 22 bp, Homo sapiens
aggaagagtgttacctatgggt

SEQ ID NO: 8104041 - DNA, 22 bp, Homo sapiens
aggaaacatccttatctattct

SEQ ID NO: 8104042 - DNA, 22 bp, Homo sapiens
aggaaacagttggtaatgcata

SEQ ID NO: 8104043 - DNA, 22 bp, Homo sapiens
agctggaaagaaggtggcagcc

SEQ ID NO: 8104044 - DNA, 22 bp, Homo sapiens
agctgccgatgcccagctgcat

SEQ ID NO: 8104045 - DNA, 17 bp, Homo sapiens
caggaaaatatgagtga

SEQ ID NO: 8104046 - DNA, 22 bp, Homo sapiens
agctcttttgtgagcatttggc

SEQ ID NO: 8104047 - DNA, 22 bp, Homo sapiens
caggaagaaagaggtgaggtgt

SEQ ID NO: 8104048 - DNA, 22 bp, Homo sapiens
caggaaccttgtctgtgttgtt

SEQ ID NO: 8104049 - DNA, 22 bp, Homo sapiens
caggaacctgtgcgtagggatg

SEQ ID NO: 8104050 - DNA, 16 bp, Homo sapiens
caggaacctgtctggc

SEQ ID NO: 8104051 - DNA, 22 bp, Homo sapiens
caggaacctgctccaagaggca

SEQ ID NO: 8104052 - DNA, 20 bp, Homo sapiens
caggaaccaaagaggactcc

SEQ ID NO: 8104053 - DNA, 22 bp, Homo sapiens
caggaaccaggagagtccctga

SEQ ID NO: 8104054 - DNA, 22 bp, Homo sapiens
caggaaccagaaccttcccccg

SEQ ID NO: 8104055 - DNA, 22 bp, Homo sapiens
caggaaccatgaagacatatac

SEQ ID NO: 8104056 - DNA, 22 bp, Homo sapiens
caggaaccattttctctttata

SEQ ID NO: 8104057 - DNA, 22 bp, Homo sapiens
caggaacctaatgaaggctcac

SEQ ID NO: 8104058 - DNA, 22 bp, Homo sapiens
caggaacctaaagagacattac

SEQ ID NO: 8104059 - DNA, 22 bp, Homo sapiens
caggaacctacatctgtttggg

SEQ ID NO: 8104060 - DNA, 18 bp, Homo sapiens
caggaacctctccttttt

SEQ ID NO: 8104061 - DNA, 22 bp, Homo sapiens
caggaacccccactctcagctc

SEQ ID NO: 8104062 - DNA, 22 bp, Homo sapiens
caggaacccaatgggccaggcc

SEQ ID NO: 8104063 - DNA, 22 bp, Homo sapiens
agctgggcagactgcagtggtt

SEQ ID NO: 8104064 - DNA, 23 bp, Homo sapiens
agctgggccaggtggtcagacct

SEQ ID NO: 8104065 - DNA, 23 bp, Homo sapiens
agctgggccaggtggtcagacct

SEQ ID NO: 8104066 - DNA, 21 bp, Homo sapiens
agctgggcctcagcctgcagt

SEQ ID NO: 8104067 - DNA, 22 bp, Homo sapiens
agctgggctccaagagggatct

SEQ ID NO: 8104068 - DNA, 22 bp, Homo sapiens
agctgggcgcagtggctggtga

SEQ ID NO: 8104069 - DNA, 22 bp, Homo sapiens
agctgggctgatgactcatgtt

SEQ ID NO: 8104070 - DNA, 22 bp, Homo sapiens
agctgggcctgagctggaagct

SEQ ID NO: 8104071 - DNA, 22 bp, Homo sapiens
agctgggcctgatttgcagggg

SEQ ID NO: 8104072 - DNA, 20 bp, Homo sapiens
caggcagaggatgctgacca

SEQ ID NO: 8104073 - DNA, 22 bp, Homo sapiens
agctggtccacttttgtatctt

SEQ ID NO: 8104074 - DNA, 22 bp, Homo sapiens
agctggtcttaaatgtgtccag

SEQ ID NO: 8104075 - DNA, 22 bp, Homo sapiens
agctggtccttccctgccctgt

SEQ ID NO: 8104076 - DNA, 22 bp, Homo sapiens
aggagctgggcccaaggatgct

SEQ ID NO: 8104077 - DNA, 22 bp, Homo sapiens
cagtggaagactcagctctccc

SEQ ID NO: 8104078 - DNA, 22 bp, Homo sapiens
cagtggaaatcagagtgagagt

SEQ ID NO: 8104079 - DNA, 22 bp, Homo sapiens
cagtggaatacgagcagatgtc

SEQ ID NO: 8104080 - DNA, 22 bp, Homo sapiens
cagtggaatacgagcagatgtc

SEQ ID NO: 8104081 - DNA, 22 bp, Homo sapiens
cagtggaagctggctgtgaaga

SEQ ID NO: 8104082 - DNA, 22 bp, Homo sapiens
aggagctggccactaggatgca

SEQ ID NO: 8104083 - DNA, 22 bp, Homo sapiens
cagtggaaatattggcagcatc

SEQ ID NO: 8104084 - DNA, 22 bp, Homo sapiens
aggagccacctaggagctgttt

SEQ ID NO: 8104085 - DNA, 22 bp, Homo sapiens
aggagccaaattttagactctg

SEQ ID NO: 8104086 - DNA, 22 bp, Homo sapiens
aggagccaaattactagctctg

SEQ ID NO: 8104087 - DNA, 22 bp, Homo sapiens
aggagcagcccactcctgtcct

SEQ ID NO: 8104088 - DNA, 22 bp, Homo sapiens
cagtgagggaagatctcagcac

SEQ ID NO: 8104089 - DNA, 23 bp, Homo sapiens
cagtgcagggcaactcagactcc

SEQ ID NO: 8104090 - DNA, 21 bp, Homo sapiens
cagtgcaggggttagcgtgta

SEQ ID NO: 8104091 - DNA, 17 bp, Homo sapiens
cagtgcagataagtgag

SEQ ID NO: 8104092 - DNA, 22 bp, Homo sapiens
aggaattaacaatatatttagg

SEQ ID NO: 8104093 - DNA, 22 bp, Homo sapiens
aggaattcaagaccagctgggc

SEQ ID NO: 8104094 - DNA, 22 bp, Homo sapiens
cagtgaggatgataattaaggt

SEQ ID NO: 8104095 - DNA, 22 bp, Homo sapiens
aggagggtggcctcatgtgagt

SEQ ID NO: 8104096 - DNA, 22 bp, Homo sapiens
aggaggtgacagcctgcatctg

SEQ ID NO: 8104097 - DNA, 22 bp, Homo sapiens
aggaggtgagcggtcatgtggt

SEQ ID NO: 8104098 - DNA, 22 bp, Homo sapiens
aggaggtgagcggtcatgtggt

SEQ ID NO: 8104099 - DNA, 20 bp, Homo sapiens
aggagggtttctctgacaca

SEQ ID NO: 8104100 - DNA, 22 bp, Homo sapiens
aggagtggtgcaggacctgcca

SEQ ID NO: 8104101 - DNA, 22 bp, Homo sapiens
catcatttcacttagatgaagt

SEQ ID NO: 8104102 - DNA, 22 bp, Homo sapiens
catattttagttgctgaacagc

SEQ ID NO: 8104103 - DNA, 22 bp, Homo sapiens
catcacccggaactgtgtctgc

SEQ ID NO: 8104104 - DNA, 22 bp, Homo sapiens
cagttataggagccattgtata

SEQ ID NO: 8104105 - DNA, 20 bp, Homo sapiens
catcagaaatcctgacccac

SEQ ID NO: 8104106 - DNA, 22 bp, Homo sapiens
catcagaacgtgagctccttgt

SEQ ID NO: 8104107 - DNA, 22 bp, Homo sapiens
catcagaagatggctctggaaa

SEQ ID NO: 8104108 - DNA, 22 bp, Homo sapiens
catcagaagaaagacaaatgat

SEQ ID NO: 8104109 - DNA, 22 bp, Homo sapiens
catcagaatctgagtctctgcc

SEQ ID NO: 8104110 - DNA, 22 bp, Homo sapiens
catcagaatgaatgttctggag

SEQ ID NO: 8104111 - DNA, 22 bp, Homo sapiens
catcagacctgccagactaggt

SEQ ID NO: 8104112 - DNA, 22 bp, Homo sapiens
aggcagagagcagtggccgtct

SEQ ID NO: 8104113 - DNA, 22 bp, Homo sapiens
aggcagagagcagtggccgtct

SEQ ID NO: 8104114 - DNA, 16 bp, Homo sapiens
aggcagagatttaccc

SEQ ID NO: 8104115 - DNA, 22 bp, Homo sapiens
ccaaaattaagcctcttatgtt

SEQ ID NO: 8104116 - DNA, 22 bp, Homo sapiens
ccaaacaaatccccattcttag

SEQ ID NO: 8104117 - DNA, 22 bp, Homo sapiens
ccaaaattattacatttgtagg

SEQ ID NO: 8104118 - DNA, 22 bp, Homo sapiens
aggcaggccctctggaaaggta

SEQ ID NO: 8104119 - DNA, 19 bp, Homo sapiens
aggcagaggcttggctagc

SEQ ID NO: 8104120 - DNA, 23 bp, Homo sapiens
aggcagagccaaggtcaaaaccc

SEQ ID NO: 8104121 - DNA, 20 bp, Homo sapiens
aggcagagcgcacttttaga

SEQ ID NO: 8104122 - DNA, 22 bp, Homo sapiens
aggcagagctaggaagaattgt

SEQ ID NO: 8104123 - DNA, 22 bp, Homo sapiens
aggcagagctgatgttctgtga

SEQ ID NO: 8104124 - DNA, 22 bp, Homo sapiens
aggcagagctgggttttgaaat

SEQ ID NO: 8104125 - DNA, 22 bp, Homo sapiens
aggcagaggaagggtggatttg

SEQ ID NO: 8104126 - DNA, 22 bp, Homo sapiens
aggcagaggagaatgatcttcc

SEQ ID NO: 8104127 - DNA, 22 bp, Homo sapiens
atctgtgagaaaggcttgtgct

SEQ ID NO: 8104128 - DNA, 22 bp, Homo sapiens
atctgtgtgttattgtttatca

SEQ ID NO: 8104129 - DNA, 22 bp, Homo sapiens
atctgttcttcaaaatattaca

SEQ ID NO: 8104130 - DNA, 22 bp, Homo sapiens
atctgtaaatgcaaatgtagct

SEQ ID NO: 8104131 - DNA, 22 bp, Homo sapiens
atctgtagtcactgcacagctc

SEQ ID NO: 8104132 - DNA, 22 bp, Homo sapiens
cttctgagaggggctaggagca

SEQ ID NO: 8104133 - DNA, 22 bp, Homo sapiens
atctccttggatcacgtttagt

SEQ ID NO: 8104134 - DNA, 22 bp, Homo sapiens
cttctgtgcttcacagttgcca

SEQ ID NO: 8104135 - DNA, 22 bp, Homo sapiens
cttctgtgtagaaaggtagccc

SEQ ID NO: 8104136 - DNA, 20 bp, Homo sapiens
cttaacacttctttgccagt

SEQ ID NO: 8104137 - DNA, 22 bp, Homo sapiens
atcatacatgtaactaagtaaa

SEQ ID NO: 8104138 - DNA, 19 bp, Homo sapiens
atcatacatgttacactct

SEQ ID NO: 8104139 - DNA, 22 bp, Homo sapiens
cttaataataggtgaggctatg

SEQ ID NO: 8104140 - DNA, 22 bp, Homo sapiens
cttaataaatggtagctgttat

SEQ ID NO: 8104141 - DNA, 22 bp, Homo sapiens
cttaaggcttcagcacaggtat

SEQ ID NO: 8104142 - DNA, 22 bp, Homo sapiens
cttccttgctgtctgctccagg

SEQ ID NO: 8104143 - DNA, 22 bp, Homo sapiens
cttcaagtccagctcatgctct

SEQ ID NO: 8104144 - DNA, 22 bp, Homo sapiens
cttcaattgccaccagctagca

SEQ ID NO: 8104145 - DNA, 21 bp, Homo sapiens
cttcaattcaacactgccatg

SEQ ID NO: 8104146 - DNA, 20 bp, Homo sapiens
cttcaagttatggttggcaa

SEQ ID NO: 8104147 - DNA, 22 bp, Homo sapiens
cttattcaatgctggaaatgtt

SEQ ID NO: 8104148 - DNA, 22 bp, Homo sapiens
cttatggcctgcccacagtagt

SEQ ID NO: 8104149 - DNA, 22 bp, Homo sapiens
cttatgtaaactacagataata

SEQ ID NO: 8104150 - DNA, 22 bp, Homo sapiens
cttattcatatattctcggtag

SEQ ID NO: 8104151 - DNA, 23 bp, Homo sapiens
cttattcattcatgtagcccatt

SEQ ID NO: 8104152 - DNA, 21 bp, Homo sapiens
cttattcactgttatttatca

SEQ ID NO: 8104153 - DNA, 22 bp, Homo sapiens
cttattcagaaggagaaatgga

SEQ ID NO: 8104154 - DNA, 22 bp, Homo sapiens
cttattcagaccttggattctt

SEQ ID NO: 8104155 - DNA, 22 bp, Homo sapiens
cttattcagatacagactcttg

SEQ ID NO: 8104156 - DNA, 22 bp, Homo sapiens
cttattcagcaagtttgggtac

SEQ ID NO: 8104157 - DNA, 22 bp, Homo sapiens
cttattcagcacttgctctgta

SEQ ID NO: 8104158 - DNA, 22 bp, Homo sapiens
cttattcataagtcagacacac

SEQ ID NO: 8104159 - DNA, 22 bp, Homo sapiens
atattcacactgtttagttaca

SEQ ID NO: 8104160 - DNA, 22 bp, Homo sapiens
atattattctagtaacagtgat

SEQ ID NO: 8104161 - DNA, 22 bp, Homo sapiens
ctggtcaggctgaactgccaca

SEQ ID NO: 8104162 - DNA, 22 bp, Homo sapiens
ctggtcagggctctttgggagc

SEQ ID NO: 8104163 - DNA, 22 bp, Homo sapiens
ctggtcaggggatggggctcag

SEQ ID NO: 8104164 - DNA, 22 bp, Homo sapiens
ctggtccctggacctccctgga

SEQ ID NO: 8104165 - DNA, 22 bp, Homo sapiens
ctggtccccagactgggcttag

SEQ ID NO: 8104166 - DNA, 22 bp, Homo sapiens
ctgggaggacaacttggagctc

SEQ ID NO: 8104167 - DNA, 22 bp, Homo sapiens
ctgggaggatacacaagatcag

SEQ ID NO: 8104168 - DNA, 22 bp, Homo sapiens
ctgggaggtggaggttgcattg

SEQ ID NO: 8104169 - DNA, 22 bp, Homo sapiens
ctgggaggtgcagcaaaaatca

SEQ ID NO: 8104170 - DNA, 22 bp, Homo sapiens
ctgggaggtgaacagaaaaact

SEQ ID NO: 8104171 - DNA, 20 bp, Homo sapiens
ctgggaggtcttccaaatca

SEQ ID NO: 8104172 - DNA, 22 bp, Homo sapiens
ctgggaggggtagccaatccta

SEQ ID NO: 8104173 - DNA, 22 bp, Homo sapiens
ctgggaggcggaggttgtagtg

SEQ ID NO: 8104174 - DNA, 22 bp, Homo sapiens
atattatgtgactcttcaccag

SEQ ID NO: 8104175 - DNA, 19 bp, Homo sapiens
ctggggctttggtactgcc

SEQ ID NO: 8104176 - DNA, 22 bp, Homo sapiens
ctggggcttcaatgcttcggtg

SEQ ID NO: 8104177 - DNA, 23 bp, Homo sapiens
ctggggctttcaaatctgggcag

SEQ ID NO: 8104178 - DNA, 19 bp, Homo sapiens
ctgggaggtgttcagagaa

SEQ ID NO: 8104179 - DNA, 22 bp, Homo sapiens
atcacagatttgatacttttgt

SEQ ID NO: 8104180 - DNA, 22 bp, Homo sapiens
ctgtaaactaggtcatttttaa

SEQ ID NO: 8104181 - DNA, 22 bp, Homo sapiens
atcacaaaggtctcagagcaca

SEQ ID NO: 8104182 - DNA, 22 bp, Homo sapiens
atcacaatgtacgttaaaatgt

SEQ ID NO: 8104183 - DNA, 22 bp, Homo sapiens
atcacaatcttcaaatcgattc

SEQ ID NO: 8104184 - DNA, 22 bp, Homo sapiens
atcacaaaggtctcagagcaca

SEQ ID NO: 8104185 - DNA, 22 bp, Homo sapiens
ctgtaaatatgaagaatatatg

SEQ ID NO: 8104186 - DNA, 22 bp, Homo sapiens
ctgtaatcccagctacctggga

SEQ ID NO: 8104187 - DNA, 22 bp, Homo sapiens
ctgtaatcccagctactcggga

SEQ ID NO: 8104188 - DNA, 22 bp, Homo sapiens
atcagctaattagaattaggat

SEQ ID NO: 8104189 - DNA, 22 bp, Homo sapiens
atcagcagctaaggaactaaca

SEQ ID NO: 8104190 - DNA, 22 bp, Homo sapiens
atcagcagaccattttccaaat

SEQ ID NO: 8104191 - DNA, 23 bp, Homo sapiens
ctgtccttggtcttggctgagtg

SEQ ID NO: 8104192 - DNA, 22 bp, Homo sapiens
ctgtctcagcaggaagtcatca

SEQ ID NO: 8104193 - DNA, 22 bp, Homo sapiens
ctgtctctgtcttaactcccag

SEQ ID NO: 8104194 - DNA, 22 bp, Homo sapiens
atcataaaattgcaccatttct

SEQ ID NO: 8104195 - DNA, 22 bp, Homo sapiens
atcataaagtgctatctgattg

SEQ ID NO: 8104196 - DNA, 22 bp, Homo sapiens
atcataaaccactttgtaatct

SEQ ID NO: 8104197 - DNA, 22 bp, Homo sapiens
atcatacactcacataaacaga

SEQ ID NO: 8104198 - DNA, 22 bp, Homo sapiens
atcataattgctccagtgatat

SEQ ID NO: 8104199 - DNA, 22 bp, Homo sapiens
atcataagacccagccagtatt

SEQ ID NO: 8104200 - DNA, 23 bp, Homo sapiens
atataaacaccagatagattgta

SEQ ID NO: 8104201 - DNA, 22 bp, Homo sapiens
atagttttctatgcactgttat

SEQ ID NO: 8104202 - DNA, 22 bp, Homo sapiens
atataaagagcttagtatagtg

SEQ ID NO: 8104203 - DNA, 22 bp, Homo sapiens
atataaagaagtggaaaatgag

SEQ ID NO: 8104204 - DNA, 22 bp, Homo sapiens
ctggcgagcaggaggcgacggc

SEQ ID NO: 8104205 - DNA, 22 bp, Homo sapiens
atatacttggagactatcattg

SEQ ID NO: 8104206 - DNA, 22 bp, Homo sapiens
ctgggagctggatgccctgccc

SEQ ID NO: 8104207 - DNA, 22 bp, Homo sapiens
atatacatgggaatatgtggag

SEQ ID NO: 8104208 - DNA, 22 bp, Homo sapiens
atatacagttttacagggtttc

SEQ ID NO: 8104209 - DNA, 22 bp, Homo sapiens
atatacagggagaaacagctta

SEQ ID NO: 8104210 - DNA, 22 bp, Homo sapiens
atatacagggagaaacagctta

SEQ ID NO: 8104211 - DNA, 22 bp, Homo sapiens
atatacacatgtgtatacattt

SEQ ID NO: 8104212 - DNA, 20 bp, Homo sapiens
atacacattcatagaaaaat

SEQ ID NO: 8104213 - DNA, 20 bp, Homo sapiens
atacacattcatagaaaaat

SEQ ID NO: 8104214 - DNA, 20 bp, Homo sapiens
atacacattcatagaaaaat

SEQ ID NO: 8104215 - DNA, 22 bp, Homo sapiens
ctggagtggccggtgctgtggc

SEQ ID NO: 8104216 - DNA, 22 bp, Homo sapiens
ctggcaagtggttgggatggat

SEQ ID NO: 8104217 - DNA, 22 bp, Homo sapiens
ctggcacagccactgcaggcag

SEQ ID NO: 8104218 - DNA, 22 bp, Homo sapiens
ctggcacacagtaggcaccaat

SEQ ID NO: 8104219 - DNA, 22 bp, Homo sapiens
atacatgtgggtctaaacatat

SEQ ID NO: 8104220 - DNA, 22 bp, Homo sapiens
ctggcaggtttggtgtctggtg

SEQ ID NO: 8104221 - DNA, 22 bp, Homo sapiens
ctggcaggtggatggggactcc

SEQ ID NO: 8104222 - DNA, 22 bp, Homo sapiens
ctggcaggtggaggttgcagtg

SEQ ID NO: 8104223 - DNA, 22 bp, Homo sapiens
ctggccagactacacatgtgtg

SEQ ID NO: 8104224 - DNA, 20 bp, Homo sapiens
ctggccagaacgcctacaca

SEQ ID NO: 8104225 - DNA, 22 bp, Homo sapiens
ctggccctatgagcctcctgat

SEQ ID NO: 8104226 - DNA, 23 bp, Homo sapiens
ctggcctccgacactggccaaga

SEQ ID NO: 8104227 - DNA, 22 bp, Homo sapiens
ctgctaaacctctctgagagct

SEQ ID NO: 8104228 - DNA, 22 bp, Homo sapiens
ctgcctgtgccaatgctccttt

SEQ ID NO: 8104229 - DNA, 22 bp, Homo sapiens
ctgcctggaaggagcaagggga

SEQ ID NO: 8104230 - DNA, 22 bp, Homo sapiens
ctgcctggaaggagcaagggga

SEQ ID NO: 8104231 - DNA, 22 bp, Homo sapiens
ctgcctggtctcaggcatgggg

SEQ ID NO: 8104232 - DNA, 22 bp, Homo sapiens
ctgctagcccgccggccagcga

SEQ ID NO: 8104233 - DNA, 22 bp, Homo sapiens
ctgctgggctcctcatgtgact

SEQ ID NO: 8104234 - DNA, 22 bp, Homo sapiens
ctgctggggaggcgcctcgacg

SEQ ID NO: 8104235 - DNA, 22 bp, Homo sapiens
ctgctgcccagtgtgcattggg

SEQ ID NO: 8104236 - DNA, 22 bp, Homo sapiens
ctgctgcccagtgtgcattggg

SEQ ID NO: 8104237 - DNA, 22 bp, Homo sapiens
ctgctgggcctggtctctgagg

SEQ ID NO: 8104238 - DNA, 18 bp, Homo sapiens
ctgctgtgtcgtctgggc

SEQ ID NO: 8104239 - DNA, 18 bp, Homo sapiens
ctgctgtgtcgtctgggc

SEQ ID NO: 8104240 - DNA, 22 bp, Homo sapiens
atacaagttaatgagaatgaca

SEQ ID NO: 8104241 - DNA, 22 bp, Homo sapiens
atacacatatgtgtgtatatgt

SEQ ID NO: 8104242 - DNA, 22 bp, Homo sapiens
atacacatatgtgtgtatatgt

SEQ ID NO: 8104243 - DNA, 20 bp, Homo sapiens
atacacatattcttgcaact

SEQ ID NO: 8104244 - DNA, 22 bp, Homo sapiens
atacacatctatttaagagaca

SEQ ID NO: 8104245 - DNA, 22 bp, Homo sapiens
atacacatctatttaagagaca

SEQ ID NO: 8104246 - DNA, 22 bp, Homo sapiens
atacacatgcacacatgtgtgt

SEQ ID NO: 8104247 - DNA, 21 bp, Homo sapiens
atacacatacacataaatgtg

SEQ ID NO: 8104248 - DNA, 22 bp, Homo sapiens
atacacaggtgctaggtcaata

SEQ ID NO: 8104249 - DNA, 22 bp, Homo sapiens
atacaagttgcccaaatgatta

SEQ ID NO: 8104250 - DNA, 22 bp, Homo sapiens
ataaagcaagcataccattaag

SEQ ID NO: 8104251 - DNA, 22 bp, Homo sapiens
ataaagatttctttttctctac

SEQ ID NO: 8104252 - DNA, 22 bp, Homo sapiens
ataaacatctgtttctcttctg

SEQ ID NO: 8104253 - DNA, 22 bp, Homo sapiens
ataaactctgcctcagaagagc

SEQ ID NO: 8104254 - DNA, 22 bp, Homo sapiens
ataaactatgtaatttgctcta

SEQ ID NO: 8104255 - DNA, 22 bp, Homo sapiens
agttctcacttcagagctgccc

SEQ ID NO: 8104256 - DNA, 22 bp, Homo sapiens
agttctcagcttagtatgctgt

SEQ ID NO: 8104257 - DNA, 22 bp, Homo sapiens
agttctcataaacgtccttgga

SEQ ID NO: 8104258 - DNA, 22 bp, Homo sapiens
agttctcatttcacaggcagtg

SEQ ID NO: 8104259 - DNA, 22 bp, Homo sapiens
agttctcaggtcagctgagtct

SEQ ID NO: 8104260 - DNA, 22 bp, Homo sapiens
agttctcatcatgaagcataag

SEQ ID NO: 8104261 - DNA, 23 bp, Homo sapiens
agttctcaaaaccagcttgacaa

SEQ ID NO: 8104262 - DNA, 22 bp, Homo sapiens
agttcttattttggaactgagg

SEQ ID NO: 8104263 - DNA, 22 bp, Homo sapiens
ataaaaaggacagatgtggtct

SEQ ID NO: 8104264 - DNA, 22 bp, Homo sapiens
ataaaacttgggtatgatccct

SEQ ID NO: 8104265 - DNA, 22 bp, Homo sapiens
cctggggctttctttgtatcat

SEQ ID NO: 8104266 - DNA, 22 bp, Homo sapiens
cctgtgccagctgggccctgcc

SEQ ID NO: 8104267 - DNA, 22 bp, Homo sapiens
aggtggcagaggactcctcctg

SEQ ID NO: 8104268 - DNA, 22 bp, Homo sapiens
aggtggcagagctggcccagcg

SEQ ID NO: 8104269 - DNA, 22 bp, Homo sapiens
aggtggcagactaacagaagga

SEQ ID NO: 8104270 - DNA, 22 bp, Homo sapiens
aggtggcaaggggcgcctctct

SEQ ID NO: 8104271 - DNA, 22 bp, Homo sapiens
aggtggcagcagcctggtgaaa

SEQ ID NO: 8104272 - DNA, 22 bp, Homo sapiens
aggtggcagagtgacaggctga

SEQ ID NO: 8104273 - DNA, 22 bp, Homo sapiens
aggtggcaggaggtcagagaaa

SEQ ID NO: 8104274 - DNA, 22 bp, Homo sapiens
ccttccagagttcagtctgccc

SEQ ID NO: 8104275 - DNA, 22 bp, Homo sapiens
aggtaaagacagtgaaagaggg

SEQ ID NO: 8104276 - DNA, 22 bp, Homo sapiens
aggtaaagactgcaaggagaat

SEQ ID NO: 8104277 - DNA, 22 bp, Homo sapiens
aggtaaggggctcccaagtccc

SEQ ID NO: 8104278 - DNA, 22 bp, Homo sapiens
aggtcacacaactgtcagaggc

SEQ ID NO: 8104279 - DNA, 22 bp, Homo sapiens
aggtaatgcatataaagtgctt

SEQ ID NO: 8104280 - DNA, 22 bp, Homo sapiens
aggtaagggtcacagttcatat

SEQ ID NO: 8104281 - DNA, 22 bp, Homo sapiens
agggtgggctagactcttcccc

SEQ ID NO: 8104282 - DNA, 22 bp, Homo sapiens
aggtcacccgtttgactatcca

SEQ ID NO: 8104283 - DNA, 22 bp, Homo sapiens
aggtcagctagacagctctctg

SEQ ID NO: 8104284 - DNA, 22 bp, Homo sapiens
aggtcagctgtgtgtgcatgag

SEQ ID NO: 8104285 - DNA, 18 bp, Homo sapiens
aggtcaggaaagcagagt

SEQ ID NO: 8104286 - DNA, 22 bp, Homo sapiens
aggtcaggaggcctctgccatt

SEQ ID NO: 8104287 - DNA, 22 bp, Homo sapiens
aggtcaggaggttaagagtctt

SEQ ID NO: 8104288 - DNA, 22 bp, Homo sapiens
cctgggaggctgtgggtctgct

SEQ ID NO: 8104289 - DNA, 21 bp, Homo sapiens
cctgggagaattgggtgtggc

SEQ ID NO: 8104290 - DNA, 22 bp, Homo sapiens
agtaaacattttcatattttct

SEQ ID NO: 8104291 - DNA, 22 bp, Homo sapiens
agtaaattatttagcttccaga

SEQ ID NO: 8104292 - DNA, 22 bp, Homo sapiens
agtaaatcagacctcattatgt

SEQ ID NO: 8104293 - DNA, 22 bp, Homo sapiens
agtagcagtgacagctgaggta

SEQ ID NO: 8104294 - DNA, 22 bp, Homo sapiens
agtacatacttcaaatgtactt

SEQ ID NO: 8104295 - DNA, 22 bp, Homo sapiens
agtaacactattttcatatgta

SEQ ID NO: 8104296 - DNA, 22 bp, Homo sapiens
ctatgaccccagcatgaataag

SEQ ID NO: 8104297 - DNA, 22 bp, Homo sapiens
ctatctttcgattctagcttaa

SEQ ID NO: 8104298 - DNA, 22 bp, Homo sapiens
ctatcttttgttcattttgagt

SEQ ID NO: 8104299 - DNA, 22 bp, Homo sapiens
agtcagcagcctggccaggaga

SEQ ID NO: 8104300 - DNA, 22 bp, Homo sapiens
agtcagcagtgaaagcacagcc

SEQ ID NO: 8104301 - DNA, 22 bp, Homo sapiens
agtcagcattttcactgagcta

SEQ ID NO: 8104302 - DNA, 19 bp, Homo sapiens
agtcagcatgcatgtgact

SEQ ID NO: 8104303 - DNA, 22 bp, Homo sapiens
agtcagcatctgcactgtgctg

SEQ ID NO: 8104304 - DNA, 22 bp, Homo sapiens
ctatcaaacagccattaatata

SEQ ID NO: 8104305 - DNA, 22 bp, Homo sapiens
ctaggcaaagtattaatgagtg

SEQ ID NO: 8104306 - DNA, 23 bp, Homo sapiens
agtcacatcttagcagccaggtc

SEQ ID NO: 8104307 - DNA, 22 bp, Homo sapiens
agtgatcttttaaaaagaagtg

SEQ ID NO: 8104308 - DNA, 23 bp, Homo sapiens
agtgatctgtgtttgaagaatgc

SEQ ID NO: 8104309 - DNA, 22 bp, Homo sapiens
agtgatggtgagtgagaagctc

SEQ ID NO: 8104310 - DNA, 22 bp, Homo sapiens
agtgagtatttgttgagtgcta

SEQ ID NO: 8104311 - DNA, 22 bp, Homo sapiens
agtgagggatgaagaactgcgg

SEQ ID NO: 8104312 - DNA, 22 bp, Homo sapiens
agtgaggggcagctgagtgggc

SEQ ID NO: 8104313 - DNA, 22 bp, Homo sapiens
agtgaggtaattagagctgctg

SEQ ID NO: 8104314 - DNA, 22 bp, Homo sapiens
agtgaaatcctggtcaacaggt

SEQ ID NO: 8104315 - DNA, 22 bp, Homo sapiens
agtgaaatgactgaatcagata

SEQ ID NO: 8104316 - DNA, 22 bp, Homo sapiens
agtgaaatgattctgagcaaga

SEQ ID NO: 8104317 - DNA, 22 bp, Homo sapiens
ctcaccacagagcctgtccagc

SEQ ID NO: 8104318 - DNA, 22 bp, Homo sapiens
agtctcaagcaccgaaagctgt

SEQ ID NO: 8104319 - DNA, 19 bp, Homo sapiens
agtctcacccaagcagtct

SEQ ID NO: 8104320 - DNA, 22 bp, Homo sapiens
agtgccctttacaacttcttga

SEQ ID NO: 8104321 - DNA, 20 bp, Homo sapiens
agtgccctccgacattgttt

SEQ ID NO: 8104322 - DNA, 22 bp, Homo sapiens
agtgccagctccacacagcagc

SEQ ID NO: 8104323 - DNA, 22 bp, Homo sapiens
agtgattctttaaagtggtatt

SEQ ID NO: 8104324 - DNA, 22 bp, Homo sapiens
agtgattaattgtaaaaattct

SEQ ID NO: 8104325 - DNA, 22 bp, Homo sapiens
agtggaggttacagctgtacat

SEQ ID NO: 8104326 - DNA, 22 bp, Homo sapiens
agtggaggcactaattggattt

SEQ ID NO: 8104327 - DNA, 19 bp, Homo sapiens
agtgtcagaattcattgaa

SEQ ID NO: 8104328 - DNA, 18 bp, Homo sapiens
agtgtcagctgcagctca

SEQ ID NO: 8104329 - DNA, 22 bp, Homo sapiens
agtgtcagctaattattcatga

SEQ ID NO: 8104330 - DNA, 22 bp, Homo sapiens
agtgtcagttgccttgtcataa

SEQ ID NO: 8104331 - DNA, 22 bp, Homo sapiens
agtgtcaaatcagcatctgggt

SEQ ID NO: 8104332 - DNA, 22 bp, Homo sapiens
agtgtatttgcctataaaaatg

SEQ ID NO: 8104333 - DNA, 22 bp, Homo sapiens
agtgtatttgcctataaaaatg

SEQ ID NO: 8104334 - DNA, 22 bp, Homo sapiens
agtggcctggagccccgcctgg

SEQ ID NO: 8104335 - DNA, 22 bp, Homo sapiens
agtggcctggagccccgcctgg

SEQ ID NO: 8104336 - DNA, 22 bp, Homo sapiens
agtggcccctgtgccaccacac

SEQ ID NO: 8104337 - DNA, 22 bp, Homo sapiens
agtggggccgcggtcctgccct

SEQ ID NO: 8104338 - DNA, 22 bp, Homo sapiens
agtggggagtttccagatgtgt

SEQ ID NO: 8104339 - DNA, 22 bp, Homo sapiens
agtggtctagtctgaggattat

SEQ ID NO: 8104340 - DNA, 22 bp, Homo sapiens
agtgttttatttcagcactttg

SEQ ID NO: 8104341 - DNA, 22 bp, Homo sapiens
agtgtttttacaagcactctgg

SEQ ID NO: 8104342 - DNA, 22 bp, Homo sapiens
agttaaactttgccagatggga

SEQ ID NO: 8104343 - DNA, 22 bp, Homo sapiens
agttaaactctagtagatacaa

SEQ ID NO: 8104344 - DNA, 22 bp, Homo sapiens
agtgtgggggctttggtgtcac

SEQ ID NO: 8104345 - DNA, 22 bp, Homo sapiens
agtgtggagcatcgagggcaga

SEQ ID NO: 8104346 - DNA, 22 bp, Homo sapiens
ctgagctcagtcccagctctac

SEQ ID NO: 8104347 - DNA, 22 bp, Homo sapiens
ctgagctctaatgtcagccttg

SEQ ID NO: 8104348 - DNA, 22 bp, Homo sapiens
ctgagctcaagcgatcctccca

SEQ ID NO: 8104349 - DNA, 22 bp, Homo sapiens
agttaactaaactgtgagtaaa

SEQ ID NO: 8104350 - DNA, 22 bp, Homo sapiens
ctgagctgcggcaggcacctgg

SEQ ID NO: 8104351 - DNA, 22 bp, Homo sapiens
aggtgagaaaacgagggttgca

SEQ ID NO: 8104352 - DNA, 22 bp, Homo sapiens
actactttgggccatttgttta

SEQ ID NO: 8104353 - DNA, 22 bp, Homo sapiens
actaccttatacaaaatgtagg

SEQ ID NO: 8104354 - DNA, 22 bp, Homo sapiens
actacagtccctcatatgttgg

SEQ ID NO: 8104355 - DNA, 22 bp, Homo sapiens
aggtgggcaccaggcttgtggt

SEQ ID NO: 8104356 - DNA, 22 bp, Homo sapiens
aggtattttatagataagtaaa

SEQ ID NO: 8104357 - DNA, 22 bp, Homo sapiens
aggtccaggatttgtggggtct

SEQ ID NO: 8104358 - DNA, 22 bp, Homo sapiens
aggtccagaacgtgcctactct

SEQ ID NO: 8104359 - DNA, 22 bp, Homo sapiens
aggtccagttgccagaatggcc

SEQ ID NO: 8104360 - DNA, 22 bp, Homo sapiens
acctttcacggtatcagacatc

SEQ ID NO: 8104361 - DNA, 22 bp, Homo sapiens
actccctgtacttgcctctctt

SEQ ID NO: 8104362 - DNA, 22 bp, Homo sapiens
aggtgggcccagtgggctccag

SEQ ID NO: 8104363 - DNA, 22 bp, Homo sapiens
agtacccttttcactgtcacaa

SEQ ID NO: 8104364 - DNA, 22 bp, Homo sapiens
agtacatatagtaatttagcca

SEQ ID NO: 8104365 - DNA, 22 bp, Homo sapiens
agtagttgctggtgtcctttat

SEQ ID NO: 8104366 - DNA, 22 bp, Homo sapiens
agtataatttacatttggtatt

SEQ ID NO: 8104367 - DNA, 22 bp, Homo sapiens
agtataattagatatcaaaagt

SEQ ID NO: 8104368 - DNA, 21 bp, Homo sapiens
actggccaccactggcagggg

SEQ ID NO: 8104369 - DNA, 21 bp, Homo sapiens
actggctgccatgatccaggg

SEQ ID NO: 8104370 - DNA, 22 bp, Homo sapiens
actggctgcggggtggaagaag

SEQ ID NO: 8104371 - DNA, 22 bp, Homo sapiens
actggctgcgttcctgtgagac

SEQ ID NO: 8104372 - DNA, 18 bp, Homo sapiens
actgcctggcgaagatag

SEQ ID NO: 8104373 - DNA, 22 bp, Homo sapiens
actgcctgtagccctgagatgt

SEQ ID NO: 8104374 - DNA, 22 bp, Homo sapiens
actgcctgccttccaggtactg

SEQ ID NO: 8104375 - DNA, 23 bp, Homo sapiens
actgccagagcaggctttgcctg

SEQ ID NO: 8104376 - DNA, 22 bp, Homo sapiens
actgcctcttggtgctgagaga

SEQ ID NO: 8104377 - DNA, 22 bp, Homo sapiens
actgccctggagacagcagagt

SEQ ID NO: 8104378 - DNA, 22 bp, Homo sapiens
actggcttgaagtagattcaaa

SEQ ID NO: 8104379 - DNA, 21 bp, Homo sapiens
actggctggtggctaagaatc

SEQ ID NO: 8104380 - DNA, 22 bp, Homo sapiens
actggctggccgcgctcttcgc

SEQ ID NO: 8104381 - DNA, 20 bp, Homo sapiens
actgggcctaggggaggcat

SEQ ID NO: 8104382 - DNA, 22 bp, Homo sapiens
actgggcctacccagattggca

SEQ ID NO: 8104383 - DNA, 22 bp, Homo sapiens
actgggccggtgcagagtagtt

SEQ ID NO: 8104384 - DNA, 22 bp, Homo sapiens
actgggccgcgctgcagagggc

SEQ ID NO: 8104385 - DNA, 22 bp, Homo sapiens
actgggcctggattggcgtgtc

SEQ ID NO: 8104386 - DNA, 22 bp, Homo sapiens
actgggcctgattgggtcggag

SEQ ID NO: 8104387 - DNA, 22 bp, Homo sapiens
actgggccaggtgtgggtgagt

SEQ ID NO: 8104388 - DNA, 22 bp, Homo sapiens
actgggccaggggctttggagc

SEQ ID NO: 8104389 - DNA, 22 bp, Homo sapiens
actgggcattttgaacgttctt

SEQ ID NO: 8104390 - DNA, 22 bp, Homo sapiens
actgcatttggtaaagtcaaga

SEQ ID NO: 8104391 - DNA, 22 bp, Homo sapiens
actgcactcctgcctgggtaac

SEQ ID NO: 8104392 - DNA, 22 bp, Homo sapiens
actgcacttcaccctgggtgac

SEQ ID NO: 8104393 - DNA, 22 bp, Homo sapiens
actgcacttcaccctgggtgac

SEQ ID NO: 8104394 - DNA, 22 bp, Homo sapiens
actgcactcctgcctgggtaac

SEQ ID NO: 8104395 - DNA, 22 bp, Homo sapiens
actgcactccagcctgggtgat

SEQ ID NO: 8104396 - DNA, 22 bp, Homo sapiens
actgcactccagcctgggtgat

SEQ ID NO: 8104397 - DNA, 21 bp, Homo sapiens
actgagagatgttggatcata

SEQ ID NO: 8104398 - DNA, 22 bp, Homo sapiens
actgagaggaaattgagactat

SEQ ID NO: 8104399 - DNA, 22 bp, Homo sapiens
actgagagcgtgtacaaactta

SEQ ID NO: 8104400 - DNA, 22 bp, Homo sapiens
actgagagtcttagaaacacat

SEQ ID NO: 8104401 - DNA, 22 bp, Homo sapiens
actgagagtcaagatagcatgg

SEQ ID NO: 8104402 - DNA, 22 bp, Homo sapiens
actgagagggaggctgtccggt

SEQ ID NO: 8104403 - DNA, 22 bp, Homo sapiens
actgagaggtgatagtgacatt

SEQ ID NO: 8104404 - DNA, 22 bp, Homo sapiens
actgagagttgtgcattcatgc

SEQ ID NO: 8104405 - DNA, 22 bp, Homo sapiens
actgagagttgaaaagggagga

SEQ ID NO: 8104406 - DNA, 22 bp, Homo sapiens
actctgccacataaaggtagat

SEQ ID NO: 8104407 - DNA, 21 bp, Homo sapiens
actctgccagtctcctgcact

SEQ ID NO: 8104408 - DNA, 22 bp, Homo sapiens
actctgcctttcagcagatgaa

SEQ ID NO: 8104409 - DNA, 22 bp, Homo sapiens
actctgcctggaggtaacagga

SEQ ID NO: 8104410 - DNA, 22 bp, Homo sapiens
agaagccacaggcctcgtctgg

SEQ ID NO: 8104411 - DNA, 22 bp, Homo sapiens
agaagccaatccttgtctctct

SEQ ID NO: 8104412 - DNA, 22 bp, Homo sapiens
agaagccaatcagctctctgct

SEQ ID NO: 8104413 - DNA, 22 bp, Homo sapiens
agaagccaattctgtgtgagtc

SEQ ID NO: 8104414 - DNA, 22 bp, Homo sapiens
agaagccacaggaaagcagctt

SEQ ID NO: 8104415 - DNA, 22 bp, Homo sapiens
agaagccaagaacagacagtgc

SEQ ID NO: 8104416 - DNA, 22 bp, Homo sapiens
agaagccaacagggcaggagag

SEQ ID NO: 8104417 - DNA, 20 bp, Homo sapiens
agaagccaagtgacatgttt

SEQ ID NO: 8104418 - DNA, 19 bp, Homo sapiens
atcccatctggtttttccc

SEQ ID NO: 8104419 - DNA, 22 bp, Homo sapiens
agaacctcaattatttttgcac

SEQ ID NO: 8104420 - DNA, 22 bp, Homo sapiens
actttttacagggtgtatacca

SEQ ID NO: 8104421 - DNA, 22 bp, Homo sapiens
acttttttataaggaagaagat

SEQ ID NO: 8104422 - DNA, 22 bp, Homo sapiens
acttttgaagaattatgcaaaa

SEQ ID NO: 8104423 - DNA, 22 bp, Homo sapiens
acttttctgcagatgatctctt

SEQ ID NO: 8104424 - DNA, 22 bp, Homo sapiens
acttttcttatcagaaaggcca

SEQ ID NO: 8104425 - DNA, 22 bp, Homo sapiens
acttttcttatcagaaaggcca

SEQ ID NO: 8104426 - DNA, 22 bp, Homo sapiens
acttttctccctcctgccttca

SEQ ID NO: 8104427 - DNA, 22 bp, Homo sapiens
acttttctaagcaatggtcttg

SEQ ID NO: 8104428 - DNA, 23 bp, Homo sapiens
acttttcaattagctatgcttaa

SEQ ID NO: 8104429 - DNA, 22 bp, Homo sapiens
atatttctccaaatgttttcaa

SEQ ID NO: 8104430 - DNA, 22 bp, Homo sapiens
atattttggggtgatgtgcatc

SEQ ID NO: 8104431 - DNA, 21 bp, Homo sapiens
atatttttgtttggactgtca

SEQ ID NO: 8104432 - DNA, 22 bp, Homo sapiens
atcagttagttactgctaagat

SEQ ID NO: 8104433 - DNA, 22 bp, Homo sapiens
agaaatcaggaacagtaaggag

SEQ ID NO: 8104434 - DNA, 22 bp, Homo sapiens
atcagtatacaggggacattca

SEQ ID NO: 8104435 - DNA, 22 bp, Homo sapiens
atcagtatcctgcagtttctat

SEQ ID NO: 8104436 - DNA, 22 bp, Homo sapiens
agaaagcccacccagaagatgt

SEQ ID NO: 8104437 - DNA, 22 bp, Homo sapiens
agaaagcctcaatcttcaggcc

SEQ ID NO: 8104438 - DNA, 22 bp, Homo sapiens
atcaaaacttctttagagttta

SEQ ID NO: 8104439 - DNA, 22 bp, Homo sapiens
atcaaaatgctccagtgatggt

SEQ ID NO: 8104440 - DNA, 22 bp, Homo sapiens
agtttctaccggtacattcagg

SEQ ID NO: 8104441 - DNA, 22 bp, Homo sapiens
agttttaagatgcgcttctgtt

SEQ ID NO: 8104442 - DNA, 22 bp, Homo sapiens
agttttatctgtaagctgttca

SEQ ID NO: 8104443 - DNA, 22 bp, Homo sapiens
agttttatgcagtgttctgata

SEQ ID NO: 8104444 - DNA, 18 bp, Homo sapiens
agtttttaggaagaaatg

SEQ ID NO: 8104445 - DNA, 23 bp, Homo sapiens
agtttttaatggtcatagctgag

SEQ ID NO: 8104446 - DNA, 22 bp, Homo sapiens
actgttttgtgccttagtttcc

SEQ ID NO: 8104447 - DNA, 22 bp, Homo sapiens
ataaagtcatttcaaaagttga

SEQ ID NO: 8104448 - DNA, 22 bp, Homo sapiens
ataaagtctaccgtattaaaga

SEQ ID NO: 8104449 - DNA, 22 bp, Homo sapiens
ataaagtttaaaagtcaatagt

SEQ ID NO: 8104450 - DNA, 22 bp, Homo sapiens
ataaagtttaaaagtcaatagt

SEQ ID NO: 8104451 - DNA, 19 bp, Homo sapiens
ataaataaaaagtgggaga

SEQ ID NO: 8104452 - DNA, 19 bp, Homo sapiens
ataaataaaaagtgggaga

SEQ ID NO: 8104453 - DNA, 22 bp, Homo sapiens
atacatcatttatggaataagg

SEQ ID NO: 8104454 - DNA, 22 bp, Homo sapiens
atacatcatttcccatcaatcg

SEQ ID NO: 8104455 - DNA, 22 bp, Homo sapiens
atacatcatgctccatatattt

SEQ ID NO: 8104456 - DNA, 22 bp, Homo sapiens
atacatcatgctccatatattt

SEQ ID NO: 8104457 - DNA, 22 bp, Homo sapiens
acttttcaaatgggaaactcag

SEQ ID NO: 8104458 - DNA, 22 bp, Homo sapiens
atacaaaatatatactggagac

SEQ ID NO: 8104459 - DNA, 22 bp, Homo sapiens
atacaaaatatatactggagac

SEQ ID NO: 8104460 - DNA, 22 bp, Homo sapiens
atacaaaaattagccgggagta

SEQ ID NO: 8104461 - DNA, 22 bp, Homo sapiens
atacaaaaattagccgggagta

SEQ ID NO: 8104462 - DNA, 22 bp, Homo sapiens
actttacaaactcctcactgtt

SEQ ID NO: 8104463 - DNA, 22 bp, Homo sapiens
actttacaaactcctcactgtt

SEQ ID NO: 8104464 - DNA, 22 bp, Homo sapiens
actttacaatatcctgtgactt

SEQ ID NO: 8104465 - DNA, 21 bp, Homo sapiens
actttacaatttacatagtga

SEQ ID NO: 8104466 - DNA, 21 bp, Homo sapiens
actttacaatttacatagtga

SEQ ID NO: 8104467 - DNA, 20 bp, Homo sapiens
actttacagagaagactgac

SEQ ID NO: 8104468 - DNA, 22 bp, Homo sapiens
actttacacatcttttctcatt

SEQ ID NO: 8104469 - DNA, 22 bp, Homo sapiens
acatacatgtaaaggaaattat

SEQ ID NO: 8104470 - DNA, 22 bp, Homo sapiens
acatacatgggattaaaaaatt

SEQ ID NO: 8104471 - DNA, 22 bp, Homo sapiens
aggccacaggtggaagccagag

SEQ ID NO: 8104472 - DNA, 22 bp, Homo sapiens
aggccacagagagtgcatgtgc

SEQ ID NO: 8104473 - DNA, 22 bp, Homo sapiens
aggccacaatttgatttggttt

SEQ ID NO: 8104474 - DNA, 22 bp, Homo sapiens
aggcccagcttgaagtgggaag

SEQ ID NO: 8104475 - DNA, 22 bp, Homo sapiens
aggccaggtggtcatgcttgct

SEQ ID NO: 8104476 - DNA, 22 bp, Homo sapiens
aggcccagtagtcgacggcgct

SEQ ID NO: 8104477 - DNA, 22 bp, Homo sapiens
aggccctgagaaaatccctgca

SEQ ID NO: 8104478 - DNA, 22 bp, Homo sapiens
aggcttcatgtagatggttccc

SEQ ID NO: 8104479 - DNA, 23 bp, Homo sapiens
aggcttcatccatatttattgcc

SEQ ID NO: 8104480 - DNA, 22 bp, Homo sapiens
aggcttcagaaagagtaattgg

SEQ ID NO: 8104481 - DNA, 22 bp, Homo sapiens
aggcttcagacaaatgttatgg

SEQ ID NO: 8104482 - DNA, 22 bp, Homo sapiens
acattcacgctctcaaagctga

SEQ ID NO: 8104483 - DNA, 22 bp, Homo sapiens
acattcactatgtccaaactct

SEQ ID NO: 8104484 - DNA, 22 bp, Homo sapiens
acattcaagatgcattcactta

SEQ ID NO: 8104485 - DNA, 22 bp, Homo sapiens
aggccctgcaggaagcaggatg

SEQ ID NO: 8104486 - DNA, 20 bp, Homo sapiens
accaggaatcttttctgagc

SEQ ID NO: 8104487 - DNA, 18 bp, Homo sapiens
accaggaagcttcttgtc

SEQ ID NO: 8104488 - DNA, 22 bp, Homo sapiens
accaaggctaaaataacatgtt

SEQ ID NO: 8104489 - DNA, 22 bp, Homo sapiens
accaacatgtcctcacacagcc

SEQ ID NO: 8104490 - DNA, 22 bp, Homo sapiens
accagggcttacagcagtagct

SEQ ID NO: 8104491 - DNA, 22 bp, Homo sapiens
agggcctcgggctcagtgggtc

SEQ ID NO: 8104492 - DNA, 22 bp, Homo sapiens
accagtgtcaccccaaccagga

SEQ ID NO: 8104493 - DNA, 22 bp, Homo sapiens
accagttaaagaatatgaggcc

SEQ ID NO: 8104494 - DNA, 22 bp, Homo sapiens
agggcctgagctctcctccagt

SEQ ID NO: 8104495 - DNA, 22 bp, Homo sapiens
agggcctgacacccttgccagc

SEQ ID NO: 8104496 - DNA, 22 bp, Homo sapiens
agggcctgacacccttgccagc

SEQ ID NO: 8104497 - DNA, 22 bp, Homo sapiens
agggcctgagaccgtggcttga

SEQ ID NO: 8104498 - DNA, 22 bp, Homo sapiens
agggcctctgacgcccccagcc

SEQ ID NO: 8104499 - DNA, 22 bp, Homo sapiens
agggcctctgcctccccgttgt

SEQ ID NO: 8104500 - DNA, 22 bp, Homo sapiens
agggcctctgagccagttctgg

SEQ ID NO: 8104501 - DNA, 22 bp, Homo sapiens
agggcctctggaacactgaggg

SEQ ID NO: 8104502 - DNA, 23 bp, Homo sapiens
agggcctctgtcccccagcactc

SEQ ID NO: 8104503 - DNA, 21 bp, Homo sapiens
agggcctctgtgtactggggg

SEQ ID NO: 8104504 - DNA, 22 bp, Homo sapiens
acccagtgcatggatagatagc

SEQ ID NO: 8104505 - DNA, 22 bp, Homo sapiens
acccagtgttgggcagaactgt

SEQ ID NO: 8104506 - DNA, 22 bp, Homo sapiens
acccatgggccagttggggtgg

SEQ ID NO: 8104507 - DNA, 22 bp, Homo sapiens
acccatggtctggtggggccct

SEQ ID NO: 8104508 - DNA, 18 bp, Homo sapiens
acccattatatttgtagc

SEQ ID NO: 8104509 - DNA, 22 bp, Homo sapiens
accccagctctgagccacacca

SEQ ID NO: 8104510 - DNA, 22 bp, Homo sapiens
accctgcctgacaacagaggat

SEQ ID NO: 8104511 - DNA, 22 bp, Homo sapiens
accctggctctctggccaccgc

SEQ ID NO: 8104512 - DNA, 21 bp, Homo sapiens
accctgggttctccataccct

SEQ ID NO: 8104513 - DNA, 22 bp, Homo sapiens
agctggctcagccgggtggtct

SEQ ID NO: 8104514 - DNA, 22 bp, Homo sapiens
agctggcaggggttcacactgc

SEQ ID NO: 8104515 - DNA, 19 bp, Homo sapiens
agctggcagcttccacttc

SEQ ID NO: 8104516 - DNA, 22 bp, Homo sapiens
agctgctgtgtgctcaggcagg

SEQ ID NO: 8104517 - DNA, 22 bp, Homo sapiens
agctgctgtggggctcggcctg

SEQ ID NO: 8104518 - DNA, 23 bp, Homo sapiens
agctgctgggcctgccgtggcct

SEQ ID NO: 8104519 - DNA, 22 bp, Homo sapiens
agctgctggtttaagggatggg

SEQ ID NO: 8104520 - DNA, 22 bp, Homo sapiens
agctgctgtggccacatctggc

SEQ ID NO: 8104521 - DNA, 22 bp, Homo sapiens
agctccagtttcctgactgagc

SEQ ID NO: 8104522 - DNA, 22 bp, Homo sapiens
agctgcaggaagtagaagcgga

SEQ ID NO: 8104523 - DNA, 22 bp, Homo sapiens
agcttagtcactcttaaattta

SEQ ID NO: 8104524 - DNA, 22 bp, Homo sapiens
agctgggcaaaatgtgaggttg

SEQ ID NO: 8104525 - DNA, 22 bp, Homo sapiens
aggaagagcattcacatggtag

SEQ ID NO: 8104526 - DNA, 22 bp, Homo sapiens
aggaagccaggcccttgggtgg

SEQ ID NO: 8104527 - DNA, 22 bp, Homo sapiens
aggaagccatggtggacgtcta

SEQ ID NO: 8104528 - DNA, 20 bp, Homo sapiens
aggaagccaaaggctgtctt

SEQ ID NO: 8104529 - DNA, 22 bp, Homo sapiens
aggaagccacgagtggcacggg

SEQ ID NO: 8104530 - DNA, 22 bp, Homo sapiens
aggaaggcatgaggtgttcaca

SEQ ID NO: 8104531 - DNA, 20 bp, Homo sapiens
aggaaggctgttggccttgc

SEQ ID NO: 8104532 - DNA, 22 bp, Homo sapiens
aggaaggctgatcactgcttgt

SEQ ID NO: 8104533 - DNA, 19 bp, Homo sapiens
aggaaggcggcggctgccc

SEQ ID NO: 8104534 - DNA, 22 bp, Homo sapiens
aggaagggatacataggatagt

SEQ ID NO: 8104535 - DNA, 22 bp, Homo sapiens
aggaagggagcagtttgttgtt

SEQ ID NO: 8104536 - DNA, 22 bp, Homo sapiens
aggaaggcttctttggtcttct

SEQ ID NO: 8104537 - DNA, 22 bp, Homo sapiens
aggaagcctgcaggtgactgct

SEQ ID NO: 8104538 - DNA, 22 bp, Homo sapiens
aggaagcccttgtcatttctgt

SEQ ID NO: 8104539 - DNA, 22 bp, Homo sapiens
aggaagcccttgtcatttctgt

SEQ ID NO: 8104540 - DNA, 22 bp, Homo sapiens
aggaagcccaagtctcatcttc

SEQ ID NO: 8104541 - DNA, 22 bp, Homo sapiens
aggaagcctggggctgccctcg

SEQ ID NO: 8104542 - DNA, 22 bp, Homo sapiens
aggaagcctggagtcctgccca

SEQ ID NO: 8104543 - DNA, 22 bp, Homo sapiens
aggaagcctggagtcctgccca

SEQ ID NO: 8104544 - DNA, 22 bp, Homo sapiens
aggaagcctggggctgccctcg

SEQ ID NO: 8104545 - DNA, 17 bp, Homo sapiens
aggaagggcaagtttct

SEQ ID NO: 8104546 - DNA, 22 bp, Homo sapiens
aggagccattgcaggatggcag

SEQ ID NO: 8104547 - DNA, 22 bp, Homo sapiens
aggagccatgagtgacatcaca

SEQ ID NO: 8104548 - DNA, 22 bp, Homo sapiens
acagggtcttagagatcacctg

SEQ ID NO: 8104549 - DNA, 22 bp, Homo sapiens
acaggggtgcatggtgcatggt

SEQ ID NO: 8104550 - DNA, 22 bp, Homo sapiens
aggagctgcttaaatggttggt

SEQ ID NO: 8104551 - DNA, 22 bp, Homo sapiens
aggagctgctttggtgcggttt

SEQ ID NO: 8104552 - DNA, 22 bp, Homo sapiens
aggagctgcactgggagttttt

SEQ ID NO: 8104553 - DNA, 22 bp, Homo sapiens
acatacatcaagtatcacaaga

SEQ ID NO: 8104554 - DNA, 23 bp, Homo sapiens
acatacatggagataaagtgatg

SEQ ID NO: 8104555 - DNA, 22 bp, Homo sapiens
acatacacaagcgtacatgaac

SEQ ID NO: 8104556 - DNA, 22 bp, Homo sapiens
aggcaacacttgcattttttag

SEQ ID NO: 8104557 - DNA, 22 bp, Homo sapiens
aggagggtacaatgggtggaaa

SEQ ID NO: 8104558 - DNA, 22 bp, Homo sapiens
aggaggggttctcgggtgctga

SEQ ID NO: 8104559 - DNA, 22 bp, Homo sapiens
aggcaaatgatcctgctccttg

SEQ ID NO: 8104560 - DNA, 22 bp, Homo sapiens
aggcaaattattgtatgcagtt

SEQ ID NO: 8104561 - DNA, 20 bp, Homo sapiens
aggagggacctggattggcg

SEQ ID NO: 8104562 - DNA, 22 bp, Homo sapiens
aggaggccgctgatgggctccc

SEQ ID NO: 8104563 - DNA, 22 bp, Homo sapiens
aggagggaataagaaagagtca

SEQ ID NO: 8104564 - DNA, 22 bp, Homo sapiens
agaggctggattgagcatagac

SEQ ID NO: 8104565 - DNA, 18 bp, Homo sapiens
agaggctggacaggggat

SEQ ID NO: 8104566 - DNA, 22 bp, Homo sapiens
agaggccaggctgcagagggat

SEQ ID NO: 8104567 - DNA, 22 bp, Homo sapiens
agaggctgatggagtagtgtct

SEQ ID NO: 8104568 - DNA, 22 bp, Homo sapiens
agaggccagcactgcagggaag

SEQ ID NO: 8104569 - DNA, 22 bp, Homo sapiens
agagctgggaccgtctggaagt

SEQ ID NO: 8104570 - DNA, 20 bp, Homo sapiens
agagctgggaagctccctat

SEQ ID NO: 8104571 - DNA, 22 bp, Homo sapiens
agagctgggaccgtctggaagt

SEQ ID NO: 8104572 - DNA, 21 bp, Homo sapiens
agagctgggacttgcctgaga

SEQ ID NO: 8104573 - DNA, 22 bp, Homo sapiens
attacacaggctggctctttga

SEQ ID NO: 8104574 - DNA, 22 bp, Homo sapiens
attacacatagacattcgttca

SEQ ID NO: 8104575 - DNA, 22 bp, Homo sapiens
agagtccaccctggggtcaggc

SEQ ID NO: 8104576 - DNA, 22 bp, Homo sapiens
agaggtggagctcttggcatca

SEQ ID NO: 8104577 - DNA, 22 bp, Homo sapiens
agagtcaaaatttaccagaatg

SEQ ID NO: 8104578 - DNA, 22 bp, Homo sapiens
agagtatgctacaaagccagcc

SEQ ID NO: 8104579 - DNA, 22 bp, Homo sapiens
agagtcaacatcgagccactgg

SEQ ID NO: 8104580 - DNA, 22 bp, Homo sapiens
agagtcaacatcgagccactgg

SEQ ID NO: 8104581 - DNA, 22 bp, Homo sapiens
agaggggaaggatgtgatgtga

SEQ ID NO: 8104582 - DNA, 22 bp, Homo sapiens
agaggctgggcaggacccacag

SEQ ID NO: 8104583 - DNA, 22 bp, Homo sapiens
agaggggaagtaatgaatgata

SEQ ID NO: 8104584 - DNA, 22 bp, Homo sapiens
agaggggacagccacctgcccg

SEQ ID NO: 8104585 - DNA, 22 bp, Homo sapiens
agaggggagagctaagcaattc

SEQ ID NO: 8104586 - DNA, 22 bp, Homo sapiens
agaggggaggcgaaccagagtc

SEQ ID NO: 8104587 - DNA, 23 bp, Homo sapiens
agaggggagcatctgctggctga

SEQ ID NO: 8104588 - DNA, 18 bp, Homo sapiens
agaggggaggtaagtctg

SEQ ID NO: 8104589 - DNA, 22 bp, Homo sapiens
agaggggagtcctaatctgatt

SEQ ID NO: 8104590 - DNA, 22 bp, Homo sapiens
attggcctgaaactggttcagc

SEQ ID NO: 8104591 - DNA, 22 bp, Homo sapiens
agatatttgtatcttgctattg

SEQ ID NO: 8104592 - DNA, 22 bp, Homo sapiens
agatatttaaatcagacaaaga

SEQ ID NO: 8104593 - DNA, 22 bp, Homo sapiens
agatattaggaggattcataat

SEQ ID NO: 8104594 - DNA, 22 bp, Homo sapiens
agatcacagtcaattgcaagtt

SEQ ID NO: 8104595 - DNA, 22 bp, Homo sapiens
agatcacagagccaagattcca

SEQ ID NO: 8104596 - DNA, 22 bp, Homo sapiens
agatcaaaaacttaatggcttt

SEQ ID NO: 8104597 - DNA, 22 bp, Homo sapiens
agatcacagtggcaactccctt

SEQ ID NO: 8104598 - DNA, 22 bp, Homo sapiens
agatgcaacctctgcttaacaa

SEQ ID NO: 8104599 - DNA, 22 bp, Homo sapiens
agatcagaaagccaatatcata

SEQ ID NO: 8104600 - DNA, 22 bp, Homo sapiens
agatcagatctccttttgcatt

SEQ ID NO: 8104601 - DNA, 22 bp, Homo sapiens
agatggagttagtaccagagtc

SEQ ID NO: 8104602 - DNA, 22 bp, Homo sapiens
agcaagaaaatctctgtccaat

SEQ ID NO: 8104603 - DNA, 22 bp, Homo sapiens
agcaagaaatcttcagtgttct

SEQ ID NO: 8104604 - DNA, 22 bp, Homo sapiens
agcaactatattgaaagccacc

SEQ ID NO: 8104605 - DNA, 22 bp, Homo sapiens
agcaacaggcataatgtgttga

SEQ ID NO: 8104606 - DNA, 20 bp, Homo sapiens
agcaagagtaaggacagcga

SEQ ID NO: 8104607 - DNA, 22 bp, Homo sapiens
caaagatgccaaaaggaagaca

SEQ ID NO: 8104608 - DNA, 22 bp, Homo sapiens
caaagattttagaatttgcaat

SEQ ID NO: 8104609 - DNA, 22 bp, Homo sapiens
caaagatgtcattggtaagaca

SEQ ID NO: 8104610 - DNA, 22 bp, Homo sapiens
attttcagaacattcattcact

SEQ ID NO: 8104611 - DNA, 22 bp, Homo sapiens
attttcagaacattcattcact

SEQ ID NO: 8104612 - DNA, 22 bp, Homo sapiens
attttcaagggagaggcctctg

SEQ ID NO: 8104613 - DNA, 22 bp, Homo sapiens
attttcaagggagaggcctctg

SEQ ID NO: 8104614 - DNA, 22 bp, Homo sapiens
attttcagagacatctggactt

SEQ ID NO: 8104615 - DNA, 22 bp, Homo sapiens
attttagtacctcaagtatcca

SEQ ID NO: 8104616 - DNA, 22 bp, Homo sapiens
attttcaaaacatctgctgtgt

SEQ ID NO: 8104617 - DNA, 22 bp, Homo sapiens
attttcaaaacatctgctgtgt

SEQ ID NO: 8104618 - DNA, 22 bp, Homo sapiens
agcaaagctcatgacattacag

SEQ ID NO: 8104619 - DNA, 22 bp, Homo sapiens
agatgtgggagatgcttctgca

SEQ ID NO: 8104620 - DNA, 22 bp, Homo sapiens
agatgtgtttctagttcctgca

SEQ ID NO: 8104621 - DNA, 22 bp, Homo sapiens
agcaacagcaggtttgcactcc

SEQ ID NO: 8104622 - DNA, 22 bp, Homo sapiens
agagcagatggagctggaagag

SEQ ID NO: 8104623 - DNA, 22 bp, Homo sapiens
agagaggtttgctggaagattc

SEQ ID NO: 8104624 - DNA, 22 bp, Homo sapiens
agagagttgaggaagcaacact

SEQ ID NO: 8104625 - DNA, 22 bp, Homo sapiens
agagcagagggctctgggacaa

SEQ ID NO: 8104626 - DNA, 22 bp, Homo sapiens
agagcctgaggatgtcccagct

SEQ ID NO: 8104627 - DNA, 22 bp, Homo sapiens
agagctggccagggatcactct

SEQ ID NO: 8104628 - DNA, 21 bp, Homo sapiens
agagctggcctgccaggccct

SEQ ID NO: 8104629 - DNA, 22 bp, Homo sapiens
agagaatacaaagaagatatgt

SEQ ID NO: 8104630 - DNA, 22 bp, Homo sapiens
agagaaaactcattgaggtgtc

SEQ ID NO: 8104631 - DNA, 22 bp, Homo sapiens
agacttcttgagctggcacttc

SEQ ID NO: 8104632 - DNA, 22 bp, Homo sapiens
agagagctctggctgggtgacc

SEQ ID NO: 8104633 - DNA, 22 bp, Homo sapiens
agagagcttccattctagtgat

SEQ ID NO: 8104634 - DNA, 22 bp, Homo sapiens
agagaggcgagttacctgtgct

SEQ ID NO: 8104635 - DNA, 21 bp, Homo sapiens
agagagaaggccatatggtcc

SEQ ID NO: 8104636 - DNA, 22 bp, Homo sapiens
agacccaggtttcaaactactc

SEQ ID NO: 8104637 - DNA, 22 bp, Homo sapiens
agaccccatacctcagcaggta

SEQ ID NO: 8104638 - DNA, 22 bp, Homo sapiens
atgccttattccaacaatctag

SEQ ID NO: 8104639 - DNA, 22 bp, Homo sapiens
atgcctggtatgaagcaaggaa

SEQ ID NO: 8104640 - DNA, 22 bp, Homo sapiens
agacacattttacattaactgt

SEQ ID NO: 8104641 - DNA, 22 bp, Homo sapiens
agacaagttctgtgggtcacct

SEQ ID NO: 8104642 - DNA, 22 bp, Homo sapiens
agacaacaccaaatgctagtgt

SEQ ID NO: 8104643 - DNA, 22 bp, Homo sapiens
atctgcctcttcttcattgcga

SEQ ID NO: 8104644 - DNA, 22 bp, Homo sapiens
atctgcctccaagtccatgtgt

SEQ ID NO: 8104645 - DNA, 22 bp, Homo sapiens
atgaagctaaaccctgcagcca

SEQ ID NO: 8104646 - DNA, 22 bp, Homo sapiens
atgaagctgaccttgtcttgct

SEQ ID NO: 8104647 - DNA, 22 bp, Homo sapiens
atgaagctggttttggcttggg

SEQ ID NO: 8104648 - DNA, 22 bp, Homo sapiens
agaatatagttaccaaattctg

SEQ ID NO: 8104649 - DNA, 22 bp, Homo sapiens
atgaagttccagtatatgcagt

SEQ ID NO: 8104650 - DNA, 22 bp, Homo sapiens
agcagcagaggtcagaaaggta

SEQ ID NO: 8104651 - DNA, 22 bp, Homo sapiens
agcagcagagctctggtctgca

SEQ ID NO: 8104652 - DNA, 21 bp, Homo sapiens
agcagcagatctggtgagggc

SEQ ID NO: 8104653 - DNA, 22 bp, Homo sapiens
agcagcagatccaaaaaatgtg

SEQ ID NO: 8104654 - DNA, 22 bp, Homo sapiens
agcagcagatcaaacaggcttg

SEQ ID NO: 8104655 - DNA, 22 bp, Homo sapiens
caatactattcggaccatctct

SEQ ID NO: 8104656 - DNA, 22 bp, Homo sapiens
caatacaattaccagttaatca

SEQ ID NO: 8104657 - DNA, 22 bp, Homo sapiens
agcagctcaacagtgtctctat

SEQ ID NO: 8104658 - DNA, 22 bp, Homo sapiens
agcagctaagtagcgcagttaa

SEQ ID NO: 8104659 - DNA, 22 bp, Homo sapiens
cacagaacatccttagctcatg

SEQ ID NO: 8104660 - DNA, 22 bp, Homo sapiens
cacagaacatccttagctcatg

SEQ ID NO: 8104661 - DNA, 22 bp, Homo sapiens
cacagaacatttttagatgcag

SEQ ID NO: 8104662 - DNA, 22 bp, Homo sapiens
agcagctggaacatatgaagaa

SEQ ID NO: 8104663 - DNA, 22 bp, Homo sapiens
agcacctggatttgatagtcag

SEQ ID NO: 8104664 - DNA, 22 bp, Homo sapiens
agcactagagccaaaatttggg

SEQ ID NO: 8104665 - DNA, 22 bp, Homo sapiens
caagtgacttctttgagcccgt

SEQ ID NO: 8104666 - DNA, 22 bp, Homo sapiens
caagtgacaagacctgtgggcc

SEQ ID NO: 8104667 - DNA, 22 bp, Homo sapiens
caagtgatcagacactgaagtc

SEQ ID NO: 8104668 - DNA, 22 bp, Homo sapiens
caagtgatcagacactgaagtc

SEQ ID NO: 8104669 - DNA, 21 bp, Homo sapiens
agcagaggggacatgtttgat

SEQ ID NO: 8104670 - DNA, 16 bp, Homo sapiens
agcagaggtgagtgaa

SEQ ID NO: 8104671 - DNA, 22 bp, Homo sapiens
agcagaggtgtttattatggga

SEQ ID NO: 8104672 - DNA, 22 bp, Homo sapiens
agcagaggtttgttggaaacct

SEQ ID NO: 8104673 - DNA, 22 bp, Homo sapiens
agcagaggacagttcttaggaa

SEQ ID NO: 8104674 - DNA, 22 bp, Homo sapiens
agcagaggaggatttagttagg

SEQ ID NO: 8104675 - DNA, 21 bp, Homo sapiens
agcagaggcagaatgtatgca

SEQ ID NO: 8104676 - DNA, 21 bp, Homo sapiens
agcagaggctgcctggtgact

SEQ ID NO: 8104677 - DNA, 19 bp, Homo sapiens
agcagtggagccatgcctg

SEQ ID NO: 8104678 - DNA, 22 bp, Homo sapiens
agcagtggcctggggctctgtg

SEQ ID NO: 8104679 - DNA, 22 bp, Homo sapiens
agcagtgagtaacacagaccag

SEQ ID NO: 8104680 - DNA, 22 bp, Homo sapiens
agcagtgagccataagtgctag

SEQ ID NO: 8104681 - DNA, 22 bp, Homo sapiens
agcagtgatgaaatgagcatcc

SEQ ID NO: 8104682 - DNA, 22 bp, Homo sapiens
agcagtggacctcagtgctatt

SEQ ID NO: 8104683 - DNA, 22 bp, Homo sapiens
agcagtaagtgaagactagttt

SEQ ID NO: 8104684 - DNA, 22 bp, Homo sapiens
agcagtccaactgaggtggcat

SEQ ID NO: 8104685 - DNA, 22 bp, Homo sapiens
agcatggggcaatgcatgtgct

SEQ ID NO: 8104686 - DNA, 19 bp, Homo sapiens
agcatggaagctggtgcca

SEQ ID NO: 8104687 - DNA, 22 bp, Homo sapiens
agcatgcaggaaccacatggca

SEQ ID NO: 8104688 - DNA, 22 bp, Homo sapiens
cactggtgacttctgagctgga

SEQ ID NO: 8104689 - DNA, 22 bp, Homo sapiens
cactgttctttttgtagtccaa

SEQ ID NO: 8104690 - DNA, 20 bp, Homo sapiens
caccagcagcagctgccacc

SEQ ID NO: 8104691 - DNA, 22 bp, Homo sapiens
caccagctacagactactgtgt

SEQ ID NO: 8104692 - DNA, 22 bp, Homo sapiens
cacagcagaaagtgtaggagga

SEQ ID NO: 8104693 - DNA, 22 bp, Homo sapiens
cacagcagaaatatgaaggcag

SEQ ID NO: 8104694 - DNA, 22 bp, Homo sapiens
agcagcttgaggctggattcca

SEQ ID NO: 8104695 - DNA, 22 bp, Homo sapiens
agccctgagctggcctgggctt

SEQ ID NO: 8104696 - DNA, 22 bp, Homo sapiens
agccctgctcatctggatcccg

SEQ ID NO: 8104697 - DNA, 23 bp, Homo sapiens
agccctgctgagacccagctccc

SEQ ID NO: 8104698 - DNA, 22 bp, Homo sapiens
agccctgctgcctgaattagct

SEQ ID NO: 8104699 - DNA, 22 bp, Homo sapiens
agccctgcttcaccatttactt

SEQ ID NO: 8104700 - DNA, 22 bp, Homo sapiens
agccctgctgcttcttgtattt

SEQ ID NO: 8104701 - DNA, 22 bp, Homo sapiens
agccctgctgcttcttgtattt

SEQ ID NO: 8104702 - DNA, 22 bp, Homo sapiens
agccctggaccttagcccccac

SEQ ID NO: 8104703 - DNA, 22 bp, Homo sapiens
agcccaggttgaggctgcagtg

SEQ ID NO: 8104704 - DNA, 22 bp, Homo sapiens
agcccatggtgtactctgtggc

SEQ ID NO: 8104705 - DNA, 22 bp, Homo sapiens
agccagtgggattagagcctct

SEQ ID NO: 8104706 - DNA, 19 bp, Homo sapiens
cagagccttcagtgactcc

SEQ ID NO: 8104707 - DNA, 22 bp, Homo sapiens
agccaggccagctgtcttgagt

SEQ ID NO: 8104708 - DNA, 22 bp, Homo sapiens
cagagcccaagagcaagccatg

SEQ ID NO: 8104709 - DNA, 22 bp, Homo sapiens
agccaggccttttctcaaggtt

SEQ ID NO: 8104710 - DNA, 22 bp, Homo sapiens
cagagacccttctcagtggcca

SEQ ID NO: 8104711 - DNA, 22 bp, Homo sapiens
cagagaccccgctgcccttctg

SEQ ID NO: 8104712 - DNA, 20 bp, Homo sapiens
agccagccacttcctgctcc

SEQ ID NO: 8104713 - DNA, 22 bp, Homo sapiens
agccagcatcccttcagtctcc

SEQ ID NO: 8104714 - DNA, 22 bp, Homo sapiens
agccagccgggggaccacagtg

SEQ ID NO: 8104715 - DNA, 22 bp, Homo sapiens
agccagcctgatctcttcttgc

SEQ ID NO: 8104716 - DNA, 22 bp, Homo sapiens
agccagcacggatttcccagga

SEQ ID NO: 8104717 - DNA, 22 bp, Homo sapiens
cactttctgtgtatcttccatt

SEQ ID NO: 8104718 - DNA, 22 bp, Homo sapiens
agcctgggcatgggacgggagg

SEQ ID NO: 8104719 - DNA, 22 bp, Homo sapiens
agcctgggccctgcctcttctc

SEQ ID NO: 8104720 - DNA, 22 bp, Homo sapiens
agcctgggcctggcttcccgcc

SEQ ID NO: 8104721 - DNA, 18 bp, Homo sapiens
agcctgggctctgcctgg

SEQ ID NO: 8104722 - DNA, 23 bp, Homo sapiens
agcctgggtagcctaaataacag

SEQ ID NO: 8104723 - DNA, 22 bp, Homo sapiens
agcctgggggcgcagaaaccgg

SEQ ID NO: 8104724 - DNA, 22 bp, Homo sapiens
agcctggggtttcagtttgcac

SEQ ID NO: 8104725 - DNA, 20 bp, Homo sapiens
agcctggggaattccacccc

SEQ ID NO: 8104726 - DNA, 22 bp, Homo sapiens
agcctggggcacttctccaaac

SEQ ID NO: 8104727 - DNA, 22 bp, Homo sapiens
agcctgggtttttattaaggag

SEQ ID NO: 8104728 - DNA, 22 bp, Homo sapiens
agcctgggttagggttcttccc

SEQ ID NO: 8104729 - DNA, 21 bp, Homo sapiens
agcctgggtatcctttgagga

SEQ ID NO: 8104730 - DNA, 22 bp, Homo sapiens
agcctgggtgggggttcggaga

SEQ ID NO: 8104731 - DNA, 22 bp, Homo sapiens
cagatgtatatgcataaaaagt

SEQ ID NO: 8104732 - DNA, 22 bp, Homo sapiens
cagcaacttggacagcagtctt

SEQ ID NO: 8104733 - DNA, 22 bp, Homo sapiens
cagcaactgtgcctgacacaca

SEQ ID NO: 8104734 - DNA, 22 bp, Homo sapiens
cagcaactctcctgtgctcaaa

SEQ ID NO: 8104735 - DNA, 22 bp, Homo sapiens
cagcaaattttaatactgcttt

SEQ ID NO: 8104736 - DNA, 22 bp, Homo sapiens
agcctggccactcagggcctga

SEQ ID NO: 8104737 - DNA, 22 bp, Homo sapiens
agcctgggcaacaacacagcga

SEQ ID NO: 8104738 - DNA, 22 bp, Homo sapiens
agcctgggcaactccattcact

SEQ ID NO: 8104739 - DNA, 22 bp, Homo sapiens
agcctgggcaacagagcaaaac

SEQ ID NO: 8104740 - DNA, 21 bp, Homo sapiens
agcctgggaggcggaggttgc

SEQ ID NO: 8104741 - DNA, 22 bp, Homo sapiens
agcctgggagacactaagttgt

SEQ ID NO: 8104742 - DNA, 17 bp, Homo sapiens
agcctgggaaggagtga

SEQ ID NO: 8104743 - DNA, 22 bp, Homo sapiens
agcctgggaatttagagttcgg

SEQ ID NO: 8104744 - DNA, 22 bp, Homo sapiens
agctccagcccatctgctcgtg

SEQ ID NO: 8104745 - DNA, 20 bp, Homo sapiens
agctaggagaaagcatggag

SEQ ID NO: 8104746 - DNA, 19 bp, Homo sapiens
agctccaggcctggatgct

SEQ ID NO: 8104747 - DNA, 22 bp, Homo sapiens
agctccagcctcttctggaggt

SEQ ID NO: 8104748 - DNA, 23 bp, Homo sapiens
agctccagctgacgtgggcagcc

SEQ ID NO: 8104749 - DNA, 21 bp, Homo sapiens
agctccaggctcctggggttc

SEQ ID NO: 8104750 - DNA, 22 bp, Homo sapiens
agctcctgtctcaagggagcct

SEQ ID NO: 8104751 - DNA, 22 bp, Homo sapiens
agctcctgggagcaggtggtac

SEQ ID NO: 8104752 - DNA, 22 bp, Homo sapiens
agctcctgtggctgaaagagga

SEQ ID NO: 8104753 - DNA, 22 bp, Homo sapiens
agctctgtaacccattccctgt

SEQ ID NO: 8104754 - DNA, 22 bp, Homo sapiens
agctctggtttagaaggggaaa

SEQ ID NO: 8104755 - DNA, 22 bp, Homo sapiens
agctctttgactaatcttgctt

SEQ ID NO: 8104756 - DNA, 22 bp, Homo sapiens
agctctttgactaatcttgctt

SEQ ID NO: 8104757 - DNA, 22 bp, Homo sapiens
acctgggaggcggaggttgcag

SEQ ID NO: 8104758 - DNA, 22 bp, Homo sapiens
acctgggaggcagaggttgcag

SEQ ID NO: 8104759 - DNA, 22 bp, Homo sapiens
acctgggagagaggagccggcg

SEQ ID NO: 8104760 - DNA, 22 bp, Homo sapiens
acctgggatggggccaggttta

SEQ ID NO: 8104761 - DNA, 20 bp, Homo sapiens
acctgggattagatacccaa

SEQ ID NO: 8104762 - DNA, 22 bp, Homo sapiens
acctgggagtcacacctgagaa

SEQ ID NO: 8104763 - DNA, 22 bp, Homo sapiens
acctgggagtatgcagtggtga

SEQ ID NO: 8104764 - DNA, 20 bp, Homo sapiens
acctgggaaaaccttttcct

SEQ ID NO: 8104765 - DNA, 22 bp, Homo sapiens
acctgggaagatctttgaagct

SEQ ID NO: 8104766 - DNA, 22 bp, Homo sapiens
acctgggaacgctttgtggagg

SEQ ID NO: 8104767 - DNA, 22 bp, Homo sapiens
acctgggaaaaggagtggccat

SEQ ID NO: 8104768 - DNA, 22 bp, Homo sapiens
acctgggaaagccgtggaaagg

SEQ ID NO: 8104769 - DNA, 22 bp, Homo sapiens
accttgatggggctgttggagt

SEQ ID NO: 8104770 - DNA, 22 bp, Homo sapiens
aagtaacacatgttacttctgc

SEQ ID NO: 8104771 - DNA, 21 bp, Homo sapiens
aagtaaatcagagaaataacc

SEQ ID NO: 8104772 - DNA, 22 bp, Homo sapiens
aagtaaatgttggagctcaaat

SEQ ID NO: 8104773 - DNA, 22 bp, Homo sapiens
aagtaaatatctgtagtcttta

SEQ ID NO: 8104774 - DNA, 22 bp, Homo sapiens
aagtaaatatctgtagtcttta

SEQ ID NO: 8104775 - DNA, 22 bp, Homo sapiens
aagtgcagagagctgacgaact

SEQ ID NO: 8104776 - DNA, 22 bp, Homo sapiens
aagtgattttcctacttgctaa

SEQ ID NO: 8104777 - DNA, 22 bp, Homo sapiens
aagtgattctagtcatgattct

SEQ ID NO: 8104778 - DNA, 22 bp, Homo sapiens
aagtgatttagtcttataaagg

SEQ ID NO: 8104779 - DNA, 22 bp, Homo sapiens
aagtgattcattgatgatgagg

SEQ ID NO: 8104780 - DNA, 22 bp, Homo sapiens
accttgtgaggttacataatgt

SEQ ID NO: 8104781 - DNA, 22 bp, Homo sapiens
aagtgaaattgccattcttata

SEQ ID NO: 8104782 - DNA, 22 bp, Homo sapiens
aagtgaagaaatacatgagaat

SEQ ID NO: 8104783 - DNA, 22 bp, Homo sapiens
aataaagactcagaggcccagg

SEQ ID NO: 8104784 - DNA, 22 bp, Homo sapiens
aataaagacaaacaggggagcc

SEQ ID NO: 8104785 - DNA, 22 bp, Homo sapiens
aataaagaatggatgagatcgt

SEQ ID NO: 8104786 - DNA, 22 bp, Homo sapiens
aataaagccttattgattttac

SEQ ID NO: 8104787 - DNA, 22 bp, Homo sapiens
aataaaggcaccataaggcaaa

SEQ ID NO: 8104788 - DNA, 22 bp, Homo sapiens
aataaagtgtattctttgtcat

SEQ ID NO: 8104789 - DNA, 22 bp, Homo sapiens
aataaagtgtattctttgtcat

SEQ ID NO: 8104790 - DNA, 22 bp, Homo sapiens
aataaagtgtattctttgtcat

SEQ ID NO: 8104791 - DNA, 22 bp, Homo sapiens
aataaatcaatcctattggtag

SEQ ID NO: 8104792 - DNA, 22 bp, Homo sapiens
actcatgatatgcctataagat

SEQ ID NO: 8104793 - DNA, 22 bp, Homo sapiens
actcatcagcctctaggaaaga

SEQ ID NO: 8104794 - DNA, 21 bp, Homo sapiens
aagtttctccctaattgttgc

SEQ ID NO: 8104795 - DNA, 22 bp, Homo sapiens
aagtggggcctggtggtacagt

SEQ ID NO: 8104796 - DNA, 22 bp, Homo sapiens
actgtgggaaccactgaatcag

SEQ ID NO: 8104797 - DNA, 22 bp, Homo sapiens
aataacagggttgatttgcaat

SEQ ID NO: 8104798 - DNA, 22 bp, Homo sapiens
aataacctttatttcaaagtgt

SEQ ID NO: 8104799 - DNA, 22 bp, Homo sapiens
aatacttgaatttcatgtcagg

SEQ ID NO: 8104800 - DNA, 22 bp, Homo sapiens
aatacttgtgaattcaaagtct

SEQ ID NO: 8104801 - DNA, 22 bp, Homo sapiens
aatacttgtcagatgaataaga

SEQ ID NO: 8104802 - DNA, 22 bp, Homo sapiens
aatatcttggcccaactccaga

SEQ ID NO: 8104803 - DNA, 22 bp, Homo sapiens
aatatgaattattgttacaagt

SEQ ID NO: 8104804 - DNA, 20 bp, Homo sapiens
agaaaatgttttcagctgga

SEQ ID NO: 8104805 - DNA, 22 bp, Homo sapiens
aatattcatttgcagaagaagt

SEQ ID NO: 8104806 - DNA, 22 bp, Homo sapiens
aatattcatttgcagaagaagt

SEQ ID NO: 8104807 - DNA, 22 bp, Homo sapiens
aatatgttcaaaatagatcact

SEQ ID NO: 8104808 - DNA, 22 bp, Homo sapiens
aatatgcattatacagactgat

SEQ ID NO: 8104809 - DNA, 22 bp, Homo sapiens
aatatgtctgctaattgtttct

SEQ ID NO: 8104810 - DNA, 22 bp, Homo sapiens
aatatcttctaaggatagaact

SEQ ID NO: 8104811 - DNA, 22 bp, Homo sapiens
aatatgcagcatgatgaagtaa

SEQ ID NO: 8104812 - DNA, 22 bp, Homo sapiens
aatcttaaagaatattctacca

SEQ ID NO: 8104813 - DNA, 22 bp, Homo sapiens
aatcttaaagaatattctacca

SEQ ID NO: 8104814 - DNA, 22 bp, Homo sapiens
agaaactatcctgagtagcaaa

SEQ ID NO: 8104815 - DNA, 22 bp, Homo sapiens
agaaactaagtcataactcttt

SEQ ID NO: 8104816 - DNA, 22 bp, Homo sapiens
agaaacctcacagcaattctga

SEQ ID NO: 8104817 - DNA, 22 bp, Homo sapiens
agaaacctgggggttgtacata

SEQ ID NO: 8104818 - DNA, 22 bp, Homo sapiens
agaaactaaagccaagggctct

SEQ ID NO: 8104819 - DNA, 22 bp, Homo sapiens
agaaactaacctggtagggttc

SEQ ID NO: 8104820 - DNA, 22 bp, Homo sapiens
agaaactattatggtaaacaaa

SEQ ID NO: 8104821 - DNA, 22 bp, Homo sapiens
agaaactctaggtcaattgagg

SEQ ID NO: 8104822 - DNA, 22 bp, Homo sapiens
aatctatatgcttttcacatac

SEQ ID NO: 8104823 - DNA, 22 bp, Homo sapiens
aatctttccctattaaatgtgg

SEQ ID NO: 8104824 - DNA, 22 bp, Homo sapiens
aatcttctttcttaacagtaca

SEQ ID NO: 8104825 - DNA, 22 bp, Homo sapiens
aatcttgagtatcagaccaaga

SEQ ID NO: 8104826 - DNA, 22 bp, Homo sapiens
aatcttaagctgaattctctcc

SEQ ID NO: 8104827 - DNA, 22 bp, Homo sapiens
aatcttcactcattcagagttg

SEQ ID NO: 8104828 - DNA, 22 bp, Homo sapiens
acatacttaacattaaagtcat

SEQ ID NO: 8104829 - DNA, 22 bp, Homo sapiens
acataatggacaataatgcatc

SEQ ID NO: 8104830 - DNA, 22 bp, Homo sapiens
acataagttatggataaaatgt

SEQ ID NO: 8104831 - DNA, 16 bp, Homo sapiens
acatggtagctctttg

SEQ ID NO: 8104832 - DNA, 22 bp, Homo sapiens
acatggctggcaccttaaattt

SEQ ID NO: 8104833 - DNA, 22 bp, Homo sapiens
acatactttttaaaagattgct

SEQ ID NO: 8104834 - DNA, 22 bp, Homo sapiens
acatacttaacattaaagtcat

SEQ ID NO: 8104835 - DNA, 22 bp, Homo sapiens
acatacttatgtgtatatgtgt

SEQ ID NO: 8104836 - DNA, 22 bp, Homo sapiens
acatacttgaagcaagtgatca

SEQ ID NO: 8104837 - DNA, 22 bp, Homo sapiens
acatacttctttacattccata

SEQ ID NO: 8104838 - DNA, 22 bp, Homo sapiens
acatggttgaatgctttatttg

SEQ ID NO: 8104839 - DNA, 22 bp, Homo sapiens
acatggtatttctattataatt

SEQ ID NO: 8104840 - DNA, 20 bp, Homo sapiens
acatggtggggactcagagc

SEQ ID NO: 8104841 - DNA, 17 bp, Homo sapiens
accacctctcaccagca

SEQ ID NO: 8104842 - DNA, 22 bp, Homo sapiens
aagggcagctgacagatgctta

SEQ ID NO: 8104843 - DNA, 22 bp, Homo sapiens
aagtaaaagcaggtgtgctggg

SEQ ID NO: 8104844 - DNA, 22 bp, Homo sapiens
aagtaaaatgtttcctttatta

SEQ ID NO: 8104845 - DNA, 22 bp, Homo sapiens
accaggaaaaacactgtgttgg

SEQ ID NO: 8104846 - DNA, 22 bp, Homo sapiens
acaggtgaggggttctaggctg

SEQ ID NO: 8104847 - DNA, 22 bp, Homo sapiens
acaggtgtagaaaacagattat

SEQ ID NO: 8104848 - DNA, 22 bp, Homo sapiens
acagtgtataaaatcttaaaga

SEQ ID NO: 8104849 - DNA, 22 bp, Homo sapiens
acagtgtatattgtttatctgg

SEQ ID NO: 8104850 - DNA, 22 bp, Homo sapiens
acagtgtagcatggtagcaatg

SEQ ID NO: 8104851 - DNA, 22 bp, Homo sapiens
acagtgtactcctttaccggag

SEQ ID NO: 8104852 - DNA, 22 bp, Homo sapiens
acagtgtagaatcctgtactta

SEQ ID NO: 8104853 - DNA, 22 bp, Homo sapiens
acagtgtactaaatagtaagag

SEQ ID NO: 8104854 - DNA, 22 bp, Homo sapiens
acagtgtactaggtacatgttc

SEQ ID NO: 8104855 - DNA, 22 bp, Homo sapiens
acagtgtactaggtacatgttc

SEQ ID NO: 8104856 - DNA, 22 bp, Homo sapiens
acagtgtaatatgggagtcagt

SEQ ID NO: 8104857 - DNA, 22 bp, Homo sapiens
acagtgtaattcatggctgaaa

SEQ ID NO: 8104858 - DNA, 22 bp, Homo sapiens
acagtgtaatatgggagtcagt

SEQ ID NO: 8104859 - DNA, 20 bp, Homo sapiens
acagtgtaatattcacattc

SEQ ID NO: 8104860 - DNA, 22 bp, Homo sapiens
acaggaggagcagctgtgtgcc

SEQ ID NO: 8104861 - DNA, 22 bp, Homo sapiens
acaggcagagagtggcggactc

SEQ ID NO: 8104862 - DNA, 22 bp, Homo sapiens
acagaactgggaaatgcacata

SEQ ID NO: 8104863 - DNA, 22 bp, Homo sapiens
acagaactgcagacagtgccaa

SEQ ID NO: 8104864 - DNA, 21 bp, Homo sapiens
acagaactgtatagtgataaa

SEQ ID NO: 8104865 - DNA, 22 bp, Homo sapiens
acagaactgggggcacagatag

SEQ ID NO: 8104866 - DNA, 22 bp, Homo sapiens
agcccaggtctggcccagcctg

SEQ ID NO: 8104867 - DNA, 22 bp, Homo sapiens
agcattccacactgaagtctgc

SEQ ID NO: 8104868 - DNA, 22 bp, Homo sapiens
agcatgaaaacatgaaacagca

SEQ ID NO: 8104869 - DNA, 22 bp, Homo sapiens
agccaggctactccttgctgac

SEQ ID NO: 8104870 - DNA, 22 bp, Homo sapiens
agccaggctactccttgctgac

SEQ ID NO: 8104871 - DNA, 22 bp, Homo sapiens
agccaggctaaatgagccatga

SEQ ID NO: 8104872 - DNA, 22 bp, Homo sapiens
agccaggcgcagtggcttatgc

SEQ ID NO: 8104873 - DNA, 22 bp, Homo sapiens
agcctgcttccctttgtgcccc

SEQ ID NO: 8104874 - DNA, 22 bp, Homo sapiens
agccctgcaggatgagggaggt

SEQ ID NO: 8104875 - DNA, 22 bp, Homo sapiens
agccctgcataaatcagttggt

SEQ ID NO: 8104876 - DNA, 22 bp, Homo sapiens
agccctgcacagttcgggagga

SEQ ID NO: 8104877 - DNA, 22 bp, Homo sapiens
agccctgcaggaggtgggagag

SEQ ID NO: 8104878 - DNA, 22 bp, Homo sapiens
agccctgcacaggtctgtggct

SEQ ID NO: 8104879 - DNA, 22 bp, Homo sapiens
agccctgcacaggtctgtggct

SEQ ID NO: 8104880 - DNA, 22 bp, Homo sapiens
agccctgcatagaagggaacac

SEQ ID NO: 8104881 - DNA, 22 bp, Homo sapiens
agccctgccattctctggagct

SEQ ID NO: 8104882 - DNA, 22 bp, Homo sapiens
agccctgccattctctggagct

SEQ ID NO: 8104883 - DNA, 22 bp, Homo sapiens
agccctgccctgccatgtggca

SEQ ID NO: 8104884 - DNA, 22 bp, Homo sapiens
agccctgcctctccaatgccca

SEQ ID NO: 8104885 - DNA, 16 bp, Homo sapiens
agccctgccgtgtact

SEQ ID NO: 8104886 - DNA, 22 bp, Homo sapiens
agccctgcgtgccaggggactg

SEQ ID NO: 8104887 - DNA, 22 bp, Homo sapiens
agccctgcgctcacgttctgca

SEQ ID NO: 8104888 - DNA, 22 bp, Homo sapiens
agccctgcgatcgtgatttctt

SEQ ID NO: 8104889 - DNA, 22 bp, Homo sapiens
agccctgcgatcgtgatttctt

SEQ ID NO: 8104890 - DNA, 22 bp, Homo sapiens
agctcaggtagactcagcatct

SEQ ID NO: 8104891 - DNA, 22 bp, Homo sapiens
agctcaggtctcaggaggtgtc

SEQ ID NO: 8104892 - DNA, 22 bp, Homo sapiens
agctccagaaaggtacacacag

SEQ ID NO: 8104893 - DNA, 22 bp, Homo sapiens
agctcagggcgatctgtctcgg

SEQ ID NO: 8104894 - DNA, 22 bp, Homo sapiens
agctcagggcaaagactcaaat

SEQ ID NO: 8104895 - DNA, 22 bp, Homo sapiens
agcctgtgactctgtgaaacca

SEQ ID NO: 8104896 - DNA, 22 bp, Homo sapiens
agcctgtgacattgactatgaa

SEQ ID NO: 8104897 - DNA, 22 bp, Homo sapiens
agcctgtgtgaagccctcagag

SEQ ID NO: 8104898 - DNA, 22 bp, Homo sapiens
agcatcagtactaatctggcca

SEQ ID NO: 8104899 - DNA, 22 bp, Homo sapiens
agcagttatgtgtctcttgact

SEQ ID NO: 8104900 - DNA, 22 bp, Homo sapiens
agcaggagggttttgtagagtc

SEQ ID NO: 8104901 - DNA, 22 bp, Homo sapiens
acacacagaaggaagccccact

SEQ ID NO: 8104902 - DNA, 22 bp, Homo sapiens
agcagaaacagccagtctggac

SEQ ID NO: 8104903 - DNA, 22 bp, Homo sapiens
agcactttgtgcatttctgaag

SEQ ID NO: 8104904 - DNA, 22 bp, Homo sapiens
agcactttgggagataaagctg

SEQ ID NO: 8104905 - DNA, 19 bp, Homo sapiens
agcacttgtggtcctccct

SEQ ID NO: 8104906 - DNA, 22 bp, Homo sapiens
agcactttaagcaacagatcaa

SEQ ID NO: 8104907 - DNA, 22 bp, Homo sapiens
agcactttagaatttagagttg

SEQ ID NO: 8104908 - DNA, 22 bp, Homo sapiens
agcactttattcaggaactcca

SEQ ID NO: 8104909 - DNA, 22 bp, Homo sapiens
agcactttcctggcaaatgtgg

SEQ ID NO: 8104910 - DNA, 20 bp, Homo sapiens
agcacttgctgtgtgccata

SEQ ID NO: 8104911 - DNA, 22 bp, Homo sapiens
acacacttcacccttgagctaa

SEQ ID NO: 8104912 - DNA, 22 bp, Homo sapiens
acacacttcagatgtaatttgt

SEQ ID NO: 8104913 - DNA, 20 bp, Homo sapiens
acacactttgatcttgagcc

SEQ ID NO: 8104914 - DNA, 20 bp, Homo sapiens
acacactttgatcttgagcc

SEQ ID NO: 8104915 - DNA, 23 bp, Homo sapiens
acacagaagaagacccaaggaag

SEQ ID NO: 8104916 - DNA, 23 bp, Homo sapiens
agcagcagcaattaagtggatat

SEQ ID NO: 8104917 - DNA, 19 bp, Homo sapiens
agcagcagcaccagggatt

SEQ ID NO: 8104918 - DNA, 22 bp, Homo sapiens
agcagcagattcagcaggaatg

SEQ ID NO: 8104919 - DNA, 22 bp, Homo sapiens
agcagcagattatggtctacat

SEQ ID NO: 8104920 - DNA, 22 bp, Homo sapiens
agaggtgggagcctggtcacat

SEQ ID NO: 8104921 - DNA, 22 bp, Homo sapiens
agaggtgggagcctggtcacat

SEQ ID NO: 8104922 - DNA, 22 bp, Homo sapiens
agaggtggccatgggcgctgga

SEQ ID NO: 8104923 - DNA, 22 bp, Homo sapiens
acaaaaaccgtggattcagcat

SEQ ID NO: 8104924 - DNA, 22 bp, Homo sapiens
acaaaaagctccattactgtcc

SEQ ID NO: 8104925 - DNA, 19 bp, Homo sapiens
agattattgcacattcatg

SEQ ID NO: 8104926 - DNA, 22 bp, Homo sapiens
agattatttccagactaatgaa

SEQ ID NO: 8104927 - DNA, 22 bp, Homo sapiens
agattatttccagactaatgaa

SEQ ID NO: 8104928 - DNA, 22 bp, Homo sapiens
agattatttaagacaggaacca

SEQ ID NO: 8104929 - DNA, 22 bp, Homo sapiens
agatatctggaaaaaatgtatg

SEQ ID NO: 8104930 - DNA, 22 bp, Homo sapiens
agatctgagtggctgcatgtaa

SEQ ID NO: 8104931 - DNA, 22 bp, Homo sapiens
agagggcatgcttggtggcctg

SEQ ID NO: 8104932 - DNA, 22 bp, Homo sapiens
agagggcattaactctgtcttg

SEQ ID NO: 8104933 - DNA, 22 bp, Homo sapiens
aatttcaagtcttgaagaagta

SEQ ID NO: 8104934 - DNA, 22 bp, Homo sapiens
aattcacaggaggtatttgtcc

SEQ ID NO: 8104935 - DNA, 22 bp, Homo sapiens
aattcacatgttgaagtcctaa

SEQ ID NO: 8104936 - DNA, 22 bp, Homo sapiens
aattcacatatacattattcct

SEQ ID NO: 8104937 - DNA, 22 bp, Homo sapiens
aatgtacatctcagtgtagtac

SEQ ID NO: 8104938 - DNA, 23 bp, Homo sapiens
agaatttctaactctagctctgt

SEQ ID NO: 8104939 - DNA, 22 bp, Homo sapiens
aatgtacaccgtgggtttttta

SEQ ID NO: 8104940 - DNA, 23 bp, Homo sapiens
agacaaaagcctcagtcttaggc

SEQ ID NO: 8104941 - DNA, 22 bp, Homo sapiens
aatgtaaacagcaagagaaggg

SEQ ID NO: 8104942 - DNA, 22 bp, Homo sapiens
agaatctgcatttctaataagc

SEQ ID NO: 8104943 - DNA, 22 bp, Homo sapiens
agaatctaagtacacagacaga

SEQ ID NO: 8104944 - DNA, 22 bp, Homo sapiens
aatgctttgactatatctataa

SEQ ID NO: 8104945 - DNA, 22 bp, Homo sapiens
aatggaatgcctcacatgtatt

SEQ ID NO: 8104946 - DNA, 22 bp, Homo sapiens
aatggaacctagttatccacat

SEQ ID NO: 8104947 - DNA, 22 bp, Homo sapiens
agaataaatcaaatgtcctgag

SEQ ID NO: 8104948 - DNA, 22 bp, Homo sapiens
agaatcattagagagaaaactt

SEQ ID NO: 8104949 - DNA, 22 bp, Homo sapiens
agaataatactgaaatgctgaa

SEQ ID NO: 8104950 - DNA, 22 bp, Homo sapiens
agagagaattggataaattggt

SEQ ID NO: 8104951 - DNA, 18 bp, Homo sapiens
agagagaattccagtagg

SEQ ID NO: 8104952 - DNA, 17 bp, Homo sapiens
agagagagcatgccacc

SEQ ID NO: 8104953 - DNA, 22 bp, Homo sapiens
agagagacgggggctgctgctt

SEQ ID NO: 8104954 - DNA, 20 bp, Homo sapiens
agagagaggtaaattgagca

SEQ ID NO: 8104955 - DNA, 22 bp, Homo sapiens
agagagaggggcgagcaaacac

SEQ ID NO: 8104956 - DNA, 22 bp, Homo sapiens
aattatgtggaagaggattaaa

SEQ ID NO: 8104957 - DNA, 17 bp, Homo sapiens
agagataaggcggagaa

SEQ ID NO: 8104958 - DNA, 23 bp, Homo sapiens
agagagagtttgtgtcaggtacc

SEQ ID NO: 8104959 - DNA, 22 bp, Homo sapiens
agacactgagcattttcctagc

SEQ ID NO: 8104960 - DNA, 22 bp, Homo sapiens
agactcttggagaagagctata

SEQ ID NO: 8104961 - DNA, 18 bp, Homo sapiens
agagaaagaccaaagcat

SEQ ID NO: 8104962 - DNA, 22 bp, Homo sapiens
aaatgctagaacattttaaagg

SEQ ID NO: 8104963 - DNA, 22 bp, Homo sapiens
aaatgctacacaggaattctca

SEQ ID NO: 8104964 - DNA, 22 bp, Homo sapiens
aaatgcctcattttctctcact

SEQ ID NO: 8104965 - DNA, 22 bp, Homo sapiens
aaatcatgttggcacaataaaa

SEQ ID NO: 8104966 - DNA, 22 bp, Homo sapiens
aaatccaggaagcagtggtgta

SEQ ID NO: 8104967 - DNA, 21 bp, Homo sapiens
aaatccaaacactagtccaca

SEQ ID NO: 8104968 - DNA, 21 bp, Homo sapiens
aaatccaaacactagtccaca

SEQ ID NO: 8104969 - DNA, 22 bp, Homo sapiens
aaatataatttctgcctcaata

SEQ ID NO: 8104970 - DNA, 22 bp, Homo sapiens
aaatatgtaagattagcactag

SEQ ID NO: 8104971 - DNA, 22 bp, Homo sapiens
aaactactgatttgtgaattga

SEQ ID NO: 8104972 - DNA, 22 bp, Homo sapiens
aaactactggattagtaactta

SEQ ID NO: 8104973 - DNA, 22 bp, Homo sapiens
aaactacactttgggaccagca

SEQ ID NO: 8104974 - DNA, 23 bp, Homo sapiens
aaactacaacgccaggcactgag

SEQ ID NO: 8104975 - DNA, 20 bp, Homo sapiens
aaacgagccatcattctggt

SEQ ID NO: 8104976 - DNA, 22 bp, Homo sapiens
aaacggaatgagtaagagtatc

SEQ ID NO: 8104977 - DNA, 22 bp, Homo sapiens
aaatagaaaccaacaaggtcag

SEQ ID NO: 8104978 - DNA, 22 bp, Homo sapiens
aaatagaattaactagctactg

SEQ ID NO: 8104979 - DNA, 22 bp, Homo sapiens
aaagtcatttagccttatctcc

SEQ ID NO: 8104980 - DNA, 22 bp, Homo sapiens
aaagtgcattcgaaagtccatc

SEQ ID NO: 8104981 - DNA, 22 bp, Homo sapiens
aaacatctattatgtgctgagc

SEQ ID NO: 8104982 - DNA, 22 bp, Homo sapiens
aaagcaatgcccgttcattatc

SEQ ID NO: 8104983 - DNA, 22 bp, Homo sapiens
aaagcaatggatgagaatctgt

SEQ ID NO: 8104984 - DNA, 22 bp, Homo sapiens
aaaggaggaatggagagatgct

SEQ ID NO: 8104985 - DNA, 22 bp, Homo sapiens
aaaggcatgtggtcaaggctca

SEQ ID NO: 8104986 - DNA, 22 bp, Homo sapiens
aaacttcttgctgcattttctg

SEQ ID NO: 8104987 - DNA, 23 bp, Homo sapiens
aaacttgctatggctgaaatcat

SEQ ID NO: 8104988 - DNA, 22 bp, Homo sapiens
aaagaaggacctggaggaggat

SEQ ID NO: 8104989 - DNA, 22 bp, Homo sapiens
aaagaaggatgggagaaatcct

SEQ ID NO: 8104990 - DNA, 22 bp, Homo sapiens
aaagatctgacttagacacaga

SEQ ID NO: 8104991 - DNA, 22 bp, Homo sapiens
aaactggtgtcactgagggctg

SEQ ID NO: 8104992 - DNA, 22 bp, Homo sapiens
aaactggtattcaaatgtttgg

SEQ ID NO: 8104993 - DNA, 22 bp, Homo sapiens
aaaccagtgatagactagacac

SEQ ID NO: 8104994 - DNA, 22 bp, Homo sapiens
aaaagtctgctctcatttcaga

SEQ ID NO: 8104995 - DNA, 19 bp, Homo sapiens
aaaagtctattcaattaca

SEQ ID NO: 8104996 - DNA, 19 bp, Homo sapiens
aaaagtctattcaattaca

SEQ ID NO: 8104997 - DNA, 22 bp, Homo sapiens
aaaagtattttggatctcagat

SEQ ID NO: 8104998 - DNA, 22 bp, Homo sapiens
aaaagtattttgagcactttat

SEQ ID NO: 8104999 - DNA, 22 bp, Homo sapiens
aaacaaatagtgcatgggaatt

SEQ ID NO: 8105000 - DNA, 22 bp, Homo sapiens
aaacaacatggtgggtgtgtag

SEQ ID NO: 8105001 - DNA, 22 bp, Homo sapiens
aaacaacctaaagttactgatc

SEQ ID NO: 8105002 - DNA, 22 bp, Homo sapiens
aaacaaatttcaagctgtgaca

SEQ ID NO: 8105003 - DNA, 22 bp, Homo sapiens
aaaatagcctcacataattgct

SEQ ID NO: 8105004 - DNA, 22 bp, Homo sapiens
aaaagtcttgtcaaggttccca

SEQ ID NO: 8105005 - DNA, 22 bp, Homo sapiens
aaaatagataatgccagggtca

SEQ ID NO: 8105006 - DNA, 22 bp, Homo sapiens
aacagtctgggagttccttata

SEQ ID NO: 8105007 - DNA, 22 bp, Homo sapiens
aacagtgagaaggtggacagga

SEQ ID NO: 8105008 - DNA, 22 bp, Homo sapiens
aacagtaggtgtaaccaaacaa

SEQ ID NO: 8105009 - DNA, 22 bp, Homo sapiens
aactgaggccaagtgaggaaag

SEQ ID NO: 8105010 - DNA, 22 bp, Homo sapiens
aactgagcaccactgatgttat

SEQ ID NO: 8105011 - DNA, 22 bp, Homo sapiens
aactaatacattaatacatgtg

SEQ ID NO: 8105012 - DNA, 22 bp, Homo sapiens
aactcaaagatgcatgacgctt

SEQ ID NO: 8105013 - DNA, 22 bp, Homo sapiens
aactatactctgtaaatgtgct

SEQ ID NO: 8105014 - DNA, 22 bp, Homo sapiens
aactattctgtggactcttata

SEQ ID NO: 8105015 - DNA, 22 bp, Homo sapiens
aacaaccaaaaagatgaatgta

SEQ ID NO: 8105016 - DNA, 22 bp, Homo sapiens
aacaactgctaaggtgtgtcct

SEQ ID NO: 8105017 - DNA, 22 bp, Homo sapiens
aacaacaacggagaaagggttg

SEQ ID NO: 8105018 - DNA, 22 bp, Homo sapiens
aacaaattagttgcaagactgg

SEQ ID NO: 8105019 - DNA, 22 bp, Homo sapiens
aaagcacctagcatagtgctta

SEQ ID NO: 8105020 - DNA, 22 bp, Homo sapiens
aaagcaatgggtctaaggtaaa

SEQ ID NO: 8105021 - DNA, 22 bp, Homo sapiens
aacacatatttatatatgcaca

SEQ ID NO: 8105022 - DNA, 21 bp, Homo sapiens
aacacatccagagtatttgac

SEQ ID NO: 8105023 - DNA, 22 bp, Homo sapiens
aacacatatttatatatgcaca

SEQ ID NO: 8105024 - DNA, 22 bp, Homo sapiens
aacacattgccagagatcagca

SEQ ID NO: 8105025 - DNA, 22 bp, Homo sapiens
aacaattatcatatacattgca

SEQ ID NO: 8105026 - DNA, 22 bp, Homo sapiens
aaatatcatttataacttttaa

SEQ ID NO: 8105027 - DNA, 22 bp, Homo sapiens
aaatatcatttataacttttaa

SEQ ID NO: 8105028 - DNA, 22 bp, Homo sapiens
aaatatcattctggtgcacaga

SEQ ID NO: 8105029 - DNA, 22 bp, Homo sapiens
aaatatcttaggagtatatgag

SEQ ID NO: 8105030 - DNA, 22 bp, Homo sapiens
aagcaaattctggaggtgaggt

SEQ ID NO: 8105031 - DNA, 22 bp, Homo sapiens
aagcacttgcttagatgtggtt

SEQ ID NO: 8105032 - DNA, 22 bp, Homo sapiens
aagcagcaagtttatttctatc

SEQ ID NO: 8105033 - DNA, 22 bp, Homo sapiens
aagcagcaacaaactggataaa

SEQ ID NO: 8105034 - DNA, 22 bp, Homo sapiens
aagccacaatctgcatcagcat

SEQ ID NO: 8105035 - DNA, 22 bp, Homo sapiens
aagcagcagcaggattaaagag

SEQ ID NO: 8105036 - DNA, 22 bp, Homo sapiens
aagaatgcatcaaaagtcagag

SEQ ID NO: 8105037 - DNA, 22 bp, Homo sapiens
aagaaagggctattgttctcca

SEQ ID NO: 8105038 - DNA, 22 bp, Homo sapiens
aagaaaggtctctgcccgctat

SEQ ID NO: 8105039 - DNA, 22 bp, Homo sapiens
aagaaaggtgtgtttgcagatg

SEQ ID NO: 8105040 - DNA, 22 bp, Homo sapiens
aagaaagctgaatattctgtgt

SEQ ID NO: 8105041 - DNA, 22 bp, Homo sapiens
aagaaaggatatatgggaggta

SEQ ID NO: 8105042 - DNA, 22 bp, Homo sapiens
aagaaagggagaaggatggtgt

SEQ ID NO: 8105043 - DNA, 22 bp, Homo sapiens
aacataaatttgaagtggcaaa

SEQ ID NO: 8105044 - DNA, 22 bp, Homo sapiens
aacattctttggaggattattc

SEQ ID NO: 8105045 - DNA, 22 bp, Homo sapiens
aactatacatatttacatagac

SEQ ID NO: 8105046 - DNA, 22 bp, Homo sapiens
aaccattagtcaatcagcaaga

SEQ ID NO: 8105047 - DNA, 22 bp, Homo sapiens
aactccatggttctcagattct

SEQ ID NO: 8105048 - DNA, 22 bp, Homo sapiens
aactccagtgtcagctgcaatg

SEQ ID NO: 8105049 - DNA, 22 bp, Homo sapiens
aactccaggtcctttgaatctg

SEQ ID NO: 8105050 - DNA, 22 bp, Homo sapiens
aactccaggcagggaggccact

SEQ ID NO: 8105051 - DNA, 22 bp, Homo sapiens
aactccagggcattgtctcctg

SEQ ID NO: 8105052 - DNA, 22 bp, Homo sapiens
aactccagcaggaaggtgagaa

SEQ ID NO: 8105053 - DNA, 22 bp, Homo sapiens
aatcaccatctctcttgtcccc

SEQ ID NO: 8105054 - DNA, 23 bp, Homo sapiens
aatcaccagcagccaatgtgcag

SEQ ID NO: 8105055 - DNA, 22 bp, Homo sapiens
aatcacattacagcatatctgt

SEQ ID NO: 8105056 - DNA, 22 bp, Homo sapiens
aatcagaaaattcagtggaatt

SEQ ID NO: 8105057 - DNA, 22 bp, Homo sapiens
aataaaatggtcagttttctca

SEQ ID NO: 8105058 - DNA, 22 bp, Homo sapiens
aataaacaaaggacaaggaggt

SEQ ID NO: 8105059 - DNA, 22 bp, Homo sapiens
aagtttctgatattgttaaagc

SEQ ID NO: 8105060 - DNA, 22 bp, Homo sapiens
aagtttctgttcgctttaataa

SEQ ID NO: 8105061 - DNA, 22 bp, Homo sapiens
aagtttctgttcatatctctga

SEQ ID NO: 8105062 - DNA, 22 bp, Homo sapiens
aagtttctgtatgctcttctgt

SEQ ID NO: 8105063 - DNA, 20 bp, Homo sapiens
aagtttctggtttatatctt

SEQ ID NO: 8105064 - DNA, 22 bp, Homo sapiens
aataaactgctcaattgcatca

SEQ ID NO: 8105065 - DNA, 22 bp, Homo sapiens
aagtcaaaccttgctcacagga

SEQ ID NO: 8105066 - DNA, 22 bp, Homo sapiens
aagttctattgtcactttatta

SEQ ID NO: 8105067 - DNA, 23 bp, Homo sapiens
aaggggatacttccactttcttt

SEQ ID NO: 8105068 - DNA, 22 bp, Homo sapiens
aaggggatagagcagacactcc

SEQ ID NO: 8105069 - DNA, 21 bp, Homo sapiens
aaggggcaaacccaggacacc

SEQ ID NO: 8105070 - DNA, 22 bp, Homo sapiens
aaggggcatgcttttgccagga

SEQ ID NO: 8105071 - DNA, 22 bp, Homo sapiens
aaggggagatgtcatgggccct

SEQ ID NO: 8105072 - DNA, 22 bp, Homo sapiens
aagggagaggagggtcttgttg

SEQ ID NO: 8105073 - DNA, 22 bp, Homo sapiens
aacaatgaccacacaatgtact

SEQ ID NO: 8105074 - DNA, 20 bp, Homo sapiens
aacaatctagaagctattct

SEQ ID NO: 8105075 - DNA, 22 bp, Homo sapiens
aacaatcaagtttctaaatgac

SEQ ID NO: 8105076 - DNA, 22 bp, Homo sapiens
aagtatgctattacagtgtcat

SEQ ID NO: 8105077 - DNA, 22 bp, Homo sapiens
aagtatgctaattaactagcac

SEQ ID NO: 8105078 - DNA, 22 bp, Homo sapiens
aacaagttactcttaaagtata

SEQ ID NO: 8105079 - DNA, 22 bp, Homo sapiens
aacaagttagattttgtgtctt

SEQ ID NO: 8105080 - DNA, 22 bp, Homo sapiens
aacaagtcattccatttgacag

SEQ ID NO: 8105081 - DNA, 22 bp, Homo sapiens
aacaagtgatatataatggaag

SEQ ID NO: 8105082 - DNA, 22 bp, Homo sapiens
aacaagtgtattaatggaaata

SEQ ID NO: 8105083 - DNA, 22 bp, Homo sapiens
aacaaatgtgtggcagtgtggg

SEQ ID NO: 8105084 - DNA, 22 bp, Homo sapiens
aagcccagatgagatccctgga

SEQ ID NO: 8105085 - DNA, 18 bp, Homo sapiens
aagctgggaaggagacag

SEQ ID NO: 8105086 - DNA, 22 bp, Homo sapiens
aagctggcctgtacctgctgag

SEQ ID NO: 8105087 - DNA, 20 bp, Homo sapiens
aagctgggtaggagaggagc

SEQ ID NO: 8105088 - DNA, 22 bp, Homo sapiens
aagctgtcaatgtatctagtct

SEQ ID NO: 8105089 - DNA, 22 bp, Homo sapiens
aaattgcctgagtatgtcacat

SEQ ID NO: 8105090 - DNA, 22 bp, Homo sapiens
aaggagaaggcatcattcaagt

SEQ ID NO: 8105091 - DNA, 22 bp, Homo sapiens
aaattattacaagctagttggc

SEQ ID NO: 8105092 - DNA, 22 bp, Homo sapiens
aaattattagttaagttgggca

SEQ ID NO: 8105093 - DNA, 22 bp, Homo sapiens
aaattattataggcagagctga

SEQ ID NO: 8105094 - DNA, 22 bp, Homo sapiens
aaattatcatgggggagaaaca

SEQ ID NO: 8105095 - DNA, 22 bp, Homo sapiens
aaattattaaacagtgggatgc

SEQ ID NO: 8105096 - DNA, 22 bp, Homo sapiens
aaattattatgcccctctataa

SEQ ID NO: 8105097 - DNA, 22 bp, Homo sapiens
aagacaagccttgtttttctgc

SEQ ID NO: 8105098 - DNA, 22 bp, Homo sapiens
aagacaaaggggtccttggatg

SEQ ID NO: 8105099 - DNA, 22 bp, Homo sapiens
aagacaacagagatgacagact

SEQ ID NO: 8105100 - DNA, 22 bp, Homo sapiens
aagaatttaaactaaccatatg

SEQ ID NO: 8105101 - DNA, 22 bp, Homo sapiens
aagaattttccagcatgtcagt

SEQ ID NO: 8105102 - DNA, 22 bp, Homo sapiens
aagaattgatgtgaattgcagc

SEQ ID NO: 8105103 - DNA, 22 bp, Homo sapiens
aagaattgcctttcaattgttt

SEQ ID NO: 8105104 - DNA, 22 bp, Homo sapiens
aagaattggtcacatgctacaa

SEQ ID NO: 8105105 - DNA, 22 bp, Homo sapiens
aagaatgaaggatttagctgtt

SEQ ID NO: 8105106 - DNA, 22 bp, Homo sapiens
aattcacaaaaccagattgctt

SEQ ID NO: 8105107 - DNA, 22 bp, Homo sapiens
aattcaacagtcagttatctca

SEQ ID NO: 8105108 - DNA, 23 bp, Homo sapiens
aattcaaattcagtgtgactagg

SEQ ID NO: 8105109 - DNA, 22 bp, Homo sapiens
aattcaaatttgagtttgtgat

SEQ ID NO: 8105110 - DNA, 22 bp, Homo sapiens
aattcaaattacaatagttgtt

SEQ ID NO: 8105111 - DNA, 22 bp, Homo sapiens
aattcaaagactagaattttgc

SEQ ID NO: 8105112 - DNA, 22 bp, Homo sapiens
aattagaagctgttagcaaaat

SEQ ID NO: 8105113 - DNA, 22 bp, Homo sapiens
aattagagaagcttcttccatt

SEQ ID NO: 8105114 - DNA, 22 bp, Homo sapiens
acaagaaaggtaggattcaggt

SEQ ID NO: 8105115 - DNA, 22 bp, Homo sapiens
acaactgttggaggaacacagg

SEQ ID NO: 8105116 - DNA, 22 bp, Homo sapiens
acaactgtcagtaaagaatatt

SEQ ID NO: 8105117 - DNA, 22 bp, Homo sapiens
acaactccttcttgggtcctgg

SEQ ID NO: 8105118 - DNA, 22 bp, Homo sapiens
aagacaatgtttctgatagata

SEQ ID NO: 8105119 - DNA, 22 bp, Homo sapiens
aagacaatgcattactaagaag

SEQ ID NO: 8105120 - DNA, 22 bp, Homo sapiens
aatgttacagttttaattctga

SEQ ID NO: 8105121 - DNA, 22 bp, Homo sapiens
aatgttacgatcaacaacacat

SEQ ID NO: 8105122 - DNA, 22 bp, Homo sapiens
aatgtgttttcactgaagattc

SEQ ID NO: 8105123 - DNA, 22 bp, Homo sapiens
aatgtcttttgatacaagttac

SEQ ID NO: 8105124 - DNA, 21 bp, Homo sapiens
aactttagaaagactgggaag

SEQ ID NO: 8105125 - DNA, 22 bp, Homo sapiens
aatgttattacacttgtgaaat

SEQ ID NO: 8105126 - DNA, 22 bp, Homo sapiens
aactttattgttaggggctaaa

SEQ ID NO: 8105127 - DNA, 20 bp, Homo sapiens
aactttagacataatctctt

SEQ ID NO: 8105128 - DNA, 22 bp, Homo sapiens
aactttctataggttgggattt

SEQ ID NO: 8105129 - DNA, 22 bp, Homo sapiens
aattacttaagagaaactttga

SEQ ID NO: 8105130 - DNA, 22 bp, Homo sapiens
aatgttttttggtctgatgaat

SEQ ID NO: 8105131 - DNA, 22 bp, Homo sapiens
aatgttttgtatgcctctgagc

SEQ ID NO: 8105132 - DNA, 20 bp, Homo sapiens
aatgtattgttttgtttcag

SEQ ID NO: 8105133 - DNA, 22 bp, Homo sapiens
aatgtcttgagaagagaaatct

SEQ ID NO: 8105134 - DNA, 22 bp, Homo sapiens
aactctatttaccctactaaac

SEQ ID NO: 8105135 - DNA, 22 bp, Homo sapiens
aagagtcactccataaatccca

SEQ ID NO: 8105136 - DNA, 22 bp, Homo sapiens
aagagtcagcttctgtatgggt

SEQ ID NO: 8105137 - DNA, 21 bp, Homo sapiens
aagagtggctgaggaggtgat

SEQ ID NO: 8105138 - DNA, 22 bp, Homo sapiens
acacctttcaggtccagacagt

SEQ ID NO: 8105139 - DNA, 22 bp, Homo sapiens
acacctttgccccaagtcatag

SEQ ID NO: 8105140 - DNA, 22 bp, Homo sapiens
acacatttctctttttgtaagt

SEQ ID NO: 8105141 - DNA, 22 bp, Homo sapiens
acactaatcttttatttggttt

SEQ ID NO: 8105142 - DNA, 22 bp, Homo sapiens
acactaaatgagtctacagtac

SEQ ID NO: 8105143 - DNA, 20 bp, Homo sapiens
acacacagagacatgcgcat

SEQ ID NO: 8105144 - DNA, 22 bp, Homo sapiens
acacacagcgcctaccatgtgc

SEQ ID NO: 8105145 - DNA, 22 bp, Homo sapiens
acacacagcgcctaccatgtgc

SEQ ID NO: 8105146 - DNA, 21 bp, Homo sapiens
aagaggtcaaattataaatgg

SEQ ID NO: 8105147 - DNA, 22 bp, Homo sapiens
aagaggtgggttggacagatac

SEQ ID NO: 8105148 - DNA, 22 bp, Homo sapiens
aagaggaggattgatgtgggag

SEQ ID NO: 8105149 - DNA, 22 bp, Homo sapiens
aagaggcataaaatttatatgg

SEQ ID NO: 8105150 - DNA, 22 bp, Homo sapiens
acagagcttaattcaggagctt

SEQ ID NO: 8105151 - DNA, 22 bp, Homo sapiens
aagcaaaaggttacacttctgg

SEQ ID NO: 8105152 - DNA, 18 bp, Homo sapiens
acagaggcagacatgtat

SEQ ID NO: 8105153 - DNA, 22 bp, Homo sapiens
aagcacagttcttagagttaca

SEQ ID NO: 8105154 - DNA, 22 bp, Homo sapiens
acagaggaaggctgagctgccc

SEQ ID NO: 8105155 - DNA, 22 bp, Homo sapiens
acagaggacaactaggcgctca

SEQ ID NO: 8105156 - DNA, 22 bp, Homo sapiens
acagatccttcttctgcattgc

SEQ ID NO: 8105157 - DNA, 22 bp, Homo sapiens
acagatgaaaaagcttgtggat

SEQ ID NO: 8105158 - DNA, 22 bp, Homo sapiens
acagagtcattcactgatgaag

SEQ ID NO: 8105159 - DNA, 22 bp, Homo sapiens
acagatcacttgactaaaatga

SEQ ID NO: 8105160 - DNA, 22 bp, Homo sapiens
acagagtcatggtagtcaaagg

SEQ ID NO: 8105161 - DNA, 22 bp, Homo sapiens
acagatgacttgtctgctgtaa

SEQ ID NO: 8105162 - DNA, 22 bp, Homo sapiens
acagatgaatttatggatggaa

SEQ ID NO: 8105163 - DNA, 22 bp, Homo sapiens
acagatgaatctgtgattgctg

SEQ ID NO: 8105164 - DNA, 22 bp, Homo sapiens
aagcacattatagctatctagg

SEQ ID NO: 8105165 - DNA, 22 bp, Homo sapiens
acagagtcataagcggagctcg

SEQ ID NO: 8105166 - DNA, 20 bp, Homo sapiens
aagcacatttctacaataat

SEQ ID NO: 8105167 - DNA, 22 bp, Homo sapiens
aagcaaaacgtgctctaggagg

SEQ ID NO: 8105168 - DNA, 20 bp, Homo sapiens
aagatactccagaaattaaa

SEQ ID NO: 8105169 - DNA, 22 bp, Homo sapiens
aagatacattttcttcagagaa

SEQ ID NO: 8105170 - DNA, 22 bp, Homo sapiens
aagatacatgttaggagcaacc

SEQ ID NO: 8105171 - DNA, 22 bp, Homo sapiens
aagatatagataaaactatgca

SEQ ID NO: 8105172 - DNA, 22 bp, Homo sapiens
aagatataataactgttgtcat

SEQ ID NO: 8105173 - DNA, 22 bp, Homo sapiens
tcacagcctggtcactctgccc

SEQ ID NO: 8105174 - DNA, 22 bp, Homo sapiens
tcacagctattctcatgtattt

SEQ ID NO: 8105175 - DNA, 23 bp, Homo sapiens
tcacatatgtagaagtggaattc

SEQ ID NO: 8105176 - DNA, 22 bp, Homo sapiens
tcacatatttaagaaagttaaa

SEQ ID NO: 8105177 - DNA, 22 bp, Homo sapiens
tcacatcaggtgtctccccaag

SEQ ID NO: 8105178 - DNA, 22 bp, Homo sapiens
tcacatcattaagacttctcct

SEQ ID NO: 8105179 - DNA, 18 bp, Homo sapiens
tcacatcatcccatgctt

SEQ ID NO: 8105180 - DNA, 22 bp, Homo sapiens
tcacatcatggagaattatggg

SEQ ID NO: 8105181 - DNA, 22 bp, Homo sapiens
tcacatctaattccatttctgc

SEQ ID NO: 8105182 - DNA, 19 bp, Homo sapiens
tcacagcatctgtctgaac

SEQ ID NO: 8105183 - DNA, 22 bp, Homo sapiens
tcacagcattgtcacaaggctg

SEQ ID NO: 8105184 - DNA, 22 bp, Homo sapiens
tcacagcagaatttaggaggca

SEQ ID NO: 8105185 - DNA, 22 bp, Homo sapiens
tcacagcaacactggggcagac

SEQ ID NO: 8105186 - DNA, 22 bp, Homo sapiens
tcacagcaacactggggcagac

SEQ ID NO: 8105187 - DNA, 22 bp, Homo sapiens
tcacagaatctctgataagtct

SEQ ID NO: 8105188 - DNA, 18 bp, Homo sapiens
tcacagaatattgagtgg

SEQ ID NO: 8105189 - DNA, 22 bp, Homo sapiens
tcacagaatgtctagcataatt

SEQ ID NO: 8105190 - DNA, 22 bp, Homo sapiens
tcacacagtggtaaaaccctga

SEQ ID NO: 8105191 - DNA, 22 bp, Homo sapiens
tcacacatgagtaaatacaggg

SEQ ID NO: 8105192 - DNA, 22 bp, Homo sapiens
tcacagcaaaagtgtgcagagc

SEQ ID NO: 8105193 - DNA, 22 bp, Homo sapiens
tcacagagaggttaagcagttg

SEQ ID NO: 8105194 - DNA, 22 bp, Homo sapiens
tcacagacaccttggccacagt

SEQ ID NO: 8105195 - DNA, 23 bp, Homo sapiens
tcacacagctggtcaggtacaga

SEQ ID NO: 8105196 - DNA, 22 bp, Homo sapiens
tcacacagctgctctgttttat

SEQ ID NO: 8105197 - DNA, 22 bp, Homo sapiens
tcacaatttggatacagctatg

SEQ ID NO: 8105198 - DNA, 22 bp, Homo sapiens
tcacaattgtttttaggatcaa

SEQ ID NO: 8105199 - DNA, 22 bp, Homo sapiens
tcaattctggtcctcaggaact

SEQ ID NO: 8105200 - DNA, 22 bp, Homo sapiens
tcaatgtctctttctaaaatgt

SEQ ID NO: 8105201 - DNA, 22 bp, Homo sapiens
tcaattatgccattgcaatatt

SEQ ID NO: 8105202 - DNA, 22 bp, Homo sapiens
tcaattaagaggctaagttact

SEQ ID NO: 8105203 - DNA, 22 bp, Homo sapiens
tcaattacagcacagtactcca

SEQ ID NO: 8105204 - DNA, 22 bp, Homo sapiens
tcaattctggtcctcaggaact

SEQ ID NO: 8105205 - DNA, 22 bp, Homo sapiens
tcaattctgcctctaaatattt

SEQ ID NO: 8105206 - DNA, 22 bp, Homo sapiens
tcaattctgcatacatttcact

SEQ ID NO: 8105207 - DNA, 22 bp, Homo sapiens
tcaattctagagccttacattg

SEQ ID NO: 8105208 - DNA, 22 bp, Homo sapiens
tcaattctagtggagagagttt

SEQ ID NO: 8105209 - DNA, 22 bp, Homo sapiens
tcaattcagactgagaaatgat

SEQ ID NO: 8105210 - DNA, 22 bp, Homo sapiens
tcaaacatctaaactacccact

SEQ ID NO: 8105211 - DNA, 23 bp, Homo sapiens
tcaaacatattgtgagacacagg

SEQ ID NO: 8105212 - DNA, 22 bp, Homo sapiens
tcaaacatatctgattttccat

SEQ ID NO: 8105213 - DNA, 22 bp, Homo sapiens
tcaaacatgaaagcttgatttt

SEQ ID NO: 8105214 - DNA, 22 bp, Homo sapiens
tcaaacataggcacacattcag

SEQ ID NO: 8105215 - DNA, 22 bp, Homo sapiens
tcaaacatatctgattttccat

SEQ ID NO: 8105216 - DNA, 22 bp, Homo sapiens
tcaaaagtttcacatagagata

SEQ ID NO: 8105217 - DNA, 22 bp, Homo sapiens
tcaaaagtctgcattcttcaca

SEQ ID NO: 8105218 - DNA, 22 bp, Homo sapiens
tcaaaaatgttttatattggta

SEQ ID NO: 8105219 - DNA, 22 bp, Homo sapiens
tcaaaaatggtctttgagctgc

SEQ ID NO: 8105220 - DNA, 22 bp, Homo sapiens
tcaaaatcaaagatacttgaaa

SEQ ID NO: 8105221 - DNA, 22 bp, Homo sapiens
tcaaaattagtgaccaaaggca

SEQ ID NO: 8105222 - DNA, 22 bp, Homo sapiens
tcaaaattaaaccaacgtccag

SEQ ID NO: 8105223 - DNA, 22 bp, Homo sapiens
tcaaaattaaaccaacgtccag

SEQ ID NO: 8105224 - DNA, 22 bp, Homo sapiens
tcaaaattttatttctcaagga

SEQ ID NO: 8105225 - DNA, 22 bp, Homo sapiens
tcaaaatttcagcactagccct

SEQ ID NO: 8105226 - DNA, 22 bp, Homo sapiens
tcaaaattttatttctcaagga

SEQ ID NO: 8105227 - DNA, 20 bp, Homo sapiens
tcacctaaaccagcagtttc

SEQ ID NO: 8105228 - DNA, 22 bp, Homo sapiens
tcacctaattgaagtcaggagt

SEQ ID NO: 8105229 - DNA, 22 bp, Homo sapiens
tcaccttaacaatctgaccatc

SEQ ID NO: 8105230 - DNA, 22 bp, Homo sapiens
tcaccttagctagaggaagaga

SEQ ID NO: 8105231 - DNA, 22 bp, Homo sapiens
tcaccttaacaatctgaccatc

SEQ ID NO: 8105232 - DNA, 22 bp, Homo sapiens
tcactgggccctgaggtgggac

SEQ ID NO: 8105233 - DNA, 22 bp, Homo sapiens
tcactacaacctccgcctcctg

SEQ ID NO: 8105234 - DNA, 23 bp, Homo sapiens
tcactaaagtgtttagtgcagat

SEQ ID NO: 8105235 - DNA, 18 bp, Homo sapiens
tcactgggtgtatgtggc

SEQ ID NO: 8105236 - DNA, 22 bp, Homo sapiens
tcagagaatgtgaatattaaac

SEQ ID NO: 8105237 - DNA, 22 bp, Homo sapiens
tcagaacttaaagccgattggg

SEQ ID NO: 8105238 - DNA, 22 bp, Homo sapiens
tcagaagaaggtatatttatac

SEQ ID NO: 8105239 - DNA, 22 bp, Homo sapiens
tcagaagaagagactccacagc

SEQ ID NO: 8105240 - DNA, 19 bp, Homo sapiens
tcagaactcagaatgtgta

SEQ ID NO: 8105241 - DNA, 22 bp, Homo sapiens
tcagaggctcactgtctacttt

SEQ ID NO: 8105242 - DNA, 22 bp, Homo sapiens
tcagaggacagcagctaaataa

SEQ ID NO: 8105243 - DNA, 22 bp, Homo sapiens
tcagaggacgcactagggttgt

SEQ ID NO: 8105244 - DNA, 22 bp, Homo sapiens
tcagaggagaagttgggaaaat

SEQ ID NO: 8105245 - DNA, 22 bp, Homo sapiens
tcagaggactaccttctccagt

SEQ ID NO: 8105246 - DNA, 22 bp, Homo sapiens
tcagaggagaccaaggggaata

SEQ ID NO: 8105247 - DNA, 19 bp, Homo sapiens
tcagaggatttggctatga

SEQ ID NO: 8105248 - DNA, 22 bp, Homo sapiens
tcagaggattggacttttatgt

SEQ ID NO: 8105249 - DNA, 18 bp, Homo sapiens
tcagaggagatacctaaa

SEQ ID NO: 8105250 - DNA, 22 bp, Homo sapiens
tcagaggaccttactgagaacc

SEQ ID NO: 8105251 - DNA, 22 bp, Homo sapiens
tcagaggacagcagctaaataa

SEQ ID NO: 8105252 - DNA, 22 bp, Homo sapiens
tcagaggacaagctccctggtg

SEQ ID NO: 8105253 - DNA, 22 bp, Homo sapiens
tcagaggaatctgtacttgaaa

SEQ ID NO: 8105254 - DNA, 22 bp, Homo sapiens
tcagaggaatttgcttttcatg

SEQ ID NO: 8105255 - DNA, 22 bp, Homo sapiens
tcagaggaagccttggtgggag

SEQ ID NO: 8105256 - DNA, 22 bp, Homo sapiens
tcagaggaataatgctgcattt

SEQ ID NO: 8105257 - DNA, 20 bp, Homo sapiens
tcagagagagggtgccactt

SEQ ID NO: 8105258 - DNA, 18 bp, Homo sapiens
tcagagagaatagtaatt

SEQ ID NO: 8105259 - DNA, 23 bp, Homo sapiens
tcatcaaacagctgctcaagaaa

SEQ ID NO: 8105260 - DNA, 22 bp, Homo sapiens
tcatcaaaggattgcatgattt

SEQ ID NO: 8105261 - DNA, 23 bp, Homo sapiens
tcatcaaaggaagtacgtgtcac

SEQ ID NO: 8105262 - DNA, 21 bp, Homo sapiens
tcataaactagtatcaaagtt

SEQ ID NO: 8105263 - DNA, 22 bp, Homo sapiens
tcataaacacactagtatgatt

SEQ ID NO: 8105264 - DNA, 22 bp, Homo sapiens
tcataaaatgctcctgatattg

SEQ ID NO: 8105265 - DNA, 22 bp, Homo sapiens
tcatctcagggcgacatcatgt

SEQ ID NO: 8105266 - DNA, 22 bp, Homo sapiens
tcatctcaaaattatgctgcac

SEQ ID NO: 8105267 - DNA, 22 bp, Homo sapiens
tcatctcagagaggtatgttag

SEQ ID NO: 8105268 - DNA, 22 bp, Homo sapiens
tcatctaagagtcttacattta

SEQ ID NO: 8105269 - DNA, 22 bp, Homo sapiens
tcatctaagagtcttacattta

SEQ ID NO: 8105270 - DNA, 19 bp, Homo sapiens
tcagtggatgaacatgttt

SEQ ID NO: 8105271 - DNA, 22 bp, Homo sapiens
tcagttcaaacaggtgtctgga

SEQ ID NO: 8105272 - DNA, 19 bp, Homo sapiens
tcagtggagaaaggggaag

SEQ ID NO: 8105273 - DNA, 22 bp, Homo sapiens
tcagtttgaatgttagcacagt

SEQ ID NO: 8105274 - DNA, 22 bp, Homo sapiens
tcagttttgattcctggttctc

SEQ ID NO: 8105275 - DNA, 22 bp, Homo sapiens
tcataaaaatagactctaaagt

SEQ ID NO: 8105276 - DNA, 22 bp, Homo sapiens
tcataaaaatagactctaaagt

SEQ ID NO: 8105277 - DNA, 22 bp, Homo sapiens
tcagtgcatcacagaactttgt

SEQ ID NO: 8105278 - DNA, 22 bp, Homo sapiens
tcaggtcaggaaaataagattg

SEQ ID NO: 8105279 - DNA, 22 bp, Homo sapiens
tcaggctgaaaggactccagtt

SEQ ID NO: 8105280 - DNA, 22 bp, Homo sapiens
tcaggctgaatcatcctagctt

SEQ ID NO: 8105281 - DNA, 22 bp, Homo sapiens
tcaggaggtctgctgcggggtg

SEQ ID NO: 8105282 - DNA, 19 bp, Homo sapiens
tcaggaggtcgacctggca

SEQ ID NO: 8105283 - DNA, 22 bp, Homo sapiens
tcaggaggtccgcccgggaggg

SEQ ID NO: 8105284 - DNA, 22 bp, Homo sapiens
tcaggcaggaagggaggacttg

SEQ ID NO: 8105285 - DNA, 22 bp, Homo sapiens
tcaggagggagtgtggatagag

SEQ ID NO: 8105286 - DNA, 21 bp, Homo sapiens
tcagagtctcaggagcaaggg

SEQ ID NO: 8105287 - DNA, 22 bp, Homo sapiens
tcagagtctatgcaacagaatt

SEQ ID NO: 8105288 - DNA, 22 bp, Homo sapiens
tcagagtcctcaccctgaggat

SEQ ID NO: 8105289 - DNA, 22 bp, Homo sapiens
tcagagtcattgcaagtagaag

SEQ ID NO: 8105290 - DNA, 22 bp, Homo sapiens
tcagagtcctttggcctgacag

SEQ ID NO: 8105291 - DNA, 22 bp, Homo sapiens
tcagagtctaaatagaagaata

SEQ ID NO: 8105292 - DNA, 22 bp, Homo sapiens
tcagagtgaggcccagcaatct

SEQ ID NO: 8105293 - DNA, 22 bp, Homo sapiens
tcagagtgaggcgtcaacatga

SEQ ID NO: 8105294 - DNA, 22 bp, Homo sapiens
tcagagtcttaactattcagag

SEQ ID NO: 8105295 - DNA, 22 bp, Homo sapiens
tcagagtcttggcaataggtta

SEQ ID NO: 8105296 - DNA, 22 bp, Homo sapiens
tcagagtccatggtacttaatt

SEQ ID NO: 8105297 - DNA, 22 bp, Homo sapiens
tcagagtctcccccagtttggg

SEQ ID NO: 8105298 - DNA, 22 bp, Homo sapiens
tcagagtctgtgcattctgcta

SEQ ID NO: 8105299 - DNA, 20 bp, Homo sapiens
tcagagtcatcaaagatggt

SEQ ID NO: 8105300 - DNA, 22 bp, Homo sapiens
tcagagtcaggaatgcttgatt

SEQ ID NO: 8105301 - DNA, 22 bp, Homo sapiens
tcagagtcaactgttgcctgtt

SEQ ID NO: 8105302 - DNA, 22 bp, Homo sapiens
tcagagtcattgcaagtagaag

SEQ ID NO: 8105303 - DNA, 22 bp, Homo sapiens
tcagaggcttccttcctcggag

SEQ ID NO: 8105304 - DNA, 21 bp, Homo sapiens
tcagagggccctggaggctca

SEQ ID NO: 8105305 - DNA, 22 bp, Homo sapiens
tcagagggtggctgggagcatc

SEQ ID NO: 8105306 - DNA, 22 bp, Homo sapiens
tcagccatggtgagagtgagag

SEQ ID NO: 8105307 - DNA, 22 bp, Homo sapiens
tcagcttgtttatgataagcag

SEQ ID NO: 8105308 - DNA, 22 bp, Homo sapiens
tcagcttatatttttagtgtaa

SEQ ID NO: 8105309 - DNA, 22 bp, Homo sapiens
tcagcctgcgtcatggtgacac

SEQ ID NO: 8105310 - DNA, 22 bp, Homo sapiens
tccctgccagtcctggtctgaa

SEQ ID NO: 8105311 - DNA, 22 bp, Homo sapiens
tccctgccaatgattggagcaa

SEQ ID NO: 8105312 - DNA, 22 bp, Homo sapiens
tccctgccctcagtgcacccgg

SEQ ID NO: 8105313 - DNA, 19 bp, Homo sapiens
tccctgagttccagcccag

SEQ ID NO: 8105314 - DNA, 22 bp, Homo sapiens
tccctgggcctcctgctatgca

SEQ ID NO: 8105315 - DNA, 22 bp, Homo sapiens
tccctgtggaagactgccagag

SEQ ID NO: 8105316 - DNA, 22 bp, Homo sapiens
tccctgtgaatcagaagcaggt

SEQ ID NO: 8105317 - DNA, 22 bp, Homo sapiens
tcccttaaccgtaggacagtct

SEQ ID NO: 8105318 - DNA, 22 bp, Homo sapiens
tcccttaagcacctgagtagtc

SEQ ID NO: 8105319 - DNA, 23 bp, Homo sapiens
tcctccctgacttctacagcaca

SEQ ID NO: 8105320 - DNA, 22 bp, Homo sapiens
tcctccctgcactcagtgaagt

SEQ ID NO: 8105321 - DNA, 23 bp, Homo sapiens
tcctcctgacacagcctgagtga

SEQ ID NO: 8105322 - DNA, 23 bp, Homo sapiens
tcctcctgacacagcctgagtga

SEQ ID NO: 8105323 - DNA, 22 bp, Homo sapiens
tcctcctgctgttagtcttgaa

SEQ ID NO: 8105324 - DNA, 22 bp, Homo sapiens
tcctcctgcctttgcttcttgt

SEQ ID NO: 8105325 - DNA, 22 bp, Homo sapiens
tcctccagctgtatcctgcctg

SEQ ID NO: 8105326 - DNA, 23 bp, Homo sapiens
tcctccaatctcatggcccttaa

SEQ ID NO: 8105327 - DNA, 22 bp, Homo sapiens
tcctcatctgtaccttggggta

SEQ ID NO: 8105328 - DNA, 22 bp, Homo sapiens
tcctcatctttcaggatttagc

SEQ ID NO: 8105329 - DNA, 22 bp, Homo sapiens
tcctcagtcgtttgagccaaaa

SEQ ID NO: 8105330 - DNA, 22 bp, Homo sapiens
tcctcagtattgtggagcagat

SEQ ID NO: 8105331 - DNA, 23 bp, Homo sapiens
tcctcagtatataaaggcagatg

SEQ ID NO: 8105332 - DNA, 22 bp, Homo sapiens
tcctcatcaataaaatcaggat

SEQ ID NO: 8105333 - DNA, 22 bp, Homo sapiens
tcctcatcaccattgcaatgta

SEQ ID NO: 8105334 - DNA, 22 bp, Homo sapiens
tcctcatctcggaacctgccac

SEQ ID NO: 8105335 - DNA, 22 bp, Homo sapiens
tcctcagttataaataggaaac

SEQ ID NO: 8105336 - DNA, 22 bp, Homo sapiens
tcctcagtgctagccaactgcc

SEQ ID NO: 8105337 - DNA, 22 bp, Homo sapiens
tccaccatgtaacaagctctgt

SEQ ID NO: 8105338 - DNA, 19 bp, Homo sapiens
tccacctttcttcatttgg

SEQ ID NO: 8105339 - DNA, 22 bp, Homo sapiens
tccactttagcaatgattgaat

SEQ ID NO: 8105340 - DNA, 22 bp, Homo sapiens
tccacagataaaaacagaggtt

SEQ ID NO: 8105341 - DNA, 22 bp, Homo sapiens
tccacagaccagtatctgcagc

SEQ ID NO: 8105342 - DNA, 22 bp, Homo sapiens
tcatgttttaatgcctttttct

SEQ ID NO: 8105343 - DNA, 22 bp, Homo sapiens
tcatgttttagtaaagtgaagg

SEQ ID NO: 8105344 - DNA, 20 bp, Homo sapiens
tccagccctgcttctctctt

SEQ ID NO: 8105345 - DNA, 22 bp, Homo sapiens
tccagccctgcactgattagat

SEQ ID NO: 8105346 - DNA, 22 bp, Homo sapiens
tccagccctctggcccgcggtg

SEQ ID NO: 8105347 - DNA, 22 bp, Homo sapiens
tccagccctcctgggatcacag

SEQ ID NO: 8105348 - DNA, 17 bp, Homo sapiens
tccagccctgcccgacg

SEQ ID NO: 8105349 - DNA, 17 bp, Homo sapiens
tccagccctgcccgacg

SEQ ID NO: 8105350 - DNA, 22 bp, Homo sapiens
tccagccctgcccattctctcg

SEQ ID NO: 8105351 - DNA, 22 bp, Homo sapiens
tccagccctgcttcctgcctca

SEQ ID NO: 8105352 - DNA, 22 bp, Homo sapiens
tccagcccgactgggcctgccg

SEQ ID NO: 8105353 - DNA, 22 bp, Homo sapiens
tccagcccgactgggcctgccg

SEQ ID NO: 8105354 - DNA, 20 bp, Homo sapiens
tccagcccctgcatgttgct

SEQ ID NO: 8105355 - DNA, 22 bp, Homo sapiens
tccagccccttttactcattca

SEQ ID NO: 8105356 - DNA, 22 bp, Homo sapiens
tccagcccgggggcaggtgacc

SEQ ID NO: 8105357 - DNA, 22 bp, Homo sapiens
tccagcccgagggcgctgatga

SEQ ID NO: 8105358 - DNA, 22 bp, Homo sapiens
tccagccctcagccaagtggaa

SEQ ID NO: 8105359 - DNA, 20 bp, Homo sapiens
tccagccctcatgtcgctca

SEQ ID NO: 8105360 - DNA, 22 bp, Homo sapiens
tccagcccatccctagcctggg

SEQ ID NO: 8105361 - DNA, 22 bp, Homo sapiens
tccagcccagtttggtgaattg

SEQ ID NO: 8105362 - DNA, 22 bp, Homo sapiens
tccagccccgaggccggcgacg

SEQ ID NO: 8105363 - DNA, 22 bp, Homo sapiens
tccagcccctcctgagccaagc

SEQ ID NO: 8105364 - DNA, 19 bp, Homo sapiens
tccagcccctctgtgtgtg

SEQ ID NO: 8105365 - DNA, 22 bp, Homo sapiens
tccagccccgggatgttcttca

SEQ ID NO: 8105366 - DNA, 22 bp, Homo sapiens
tccagccccggcttccttacag

SEQ ID NO: 8105367 - DNA, 20 bp, Homo sapiens
tccagcccaggtcctgcctg

SEQ ID NO: 8105368 - DNA, 21 bp, Homo sapiens
tcccagctgggtcagtgctgc

SEQ ID NO: 8105369 - DNA, 22 bp, Homo sapiens
tcccagattcctgctcttatat

SEQ ID NO: 8105370 - DNA, 22 bp, Homo sapiens
tcccagcagtcagagctatgtg

SEQ ID NO: 8105371 - DNA, 21 bp, Homo sapiens
tccagttgagactgaagatct

SEQ ID NO: 8105372 - DNA, 22 bp, Homo sapiens
tccagtgtgagaagcagcatga

SEQ ID NO: 8105373 - DNA, 22 bp, Homo sapiens
tccagtgtacaaaagctatctt

SEQ ID NO: 8105374 - DNA, 22 bp, Homo sapiens
tcccactggacgtctgtgctgg

SEQ ID NO: 8105375 - DNA, 21 bp, Homo sapiens
tccaggcctcaggaagggatg

SEQ ID NO: 8105376 - DNA, 22 bp, Homo sapiens
tccaggcctaggccaagtgatt

SEQ ID NO: 8105377 - DNA, 22 bp, Homo sapiens
tccaggccctgggatgggagca

SEQ ID NO: 8105378 - DNA, 22 bp, Homo sapiens
tccaggccgcaggggcagcccc

SEQ ID NO: 8105379 - DNA, 22 bp, Homo sapiens
tccaggcccagacggggtgagg

SEQ ID NO: 8105380 - DNA, 22 bp, Homo sapiens
tccaggcccactcagctgaaat

SEQ ID NO: 8105381 - DNA, 22 bp, Homo sapiens
tccaggcccactcggtggggct

SEQ ID NO: 8105382 - DNA, 20 bp, Homo sapiens
tccaggcccactcagctgaa

SEQ ID NO: 8105383 - DNA, 21 bp, Homo sapiens
tccaggccatggtggggaggc

SEQ ID NO: 8105384 - DNA, 19 bp, Homo sapiens
tccaggccattcccagagc

SEQ ID NO: 8105385 - DNA, 22 bp, Homo sapiens
tccaggccagggtaagaggaga

SEQ ID NO: 8105386 - DNA, 22 bp, Homo sapiens
tccagtccagggaatggctgat

SEQ ID NO: 8105387 - DNA, 22 bp, Homo sapiens
tccagtctaatgagtcagagtg

SEQ ID NO: 8105388 - DNA, 22 bp, Homo sapiens
tccagtctctactctgagataa

SEQ ID NO: 8105389 - DNA, 22 bp, Homo sapiens
tacatacacaaatgctgaatgg

SEQ ID NO: 8105390 - DNA, 22 bp, Homo sapiens
tacatacagccaagtatgaagt

SEQ ID NO: 8105391 - DNA, 22 bp, Homo sapiens
tacatacacaaatatactgttt

SEQ ID NO: 8105392 - DNA, 22 bp, Homo sapiens
tacatacagtggatgctttagg

SEQ ID NO: 8105393 - DNA, 22 bp, Homo sapiens
tacatacatattcatacaggtg

SEQ ID NO: 8105394 - DNA, 22 bp, Homo sapiens
tacatacatattcatacaggtg

SEQ ID NO: 8105395 - DNA, 22 bp, Homo sapiens
tacattatttcatcagtcatct

SEQ ID NO: 8105396 - DNA, 20 bp, Homo sapiens
tacattcaaaacaaactctg

SEQ ID NO: 8105397 - DNA, 22 bp, Homo sapiens
tacagttactgcatttctaata

SEQ ID NO: 8105398 - DNA, 22 bp, Homo sapiens
tacaggaagttacagactatga

SEQ ID NO: 8105399 - DNA, 22 bp, Homo sapiens
tacagtttttcactgaagatgt

SEQ ID NO: 8105400 - DNA, 22 bp, Homo sapiens
tacatacaagatgtgtttaaaa

SEQ ID NO: 8105401 - DNA, 22 bp, Homo sapiens
tacataattaatctttaagttc

SEQ ID NO: 8105402 - DNA, 18 bp, Homo sapiens
tacaggaaaagtgttaca

SEQ ID NO: 8105403 - DNA, 22 bp, Homo sapiens
tacaggaagcactcaagaaatg

SEQ ID NO: 8105404 - DNA, 22 bp, Homo sapiens
tactgcttgttagctgtatttg

SEQ ID NO: 8105405 - DNA, 22 bp, Homo sapiens
tactgtaaaagacaggcttcct

SEQ ID NO: 8105406 - DNA, 22 bp, Homo sapiens
tacttgataggtctaatatgca

SEQ ID NO: 8105407 - DNA, 22 bp, Homo sapiens
tacctgggcccaccagtgcctg

SEQ ID NO: 8105408 - DNA, 22 bp, Homo sapiens
tacctgggaagtgggacctgag

SEQ ID NO: 8105409 - DNA, 22 bp, Homo sapiens
tacctgtggcttgttggatgga

SEQ ID NO: 8105410 - DNA, 22 bp, Homo sapiens
taccttgaaaagaaggtgctca

SEQ ID NO: 8105411 - DNA, 22 bp, Homo sapiens
taccttgaaccccaagctttgc

SEQ ID NO: 8105412 - DNA, 22 bp, Homo sapiens
taccttgagccgttgctgatga

SEQ ID NO: 8105413 - DNA, 23 bp, Homo sapiens
tacattcatttgcacagccagta

SEQ ID NO: 8105414 - DNA, 22 bp, Homo sapiens
tacccacagcctctcttcaaaa

SEQ ID NO: 8105415 - DNA, 22 bp, Homo sapiens
taagttcattagactacagata

SEQ ID NO: 8105416 - DNA, 22 bp, Homo sapiens
taagttcagttggtcgaagtag

SEQ ID NO: 8105417 - DNA, 22 bp, Homo sapiens
taagttatcggagtgtgtttca

SEQ ID NO: 8105418 - DNA, 22 bp, Homo sapiens
taagttcaccagttgtaataag

SEQ ID NO: 8105419 - DNA, 22 bp, Homo sapiens
taagttcaatgaactcagttct

SEQ ID NO: 8105420 - DNA, 22 bp, Homo sapiens
taagcagtttttcttgtattaa

SEQ ID NO: 8105421 - DNA, 22 bp, Homo sapiens
taagcactttatatgctttatc

SEQ ID NO: 8105422 - DNA, 22 bp, Homo sapiens
taagcagtttttcttgtattaa

SEQ ID NO: 8105423 - DNA, 22 bp, Homo sapiens
taagcaggggtcaagtgtacaa

SEQ ID NO: 8105424 - DNA, 20 bp, Homo sapiens
taagttgtatttgtcatgaa

SEQ ID NO: 8105425 - DNA, 22 bp, Homo sapiens
taagttctctgaaatgaaaaag

SEQ ID NO: 8105426 - DNA, 23 bp, Homo sapiens
taagttctatgagaagagaaatc

SEQ ID NO: 8105427 - DNA, 22 bp, Homo sapiens
taagttctcaatacattgtagc

SEQ ID NO: 8105428 - DNA, 22 bp, Homo sapiens
taagttctgaagataggaaatg

SEQ ID NO: 8105429 - DNA, 22 bp, Homo sapiens
taagtttaccactttcagaatt

SEQ ID NO: 8105430 - DNA, 22 bp, Homo sapiens
taataaagatgtgggctttgaa

SEQ ID NO: 8105431 - DNA, 22 bp, Homo sapiens
taataaatgaaagtgctggcat

SEQ ID NO: 8105432 - DNA, 22 bp, Homo sapiens
taataaatgaaagtgctggcat

SEQ ID NO: 8105433 - DNA, 22 bp, Homo sapiens
taatttcaatagcttgcataat

SEQ ID NO: 8105434 - DNA, 22 bp, Homo sapiens
taatttctaattcattttcagt

SEQ ID NO: 8105435 - DNA, 22 bp, Homo sapiens
taatttcactgatatgaagtca

SEQ ID NO: 8105436 - DNA, 22 bp, Homo sapiens
taatttcaccgttgctagaaat

SEQ ID NO: 8105437 - DNA, 22 bp, Homo sapiens
taatgctttgttttgatctaac

SEQ ID NO: 8105438 - DNA, 22 bp, Homo sapiens
taatgcttcaatttccttgatt

SEQ ID NO: 8105439 - DNA, 22 bp, Homo sapiens
taatgccttatgtcaaatgtaa

SEQ ID NO: 8105440 - DNA, 22 bp, Homo sapiens
taatgcctagattattctgttt

SEQ ID NO: 8105441 - DNA, 22 bp, Homo sapiens
taatgaacatgcatcgtgtgta

SEQ ID NO: 8105442 - DNA, 22 bp, Homo sapiens
taatgcagtaggtattaaagaa

SEQ ID NO: 8105443 - DNA, 22 bp, Homo sapiens
taatgcagtactgatataaaca

SEQ ID NO: 8105444 - DNA, 19 bp, Homo sapiens
tacaagcttaaagtaatgt

SEQ ID NO: 8105445 - DNA, 22 bp, Homo sapiens
taatttttccacgtacactggg

SEQ ID NO: 8105446 - DNA, 22 bp, Homo sapiens
taattttccactctgtttatct

SEQ ID NO: 8105447 - DNA, 22 bp, Homo sapiens
taatttctggagggagaaagag

SEQ ID NO: 8105448 - DNA, 22 bp, Homo sapiens
taatttcttcatctctgcagct

SEQ ID NO: 8105449 - DNA, 22 bp, Homo sapiens
tacacaaaggcactctgttgtt

SEQ ID NO: 8105450 - DNA, 22 bp, Homo sapiens
tacacatatgtccattaatcag

SEQ ID NO: 8105451 - DNA, 22 bp, Homo sapiens
tacacatatgtgtgtatatgtg

SEQ ID NO: 8105452 - DNA, 20 bp, Homo sapiens
tacactaagtatgaagtgct

SEQ ID NO: 8105453 - DNA, 22 bp, Homo sapiens
tacactaagaacaaagatctgt

SEQ ID NO: 8105454 - DNA, 22 bp, Homo sapiens
tacactaatgtttttgcaaagc

SEQ ID NO: 8105455 - DNA, 22 bp, Homo sapiens
gtttataatccaactctgctcc

SEQ ID NO: 8105456 - DNA, 22 bp, Homo sapiens
gtttctaattggaactttgagg

SEQ ID NO: 8105457 - DNA, 22 bp, Homo sapiens
gtttcgtcaggcttattctatc

SEQ ID NO: 8105458 - DNA, 22 bp, Homo sapiens
gtttcttaatagcaggggccaa

SEQ ID NO: 8105459 - DNA, 22 bp, Homo sapiens
gtttcttaccacttggacctct

SEQ ID NO: 8105460 - DNA, 22 bp, Homo sapiens
gtttcttaagttacaaaatctt

SEQ ID NO: 8105461 - DNA, 22 bp, Homo sapiens
gtttcttaaatgtagcaggacc

SEQ ID NO: 8105462 - DNA, 22 bp, Homo sapiens
gtttcttaaaagaggagttaga

SEQ ID NO: 8105463 - DNA, 22 bp, Homo sapiens
gtttctcttaacacataaagta

SEQ ID NO: 8105464 - DNA, 22 bp, Homo sapiens
gtttctctgtacctctgtccca

SEQ ID NO: 8105465 - DNA, 22 bp, Homo sapiens
gtttctctgtctgttacattgg

SEQ ID NO: 8105466 - DNA, 22 bp, Homo sapiens
gtttctctttgaagcctggctg

SEQ ID NO: 8105467 - DNA, 22 bp, Homo sapiens
gtttataaattctgcttttgtt

SEQ ID NO: 8105468 - DNA, 22 bp, Homo sapiens
gtttacaaatattttaaatggt

SEQ ID NO: 8105469 - DNA, 22 bp, Homo sapiens
gtttacaaatattttaaatggt

SEQ ID NO: 8105470 - DNA, 22 bp, Homo sapiens
gtttacattgctgtttgtgtct

SEQ ID NO: 8105471 - DNA, 22 bp, Homo sapiens
gtttacttagatgctcatgcag

SEQ ID NO: 8105472 - DNA, 22 bp, Homo sapiens
gtttacttgtgccttggcttaa

SEQ ID NO: 8105473 - DNA, 22 bp, Homo sapiens
gttcctttgtttagcagagaca

SEQ ID NO: 8105474 - DNA, 22 bp, Homo sapiens
gttataaatacctaataggatt

SEQ ID NO: 8105475 - DNA, 23 bp, Homo sapiens
gttcattttattgtctgattgct

SEQ ID NO: 8105476 - DNA, 22 bp, Homo sapiens
gttcatttttactttgatctac

SEQ ID NO: 8105477 - DNA, 22 bp, Homo sapiens
gttcatttttagaatgctagta

SEQ ID NO: 8105478 - DNA, 22 bp, Homo sapiens
gttcatttttactttgatctac

SEQ ID NO: 8105479 - DNA, 22 bp, Homo sapiens
gttcatttttccctaatgagta

SEQ ID NO: 8105480 - DNA, 22 bp, Homo sapiens
gttactcctggttgagcttggt

SEQ ID NO: 8105481 - DNA, 22 bp, Homo sapiens
gttacaaaggtcataaaagtgt

SEQ ID NO: 8105482 - DNA, 21 bp, Homo sapiens
taaacataaccttgtatggct

SEQ ID NO: 8105483 - DNA, 22 bp, Homo sapiens
gttttcaattataagatggctt

SEQ ID NO: 8105484 - DNA, 22 bp, Homo sapiens
gttttcaaggggatttaactga

SEQ ID NO: 8105485 - DNA, 22 bp, Homo sapiens
gttttcaaggggatttaactga

SEQ ID NO: 8105486 - DNA, 22 bp, Homo sapiens
gttttcagccaggagcacattt

SEQ ID NO: 8105487 - DNA, 22 bp, Homo sapiens
gttttataattgcttcataaga

SEQ ID NO: 8105488 - DNA, 22 bp, Homo sapiens
gttttataattgcttcataaga

SEQ ID NO: 8105489 - DNA, 22 bp, Homo sapiens
gttttataggtgaaatattact

SEQ ID NO: 8105490 - DNA, 20 bp, Homo sapiens
gttttatgccagttctgtgt

SEQ ID NO: 8105491 - DNA, 23 bp, Homo sapiens
gttttcaacacaataaatgtaac

SEQ ID NO: 8105492 - DNA, 23 bp, Homo sapiens
gttttcaacacaataaatgtaac

SEQ ID NO: 8105493 - DNA, 22 bp, Homo sapiens
gttttatttccatgagagaccg

SEQ ID NO: 8105494 - DNA, 22 bp, Homo sapiens
gttttattggaacacagccatg

SEQ ID NO: 8105495 - DNA, 17 bp, Homo sapiens
taaatacacaagggtat

SEQ ID NO: 8105496 - DNA, 22 bp, Homo sapiens
taaataagttcttcattgtttg

SEQ ID NO: 8105497 - DNA, 21 bp, Homo sapiens
taaataataagttgctgagat

SEQ ID NO: 8105498 - DNA, 22 bp, Homo sapiens
taaagttctggtgagaggtaag

SEQ ID NO: 8105499 - DNA, 22 bp, Homo sapiens
taaagttcttagaacaaggcct

SEQ ID NO: 8105500 - DNA, 21 bp, Homo sapiens
taaagaagatgaatgtgatca

SEQ ID NO: 8105501 - DNA, 22 bp, Homo sapiens
taaactgtagctctcgtaattc

SEQ ID NO: 8105502 - DNA, 22 bp, Homo sapiens
taaagacaaatgacattacggc

SEQ ID NO: 8105503 - DNA, 22 bp, Homo sapiens
taaagaatagatgggtagggag

SEQ ID NO: 8105504 - DNA, 22 bp, Homo sapiens
taaagaataatacccatggagc

SEQ ID NO: 8105505 - DNA, 22 bp, Homo sapiens
taaagtgttgtacaaatgtatg

SEQ ID NO: 8105506 - DNA, 22 bp, Homo sapiens
taagataatccattataatgtt

SEQ ID NO: 8105507 - DNA, 22 bp, Homo sapiens
taagataataagtatgtctatg

SEQ ID NO: 8105508 - DNA, 22 bp, Homo sapiens
taacaatagtgtttgctagtca

SEQ ID NO: 8105509 - DNA, 22 bp, Homo sapiens
taaatacagtcatttgagccat

SEQ ID NO: 8105510 - DNA, 22 bp, Homo sapiens
taaatacttagttttgtgtcta

SEQ ID NO: 8105511 - DNA, 22 bp, Homo sapiens
taacaatagtgtttgctagtca

SEQ ID NO: 8105512 - DNA, 22 bp, Homo sapiens
taacacagagtaagtggtcaat

SEQ ID NO: 8105513 - DNA, 22 bp, Homo sapiens
taacacatagatattttaactt

SEQ ID NO: 8105514 - DNA, 22 bp, Homo sapiens
taacacataagctgagaccatg

SEQ ID NO: 8105515 - DNA, 22 bp, Homo sapiens
taacacatatttgcagtaagca

SEQ ID NO: 8105516 - DNA, 22 bp, Homo sapiens
taacacatggttagtacacaat

SEQ ID NO: 8105517 - DNA, 22 bp, Homo sapiens
taacacatatttcaagagtagt

SEQ ID NO: 8105518 - DNA, 22 bp, Homo sapiens
taacacattttcctcatacgga

SEQ ID NO: 8105519 - DNA, 22 bp, Homo sapiens
taggctaaaacagtttgtttca

SEQ ID NO: 8105520 - DNA, 22 bp, Homo sapiens
taggaaatatttgaacatagga

SEQ ID NO: 8105521 - DNA, 22 bp, Homo sapiens
taggaagatgagtatcaacttg

SEQ ID NO: 8105522 - DNA, 22 bp, Homo sapiens
taggaagcctgctgtgcacagc

SEQ ID NO: 8105523 - DNA, 22 bp, Homo sapiens
taggaaatgaggccaacatgtg

SEQ ID NO: 8105524 - DNA, 22 bp, Homo sapiens
taggaaccttgatcttggattt

SEQ ID NO: 8105525 - DNA, 22 bp, Homo sapiens
taggaacctactgtggttttaa

SEQ ID NO: 8105526 - DNA, 22 bp, Homo sapiens
taggaacccgcagcagtccgag

SEQ ID NO: 8105527 - DNA, 22 bp, Homo sapiens
tagtcagacccaagagagccat

SEQ ID NO: 8105528 - DNA, 22 bp, Homo sapiens
tagtcagatatatgacttacgt

SEQ ID NO: 8105529 - DNA, 22 bp, Homo sapiens
tagtcagtagcaaggtattttg

SEQ ID NO: 8105530 - DNA, 22 bp, Homo sapiens
tagtcatttttccactaagtta

SEQ ID NO: 8105531 - DNA, 22 bp, Homo sapiens
tagtcagtgatcagtggagttg

SEQ ID NO: 8105532 - DNA, 22 bp, Homo sapiens
tagtcattctccttacaaagcc

SEQ ID NO: 8105533 - DNA, 22 bp, Homo sapiens
tagtcagtatgaaattgctcaa

SEQ ID NO: 8105534 - DNA, 22 bp, Homo sapiens
tagtcagtcttacatatttgaa

SEQ ID NO: 8105535 - DNA, 22 bp, Homo sapiens
tagtattcagcttctcaggcaa

SEQ ID NO: 8105536 - DNA, 21 bp, Homo sapiens
tagtgtagctgcagcagcaga

SEQ ID NO: 8105537 - DNA, 22 bp, Homo sapiens
taggctggaggaagcagtgcct

SEQ ID NO: 8105538 - DNA, 22 bp, Homo sapiens
taggttcaggagatattgcaca

SEQ ID NO: 8105539 - DNA, 21 bp, Homo sapiens
tagagccagtggtgttctgac

SEQ ID NO: 8105540 - DNA, 23 bp, Homo sapiens
tagagcagtagatcaccatggga

SEQ ID NO: 8105541 - DNA, 22 bp, Homo sapiens
tagagcagtgggtaccatggca

SEQ ID NO: 8105542 - DNA, 22 bp, Homo sapiens
tagagcagatagtgaaacagaa

SEQ ID NO: 8105543 - DNA, 22 bp, Homo sapiens
tagagcagccttcagagcagtt

SEQ ID NO: 8105544 - DNA, 23 bp, Homo sapiens
tagagcagccccgaggtgctgtc

SEQ ID NO: 8105545 - DNA, 23 bp, Homo sapiens
tagagcagggaaatctgtcagag

SEQ ID NO: 8105546 - DNA, 22 bp, Homo sapiens
tagagatgtgatatagcagagt

SEQ ID NO: 8105547 - DNA, 22 bp, Homo sapiens
tagaggagagttgctggatgga

SEQ ID NO: 8105548 - DNA, 22 bp, Homo sapiens
tagaggagcggcgagctgagct

SEQ ID NO: 8105549 - DNA, 23 bp, Homo sapiens
tagaggaggatgtgatgcatatt

SEQ ID NO: 8105550 - DNA, 22 bp, Homo sapiens
tagatgcttgtcagtttctgtc

SEQ ID NO: 8105551 - DNA, 22 bp, Homo sapiens
tacttgtgtgtcatgtgcagag

SEQ ID NO: 8105552 - DNA, 22 bp, Homo sapiens
tactttctgtccttctgttaaa

SEQ ID NO: 8105553 - DNA, 22 bp, Homo sapiens
tactttctaagacatacaactt

SEQ ID NO: 8105554 - DNA, 22 bp, Homo sapiens
tactttcatgggttttctttat

SEQ ID NO: 8105555 - DNA, 17 bp, Homo sapiens
tagaagttagaacactt

SEQ ID NO: 8105556 - DNA, 22 bp, Homo sapiens
tagaaggaggactggcagtgtt

SEQ ID NO: 8105557 - DNA, 22 bp, Homo sapiens
tagaagtttaaattcaccatgc

SEQ ID NO: 8105558 - DNA, 22 bp, Homo sapiens
tagaatctgaatattcttattt

SEQ ID NO: 8105559 - DNA, 22 bp, Homo sapiens
tagcacatacataatagataga

SEQ ID NO: 8105560 - DNA, 22 bp, Homo sapiens
tagcacatctggcgcttatagg

SEQ ID NO: 8105561 - DNA, 21 bp, Homo sapiens
tagcatttttgtattgctgaa

SEQ ID NO: 8105562 - DNA, 22 bp, Homo sapiens
tagcattttagctgttttctct

SEQ ID NO: 8105563 - DNA, 22 bp, Homo sapiens
tagcaaaaactgcagttacttt

SEQ ID NO: 8105564 - DNA, 22 bp, Homo sapiens
tatagcaagcaggacagtctca

SEQ ID NO: 8105565 - DNA, 22 bp, Homo sapiens
tataccttccacaaaacagctt

SEQ ID NO: 8105566 - DNA, 22 bp, Homo sapiens
tatacatgttttacataagtga

SEQ ID NO: 8105567 - DNA, 22 bp, Homo sapiens
tatacagatatctaagatgtaa

SEQ ID NO: 8105568 - DNA, 21 bp, Homo sapiens
tatacagaggggaacaggaga

SEQ ID NO: 8105569 - DNA, 22 bp, Homo sapiens
tatacagaactgcacgtgcacg

SEQ ID NO: 8105570 - DNA, 22 bp, Homo sapiens
tatacagaaccgcctgaagtct

SEQ ID NO: 8105571 - DNA, 22 bp, Homo sapiens
tagttaattctttaagaacaag

SEQ ID NO: 8105572 - DNA, 22 bp, Homo sapiens
tatatttaatcctagagccatt

SEQ ID NO: 8105573 - DNA, 22 bp, Homo sapiens
tatcaaagttgtcctgtgaagt

SEQ ID NO: 8105574 - DNA, 22 bp, Homo sapiens
tatcaaattgaggcagctgggg

SEQ ID NO: 8105575 - DNA, 19 bp, Homo sapiens
tatatttgttgaataaaaa

SEQ ID NO: 8105576 - DNA, 22 bp, Homo sapiens
tatcacacataactaagctgca

SEQ ID NO: 8105577 - DNA, 22 bp, Homo sapiens
tatcacactgttttaattactt

SEQ ID NO: 8105578 - DNA, 22 bp, Homo sapiens
tatcacactcggaaatctagga

SEQ ID NO: 8105579 - DNA, 22 bp, Homo sapiens
tatcaatacatgttatcagtgt

SEQ ID NO: 8105580 - DNA, 22 bp, Homo sapiens
tatcaattgggccaaatggtac

SEQ ID NO: 8105581 - DNA, 22 bp, Homo sapiens
tatcttaaaaatcgaagcagat

SEQ ID NO: 8105582 - DNA, 22 bp, Homo sapiens
tatcttaaatgcatgatagaca

SEQ ID NO: 8105583 - DNA, 22 bp, Homo sapiens
tatctttattatgtctatctgc

SEQ ID NO: 8105584 - DNA, 22 bp, Homo sapiens
tatctttattatgtctatctgc

SEQ ID NO: 8105585 - DNA, 22 bp, Homo sapiens
tatctttagaggaagagaatct

SEQ ID NO: 8105586 - DNA, 22 bp, Homo sapiens
tatcttgtgggagagcagtgga

SEQ ID NO: 8105587 - DNA, 22 bp, Homo sapiens
tatcttgtttaggtgcacaggt

SEQ ID NO: 8105588 - DNA, 22 bp, Homo sapiens
tatcttgtgcagatgaaagaat

SEQ ID NO: 8105589 - DNA, 22 bp, Homo sapiens
tatgcagtgtacgatgtttagt

SEQ ID NO: 8105590 - DNA, 22 bp, Homo sapiens
tatgcattatacattaatttct

SEQ ID NO: 8105591 - DNA, 22 bp, Homo sapiens
tatgccactgctctccatccta

SEQ ID NO: 8105592 - DNA, 22 bp, Homo sapiens
tatgcactgaaaattaacagtt

SEQ ID NO: 8105593 - DNA, 15 bp, Homo sapiens
tatgcactgaagtat

SEQ ID NO: 8105594 - DNA, 22 bp, Homo sapiens
tatgcactggattacaaagcaa

SEQ ID NO: 8105595 - DNA, 22 bp, Homo sapiens
tatgcactggtactattcgtgt

SEQ ID NO: 8105596 - DNA, 22 bp, Homo sapiens
tatgcactccacacggcctcca

SEQ ID NO: 8105597 - DNA, 20 bp, Homo sapiens
tatgataattacaaaatagt

SEQ ID NO: 8105598 - DNA, 22 bp, Homo sapiens
tatttctaagagatatctgtac

SEQ ID NO: 8105599 - DNA, 22 bp, Homo sapiens
tatttccatgttagaactaagt

SEQ ID NO: 8105600 - DNA, 22 bp, Homo sapiens
tatttccaggccccactctaga

SEQ ID NO: 8105601 - DNA, 22 bp, Homo sapiens
tatttccaggccccactctaga

SEQ ID NO: 8105602 - DNA, 22 bp, Homo sapiens
tatttccagcagtaagaagaca

SEQ ID NO: 8105603 - DNA, 22 bp, Homo sapiens
tatttcagggggtacaagaaga

SEQ ID NO: 8105604 - DNA, 22 bp, Homo sapiens
tatttcagggggtacaagaaga

SEQ ID NO: 8105605 - DNA, 22 bp, Homo sapiens
tattttcattctgtgtgactgt

SEQ ID NO: 8105606 - DNA, 22 bp, Homo sapiens
tatttgttgcgggaattgctat

SEQ ID NO: 8105607 - DNA, 22 bp, Homo sapiens
tatttcagcaagaagaatgtgg

SEQ ID NO: 8105608 - DNA, 19 bp, Homo sapiens
tatttcaggctcagagtct

SEQ ID NO: 8105609 - DNA, 19 bp, Homo sapiens
tatttcaggctcagagtct

SEQ ID NO: 8105610 - DNA, 20 bp, Homo sapiens
tatttcactctccagatggc

SEQ ID NO: 8105611 - DNA, 21 bp, Homo sapiens
tatttcagaagagtctcagag

SEQ ID NO: 8105612 - DNA, 22 bp, Homo sapiens
tatttcacctcacccaggagaa

SEQ ID NO: 8105613 - DNA, 22 bp, Homo sapiens
tattgcagaagaaatgaatgaa

SEQ ID NO: 8105614 - DNA, 22 bp, Homo sapiens
tatgttaagtgggataatcaaa

SEQ ID NO: 8105615 - DNA, 22 bp, Homo sapiens
tatgttcatctggtgcatcagt

SEQ ID NO: 8105616 - DNA, 22 bp, Homo sapiens
tatgttgtggggtgcatcaaaa

SEQ ID NO: 8105617 - DNA, 22 bp, Homo sapiens
tatgttgtagctagtaataaat

SEQ ID NO: 8105618 - DNA, 22 bp, Homo sapiens
tatgtgtgtttcagtggaaatg

SEQ ID NO: 8105619 - DNA, 22 bp, Homo sapiens
tatgtgtttgacaccctgcaag

SEQ ID NO: 8105620 - DNA, 21 bp, Homo sapiens
tattcagtccattgatgttta

SEQ ID NO: 8105621 - DNA, 22 bp, Homo sapiens
tattcatagtaaacaaaagtgg

SEQ ID NO: 8105622 - DNA, 22 bp, Homo sapiens
tattcagtgcgggaactcagcc

SEQ ID NO: 8105623 - DNA, 22 bp, Homo sapiens
tattcacattctcaggcctggt

SEQ ID NO: 8105624 - DNA, 22 bp, Homo sapiens
tattcactgtaactcagcaata

SEQ ID NO: 8105625 - DNA, 22 bp, Homo sapiens
tattcatattgtaaaagaagtg

SEQ ID NO: 8105626 - DNA, 20 bp, Homo sapiens
tattcaactttaaaaactta

SEQ ID NO: 8105627 - DNA, 22 bp, Homo sapiens
tattcacagctgccgcactcag

SEQ ID NO: 8105628 - DNA, 22 bp, Homo sapiens
tattcacaaaatgaggtcctca

SEQ ID NO: 8105629 - DNA, 22 bp, Homo sapiens
tattcacaggttctggggatca

SEQ ID NO: 8105630 - DNA, 22 bp, Homo sapiens
tattcacatgaaaacaaatttt

SEQ ID NO: 8105631 - DNA, 22 bp, Homo sapiens
ggagaggagctattgggggctc

SEQ ID NO: 8105632 - DNA, 22 bp, Homo sapiens
ggagaggcttccagagtcgtgc

SEQ ID NO: 8105633 - DNA, 19 bp, Homo sapiens
ggagaggctggagggatgc

SEQ ID NO: 8105634 - DNA, 22 bp, Homo sapiens
ggagaggcgatgagtcacagcc

SEQ ID NO: 8105635 - DNA, 22 bp, Homo sapiens
ggactgaggacatgtgaggcat

SEQ ID NO: 8105636 - DNA, 21 bp, Homo sapiens
ggactctacacaggccatctt

SEQ ID NO: 8105637 - DNA, 22 bp, Homo sapiens
ggacagagccctggtggcctaa

SEQ ID NO: 8105638 - DNA, 22 bp, Homo sapiens
ggacagagccctggtggcctaa

SEQ ID NO: 8105639 - DNA, 22 bp, Homo sapiens
ggacagagcagacgagcagcgg

SEQ ID NO: 8105640 - DNA, 21 bp, Homo sapiens
ggacagaggagaaggcaccct

SEQ ID NO: 8105641 - DNA, 20 bp, Homo sapiens
ggaccctgggttcttctgag

SEQ ID NO: 8105642 - DNA, 17 bp, Homo sapiens
ggaaaggtagagtaatc

SEQ ID NO: 8105643 - DNA, 22 bp, Homo sapiens
ggaaaggagatattggagagtg

SEQ ID NO: 8105644 - DNA, 22 bp, Homo sapiens
ggaaaggagatgaataggatta

SEQ ID NO: 8105645 - DNA, 18 bp, Homo sapiens
gcttcctgaaagctgccc

SEQ ID NO: 8105646 - DNA, 22 bp, Homo sapiens
ggaagccataccctgatttctg

SEQ ID NO: 8105647 - DNA, 22 bp, Homo sapiens
ggaagccatgagggacagttct

SEQ ID NO: 8105648 - DNA, 22 bp, Homo sapiens
ggaagcccagctgtctcctgtc

SEQ ID NO: 8105649 - DNA, 22 bp, Homo sapiens
ggaagccagttgcttggtgtgg

SEQ ID NO: 8105650 - DNA, 22 bp, Homo sapiens
ggaagccaggctgggggatctg

SEQ ID NO: 8105651 - DNA, 22 bp, Homo sapiens
ggaagccaggttactgttcaga

SEQ ID NO: 8105652 - DNA, 22 bp, Homo sapiens
ggaagccccagacccagagtct

SEQ ID NO: 8105653 - DNA, 22 bp, Homo sapiens
ggaagccagagtgctgggcagg

SEQ ID NO: 8105654 - DNA, 22 bp, Homo sapiens
ggaagccagaaagtgagaatat

SEQ ID NO: 8105655 - DNA, 22 bp, Homo sapiens
ggaagccacccagctttgatag

SEQ ID NO: 8105656 - DNA, 22 bp, Homo sapiens
ggaagccaaggtggcctctatt

SEQ ID NO: 8105657 - DNA, 22 bp, Homo sapiens
ggaagccaggccaatgagaaca

SEQ ID NO: 8105658 - DNA, 22 bp, Homo sapiens
ggaagccaggcccagagatgct

SEQ ID NO: 8105659 - DNA, 20 bp, Homo sapiens
ggaagccagcatccttgagg

SEQ ID NO: 8105660 - DNA, 20 bp, Homo sapiens
ggaagccagggtgcagggga

SEQ ID NO: 8105661 - DNA, 19 bp, Homo sapiens
ggaagccaggtcagcccac

SEQ ID NO: 8105662 - DNA, 22 bp, Homo sapiens
gctgtgagaaacagggagtgtc

SEQ ID NO: 8105663 - DNA, 22 bp, Homo sapiens
gctgtgagccgctgctgagcat

SEQ ID NO: 8105664 - DNA, 22 bp, Homo sapiens
gctgtgagtggagttctgtgct

SEQ ID NO: 8105665 - DNA, 22 bp, Homo sapiens
gctgtgagggcttctgaggcat

SEQ ID NO: 8105666 - DNA, 22 bp, Homo sapiens
gctgtgagtggaggaggctgag

SEQ ID NO: 8105667 - DNA, 22 bp, Homo sapiens
gctgtgcccatattctgctgac

SEQ ID NO: 8105668 - DNA, 22 bp, Homo sapiens
gctgtgcccagctccagctctg

SEQ ID NO: 8105669 - DNA, 22 bp, Homo sapiens
gctgtgcatcttcattctggac

SEQ ID NO: 8105670 - DNA, 22 bp, Homo sapiens
gctgtgcagccaagtgcctctg

SEQ ID NO: 8105671 - DNA, 22 bp, Homo sapiens
gcttccaatgcttctatcacat

SEQ ID NO: 8105672 - DNA, 22 bp, Homo sapiens
gcttccacctactaaatgccac

SEQ ID NO: 8105673 - DNA, 22 bp, Homo sapiens
gcttccaaatctgttcaaaatg

SEQ ID NO: 8105674 - DNA, 21 bp, Homo sapiens
gcttccaagatggcaccttga

SEQ ID NO: 8105675 - DNA, 22 bp, Homo sapiens
gcttcattttgccctctggtgg

SEQ ID NO: 8105676 - DNA, 16 bp, Homo sapiens
gctgggagggagaggt

SEQ ID NO: 8105677 - DNA, 18 bp, Homo sapiens
gctggggttgagctctcc

SEQ ID NO: 8105678 - DNA, 21 bp, Homo sapiens
gctgggtcagcaggtcctctg

SEQ ID NO: 8105679 - DNA, 22 bp, Homo sapiens
gctggtagacctcactgcactc

SEQ ID NO: 8105680 - DNA, 22 bp, Homo sapiens
gctgtctgttcgagcgtgtgtt

SEQ ID NO: 8105681 - DNA, 22 bp, Homo sapiens
gctgggagcaaagccatgcata

SEQ ID NO: 8105682 - DNA, 22 bp, Homo sapiens
gctgggaggatctctccctgtc

SEQ ID NO: 8105683 - DNA, 22 bp, Homo sapiens
gctgggagaggccctgaagtga

SEQ ID NO: 8105684 - DNA, 22 bp, Homo sapiens
gctgggagaggcagctttcgga

SEQ ID NO: 8105685 - DNA, 22 bp, Homo sapiens
gctgggagacagacttggaacc

SEQ ID NO: 8105686 - DNA, 22 bp, Homo sapiens
gctgggaagtggcagagctgga

SEQ ID NO: 8105687 - DNA, 22 bp, Homo sapiens
gctgggaatgattttggagagg

SEQ ID NO: 8105688 - DNA, 22 bp, Homo sapiens
gctgggaagagatgcacatgat

SEQ ID NO: 8105689 - DNA, 22 bp, Homo sapiens
gctggcagacttcctctggaac

SEQ ID NO: 8105690 - DNA, 22 bp, Homo sapiens
gctggcagactgggggcagaac

SEQ ID NO: 8105691 - DNA, 22 bp, Homo sapiens
gctggcagaatttcttcttgct

SEQ ID NO: 8105692 - DNA, 22 bp, Homo sapiens
gctggcagctggaagttgggct

SEQ ID NO: 8105693 - DNA, 22 bp, Homo sapiens
gctggcaggatagaagtctaat

SEQ ID NO: 8105694 - DNA, 22 bp, Homo sapiens
gctggcaggatagaagtctaat

SEQ ID NO: 8105695 - DNA, 22 bp, Homo sapiens
gctgatataaaattacagagga

SEQ ID NO: 8105696 - DNA, 22 bp, Homo sapiens
gctgattctgaggtgctttcct

SEQ ID NO: 8105697 - DNA, 22 bp, Homo sapiens
gctgcacaggagaccccattta

SEQ ID NO: 8105698 - DNA, 22 bp, Homo sapiens
gctgccaggggcagctgtctca

SEQ ID NO: 8105699 - DNA, 22 bp, Homo sapiens
gctgccagtgtggcatgatgca

SEQ ID NO: 8105700 - DNA, 22 bp, Homo sapiens
gctgccagctgcggcccacgcg

SEQ ID NO: 8105701 - DNA, 22 bp, Homo sapiens
gctgccagcccagcaaggtgtg

SEQ ID NO: 8105702 - DNA, 19 bp, Homo sapiens
gctgccaggacagttactg

SEQ ID NO: 8105703 - DNA, 22 bp, Homo sapiens
gctgccagcacacaggtgttag

SEQ ID NO: 8105704 - DNA, 22 bp, Homo sapiens
gctgcaggagctggagctgtgg

SEQ ID NO: 8105705 - DNA, 22 bp, Homo sapiens
gctcaggctggattgcagtggc

SEQ ID NO: 8105706 - DNA, 21 bp, Homo sapiens
gctcctggtgctgcgtggcgc

SEQ ID NO: 8105707 - DNA, 22 bp, Homo sapiens
gctcagggaactttttgcaggc

SEQ ID NO: 8105708 - DNA, 22 bp, Homo sapiens
gctcctgtcatcaaacaatcct

SEQ ID NO: 8105709 - DNA, 22 bp, Homo sapiens
gctctgcctctttgctgcgtca

SEQ ID NO: 8105710 - DNA, 17 bp, Homo sapiens
gctctgccccagcctct

SEQ ID NO: 8105711 - DNA, 22 bp, Homo sapiens
gctctgcccagtgccctgagac

SEQ ID NO: 8105712 - DNA, 22 bp, Homo sapiens
gcctggcttgccagccctggcg

SEQ ID NO: 8105713 - DNA, 22 bp, Homo sapiens
gcctggctggtcactgcctggc

SEQ ID NO: 8105714 - DNA, 21 bp, Homo sapiens
gcctggctagaagctcctagc

SEQ ID NO: 8105715 - DNA, 22 bp, Homo sapiens
gcctggctgccggccttggcaa

SEQ ID NO: 8105716 - DNA, 22 bp, Homo sapiens
gccttcaggaaatcagtccttg

SEQ ID NO: 8105717 - DNA, 22 bp, Homo sapiens
gcctggtgctatgagggccagc

SEQ ID NO: 8105718 - DNA, 22 bp, Homo sapiens
gccttcagagtaccatgtcctc

SEQ ID NO: 8105719 - DNA, 22 bp, Homo sapiens
gcggaggaaactgaggcaagag

SEQ ID NO: 8105720 - DNA, 23 bp, Homo sapiens
gcggaaggggtcataatggagac

SEQ ID NO: 8105721 - DNA, 22 bp, Homo sapiens
gccttgatctgctgtgtttgag

SEQ ID NO: 8105722 - DNA, 22 bp, Homo sapiens
gccttctctgtgagctcctagg

SEQ ID NO: 8105723 - DNA, 22 bp, Homo sapiens
gccttctgatatctcttggcat

SEQ ID NO: 8105724 - DNA, 22 bp, Homo sapiens
gctatcttcatggaaatacagg

SEQ ID NO: 8105725 - DNA, 22 bp, Homo sapiens
gctatctttctgcaccataatt

SEQ ID NO: 8105726 - DNA, 22 bp, Homo sapiens
gctcaagccttctgcccacctc

SEQ ID NO: 8105727 - DNA, 18 bp, Homo sapiens
gctcaggccctagtcagt

SEQ ID NO: 8105728 - DNA, 22 bp, Homo sapiens
gcacagccttgccctgtgccct

SEQ ID NO: 8105729 - DNA, 22 bp, Homo sapiens
gcacagccctggtcggggcccc

SEQ ID NO: 8105730 - DNA, 22 bp, Homo sapiens
gcacagcctgtccctgtcctgg

SEQ ID NO: 8105731 - DNA, 22 bp, Homo sapiens
gcacagccctgagcgcatgtct

SEQ ID NO: 8105732 - DNA, 22 bp, Homo sapiens
gcacagccagcatctgagggat

SEQ ID NO: 8105733 - DNA, 20 bp, Homo sapiens
gcacagctgagttcagggtc

SEQ ID NO: 8105734 - DNA, 22 bp, Homo sapiens
gcacagccacgtaatgtggtca

SEQ ID NO: 8105735 - DNA, 22 bp, Homo sapiens
gcaagcagacattcaggtaggt

SEQ ID NO: 8105736 - DNA, 22 bp, Homo sapiens
gaggggtggccctggcgtgtac

SEQ ID NO: 8105737 - DNA, 22 bp, Homo sapiens
gagggggaaagtccctggagtc

SEQ ID NO: 8105738 - DNA, 22 bp, Homo sapiens
gaggggtccaggaggcacttac

SEQ ID NO: 8105739 - DNA, 22 bp, Homo sapiens
gaggggtcttttgttgtcaggg

SEQ ID NO: 8105740 - DNA, 22 bp, Homo sapiens
gagggggagatgtgcacacact

SEQ ID NO: 8105741 - DNA, 22 bp, Homo sapiens
gcaagaaaagagccttcagtgg

SEQ ID NO: 8105742 - DNA, 22 bp, Homo sapiens
gcactgtgctaggtatcaggga

SEQ ID NO: 8105743 - DNA, 22 bp, Homo sapiens
gcactgtgctagaagccagggg

SEQ ID NO: 8105744 - DNA, 22 bp, Homo sapiens
gcactgttctcagagcattaga

SEQ ID NO: 8105745 - DNA, 22 bp, Homo sapiens
gcacttccactttgctttactg

SEQ ID NO: 8105746 - DNA, 22 bp, Homo sapiens
gcactgggaatgctgatgggct

SEQ ID NO: 8105747 - DNA, 22 bp, Homo sapiens
gcactgggaatgtgagcagctg

SEQ ID NO: 8105748 - DNA, 22 bp, Homo sapiens
gcagaggacacaggagggcaag

SEQ ID NO: 8105749 - DNA, 22 bp, Homo sapiens
gcagagctgagcggctgcccgg

SEQ ID NO: 8105750 - DNA, 22 bp, Homo sapiens
gcagagctgcagcgaggcctgg

SEQ ID NO: 8105751 - DNA, 22 bp, Homo sapiens
gcagagctctgttcttatctcc

SEQ ID NO: 8105752 - DNA, 22 bp, Homo sapiens
gcagaggagcaagctggacacc

SEQ ID NO: 8105753 - DNA, 23 bp, Homo sapiens
gcagaggagcaagctggacacca

SEQ ID NO: 8105754 - DNA, 22 bp, Homo sapiens
gcagaggactcaatcaaggtat

SEQ ID NO: 8105755 - DNA, 22 bp, Homo sapiens
gcactgggaatgagggcagctt

SEQ ID NO: 8105756 - DNA, 22 bp, Homo sapiens
gcactgggaagaatgagcctgt

SEQ ID NO: 8105757 - DNA, 22 bp, Homo sapiens
gcactgagtctgtcatgctgca

SEQ ID NO: 8105758 - DNA, 22 bp, Homo sapiens
gcactccagcctgggtaacagc

SEQ ID NO: 8105759 - DNA, 22 bp, Homo sapiens
gcagcaggtctgtcaatgtcat

SEQ ID NO: 8105760 - DNA, 22 bp, Homo sapiens
gcagaggagcaagttgctacag

SEQ ID NO: 8105761 - DNA, 22 bp, Homo sapiens
gcagaggaggacccaggaatta

SEQ ID NO: 8105762 - DNA, 22 bp, Homo sapiens
gcagcagtactcaatatcctgg

SEQ ID NO: 8105763 - DNA, 20 bp, Homo sapiens
gcagcagtgcaagtcctctt

SEQ ID NO: 8105764 - DNA, 22 bp, Homo sapiens
gcagcagtaggaaataacacag

SEQ ID NO: 8105765 - DNA, 19 bp, Homo sapiens
gcagcagtggaaggaaaaa

SEQ ID NO: 8105766 - DNA, 22 bp, Homo sapiens
gcagcagtggcagttaatattt

SEQ ID NO: 8105767 - DNA, 22 bp, Homo sapiens
gcagcagtgctttggaatcctg

SEQ ID NO: 8105768 - DNA, 22 bp, Homo sapiens
gcagcagtgcgggcagctacag

SEQ ID NO: 8105769 - DNA, 22 bp, Homo sapiens
gcagcagtgtctcccatcttgc

SEQ ID NO: 8105770 - DNA, 22 bp, Homo sapiens
gcagcagtggttttatcatttt

SEQ ID NO: 8105771 - DNA, 22 bp, Homo sapiens
gcagcagtgtgggctgaaccta

SEQ ID NO: 8105772 - DNA, 22 bp, Homo sapiens
gcagcagtggctgcaggtccca

SEQ ID NO: 8105773 - DNA, 22 bp, Homo sapiens
gcagcagtggtctgtagaagga

SEQ ID NO: 8105774 - DNA, 21 bp, Homo sapiens
gcagcagtgttctagaatact

SEQ ID NO: 8105775 - DNA, 22 bp, Homo sapiens
gcagctgcagagaccgggtggg

SEQ ID NO: 8105776 - DNA, 20 bp, Homo sapiens
gcaggctccgggcttgggag

SEQ ID NO: 8105777 - DNA, 22 bp, Homo sapiens
gcagggccttagcagcggctgc

SEQ ID NO: 8105778 - DNA, 22 bp, Homo sapiens
gcagggccttggtcatcttttt

SEQ ID NO: 8105779 - DNA, 22 bp, Homo sapiens
gcaggctgatgactggagttgg

SEQ ID NO: 8105780 - DNA, 22 bp, Homo sapiens
gcagctggagccagccagacac

SEQ ID NO: 8105781 - DNA, 22 bp, Homo sapiens
gcagctgcctattcagggcttg

SEQ ID NO: 8105782 - DNA, 22 bp, Homo sapiens
gcatttctgtgcatacacatga

SEQ ID NO: 8105783 - DNA, 22 bp, Homo sapiens
gcagtccttaggagaggaagta

SEQ ID NO: 8105784 - DNA, 22 bp, Homo sapiens
gcagtcctcgtaaaggtcgaag

SEQ ID NO: 8105785 - DNA, 22 bp, Homo sapiens
gcagtcctggaggaaggtgtga

SEQ ID NO: 8105786 - DNA, 22 bp, Homo sapiens
gcagtccccgtcgtggcaggga

SEQ ID NO: 8105787 - DNA, 22 bp, Homo sapiens
gcagggctccccaggcccgagg

SEQ ID NO: 8105788 - DNA, 22 bp, Homo sapiens
gccagaggaacgctgcgcgccc

SEQ ID NO: 8105789 - DNA, 22 bp, Homo sapiens
gccagccccttagggctctccc

SEQ ID NO: 8105790 - DNA, 22 bp, Homo sapiens
gccagccccagacatcctatcg

SEQ ID NO: 8105791 - DNA, 22 bp, Homo sapiens
gccagcccctccatcctgttca

SEQ ID NO: 8105792 - DNA, 22 bp, Homo sapiens
gccagcccagctccaggggaaa

SEQ ID NO: 8105793 - DNA, 22 bp, Homo sapiens
gccagcccattaacccctgtcc

SEQ ID NO: 8105794 - DNA, 22 bp, Homo sapiens
gcattttaatgaggtttatgag

SEQ ID NO: 8105795 - DNA, 22 bp, Homo sapiens
gcattttaataagattcatagg

SEQ ID NO: 8105796 - DNA, 22 bp, Homo sapiens
gccaaggcctctgcaggatgag

SEQ ID NO: 8105797 - DNA, 19 bp, Homo sapiens
gccaagggacttgcttctt

SEQ ID NO: 8105798 - DNA, 21 bp, Homo sapiens
gccaagggggtagctattcct

SEQ ID NO: 8105799 - DNA, 22 bp, Homo sapiens
gccaaggggttcaaaatgtata

SEQ ID NO: 8105800 - DNA, 22 bp, Homo sapiens
gcccatggacacccaagtgcca

SEQ ID NO: 8105801 - DNA, 23 bp, Homo sapiens
gcccatggagtctggatctggcc

SEQ ID NO: 8105802 - DNA, 23 bp, Homo sapiens
gcccatgctgttgggcccgagca

SEQ ID NO: 8105803 - DNA, 22 bp, Homo sapiens
gcccatggaaaacctgtcctct

SEQ ID NO: 8105804 - DNA, 22 bp, Homo sapiens
gcccatgcactttctgtgatgg

SEQ ID NO: 8105805 - DNA, 22 bp, Homo sapiens
gcccatggcagaactgtgagca

SEQ ID NO: 8105806 - DNA, 22 bp, Homo sapiens
gccctctggggcacacagagga

SEQ ID NO: 8105807 - DNA, 22 bp, Homo sapiens
gcccagagttcaaggctgcagt

SEQ ID NO: 8105808 - DNA, 20 bp, Homo sapiens
gcctagagatggaaggcgca

SEQ ID NO: 8105809 - DNA, 22 bp, Homo sapiens
gcctcagagggccctagggaca

SEQ ID NO: 8105810 - DNA, 22 bp, Homo sapiens
gccctgagactgagcatgggtt

SEQ ID NO: 8105811 - DNA, 19 bp, Homo sapiens
gccctgagagcttgggttc

SEQ ID NO: 8105812 - DNA, 22 bp, Homo sapiens
gccaggtgtagtggccacacct

SEQ ID NO: 8105813 - DNA, 22 bp, Homo sapiens
gccaggcacagttctaggtgct

SEQ ID NO: 8105814 - DNA, 19 bp, Homo sapiens
gccaggacatcctcctgct

SEQ ID NO: 8105815 - DNA, 22 bp, Homo sapiens
gcccagagggaagaggtgtcat

SEQ ID NO: 8105816 - DNA, 18 bp, Homo sapiens
gcccagaggtctgggccc

SEQ ID NO: 8105817 - DNA, 22 bp, Homo sapiens
gcccagagtgagtcctgggccc

SEQ ID NO: 8105818 - DNA, 22 bp, Homo sapiens
gccagtgcctcgccgcgctcct

SEQ ID NO: 8105819 - DNA, 22 bp, Homo sapiens
gccagtggaggacccatggaga

SEQ ID NO: 8105820 - DNA, 22 bp, Homo sapiens
gccagtgggacccgctgtgggc

SEQ ID NO: 8105821 - DNA, 20 bp, Homo sapiens
ggtgcaggtaacgctgtgct

SEQ ID NO: 8105822 - DNA, 22 bp, Homo sapiens
ggtgaagggccttaggagacag

SEQ ID NO: 8105823 - DNA, 22 bp, Homo sapiens
ggtgaaggcacaagagggcaag

SEQ ID NO: 8105824 - DNA, 22 bp, Homo sapiens
ggtgggaggcaggctgctccca

SEQ ID NO: 8105825 - DNA, 22 bp, Homo sapiens
ggtgggagggctgcgttcctct

SEQ ID NO: 8105826 - DNA, 22 bp, Homo sapiens
ggtgccctgccaggatgtgcca

SEQ ID NO: 8105827 - DNA, 22 bp, Homo sapiens
ggtgccctggaagctgctgcat

SEQ ID NO: 8105828 - DNA, 22 bp, Homo sapiens
ggtgcctgatggtgatgaggtc

SEQ ID NO: 8105829 - DNA, 22 bp, Homo sapiens
ggtgcccttcagacagtgggca

SEQ ID NO: 8105830 - DNA, 22 bp, Homo sapiens
ggtgccctgtaaaagccatgca

SEQ ID NO: 8105831 - DNA, 22 bp, Homo sapiens
ggtgcccacctgtcttcctgga

SEQ ID NO: 8105832 - DNA, 19 bp, Homo sapiens
ggtccagcacagttccagg

SEQ ID NO: 8105833 - DNA, 23 bp, Homo sapiens
ggtccaggaaaggcagcagcacc

SEQ ID NO: 8105834 - DNA, 18 bp, Homo sapiens
ggtcaggggcggagagaa

SEQ ID NO: 8105835 - DNA, 22 bp, Homo sapiens
ggtcagggggatctgtgaggta

SEQ ID NO: 8105836 - DNA, 22 bp, Homo sapiens
ggtcagcagtttctttgaattt

SEQ ID NO: 8105837 - DNA, 22 bp, Homo sapiens
ggtcagcatctggttgagggca

SEQ ID NO: 8105838 - DNA, 22 bp, Homo sapiens
ggtagggaaggctctgcgggga

SEQ ID NO: 8105839 - DNA, 22 bp, Homo sapiens
gggtcaggctagcccagacttc

SEQ ID NO: 8105840 - DNA, 22 bp, Homo sapiens
gggggccttattcatctgccag

SEQ ID NO: 8105841 - DNA, 22 bp, Homo sapiens
gggtcagctccctccccagggc

SEQ ID NO: 8105842 - DNA, 22 bp, Homo sapiens
gggtcagctgctgggggctgac

SEQ ID NO: 8105843 - DNA, 22 bp, Homo sapiens
gggtcagcgatttcaggggcag

SEQ ID NO: 8105844 - DNA, 22 bp, Homo sapiens
gggtattaaaatgaaggagaaa

SEQ ID NO: 8105845 - DNA, 22 bp, Homo sapiens
gggtcaaatgataattgcttct

SEQ ID NO: 8105846 - DNA, 22 bp, Homo sapiens
gggctgggcatggtgttccctc

SEQ ID NO: 8105847 - DNA, 22 bp, Homo sapiens
gggctgggattgcttgctgtga

SEQ ID NO: 8105848 - DNA, 22 bp, Homo sapiens
gggctggctgattttcctctct

SEQ ID NO: 8105849 - DNA, 22 bp, Homo sapiens
ggggatggaatgtagtagtgat

SEQ ID NO: 8105850 - DNA, 22 bp, Homo sapiens
ggggatggaggcgtgtggtcct

SEQ ID NO: 8105851 - DNA, 22 bp, Homo sapiens
ggggatggtgggaaggcaatct

SEQ ID NO: 8105852 - DNA, 22 bp, Homo sapiens
ggggcacttccaggctgaggct

SEQ ID NO: 8105853 - DNA, 22 bp, Homo sapiens
ggggcagaaagcccacagagtg

SEQ ID NO: 8105854 - DNA, 22 bp, Homo sapiens
gggctggctaagacttttctgt

SEQ ID NO: 8105855 - DNA, 22 bp, Homo sapiens
gggctctcgattagaccctggg

SEQ ID NO: 8105856 - DNA, 21 bp, Homo sapiens
gggctctcctgaggccatgaa

SEQ ID NO: 8105857 - DNA, 21 bp, Homo sapiens
gggctctcctgaggccatgaa

SEQ ID NO: 8105858 - DNA, 22 bp, Homo sapiens
gggctcctgcctcctggcacct

SEQ ID NO: 8105859 - DNA, 22 bp, Homo sapiens
gggctcctggcagtcatgctca

SEQ ID NO: 8105860 - DNA, 22 bp, Homo sapiens
gggctcctcctctgactgtggc

SEQ ID NO: 8105861 - DNA, 23 bp, Homo sapiens
gggctccagtctctgctcagttg

SEQ ID NO: 8105862 - DNA, 22 bp, Homo sapiens
gggcctgcaggttctgagaggc

SEQ ID NO: 8105863 - DNA, 22 bp, Homo sapiens
gggcctgccattgctgccccag

SEQ ID NO: 8105864 - DNA, 22 bp, Homo sapiens
gggcctgctggtgcttccattg

SEQ ID NO: 8105865 - DNA, 22 bp, Homo sapiens
gggcctggcatgcagccccgtt

SEQ ID NO: 8105866 - DNA, 21 bp, Homo sapiens
gggcctggctgcgcaggacgg

SEQ ID NO: 8105867 - DNA, 22 bp, Homo sapiens
gggcctggtgcttctgactcct

SEQ ID NO: 8105868 - DNA, 22 bp, Homo sapiens
gggcatgagcacatagtgtcta

SEQ ID NO: 8105869 - DNA, 22 bp, Homo sapiens
gggcctccgtgtgctggtgctc

SEQ ID NO: 8105870 - DNA, 22 bp, Homo sapiens
gggcctctcccttctcacgcat

SEQ ID NO: 8105871 - DNA, 22 bp, Homo sapiens
gggcctctccggcctttgcatc

SEQ ID NO: 8105872 - DNA, 22 bp, Homo sapiens
gggcctccggggtgagctgtgg

SEQ ID NO: 8105873 - DNA, 22 bp, Homo sapiens
gggcctccggggtgagctgtgg

SEQ ID NO: 8105874 - DNA, 22 bp, Homo sapiens
gggcctccgtgtgctggtgctc

SEQ ID NO: 8105875 - DNA, 22 bp, Homo sapiens
gggcctcatgatggctcaggaa

SEQ ID NO: 8105876 - DNA, 22 bp, Homo sapiens
gggcctcaggccttgctctgtg

SEQ ID NO: 8105877 - DNA, 22 bp, Homo sapiens
gggcctcagctctgctctgcaa

SEQ ID NO: 8105878 - DNA, 22 bp, Homo sapiens
gggcctcagctctgctctgcaa

SEQ ID NO: 8105879 - DNA, 23 bp, Homo sapiens
gtgatattaaggatagagacaag

SEQ ID NO: 8105880 - DNA, 22 bp, Homo sapiens
gtgatcttgtaattgggcaatg

SEQ ID NO: 8105881 - DNA, 22 bp, Homo sapiens
gtgaggctactcagctgtccga

SEQ ID NO: 8105882 - DNA, 22 bp, Homo sapiens
gtcttctttgtcatcttaggtt

SEQ ID NO: 8105883 - DNA, 22 bp, Homo sapiens
gtcttcattcaacaaatattca

SEQ ID NO: 8105884 - DNA, 20 bp, Homo sapiens
gtcttatttaacacatgact

SEQ ID NO: 8105885 - DNA, 20 bp, Homo sapiens
gtcttatttaacacatgact

SEQ ID NO: 8105886 - DNA, 22 bp, Homo sapiens
gtcttatttaaggacaagaaga

SEQ ID NO: 8105887 - DNA, 22 bp, Homo sapiens
gtcttagatttcaccgataatg

SEQ ID NO: 8105888 - DNA, 22 bp, Homo sapiens
gtctctatcatagctgaaccct

SEQ ID NO: 8105889 - DNA, 22 bp, Homo sapiens
gtgccctgaggtcttcactttg

SEQ ID NO: 8105890 - DNA, 22 bp, Homo sapiens
gtgccctgagtgggtaggagag

SEQ ID NO: 8105891 - DNA, 22 bp, Homo sapiens
gtgccctgagcttatgcattct

SEQ ID NO: 8105892 - DNA, 22 bp, Homo sapiens
gtgccctgaggtcttcactttg

SEQ ID NO: 8105893 - DNA, 22 bp, Homo sapiens
gtgccctggaggggttgaaggg

SEQ ID NO: 8105894 - DNA, 22 bp, Homo sapiens
gtgccctggatgactttggtct

SEQ ID NO: 8105895 - DNA, 22 bp, Homo sapiens
gtgccctgcatgccccgggtat

SEQ ID NO: 8105896 - DNA, 22 bp, Homo sapiens
gtgattctgcctggaaggtcct

SEQ ID NO: 8105897 - DNA, 22 bp, Homo sapiens
gtgattcaaatgtaactaatta

SEQ ID NO: 8105898 - DNA, 22 bp, Homo sapiens
gtgattcatcctggcattcatt

SEQ ID NO: 8105899 - DNA, 22 bp, Homo sapiens
gtgattcattcgattagtattt

SEQ ID NO: 8105900 - DNA, 22 bp, Homo sapiens
gtgccctgttgcacacttgagg

SEQ ID NO: 8105901 - DNA, 22 bp, Homo sapiens
gtgccctgttgcacacttgagg

SEQ ID NO: 8105902 - DNA, 22 bp, Homo sapiens
gtgcccttcagctttgctgaaa

SEQ ID NO: 8105903 - DNA, 22 bp, Homo sapiens
gtgccctgtgaactgtaaggaa

SEQ ID NO: 8105904 - DNA, 20 bp, Homo sapiens
gtgccctgtgggctattttc

SEQ ID NO: 8105905 - DNA, 22 bp, Homo sapiens
gtgccctgttcatttctctccc

SEQ ID NO: 8105906 - DNA, 22 bp, Homo sapiens
gtgccctggctcacagtgtctc

SEQ ID NO: 8105907 - DNA, 22 bp, Homo sapiens
gtgccctgggccttcagggcca

SEQ ID NO: 8105908 - DNA, 22 bp, Homo sapiens
gtcctctccaggaggctctgat

SEQ ID NO: 8105909 - DNA, 22 bp, Homo sapiens
gtccctggatctgggacagctg

SEQ ID NO: 8105910 - DNA, 22 bp, Homo sapiens
gtcatttatcttcagaatttct

SEQ ID NO: 8105911 - DNA, 22 bp, Homo sapiens
gtcctcaggaaggctttctgac

SEQ ID NO: 8105912 - DNA, 22 bp, Homo sapiens
gtcctcagcaccagaactaggg

SEQ ID NO: 8105913 - DNA, 21 bp, Homo sapiens
gtcctcagctgatgggagctg

SEQ ID NO: 8105914 - DNA, 22 bp, Homo sapiens
gtcattcctatccatttgatac

SEQ ID NO: 8105915 - DNA, 22 bp, Homo sapiens
gtcattccttatgttgattcag

SEQ ID NO: 8105916 - DNA, 22 bp, Homo sapiens
gtcataaaaggaccacctattg

SEQ ID NO: 8105917 - DNA, 19 bp, Homo sapiens
gtcaggtcgttcctgccgg

SEQ ID NO: 8105918 - DNA, 22 bp, Homo sapiens
gtcaggtcttggaagataggct

SEQ ID NO: 8105919 - DNA, 23 bp, Homo sapiens
gtcaggtcattagaggtgacttc

SEQ ID NO: 8105920 - DNA, 22 bp, Homo sapiens
gtcacaaatcccctcagcaact

SEQ ID NO: 8105921 - DNA, 22 bp, Homo sapiens
gtaataggttttcttgctccag

SEQ ID NO: 8105922 - DNA, 22 bp, Homo sapiens
gtagcccacctggggagggcga

SEQ ID NO: 8105923 - DNA, 22 bp, Homo sapiens
gtagaccatttatctggggagt

SEQ ID NO: 8105924 - DNA, 22 bp, Homo sapiens
gtcaagtcatgactcaaaggaa

SEQ ID NO: 8105925 - DNA, 22 bp, Homo sapiens
ggatgctgtctaagctgaggac

SEQ ID NO: 8105926 - DNA, 22 bp, Homo sapiens
ggatgctgctgcacatcctgca

SEQ ID NO: 8105927 - DNA, 22 bp, Homo sapiens
ggatgctgggagacagcaggca

SEQ ID NO: 8105928 - DNA, 22 bp, Homo sapiens
ggatgcccactatctgctggct

SEQ ID NO: 8105929 - DNA, 21 bp, Homo sapiens
ggatgccacgaagcaccagga

SEQ ID NO: 8105930 - DNA, 22 bp, Homo sapiens
ggatgcaggagttgaagaagga

SEQ ID NO: 8105931 - DNA, 22 bp, Homo sapiens
ggatgcacgaaggcgcctcgga

SEQ ID NO: 8105932 - DNA, 22 bp, Homo sapiens
ggatgggaacttggtagggcat

SEQ ID NO: 8105933 - DNA, 22 bp, Homo sapiens
ggatggaggttctcagatgctc

SEQ ID NO: 8105934 - DNA, 22 bp, Homo sapiens
ggatggagatgaccatggtgac

SEQ ID NO: 8105935 - DNA, 22 bp, Homo sapiens
ggattgcaacaagctagtttag

SEQ ID NO: 8105936 - DNA, 22 bp, Homo sapiens
ggcactttccagtctatagagc

SEQ ID NO: 8105937 - DNA, 22 bp, Homo sapiens
ggcacttttctccccggtcatg

SEQ ID NO: 8105938 - DNA, 22 bp, Homo sapiens
ggcactttccagtctatagagc

SEQ ID NO: 8105939 - DNA, 22 bp, Homo sapiens
ggcacttttctccccggtcatg

SEQ ID NO: 8105940 - DNA, 22 bp, Homo sapiens
ggcagcagggtagccatttctc

SEQ ID NO: 8105941 - DNA, 20 bp, Homo sapiens
ggcagcaggagtttcctctt

SEQ ID NO: 8105942 - DNA, 22 bp, Homo sapiens
ggcagcaggcgacttccctatt

SEQ ID NO: 8105943 - DNA, 22 bp, Homo sapiens
ggcagccagtagggccagcctg

SEQ ID NO: 8105944 - DNA, 22 bp, Homo sapiens
ggcctgctttccgagcctgcag

SEQ ID NO: 8105945 - DNA, 22 bp, Homo sapiens
ggcctgctggctccagcgcccg

SEQ ID NO: 8105946 - DNA, 22 bp, Homo sapiens
ggcctgctctggctgtggtcag

SEQ ID NO: 8105947 - DNA, 22 bp, Homo sapiens
ggcctgctctgcagcctctaca

SEQ ID NO: 8105948 - DNA, 22 bp, Homo sapiens
ggcctgctctgcagcctctaca

SEQ ID NO: 8105949 - DNA, 22 bp, Homo sapiens
ggcctgctctgtttagaggggg

SEQ ID NO: 8105950 - DNA, 22 bp, Homo sapiens
ggcctcagaccggagctggcca

SEQ ID NO: 8105951 - DNA, 22 bp, Homo sapiens
ggcctgctattggtgggcagac

SEQ ID NO: 8105952 - DNA, 22 bp, Homo sapiens
ggccctgctgaagccgggtcta

SEQ ID NO: 8105953 - DNA, 22 bp, Homo sapiens
ggccctgctgaagccgggtcta

SEQ ID NO: 8105954 - DNA, 22 bp, Homo sapiens
ggccctgctcaggctgcgatga

SEQ ID NO: 8105955 - DNA, 22 bp, Homo sapiens
ggccctgctcaggctgcgatga

SEQ ID NO: 8105956 - DNA, 22 bp, Homo sapiens
ggccctgctgagtggagtggag

SEQ ID NO: 8105957 - DNA, 21 bp, Homo sapiens
ggccctggttacgcctcctct

SEQ ID NO: 8105958 - DNA, 22 bp, Homo sapiens
ggcctcaagctaccctctcacc

SEQ ID NO: 8105959 - DNA, 22 bp, Homo sapiens
ggcctatgagaggcagcatgtt

SEQ ID NO: 8105960 - DNA, 22 bp, Homo sapiens
ggcagtggtgggaggctcgctc

SEQ ID NO: 8105961 - DNA, 21 bp, Homo sapiens
ggcatgagggcagtgagcaga

SEQ ID NO: 8105962 - DNA, 22 bp, Homo sapiens
ggcagggtgtggagttgggaca

SEQ ID NO: 8105963 - DNA, 22 bp, Homo sapiens
ggcaggagctctccagtttgcc

SEQ ID NO: 8105964 - DNA, 22 bp, Homo sapiens
ggcagggtctggactgaaagct

SEQ ID NO: 8105965 - DNA, 22 bp, Homo sapiens
gggcactggaaggctctcaggc

SEQ ID NO: 8105966 - DNA, 22 bp, Homo sapiens
gggcactgctttgctctgtcac

SEQ ID NO: 8105967 - DNA, 22 bp, Homo sapiens
gggcactggaaggctctcaggc

SEQ ID NO: 8105968 - DNA, 22 bp, Homo sapiens
gggcacagtctaaagttgggcc

SEQ ID NO: 8105969 - DNA, 22 bp, Homo sapiens
gggcactgaacaccctcttcgc

SEQ ID NO: 8105970 - DNA, 19 bp, Homo sapiens
gggcagtggcactagggag

SEQ ID NO: 8105971 - DNA, 22 bp, Homo sapiens
gggcagtgattttccttagagg

SEQ ID NO: 8105972 - DNA, 22 bp, Homo sapiens
gggaggtgttctgccaacgcgg

SEQ ID NO: 8105973 - DNA, 22 bp, Homo sapiens
gggaggtgttccagtgttggta

SEQ ID NO: 8105974 - DNA, 22 bp, Homo sapiens
gggagggccaggctcacccagg

SEQ ID NO: 8105975 - DNA, 22 bp, Homo sapiens
gggaggtgatggcaagcagcgg

SEQ ID NO: 8105976 - DNA, 22 bp, Homo sapiens
gggaggtgattaggaccatgta

SEQ ID NO: 8105977 - DNA, 22 bp, Homo sapiens
gggaggtgattaggaccatgta

SEQ ID NO: 8105978 - DNA, 22 bp, Homo sapiens
gggagggattagttctgcctgg

SEQ ID NO: 8105979 - DNA, 22 bp, Homo sapiens
gggagggacacaaagagttccc

SEQ ID NO: 8105980 - DNA, 22 bp, Homo sapiens
gggagggagaggacagttctat

SEQ ID NO: 8105981 - DNA, 22 bp, Homo sapiens
gggagggatctgctaggcaatg

SEQ ID NO: 8105982 - DNA, 22 bp, Homo sapiens
gggagggaggtgctggttcacg

SEQ ID NO: 8105983 - DNA, 22 bp, Homo sapiens
gggagggaggtgatgcttggct

SEQ ID NO: 8105984 - DNA, 22 bp, Homo sapiens
gggaagggacttgtttaaggtc

SEQ ID NO: 8105985 - DNA, 22 bp, Homo sapiens
gggaaggctgcctgagggatgg

SEQ ID NO: 8105986 - DNA, 22 bp, Homo sapiens
gggaagggagggacctcagtct

SEQ ID NO: 8105987 - DNA, 22 bp, Homo sapiens
gggaagggagctgggtatttag

SEQ ID NO: 8105988 - DNA, 22 bp, Homo sapiens
ggctttcagccaaaggacaacc

SEQ ID NO: 8105989 - DNA, 20 bp, Homo sapiens
ggctttctgtgatcctcagt

SEQ ID NO: 8105990 - DNA, 22 bp, Homo sapiens
ggctttgacatgctgaattaaa

SEQ ID NO: 8105991 - DNA, 22 bp, Homo sapiens
ggctttgacatgctgaattaaa

SEQ ID NO: 8105992 - DNA, 23 bp, Homo sapiens
gggaagtggggatttgaagtcat

SEQ ID NO: 8105993 - DNA, 17 bp, Homo sapiens
gggaagtggagaaagct

SEQ ID NO: 8105994 - DNA, 22 bp, Homo sapiens
gggaagggtgttgtcttatctt

SEQ ID NO: 8105995 - DNA, 22 bp, Homo sapiens
gggaagggctccttttattgca

SEQ ID NO: 8105996 - DNA, 22 bp, Homo sapiens
gggaagggagggcctccagtca

SEQ ID NO: 8105997 - DNA, 23 bp, Homo sapiens
gggaagtgaggagcccctctgcc

SEQ ID NO: 8105998 - DNA, 23 bp, Homo sapiens
gggaagtgaggagcccctcagcc

SEQ ID NO: 8105999 - DNA, 22 bp, Homo sapiens
gggaagtgaggagcccctctgc

SEQ ID NO: 8106000 - DNA, 22 bp, Homo sapiens
gggaagtgaagtgtagctgtct

SEQ ID NO: 8106001 - DNA, 19 bp, Homo sapiens
gggagctgaggtctttggt

SEQ ID NO: 8106002 - DNA, 22 bp, Homo sapiens
gggagctgagggacctctgtgg

SEQ ID NO: 8106003 - DNA, 21 bp, Homo sapiens
gggagctgacagcagcacggc

SEQ ID NO: 8106004 - DNA, 22 bp, Homo sapiens
ggctccagggagtggagagaag

SEQ ID NO: 8106005 - DNA, 22 bp, Homo sapiens
ggcggtggcgtgaaggtggctg

SEQ ID NO: 8106006 - DNA, 22 bp, Homo sapiens
ggctacagggcctggccaaggt

SEQ ID NO: 8106007 - DNA, 22 bp, Homo sapiens
ggctcctgatgctcagatttca

SEQ ID NO: 8106008 - DNA, 22 bp, Homo sapiens
ggctctgggtctgtggggagcg

SEQ ID NO: 8106009 - DNA, 22 bp, Homo sapiens
ggctctgtttactttcagaggc

SEQ ID NO: 8106010 - DNA, 22 bp, Homo sapiens
ggctctgtcacctatgagctga

SEQ ID NO: 8106011 - DNA, 22 bp, Homo sapiens
ggctgagccatgggcactgcag

SEQ ID NO: 8106012 - DNA, 22 bp, Homo sapiens
ggctgagccactgcgcctggct

SEQ ID NO: 8106013 - DNA, 21 bp, Homo sapiens
ggctgggtcatgcagctggcc

SEQ ID NO: 8106014 - DNA, 22 bp, Homo sapiens
ggctgggtcccagctgggagga

SEQ ID NO: 8106015 - DNA, 22 bp, Homo sapiens
ggctgggtcccagctgggagga

SEQ ID NO: 8106016 - DNA, 22 bp, Homo sapiens
ggctgtgagtttgtcctccatg

SEQ ID NO: 8106017 - DNA, 22 bp, Homo sapiens
ggctgctgtttcagagactgtt

SEQ ID NO: 8106018 - DNA, 22 bp, Homo sapiens
ggctgctggggacgtgggagag

SEQ ID NO: 8106019 - DNA, 22 bp, Homo sapiens
ttgcacagatgagcttatttaa

SEQ ID NO: 8106020 - DNA, 22 bp, Homo sapiens
ttgcacagatgcacatggttgc

SEQ ID NO: 8106021 - DNA, 22 bp, Homo sapiens
ttgcacaggcagtaattgcttg

SEQ ID NO: 8106022 - DNA, 22 bp, Homo sapiens
ttgcacagggctggaatgtcct

SEQ ID NO: 8106023 - DNA, 22 bp, Homo sapiens
ttgcacagtagcgcgtgattgt

SEQ ID NO: 8106024 - DNA, 22 bp, Homo sapiens
ttgcacagtttgaagatgactc

SEQ ID NO: 8106025 - DNA, 23 bp, Homo sapiens
ttgcacagtgtatacacatattt

SEQ ID NO: 8106026 - DNA, 22 bp, Homo sapiens
ttgcacagtggtttagagcctg

SEQ ID NO: 8106027 - DNA, 22 bp, Homo sapiens
ttgcacagtttgaagatgactc

SEQ ID NO: 8106028 - DNA, 22 bp, Homo sapiens
ttgcacagagtggatattcagt

SEQ ID NO: 8106029 - DNA, 18 bp, Homo sapiens
ctcaggcctttccctgtg

SEQ ID NO: 8106030 - DNA, 20 bp, Homo sapiens
ttgcacagaggtttcaagtg

SEQ ID NO: 8106031 - DNA, 22 bp, Homo sapiens
ttgcacagaatgacaatatgta

SEQ ID NO: 8106032 - DNA, 22 bp, Homo sapiens
ttgctgctttcatttatacagt

SEQ ID NO: 8106033 - DNA, 22 bp, Homo sapiens
ttgctgaggacgcagtgcagtg

SEQ ID NO: 8106034 - DNA, 22 bp, Homo sapiens
ctcaggccattcttccagctgc

SEQ ID NO: 8106035 - DNA, 22 bp, Homo sapiens
ctcaggccaggtttctcccaca

SEQ ID NO: 8106036 - DNA, 22 bp, Homo sapiens
ctcaggcccacagcagacccac

SEQ ID NO: 8106037 - DNA, 22 bp, Homo sapiens
ctcagccagtgatctttccttt

SEQ ID NO: 8106038 - DNA, 22 bp, Homo sapiens
ctcagccatgtcatgcctacct

SEQ ID NO: 8106039 - DNA, 22 bp, Homo sapiens
ctcagccccaattctccccatt

SEQ ID NO: 8106040 - DNA, 22 bp, Homo sapiens
ttgatttttttctactatgcgc

SEQ ID NO: 8106041 - DNA, 22 bp, Homo sapiens
ttgatttttccagcttctagag

SEQ ID NO: 8106042 - DNA, 22 bp, Homo sapiens
ttgaatacaagtagagaagaca

SEQ ID NO: 8106043 - DNA, 22 bp, Homo sapiens
ttgaatactcagaaaatgacat

SEQ ID NO: 8106044 - DNA, 22 bp, Homo sapiens
ctcactgcaagctctgcctccc

SEQ ID NO: 8106045 - DNA, 22 bp, Homo sapiens
ctcactgcaagctctgcctcca

SEQ ID NO: 8106046 - DNA, 22 bp, Homo sapiens
ttgaaatatggattgaccttga

SEQ ID NO: 8106047 - DNA, 22 bp, Homo sapiens
ttgaaatatcaagttattagtg

SEQ ID NO: 8106048 - DNA, 21 bp, Homo sapiens
ttcttcaggccaatgctcatt

SEQ ID NO: 8106049 - DNA, 22 bp, Homo sapiens
ttcttcattcccttacttccga

SEQ ID NO: 8106050 - DNA, 22 bp, Homo sapiens
ttcttcaggatacgtcatccag

SEQ ID NO: 8106051 - DNA, 22 bp, Homo sapiens
ttcttacaagtatgacgtagca

SEQ ID NO: 8106052 - DNA, 22 bp, Homo sapiens
ttcttacaagtatgacgtagca

SEQ ID NO: 8106053 - DNA, 22 bp, Homo sapiens
ttcttaagaaaccatcacattc

SEQ ID NO: 8106054 - DNA, 22 bp, Homo sapiens
ttcttaagactgcaaatcaacc

SEQ ID NO: 8106055 - DNA, 22 bp, Homo sapiens
ttcttaagcagtttggcatgtt

SEQ ID NO: 8106056 - DNA, 22 bp, Homo sapiens
ttcttaagcgtatgataatgaa

SEQ ID NO: 8106057 - DNA, 22 bp, Homo sapiens
ttcttaactcaaatatatatcc

SEQ ID NO: 8106058 - DNA, 20 bp, Homo sapiens
ttcttaaagacctcactttg

SEQ ID NO: 8106059 - DNA, 20 bp, Homo sapiens
ttcttaaagacctcactttg

SEQ ID NO: 8106060 - DNA, 22 bp, Homo sapiens
ctataaatctacccagcattgg

SEQ ID NO: 8106061 - DNA, 22 bp, Homo sapiens
ctataaatctacccagcattgg

SEQ ID NO: 8106062 - DNA, 19 bp, Homo sapiens
ttctaccttactgtaggct

SEQ ID NO: 8106063 - DNA, 22 bp, Homo sapiens
ttctacattcatgtattacctc

SEQ ID NO: 8106064 - DNA, 22 bp, Homo sapiens
ttctacattcatgtattacctc

SEQ ID NO: 8106065 - DNA, 22 bp, Homo sapiens
ttctacatcacttaacatgcta

SEQ ID NO: 8106066 - DNA, 22 bp, Homo sapiens
ttctacatcacttaacatgcta

SEQ ID NO: 8106067 - DNA, 22 bp, Homo sapiens
ttctacatgagaaaatgtattt

SEQ ID NO: 8106068 - DNA, 22 bp, Homo sapiens
ttctacatatatttttctcact

SEQ ID NO: 8106069 - DNA, 21 bp, Homo sapiens
ttctcagtgtccatgttagtt

SEQ ID NO: 8106070 - DNA, 23 bp, Homo sapiens
ttctcagtcctgcccagggaggc

SEQ ID NO: 8106071 - DNA, 21 bp, Homo sapiens
ttctcatgggataagtacatg

SEQ ID NO: 8106072 - DNA, 22 bp, Homo sapiens
ttctccttattcatagttgtct

SEQ ID NO: 8106073 - DNA, 22 bp, Homo sapiens
cgtcccgggttcacgccattct

SEQ ID NO: 8106074 - DNA, 22 bp, Homo sapiens
cgtcatcacggcaagcatctcc

SEQ ID NO: 8106075 - DNA, 22 bp, Homo sapiens
cgtcatcacggcaagcatctcc

SEQ ID NO: 8106076 - DNA, 22 bp, Homo sapiens
ttccacttttctctctcatgcc

SEQ ID NO: 8106077 - DNA, 22 bp, Homo sapiens
cgtctttattgattccttcaag

SEQ ID NO: 8106078 - DNA, 22 bp, Homo sapiens
cggctggtgtcgggcacagcaa

SEQ ID NO: 8106079 - DNA, 22 bp, Homo sapiens
cgggaaggtggaggttgcagtg

SEQ ID NO: 8106080 - DNA, 19 bp, Homo sapiens
cgcagagggcttctgagag

SEQ ID NO: 8106081 - DNA, 20 bp, Homo sapiens
cgcagcagtggaagtggaat

SEQ ID NO: 8106082 - DNA, 22 bp, Homo sapiens
cgcagcagccccgtggtaggtg

SEQ ID NO: 8106083 - DNA, 22 bp, Homo sapiens
ttcagtttccacttacatttaa

SEQ ID NO: 8106084 - DNA, 22 bp, Homo sapiens
ttcagtttcgttatctatgaga

SEQ ID NO: 8106085 - DNA, 22 bp, Homo sapiens
tgtttcttctcacacaaactca

SEQ ID NO: 8106086 - DNA, 19 bp, Homo sapiens
tgtttcttcctccatctga

SEQ ID NO: 8106087 - DNA, 22 bp, Homo sapiens
tgtttcttacgtttttagaggc

SEQ ID NO: 8106088 - DNA, 23 bp, Homo sapiens
cctggggcacttgagtcctcatc

SEQ ID NO: 8106089 - DNA, 22 bp, Homo sapiens
tggttccagttttcaatagagc

SEQ ID NO: 8106090 - DNA, 22 bp, Homo sapiens
tggttcattgagaagactgaag

SEQ ID NO: 8106091 - DNA, 22 bp, Homo sapiens
tggttcaggcagggtgttgctg

SEQ ID NO: 8106092 - DNA, 23 bp, Homo sapiens
tggttcaagtgagaagtaatgtt

SEQ ID NO: 8106093 - DNA, 22 bp, Homo sapiens
cctggggagaagagcttccccc

SEQ ID NO: 8106094 - DNA, 22 bp, Homo sapiens
tgttgattagtgtttagactta

SEQ ID NO: 8106095 - DNA, 22 bp, Homo sapiens
tgttgatttgtgggctgcaaaa

SEQ ID NO: 8106096 - DNA, 20 bp, Homo sapiens
tgttgattggtgtcatctca

SEQ ID NO: 8106097 - DNA, 23 bp, Homo sapiens
ttaaaagtggagagagaagctgg

SEQ ID NO: 8106098 - DNA, 22 bp, Homo sapiens
ttaaaagtctgatgatttacat

SEQ ID NO: 8106099 - DNA, 22 bp, Homo sapiens
ttaaaagtctgatgatttacat

SEQ ID NO: 8106100 - DNA, 22 bp, Homo sapiens
ttaaaatagccagtgcccctct

SEQ ID NO: 8106101 - DNA, 22 bp, Homo sapiens
ttaagctctcattattattatt

SEQ ID NO: 8106102 - DNA, 22 bp, Homo sapiens
ttaatagatttgattttaaagg

SEQ ID NO: 8106103 - DNA, 19 bp, Homo sapiens
ttaatcctttcatcagctg

SEQ ID NO: 8106104 - DNA, 22 bp, Homo sapiens
ttaatcctcacaattacctcag

SEQ ID NO: 8106105 - DNA, 22 bp, Homo sapiens
cctgtggacattctgtgtggaa

SEQ ID NO: 8106106 - DNA, 22 bp, Homo sapiens
cctgtgctttaggcctcaaact

SEQ ID NO: 8106107 - DNA, 22 bp, Homo sapiens
cctgtggaccaggaggcagccc

SEQ ID NO: 8106108 - DNA, 22 bp, Homo sapiens
cctgtggcacatgcagggattc

SEQ ID NO: 8106109 - DNA, 22 bp, Homo sapiens
cctgtgcttggccagagaggtt

SEQ ID NO: 8106110 - DNA, 22 bp, Homo sapiens
ttacaataccacatcacctcat

SEQ ID NO: 8106111 - DNA, 22 bp, Homo sapiens
ttacaatagttccttcttttgt

SEQ ID NO: 8106112 - DNA, 22 bp, Homo sapiens
ttacaagtttctggcttcatcc

SEQ ID NO: 8106113 - DNA, 22 bp, Homo sapiens
cctgtggcgggggccagtgcct

SEQ ID NO: 8106114 - DNA, 18 bp, Homo sapiens
cctgtggctcagcccaca

SEQ ID NO: 8106115 - DNA, 22 bp, Homo sapiens
cctgtggctgccacttgggtga

SEQ ID NO: 8106116 - DNA, 22 bp, Homo sapiens
ttacaagtgtcaggtactggca

SEQ ID NO: 8106117 - DNA, 22 bp, Homo sapiens
ttacaagtatttaagatgctgt

SEQ ID NO: 8106118 - DNA, 17 bp, Homo sapiens
cctttcttcccagaggg

SEQ ID NO: 8106119 - DNA, 22 bp, Homo sapiens
cctttcttttatccaccagcca

SEQ ID NO: 8106120 - DNA, 22 bp, Homo sapiens
ttattattgtggttgcattatc

SEQ ID NO: 8106121 - DNA, 22 bp, Homo sapiens
ttattattgtgacctgagaatg

SEQ ID NO: 8106122 - DNA, 22 bp, Homo sapiens
ttattcactcattaaagcagga

SEQ ID NO: 8106123 - DNA, 22 bp, Homo sapiens
ttattcactctgaagccatcct

SEQ ID NO: 8106124 - DNA, 22 bp, Homo sapiens
ttattcacttcttggtccctca

SEQ ID NO: 8106125 - DNA, 18 bp, Homo sapiens
ttattcagacgcatatga

SEQ ID NO: 8106126 - DNA, 22 bp, Homo sapiens
ttattcaccagtgtaaaacact

SEQ ID NO: 8106127 - DNA, 22 bp, Homo sapiens
cgcagagggcaggcagtgctgg

SEQ ID NO: 8106128 - DNA, 22 bp, Homo sapiens
cgcagagggagccgcgggctgc

SEQ ID NO: 8106129 - DNA, 22 bp, Homo sapiens
ttatttttaaaagttcacacag

SEQ ID NO: 8106130 - DNA, 22 bp, Homo sapiens
ttcaaaaaggtatgttcaagtc

SEQ ID NO: 8106131 - DNA, 22 bp, Homo sapiens
ttcaaaaaggtatgttcaagtc

SEQ ID NO: 8106132 - DNA, 22 bp, Homo sapiens
ttatggcttaaatactacaggg

SEQ ID NO: 8106133 - DNA, 22 bp, Homo sapiens
cctttacagtatggttgtatca

SEQ ID NO: 8106134 - DNA, 22 bp, Homo sapiens
cctttacacgtaaggctgttga

SEQ ID NO: 8106135 - DNA, 22 bp, Homo sapiens
cctttacaaagttcttcatggg

SEQ ID NO: 8106136 - DNA, 21 bp, Homo sapiens
ttactaaacaaaacatgcagg

SEQ ID NO: 8106137 - DNA, 22 bp, Homo sapiens
ttacgaatgttagattgcatct

SEQ ID NO: 8106138 - DNA, 22 bp, Homo sapiens
ccttgggaggctcccagggaga

SEQ ID NO: 8106139 - DNA, 22 bp, Homo sapiens
ccttgggaccctgctggaggtt

SEQ ID NO: 8106140 - DNA, 22 bp, Homo sapiens
ccttgggagaaattgcagagtc

SEQ ID NO: 8106141 - DNA, 21 bp, Homo sapiens
ccttgggatgcaagtgagact

SEQ ID NO: 8106142 - DNA, 22 bp, Homo sapiens
ccttggcttgcacacggccacc

SEQ ID NO: 8106143 - DNA, 22 bp, Homo sapiens
ttacctaaaatagctcaattta

SEQ ID NO: 8106144 - DNA, 22 bp, Homo sapiens
ccttctgctggtcatcccagtg

SEQ ID NO: 8106145 - DNA, 22 bp, Homo sapiens
ccttctgggccaacttccagga

SEQ ID NO: 8106146 - DNA, 22 bp, Homo sapiens
ttacagaagtattgagagatcc

SEQ ID NO: 8106147 - DNA, 22 bp, Homo sapiens
ttacagaagagaaagaattcag

SEQ ID NO: 8106148 - DNA, 22 bp, Homo sapiens
tttctctctacagtactttcat

SEQ ID NO: 8106149 - DNA, 22 bp, Homo sapiens
tttctcacccaagagttatttt

SEQ ID NO: 8106150 - DNA, 22 bp, Homo sapiens
ctctgctgcccaggcctgctag

SEQ ID NO: 8106151 - DNA, 22 bp, Homo sapiens
ctctgctgctttgccagtggaa

SEQ ID NO: 8106152 - DNA, 22 bp, Homo sapiens
ctctgctgttcttatgtgtcct

SEQ ID NO: 8106153 - DNA, 21 bp, Homo sapiens
ctctgctgtctaccagctgtt

SEQ ID NO: 8106154 - DNA, 22 bp, Homo sapiens
tttcttcttgatttaaacaggg

SEQ ID NO: 8106155 - DNA, 22 bp, Homo sapiens
tttcttcttgatttaaacaggg

SEQ ID NO: 8106156 - DNA, 22 bp, Homo sapiens
tttcttctgtttgtagttacac

SEQ ID NO: 8106157 - DNA, 22 bp, Homo sapiens
tttcaaagtcaatatcattacc

SEQ ID NO: 8106158 - DNA, 22 bp, Homo sapiens
tttcaaagtcaatatcattacc

SEQ ID NO: 8106159 - DNA, 22 bp, Homo sapiens
tttcaaagtcaagaaggatact

SEQ ID NO: 8106160 - DNA, 22 bp, Homo sapiens
tttcaaagttgggaattgtaat

SEQ ID NO: 8106161 - DNA, 22 bp, Homo sapiens
tttcaaagtggagaattagaca

SEQ ID NO: 8106162 - DNA, 22 bp, Homo sapiens
tttcaaagtggagaattagaca

SEQ ID NO: 8106163 - DNA, 22 bp, Homo sapiens
tttcaaagtggagaattagaca

SEQ ID NO: 8106164 - DNA, 22 bp, Homo sapiens
tttcaaagtcaatatcattacc

SEQ ID NO: 8106165 - DNA, 22 bp, Homo sapiens
tttcaaatagaatctttccaaa

SEQ ID NO: 8106166 - DNA, 22 bp, Homo sapiens
tttcaaatgcatgtctttcctc

SEQ ID NO: 8106167 - DNA, 22 bp, Homo sapiens
tttcaaataccataaacctaat

SEQ ID NO: 8106168 - DNA, 22 bp, Homo sapiens
ctcgtgccaggacgcgcagttt

SEQ ID NO: 8106169 - DNA, 22 bp, Homo sapiens
tttacacaaaagatagcacacc

SEQ ID NO: 8106170 - DNA, 22 bp, Homo sapiens
tttacacaaaagatagcacacc

SEQ ID NO: 8106171 - DNA, 22 bp, Homo sapiens
ctcctggaagcccgccctgctg

SEQ ID NO: 8106172 - DNA, 22 bp, Homo sapiens
tttatatgtttgtacaattaag

SEQ ID NO: 8106173 - DNA, 22 bp, Homo sapiens
ctcctggaccaccttgtggcca

SEQ ID NO: 8106174 - DNA, 22 bp, Homo sapiens
ctcctggagtcctttcctattc

SEQ ID NO: 8106175 - DNA, 22 bp, Homo sapiens
ctcaggctgtgccacctgtgtg

SEQ ID NO: 8106176 - DNA, 22 bp, Homo sapiens
ctcaggctctgtactccctttg

SEQ ID NO: 8106177 - DNA, 22 bp, Homo sapiens
ctcccagtgttgttttctgatg

SEQ ID NO: 8106178 - DNA, 22 bp, Homo sapiens
ttgtttatgtaattggcacact

SEQ ID NO: 8106179 - DNA, 22 bp, Homo sapiens
ttgtttcaaggaagaattagga

SEQ ID NO: 8106180 - DNA, 22 bp, Homo sapiens
ctccctggtgtcccctccagga

SEQ ID NO: 8106181 - DNA, 22 bp, Homo sapiens
ctccctgaaattcagatgcctc

SEQ ID NO: 8106182 - DNA, 22 bp, Homo sapiens
ctccctgaggacaggccctgtc

SEQ ID NO: 8106183 - DNA, 23 bp, Homo sapiens
ctccctgaacatgacacaccaga

SEQ ID NO: 8106184 - DNA, 22 bp, Homo sapiens
ctccctggcagccgcactcctg

SEQ ID NO: 8106185 - DNA, 22 bp, Homo sapiens
ctccctggctttgtcctgaggc

SEQ ID NO: 8106186 - DNA, 22 bp, Homo sapiens
ctgccctgggagtacctgtcct

SEQ ID NO: 8106187 - DNA, 22 bp, Homo sapiens
ctgccctggcagcctaccatgg

SEQ ID NO: 8106188 - DNA, 22 bp, Homo sapiens
ctgccctgcttgtttccagtgg

SEQ ID NO: 8106189 - DNA, 22 bp, Homo sapiens
ctgccctgagggcctgtgtgtt

SEQ ID NO: 8106190 - DNA, 18 bp, Homo sapiens
ctgccccttctctgagat

SEQ ID NO: 8106191 - DNA, 23 bp, Homo sapiens
ctgccctgatcttgatctattgt

SEQ ID NO: 8106192 - DNA, 22 bp, Homo sapiens
ctgccctgcttgatgacagcga

SEQ ID NO: 8106193 - DNA, 22 bp, Homo sapiens
ctgccctgctctccgggatctt

SEQ ID NO: 8106194 - DNA, 22 bp, Homo sapiens
ctgccctgctaatgagttccaa

SEQ ID NO: 8106195 - DNA, 20 bp, Homo sapiens
ctgccctgccctgggtcctg

SEQ ID NO: 8106196 - DNA, 22 bp, Homo sapiens
ctgccctgcctggccagtgtgg

SEQ ID NO: 8106197 - DNA, 22 bp, Homo sapiens
ctgccctgcccaggccttgggc

SEQ ID NO: 8106198 - DNA, 22 bp, Homo sapiens
ctgccctgcccaggccttgggc

SEQ ID NO: 8106199 - DNA, 22 bp, Homo sapiens
ctgcccctggctggtgaagcag

SEQ ID NO: 8106200 - DNA, 22 bp, Homo sapiens
ctgcagtgttctggaatgcatt

SEQ ID NO: 8106201 - DNA, 22 bp, Homo sapiens
ctgcagtgaaatcaggaagcaa

SEQ ID NO: 8106202 - DNA, 22 bp, Homo sapiens
ctgctgagcatttgcagggaca

SEQ ID NO: 8106203 - DNA, 22 bp, Homo sapiens
ctgctctccccaggccagtctg

SEQ ID NO: 8106204 - DNA, 20 bp, Homo sapiens
ctgctgccctgtcagcctct

SEQ ID NO: 8106205 - DNA, 22 bp, Homo sapiens
ctgctgcccctgagctcagcct

SEQ ID NO: 8106206 - DNA, 22 bp, Homo sapiens
ctgctgccctagacccagtcct

SEQ ID NO: 8106207 - DNA, 22 bp, Homo sapiens
ctgctgagccctggcacaggtg

SEQ ID NO: 8106208 - DNA, 22 bp, Homo sapiens
ctgctgagccgcacccaggagc

SEQ ID NO: 8106209 - DNA, 22 bp, Homo sapiens
ctgctgagcctggtgcgggatg

SEQ ID NO: 8106210 - DNA, 22 bp, Homo sapiens
ctgctgctgctatctacccagg

SEQ ID NO: 8106211 - DNA, 22 bp, Homo sapiens
ctgctgctgagagctcagcctg

SEQ ID NO: 8106212 - DNA, 22 bp, Homo sapiens
ctgctgctgtaaggcagaatta

SEQ ID NO: 8106213 - DNA, 21 bp, Homo sapiens
ctgctgctggggtctgggcag

SEQ ID NO: 8106214 - DNA, 22 bp, Homo sapiens
ctgctgccttccaaaggccagg

SEQ ID NO: 8106215 - DNA, 22 bp, Homo sapiens
ctgctgcctgattgcagacctc

SEQ ID NO: 8106216 - DNA, 19 bp, Homo sapiens
ctgctgccggagactcgtc

SEQ ID NO: 8106217 - DNA, 22 bp, Homo sapiens
ctgctgctcgaccagtcccagg

SEQ ID NO: 8106218 - DNA, 22 bp, Homo sapiens
ctgctgctgactcatcccagct

SEQ ID NO: 8106219 - DNA, 22 bp, Homo sapiens
ctgctggcctagcccatcctct

SEQ ID NO: 8106220 - DNA, 22 bp, Homo sapiens
ctgctggcctcggccatgcctg

SEQ ID NO: 8106221 - DNA, 22 bp, Homo sapiens
ctgctggaagtttgctgtggat

SEQ ID NO: 8106222 - DNA, 22 bp, Homo sapiens
ctgcctgcatgctgccatagct

SEQ ID NO: 8106223 - DNA, 22 bp, Homo sapiens
ctgcctgccacgttcagctgta

SEQ ID NO: 8106224 - DNA, 22 bp, Homo sapiens
ctgcctgcatcccacagtgggg

SEQ ID NO: 8106225 - DNA, 22 bp, Homo sapiens
ctgcctgccacgttcagctgta

SEQ ID NO: 8106226 - DNA, 22 bp, Homo sapiens
ctgcctgaagaattgtgttgca

SEQ ID NO: 8106227 - DNA, 22 bp, Homo sapiens
ctgcctctgttgggcatggtct

SEQ ID NO: 8106228 - DNA, 22 bp, Homo sapiens
ctgcctgcactgcctggctcca

SEQ ID NO: 8106229 - DNA, 22 bp, Homo sapiens
ctgcctgagtacaagtcccaga

SEQ ID NO: 8106230 - DNA, 22 bp, Homo sapiens
ctgcctgactgataatctctga

SEQ ID NO: 8106231 - DNA, 22 bp, Homo sapiens
ctgcctgcaggacacctcgcta

SEQ ID NO: 8106232 - DNA, 22 bp, Homo sapiens
ctgcctgcactgcctggctcca

SEQ ID NO: 8106233 - DNA, 22 bp, Homo sapiens
ctgcctgcatcccacagtgggg

SEQ ID NO: 8106234 - DNA, 19 bp, Homo sapiens
ctgctccctccttctggca

SEQ ID NO: 8106235 - DNA, 19 bp, Homo sapiens
ctgctccctccttctggca

SEQ ID NO: 8106236 - DNA, 22 bp, Homo sapiens
ctgctccccagcctgcgccttt

SEQ ID NO: 8106237 - DNA, 18 bp, Homo sapiens
ctgctccagtctggccag

SEQ ID NO: 8106238 - DNA, 22 bp, Homo sapiens
ctgctcctggtcatcctccact

SEQ ID NO: 8106239 - DNA, 22 bp, Homo sapiens
ctgagggagttcctgagcccac

SEQ ID NO: 8106240 - DNA, 22 bp, Homo sapiens
ctgagaggggaccagggtgttt

SEQ ID NO: 8106241 - DNA, 22 bp, Homo sapiens
ctgagagtaattttctacttga

SEQ ID NO: 8106242 - DNA, 22 bp, Homo sapiens
ctgagaggtgctggtggctgca

SEQ ID NO: 8106243 - DNA, 22 bp, Homo sapiens
ctgagaggtgctggtggctgca

SEQ ID NO: 8106244 - DNA, 22 bp, Homo sapiens
ctgagagtagctggagaacatt

SEQ ID NO: 8106245 - DNA, 22 bp, Homo sapiens
ctgagagtattggcaggcttgg

SEQ ID NO: 8106246 - DNA, 22 bp, Homo sapiens
ctgagagtattggcaggcttgg

SEQ ID NO: 8106247 - DNA, 22 bp, Homo sapiens
ctgagccttgatgtcccttgtc

SEQ ID NO: 8106248 - DNA, 23 bp, Homo sapiens
ctgagcaaagggggaagctgctt

SEQ ID NO: 8106249 - DNA, 22 bp, Homo sapiens
ctgagatctttatacgaggcac

SEQ ID NO: 8106250 - DNA, 22 bp, Homo sapiens
ctgagagttcgttccaccctcc

SEQ ID NO: 8106251 - DNA, 22 bp, Homo sapiens
ttttctctatattgtctgtgaa

SEQ ID NO: 8106252 - DNA, 22 bp, Homo sapiens
ttttctctacaaaataaccagc

SEQ ID NO: 8106253 - DNA, 22 bp, Homo sapiens
ttttctccccagagaccatcat

SEQ ID NO: 8106254 - DNA, 22 bp, Homo sapiens
ttttctccagggaacaaggtga

SEQ ID NO: 8106255 - DNA, 22 bp, Homo sapiens
ttttctcctaagacccttcacc

SEQ ID NO: 8106256 - DNA, 22 bp, Homo sapiens
ttttctctccaggtggggtgat

SEQ ID NO: 8106257 - DNA, 22 bp, Homo sapiens
ctgaagcaaaggatcgagctaa

SEQ ID NO: 8106258 - DNA, 22 bp, Homo sapiens
tttttcttgtgctggatctaat

SEQ ID NO: 8106259 - DNA, 22 bp, Homo sapiens
tttttcttaaatgtgggttggc

SEQ ID NO: 8106260 - DNA, 22 bp, Homo sapiens
ctgaaagaataagatgtttaca

SEQ ID NO: 8106261 - DNA, 22 bp, Homo sapiens
gactctttcaaacagaaagcca

SEQ ID NO: 8106262 - DNA, 22 bp, Homo sapiens
gactctttccctgtgacagagt

SEQ ID NO: 8106263 - DNA, 22 bp, Homo sapiens
gactccagtgattgtcctgtct

SEQ ID NO: 8106264 - DNA, 22 bp, Homo sapiens
gactccagggattggaagatgt

SEQ ID NO: 8106265 - DNA, 22 bp, Homo sapiens
gacagaggagaagatgctgtgg

SEQ ID NO: 8106266 - DNA, 22 bp, Homo sapiens
gacagcagagcagactaatgga

SEQ ID NO: 8106267 - DNA, 22 bp, Homo sapiens
gacagcagacagcctggcccct

SEQ ID NO: 8106268 - DNA, 22 bp, Homo sapiens
gagaaagcttcagaaatggcct

SEQ ID NO: 8106269 - DNA, 22 bp, Homo sapiens
gagagaaaggcttgcaggctgt

SEQ ID NO: 8106270 - DNA, 22 bp, Homo sapiens
gagagaaaggataacagctcaa

SEQ ID NO: 8106271 - DNA, 22 bp, Homo sapiens
gagactgaggtcaccaggctgt

SEQ ID NO: 8106272 - DNA, 22 bp, Homo sapiens
gagactgatggggctcccagaa

SEQ ID NO: 8106273 - DNA, 22 bp, Homo sapiens
gagagggcaaggtagatgctac

SEQ ID NO: 8106274 - DNA, 22 bp, Homo sapiens
gagagggccgggggccagctcc

SEQ ID NO: 8106275 - DNA, 22 bp, Homo sapiens
gaagggtgtgtgtgagggacac

SEQ ID NO: 8106276 - DNA, 22 bp, Homo sapiens
gaagggtgcatggagggaagtc

SEQ ID NO: 8106277 - DNA, 18 bp, Homo sapiens
gaagggagctggaatgca

SEQ ID NO: 8106278 - DNA, 22 bp, Homo sapiens
gaaggggactggcagctgcaga

SEQ ID NO: 8106279 - DNA, 22 bp, Homo sapiens
gaagggggaaaatgacaacaga

SEQ ID NO: 8106280 - DNA, 19 bp, Homo sapiens
gaaggggaaggtgggtacc

SEQ ID NO: 8106281 - DNA, 22 bp, Homo sapiens
gacagacaggggttctcctgga

SEQ ID NO: 8106282 - DNA, 22 bp, Homo sapiens
gaatgaataggtgtccagatgg

SEQ ID NO: 8106283 - DNA, 22 bp, Homo sapiens
gaatgaacaaggatgttcatcc

SEQ ID NO: 8106284 - DNA, 22 bp, Homo sapiens
gaaaggaaatattctaagcact

SEQ ID NO: 8106285 - DNA, 22 bp, Homo sapiens
gaaaggaagaaaggtcatttta

SEQ ID NO: 8106286 - DNA, 22 bp, Homo sapiens
gaaaggaaattgagggacgcat

SEQ ID NO: 8106287 - DNA, 22 bp, Homo sapiens
gaaaggaacttgtgagtgggag

SEQ ID NO: 8106288 - DNA, 22 bp, Homo sapiens
gaaaggagagggttaaggagct

SEQ ID NO: 8106289 - DNA, 22 bp, Homo sapiens
gaaaggagggaaacagagcggt

SEQ ID NO: 8106290 - DNA, 22 bp, Homo sapiens
gaaaggagtgaatatttgtgac

SEQ ID NO: 8106291 - DNA, 22 bp, Homo sapiens
gaaaggagtcagtcttactgaa

SEQ ID NO: 8106292 - DNA, 20 bp, Homo sapiens
gaaaggagtgtccctgtgag

SEQ ID NO: 8106293 - DNA, 22 bp, Homo sapiens
gaagcagctggtgagatggagc

SEQ ID NO: 8106294 - DNA, 22 bp, Homo sapiens
gaagccaagccagctgatggag

SEQ ID NO: 8106295 - DNA, 22 bp, Homo sapiens
gaagcaaagagctagtgccgct

SEQ ID NO: 8106296 - DNA, 22 bp, Homo sapiens
gaagcaaaatgtctgcacatat

SEQ ID NO: 8106297 - DNA, 22 bp, Homo sapiens
gaagggagaaggttgggtgacg

SEQ ID NO: 8106298 - DNA, 22 bp, Homo sapiens
gaaggcccagtcaaggggctag

SEQ ID NO: 8106299 - DNA, 22 bp, Homo sapiens
gaaggcagtaaatggctgtttt

SEQ ID NO: 8106300 - DNA, 22 bp, Homo sapiens
gaagccaagtgcaaatgcctta

SEQ ID NO: 8106301 - DNA, 22 bp, Homo sapiens
gagggctgatgttgccacctca

SEQ ID NO: 8106302 - DNA, 22 bp, Homo sapiens
gaggggctggcacgatggctgc

SEQ ID NO: 8106303 - DNA, 22 bp, Homo sapiens
gagggcttccatggggagcccc

SEQ ID NO: 8106304 - DNA, 22 bp, Homo sapiens
gagggctgtgaaggagcgggtt

SEQ ID NO: 8106305 - DNA, 22 bp, Homo sapiens
gagggctgtggggcatgaccag

SEQ ID NO: 8106306 - DNA, 22 bp, Homo sapiens
gagggctggggcttaggcttag

SEQ ID NO: 8106307 - DNA, 22 bp, Homo sapiens
gagggaggcatcatgaatccag

SEQ ID NO: 8106308 - DNA, 22 bp, Homo sapiens
gagggagccgccacagactggg

SEQ ID NO: 8106309 - DNA, 22 bp, Homo sapiens
gagggagagtgatggaccattg

SEQ ID NO: 8106310 - DNA, 22 bp, Homo sapiens
gagggaggggagctccaccctc

SEQ ID NO: 8106311 - DNA, 22 bp, Homo sapiens
gagggagggccaggtcccaacc

SEQ ID NO: 8106312 - DNA, 22 bp, Homo sapiens
gagggagggactagcattctct

SEQ ID NO: 8106313 - DNA, 22 bp, Homo sapiens
gagggagggactagcattctct

SEQ ID NO: 8106314 - DNA, 22 bp, Homo sapiens
gaggcagtgcattgtctagggg

SEQ ID NO: 8106315 - DNA, 22 bp, Homo sapiens
gaggcagtccagtgggtaagaa

SEQ ID NO: 8106316 - DNA, 19 bp, Homo sapiens
gaggcagtagtcaaagctt

SEQ ID NO: 8106317 - DNA, 22 bp, Homo sapiens
gaggcagtgtcggtggcaggat

SEQ ID NO: 8106318 - DNA, 22 bp, Homo sapiens
gaggcagtgtttactgccctgt

SEQ ID NO: 8106319 - DNA, 22 bp, Homo sapiens
gaggcataaatcacagtgttca

SEQ ID NO: 8106320 - DNA, 22 bp, Homo sapiens
gaggagcccccactgggctcac

SEQ ID NO: 8106321 - DNA, 22 bp, Homo sapiens
gaggagcccagcaccatcactt

SEQ ID NO: 8106322 - DNA, 22 bp, Homo sapiens
gaggagcccagcaccatcactt

SEQ ID NO: 8106323 - DNA, 22 bp, Homo sapiens
gaggcaggaggattgcttgagc

SEQ ID NO: 8106324 - DNA, 22 bp, Homo sapiens
gaggcaggcagattgcttgagg

SEQ ID NO: 8106325 - DNA, 22 bp, Homo sapiens
gaggagcacatgaggctgaggg

SEQ ID NO: 8106326 - DNA, 22 bp, Homo sapiens
gaggagccaggaggtctccctg

SEQ ID NO: 8106327 - DNA, 22 bp, Homo sapiens
gaggagcatgggaaggctctgg

SEQ ID NO: 8106328 - DNA, 22 bp, Homo sapiens
gaggagaggctggacgcggtga

SEQ ID NO: 8106329 - DNA, 22 bp, Homo sapiens
gagcagtggtctgatcttctaa

SEQ ID NO: 8106330 - DNA, 22 bp, Homo sapiens
gagagggctgcctggtgtgagg

SEQ ID NO: 8106331 - DNA, 22 bp, Homo sapiens
gagaggggacctgtgtgtctag

SEQ ID NO: 8106332 - DNA, 22 bp, Homo sapiens
gagaggggcgcgcagctcgcga

SEQ ID NO: 8106333 - DNA, 22 bp, Homo sapiens
gagcagtgatgggaggacgtca

SEQ ID NO: 8106334 - DNA, 20 bp, Homo sapiens
gagcagtgagccagggaaag

SEQ ID NO: 8106335 - DNA, 22 bp, Homo sapiens
gagccctgaacaacagcaggaa

SEQ ID NO: 8106336 - DNA, 22 bp, Homo sapiens
gagcccagtctgctcctgcgcc

SEQ ID NO: 8106337 - DNA, 22 bp, Homo sapiens
gagcccaggttctgcttccagc

SEQ ID NO: 8106338 - DNA, 22 bp, Homo sapiens
gagcccaggatggtgtatggct

SEQ ID NO: 8106339 - DNA, 22 bp, Homo sapiens
gagcccagctgcggccctcagc

SEQ ID NO: 8106340 - DNA, 22 bp, Homo sapiens
gagcccagctgtccttggcaaa

SEQ ID NO: 8106341 - DNA, 22 bp, Homo sapiens
gagccctgttcaggcctcctca

SEQ ID NO: 8106342 - DNA, 22 bp, Homo sapiens
gagctgagatttgaagcaagtt

SEQ ID NO: 8106343 - DNA, 22 bp, Homo sapiens
gagctgaggctcaggctggcgt

SEQ ID NO: 8106344 - DNA, 23 bp, Homo sapiens
gagctgagtgtagggagactagg

SEQ ID NO: 8106345 - DNA, 22 bp, Homo sapiens
gaggaaaatgggacaggctgta

SEQ ID NO: 8106346 - DNA, 22 bp, Homo sapiens
gaggaagaagcaaaccagctaa

SEQ ID NO: 8106347 - DNA, 22 bp, Homo sapiens
gaggaacctcctgaaaagtata

SEQ ID NO: 8106348 - DNA, 22 bp, Homo sapiens
gaggaacctgggcttccatcct

SEQ ID NO: 8106349 - DNA, 22 bp, Homo sapiens
gaggaacctatgatttagagca

SEQ ID NO: 8106350 - DNA, 22 bp, Homo sapiens
gaggaacccagctggggttgcc

SEQ ID NO: 8106351 - DNA, 20 bp, Homo sapiens
gaggaaccactgggaggaga

SEQ ID NO: 8106352 - DNA, 22 bp, Homo sapiens
gaggaacccaagctcaccgtca

SEQ ID NO: 8106353 - DNA, 22 bp, Homo sapiens
gaggaaccactctgagaagcca

SEQ ID NO: 8106354 - DNA, 22 bp, Homo sapiens
gaggaaccaatctgtgatattc

SEQ ID NO: 8106355 - DNA, 22 bp, Homo sapiens
gaggaaccaccttgggtaggct

SEQ ID NO: 8106356 - DNA, 22 bp, Homo sapiens
gaggaaccaaatcagcttgcac

SEQ ID NO: 8106357 - DNA, 23 bp, Homo sapiens
ctgtgctgggtcccatcttgggc

SEQ ID NO: 8106358 - DNA, 22 bp, Homo sapiens
ctgtgctggagatgggccagag

SEQ ID NO: 8106359 - DNA, 22 bp, Homo sapiens
ctgtctgtggagcttctgatgt

SEQ ID NO: 8106360 - DNA, 22 bp, Homo sapiens
ctgtgccctgtggctggcacct

SEQ ID NO: 8106361 - DNA, 22 bp, Homo sapiens
ctgtgccctttcgctgcactgt

SEQ ID NO: 8106362 - DNA, 22 bp, Homo sapiens
ctgtgctgattcagcacaggcc

SEQ ID NO: 8106363 - DNA, 22 bp, Homo sapiens
ctgtctggtgtccctgtctaca

SEQ ID NO: 8106364 - DNA, 22 bp, Homo sapiens
ctgtctgtcaagttcatctcca

SEQ ID NO: 8106365 - DNA, 22 bp, Homo sapiens
ctgtcaaatggaaacttatcct

SEQ ID NO: 8106366 - DNA, 22 bp, Homo sapiens
ctgtcaaattcataacacttat

SEQ ID NO: 8106367 - DNA, 22 bp, Homo sapiens
ctgtatttgaaagaaaagattt

SEQ ID NO: 8106368 - DNA, 22 bp, Homo sapiens
ctgtccttgctggccaggtatg

SEQ ID NO: 8106369 - DNA, 22 bp, Homo sapiens
ctggtgagactcagggatgctt

SEQ ID NO: 8106370 - DNA, 22 bp, Homo sapiens
ctggtgccattctgtggcctag

SEQ ID NO: 8106371 - DNA, 22 bp, Homo sapiens
ctggtcagagcaactgctcaca

SEQ ID NO: 8106372 - DNA, 23 bp, Homo sapiens
ctggtcagaggctgctggaaggg

SEQ ID NO: 8106373 - DNA, 22 bp, Homo sapiens
ctggtcaggaaggtggggacag

SEQ ID NO: 8106374 - DNA, 22 bp, Homo sapiens
ctggtctgaaaaggaggcatgc

SEQ ID NO: 8106375 - DNA, 20 bp, Homo sapiens
ctggggagcctcgcggtggc

SEQ ID NO: 8106376 - DNA, 22 bp, Homo sapiens
ctggtctgcgggaaggcgtggg

SEQ ID NO: 8106377 - DNA, 22 bp, Homo sapiens
ctggtctgctagaaagatgcat

SEQ ID NO: 8106378 - DNA, 19 bp, Homo sapiens
ctggtctgctgcttccagg

SEQ ID NO: 8106379 - DNA, 22 bp, Homo sapiens
ctggtctgaggttgcccttgaa

SEQ ID NO: 8106380 - DNA, 22 bp, Homo sapiens
ctggtctgagggctcttgaggc

SEQ ID NO: 8106381 - DNA, 20 bp, Homo sapiens
ctggtctgccactcacagtt

SEQ ID NO: 8106382 - DNA, 22 bp, Homo sapiens
ctggtctgcaaggccatataga

SEQ ID NO: 8106383 - DNA, 22 bp, Homo sapiens
ctggtctgccacccacacccct

SEQ ID NO: 8106384 - DNA, 22 bp, Homo sapiens
ctggtctgtggtattttattat

SEQ ID NO: 8106385 - DNA, 22 bp, Homo sapiens
ctggtctgtccgcaggtcacct

SEQ ID NO: 8106386 - DNA, 19 bp, Homo sapiens
ctggtctgtcatgctcccc

SEQ ID NO: 8106387 - DNA, 22 bp, Homo sapiens
ctggtctggctagtttaggcca

SEQ ID NO: 8106388 - DNA, 22 bp, Homo sapiens
ctggtctgggatgagggatgta

SEQ ID NO: 8106389 - DNA, 22 bp, Homo sapiens
ctggtctggtttgtttagacag

SEQ ID NO: 8106390 - DNA, 22 bp, Homo sapiens
ctggtctggctacccagcgaat

SEQ ID NO: 8106391 - DNA, 21 bp, Homo sapiens
ctggtctggccaataaggtcc

SEQ ID NO: 8106392 - DNA, 22 bp, Homo sapiens
ctggggaaggcggtgactgcgc

SEQ ID NO: 8106393 - DNA, 22 bp, Homo sapiens
ctggggaatagagctggagacc

SEQ ID NO: 8106394 - DNA, 22 bp, Homo sapiens
ctgcttatggagatgagtaaga

SEQ ID NO: 8106395 - DNA, 22 bp, Homo sapiens
ctgctgtgtggattcaatggct

SEQ ID NO: 8106396 - DNA, 22 bp, Homo sapiens
ctgctgtgttcctcctgcatct

SEQ ID NO: 8106397 - DNA, 21 bp, Homo sapiens
ctgcttcctctcttcatggca

SEQ ID NO: 8106398 - DNA, 22 bp, Homo sapiens
ctgggaagaagggacaacagcg

SEQ ID NO: 8106399 - DNA, 22 bp, Homo sapiens
ctgggaagaagtgggctacatt

SEQ ID NO: 8106400 - DNA, 22 bp, Homo sapiens
ctgggacctcctcactgttcta

SEQ ID NO: 8106401 - DNA, 22 bp, Homo sapiens
ctgggactgccattcacagcca

SEQ ID NO: 8106402 - DNA, 22 bp, Homo sapiens
ctgggacagttcaggtagggca

SEQ ID NO: 8106403 - DNA, 22 bp, Homo sapiens
ctgggagatatgaggatctgga

SEQ ID NO: 8106404 - DNA, 22 bp, Homo sapiens
ctgggagaggtggtgggaagta

SEQ ID NO: 8106405 - DNA, 22 bp, Homo sapiens
ctgggagaggtggtgggaagta

SEQ ID NO: 8106406 - DNA, 22 bp, Homo sapiens
ctgggagatgactcagagcagg

SEQ ID NO: 8106407 - DNA, 22 bp, Homo sapiens
ctgggagatctcctgagggcag

SEQ ID NO: 8106408 - DNA, 22 bp, Homo sapiens
ctgggagattgaggccatggtg

SEQ ID NO: 8106409 - DNA, 22 bp, Homo sapiens
ctgggagattcaggtgaagttt

SEQ ID NO: 8106410 - DNA, 22 bp, Homo sapiens
ctgggagattgctagagatgca

SEQ ID NO: 8106411 - DNA, 22 bp, Homo sapiens
ctgggcagagtccggaagatgg

SEQ ID NO: 8106412 - DNA, 22 bp, Homo sapiens
ctgggcagagtccggaagatgg

SEQ ID NO: 8106413 - DNA, 22 bp, Homo sapiens
ctgggcagaattttaggatggc

SEQ ID NO: 8106414 - DNA, 22 bp, Homo sapiens
ctgggcactgcagggtgttgag

SEQ ID NO: 8106415 - DNA, 22 bp, Homo sapiens
ctgggagcggctgtcactggtt

SEQ ID NO: 8106416 - DNA, 22 bp, Homo sapiens
ctgggagcaagaggctgcaaat

SEQ ID NO: 8106417 - DNA, 22 bp, Homo sapiens
ctgggagcaccatacttgtttc

SEQ ID NO: 8106418 - DNA, 22 bp, Homo sapiens
ctgggagccctgactagcctgg

SEQ ID NO: 8106419 - DNA, 22 bp, Homo sapiens
ctgggcgtgtcttccagctggc

SEQ ID NO: 8106420 - DNA, 22 bp, Homo sapiens
ctgggccttgccttgcccacag

SEQ ID NO: 8106421 - DNA, 22 bp, Homo sapiens
ctgggccttggattgacactgt

SEQ ID NO: 8106422 - DNA, 22 bp, Homo sapiens
ctgggcctttacctacggagtt

SEQ ID NO: 8106423 - DNA, 22 bp, Homo sapiens
ctgggcctttgggagttcggtg

SEQ ID NO: 8106424 - DNA, 18 bp, Homo sapiens
ctgggcctttgtattttt

SEQ ID NO: 8106425 - DNA, 22 bp, Homo sapiens
ctgggctggataattctttgct

SEQ ID NO: 8106426 - DNA, 22 bp, Homo sapiens
ctgggcctcctctgcccaagct

SEQ ID NO: 8106427 - DNA, 17 bp, Homo sapiens
ctgggcctcccctgtcc

SEQ ID NO: 8106428 - DNA, 17 bp, Homo sapiens
ctgggcctcccctgtcc

SEQ ID NO: 8106429 - DNA, 22 bp, Homo sapiens
ctgggccttagggcactccctt

SEQ ID NO: 8106430 - DNA, 22 bp, Homo sapiens
ctgggcctgtgggcacacggac

SEQ ID NO: 8106431 - DNA, 22 bp, Homo sapiens
ctgggcctgtccctgattgagg

SEQ ID NO: 8106432 - DNA, 22 bp, Homo sapiens
ctgggcctgtcagggctttttg

SEQ ID NO: 8106433 - DNA, 22 bp, Homo sapiens
ctgggccttgcatcccagagcc

SEQ ID NO: 8106434 - DNA, 22 bp, Homo sapiens
ctgggccttgcatcccagagcc

SEQ ID NO: 8106435 - DNA, 22 bp, Homo sapiens
ctgggccttcattgctctccca

SEQ ID NO: 8106436 - DNA, 22 bp, Homo sapiens
ctgggccttgagaatcatgttt

SEQ ID NO: 8106437 - DNA, 22 bp, Homo sapiens
ctgggccttcattgctctccca

SEQ ID NO: 8106438 - DNA, 22 bp, Homo sapiens
ctgggccttatgagtacctgga

SEQ ID NO: 8106439 - DNA, 19 bp, Homo sapiens
ctgtttctgagcttgcttt

SEQ ID NO: 8106440 - DNA, 22 bp, Homo sapiens
ctgtggaaggtttagataggta

SEQ ID NO: 8106441 - DNA, 22 bp, Homo sapiens
ctgttttatctcaagagttcaa

SEQ ID NO: 8106442 - DNA, 22 bp, Homo sapiens
ctgttttaatggagactgatgt

SEQ ID NO: 8106443 - DNA, 22 bp, Homo sapiens
cttaaattttcatctacaagaa

SEQ ID NO: 8106444 - DNA, 22 bp, Homo sapiens
cttaatttcaaactgctagtga

SEQ ID NO: 8106445 - DNA, 22 bp, Homo sapiens
cttacaaaggagaggagatagg

SEQ ID NO: 8106446 - DNA, 22 bp, Homo sapiens
cttacaaatacacttaggagag

SEQ ID NO: 8106447 - DNA, 22 bp, Homo sapiens
cttacatactgagaaaatatcc

SEQ ID NO: 8106448 - DNA, 22 bp, Homo sapiens
cttacattgtctcttgctgagc

SEQ ID NO: 8106449 - DNA, 22 bp, Homo sapiens
cttacatactgagaaaatatcc

SEQ ID NO: 8106450 - DNA, 22 bp, Homo sapiens
cttacatatgcaagacaaaggg

SEQ ID NO: 8106451 - DNA, 22 bp, Homo sapiens
cttacaagcaaaacaactgtag

SEQ ID NO: 8106452 - DNA, 22 bp, Homo sapiens
cttacacttcatctcatccagg

SEQ ID NO: 8106453 - DNA, 22 bp, Homo sapiens
cttacagtgaccctgcagattt

SEQ ID NO: 8106454 - DNA, 22 bp, Homo sapiens
cttacattgtgtgcatgagggg

SEQ ID NO: 8106455 - DNA, 19 bp, Homo sapiens
cttcattcttcagcttttg

SEQ ID NO: 8106456 - DNA, 22 bp, Homo sapiens
cttatacataaaatgggtgtag

SEQ ID NO: 8106457 - DNA, 22 bp, Homo sapiens
cttatacagatcaagggaaaag

SEQ ID NO: 8106458 - DNA, 19 bp, Homo sapiens
cttatacagattttctcat

SEQ ID NO: 8106459 - DNA, 22 bp, Homo sapiens
cttatatttgtcaactttacaa

SEQ ID NO: 8106460 - DNA, 22 bp, Homo sapiens
cttccaaatgtaaataagtttc

SEQ ID NO: 8106461 - DNA, 22 bp, Homo sapiens
cttcatttccatccaactggga

SEQ ID NO: 8106462 - DNA, 22 bp, Homo sapiens
cttatacacgaacacaaggtgt

SEQ ID NO: 8106463 - DNA, 22 bp, Homo sapiens
cttatacaccctcttcccaggc

SEQ ID NO: 8106464 - DNA, 22 bp, Homo sapiens
cttaggaacgctctgcctagtg

SEQ ID NO: 8106465 - DNA, 22 bp, Homo sapiens
cttctcttggtagttcttgttg

SEQ ID NO: 8106466 - DNA, 22 bp, Homo sapiens
cttctacacatccctcttgctt

SEQ ID NO: 8106467 - DNA, 22 bp, Homo sapiens
cttccagctgattggcatccag

SEQ ID NO: 8106468 - DNA, 22 bp, Homo sapiens
cttcgatttaattcttaacctt

SEQ ID NO: 8106469 - DNA, 22 bp, Homo sapiens
cttttcttgtattggatgcccc

SEQ ID NO: 8106470 - DNA, 22 bp, Homo sapiens
cttttgcagccattattgctgc

SEQ ID NO: 8106471 - DNA, 22 bp, Homo sapiens
gaaaatttagaactgaacttct

SEQ ID NO: 8106472 - DNA, 22 bp, Homo sapiens
gaaaatttagaactgaacttct

SEQ ID NO: 8106473 - DNA, 22 bp, Homo sapiens
gaaaatttaattctcttctgtg

SEQ ID NO: 8106474 - DNA, 22 bp, Homo sapiens
gaaaattattgaaaatggctct

SEQ ID NO: 8106475 - DNA, 22 bp, Homo sapiens
gaaacaactactattgatttct

SEQ ID NO: 8106476 - DNA, 22 bp, Homo sapiens
gaaaatttctgccacatgtgtg

SEQ ID NO: 8106477 - DNA, 22 bp, Homo sapiens
gaaacaatacttgtcctcacta

SEQ ID NO: 8106478 - DNA, 19 bp, Homo sapiens
gaaacaagtcattccagag

SEQ ID NO: 8106479 - DNA, 22 bp, Homo sapiens
gaaagccatctggctgctggga

SEQ ID NO: 8106480 - DNA, 22 bp, Homo sapiens
gaaacactcaatttagtaattc

SEQ ID NO: 8106481 - DNA, 22 bp, Homo sapiens
cttttccactgagcctcacaaa

SEQ ID NO: 8106482 - DNA, 22 bp, Homo sapiens
ctttgcaaaagttaattgttga

SEQ ID NO: 8106483 - DNA, 22 bp, Homo sapiens
ctttgattccaggcacatgttt

SEQ ID NO: 8106484 - DNA, 22 bp, Homo sapiens
ctttgcaagtgctttgtagtcc

SEQ ID NO: 8106485 - DNA, 21 bp, Homo sapiens
ctttgcaagatgtctatgaaa

SEQ ID NO: 8106486 - DNA, 22 bp, Homo sapiens
cttttcttactcccgcaaggca

SEQ ID NO: 8106487 - DNA, 22 bp, Homo sapiens
cttttcttatgtggacgtacct

SEQ ID NO: 8106488 - DNA, 22 bp, Homo sapiens
cttttcttctcacggctgtcag

SEQ ID NO: 8106489 - DNA, 22 bp, Homo sapiens
cttttcttgtattggatgcccc

SEQ ID NO: 8106490 - DNA, 22 bp, Homo sapiens
cttttcctattgattctgttac

SEQ ID NO: 8106491 - DNA, 22 bp, Homo sapiens
ctttaacagttccattcaattt

SEQ ID NO: 8106492 - DNA, 22 bp, Homo sapiens
ctttacaaagcaattttgtctc

SEQ ID NO: 8106493 - DNA, 22 bp, Homo sapiens
ctttacaaagcaattttgtctc

SEQ ID NO: 8106494 - DNA, 22 bp, Homo sapiens
ctttctcttcagcacccagccc

SEQ ID NO: 8106495 - DNA, 22 bp, Homo sapiens
ctttctttgtccaccaacaatg

SEQ ID NO: 8106496 - DNA, 22 bp, Homo sapiens
ctttctcttcgaaaacctgccc

SEQ ID NO: 8106497 - DNA, 22 bp, Homo sapiens
ctttctttgcagtgagccagag

SEQ ID NO: 8106498 - DNA, 22 bp, Homo sapiens
ctttgaaaacttaaataacagc

SEQ ID NO: 8106499 - DNA, 22 bp, Homo sapiens
ctttgatctactcactaaacaa

SEQ ID NO: 8106500 - DNA, 22 bp, Homo sapiens
ctttgaattgccgtttcatctg

SEQ ID NO: 8106501 - DNA, 22 bp, Homo sapiens
ctttgaaaacttaaataacagc

SEQ ID NO: 8106502 - DNA, 22 bp, Homo sapiens
ctttaaataatacaaggtccag

SEQ ID NO: 8106503 - DNA, 22 bp, Homo sapiens
cttctggcaatcccagggtctt

SEQ ID NO: 8106504 - DNA, 22 bp, Homo sapiens
tgagcagtaggtctgaatagtg

SEQ ID NO: 8106505 - DNA, 22 bp, Homo sapiens
tgagcagagacttcaagggcag

SEQ ID NO: 8106506 - DNA, 22 bp, Homo sapiens
ccagtcagtcagttgctggcat

SEQ ID NO: 8106507 - DNA, 22 bp, Homo sapiens
tgagcccagagatctgagctat

SEQ ID NO: 8106508 - DNA, 22 bp, Homo sapiens
tgagcccaggagttggagaccg

SEQ ID NO: 8106509 - DNA, 22 bp, Homo sapiens
tgagcccagaagcccactcggc

SEQ ID NO: 8106510 - DNA, 22 bp, Homo sapiens
tgagccagttcttcagatccat

SEQ ID NO: 8106511 - DNA, 22 bp, Homo sapiens
ccagtcccagctctgccatgct

SEQ ID NO: 8106512 - DNA, 22 bp, Homo sapiens
ccagtgccttttgtgggtttgt

SEQ ID NO: 8106513 - DNA, 22 bp, Homo sapiens
ccagtgcgcaggcgccacctgt

SEQ ID NO: 8106514 - DNA, 22 bp, Homo sapiens
ccatcccttcaccacagcagta

SEQ ID NO: 8106515 - DNA, 22 bp, Homo sapiens
ccatcccttctctggccagcag

SEQ ID NO: 8106516 - DNA, 22 bp, Homo sapiens
ccatccctgggccatgtcccct

SEQ ID NO: 8106517 - DNA, 22 bp, Homo sapiens
tgagtcagtctgccctggcttc

SEQ ID NO: 8106518 - DNA, 22 bp, Homo sapiens
tgagtcagccagagctgccatg

SEQ ID NO: 8106519 - DNA, 22 bp, Homo sapiens
ccatcctgcaggacctccatat

SEQ ID NO: 8106520 - DNA, 22 bp, Homo sapiens
tgaggccatggaactagcttgg

SEQ ID NO: 8106521 - DNA, 22 bp, Homo sapiens
tgaggccagtctcatcacaggc

SEQ ID NO: 8106522 - DNA, 22 bp, Homo sapiens
tgaggcccatctgagattttga

SEQ ID NO: 8106523 - DNA, 22 bp, Homo sapiens
tgaggccccgaagctgaggttt

SEQ ID NO: 8106524 - DNA, 18 bp, Homo sapiens
tgaggcccatctctctga

SEQ ID NO: 8106525 - DNA, 22 bp, Homo sapiens
tgaggcccaccttggccccggc

SEQ ID NO: 8106526 - DNA, 22 bp, Homo sapiens
tgaggcccagccgccctgagag

SEQ ID NO: 8106527 - DNA, 20 bp, Homo sapiens
tgaggcccagcagagtcggg

SEQ ID NO: 8106528 - DNA, 22 bp, Homo sapiens
ccatcagttttatctgacaaaa

SEQ ID NO: 8106529 - DNA, 22 bp, Homo sapiens
ccatcagtggcaaataaacacc

SEQ ID NO: 8106530 - DNA, 19 bp, Homo sapiens
ccatataaccagcaagtgt

SEQ ID NO: 8106531 - DNA, 22 bp, Homo sapiens
cccagcagcttgcacagtgctg

SEQ ID NO: 8106532 - DNA, 22 bp, Homo sapiens
tgcaggagaaagtacggagcgt

SEQ ID NO: 8106533 - DNA, 22 bp, Homo sapiens
tgcaggactttcagtgctcaaa

SEQ ID NO: 8106534 - DNA, 22 bp, Homo sapiens
tgcagctgcctagggctggctt

SEQ ID NO: 8106535 - DNA, 22 bp, Homo sapiens
tgcactccaggctgggtgacag

SEQ ID NO: 8106536 - DNA, 22 bp, Homo sapiens
tgcaatatgttgcattgtatgg

SEQ ID NO: 8106537 - DNA, 23 bp, Homo sapiens
tgcaatatgtcagtgcaaagtgg

SEQ ID NO: 8106538 - DNA, 22 bp, Homo sapiens
tgcaataaagtgctataaatcc

SEQ ID NO: 8106539 - DNA, 22 bp, Homo sapiens
tgcacttcattgtaaattgtac

SEQ ID NO: 8106540 - DNA, 22 bp, Homo sapiens
tgcacttcaaaaatgtcactga

SEQ ID NO: 8106541 - DNA, 21 bp, Homo sapiens
tgcacttcagtggctaaattc

SEQ ID NO: 8106542 - DNA, 23 bp, Homo sapiens
tgcacttctccatagatgcatct

SEQ ID NO: 8106543 - DNA, 19 bp, Homo sapiens
tgcacttgagatgtttgta

SEQ ID NO: 8106544 - DNA, 22 bp, Homo sapiens
tgcacttgaggattttccacag

SEQ ID NO: 8106545 - DNA, 22 bp, Homo sapiens
tgcacttgtgttttcagaatct

SEQ ID NO: 8106546 - DNA, 22 bp, Homo sapiens
tgcactttgcaggcatggaaac

SEQ ID NO: 8106547 - DNA, 22 bp, Homo sapiens
tgcacttattgacatagaaaaa

SEQ ID NO: 8106548 - DNA, 22 bp, Homo sapiens
tgcagagagacccctgggccag

SEQ ID NO: 8106549 - DNA, 23 bp, Homo sapiens
cccagaggagcagggcgtgagat

SEQ ID NO: 8106550 - DNA, 22 bp, Homo sapiens
tcttgcacttcatgaatatgtt

SEQ ID NO: 8106551 - DNA, 22 bp, Homo sapiens
tcttgattttgtgaataagttg

SEQ ID NO: 8106552 - DNA, 22 bp, Homo sapiens
tcttgatttactctaatagctt

SEQ ID NO: 8106553 - DNA, 22 bp, Homo sapiens
tcttgatttattctacccagaa

SEQ ID NO: 8106554 - DNA, 22 bp, Homo sapiens
tcttttcttgcattattgcact

SEQ ID NO: 8106555 - DNA, 22 bp, Homo sapiens
tcttttcttgcattattgcact

SEQ ID NO: 8106556 - DNA, 22 bp, Homo sapiens
tcttttcttcttaatggttaat

SEQ ID NO: 8106557 - DNA, 22 bp, Homo sapiens
tcttttctgtaactcagtgtct

SEQ ID NO: 8106558 - DNA, 22 bp, Homo sapiens
tcttttctgccacagcctgagc

SEQ ID NO: 8106559 - DNA, 22 bp, Homo sapiens
tcttttctgccagctgagccct

SEQ ID NO: 8106560 - DNA, 22 bp, Homo sapiens
tcttttctggactctgcatgga

SEQ ID NO: 8106561 - DNA, 22 bp, Homo sapiens
tgaaacaatgtgaagttgctga

SEQ ID NO: 8106562 - DNA, 22 bp, Homo sapiens
tgaaacaattagaatgtaatga

SEQ ID NO: 8106563 - DNA, 21 bp, Homo sapiens
tgaaacaatcagacagagtct

SEQ ID NO: 8106564 - DNA, 22 bp, Homo sapiens
tgaaacaagatccacagacttg

SEQ ID NO: 8106565 - DNA, 22 bp, Homo sapiens
tcttttgtgattctttagttac

SEQ ID NO: 8106566 - DNA, 22 bp, Homo sapiens
tgaaacaaatttggaaaatcta

SEQ ID NO: 8106567 - DNA, 17 bp, Homo sapiens
ccagggaggggccgcgc

SEQ ID NO: 8106568 - DNA, 22 bp, Homo sapiens
ccagggcctcgtgttctgagtg

SEQ ID NO: 8106569 - DNA, 22 bp, Homo sapiens
tgaagtaggcagcatgctgaga

SEQ ID NO: 8106570 - DNA, 22 bp, Homo sapiens
tgaagtatacggaaattgtgga

SEQ ID NO: 8106571 - DNA, 22 bp, Homo sapiens
ccaggcagcctgctccattctg

SEQ ID NO: 8106572 - DNA, 22 bp, Homo sapiens
tcttctggatcgatcacattgt

SEQ ID NO: 8106573 - DNA, 22 bp, Homo sapiens
ccaggcagagggatccccatcc

SEQ ID NO: 8106574 - DNA, 22 bp, Homo sapiens
ccaggcagatgggccggcttca

SEQ ID NO: 8106575 - DNA, 22 bp, Homo sapiens
tcttacaccattcaaatatttt

SEQ ID NO: 8106576 - DNA, 22 bp, Homo sapiens
tcttacatatacgtcatttagt

SEQ ID NO: 8106577 - DNA, 20 bp, Homo sapiens
tcttacaatcgttacatcca

SEQ ID NO: 8106578 - DNA, 20 bp, Homo sapiens
tcttacaatcgttacatcca

SEQ ID NO: 8106579 - DNA, 22 bp, Homo sapiens
ccaggaggctcttgtccctggt

SEQ ID NO: 8106580 - DNA, 22 bp, Homo sapiens
tctgggctctgtcagcacctct

SEQ ID NO: 8106581 - DNA, 22 bp, Homo sapiens
ccagcactctattgaatattct

SEQ ID NO: 8106582 - DNA, 22 bp, Homo sapiens
ccaggagagcaaaggtcactct

SEQ ID NO: 8106583 - DNA, 22 bp, Homo sapiens
tctgggcttttgcactggccat

SEQ ID NO: 8106584 - DNA, 22 bp, Homo sapiens
tgggagagcactgcagccccgg

SEQ ID NO: 8106585 - DNA, 22 bp, Homo sapiens
tgggagagaattctggtgactg

SEQ ID NO: 8106586 - DNA, 22 bp, Homo sapiens
tgggacagattataagtctgca

SEQ ID NO: 8106587 - DNA, 22 bp, Homo sapiens
tgggcagaaatcagtatcagat

SEQ ID NO: 8106588 - DNA, 22 bp, Homo sapiens
tgggcagaatgtgggatccaga

SEQ ID NO: 8106589 - DNA, 22 bp, Homo sapiens
tgggcagaaggaagagccacct

SEQ ID NO: 8106590 - DNA, 22 bp, Homo sapiens
tgggcaggagagaagctaaaga

SEQ ID NO: 8106591 - DNA, 22 bp, Homo sapiens
tgggcagacgggagcttgcctt

SEQ ID NO: 8106592 - DNA, 22 bp, Homo sapiens
tgggcagactaaggtcaaagct

SEQ ID NO: 8106593 - DNA, 22 bp, Homo sapiens
tgggcagacgctgttggaaggc

SEQ ID NO: 8106594 - DNA, 22 bp, Homo sapiens
tgggcagacgctgttggaaggc

SEQ ID NO: 8106595 - DNA, 22 bp, Homo sapiens
tgggaaggcgtggaagtagaag

SEQ ID NO: 8106596 - DNA, 22 bp, Homo sapiens
cctcctggcctgtgcagagccc

SEQ ID NO: 8106597 - DNA, 22 bp, Homo sapiens
cctcctgggactcattagcacc

SEQ ID NO: 8106598 - DNA, 22 bp, Homo sapiens
cctcctgggccttgctctgtga

SEQ ID NO: 8106599 - DNA, 22 bp, Homo sapiens
cctccatgtaaaggtcccctca

SEQ ID NO: 8106600 - DNA, 23 bp, Homo sapiens
tggcattttagttagcttcagtg

SEQ ID NO: 8106601 - DNA, 22 bp, Homo sapiens
tggcattttgttcagtatatgg

SEQ ID NO: 8106602 - DNA, 22 bp, Homo sapiens
tggccaaatttggtgtaacttg

SEQ ID NO: 8106603 - DNA, 22 bp, Homo sapiens
cctccagctgcctcagtctctt

SEQ ID NO: 8106604 - DNA, 22 bp, Homo sapiens
tggcagtggtaccggctctcag

SEQ ID NO: 8106605 - DNA, 22 bp, Homo sapiens
tggcagtgggaagctggaagtc

SEQ ID NO: 8106606 - DNA, 23 bp, Homo sapiens
tggggagagttaccctggaagcg

SEQ ID NO: 8106607 - DNA, 22 bp, Homo sapiens
cctgcagctttgcctcctgaac

SEQ ID NO: 8106608 - DNA, 22 bp, Homo sapiens
tgggctcatgctggagatgaga

SEQ ID NO: 8106609 - DNA, 22 bp, Homo sapiens
tgggctcatggcccagcactgg

SEQ ID NO: 8106610 - DNA, 22 bp, Homo sapiens
tgggcctgggagggcagacgct

SEQ ID NO: 8106611 - DNA, 22 bp, Homo sapiens
tgggcctggccctgtggaggag

SEQ ID NO: 8106612 - DNA, 22 bp, Homo sapiens
tgggctccagcacctgtgctct

SEQ ID NO: 8106613 - DNA, 19 bp, Homo sapiens
tgggctcattcaggtggtt

SEQ ID NO: 8106614 - DNA, 22 bp, Homo sapiens
tgggctcatgtttctttgagga

SEQ ID NO: 8106615 - DNA, 22 bp, Homo sapiens
tgggctccgttgcctggggcag

SEQ ID NO: 8106616 - DNA, 22 bp, Homo sapiens
tgggctccggcggcctcaggct

SEQ ID NO: 8106617 - DNA, 22 bp, Homo sapiens
tgggcctggagccctggagagt

SEQ ID NO: 8106618 - DNA, 22 bp, Homo sapiens
tgggcctggagtttgtccagag

SEQ ID NO: 8106619 - DNA, 22 bp, Homo sapiens
tgggcctggacatctgtatttt

SEQ ID NO: 8106620 - DNA, 22 bp, Homo sapiens
tgggcctggagtttgtccagag

SEQ ID NO: 8106621 - DNA, 22 bp, Homo sapiens
tgggcctaggggagggacctca

SEQ ID NO: 8106622 - DNA, 22 bp, Homo sapiens
tgggcctatatatggctgagag

SEQ ID NO: 8106623 - DNA, 22 bp, Homo sapiens
tgggcctggacatctgtatttt

SEQ ID NO: 8106624 - DNA, 22 bp, Homo sapiens
cctgcctcatcaacttgtcgtg

SEQ ID NO: 8106625 - DNA, 22 bp, Homo sapiens
cctgcctcaggactctgcatat

SEQ ID NO: 8106626 - DNA, 22 bp, Homo sapiens
cctgccctgtgtttggggacta

SEQ ID NO: 8106627 - DNA, 22 bp, Homo sapiens
tggtacataaatggatgttttc

SEQ ID NO: 8106628 - DNA, 22 bp, Homo sapiens
cctgcccagcttcacctcaggc

SEQ ID NO: 8106629 - DNA, 22 bp, Homo sapiens
cctgcctgaaggtcagccaccc

SEQ ID NO: 8106630 - DNA, 23 bp, Homo sapiens
cctgcctccccatcagttataca

SEQ ID NO: 8106631 - DNA, 19 bp, Homo sapiens
cctgcctgagctgtccctc

SEQ ID NO: 8106632 - DNA, 22 bp, Homo sapiens
cctgcctgaaggtcagccaccc

SEQ ID NO: 8106633 - DNA, 22 bp, Homo sapiens
cctgcctgcaaaatgggacaag

SEQ ID NO: 8106634 - DNA, 19 bp, Homo sapiens
cctgcagggatgagaggtt

SEQ ID NO: 8106635 - DNA, 22 bp, Homo sapiens
cctgcaggtttcccccggacgg

SEQ ID NO: 8106636 - DNA, 22 bp, Homo sapiens
cctgccagaaaagagggagttc

SEQ ID NO: 8106637 - DNA, 22 bp, Homo sapiens
ccctccctgtgtgcctcatttg

SEQ ID NO: 8106638 - DNA, 22 bp, Homo sapiens
ccctccctttgtctttatgaac

SEQ ID NO: 8106639 - DNA, 22 bp, Homo sapiens
tggagacatgggcgaatctaag

SEQ ID NO: 8106640 - DNA, 22 bp, Homo sapiens
tggaggcattgtgactgctgaa

SEQ ID NO: 8106641 - DNA, 22 bp, Homo sapiens
tggaggccaaggcaggcggatc

SEQ ID NO: 8106642 - DNA, 22 bp, Homo sapiens
tggaggccaactttcctcatct

SEQ ID NO: 8106643 - DNA, 22 bp, Homo sapiens
tggaggagaactccctggctac

SEQ ID NO: 8106644 - DNA, 22 bp, Homo sapiens
tggcagagaacacacatgattc

SEQ ID NO: 8106645 - DNA, 22 bp, Homo sapiens
tggcagaatttctagcagattc

SEQ ID NO: 8106646 - DNA, 22 bp, Homo sapiens
tggcagaagttcactagtagct

SEQ ID NO: 8106647 - DNA, 22 bp, Homo sapiens
tggcagaaagaaccatgtgcaa

SEQ ID NO: 8106648 - DNA, 22 bp, Homo sapiens
tggcaggaaaaacattggagat

SEQ ID NO: 8106649 - DNA, 22 bp, Homo sapiens
ccctgggagtccactgatgtca

SEQ ID NO: 8106650 - DNA, 22 bp, Homo sapiens
ccctgggacccgctgcagaggc

SEQ ID NO: 8106651 - DNA, 22 bp, Homo sapiens
ccctgggagaagttgagggctg

SEQ ID NO: 8106652 - DNA, 22 bp, Homo sapiens
ccctgggagaagttgagggctg

SEQ ID NO: 8106653 - DNA, 22 bp, Homo sapiens
ccctgggagctgcctggctgac

SEQ ID NO: 8106654 - DNA, 22 bp, Homo sapiens
ccctgggaggcttccaggcaga

SEQ ID NO: 8106655 - DNA, 22 bp, Homo sapiens
ccctgggaagtattccagctat

SEQ ID NO: 8106656 - DNA, 22 bp, Homo sapiens
cccttgagcctggaggagctct

SEQ ID NO: 8106657 - DNA, 22 bp, Homo sapiens
ccctttaagtagaatatattat

SEQ ID NO: 8106658 - DNA, 22 bp, Homo sapiens
cccttggcaaagctccccagtc

SEQ ID NO: 8106659 - DNA, 22 bp, Homo sapiens
ccctcccggcgtgctgggctcg

SEQ ID NO: 8106660 - DNA, 22 bp, Homo sapiens
ccctccatgacgtcttcagccg

SEQ ID NO: 8106661 - DNA, 22 bp, Homo sapiens
tgcttgtcaggataagctctgg

SEQ ID NO: 8106662 - DNA, 22 bp, Homo sapiens
tgctgggggtgtctcaccaggc

SEQ ID NO: 8106663 - DNA, 22 bp, Homo sapiens
tgctgggggctttctggatacc

SEQ ID NO: 8106664 - DNA, 22 bp, Homo sapiens
tgctgggggtagctctgcgtag

SEQ ID NO: 8106665 - DNA, 22 bp, Homo sapiens
ccccagctgcatacttgccaag

SEQ ID NO: 8106666 - DNA, 22 bp, Homo sapiens
cccagtggcttttgcccaggtt

SEQ ID NO: 8106667 - DNA, 22 bp, Homo sapiens
tgctgggcactgtctaggtact

SEQ ID NO: 8106668 - DNA, 22 bp, Homo sapiens
cccagttgttgccggctctgga

SEQ ID NO: 8106669 - DNA, 22 bp, Homo sapiens
cccagtggcccagcatgtggtg

SEQ ID NO: 8106670 - DNA, 22 bp, Homo sapiens
cccagtgccaggcacaggcagc

SEQ ID NO: 8106671 - DNA, 22 bp, Homo sapiens
cccagtgctatgcctattacat

SEQ ID NO: 8106672 - DNA, 18 bp, Homo sapiens
cccagtgctcactgcctc

SEQ ID NO: 8106673 - DNA, 22 bp, Homo sapiens
tgctctggaatagtcctaggca

SEQ ID NO: 8106674 - DNA, 22 bp, Homo sapiens
tgctacagctgttcagtgccct

SEQ ID NO: 8106675 - DNA, 22 bp, Homo sapiens
tgctagtgtgtgagatgttcaa

SEQ ID NO: 8106676 - DNA, 22 bp, Homo sapiens
ccagaggatcagtactggctgg

SEQ ID NO: 8106677 - DNA, 22 bp, Homo sapiens
ccagagcctcaacacaggtcct

SEQ ID NO: 8106678 - DNA, 19 bp, Homo sapiens
ccagagcccgccagatggg

SEQ ID NO: 8106679 - DNA, 22 bp, Homo sapiens
ccagagcccctgagcttccctg

SEQ ID NO: 8106680 - DNA, 22 bp, Homo sapiens
ccagagccagagaggtgcctgc

SEQ ID NO: 8106681 - DNA, 18 bp, Homo sapiens
tctagaaacttctctcct

SEQ ID NO: 8106682 - DNA, 22 bp, Homo sapiens
tctagaacttctctaaaatgaa

SEQ ID NO: 8106683 - DNA, 22 bp, Homo sapiens
tcctgtgtgctttctttaggtt

SEQ ID NO: 8106684 - DNA, 22 bp, Homo sapiens
tctcagtgtgttttctctcaga

SEQ ID NO: 8106685 - DNA, 22 bp, Homo sapiens
tctcagtgtggtgcttaggata

SEQ ID NO: 8106686 - DNA, 22 bp, Homo sapiens
tctcagtggcttcctcactttt

SEQ ID NO: 8106687 - DNA, 23 bp, Homo sapiens
tctcagttccagaggctacaagt

SEQ ID NO: 8106688 - DNA, 22 bp, Homo sapiens
tctcagttctgccgcaagtatt

SEQ ID NO: 8106689 - DNA, 22 bp, Homo sapiens
tctcagtgttatctatctgcct

SEQ ID NO: 8106690 - DNA, 22 bp, Homo sapiens
tctcagtgttgttctgcagatg

SEQ ID NO: 8106691 - DNA, 22 bp, Homo sapiens
tctcagtgtttaaaaagatttc

SEQ ID NO: 8106692 - DNA, 23 bp, Homo sapiens
tctcaggcaaaccaggacaagtt

SEQ ID NO: 8106693 - DNA, 22 bp, Homo sapiens
tctcagagacctgaactccctg

SEQ ID NO: 8106694 - DNA, 22 bp, Homo sapiens
tctcagagaagtgatgagcaat

SEQ ID NO: 8106695 - DNA, 22 bp, Homo sapiens
tctataaattatgcagtctcag

SEQ ID NO: 8106696 - DNA, 22 bp, Homo sapiens
tctagaatctaaactatagttt

SEQ ID NO: 8106697 - DNA, 22 bp, Homo sapiens
tccatacacatttatttggcct

SEQ ID NO: 8106698 - DNA, 23 bp, Homo sapiens
tccataatcccagaaagctcaga

SEQ ID NO: 8106699 - DNA, 22 bp, Homo sapiens
tccataaaccagaaaatcaaga

SEQ ID NO: 8106700 - DNA, 22 bp, Homo sapiens
catttccactctgggagtcaga

SEQ ID NO: 8106701 - DNA, 22 bp, Homo sapiens
catttccacttctgaaaactgg

SEQ ID NO: 8106702 - DNA, 22 bp, Homo sapiens
catttcctgtctggaggtcaaa

SEQ ID NO: 8106703 - DNA, 22 bp, Homo sapiens
catttccagctcctgcatcatg

SEQ ID NO: 8106704 - DNA, 22 bp, Homo sapiens
tcctggctagttttgctgaaat

SEQ ID NO: 8106705 - DNA, 22 bp, Homo sapiens
tcctggccttgctcctgatgcc

SEQ ID NO: 8106706 - DNA, 22 bp, Homo sapiens
ccacagggcacagacaggaagc

SEQ ID NO: 8106707 - DNA, 22 bp, Homo sapiens
tcctgctccaccgtgggctgga

SEQ ID NO: 8106708 - DNA, 23 bp, Homo sapiens
tcctgctgaaagctccagctggc

SEQ ID NO: 8106709 - DNA, 22 bp, Homo sapiens
tcctgccttcatactgctgtat

SEQ ID NO: 8106710 - DNA, 22 bp, Homo sapiens
tcctgccttgcctgggacatca

SEQ ID NO: 8106711 - DNA, 22 bp, Homo sapiens
ccaagaggaccttgccagggca

SEQ ID NO: 8106712 - DNA, 22 bp, Homo sapiens
tcatacataacttgtacagtga

SEQ ID NO: 8106713 - DNA, 22 bp, Homo sapiens
tcatcaaagtcaaagaatgact

SEQ ID NO: 8106714 - DNA, 22 bp, Homo sapiens
tcatacaattcaatctctgatt

SEQ ID NO: 8106715 - DNA, 22 bp, Homo sapiens
tcatacaattcaatctctgatt

SEQ ID NO: 8106716 - DNA, 22 bp, Homo sapiens
tcatacaaggagggtgttcaaa

SEQ ID NO: 8106717 - DNA, 22 bp, Homo sapiens
tcatacaactaagagtttcaga

SEQ ID NO: 8106718 - DNA, 22 bp, Homo sapiens
tcatacaactaagagtttcaga

SEQ ID NO: 8106719 - DNA, 22 bp, Homo sapiens
catccctgtctgccactctgaa

SEQ ID NO: 8106720 - DNA, 22 bp, Homo sapiens
tcagtgtgaattcattttagat

SEQ ID NO: 8106721 - DNA, 22 bp, Homo sapiens
tcagtgtgcacgatacagattg

SEQ ID NO: 8106722 - DNA, 22 bp, Homo sapiens
catcatcacctgctatacgatc

SEQ ID NO: 8106723 - DNA, 22 bp, Homo sapiens
catcagtcagtctcttcagtat

SEQ ID NO: 8106724 - DNA, 22 bp, Homo sapiens
catcagctcttcattcttgatt

SEQ ID NO: 8106725 - DNA, 22 bp, Homo sapiens
cagtgtaagctctagactagaa

SEQ ID NO: 8106726 - DNA, 22 bp, Homo sapiens
tcacttcacacccactatcatg

SEQ ID NO: 8106727 - DNA, 22 bp, Homo sapiens
tcaggaggctcaagacctggca

SEQ ID NO: 8106728 - DNA, 22 bp, Homo sapiens
tcaggaggcgtctcgctggggc

SEQ ID NO: 8106729 - DNA, 22 bp, Homo sapiens
tcaggaggcgtgctggggtaca

SEQ ID NO: 8106730 - DNA, 21 bp, Homo sapiens
catcaactcttgtgctcacac

SEQ ID NO: 8106731 - DNA, 22 bp, Homo sapiens
catcacatttaaggggaaggac

SEQ ID NO: 8106732 - DNA, 22 bp, Homo sapiens
tcaggctgcccgttcagggctc

SEQ ID NO: 8106733 - DNA, 22 bp, Homo sapiens
catcaaaattagacattgttga

SEQ ID NO: 8106734 - DNA, 22 bp, Homo sapiens
catcaaagcttttttctgtgtt

SEQ ID NO: 8106735 - DNA, 22 bp, Homo sapiens
catcaaataggaatatttggca

SEQ ID NO: 8106736 - DNA, 22 bp, Homo sapiens
catcaaatgccatatatggttg

SEQ ID NO: 8106737 - DNA, 22 bp, Homo sapiens
catcaaataggaatatttggca

SEQ ID NO: 8106738 - DNA, 22 bp, Homo sapiens
catcaaatactacatgggttgg

SEQ ID NO: 8106739 - DNA, 22 bp, Homo sapiens
catgggctcttctggactgcac

SEQ ID NO: 8106740 - DNA, 22 bp, Homo sapiens
catgtaaaacactcagaacagt

SEQ ID NO: 8106741 - DNA, 22 bp, Homo sapiens
tccagcagaaaagaggtaggga

SEQ ID NO: 8106742 - DNA, 22 bp, Homo sapiens
catgcttcatgcaaaattctga

SEQ ID NO: 8106743 - DNA, 22 bp, Homo sapiens
tcatcagtcagaacttaagctt

SEQ ID NO: 8106744 - DNA, 22 bp, Homo sapiens
tccagagtttgagtctccttcc

SEQ ID NO: 8106745 - DNA, 22 bp, Homo sapiens
tccagagttgtaagtgttgaca

SEQ ID NO: 8106746 - DNA, 23 bp, Homo sapiens
tccagagtgtgagcttgccgtgc

SEQ ID NO: 8106747 - DNA, 22 bp, Homo sapiens
tccagagtgctgacgcagaccc

SEQ ID NO: 8106748 - DNA, 22 bp, Homo sapiens
tccagagtgacaaatgactgat

SEQ ID NO: 8106749 - DNA, 22 bp, Homo sapiens
tccagagtctcctgttgttgtt

SEQ ID NO: 8106750 - DNA, 22 bp, Homo sapiens
tccagagtacggaagagtcatc

SEQ ID NO: 8106751 - DNA, 22 bp, Homo sapiens
tccaagatctacagcagtttag

SEQ ID NO: 8106752 - DNA, 22 bp, Homo sapiens
catgtgggaagaggccagctgg

SEQ ID NO: 8106753 - DNA, 22 bp, Homo sapiens
catgtggctttggcatgtgccc

SEQ ID NO: 8106754 - DNA, 22 bp, Homo sapiens
catgtgctgtagcagagaggaa

SEQ ID NO: 8106755 - DNA, 22 bp, Homo sapiens
catgtgtaaggctcacaggcag

SEQ ID NO: 8106756 - DNA, 22 bp, Homo sapiens
catgtgtagtgaaataagcagt

SEQ ID NO: 8106757 - DNA, 22 bp, Homo sapiens
catgtgtaggtatacaaaattc

SEQ ID NO: 8106758 - DNA, 22 bp, Homo sapiens
catgtgtatgcattcatacata

SEQ ID NO: 8106759 - DNA, 22 bp, Homo sapiens
catgttttctaggctttcacaa

SEQ ID NO: 8106760 - DNA, 21 bp, Homo sapiens
cattacaagatttccaatttg

SEQ ID NO: 8106761 - DNA, 22 bp, Homo sapiens
cattacaaccccaaattacaaa

SEQ ID NO: 8106762 - DNA, 22 bp, Homo sapiens
cattacaaccccaaattacaaa

SEQ ID NO: 8106763 - DNA, 22 bp, Homo sapiens
cattacaacaatctgccatggc

SEQ ID NO: 8106764 - DNA, 19 bp, Homo sapiens
cattacaaatttgtaggga

SEQ ID NO: 8106765 - DNA, 22 bp, Homo sapiens
cattacaaagttataaacagtt

SEQ ID NO: 8106766 - DNA, 22 bp, Homo sapiens
cattacaaacatgttaagattt

SEQ ID NO: 8106767 - DNA, 22 bp, Homo sapiens
cagctctgctgggaggatgcag

SEQ ID NO: 8106768 - DNA, 22 bp, Homo sapiens
tacacagggaaaggtctcagag

SEQ ID NO: 8106769 - DNA, 22 bp, Homo sapiens
tacacagaggcagctgtctgct

SEQ ID NO: 8106770 - DNA, 22 bp, Homo sapiens
caggccaccagatacatgcccc

SEQ ID NO: 8106771 - DNA, 22 bp, Homo sapiens
tacagagaataataggacaggt

SEQ ID NO: 8106772 - DNA, 22 bp, Homo sapiens
caggctcctcactcatgctccc

SEQ ID NO: 8106773 - DNA, 22 bp, Homo sapiens
caggctcccacaagctcccagc

SEQ ID NO: 8106774 - DNA, 22 bp, Homo sapiens
tacagtttagaaccatagatgg

SEQ ID NO: 8106775 - DNA, 20 bp, Homo sapiens
tacagttctgtagaagtaga

SEQ ID NO: 8106776 - DNA, 22 bp, Homo sapiens
tacagttctttgaaggatctag

SEQ ID NO: 8106777 - DNA, 22 bp, Homo sapiens
caggcctggagtgcaatggcac

SEQ ID NO: 8106778 - DNA, 22 bp, Homo sapiens
caggccttagtaggtgctccct

SEQ ID NO: 8106779 - DNA, 22 bp, Homo sapiens
caggccttgcgtcccatggcct

SEQ ID NO: 8106780 - DNA, 22 bp, Homo sapiens
tacagctaggcaaaaatgacat

SEQ ID NO: 8106781 - DNA, 22 bp, Homo sapiens
tacagcatgtccttagcaaggc

SEQ ID NO: 8106782 - DNA, 22 bp, Homo sapiens
tacagcatgatcacaatggaaa

SEQ ID NO: 8106783 - DNA, 22 bp, Homo sapiens
tacagagagtacagcatccaca

SEQ ID NO: 8106784 - DNA, 22 bp, Homo sapiens
tacagagagaggggttaccagg

SEQ ID NO: 8106785 - DNA, 22 bp, Homo sapiens
cagggatgagaaagctctctaa

SEQ ID NO: 8106786 - DNA, 22 bp, Homo sapiens
cagggatggagagactactggc

SEQ ID NO: 8106787 - DNA, 22 bp, Homo sapiens
cagggatgctgcttaggcagtt

SEQ ID NO: 8106788 - DNA, 22 bp, Homo sapiens
cagggcaggacagatacattac

SEQ ID NO: 8106789 - DNA, 22 bp, Homo sapiens
tagcataacaggtaagagtgag

SEQ ID NO: 8106790 - DNA, 22 bp, Homo sapiens
tagcagttagagttgactgcaa

SEQ ID NO: 8106791 - DNA, 22 bp, Homo sapiens
tagcagcacctacacgtcagag

SEQ ID NO: 8106792 - DNA, 22 bp, Homo sapiens
tagcattagagatagaaatagt

SEQ ID NO: 8106793 - DNA, 22 bp, Homo sapiens
tagcattaaaggtaagacatta

SEQ ID NO: 8106794 - DNA, 22 bp, Homo sapiens
tagaaacaagtttctctttggg

SEQ ID NO: 8106795 - DNA, 22 bp, Homo sapiens
tagaaagacaatgggaagtgct

SEQ ID NO: 8106796 - DNA, 22 bp, Homo sapiens
tagaaagatctgtaggcaagag

SEQ ID NO: 8106797 - DNA, 22 bp, Homo sapiens
cagtctttgatgcatcctagcc

SEQ ID NO: 8106798 - DNA, 22 bp, Homo sapiens
cagtctttgacaagccctttca

SEQ ID NO: 8106799 - DNA, 22 bp, Homo sapiens
cagtctttgttcccattactga

SEQ ID NO: 8106800 - DNA, 22 bp, Homo sapiens
tcaaatgtgtaaggtcaggaca

SEQ ID NO: 8106801 - DNA, 22 bp, Homo sapiens
tcaaatgtaatttattgtttta

SEQ ID NO: 8106802 - DNA, 17 bp, Homo sapiens
tcaaatgtacagaacta

SEQ ID NO: 8106803 - DNA, 19 bp, Homo sapiens
tcaaattcctaagttctgg

SEQ ID NO: 8106804 - DNA, 22 bp, Homo sapiens
cagtcttaggagaaactacaga

SEQ ID NO: 8106805 - DNA, 22 bp, Homo sapiens
cagtctgtttctgagaaacaga

SEQ ID NO: 8106806 - DNA, 22 bp, Homo sapiens
cagtcccatctcccaggtggct

SEQ ID NO: 8106807 - DNA, 22 bp, Homo sapiens
cagtcccagtttgagactctgg

SEQ ID NO: 8106808 - DNA, 22 bp, Homo sapiens
cagtccctagtggagctcacag

SEQ ID NO: 8106809 - DNA, 22 bp, Homo sapiens
cagtccctgggggagtcaccag

SEQ ID NO: 8106810 - DNA, 22 bp, Homo sapiens
tcaaaagaaacaccatgttcct

SEQ ID NO: 8106811 - DNA, 22 bp, Homo sapiens
tcaaaactcattttggaagtaa

SEQ ID NO: 8106812 - DNA, 22 bp, Homo sapiens
tcaaaggagacacaaggagaaa

SEQ ID NO: 8106813 - DNA, 22 bp, Homo sapiens
tcaaaggagtttaagttactgg

SEQ ID NO: 8106814 - DNA, 22 bp, Homo sapiens
cagtagaattattataaaacat

SEQ ID NO: 8106815 - DNA, 22 bp, Homo sapiens
cagtggcagagaacagagacct

SEQ ID NO: 8106816 - DNA, 21 bp, Homo sapiens
cagtggtttataaacaacaga

SEQ ID NO: 8106817 - DNA, 22 bp, Homo sapiens
cagtggcaatgggacagagcac

SEQ ID NO: 8106818 - DNA, 22 bp, Homo sapiens
tcactgcaagctccacctcccg

SEQ ID NO: 8106819 - DNA, 22 bp, Homo sapiens
tcactgcaacctccgcctgctg

SEQ ID NO: 8106820 - DNA, 22 bp, Homo sapiens
tcacattcatggtgctaataaa

SEQ ID NO: 8106821 - DNA, 22 bp, Homo sapiens
tcactctctaagcatgacagac

SEQ ID NO: 8106822 - DNA, 22 bp, Homo sapiens
cagtgcagtttcccagatgctg

SEQ ID NO: 8106823 - DNA, 22 bp, Homo sapiens
tcacacatttctcaagtgtagg

SEQ ID NO: 8106824 - DNA, 22 bp, Homo sapiens
tcacacatttctcaagtgtagg

SEQ ID NO: 8106825 - DNA, 22 bp, Homo sapiens
cagtgcagtcaaggaagaacca

SEQ ID NO: 8106826 - DNA, 22 bp, Homo sapiens
cagtgcaggtggcagaggacag

SEQ ID NO: 8106827 - DNA, 22 bp, Homo sapiens
cagtgcaggtggcagaggacag

SEQ ID NO: 8106828 - DNA, 22 bp, Homo sapiens
tagttttacttgcgatgataat

SEQ ID NO: 8106829 - DNA, 22 bp, Homo sapiens
tagttttacatcagccattgtt

SEQ ID NO: 8106830 - DNA, 22 bp, Homo sapiens
tatattcattttaaagccatct

SEQ ID NO: 8106831 - DNA, 22 bp, Homo sapiens
tatataatttgtaaaagcacct

SEQ ID NO: 8106832 - DNA, 22 bp, Homo sapiens
tatataatttgtaaaagcacct

SEQ ID NO: 8106833 - DNA, 22 bp, Homo sapiens
cagggctggatcctccagactc

SEQ ID NO: 8106834 - DNA, 22 bp, Homo sapiens
cagggctgaggacacaagtaaa

SEQ ID NO: 8106835 - DNA, 22 bp, Homo sapiens
cagggctgaggacacaagtaaa

SEQ ID NO: 8106836 - DNA, 22 bp, Homo sapiens
tagtaaattaaaatattgactt

SEQ ID NO: 8106837 - DNA, 22 bp, Homo sapiens
tagtaaatctcagaaaaagatc

SEQ ID NO: 8106838 - DNA, 20 bp, Homo sapiens
cagggccacgctccaaggca

SEQ ID NO: 8106839 - DNA, 22 bp, Homo sapiens
tatgaacatgctgtggttataa

SEQ ID NO: 8106840 - DNA, 21 bp, Homo sapiens
tatgaacatgaccaatagtcc

SEQ ID NO: 8106841 - DNA, 22 bp, Homo sapiens
tatgaacatgttcattgactta

SEQ ID NO: 8106842 - DNA, 22 bp, Homo sapiens
tatgaacattttggtatatatg

SEQ ID NO: 8106843 - DNA, 22 bp, Homo sapiens
tatgaacattttggtatatatg

SEQ ID NO: 8106844 - DNA, 22 bp, Homo sapiens
tatattctattgtacctctcct

SEQ ID NO: 8106845 - DNA, 22 bp, Homo sapiens
tatgcaattctcttaatattct

SEQ ID NO: 8106846 - DNA, 22 bp, Homo sapiens
caggtgggctgcctctccagct

SEQ ID NO: 8106847 - DNA, 22 bp, Homo sapiens
caggtggcttagtcccatttta

SEQ ID NO: 8106848 - DNA, 22 bp, Homo sapiens
caggtggggcgccctcaggcag

SEQ ID NO: 8106849 - DNA, 22 bp, Homo sapiens
caggtggggggcttccgagcct

SEQ ID NO: 8106850 - DNA, 22 bp, Homo sapiens
tatgtacatcttgagcaatgaa

SEQ ID NO: 8106851 - DNA, 22 bp, Homo sapiens
cagtacaattttacaaaggacg

SEQ ID NO: 8106852 - DNA, 22 bp, Homo sapiens
cagtaatgggcaagacaatatg

SEQ ID NO: 8106853 - DNA, 23 bp, Homo sapiens
cagtacaatgtggaaaaggagtg

SEQ ID NO: 8106854 - DNA, 22 bp, Homo sapiens
cagtacaatgttgaaaaggagt

SEQ ID NO: 8106855 - DNA, 22 bp, Homo sapiens
tatgtacatgttaaagggcaaa

SEQ ID NO: 8106856 - DNA, 22 bp, Homo sapiens
ttgggggcatattgagtagtgg

SEQ ID NO: 8106857 - DNA, 22 bp, Homo sapiens
ttgggggcagagggagcatctg

SEQ ID NO: 8106858 - DNA, 22 bp, Homo sapiens
ttgtacttacattttaaagcta

SEQ ID NO: 8106859 - DNA, 22 bp, Homo sapiens
ttgtacttgccatagaacaaca

SEQ ID NO: 8106860 - DNA, 22 bp, Homo sapiens
ttgtagagtacacaacacttgg

SEQ ID NO: 8106861 - DNA, 22 bp, Homo sapiens
ttgtataagaagttggcagata

SEQ ID NO: 8106862 - DNA, 22 bp, Homo sapiens
ttgttcatggttgtaagtttga

SEQ ID NO: 8106863 - DNA, 22 bp, Homo sapiens
ttgtgcagagttgcctttattt

SEQ ID NO: 8106864 - DNA, 22 bp, Homo sapiens
ttgtgcagagaaatctttcttg

SEQ ID NO: 8106865 - DNA, 22 bp, Homo sapiens
ttggccttctggtgttcatttt

SEQ ID NO: 8106866 - DNA, 22 bp, Homo sapiens
ttggcagagggaccagcctaca

SEQ ID NO: 8106867 - DNA, 22 bp, Homo sapiens
ttggcagagagtatgctgaaga

SEQ ID NO: 8106868 - DNA, 22 bp, Homo sapiens
ttggctcacctgtctacccaga

SEQ ID NO: 8106869 - DNA, 20 bp, Homo sapiens
ttggctcatgcaacacctac

SEQ ID NO: 8106870 - DNA, 21 bp, Homo sapiens
ttgggccttttctggtagctt

SEQ ID NO: 8106871 - DNA, 22 bp, Homo sapiens
ttgggctcaggagtttgagacc

SEQ ID NO: 8106872 - DNA, 21 bp, Homo sapiens
ttgggccttttctggtagctt

SEQ ID NO: 8106873 - DNA, 20 bp, Homo sapiens
ttggatgtgcatggccgtgc

SEQ ID NO: 8106874 - DNA, 22 bp, Homo sapiens
ttgctttactttgccattcgtt

SEQ ID NO: 8106875 - DNA, 22 bp, Homo sapiens
ttgctcagctgtgagatatcca

SEQ ID NO: 8106876 - DNA, 22 bp, Homo sapiens
ttgctaggattcattctatact

SEQ ID NO: 8106877 - DNA, 22 bp, Homo sapiens
ttgctaaatccctataatattc

SEQ ID NO: 8106878 - DNA, 22 bp, Homo sapiens
ttgctaaatgtgttatatctgt

SEQ ID NO: 8106879 - DNA, 22 bp, Homo sapiens
ttgctaaaaggtgaaaagtgta

SEQ ID NO: 8106880 - DNA, 22 bp, Homo sapiens
ttgctaaaaatggaattatagg

SEQ ID NO: 8106881 - DNA, 22 bp, Homo sapiens
ttgcccagagtcacccagctca

SEQ ID NO: 8106882 - DNA, 22 bp, Homo sapiens
ttgcccagagctgcctgttaca

SEQ ID NO: 8106883 - DNA, 22 bp, Homo sapiens
ttgccagtgccagcccaggcag

SEQ ID NO: 8106884 - DNA, 22 bp, Homo sapiens
ttgcctgtgaacgctgagtcct

SEQ ID NO: 8106885 - DNA, 22 bp, Homo sapiens
ttgcctgtgtcagcaggtggaa

SEQ ID NO: 8106886 - DNA, 22 bp, Homo sapiens
ttgcctgtgaggattctggttg

SEQ ID NO: 8106887 - DNA, 22 bp, Homo sapiens
ttgccaggcttgtttctaggct

SEQ ID NO: 8106888 - DNA, 22 bp, Homo sapiens
ttgccaggagacatctggagcc

SEQ ID NO: 8106889 - DNA, 22 bp, Homo sapiens
ttgccaggggacatctggagcc

SEQ ID NO: 8106890 - DNA, 22 bp, Homo sapiens
ttgccaggagctcatctgaggg

SEQ ID NO: 8106891 - DNA, 23 bp, Homo sapiens
tttccaggtgaccgtcagaatta

SEQ ID NO: 8106892 - DNA, 18 bp, Homo sapiens
tttccagggattaggtgg

SEQ ID NO: 8106893 - DNA, 22 bp, Homo sapiens
tttccaggccagacctttcaat

SEQ ID NO: 8106894 - DNA, 22 bp, Homo sapiens
tttccaaataaggtcacattct

SEQ ID NO: 8106895 - DNA, 22 bp, Homo sapiens
tttcatctatttgctttgtgaa

SEQ ID NO: 8106896 - DNA, 22 bp, Homo sapiens
tttccaaataaggtcacattct

SEQ ID NO: 8106897 - DNA, 22 bp, Homo sapiens
tttcataatatccagagatttt

SEQ ID NO: 8106898 - DNA, 22 bp, Homo sapiens
tttcataagggtttctagactt

SEQ ID NO: 8106899 - DNA, 22 bp, Homo sapiens
tttcataatactgtacatgaaa

SEQ ID NO: 8106900 - DNA, 22 bp, Homo sapiens
tttcataatactgtacatgaaa

SEQ ID NO: 8106901 - DNA, 22 bp, Homo sapiens
tttcatctctctaaaagacagt

SEQ ID NO: 8106902 - DNA, 22 bp, Homo sapiens
tttcatagccttctaatgagtt

SEQ ID NO: 8106903 - DNA, 22 bp, Homo sapiens
tttcccaagtgaagtgaagcca

SEQ ID NO: 8106904 - DNA, 22 bp, Homo sapiens
tttcctttgagggtcctacact

SEQ ID NO: 8106905 - DNA, 22 bp, Homo sapiens
tttcctttctggtttggtcata

SEQ ID NO: 8106906 - DNA, 22 bp, Homo sapiens
tttcctttgcccaatacatgtc

SEQ ID NO: 8106907 - DNA, 22 bp, Homo sapiens
tttcctttgggagcatgaattt

SEQ ID NO: 8106908 - DNA, 22 bp, Homo sapiens
tttcccaagaccatagatggaa

SEQ ID NO: 8106909 - DNA, 22 bp, Homo sapiens
tttcccaagaaaaataattgga

SEQ ID NO: 8106910 - DNA, 22 bp, Homo sapiens
tttctaaaatagattttatggt

SEQ ID NO: 8106911 - DNA, 22 bp, Homo sapiens
tttccttttggctaggtgtgaa

SEQ ID NO: 8106912 - DNA, 22 bp, Homo sapiens
tttcctttgtgcaggccttggg

SEQ ID NO: 8106913 - DNA, 22 bp, Homo sapiens
tttccttttataaggcttgagg

SEQ ID NO: 8106914 - DNA, 22 bp, Homo sapiens
tttctaaagggtagatttggcc

SEQ ID NO: 8106915 - DNA, 22 bp, Homo sapiens
tttctaagaatattgctcttaa

SEQ ID NO: 8106916 - DNA, 22 bp, Homo sapiens
tttctaaggctaggtcttaagg

SEQ ID NO: 8106917 - DNA, 22 bp, Homo sapiens
tttctaaggtgaggtagaaaat

SEQ ID NO: 8106918 - DNA, 21 bp, Homo sapiens
tttctaaggaggaagaaaaga

SEQ ID NO: 8106919 - DNA, 22 bp, Homo sapiens
tttctaaggaaagtacctggga

SEQ ID NO: 8106920 - DNA, 19 bp, Homo sapiens
tttctaagctaaatgcttc

SEQ ID NO: 8106921 - DNA, 22 bp, Homo sapiens
tttcataaacagtagaagacta

SEQ ID NO: 8106922 - DNA, 22 bp, Homo sapiens
tttcagtgtcagtaatgcagca

SEQ ID NO: 8106923 - DNA, 22 bp, Homo sapiens
tttcacattagatatgtcattt

SEQ ID NO: 8106924 - DNA, 22 bp, Homo sapiens
tttcacaggattctgatgtagt

SEQ ID NO: 8106925 - DNA, 22 bp, Homo sapiens
tttcacaggccttttgtagccc

SEQ ID NO: 8106926 - DNA, 22 bp, Homo sapiens
tttcacaggggcaacctccatg

SEQ ID NO: 8106927 - DNA, 22 bp, Homo sapiens
tttcacatcagaggtagattag

SEQ ID NO: 8106928 - DNA, 23 bp, Homo sapiens
tttcacagcttttattctgcatc

SEQ ID NO: 8106929 - DNA, 22 bp, Homo sapiens
tttcacaggatgctgttttata

SEQ ID NO: 8106930 - DNA, 22 bp, Homo sapiens
tttcacaggagttgtaccattt

SEQ ID NO: 8106931 - DNA, 22 bp, Homo sapiens
tttcacaggagtcctttctata

SEQ ID NO: 8106932 - DNA, 22 bp, Homo sapiens
tttcacaggagtcctttctata

SEQ ID NO: 8106933 - DNA, 22 bp, Homo sapiens
tttcacaggaatacccggcttt

SEQ ID NO: 8106934 - DNA, 22 bp, Homo sapiens
tttcacaacgttgtggtgagag

SEQ ID NO: 8106935 - DNA, 22 bp, Homo sapiens
tttcacaactgcttatttgaga

SEQ ID NO: 8106936 - DNA, 22 bp, Homo sapiens
tttcacaagtttcaggattctg

SEQ ID NO: 8106937 - DNA, 22 bp, Homo sapiens
tttcacaagtaaagtcctaagt

SEQ ID NO: 8106938 - DNA, 22 bp, Homo sapiens
tttcaagttgtttatatccaga

SEQ ID NO: 8106939 - DNA, 20 bp, Homo sapiens
tttcaagttgtaaggtatca

SEQ ID NO: 8106940 - DNA, 22 bp, Homo sapiens
tttcaagttgttgcattaaatg

SEQ ID NO: 8106941 - DNA, 22 bp, Homo sapiens
tttcaagttgttgcattaaatg

SEQ ID NO: 8106942 - DNA, 22 bp, Homo sapiens
tttcaagttctgttcctaaact

SEQ ID NO: 8106943 - DNA, 22 bp, Homo sapiens
tttcaagtgtcctgattaatgg

SEQ ID NO: 8106944 - DNA, 22 bp, Homo sapiens
tttcaagttcccagttttgtgg

SEQ ID NO: 8106945 - DNA, 22 bp, Homo sapiens
tttcaagtgtcctgattaatgg

SEQ ID NO: 8106946 - DNA, 22 bp, Homo sapiens
tttcaagtggggacatttgaga

SEQ ID NO: 8106947 - DNA, 22 bp, Homo sapiens
tttcaagtggcgagataaggaa

SEQ ID NO: 8106948 - DNA, 20 bp, Homo sapiens
tttcaagtcagcaattctca

SEQ ID NO: 8106949 - DNA, 22 bp, Homo sapiens
tttcaagtagagggatcgctag

SEQ ID NO: 8106950 - DNA, 22 bp, Homo sapiens
tttcaagtactgtaaacatgct

SEQ ID NO: 8106951 - DNA, 22 bp, Homo sapiens
tttcaagtaagatacatttcag

SEQ ID NO: 8106952 - DNA, 22 bp, Homo sapiens
tttcaagtcattctataatatc

SEQ ID NO: 8106953 - DNA, 20 bp, Homo sapiens
tttcaagtcggtagagtcta

SEQ ID NO: 8106954 - DNA, 22 bp, Homo sapiens
tttcaagtcagtagctaatcat

SEQ ID NO: 8106955 - DNA, 22 bp, Homo sapiens
tttcaaggctaatccacagtat

SEQ ID NO: 8106956 - DNA, 23 bp, Homo sapiens
tttcaaggtgtctgtaccactga

SEQ ID NO: 8106957 - DNA, 22 bp, Homo sapiens
tttatgaaccactctacacctt

SEQ ID NO: 8106958 - DNA, 22 bp, Homo sapiens
tttatctttaggactttgcaga

SEQ ID NO: 8106959 - DNA, 22 bp, Homo sapiens
tttatctggactgtgatataaa

SEQ ID NO: 8106960 - DNA, 22 bp, Homo sapiens
tttaggaaatactgtcctatga

SEQ ID NO: 8106961 - DNA, 22 bp, Homo sapiens
tttaggaatattttctttcagg

SEQ ID NO: 8106962 - DNA, 22 bp, Homo sapiens
tttaacttgatcagtagagcat

SEQ ID NO: 8106963 - DNA, 22 bp, Homo sapiens
tttacacattattttcagtgtg

SEQ ID NO: 8106964 - DNA, 22 bp, Homo sapiens
tttacaagtttacagaatgatg

SEQ ID NO: 8106965 - DNA, 22 bp, Homo sapiens
tttaagacttagatttattggg

SEQ ID NO: 8106966 - DNA, 22 bp, Homo sapiens
tttacaagtcagggactgttct

SEQ ID NO: 8106967 - DNA, 22 bp, Homo sapiens
tttacagctagacatacctgag

SEQ ID NO: 8106968 - DNA, 22 bp, Homo sapiens
tttacagctactgtcctatttc

SEQ ID NO: 8106969 - DNA, 22 bp, Homo sapiens
tttacagcaacagtgcagaggt

SEQ ID NO: 8106970 - DNA, 22 bp, Homo sapiens
ttatacagcattgctagtgatg

SEQ ID NO: 8106971 - DNA, 22 bp, Homo sapiens
ttatgcatatagcagatacgag

SEQ ID NO: 8106972 - DNA, 22 bp, Homo sapiens
tcctcgatgggcaggaagatct

SEQ ID NO: 8106973 - DNA, 22 bp, Homo sapiens
tcctctactcgcttgccctttg

SEQ ID NO: 8106974 - DNA, 22 bp, Homo sapiens
tcctccttgttttgtctctgct

SEQ ID NO: 8106975 - DNA, 23 bp, Homo sapiens
tcctccttttgcttgtgcttccc

SEQ ID NO: 8106976 - DNA, 22 bp, Homo sapiens
tcctccttcgggactgcttgac

SEQ ID NO: 8106977 - DNA, 22 bp, Homo sapiens
tcctcctgtctaccagttcctg

SEQ ID NO: 8106978 - DNA, 21 bp, Homo sapiens
tcctcctgtagagggtcctgg

SEQ ID NO: 8106979 - DNA, 22 bp, Homo sapiens
ttattttctcctcagaaagtgg

SEQ ID NO: 8106980 - DNA, 22 bp, Homo sapiens
ttattttctcctcagaaagtgg

SEQ ID NO: 8106981 - DNA, 22 bp, Homo sapiens
ttattttaccttcctctgagct

SEQ ID NO: 8106982 - DNA, 22 bp, Homo sapiens
ttcaaaagtaatcagtattaga

SEQ ID NO: 8106983 - DNA, 22 bp, Homo sapiens
ttcaaaattgttctaagctctg

SEQ ID NO: 8106984 - DNA, 22 bp, Homo sapiens
ttcaagaaggtacatttacatc

SEQ ID NO: 8106985 - DNA, 22 bp, Homo sapiens
ttcaaacaactcatttatgcaa

SEQ ID NO: 8106986 - DNA, 22 bp, Homo sapiens
ttcaagatggctgcaaatactt

SEQ ID NO: 8106987 - DNA, 22 bp, Homo sapiens
ttcaagatgtcttcacaatagt

SEQ ID NO: 8106988 - DNA, 22 bp, Homo sapiens
ttattgtttactagtttgcaga

SEQ ID NO: 8106989 - DNA, 22 bp, Homo sapiens
ttatttaaaagtggtaagattc

SEQ ID NO: 8106990 - DNA, 22 bp, Homo sapiens
ttatttaattttctcactcaga

SEQ ID NO: 8106991 - DNA, 22 bp, Homo sapiens
ttatttagtctagatgaatttt

SEQ ID NO: 8106992 - DNA, 22 bp, Homo sapiens
ttatttagtctagatgaatttt

SEQ ID NO: 8106993 - DNA, 22 bp, Homo sapiens
ttcatcaatgtgtttaataatg

SEQ ID NO: 8106994 - DNA, 22 bp, Homo sapiens
ttcatcaatgtgtttaataatg

SEQ ID NO: 8106995 - DNA, 22 bp, Homo sapiens
ttcatataaatggaatcagaat

SEQ ID NO: 8106996 - DNA, 22 bp, Homo sapiens
ttcatatatatgcactacgtac

SEQ ID NO: 8106997 - DNA, 22 bp, Homo sapiens
ttcatataaatggaatcagaat

SEQ ID NO: 8106998 - DNA, 22 bp, Homo sapiens
ttcagaatgtgaccttatttgg

SEQ ID NO: 8106999 - DNA, 19 bp, Homo sapiens
ttcagaattgggaggtgat

SEQ ID NO: 8107000 - DNA, 22 bp, Homo sapiens
ttcagaatgtactgatagaaca

SEQ ID NO: 8107001 - DNA, 22 bp, Homo sapiens
ttcagaatgctatttctgaaat

SEQ ID NO: 8107002 - DNA, 22 bp, Homo sapiens
ttcagaatgagaatggatgggt

SEQ ID NO: 8107003 - DNA, 22 bp, Homo sapiens
ttcagaatgacttatgtaaggc

SEQ ID NO: 8107004 - DNA, 22 bp, Homo sapiens
ttcagaatctatgtgccagctc

SEQ ID NO: 8107005 - DNA, 22 bp, Homo sapiens
ttcatagaaagtgcttagattg

SEQ ID NO: 8107006 - DNA, 22 bp, Homo sapiens
ttcatagacccagaactcatta

SEQ ID NO: 8107007 - DNA, 22 bp, Homo sapiens
ttcatagaagcagaaagtaaac

SEQ ID NO: 8107008 - DNA, 22 bp, Homo sapiens
ttcatactcactccaataactg

SEQ ID NO: 8107009 - DNA, 22 bp, Homo sapiens
ttcatacatttttactaacagc

SEQ ID NO: 8107010 - DNA, 22 bp, Homo sapiens
ttcatacatgagactagatgca

SEQ ID NO: 8107011 - DNA, 22 bp, Homo sapiens
ttcagaagtgctttcacactct

SEQ ID NO: 8107012 - DNA, 22 bp, Homo sapiens
ttcagaagttttcaaaactaag

SEQ ID NO: 8107013 - DNA, 22 bp, Homo sapiens
ttcagaaggattttaacacatg

SEQ ID NO: 8107014 - DNA, 17 bp, Homo sapiens
ttcagaagcattttggc

SEQ ID NO: 8107015 - DNA, 22 bp, Homo sapiens
ttcagaaggatgacaccagttg

SEQ ID NO: 8107016 - DNA, 22 bp, Homo sapiens
ttcagaagagacactgtgacag

SEQ ID NO: 8107017 - DNA, 22 bp, Homo sapiens
ttcagaaatgtcagccatcaga

SEQ ID NO: 8107018 - DNA, 22 bp, Homo sapiens
ttcagaaatcgagtttcatgtc

SEQ ID NO: 8107019 - DNA, 22 bp, Homo sapiens
ttcaagtagaaagtattgatga

SEQ ID NO: 8107020 - DNA, 22 bp, Homo sapiens
ttcaagtagctaaattagctgc

SEQ ID NO: 8107021 - DNA, 22 bp, Homo sapiens
ttcaagtagctaaattagctgc

SEQ ID NO: 8107022 - DNA, 21 bp, Homo sapiens
ttcaagtctctaggacttctc

SEQ ID NO: 8107023 - DNA, 22 bp, Homo sapiens
ttcaagtcatgttaactgcttc

SEQ ID NO: 8107024 - DNA, 22 bp, Homo sapiens
ttcaagtagtcacacatgatat

SEQ ID NO: 8107025 - DNA, 22 bp, Homo sapiens
ttcaagtatatttaacatcgta

SEQ ID NO: 8107026 - DNA, 22 bp, Homo sapiens
ttcaagtcagagcaagccaagt

SEQ ID NO: 8107027 - DNA, 22 bp, Homo sapiens
ttcccagacctgtaggatcaga

SEQ ID NO: 8107028 - DNA, 17 bp, Homo sapiens
ttcccctgaccaagcct

SEQ ID NO: 8107029 - DNA, 21 bp, Homo sapiens
ttcccagcacctagcacaggt

SEQ ID NO: 8107030 - DNA, 21 bp, Homo sapiens
ttcccagcacctagcacaggt

SEQ ID NO: 8107031 - DNA, 22 bp, Homo sapiens
ttcccagattggagggcagggg

SEQ ID NO: 8107032 - DNA, 22 bp, Homo sapiens
ttccaaggagtgaacttcaaat

SEQ ID NO: 8107033 - DNA, 17 bp, Homo sapiens
ttccaaggagcatttga

SEQ ID NO: 8107034 - DNA, 19 bp, Homo sapiens
ttccaaggcatttctttgc

SEQ ID NO: 8107035 - DNA, 23 bp, Homo sapiens
ttcatcagttgctgttgcagaac

SEQ ID NO: 8107036 - DNA, 22 bp, Homo sapiens
ttccaacaatgtgttattgttc

SEQ ID NO: 8107037 - DNA, 22 bp, Homo sapiens
ttccaactttgtcatatattat

SEQ ID NO: 8107038 - DNA, 22 bp, Homo sapiens
ttccaaggctgtcctcactttg

SEQ ID NO: 8107039 - DNA, 20 bp, Homo sapiens
ttccaaggtctatgcttctt

SEQ ID NO: 8107040 - DNA, 22 bp, Homo sapiens
ttccaagtgcccatatttcatc

SEQ ID NO: 8107041 - DNA, 23 bp, Homo sapiens
ttccaagtgctttacttaatcct

SEQ ID NO: 8107042 - DNA, 22 bp, Homo sapiens
ttccaagtctaagttataaatc

SEQ ID NO: 8107043 - DNA, 22 bp, Homo sapiens
ttccaagttgagcgattttcct

SEQ ID NO: 8107044 - DNA, 22 bp, Homo sapiens
ttccaagtgggggaagctgagt

SEQ ID NO: 8107045 - DNA, 22 bp, Homo sapiens
ttccaagtgggggaagctgagt

SEQ ID NO: 8107046 - DNA, 22 bp, Homo sapiens
ttccaatgactagtggcatcct

SEQ ID NO: 8107047 - DNA, 22 bp, Homo sapiens
ttccatatctgttgcatatcat

SEQ ID NO: 8107048 - DNA, 22 bp, Homo sapiens
ttctcttcccactttctgtatt

SEQ ID NO: 8107049 - DNA, 22 bp, Homo sapiens
ttctcttgtgccaagttgttgc

SEQ ID NO: 8107050 - DNA, 22 bp, Homo sapiens
ttctcttcacagggatcatcct

SEQ ID NO: 8107051 - DNA, 22 bp, Homo sapiens
ttctcttacattttctcagcct

SEQ ID NO: 8107052 - DNA, 22 bp, Homo sapiens
ttctgatgaggaggtctctaag

SEQ ID NO: 8107053 - DNA, 22 bp, Homo sapiens
ttctgatgcatgggtctctgtt

SEQ ID NO: 8107054 - DNA, 22 bp, Homo sapiens
ttctctttctgctgggctggaa

SEQ ID NO: 8107055 - DNA, 22 bp, Homo sapiens
ttctctttatgtatttagtggg

SEQ ID NO: 8107056 - DNA, 22 bp, Homo sapiens
ttctgcagatcaacttgactgc

SEQ ID NO: 8107057 - DNA, 22 bp, Homo sapiens
ttctcacaggaagtaggacttt

SEQ ID NO: 8107058 - DNA, 22 bp, Homo sapiens
ttctcaaagaaagctgtcatta

SEQ ID NO: 8107059 - DNA, 22 bp, Homo sapiens
ttctcagacttccagcaccagc

SEQ ID NO: 8107060 - DNA, 22 bp, Homo sapiens
ttctcagagtgaccaagtcttt

SEQ ID NO: 8107061 - DNA, 22 bp, Homo sapiens
ttccctctcctactcaggaaag

SEQ ID NO: 8107062 - DNA, 20 bp, Homo sapiens
ttctaaactgttaggcttgc

SEQ ID NO: 8107063 - DNA, 22 bp, Homo sapiens
ttctaaactgaagtattttaaa

SEQ ID NO: 8107064 - DNA, 22 bp, Homo sapiens
ttctaaacggcttcacaggaat

SEQ ID NO: 8107065 - DNA, 22 bp, Homo sapiens
ttctaaacactacgggatttgg

SEQ ID NO: 8107066 - DNA, 22 bp, Homo sapiens
ttctaaacttcaattctaaatt

SEQ ID NO: 8107067 - DNA, 22 bp, Homo sapiens
ttctaaagcctgtcctatcaga

SEQ ID NO: 8107068 - DNA, 22 bp, Homo sapiens
ttctaaagtgcaatctgacaga

SEQ ID NO: 8107069 - DNA, 22 bp, Homo sapiens
ttctggctttgaccaagttcaa

SEQ ID NO: 8107070 - DNA, 22 bp, Homo sapiens
ttctggaggttattaggagtct

SEQ ID NO: 8107071 - DNA, 22 bp, Homo sapiens
ttcttcagcccatatcttccag

SEQ ID NO: 8107072 - DNA, 22 bp, Homo sapiens
ttcttcttcaagtgctgcattc

SEQ ID NO: 8107073 - DNA, 22 bp, Homo sapiens
ttcttcttctggctgcacctgg

SEQ ID NO: 8107074 - DNA, 22 bp, Homo sapiens
ttcttcttgaaactttaggttg

SEQ ID NO: 8107075 - DNA, 22 bp, Homo sapiens
ttctttctcactctttaggaag

SEQ ID NO: 8107076 - DNA, 22 bp, Homo sapiens
ttctttctcactctttaggaag

SEQ ID NO: 8107077 - DNA, 22 bp, Homo sapiens
ttctttctcagtgggcagatac

SEQ ID NO: 8107078 - DNA, 22 bp, Homo sapiens
ttctttcttagcaatctatggt

SEQ ID NO: 8107079 - DNA, 22 bp, Homo sapiens
ttcttctcctaaggagagtcct

SEQ ID NO: 8107080 - DNA, 22 bp, Homo sapiens
ttctttcttggggaacacactc

SEQ ID NO: 8107081 - DNA, 22 bp, Homo sapiens
ttgaggctgcacagtacaggct

SEQ ID NO: 8107082 - DNA, 22 bp, Homo sapiens
ttgagagtagagatggcagggc

SEQ ID NO: 8107083 - DNA, 22 bp, Homo sapiens
ttgagagtcatttaaggtgttg

SEQ ID NO: 8107084 - DNA, 22 bp, Homo sapiens
ttgagagttaccagcagaggaa

SEQ ID NO: 8107085 - DNA, 22 bp, Homo sapiens
ttgagagtttgggggcaatatg

SEQ ID NO: 8107086 - DNA, 22 bp, Homo sapiens
ttctttttggatagctgatgaa

SEQ ID NO: 8107087 - DNA, 22 bp, Homo sapiens
ttctttttggatagctgatgaa

SEQ ID NO: 8107088 - DNA, 22 bp, Homo sapiens
ttctttttatcttcccataaga

SEQ ID NO: 8107089 - DNA, 22 bp, Homo sapiens
ttgaaactttagtaaactaagg

SEQ ID NO: 8107090 - DNA, 22 bp, Homo sapiens
ttgaaactgtcagcttttacgc

SEQ ID NO: 8107091 - DNA, 22 bp, Homo sapiens
ttttggctcttggtaggtcaga

SEQ ID NO: 8107092 - DNA, 22 bp, Homo sapiens
ttttccttagcttctctgcgag

SEQ ID NO: 8107093 - DNA, 22 bp, Homo sapiens
ttttccagatgaattccacagt

SEQ ID NO: 8107094 - DNA, 22 bp, Homo sapiens
ttttccagatggatactagaat

SEQ ID NO: 8107095 - DNA, 22 bp, Homo sapiens
ttttccttcacctcttgagcct

SEQ ID NO: 8107096 - DNA, 22 bp, Homo sapiens
ttttttagttaggtcagaatgt

SEQ ID NO: 8107097 - DNA, 22 bp, Homo sapiens
ttttttcagcctgtctgtgcca

SEQ ID NO: 8107098 - DNA, 22 bp, Homo sapiens
tttttgtcatctatttctggtg

SEQ ID NO: 8107099 - DNA, 22 bp, Homo sapiens
ttttacaagctgagtcgttaaa

SEQ ID NO: 8107100 - DNA, 23 bp, Homo sapiens
ttttaatttggacataagaagat

SEQ ID NO: 8107101 - DNA, 22 bp, Homo sapiens
tttgtgcacttctgtagctgcc

SEQ ID NO: 8107102 - DNA, 22 bp, Homo sapiens
tttgtggcaggagcggagaccg

SEQ ID NO: 8107103 - DNA, 22 bp, Homo sapiens
tttgtcttatccaatctctcag

SEQ ID NO: 8107104 - DNA, 22 bp, Homo sapiens
tttgtcttaaatcttgttactg

SEQ ID NO: 8107105 - DNA, 22 bp, Homo sapiens
tttgtcttaaatcttgttactg

SEQ ID NO: 8107106 - DNA, 22 bp, Homo sapiens
tttgtctacaaaaagtgtacag

SEQ ID NO: 8107107 - DNA, 22 bp, Homo sapiens
ttttcaaagactggaggctgat

SEQ ID NO: 8107108 - DNA, 16 bp, Homo sapiens
ttttattgtgacagcc

SEQ ID NO: 8107109 - DNA, 22 bp, Homo sapiens
ttttcaaagactggaggctgat

SEQ ID NO: 8107110 - DNA, 22 bp, Homo sapiens
ttttccactttagtgcaataac

SEQ ID NO: 8107111 - DNA, 22 bp, Homo sapiens
ttttcaagagagtgttctatgt

SEQ ID NO: 8107112 - DNA, 22 bp, Homo sapiens
ttttcaagagagtgttctatgt

SEQ ID NO: 8107113 - DNA, 22 bp, Homo sapiens
ttttattggtaatgataaaagt

SEQ ID NO: 8107114 - DNA, 22 bp, Homo sapiens
ttttattgtcaatgaagacaga

SEQ ID NO: 8107115 - DNA, 22 bp, Homo sapiens
ttttattgtcaatgaagacaga

SEQ ID NO: 8107116 - DNA, 22 bp, Homo sapiens
ttttattgtctgtattgcctat

SEQ ID NO: 8107117 - DNA, 22 bp, Homo sapiens
ttttattgtctcccagttctgg

SEQ ID NO: 8107118 - DNA, 22 bp, Homo sapiens
ttttattgtctcccagttctgg

SEQ ID NO: 8107119 - DNA, 22 bp, Homo sapiens
ttttattggtaatgataaaagt

SEQ ID NO: 8107120 - DNA, 22 bp, Homo sapiens
ttttattgggagtcctctactg

SEQ ID NO: 8107121 - DNA, 22 bp, Homo sapiens
ttttaccactgggtgacatgga

SEQ ID NO: 8107122 - DNA, 22 bp, Homo sapiens
ttttacttcattcctgacttca

SEQ ID NO: 8107123 - DNA, 22 bp, Homo sapiens
tttgaacaggagtatctatagt

SEQ ID NO: 8107124 - DNA, 22 bp, Homo sapiens
tttgaaattggctcattggttt

SEQ ID NO: 8107125 - DNA, 22 bp, Homo sapiens
tttgacatggaataactcattt

SEQ ID NO: 8107126 - DNA, 22 bp, Homo sapiens
tttgacattaaggaacatatat

SEQ ID NO: 8107127 - DNA, 22 bp, Homo sapiens
tttgacatcactgacctgtttt

SEQ ID NO: 8107128 - DNA, 22 bp, Homo sapiens
tttgacagtgacgcctgtatga

SEQ ID NO: 8107129 - DNA, 22 bp, Homo sapiens
tttgaaatgtatcagtataggt

SEQ ID NO: 8107130 - DNA, 22 bp, Homo sapiens
tttgaaattaagatattgtcca

SEQ ID NO: 8107131 - DNA, 22 bp, Homo sapiens
tttgaaatatgaggcattatga

SEQ ID NO: 8107132 - DNA, 22 bp, Homo sapiens
tttgtccagtgcaccagcctca

SEQ ID NO: 8107133 - DNA, 22 bp, Homo sapiens
tttgtccagatgcacagataat

SEQ ID NO: 8107134 - DNA, 20 bp, Homo sapiens
tttgtccagcgtctactctg

SEQ ID NO: 8107135 - DNA, 22 bp, Homo sapiens
tttggcttgcactggcaccaac

SEQ ID NO: 8107136 - DNA, 21 bp, Homo sapiens
ttttttcttgcgtgaggcctg

SEQ ID NO: 8107137 - DNA, 23 bp, Homo sapiens
gcagagctgccctattgccttgg

SEQ ID NO: 8107138 - DNA, 21 bp, Homo sapiens
gcagagctggaaccaggaccc

SEQ ID NO: 8107139 - DNA, 22 bp, Homo sapiens
gcagagctgggatttgtactgg

SEQ ID NO: 8107140 - DNA, 18 bp, Homo sapiens
gcagagctgggattccca

SEQ ID NO: 8107141 - DNA, 22 bp, Homo sapiens
gcagagctgggtctgtatccaa

SEQ ID NO: 8107142 - DNA, 22 bp, Homo sapiens
gcagagctgggatatgaaccca

SEQ ID NO: 8107143 - DNA, 22 bp, Homo sapiens
gcagagctggaactggtactca

SEQ ID NO: 8107144 - DNA, 22 bp, Homo sapiens
gcagagctgttaatggagctga

SEQ ID NO: 8107145 - DNA, 20 bp, Homo sapiens
gcagagctgttctgtgggga

SEQ ID NO: 8107146 - DNA, 22 bp, Homo sapiens
gcagagctggtacttgagcctg

SEQ ID NO: 8107147 - DNA, 22 bp, Homo sapiens
gcagagctgtctaagtcacttc

SEQ ID NO: 8107148 - DNA, 22 bp, Homo sapiens
gcagagcttctgtccttcagga

SEQ ID NO: 8107149 - DNA, 22 bp, Homo sapiens
attccactttatgtctgtatga

SEQ ID NO: 8107150 - DNA, 22 bp, Homo sapiens
attcctcattatttactgagga

SEQ ID NO: 8107151 - DNA, 20 bp, Homo sapiens
attcctcagccccagcctca

SEQ ID NO: 8107152 - DNA, 22 bp, Homo sapiens
attctacatttggagtgatgtc

SEQ ID NO: 8107153 - DNA, 22 bp, Homo sapiens
attgcacttcagcctgggtgac

SEQ ID NO: 8107154 - DNA, 22 bp, Homo sapiens
attgacacaatgggatgtaagg

SEQ ID NO: 8107155 - DNA, 22 bp, Homo sapiens
attctcaatggctactttcata

SEQ ID NO: 8107156 - DNA, 22 bp, Homo sapiens
attctcagatcttagaggaata

SEQ ID NO: 8107157 - DNA, 21 bp, Homo sapiens
attctcaggcccatcctcagg

SEQ ID NO: 8107158 - DNA, 22 bp, Homo sapiens
attcttcacatggataggatct

SEQ ID NO: 8107159 - DNA, 22 bp, Homo sapiens
attcttcacataagtgctgtac

SEQ ID NO: 8107160 - DNA, 22 bp, Homo sapiens
attcttcaccatggataatttg

SEQ ID NO: 8107161 - DNA, 22 bp, Homo sapiens
atgtgttagtttgtgattatac

SEQ ID NO: 8107162 - DNA, 19 bp, Homo sapiens
atgttttatgctgatggga

SEQ ID NO: 8107163 - DNA, 22 bp, Homo sapiens
atgttttattaccaacttgtac

SEQ ID NO: 8107164 - DNA, 22 bp, Homo sapiens
attaaaagcttcccaagagtta

SEQ ID NO: 8107165 - DNA, 22 bp, Homo sapiens
attaaaagcttcccaagagtta

SEQ ID NO: 8107166 - DNA, 22 bp, Homo sapiens
attaaatggtggtcattcattt

SEQ ID NO: 8107167 - DNA, 22 bp, Homo sapiens
atgtttttcataccagtgttgg

SEQ ID NO: 8107168 - DNA, 22 bp, Homo sapiens
atgtttttggaaatgggaacat

SEQ ID NO: 8107169 - DNA, 22 bp, Homo sapiens
attaaattaagtggctaattta

SEQ ID NO: 8107170 - DNA, 22 bp, Homo sapiens
gcaagaaaaaggcttcatgaac

SEQ ID NO: 8107171 - DNA, 22 bp, Homo sapiens
attacaaaagaagggagaaggt

SEQ ID NO: 8107172 - DNA, 22 bp, Homo sapiens
attaatttttctgacagccaca

SEQ ID NO: 8107173 - DNA, 22 bp, Homo sapiens
attaatcatttctgcattatct

SEQ ID NO: 8107174 - DNA, 22 bp, Homo sapiens
attattcattggtaggcaagct

SEQ ID NO: 8107175 - DNA, 22 bp, Homo sapiens
attattcatggtcttccacaat

SEQ ID NO: 8107176 - DNA, 22 bp, Homo sapiens
attattcaatgttatttcagtg

SEQ ID NO: 8107177 - DNA, 22 bp, Homo sapiens
attattcattggtaggcaagct

SEQ ID NO: 8107178 - DNA, 22 bp, Homo sapiens
attattcagtcttgtaaggagt

SEQ ID NO: 8107179 - DNA, 20 bp, Homo sapiens
attattcatacatgtgtgac

SEQ ID NO: 8107180 - DNA, 22 bp, Homo sapiens
attattcaatgttatttcagtg

SEQ ID NO: 8107181 - DNA, 22 bp, Homo sapiens
attattaaagctacatcaagga

SEQ ID NO: 8107182 - DNA, 22 bp, Homo sapiens
attattcaatcatattaaaagt

SEQ ID NO: 8107183 - DNA, 22 bp, Homo sapiens
attattcaatcatattaaaagt

SEQ ID NO: 8107184 - DNA, 22 bp, Homo sapiens
attattcaatcatattaaaagt

SEQ ID NO: 8107185 - DNA, 22 bp, Homo sapiens
attattaaagctacatcaagga

SEQ ID NO: 8107186 - DNA, 17 bp, Homo sapiens
gcaagggatgggagatt

SEQ ID NO: 8107187 - DNA, 22 bp, Homo sapiens
attagaattatgcttgctaatg

SEQ ID NO: 8107188 - DNA, 22 bp, Homo sapiens
attagaatgaagtataggattt

SEQ ID NO: 8107189 - DNA, 22 bp, Homo sapiens
attagaatgacagaaatgaggc

SEQ ID NO: 8107190 - DNA, 22 bp, Homo sapiens
gcctgggagattaattaggaag

SEQ ID NO: 8107191 - DNA, 22 bp, Homo sapiens
gcctgggagcacatcggggtcc

SEQ ID NO: 8107192 - DNA, 22 bp, Homo sapiens
gcctgggagatgcgttgtggcc

SEQ ID NO: 8107193 - DNA, 22 bp, Homo sapiens
gcctgggagagggatagtgcag

SEQ ID NO: 8107194 - DNA, 22 bp, Homo sapiens
gcctgctgggagacacccccag

SEQ ID NO: 8107195 - DNA, 22 bp, Homo sapiens
gcctggagctactggacactga

SEQ ID NO: 8107196 - DNA, 22 bp, Homo sapiens
gcctggagctcatgtgggcatt

SEQ ID NO: 8107197 - DNA, 22 bp, Homo sapiens
gcctgctggacattggccggcc

SEQ ID NO: 8107198 - DNA, 22 bp, Homo sapiens
gcctgctggacattggccggcc

SEQ ID NO: 8107199 - DNA, 22 bp, Homo sapiens
gcctgctgccaccctggctccg

SEQ ID NO: 8107200 - DNA, 21 bp, Homo sapiens
gcctgctgcctgtggccggtc

SEQ ID NO: 8107201 - DNA, 22 bp, Homo sapiens
gcctgctgccagaggcaaacac

SEQ ID NO: 8107202 - DNA, 21 bp, Homo sapiens
gcctgctgcctgtggccggtc

SEQ ID NO: 8107203 - DNA, 22 bp, Homo sapiens
gcctgctgccaccctggctccg

SEQ ID NO: 8107204 - DNA, 22 bp, Homo sapiens
gcctgctgccaccctggctccg

SEQ ID NO: 8107205 - DNA, 22 bp, Homo sapiens
gcctgctgcatccaggctattg

SEQ ID NO: 8107206 - DNA, 22 bp, Homo sapiens
gcctgctgcatccaggctattg

SEQ ID NO: 8107207 - DNA, 22 bp, Homo sapiens
gcctgctggatgtggccaggcc

SEQ ID NO: 8107208 - DNA, 22 bp, Homo sapiens
gcctgctggatcaagcttatgc

SEQ ID NO: 8107209 - DNA, 22 bp, Homo sapiens
gcctgctggaggagcctcaggg

SEQ ID NO: 8107210 - DNA, 22 bp, Homo sapiens
gcctgctggctggaaattctcc

SEQ ID NO: 8107211 - DNA, 22 bp, Homo sapiens
gcctgctggctgtccattgcag

SEQ ID NO: 8107212 - DNA, 22 bp, Homo sapiens
gcctgctggctgtccattgcag

SEQ ID NO: 8107213 - DNA, 22 bp, Homo sapiens
gcctgctggatgtggccaggcc

SEQ ID NO: 8107214 - DNA, 18 bp, Homo sapiens
gcctgcctagagcttgcc

SEQ ID NO: 8107215 - DNA, 22 bp, Homo sapiens
gcctctctctacccagtatgat

SEQ ID NO: 8107216 - DNA, 22 bp, Homo sapiens
gcctgctgaagccagagtgtgt

SEQ ID NO: 8107217 - DNA, 22 bp, Homo sapiens
gcctgctgaacctcatgcagtc

SEQ ID NO: 8107218 - DNA, 22 bp, Homo sapiens
gcctgctgaagccagagtgtgt

SEQ ID NO: 8107219 - DNA, 22 bp, Homo sapiens
gcctgctgagggaagttgggca

SEQ ID NO: 8107220 - DNA, 22 bp, Homo sapiens
gcctgctgagggaagttgggca

SEQ ID NO: 8107221 - DNA, 22 bp, Homo sapiens
gcctgctgaacctcatgcagtc

SEQ ID NO: 8107222 - DNA, 22 bp, Homo sapiens
atttctcagtgtacattatgtt

SEQ ID NO: 8107223 - DNA, 22 bp, Homo sapiens
atttctcagtgaaatgacaggc

SEQ ID NO: 8107224 - DNA, 22 bp, Homo sapiens
atttctcagtaggtgcacagtg

SEQ ID NO: 8107225 - DNA, 22 bp, Homo sapiens
gcctccagcccacgcaggcctg

SEQ ID NO: 8107226 - DNA, 22 bp, Homo sapiens
atttctcactgagcagataaaa

SEQ ID NO: 8107227 - DNA, 22 bp, Homo sapiens
atttctcaagtaaatgagtcat

SEQ ID NO: 8107228 - DNA, 23 bp, Homo sapiens
gcctgggagttgcgatctgcccg

SEQ ID NO: 8107229 - DNA, 18 bp, Homo sapiens
gcctgggaggaggaaatg

SEQ ID NO: 8107230 - DNA, 16 bp, Homo sapiens
gcctgggagggaacag

SEQ ID NO: 8107231 - DNA, 22 bp, Homo sapiens
gcctgggagggcagcagtgtgg

SEQ ID NO: 8107232 - DNA, 22 bp, Homo sapiens
gcctgggagtgcacagtgaggt

SEQ ID NO: 8107233 - DNA, 22 bp, Homo sapiens
gcctgtctacactttctctgca

SEQ ID NO: 8107234 - DNA, 22 bp, Homo sapiens
gcctgtctacactttctctgca

SEQ ID NO: 8107235 - DNA, 22 bp, Homo sapiens
gcctgtgactcgtcttgggcca

SEQ ID NO: 8107236 - DNA, 22 bp, Homo sapiens
gcctgtgacccctccatctgct

SEQ ID NO: 8107237 - DNA, 22 bp, Homo sapiens
gcctgtgcctcagcctgcagcc

SEQ ID NO: 8107238 - DNA, 23 bp, Homo sapiens
gcctgtgcctatgcccagctctg

SEQ ID NO: 8107239 - DNA, 22 bp, Homo sapiens
caaaacattctctgcagcaggg

SEQ ID NO: 8107240 - DNA, 22 bp, Homo sapiens
caaaactatcaggctcaaagct

SEQ ID NO: 8107241 - DNA, 22 bp, Homo sapiens
caaaaccaagaacattcatttc

SEQ ID NO: 8107242 - DNA, 22 bp, Homo sapiens
caaaactgtctagagagagaag

SEQ ID NO: 8107243 - DNA, 22 bp, Homo sapiens
gctcaggcaggagtgcagtggc

SEQ ID NO: 8107244 - DNA, 22 bp, Homo sapiens
caaactttgcaaaacttacagt

SEQ ID NO: 8107245 - DNA, 22 bp, Homo sapiens
caaactattgttcacaagacaa

SEQ ID NO: 8107246 - DNA, 22 bp, Homo sapiens
caaactatttacaatggaatca

SEQ ID NO: 8107247 - DNA, 22 bp, Homo sapiens
gcgcagagtagcagagtgctga

SEQ ID NO: 8107248 - DNA, 22 bp, Homo sapiens
atttcatactaaggctcaaaaa

SEQ ID NO: 8107249 - DNA, 22 bp, Homo sapiens
atttcatcccaggctctggaag

SEQ ID NO: 8107250 - DNA, 22 bp, Homo sapiens
atttcatccattaagagtactc

SEQ ID NO: 8107251 - DNA, 22 bp, Homo sapiens
atttcatccagagtcctattag

SEQ ID NO: 8107252 - DNA, 22 bp, Homo sapiens
atttcatctctggaacataact

SEQ ID NO: 8107253 - DNA, 22 bp, Homo sapiens
atttctactgtgagaaacatga

SEQ ID NO: 8107254 - DNA, 22 bp, Homo sapiens
atttcctttgcaaagactgtgc

SEQ ID NO: 8107255 - DNA, 22 bp, Homo sapiens
atttccttgcaagtttctgtaa

SEQ ID NO: 8107256 - DNA, 22 bp, Homo sapiens
atttccttcggacagtttgggt

SEQ ID NO: 8107257 - DNA, 22 bp, Homo sapiens
atttccttcccagatttggttc

SEQ ID NO: 8107258 - DNA, 22 bp, Homo sapiens
gccaggcctgcaagtgctggtg

SEQ ID NO: 8107259 - DNA, 19 bp, Homo sapiens
gccaggcctggacctgcag

SEQ ID NO: 8107260 - DNA, 22 bp, Homo sapiens
atttcacaaaccatcctgattt

SEQ ID NO: 8107261 - DNA, 22 bp, Homo sapiens
atttcagattcagaaatgtagg

SEQ ID NO: 8107262 - DNA, 22 bp, Homo sapiens
atttcagattcagaaatgtagg

SEQ ID NO: 8107263 - DNA, 22 bp, Homo sapiens
atttcagatgaccaaatggaaa

SEQ ID NO: 8107264 - DNA, 22 bp, Homo sapiens
atttcagattcgagaggaagtg

SEQ ID NO: 8107265 - DNA, 22 bp, Homo sapiens
atttcagattcgagaggaagtg

SEQ ID NO: 8107266 - DNA, 22 bp, Homo sapiens
atttcagagtgagagtgctcaa

SEQ ID NO: 8107267 - DNA, 22 bp, Homo sapiens
atttcagagtagatcgttattt

SEQ ID NO: 8107268 - DNA, 22 bp, Homo sapiens
atttcagagctttgcagctaat

SEQ ID NO: 8107269 - DNA, 22 bp, Homo sapiens
atttcagagaatgaacctaatc

SEQ ID NO: 8107270 - DNA, 21 bp, Homo sapiens
atttcagagcacacaagtaaa

SEQ ID NO: 8107271 - DNA, 22 bp, Homo sapiens
atttcagaatgtcctaatttag

SEQ ID NO: 8107272 - DNA, 22 bp, Homo sapiens
atttattggatgcttacttggg

SEQ ID NO: 8107273 - DNA, 22 bp, Homo sapiens
atttattgagcctttcctatgt

SEQ ID NO: 8107274 - DNA, 22 bp, Homo sapiens
atttattggatgcttacttggg

SEQ ID NO: 8107275 - DNA, 22 bp, Homo sapiens
atttattgagacttaacaaccc

SEQ ID NO: 8107276 - DNA, 22 bp, Homo sapiens
atttattgagacttaacaaccc

SEQ ID NO: 8107277 - DNA, 22 bp, Homo sapiens
atttattgagacttaacaaccc

SEQ ID NO: 8107278 - DNA, 22 bp, Homo sapiens
atttattgagagggaggggaat

SEQ ID NO: 8107279 - DNA, 22 bp, Homo sapiens
atttacacattcataagatttc

SEQ ID NO: 8107280 - DNA, 22 bp, Homo sapiens
attgcttatctatctttaagtc

SEQ ID NO: 8107281 - DNA, 22 bp, Homo sapiens
atttaaattttctgatggagag

SEQ ID NO: 8107282 - DNA, 22 bp, Homo sapiens
cttgcctttgtcttcaaaggct

SEQ ID NO: 8107283 - DNA, 22 bp, Homo sapiens
cttgctcacagtacctggcttg

SEQ ID NO: 8107284 - DNA, 19 bp, Homo sapiens
cttgcctgttcctacagct

SEQ ID NO: 8107285 - DNA, 22 bp, Homo sapiens
atctatactacaaatggctggt

SEQ ID NO: 8107286 - DNA, 22 bp, Homo sapiens
atctatactcagagttaatatc

SEQ ID NO: 8107287 - DNA, 22 bp, Homo sapiens
atctagaaaaggtgactaaaat

SEQ ID NO: 8107288 - DNA, 22 bp, Homo sapiens
atctacaggatagtttaatatt

SEQ ID NO: 8107289 - DNA, 19 bp, Homo sapiens
atctacaattattctcagt

SEQ ID NO: 8107290 - DNA, 19 bp, Homo sapiens
atctacaattattctcagt

SEQ ID NO: 8107291 - DNA, 22 bp, Homo sapiens
atctacagccagtctggtttgt

SEQ ID NO: 8107292 - DNA, 22 bp, Homo sapiens
atctagaacttaaagtcagtca

SEQ ID NO: 8107293 - DNA, 23 bp, Homo sapiens
atctagaaacctgatgactctgt

SEQ ID NO: 8107294 - DNA, 22 bp, Homo sapiens
atctagaaagtgttgaagatca

SEQ ID NO: 8107295 - DNA, 22 bp, Homo sapiens
atctagaagtggcatgaattac

SEQ ID NO: 8107296 - DNA, 22 bp, Homo sapiens
atctagcagtgttataattgga

SEQ ID NO: 8107297 - DNA, 22 bp, Homo sapiens
atctagctagatcctgtccacc

SEQ ID NO: 8107298 - DNA, 22 bp, Homo sapiens
atctagattaggtataagagct

SEQ ID NO: 8107299 - DNA, 22 bp, Homo sapiens
cttggcagcttttggaggagcc

SEQ ID NO: 8107300 - DNA, 22 bp, Homo sapiens
cttggcagggtggaggatgcag

SEQ ID NO: 8107301 - DNA, 22 bp, Homo sapiens
cttggccagacagggagctcca

SEQ ID NO: 8107302 - DNA, 22 bp, Homo sapiens
cttggcctcttctcagggtggg

SEQ ID NO: 8107303 - DNA, 22 bp, Homo sapiens
cttggtctaatggtaataagca

SEQ ID NO: 8107304 - DNA, 22 bp, Homo sapiens
atcttctggtcaaatttttgca

SEQ ID NO: 8107305 - DNA, 19 bp, Homo sapiens
cttttcaagccatcagttt

SEQ ID NO: 8107306 - DNA, 22 bp, Homo sapiens
cttttcaaacgctgatgtcagt

SEQ ID NO: 8107307 - DNA, 22 bp, Homo sapiens
cttttcaaacgctgatgtcagt

SEQ ID NO: 8107308 - DNA, 19 bp, Homo sapiens
cttttcaagccatcagttt

SEQ ID NO: 8107309 - DNA, 19 bp, Homo sapiens
cttttcaagccatcagttt

SEQ ID NO: 8107310 - DNA, 19 bp, Homo sapiens
cttttcatcaacagccaat

SEQ ID NO: 8107311 - DNA, 22 bp, Homo sapiens
cttttcatgagtctgttatggg

SEQ ID NO: 8107312 - DNA, 22 bp, Homo sapiens
atgaaattaatcaacacataca

SEQ ID NO: 8107313 - DNA, 22 bp, Homo sapiens
cttttattttgaattaagggct

SEQ ID NO: 8107314 - DNA, 22 bp, Homo sapiens
atgaaatatcttgaagaaattc

SEQ ID NO: 8107315 - DNA, 22 bp, Homo sapiens
atgaaatgtctggatctttttc

SEQ ID NO: 8107316 - DNA, 22 bp, Homo sapiens
cttgtgtagtgctccacagtga

SEQ ID NO: 8107317 - DNA, 22 bp, Homo sapiens
atgaaaagggagtgatatttgt

SEQ ID NO: 8107318 - DNA, 18 bp, Homo sapiens
cttgttcttctcttggcg

SEQ ID NO: 8107319 - DNA, 22 bp, Homo sapiens
atctttttatctgtttggaaca

SEQ ID NO: 8107320 - DNA, 22 bp, Homo sapiens
atctttttgacatggtgatggt

SEQ ID NO: 8107321 - DNA, 22 bp, Homo sapiens
atctttttgacatggtgatggt

SEQ ID NO: 8107322 - DNA, 22 bp, Homo sapiens
atcttttttgtcttggtcactg

SEQ ID NO: 8107323 - DNA, 22 bp, Homo sapiens
atgaaaactttagcctcattag

SEQ ID NO: 8107324 - DNA, 22 bp, Homo sapiens
atgaaaacggaccagagctatt

SEQ ID NO: 8107325 - DNA, 22 bp, Homo sapiens
atcttgcttccttttaattacc

SEQ ID NO: 8107326 - DNA, 22 bp, Homo sapiens
atcttttctgtttgctatgtct

SEQ ID NO: 8107327 - DNA, 22 bp, Homo sapiens
gaaagcagctaagtcttatgat

SEQ ID NO: 8107328 - DNA, 22 bp, Homo sapiens
atgaggtcacagtgtttggcat

SEQ ID NO: 8107329 - DNA, 22 bp, Homo sapiens
atgagtaagtgaatctccaaag

SEQ ID NO: 8107330 - DNA, 22 bp, Homo sapiens
atgaggtgttcgctggcctttt

SEQ ID NO: 8107331 - DNA, 22 bp, Homo sapiens
atgaggtttgagcctcttgacc

SEQ ID NO: 8107332 - DNA, 22 bp, Homo sapiens
atgattcagcccaatttttcta

SEQ ID NO: 8107333 - DNA, 22 bp, Homo sapiens
gaaagcaatttgtgtaatctgt

SEQ ID NO: 8107334 - DNA, 22 bp, Homo sapiens
atgcattctgtagagcatttat

SEQ ID NO: 8107335 - DNA, 22 bp, Homo sapiens
atgcatgatcctgagcaaccca

SEQ ID NO: 8107336 - DNA, 22 bp, Homo sapiens
atgcatctatgacttagacatt

SEQ ID NO: 8107337 - DNA, 20 bp, Homo sapiens
atgcatctggtatctttcct

SEQ ID NO: 8107338 - DNA, 22 bp, Homo sapiens
atgcagctgctgacagctttca

SEQ ID NO: 8107339 - DNA, 22 bp, Homo sapiens
atgcagcttcaggattatgatg

SEQ ID NO: 8107340 - DNA, 22 bp, Homo sapiens
atgcagctgtcagggagaacat

SEQ ID NO: 8107341 - DNA, 22 bp, Homo sapiens
atgcagcttcaggattatgatg

SEQ ID NO: 8107342 - DNA, 22 bp, Homo sapiens
atgcagcttccatattttgctg

SEQ ID NO: 8107343 - DNA, 22 bp, Homo sapiens
atgcagcagtttacaaagcaat

SEQ ID NO: 8107344 - DNA, 22 bp, Homo sapiens
atgcagcagctacttgggaagg

SEQ ID NO: 8107345 - DNA, 20 bp, Homo sapiens
atgcagcattgttgtggcaa

SEQ ID NO: 8107346 - DNA, 22 bp, Homo sapiens
atgcagctagattttccagtgt

SEQ ID NO: 8107347 - DNA, 22 bp, Homo sapiens
atgcagctcatttgtttaaaag

SEQ ID NO: 8107348 - DNA, 22 bp, Homo sapiens
atgcacttcaagcatctctctg

SEQ ID NO: 8107349 - DNA, 22 bp, Homo sapiens
atgcactttctagagattctga

SEQ ID NO: 8107350 - DNA, 22 bp, Homo sapiens
atgcacttgcgtgtttgcaaat

SEQ ID NO: 8107351 - DNA, 22 bp, Homo sapiens
atgcagaaagcggcaaacaggt

SEQ ID NO: 8107352 - DNA, 22 bp, Homo sapiens
atgcagaaagagaatgtaatgt

SEQ ID NO: 8107353 - DNA, 22 bp, Homo sapiens
atgcactttgtaatctgttcaa

SEQ ID NO: 8107354 - DNA, 22 bp, Homo sapiens
atgcagaagcagaacttacaca

SEQ ID NO: 8107355 - DNA, 22 bp, Homo sapiens
atgcagaagactgaaaagctga

SEQ ID NO: 8107356 - DNA, 22 bp, Homo sapiens
atgcagaatcttgagaaaaatt

SEQ ID NO: 8107357 - DNA, 23 bp, Homo sapiens
atgcagagaataacaaatgccat

SEQ ID NO: 8107358 - DNA, 22 bp, Homo sapiens
atgcagatgtttggttcattgt

SEQ ID NO: 8107359 - DNA, 22 bp, Homo sapiens
atgcagatttctttgctgcacc

SEQ ID NO: 8107360 - DNA, 18 bp, Homo sapiens
atgcagcaatcagaaata

SEQ ID NO: 8107361 - DNA, 22 bp, Homo sapiens
atgcagcactgatctttagcca

SEQ ID NO: 8107362 - DNA, 22 bp, Homo sapiens
atgcagcagccccttgaggtgc

SEQ ID NO: 8107363 - DNA, 22 bp, Homo sapiens
atgcagataagaatcaggtttg

SEQ ID NO: 8107364 - DNA, 22 bp, Homo sapiens
atggaagggacagaagggcaag

SEQ ID NO: 8107365 - DNA, 22 bp, Homo sapiens
atggaaggtcctacagagcgca

SEQ ID NO: 8107366 - DNA, 22 bp, Homo sapiens
atggaaggctttatgactcaaa

SEQ ID NO: 8107367 - DNA, 22 bp, Homo sapiens
gacagaggctggagcacctcct

SEQ ID NO: 8107368 - DNA, 22 bp, Homo sapiens
atgccactgcacttcagcttgg

SEQ ID NO: 8107369 - DNA, 22 bp, Homo sapiens
atgccactgcgctccagcctgg

SEQ ID NO: 8107370 - DNA, 22 bp, Homo sapiens
gagccagctgagctgcactgtc

SEQ ID NO: 8107371 - DNA, 22 bp, Homo sapiens
gagccaggaggcagagactgca

SEQ ID NO: 8107372 - DNA, 22 bp, Homo sapiens
gagccaggcccgtacttgctgt

SEQ ID NO: 8107373 - DNA, 22 bp, Homo sapiens
atggctgcttcagtaccagttc

SEQ ID NO: 8107374 - DNA, 22 bp, Homo sapiens
gagccagcctccgcctctctcc

SEQ ID NO: 8107375 - DNA, 22 bp, Homo sapiens
gagaggaaagaaccaatgaccc

SEQ ID NO: 8107376 - DNA, 22 bp, Homo sapiens
gagaggaaagaaccaatgaccc

SEQ ID NO: 8107377 - DNA, 22 bp, Homo sapiens
gagagctgtggtttgaccaggc

SEQ ID NO: 8107378 - DNA, 22 bp, Homo sapiens
gagaggaagccagggggtgttg

SEQ ID NO: 8107379 - DNA, 22 bp, Homo sapiens
gaggctgcggggaggagcctgc

SEQ ID NO: 8107380 - DNA, 22 bp, Homo sapiens
gaggcctggctctgccctcctg

SEQ ID NO: 8107381 - DNA, 22 bp, Homo sapiens
gaggcctggagccgcctaggcg

SEQ ID NO: 8107382 - DNA, 22 bp, Homo sapiens
gaggcctggctgggaggaggtg

SEQ ID NO: 8107383 - DNA, 22 bp, Homo sapiens
gaggcctggctgtcagtcccca

SEQ ID NO: 8107384 - DNA, 22 bp, Homo sapiens
gaggcctgggttacctactcgt

SEQ ID NO: 8107385 - DNA, 22 bp, Homo sapiens
atgtctgctttccttttaatca

SEQ ID NO: 8107386 - DNA, 22 bp, Homo sapiens
gaggcctgggcaagggggtctg

SEQ ID NO: 8107387 - DNA, 22 bp, Homo sapiens
gaggcctgggagcctgtcctcc

SEQ ID NO: 8107388 - DNA, 16 bp, Homo sapiens
gaggggagcagtaggc

SEQ ID NO: 8107389 - DNA, 22 bp, Homo sapiens
gaggggagcatgatctagattg

SEQ ID NO: 8107390 - DNA, 22 bp, Homo sapiens
gaggggagcccccatcctccag

SEQ ID NO: 8107391 - DNA, 22 bp, Homo sapiens
gaggggaagacttctggacagt

SEQ ID NO: 8107392 - DNA, 22 bp, Homo sapiens
atgtgtattaccctttcattcc

SEQ ID NO: 8107393 - DNA, 22 bp, Homo sapiens
gaggagctgggctgagagggtc

SEQ ID NO: 8107394 - DNA, 20 bp, Homo sapiens
atgtactccccacaagcaac

SEQ ID NO: 8107395 - DNA, 22 bp, Homo sapiens
gaggagctgcagggggagtcta

SEQ ID NO: 8107396 - DNA, 21 bp, Homo sapiens
gagctgggcgaggctccgggg

SEQ ID NO: 8107397 - DNA, 22 bp, Homo sapiens
gagctgggcctgcgagtgctgc

SEQ ID NO: 8107398 - DNA, 22 bp, Homo sapiens
atggtcagttgcagctaatgtt

SEQ ID NO: 8107399 - DNA, 23 bp, Homo sapiens
atggtcagaattttccagctgag

SEQ ID NO: 8107400 - DNA, 22 bp, Homo sapiens
atggtactggggtcccggagtt

SEQ ID NO: 8107401 - DNA, 22 bp, Homo sapiens
ggcatatgtagcgtgtgttctg

SEQ ID NO: 8107402 - DNA, 22 bp, Homo sapiens
cacccaggctggaatgcagtgg

SEQ ID NO: 8107403 - DNA, 22 bp, Homo sapiens
caccctgaaggctggccctgac

SEQ ID NO: 8107404 - DNA, 22 bp, Homo sapiens
caccctgaggccacccagacct

SEQ ID NO: 8107405 - DNA, 22 bp, Homo sapiens
caccctggaatagccccgggag

SEQ ID NO: 8107406 - DNA, 22 bp, Homo sapiens
caccctcccgtcagcccctggg

SEQ ID NO: 8107407 - DNA, 22 bp, Homo sapiens
cacccctgggctgggcacacag

SEQ ID NO: 8107408 - DNA, 22 bp, Homo sapiens
ggcagtgtccttgcagctctac

SEQ ID NO: 8107409 - DNA, 22 bp, Homo sapiens
caccatcagcagcaggtgtcaa

SEQ ID NO: 8107410 - DNA, 22 bp, Homo sapiens
caccatcttggcaaaggttcgc

SEQ ID NO: 8107411 - DNA, 22 bp, Homo sapiens
cacccacatggaaattcacagt

SEQ ID NO: 8107412 - DNA, 22 bp, Homo sapiens
cactggaatggattggccgtgg

SEQ ID NO: 8107413 - DNA, 22 bp, Homo sapiens
ggctagggagacagagggcatg

SEQ ID NO: 8107414 - DNA, 22 bp, Homo sapiens
ggcctctcatgtcctgggcttc

SEQ ID NO: 8107415 - DNA, 22 bp, Homo sapiens
ggcctctcagggcagagaccct

SEQ ID NO: 8107416 - DNA, 22 bp, Homo sapiens
ggcctctcatgcccagagccaa

SEQ ID NO: 8107417 - DNA, 22 bp, Homo sapiens
ggatgggagcagaggacgacca

SEQ ID NO: 8107418 - DNA, 22 bp, Homo sapiens
ggagggagtcagctgattagaa

SEQ ID NO: 8107419 - DNA, 22 bp, Homo sapiens
ggaggcggaggctgcagtgagc

SEQ ID NO: 8107420 - DNA, 22 bp, Homo sapiens
ggagggagcatccccttgctga

SEQ ID NO: 8107421 - DNA, 22 bp, Homo sapiens
ggatgggcagacaggacggcac

SEQ ID NO: 8107422 - DNA, 22 bp, Homo sapiens
cacagggaggacatcaacagtg

SEQ ID NO: 8107423 - DNA, 22 bp, Homo sapiens
cacagggagttacagaagcact

SEQ ID NO: 8107424 - DNA, 22 bp, Homo sapiens
ggaggcggagcttgcagtgagc

SEQ ID NO: 8107425 - DNA, 22 bp, Homo sapiens
ggaggcgcggctcggctgtgcc

SEQ ID NO: 8107426 - DNA, 22 bp, Homo sapiens
ggaggcggaagttgcagtgagc

SEQ ID NO: 8107427 - DNA, 22 bp, Homo sapiens
ggcagagcttgcagtgagccga

SEQ ID NO: 8107428 - DNA, 17 bp, Homo sapiens
ggcagagctgacagggc

SEQ ID NO: 8107429 - DNA, 22 bp, Homo sapiens
ggcagagccttctggagctcgc

SEQ ID NO: 8107430 - DNA, 22 bp, Homo sapiens
ggcagcagttacaaatgtgcag

SEQ ID NO: 8107431 - DNA, 22 bp, Homo sapiens
ggcagcagtggctgctattgtc

SEQ ID NO: 8107432 - DNA, 22 bp, Homo sapiens
gcttggcatttgctgggagctg

SEQ ID NO: 8107433 - DNA, 22 bp, Homo sapiens
caatttctctttatatctcaca

SEQ ID NO: 8107434 - DNA, 22 bp, Homo sapiens
caatttctaacattccatggat

SEQ ID NO: 8107435 - DNA, 19 bp, Homo sapiens
gcttgggagagggagctaa

SEQ ID NO: 8107436 - DNA, 22 bp, Homo sapiens
gcttgggactggagaatagggt

SEQ ID NO: 8107437 - DNA, 22 bp, Homo sapiens
gctgtaaataagcttacttgaa

SEQ ID NO: 8107438 - DNA, 22 bp, Homo sapiens
caaggaggcagtgggacttgaa

SEQ ID NO: 8107439 - DNA, 20 bp, Homo sapiens
gctgtggcaagtgctcactg

SEQ ID NO: 8107440 - DNA, 22 bp, Homo sapiens
gctgtctgactccaagttggag

SEQ ID NO: 8107441 - DNA, 22 bp, Homo sapiens
gctgtctgagaacatggtggaa

SEQ ID NO: 8107442 - DNA, 19 bp, Homo sapiens
gctgtctgatgctgaggtc

SEQ ID NO: 8107443 - DNA, 22 bp, Homo sapiens
gctgtctgagtaagagaatcct

SEQ ID NO: 8107444 - DNA, 22 bp, Homo sapiens
gctgtctgcaagccaggaaatg

SEQ ID NO: 8107445 - DNA, 22 bp, Homo sapiens
cacaataaatgtttgctgatga

SEQ ID NO: 8107446 - DNA, 22 bp, Homo sapiens
cacaatcataatgtatgtacat

SEQ ID NO: 8107447 - DNA, 22 bp, Homo sapiens
cacaaggttctgtaaaatcaaa

SEQ ID NO: 8107448 - DNA, 22 bp, Homo sapiens
cacaaaggagaatgtcagcata

SEQ ID NO: 8107449 - DNA, 22 bp, Homo sapiens
cacaaaatatcaagcactttta

SEQ ID NO: 8107450 - DNA, 22 bp, Homo sapiens
cacaaaatctttctcgattatt

SEQ ID NO: 8107451 - DNA, 22 bp, Homo sapiens
cacaaagttggacaacgcaccc

SEQ ID NO: 8107452 - DNA, 22 bp, Homo sapiens
cacaccaaagtatttggtattt

SEQ ID NO: 8107453 - DNA, 22 bp, Homo sapiens
cacacattcaccatgactgaaa

SEQ ID NO: 8107454 - DNA, 22 bp, Homo sapiens
cacaccctcgtgctccctcccg

SEQ ID NO: 8107455 - DNA, 22 bp, Homo sapiens
cacacagtgggaaaacctgaag

SEQ ID NO: 8107456 - DNA, 22 bp, Homo sapiens
caaggaggaagatgcaggggac

SEQ ID NO: 8107457 - DNA, 22 bp, Homo sapiens
caagatgaatgatgaagtgtgt

SEQ ID NO: 8107458 - DNA, 22 bp, Homo sapiens
caaggaatcccatttctaactc

SEQ ID NO: 8107459 - DNA, 22 bp, Homo sapiens
caagatcacacaggtaacaagt

SEQ ID NO: 8107460 - DNA, 22 bp, Homo sapiens
caactacaggaaaagtcattca

SEQ ID NO: 8107461 - DNA, 22 bp, Homo sapiens
gctgccttcccggaatgtcatc

SEQ ID NO: 8107462 - DNA, 22 bp, Homo sapiens
gctgctggccccacatgctcca

SEQ ID NO: 8107463 - DNA, 22 bp, Homo sapiens
gctgctggcatctagggggtgg

SEQ ID NO: 8107464 - DNA, 22 bp, Homo sapiens
gctgctggccccacatgctcca

SEQ ID NO: 8107465 - DNA, 22 bp, Homo sapiens
gctgctggagagcgagactgtt

SEQ ID NO: 8107466 - DNA, 22 bp, Homo sapiens
gctgctggagctttgcagaagg

SEQ ID NO: 8107467 - DNA, 22 bp, Homo sapiens
gctgctggagagcgagactgtt

SEQ ID NO: 8107468 - DNA, 22 bp, Homo sapiens
gctgctggagagcgagactgtt

SEQ ID NO: 8107469 - DNA, 22 bp, Homo sapiens
gctgctggcactggagtgagcc

SEQ ID NO: 8107470 - DNA, 22 bp, Homo sapiens
gctgctggcactggagtgagcc

SEQ ID NO: 8107471 - DNA, 22 bp, Homo sapiens
gctgctggatgcgcttgatggt

SEQ ID NO: 8107472 - DNA, 22 bp, Homo sapiens
gctgcagtgagccaagatcgtg

SEQ ID NO: 8107473 - DNA, 22 bp, Homo sapiens
gctgcagccttcttgccattaa

SEQ ID NO: 8107474 - DNA, 17 bp, Homo sapiens
gctgcagcggtaggcag

SEQ ID NO: 8107475 - DNA, 23 bp, Homo sapiens
gctgccacagggctcaggcaggt

SEQ ID NO: 8107476 - DNA, 22 bp, Homo sapiens
caacagtcttgagataaaactt

SEQ ID NO: 8107477 - DNA, 22 bp, Homo sapiens
caacatctttgtgtatgtgaga

SEQ ID NO: 8107478 - DNA, 22 bp, Homo sapiens
caacatattttccaagagtgaa

SEQ ID NO: 8107479 - DNA, 22 bp, Homo sapiens
caacatcagtcctcatgagaca

SEQ ID NO: 8107480 - DNA, 22 bp, Homo sapiens
caacagtttatagtgttatctt

SEQ ID NO: 8107481 - DNA, 22 bp, Homo sapiens
caaagtatattggattgaatgg

SEQ ID NO: 8107482 - DNA, 22 bp, Homo sapiens
caaagtatatttcatagtctca

SEQ ID NO: 8107483 - DNA, 22 bp, Homo sapiens
caaagtatgaaccagtttctct

SEQ ID NO: 8107484 - DNA, 17 bp, Homo sapiens
gctcctgcaggtcagga

SEQ ID NO: 8107485 - DNA, 22 bp, Homo sapiens
gctcctgccctcttgcaattcc

SEQ ID NO: 8107486 - DNA, 22 bp, Homo sapiens
gctcctgcaggacccaggagac

SEQ ID NO: 8107487 - DNA, 22 bp, Homo sapiens
gctcctgcagagatgttccatg

SEQ ID NO: 8107488 - DNA, 22 bp, Homo sapiens
gctcctgcagagatgttccatg

SEQ ID NO: 8107489 - DNA, 22 bp, Homo sapiens
gctcctggagagattgagaaag

SEQ ID NO: 8107490 - DNA, 22 bp, Homo sapiens
gggaaggaaatcttgcttgtga

SEQ ID NO: 8107491 - DNA, 18 bp, Homo sapiens
gggaagccgggaagccgg

SEQ ID NO: 8107492 - DNA, 19 bp, Homo sapiens
gggactggaggatgtggag

SEQ ID NO: 8107493 - DNA, 22 bp, Homo sapiens
gggactggcacagggctgggag

SEQ ID NO: 8107494 - DNA, 22 bp, Homo sapiens
gggactggagtagaggccggtg

SEQ ID NO: 8107495 - DNA, 22 bp, Homo sapiens
cactgggacctaggactgagct

SEQ ID NO: 8107496 - DNA, 21 bp, Homo sapiens
cagaagtaagggtaacttctc

SEQ ID NO: 8107497 - DNA, 22 bp, Homo sapiens
cagaagtaatgatgtcattcct

SEQ ID NO: 8107498 - DNA, 22 bp, Homo sapiens
gggaaactcacaggtgcagggg

SEQ ID NO: 8107499 - DNA, 22 bp, Homo sapiens
gggaaactggggactgaatctg

SEQ ID NO: 8107500 - DNA, 22 bp, Homo sapiens
gggaaactgcaactcagagagg

SEQ ID NO: 8107501 - DNA, 22 bp, Homo sapiens
gggagggcttggacccagatgt

SEQ ID NO: 8107502 - DNA, 22 bp, Homo sapiens
gggagggccagtgctctctaga

SEQ ID NO: 8107503 - DNA, 22 bp, Homo sapiens
gggaggtgaaaggttgctgcag

SEQ ID NO: 8107504 - DNA, 22 bp, Homo sapiens
gggaggtcagggtgcctgctgg

SEQ ID NO: 8107505 - DNA, 22 bp, Homo sapiens
gggaggtgaaaggtcatgtgtg

SEQ ID NO: 8107506 - DNA, 22 bp, Homo sapiens
gggagggtctgagagctgcacc

SEQ ID NO: 8107507 - DNA, 22 bp, Homo sapiens
cagaagtttgaatgagagcctg

SEQ ID NO: 8107508 - DNA, 22 bp, Homo sapiens
cagaagttgccacatgaccctt

SEQ ID NO: 8107509 - DNA, 22 bp, Homo sapiens
cagaagttcatttagcctctct

SEQ ID NO: 8107510 - DNA, 22 bp, Homo sapiens
gggcagagaaatggacagttgg

SEQ ID NO: 8107511 - DNA, 22 bp, Homo sapiens
cagagccagctgtccttggcat

SEQ ID NO: 8107512 - DNA, 22 bp, Homo sapiens
gggccttgccatggagcctgag

SEQ ID NO: 8107513 - DNA, 22 bp, Homo sapiens
gggccttgccatggagcctgag

SEQ ID NO: 8107514 - DNA, 22 bp, Homo sapiens
gggccttcagccttggactgag

SEQ ID NO: 8107515 - DNA, 22 bp, Homo sapiens
gggcgagggcgaaagcgagagc

SEQ ID NO: 8107516 - DNA, 22 bp, Homo sapiens
cagagccctcaaggccgatgca

SEQ ID NO: 8107517 - DNA, 22 bp, Homo sapiens
cagagccctgtgtgccatgtga

SEQ ID NO: 8107518 - DNA, 22 bp, Homo sapiens
cagagctgacccaaggattgaa

SEQ ID NO: 8107519 - DNA, 21 bp, Homo sapiens
cagagctgaagggtgtagtgt

SEQ ID NO: 8107520 - DNA, 22 bp, Homo sapiens
cagagctgacccaaggattgaa

SEQ ID NO: 8107521 - DNA, 22 bp, Homo sapiens
cagagctgagaatgttgatgct

SEQ ID NO: 8107522 - DNA, 22 bp, Homo sapiens
cagagctgcaaatgcccctccg

SEQ ID NO: 8107523 - DNA, 22 bp, Homo sapiens
cagagctgcacattctatgatg

SEQ ID NO: 8107524 - DNA, 22 bp, Homo sapiens
cagagctgcagattgaaggcat

SEQ ID NO: 8107525 - DNA, 22 bp, Homo sapiens
cagagctgagtcttcaaggttg

SEQ ID NO: 8107526 - DNA, 22 bp, Homo sapiens
cagagctgattggatccagaga

SEQ ID NO: 8107527 - DNA, 22 bp, Homo sapiens
gggctgtgtactatgaggaggg

SEQ ID NO: 8107528 - DNA, 19 bp, Homo sapiens
cagagctgctggcctcgtc

SEQ ID NO: 8107529 - DNA, 22 bp, Homo sapiens
cagagctgctcatggtggccag

SEQ ID NO: 8107530 - DNA, 22 bp, Homo sapiens
cagagctgctcatggtggccag

SEQ ID NO: 8107531 - DNA, 22 bp, Homo sapiens
cagagctgcgctttttcctggt

SEQ ID NO: 8107532 - DNA, 22 bp, Homo sapiens
cagagctgtatttatctttcca

SEQ ID NO: 8107533 - DNA, 22 bp, Homo sapiens
cagagctgtcatttgccagtga

SEQ ID NO: 8107534 - DNA, 22 bp, Homo sapiens
cagagctggtgttacaagtcca

SEQ ID NO: 8107535 - DNA, 22 bp, Homo sapiens
cagagctggtgtgtcctggcat

SEQ ID NO: 8107536 - DNA, 22 bp, Homo sapiens
cagagctggtaagtggtagagg

SEQ ID NO: 8107537 - DNA, 22 bp, Homo sapiens
cagaggccaggctgcctgactg

SEQ ID NO: 8107538 - DNA, 22 bp, Homo sapiens
cagaggccagggggctcacaaa

SEQ ID NO: 8107539 - DNA, 19 bp, Homo sapiens
cagaggccagaagcacagg

SEQ ID NO: 8107540 - DNA, 22 bp, Homo sapiens
cagaggctgggacctcaggcat

SEQ ID NO: 8107541 - DNA, 22 bp, Homo sapiens
gggtgccctgggtaggtcagtt

SEQ ID NO: 8107542 - DNA, 22 bp, Homo sapiens
cagaggcctggcttggacacct

SEQ ID NO: 8107543 - DNA, 22 bp, Homo sapiens
cagcagctacttggagcagcag

SEQ ID NO: 8107544 - DNA, 22 bp, Homo sapiens
cagcagcctggcccctcctcgg

SEQ ID NO: 8107545 - DNA, 22 bp, Homo sapiens
cagcagcctcttgtgcctgtgg

SEQ ID NO: 8107546 - DNA, 22 bp, Homo sapiens
cagcagcctccactcgccccac

SEQ ID NO: 8107547 - DNA, 22 bp, Homo sapiens
cagcagcaacaacggaagcctt

SEQ ID NO: 8107548 - DNA, 22 bp, Homo sapiens
cagcagcaacaatagcggtcac

SEQ ID NO: 8107549 - DNA, 22 bp, Homo sapiens
cagcagcaaatctagaagagga

SEQ ID NO: 8107550 - DNA, 22 bp, Homo sapiens
cagcagagcttatgttgggtca

SEQ ID NO: 8107551 - DNA, 22 bp, Homo sapiens
gtatcggtttatttttgggata

SEQ ID NO: 8107552 - DNA, 22 bp, Homo sapiens
gtatcctccccgctggccttca

SEQ ID NO: 8107553 - DNA, 22 bp, Homo sapiens
gtatcctttgcggaaatttcta

SEQ ID NO: 8107554 - DNA, 22 bp, Homo sapiens
gtatctagtcaatgctgttcaa

SEQ ID NO: 8107555 - DNA, 22 bp, Homo sapiens
cagcagcagagatactggtttc

SEQ ID NO: 8107556 - DNA, 22 bp, Homo sapiens
cagcagcagattcagcgtctgg

SEQ ID NO: 8107557 - DNA, 20 bp, Homo sapiens
gtaaaatatggtctttgggt

SEQ ID NO: 8107558 - DNA, 22 bp, Homo sapiens
gtaaaatagaataacgtggcta

SEQ ID NO: 8107559 - DNA, 22 bp, Homo sapiens
ggttccccaggcggcccttgga

SEQ ID NO: 8107560 - DNA, 22 bp, Homo sapiens
ggtgggagagctctgtctccag

SEQ ID NO: 8107561 - DNA, 22 bp, Homo sapiens
ggtggggctgcaagcagttcgg

SEQ ID NO: 8107562 - DNA, 22 bp, Homo sapiens
ggtggggctcagcaatctgtgt

SEQ ID NO: 8107563 - DNA, 22 bp, Homo sapiens
cagcccagcagggtctggccct

SEQ ID NO: 8107564 - DNA, 22 bp, Homo sapiens
cagccaaatgagtcataaatgt

SEQ ID NO: 8107565 - DNA, 22 bp, Homo sapiens
cagcattttcttaatgtaggtg

SEQ ID NO: 8107566 - DNA, 22 bp, Homo sapiens
cagccacagctgggtgcctgac

SEQ ID NO: 8107567 - DNA, 22 bp, Homo sapiens
cagccaccatacagcagaagct

SEQ ID NO: 8107568 - DNA, 22 bp, Homo sapiens
cagccactacaattggttccat

SEQ ID NO: 8107569 - DNA, 22 bp, Homo sapiens
cagccacgtagcccttggccgt

SEQ ID NO: 8107570 - DNA, 22 bp, Homo sapiens
cagccacttcgagcttcctgat

SEQ ID NO: 8107571 - DNA, 22 bp, Homo sapiens
cagccactgaactcctggctat

SEQ ID NO: 8107572 - DNA, 22 bp, Homo sapiens
gtattttactgctcaaagctct

SEQ ID NO: 8107573 - DNA, 22 bp, Homo sapiens
gtattttactgctcaaagctct

SEQ ID NO: 8107574 - DNA, 22 bp, Homo sapiens
gtattttaagtgactactaggt

SEQ ID NO: 8107575 - DNA, 22 bp, Homo sapiens
gtattttaagtgactactaggt

SEQ ID NO: 8107576 - DNA, 22 bp, Homo sapiens
gtatttgatcattagaatgatt

SEQ ID NO: 8107577 - DNA, 22 bp, Homo sapiens
gtatttgagctttatgtatatt

SEQ ID NO: 8107578 - DNA, 22 bp, Homo sapiens
cagcattttccatagaaagaag

SEQ ID NO: 8107579 - DNA, 22 bp, Homo sapiens
aggtgcaggagctgtgcaggga

SEQ ID NO: 8107580 - DNA, 19 bp, Homo sapiens
cctgggacttaggctgggt

SEQ ID NO: 8107581 - DNA, 22 bp, Homo sapiens
cctgggacttggtctggggttt

SEQ ID NO: 8107582 - DNA, 21 bp, Homo sapiens
cctgggacactcaccagctcc

SEQ ID NO: 8107583 - DNA, 22 bp, Homo sapiens
cctgggacctcgcgggaagcgg

SEQ ID NO: 8107584 - DNA, 22 bp, Homo sapiens
cctgggacctcgcgggaagcgg

SEQ ID NO: 8107585 - DNA, 22 bp, Homo sapiens
cctgggaagttgtggctgcagt

SEQ ID NO: 8107586 - DNA, 22 bp, Homo sapiens
cctgggaatcggtgcgttgagg

SEQ ID NO: 8107587 - DNA, 22 bp, Homo sapiens
cctgggaatcggtgcgttgagg

SEQ ID NO: 8107588 - DNA, 22 bp, Homo sapiens
aggtggcatgagactgtaccag

SEQ ID NO: 8107589 - DNA, 22 bp, Homo sapiens
aggtgctggagtctgggcagga

SEQ ID NO: 8107590 - DNA, 22 bp, Homo sapiens
aggtgggcaatgaggcctgagt

SEQ ID NO: 8107591 - DNA, 22 bp, Homo sapiens
aggtggctgagctgtgcccctg

SEQ ID NO: 8107592 - DNA, 22 bp, Homo sapiens
aggtggctgtggcttcccttgt

SEQ ID NO: 8107593 - DNA, 22 bp, Homo sapiens
ccttggctaggcagcggctgtc

SEQ ID NO: 8107594 - DNA, 22 bp, Homo sapiens
ccttttatactctgtcctctgg

SEQ ID NO: 8107595 - DNA, 22 bp, Homo sapiens
cctttgttcactggagagtgga

SEQ ID NO: 8107596 - DNA, 22 bp, Homo sapiens
aggtgggggctgtgtccttgac

SEQ ID NO: 8107597 - DNA, 22 bp, Homo sapiens
cggctcactgcagctccgcctc

SEQ ID NO: 8107598 - DNA, 22 bp, Homo sapiens
cggccctgctgagcttgtctgg

SEQ ID NO: 8107599 - DNA, 22 bp, Homo sapiens
cggccctgctgagcttgtctgg

SEQ ID NO: 8107600 - DNA, 22 bp, Homo sapiens
cggccttgacaagcttagcagc

SEQ ID NO: 8107601 - DNA, 20 bp, Homo sapiens
agggtcagtagcacagagct

SEQ ID NO: 8107602 - DNA, 22 bp, Homo sapiens
agggtcagagtcaggtgcagta

SEQ ID NO: 8107603 - DNA, 19 bp, Homo sapiens
agggtcaggacaaggactt

SEQ ID NO: 8107604 - DNA, 22 bp, Homo sapiens
cctgccctgctcactgtcggta

SEQ ID NO: 8107605 - DNA, 22 bp, Homo sapiens
agggtctgtggatgcatctggg

SEQ ID NO: 8107606 - DNA, 22 bp, Homo sapiens
agggtctgttgtttgttctgga

SEQ ID NO: 8107607 - DNA, 22 bp, Homo sapiens
agggtgaatctcacaactctta

SEQ ID NO: 8107608 - DNA, 22 bp, Homo sapiens
agggtctgaccaccagtaggga

SEQ ID NO: 8107609 - DNA, 20 bp, Homo sapiens
agggtctgatgtggtggccc

SEQ ID NO: 8107610 - DNA, 22 bp, Homo sapiens
agggtctgactcctctggcaag

SEQ ID NO: 8107611 - DNA, 22 bp, Homo sapiens
cctgccctatgaccagcttcac

SEQ ID NO: 8107612 - DNA, 22 bp, Homo sapiens
cctgccaggacattgcttgaag

SEQ ID NO: 8107613 - DNA, 22 bp, Homo sapiens
cctgcccaggagtctctctgtg

SEQ ID NO: 8107614 - DNA, 22 bp, Homo sapiens
cctgcccagcttcccgagtgca

SEQ ID NO: 8107615 - DNA, 22 bp, Homo sapiens
cctggccagaggcgtgcctgtg

SEQ ID NO: 8107616 - DNA, 19 bp, Homo sapiens
cctggccagacttctgccc

SEQ ID NO: 8107617 - DNA, 22 bp, Homo sapiens
cctggccacccagccttggcca

SEQ ID NO: 8107618 - DNA, 22 bp, Homo sapiens
cctggccacagggctctgcatt

SEQ ID NO: 8107619 - DNA, 22 bp, Homo sapiens
cctggcagctcctccccggcgg

SEQ ID NO: 8107620 - DNA, 22 bp, Homo sapiens
cctggcagctcctccccggcgg

SEQ ID NO: 8107621 - DNA, 22 bp, Homo sapiens
cctggcagctaagtgctttgag

SEQ ID NO: 8107622 - DNA, 22 bp, Homo sapiens
cctggcagctccgtggccttcc

SEQ ID NO: 8107623 - DNA, 22 bp, Homo sapiens
cctggcagctgtttggcttggc

SEQ ID NO: 8107624 - DNA, 22 bp, Homo sapiens
cctggccaatctagggctgtta

SEQ ID NO: 8107625 - DNA, 22 bp, Homo sapiens
cctggccaatctagggctgtta

SEQ ID NO: 8107626 - DNA, 19 bp, Homo sapiens
cctggctgctgtgggatgc

SEQ ID NO: 8107627 - DNA, 22 bp, Homo sapiens
cctggctggatggagcccctgg

SEQ ID NO: 8107628 - DNA, 23 bp, Homo sapiens
cctggctggattctctgcattca

SEQ ID NO: 8107629 - DNA, 22 bp, Homo sapiens
cctggctggggtagaagtgagg

SEQ ID NO: 8107630 - DNA, 17 bp, Homo sapiens
cctggctgggaatctga

SEQ ID NO: 8107631 - DNA, 22 bp, Homo sapiens
cctggctggtggcagcgacaag

SEQ ID NO: 8107632 - DNA, 22 bp, Homo sapiens
cctgggaaggtgaggccctgga

SEQ ID NO: 8107633 - DNA, 22 bp, Homo sapiens
cctggaagagctgaatcaggca

SEQ ID NO: 8107634 - DNA, 22 bp, Homo sapiens
cctggaaggcaggcatggattg

SEQ ID NO: 8107635 - DNA, 22 bp, Homo sapiens
cctggaagttggaggttgcagt

SEQ ID NO: 8107636 - DNA, 22 bp, Homo sapiens
cctggaagtcattcctcgttcc

SEQ ID NO: 8107637 - DNA, 22 bp, Homo sapiens
cctggaagtcattcctcgttcc

SEQ ID NO: 8107638 - DNA, 22 bp, Homo sapiens
cctggcagcgccgaagctggcc

SEQ ID NO: 8107639 - DNA, 22 bp, Homo sapiens
cctggcagcgtgccgagctgcg

SEQ ID NO: 8107640 - DNA, 22 bp, Homo sapiens
cctggcagcgtgccgagctgcg

SEQ ID NO: 8107641 - DNA, 22 bp, Homo sapiens
cctggcagcgtgccgagctgcg

SEQ ID NO: 8107642 - DNA, 22 bp, Homo sapiens
cctggacctgcagcatcagcat

SEQ ID NO: 8107643 - DNA, 22 bp, Homo sapiens
cctggcagcccagagcgccgct

SEQ ID NO: 8107644 - DNA, 22 bp, Homo sapiens
cctggcagcgccgaagctggcc

SEQ ID NO: 8107645 - DNA, 22 bp, Homo sapiens
cctggcagcctcagccaattct

SEQ ID NO: 8107646 - DNA, 22 bp, Homo sapiens
cctgctctgccaagtcctcttt

SEQ ID NO: 8107647 - DNA, 22 bp, Homo sapiens
cctgctctggtttagtcagtct

SEQ ID NO: 8107648 - DNA, 20 bp, Homo sapiens
cctgctgagccagtgtgagg

SEQ ID NO: 8107649 - DNA, 22 bp, Homo sapiens
cctgctgctatgaaggtgacag

SEQ ID NO: 8107650 - DNA, 19 bp, Homo sapiens
cctgctgcccaccctctgc

SEQ ID NO: 8107651 - DNA, 22 bp, Homo sapiens
agtgggagagaagcaagtagta

SEQ ID NO: 8107652 - DNA, 22 bp, Homo sapiens
ctctgtcaggctgcagatgctc

SEQ ID NO: 8107653 - DNA, 22 bp, Homo sapiens
agtggcttggctgcactacagg

SEQ ID NO: 8107654 - DNA, 22 bp, Homo sapiens
ctctggacagcaggtgctgtgg

SEQ ID NO: 8107655 - DNA, 22 bp, Homo sapiens
ctctgctgccaccagaaccact

SEQ ID NO: 8107656 - DNA, 22 bp, Homo sapiens
agtggttcagttttggtctggc

SEQ ID NO: 8107657 - DNA, 22 bp, Homo sapiens
agtggttcttgatctgtagagt

SEQ ID NO: 8107658 - DNA, 18 bp, Homo sapiens
agtggtctgttatatcat

SEQ ID NO: 8107659 - DNA, 22 bp, Homo sapiens
agtgctgggattacaggcataa

SEQ ID NO: 8107660 - DNA, 22 bp, Homo sapiens
agtgctgggattgcaggcatga

SEQ ID NO: 8107661 - DNA, 22 bp, Homo sapiens
ctcgggcttgaggctgtttacc

SEQ ID NO: 8107662 - DNA, 22 bp, Homo sapiens
agtgctatcgagttctaatgct

SEQ ID NO: 8107663 - DNA, 22 bp, Homo sapiens
ctcctgcatgctcacatatgcc

SEQ ID NO: 8107664 - DNA, 22 bp, Homo sapiens
ctcctgcagccctcagcagcca

SEQ ID NO: 8107665 - DNA, 22 bp, Homo sapiens
ctcagactagcctgtaccgaca

SEQ ID NO: 8107666 - DNA, 22 bp, Homo sapiens
ctcagactggggctccctgagt

SEQ ID NO: 8107667 - DNA, 22 bp, Homo sapiens
ctcagactggtgggtaaaacct

SEQ ID NO: 8107668 - DNA, 22 bp, Homo sapiens
ctcagactttcagggtaggcca

SEQ ID NO: 8107669 - DNA, 22 bp, Homo sapiens
ctcagacttgctttttatggaa

SEQ ID NO: 8107670 - DNA, 22 bp, Homo sapiens
ctcagactggagccccaaggac

SEQ ID NO: 8107671 - DNA, 22 bp, Homo sapiens
ctcagaattaataaccacaagg

SEQ ID NO: 8107672 - DNA, 23 bp, Homo sapiens
ctcaaccctagtaagggagtagg

SEQ ID NO: 8107673 - DNA, 22 bp, Homo sapiens
ctcaagaatctagggaggattc

SEQ ID NO: 8107674 - DNA, 22 bp, Homo sapiens
agtcccagagaggtcggggcca

SEQ ID NO: 8107675 - DNA, 22 bp, Homo sapiens
ctcaaaatggttaattttaata

SEQ ID NO: 8107676 - DNA, 22 bp, Homo sapiens
ctcaaatagaactgatctataa

SEQ ID NO: 8107677 - DNA, 22 bp, Homo sapiens
cgggttcacgccattctcctgc

SEQ ID NO: 8107678 - DNA, 22 bp, Homo sapiens
cgggttcacgccattctcctgc

SEQ ID NO: 8107679 - DNA, 22 bp, Homo sapiens
agtatgaaagttaatcaattta

SEQ ID NO: 8107680 - DNA, 22 bp, Homo sapiens
agtatgaatacagattttctct

SEQ ID NO: 8107681 - DNA, 22 bp, Homo sapiens
agtatgaagattataatttttc

SEQ ID NO: 8107682 - DNA, 22 bp, Homo sapiens
agtatgaagctgaatgatttta

SEQ ID NO: 8107683 - DNA, 22 bp, Homo sapiens
ctcagcccggtgctcgtgccac

SEQ ID NO: 8107684 - DNA, 22 bp, Homo sapiens
ctcagctccaggtgtgcatctt

SEQ ID NO: 8107685 - DNA, 22 bp, Homo sapiens
ctcaggccaataagctccagcc

SEQ ID NO: 8107686 - DNA, 22 bp, Homo sapiens
ctcagggaggtcctgtgctgaa

SEQ ID NO: 8107687 - DNA, 22 bp, Homo sapiens
ctcagggaggcctctgctggtt

SEQ ID NO: 8107688 - DNA, 22 bp, Homo sapiens
agtgacagagcttggtgccccc

SEQ ID NO: 8107689 - DNA, 20 bp, Homo sapiens
agtgacagagactgtgtggc

SEQ ID NO: 8107690 - DNA, 22 bp, Homo sapiens
agtgacagaggcaggcctgtgg

SEQ ID NO: 8107691 - DNA, 20 bp, Homo sapiens
ctccagactacagaagagcc

SEQ ID NO: 8107692 - DNA, 22 bp, Homo sapiens
ctcagtgtctggggccccaggg

SEQ ID NO: 8107693 - DNA, 22 bp, Homo sapiens
ctcagtggttgagagcctgggc

SEQ ID NO: 8107694 - DNA, 22 bp, Homo sapiens
ctcagggagtagcacatgtgga

SEQ ID NO: 8107695 - DNA, 22 bp, Homo sapiens
ctgtggagcttgtggcagtggg

SEQ ID NO: 8107696 - DNA, 22 bp, Homo sapiens
atcattttgtgacaatgcctgt

SEQ ID NO: 8107697 - DNA, 22 bp, Homo sapiens
atcattttgtgacaatgcctgt

SEQ ID NO: 8107698 - DNA, 22 bp, Homo sapiens
atccccctgtatctggaagaat

SEQ ID NO: 8107699 - DNA, 22 bp, Homo sapiens
atccctcagccacctttgagga

SEQ ID NO: 8107700 - DNA, 22 bp, Homo sapiens
atcctcagacctcagcaaagcc

SEQ ID NO: 8107701 - DNA, 22 bp, Homo sapiens
atctacaacccctcaaactgtg

SEQ ID NO: 8107702 - DNA, 22 bp, Homo sapiens
atctacaacgggtggagtaggg

SEQ ID NO: 8107703 - DNA, 22 bp, Homo sapiens
atctacaaaaactgtctcagga

SEQ ID NO: 8107704 - DNA, 22 bp, Homo sapiens
atcctcatctggttttaggctg

SEQ ID NO: 8107705 - DNA, 22 bp, Homo sapiens
atcctccagctcctgcttctgc

SEQ ID NO: 8107706 - DNA, 22 bp, Homo sapiens
atcctcagcatctagcatgaag

SEQ ID NO: 8107707 - DNA, 22 bp, Homo sapiens
atatttgtcaattcactgttca

SEQ ID NO: 8107708 - DNA, 22 bp, Homo sapiens
ctgggtcctgcaaatattatta

SEQ ID NO: 8107709 - DNA, 22 bp, Homo sapiens
ctgtccagtgactttgggccat

SEQ ID NO: 8107710 - DNA, 18 bp, Homo sapiens
ctgggtctccaggctgcc

SEQ ID NO: 8107711 - DNA, 22 bp, Homo sapiens
ctgtcctcaacccatccttctc

SEQ ID NO: 8107712 - DNA, 22 bp, Homo sapiens
ctgtcctcaccttggcaggggg

SEQ ID NO: 8107713 - DNA, 22 bp, Homo sapiens
ctgtcctccagacgacagtccc

SEQ ID NO: 8107714 - DNA, 22 bp, Homo sapiens
ctgtcctctgtcctcagcagga

SEQ ID NO: 8107715 - DNA, 22 bp, Homo sapiens
ctgtcctccggccacctacagt

SEQ ID NO: 8107716 - DNA, 19 bp, Homo sapiens
ctgtgcaggccgggctgag

SEQ ID NO: 8107717 - DNA, 22 bp, Homo sapiens
ctgtctgtttctgattcaacct

SEQ ID NO: 8107718 - DNA, 22 bp, Homo sapiens
ctgtgagtgaccctggtcagca

SEQ ID NO: 8107719 - DNA, 22 bp, Homo sapiens
atatgaatttggctggaaaggt

SEQ ID NO: 8107720 - DNA, 22 bp, Homo sapiens
atatgacagcggattcacatat

SEQ ID NO: 8107721 - DNA, 22 bp, Homo sapiens
atatgagagaggaaagatttta

SEQ ID NO: 8107722 - DNA, 21 bp, Homo sapiens
atatgagtttcagatgttgct

SEQ ID NO: 8107723 - DNA, 22 bp, Homo sapiens
atatgagaattggaaaatatca

SEQ ID NO: 8107724 - DNA, 22 bp, Homo sapiens
atatgacataaaatcatttttg

SEQ ID NO: 8107725 - DNA, 20 bp, Homo sapiens
atatgctgagtgaaggcaga

SEQ ID NO: 8107726 - DNA, 20 bp, Homo sapiens
atatttcttaagaactttca

SEQ ID NO: 8107727 - DNA, 22 bp, Homo sapiens
atatttctctcagacatggaag

SEQ ID NO: 8107728 - DNA, 22 bp, Homo sapiens
atatttgtagtgggtaagaagt

SEQ ID NO: 8107729 - DNA, 22 bp, Homo sapiens
atatgggggggcgtgcagagga

SEQ ID NO: 8107730 - DNA, 22 bp, Homo sapiens
atatgtgtaaatgcatttgttt

SEQ ID NO: 8107731 - DNA, 22 bp, Homo sapiens
atatgtccacctgtatgctaaa

SEQ ID NO: 8107732 - DNA, 22 bp, Homo sapiens
atatgtgtcgtgctactgccca

SEQ ID NO: 8107733 - DNA, 22 bp, Homo sapiens
atatgtgtatttggttagccta

SEQ ID NO: 8107734 - DNA, 22 bp, Homo sapiens
ctggcagctgcccgagatgccc

SEQ ID NO: 8107735 - DNA, 22 bp, Homo sapiens
ctgggaagcatggtgatggtat

SEQ ID NO: 8107736 - DNA, 22 bp, Homo sapiens
ctgggaagccacagggtgtggg

SEQ ID NO: 8107737 - DNA, 22 bp, Homo sapiens
ctgggaagccacagggtgtggg

SEQ ID NO: 8107738 - DNA, 22 bp, Homo sapiens
ctgggaagcttcgagcaggaaa

SEQ ID NO: 8107739 - DNA, 22 bp, Homo sapiens
ctgggaagtggtgagggcctga

SEQ ID NO: 8107740 - DNA, 22 bp, Homo sapiens
ctgggaagtggtgagggcctga

SEQ ID NO: 8107741 - DNA, 22 bp, Homo sapiens
ctgggaaggggaaggtcctctc

SEQ ID NO: 8107742 - DNA, 22 bp, Homo sapiens
atatataagctgatgagccaca

SEQ ID NO: 8107743 - DNA, 22 bp, Homo sapiens
atatataatacttgctgtgggc

SEQ ID NO: 8107744 - DNA, 22 bp, Homo sapiens
atataacatacatacagaaaag

SEQ ID NO: 8107745 - DNA, 22 bp, Homo sapiens
atataacatacatacagaaaag

SEQ ID NO: 8107746 - DNA, 22 bp, Homo sapiens
atataagtgtgtggctgttagt

SEQ ID NO: 8107747 - DNA, 22 bp, Homo sapiens
atataactcttgttcttatagt

SEQ ID NO: 8107748 - DNA, 22 bp, Homo sapiens
ctgggcacagaccccctgggcc

SEQ ID NO: 8107749 - DNA, 22 bp, Homo sapiens
ctgggcacagcgttgggctctt

SEQ ID NO: 8107750 - DNA, 22 bp, Homo sapiens
ctgggcacactctgctccagct

SEQ ID NO: 8107751 - DNA, 22 bp, Homo sapiens
ctgggcacaagtggccctggat

SEQ ID NO: 8107752 - DNA, 22 bp, Homo sapiens
ctgggagtactgggggatgtca

SEQ ID NO: 8107753 - DNA, 22 bp, Homo sapiens
ctgggactttaccctgtggccc

SEQ ID NO: 8107754 - DNA, 22 bp, Homo sapiens
atatatactttgacacattctg

SEQ ID NO: 8107755 - DNA, 22 bp, Homo sapiens
ctgggagacaagagagggctga

SEQ ID NO: 8107756 - DNA, 22 bp, Homo sapiens
ctgggagaggaacctcgagggt

SEQ ID NO: 8107757 - DNA, 22 bp, Homo sapiens
ctgggagagaagcgaagctggg

SEQ ID NO: 8107758 - DNA, 20 bp, Homo sapiens
ataaaataactgccacaaga

SEQ ID NO: 8107759 - DNA, 22 bp, Homo sapiens
ataaaagttcaagagagtacag

SEQ ID NO: 8107760 - DNA, 22 bp, Homo sapiens
ataaatatcactgttgtccctc

SEQ ID NO: 8107761 - DNA, 22 bp, Homo sapiens
ataaatagtgtgtcataaagtc

SEQ ID NO: 8107762 - DNA, 22 bp, Homo sapiens
ctgccaggactgacgtcttcag

SEQ ID NO: 8107763 - DNA, 22 bp, Homo sapiens
ctgcagctcctctctgtgcccc

SEQ ID NO: 8107764 - DNA, 22 bp, Homo sapiens
ctgaggcctcactgtagtccct

SEQ ID NO: 8107765 - DNA, 22 bp, Homo sapiens
ctgaggcctaagacatgaatga

SEQ ID NO: 8107766 - DNA, 21 bp, Homo sapiens
ctgaggcatgcaggcctgggc

SEQ ID NO: 8107767 - DNA, 22 bp, Homo sapiens
agttgtaagagacagatataaa

SEQ ID NO: 8107768 - DNA, 22 bp, Homo sapiens
ctgaggcaggagaattgctgga

SEQ ID NO: 8107769 - DNA, 22 bp, Homo sapiens
ctgaggcaggatggcctggctg

SEQ ID NO: 8107770 - DNA, 22 bp, Homo sapiens
ctgaggcaggggcagctggaga

SEQ ID NO: 8107771 - DNA, 21 bp, Homo sapiens
agttgctgctgctgcaggtga

SEQ ID NO: 8107772 - DNA, 22 bp, Homo sapiens
agttgctgcttctctctagaga

SEQ ID NO: 8107773 - DNA, 22 bp, Homo sapiens
agttgctggcacctgtgagtat

SEQ ID NO: 8107774 - DNA, 22 bp, Homo sapiens
agttgctgggaaagatttcagt

SEQ ID NO: 8107775 - DNA, 22 bp, Homo sapiens
ctgaggctttgtgtgcatgcct

SEQ ID NO: 8107776 - DNA, 22 bp, Homo sapiens
agttgtaataacaataccaaaa

SEQ ID NO: 8107777 - DNA, 22 bp, Homo sapiens
ctgaggcctctcccactccagc

SEQ ID NO: 8107778 - DNA, 22 bp, Homo sapiens
ctgaggcctctgttcaccagaa

SEQ ID NO: 8107779 - DNA, 22 bp, Homo sapiens
ctgaggcctctgttcaccagaa

SEQ ID NO: 8107780 - DNA, 22 bp, Homo sapiens
ctgaggctgggcttgccttctt

SEQ ID NO: 8107781 - DNA, 22 bp, Homo sapiens
atacaagactcagcacagacgg

SEQ ID NO: 8107782 - DNA, 20 bp, Homo sapiens
atacaagatgagtaatttct

SEQ ID NO: 8107783 - DNA, 22 bp, Homo sapiens
atacaaggtggagtcaggaaaa

SEQ ID NO: 8107784 - DNA, 18 bp, Homo sapiens
atacaagctctgttactt

SEQ ID NO: 8107785 - DNA, 22 bp, Homo sapiens
atacaagtgatataattgtttc

SEQ ID NO: 8107786 - DNA, 22 bp, Homo sapiens
atacaagtcaatccatgtgatt

SEQ ID NO: 8107787 - DNA, 22 bp, Homo sapiens
atacaaggtcatgaaggtttac

SEQ ID NO: 8107788 - DNA, 22 bp, Homo sapiens
atacaagtgagaaaactgaaga

SEQ ID NO: 8107789 - DNA, 22 bp, Homo sapiens
atacaagtgagaaaactgaaga

SEQ ID NO: 8107790 - DNA, 20 bp, Homo sapiens
ctgctctgctttgcaggtgg

SEQ ID NO: 8107791 - DNA, 20 bp, Homo sapiens
ctgctctgctttgcaggtgg

SEQ ID NO: 8107792 - DNA, 22 bp, Homo sapiens
ctgctctgctgatcagtgtctc

SEQ ID NO: 8107793 - DNA, 22 bp, Homo sapiens
ataatacatggttaacctcttt

SEQ ID NO: 8107794 - DNA, 22 bp, Homo sapiens
ctgctctggggaagccagatgt

SEQ ID NO: 8107795 - DNA, 22 bp, Homo sapiens
ataaatatcactgttgtccctc

SEQ ID NO: 8107796 - DNA, 22 bp, Homo sapiens
ataaatctattggacatgtgtg

SEQ ID NO: 8107797 - DNA, 22 bp, Homo sapiens
ctgcccagaagccagatgggca

SEQ ID NO: 8107798 - DNA, 22 bp, Homo sapiens
ctgcccagaagccagatgggca

SEQ ID NO: 8107799 - DNA, 22 bp, Homo sapiens
atacaagttaatgagaatgaca

SEQ ID NO: 8107800 - DNA, 22 bp, Homo sapiens
atacaagtggccacttgaattc

SEQ ID NO: 8107801 - DNA, 22 bp, Homo sapiens
ctggagccagccagggccctct

SEQ ID NO: 8107802 - DNA, 22 bp, Homo sapiens
ctggagcattttctgcttctgc

SEQ ID NO: 8107803 - DNA, 22 bp, Homo sapiens
atacagaagttttccacttatt

SEQ ID NO: 8107804 - DNA, 22 bp, Homo sapiens
atacagaattcactacagtttc

SEQ ID NO: 8107805 - DNA, 22 bp, Homo sapiens
atacagagaagggaggcaaaat

SEQ ID NO: 8107806 - DNA, 22 bp, Homo sapiens
ctggagggagattcaaaggagg

SEQ ID NO: 8107807 - DNA, 22 bp, Homo sapiens
ctggagggagttaggacccgga

SEQ ID NO: 8107808 - DNA, 22 bp, Homo sapiens
ctggagggaggaggctgctatt

SEQ ID NO: 8107809 - DNA, 22 bp, Homo sapiens
ctggcagcggtttgcagcctgg

SEQ ID NO: 8107810 - DNA, 22 bp, Homo sapiens
ctggcagcgtgagcagcatcca

SEQ ID NO: 8107811 - DNA, 22 bp, Homo sapiens
ctggcagctctactcagagcct

SEQ ID NO: 8107812 - DNA, 20 bp, Homo sapiens
atacttgttttcaggctttt

SEQ ID NO: 8107813 - DNA, 22 bp, Homo sapiens
atacttgtagccatcatagcat

SEQ ID NO: 8107814 - DNA, 22 bp, Homo sapiens
atacttgtgagtttccaacaat

SEQ ID NO: 8107815 - DNA, 22 bp, Homo sapiens
atacttgaggtagcaacttaag

SEQ ID NO: 8107816 - DNA, 22 bp, Homo sapiens
atacttgaggttgtataaatat

SEQ ID NO: 8107817 - DNA, 22 bp, Homo sapiens
atacttctttagcatattgaac

SEQ ID NO: 8107818 - DNA, 22 bp, Homo sapiens
ctggagggctgcagcgaggctg

SEQ ID NO: 8107819 - DNA, 22 bp, Homo sapiens
ctggagggatgtagggtgtatt

SEQ ID NO: 8107820 - DNA, 22 bp, Homo sapiens
aggcagtggcttttgttgtgtt

SEQ ID NO: 8107821 - DNA, 21 bp, Homo sapiens
ccactgctcttccctagggcc

SEQ ID NO: 8107822 - DNA, 22 bp, Homo sapiens
aggcagtggagaaggtttgtga

SEQ ID NO: 8107823 - DNA, 22 bp, Homo sapiens
aggcagtctatctctggagcct

SEQ ID NO: 8107824 - DNA, 22 bp, Homo sapiens
aggcagtccccaggggtgttgc

SEQ ID NO: 8107825 - DNA, 22 bp, Homo sapiens
aggcagtcagccctgctagggt

SEQ ID NO: 8107826 - DNA, 22 bp, Homo sapiens
aggcccagctgggccaggaaca

SEQ ID NO: 8107827 - DNA, 22 bp, Homo sapiens
aggcccagtcctctgccgtctg

SEQ ID NO: 8107828 - DNA, 22 bp, Homo sapiens
aggcccagtagtgctgccttta

SEQ ID NO: 8107829 - DNA, 22 bp, Homo sapiens
aggccaggaccattagcccaga

SEQ ID NO: 8107830 - DNA, 22 bp, Homo sapiens
aggccaggaatccttgtcccag

SEQ ID NO: 8107831 - DNA, 22 bp, Homo sapiens
aggccctattcaatggggccca

SEQ ID NO: 8107832 - DNA, 22 bp, Homo sapiens
aggccagcaagaaagagagtct

SEQ ID NO: 8107833 - DNA, 22 bp, Homo sapiens
aggccagctctacccttggact

SEQ ID NO: 8107834 - DNA, 22 bp, Homo sapiens
aggccagctgttactagagcca

SEQ ID NO: 8107835 - DNA, 22 bp, Homo sapiens
ccaggcccttgcaagtcccacc

SEQ ID NO: 8107836 - DNA, 22 bp, Homo sapiens
ccaggcctcacctgcccaccta

SEQ ID NO: 8107837 - DNA, 22 bp, Homo sapiens
ccaggccaaattcagtcagcag

SEQ ID NO: 8107838 - DNA, 22 bp, Homo sapiens
ccaggcagtggaagctaaaatt

SEQ ID NO: 8107839 - DNA, 22 bp, Homo sapiens
aggcctcacacaacagatgcat

SEQ ID NO: 8107840 - DNA, 22 bp, Homo sapiens
aggcctcacattgggcttcaag

SEQ ID NO: 8107841 - DNA, 22 bp, Homo sapiens
aggcctcagcctgccaggcctg

SEQ ID NO: 8107842 - DNA, 22 bp, Homo sapiens
aggcctcagtgatcatcatcag

SEQ ID NO: 8107843 - DNA, 22 bp, Homo sapiens
aggcctcagtttccccagttgt

SEQ ID NO: 8107844 - DNA, 22 bp, Homo sapiens
aggcctcagtttgtcatctgta

SEQ ID NO: 8107845 - DNA, 22 bp, Homo sapiens
aggcctcatagtagacctgccc

SEQ ID NO: 8107846 - DNA, 22 bp, Homo sapiens
aggcctcattgcccacctgtgg

SEQ ID NO: 8107847 - DNA, 22 bp, Homo sapiens
aggcctcattttcactttatgc

SEQ ID NO: 8107848 - DNA, 20 bp, Homo sapiens
aggctctgcctgcaggccca

SEQ ID NO: 8107849 - DNA, 22 bp, Homo sapiens
ccagttcatacacttagaaatt

SEQ ID NO: 8107850 - DNA, 23 bp, Homo sapiens
ccagttctcctttgaacagtgac

SEQ ID NO: 8107851 - DNA, 22 bp, Homo sapiens
aggctgaggcgggaggatcact

SEQ ID NO: 8107852 - DNA, 23 bp, Homo sapiens
ccagtgattgcctggaaggaggt

SEQ ID NO: 8107853 - DNA, 22 bp, Homo sapiens
ccagtgagatatctgggcatta

SEQ ID NO: 8107854 - DNA, 22 bp, Homo sapiens
aggctgagcggggtcccagagc

SEQ ID NO: 8107855 - DNA, 22 bp, Homo sapiens
agggagccagagttgggagctc

SEQ ID NO: 8107856 - DNA, 21 bp, Homo sapiens
ccccatggagtacagttgggc

SEQ ID NO: 8107857 - DNA, 22 bp, Homo sapiens
agggaagggcagggtctatgca

SEQ ID NO: 8107858 - DNA, 23 bp, Homo sapiens
agggaagggggcttattccacag

SEQ ID NO: 8107859 - DNA, 22 bp, Homo sapiens
agggaaggaaaagctgtcgctt

SEQ ID NO: 8107860 - DNA, 22 bp, Homo sapiens
agggaaggcttttgacatttcc

SEQ ID NO: 8107861 - DNA, 22 bp, Homo sapiens
agggaagggaaaaacactcgtc

SEQ ID NO: 8107862 - DNA, 22 bp, Homo sapiens
agggaaggaggccatgtgtccc

SEQ ID NO: 8107863 - DNA, 19 bp, Homo sapiens
agggaaggattctgtcatt

SEQ ID NO: 8107864 - DNA, 22 bp, Homo sapiens
cccagcctctgtttgctcctct

SEQ ID NO: 8107865 - DNA, 22 bp, Homo sapiens
cccagcctctgggttctgccgg

SEQ ID NO: 8107866 - DNA, 22 bp, Homo sapiens
cccagcctctggattctgccct

SEQ ID NO: 8107867 - DNA, 19 bp, Homo sapiens
aggctgtttgttaataaag

SEQ ID NO: 8107868 - DNA, 22 bp, Homo sapiens
cccagcactcagcaggctcata

SEQ ID NO: 8107869 - DNA, 22 bp, Homo sapiens
cccagcagtgacccagtgatac

SEQ ID NO: 8107870 - DNA, 22 bp, Homo sapiens
cccagcagtagagctcatatgg

SEQ ID NO: 8107871 - DNA, 22 bp, Homo sapiens
cccagcagtggttctcaaactt

SEQ ID NO: 8107872 - DNA, 18 bp, Homo sapiens
cccagcctctcctttcta

SEQ ID NO: 8107873 - DNA, 22 bp, Homo sapiens
cccagcctcagctttacttcca

SEQ ID NO: 8107874 - DNA, 22 bp, Homo sapiens
ccatgatttcccctgctgcaca

SEQ ID NO: 8107875 - DNA, 22 bp, Homo sapiens
ccatcttctcttgaacctcctt

SEQ ID NO: 8107876 - DNA, 22 bp, Homo sapiens
ccataaggtttggggccatgca

SEQ ID NO: 8107877 - DNA, 22 bp, Homo sapiens
ccctgtgtcttcttgcctttgt

SEQ ID NO: 8107878 - DNA, 22 bp, Homo sapiens
cctcagacgcaggcctatgggc

SEQ ID NO: 8107879 - DNA, 22 bp, Homo sapiens
cctcagacccctgctgagcttc

SEQ ID NO: 8107880 - DNA, 18 bp, Homo sapiens
cctcacagacttccatgt

SEQ ID NO: 8107881 - DNA, 22 bp, Homo sapiens
cctcccagtgccggggccggct

SEQ ID NO: 8107882 - DNA, 22 bp, Homo sapiens
cctcccatggagctctgtccat

SEQ ID NO: 8107883 - DNA, 22 bp, Homo sapiens
cctcagtgagatgctcagcgaa

SEQ ID NO: 8107884 - DNA, 22 bp, Homo sapiens
ccctgggattgccttggccttg

SEQ ID NO: 8107885 - DNA, 22 bp, Homo sapiens
ccctgggcagtctgcacttcag

SEQ ID NO: 8107886 - DNA, 22 bp, Homo sapiens
ccctggcccctcactccgaggc

SEQ ID NO: 8107887 - DNA, 22 bp, Homo sapiens
ccctgggattcaatttcactct

SEQ ID NO: 8107888 - DNA, 21 bp, Homo sapiens
ccctgggatgggcttggactt

SEQ ID NO: 8107889 - DNA, 22 bp, Homo sapiens
agggaggagaatggactccttc

SEQ ID NO: 8107890 - DNA, 22 bp, Homo sapiens
agggaggaaggaactccttcta

SEQ ID NO: 8107891 - DNA, 22 bp, Homo sapiens
aggagaggcatcaagaaaatcg

SEQ ID NO: 8107892 - DNA, 22 bp, Homo sapiens
aggagaggctctaactctgtgt

SEQ ID NO: 8107893 - DNA, 22 bp, Homo sapiens
aggagagaatgttccaggcttg

SEQ ID NO: 8107894 - DNA, 22 bp, Homo sapiens
aggagagagaacacttgggtcc

SEQ ID NO: 8107895 - DNA, 22 bp, Homo sapiens
aggagagcaggccagccgtccc

SEQ ID NO: 8107896 - DNA, 22 bp, Homo sapiens
aggagccatgagcaggaggcaa

SEQ ID NO: 8107897 - DNA, 22 bp, Homo sapiens
aggagctcattgaagtggatga

SEQ ID NO: 8107898 - DNA, 22 bp, Homo sapiens
aggagctcatgtggctgcctgt

SEQ ID NO: 8107899 - DNA, 22 bp, Homo sapiens
aggaggcaaaggtctctgataa

SEQ ID NO: 8107900 - DNA, 22 bp, Homo sapiens
aggaggaggtgggacacagtga

SEQ ID NO: 8107901 - DNA, 22 bp, Homo sapiens
aggaggaggtaagaaaagcata

SEQ ID NO: 8107902 - DNA, 22 bp, Homo sapiens
aggaggaatacaatccagcagc

SEQ ID NO: 8107903 - DNA, 22 bp, Homo sapiens
aggaggaattgacacagaagcc

SEQ ID NO: 8107904 - DNA, 22 bp, Homo sapiens
aggaggaggctggagtacaccc

SEQ ID NO: 8107905 - DNA, 22 bp, Homo sapiens
aggaggagcagctttttgtctc

SEQ ID NO: 8107906 - DNA, 21 bp, Homo sapiens
aggaggagagcttggcctacc

SEQ ID NO: 8107907 - DNA, 22 bp, Homo sapiens
aggaggaagggaagacaagtaa

SEQ ID NO: 8107908 - DNA, 22 bp, Homo sapiens
aggaggaaggcttcattaggtt

SEQ ID NO: 8107909 - DNA, 22 bp, Homo sapiens
aggagctctgggcagggcctcc

SEQ ID NO: 8107910 - DNA, 21 bp, Homo sapiens
aggacaggaactggctgaata

SEQ ID NO: 8107911 - DNA, 22 bp, Homo sapiens
cagtctctggtgagttgacagt

SEQ ID NO: 8107912 - DNA, 22 bp, Homo sapiens
aggagaattaggaactcaagat

SEQ ID NO: 8107913 - DNA, 22 bp, Homo sapiens
cagtctctgccacttctaagct

SEQ ID NO: 8107914 - DNA, 22 bp, Homo sapiens
cagtctctctgaagtattaaga

SEQ ID NO: 8107915 - DNA, 22 bp, Homo sapiens
cattatgatggtaattttctct

SEQ ID NO: 8107916 - DNA, 22 bp, Homo sapiens
catggcctgcctcctcctggtg

SEQ ID NO: 8107917 - DNA, 22 bp, Homo sapiens
catggccccaaatcccatgcat

SEQ ID NO: 8107918 - DNA, 22 bp, Homo sapiens
catggccttcacctcccctgcc

SEQ ID NO: 8107919 - DNA, 22 bp, Homo sapiens
cattcaaacattaatttattca

SEQ ID NO: 8107920 - DNA, 20 bp, Homo sapiens
cattcctgaggaattcatgt

SEQ ID NO: 8107921 - DNA, 22 bp, Homo sapiens
cattccttaacgtggggagtct

SEQ ID NO: 8107922 - DNA, 22 bp, Homo sapiens
aggcagccacatgagctcctga

SEQ ID NO: 8107923 - DNA, 21 bp, Homo sapiens
catttacatgacagattggtt

SEQ ID NO: 8107924 - DNA, 22 bp, Homo sapiens
catgcctgtatttctgatctat

SEQ ID NO: 8107925 - DNA, 20 bp, Homo sapiens
catgcctgctggtatctggc

SEQ ID NO: 8107926 - DNA, 22 bp, Homo sapiens
catgcagcagaataatgactat

SEQ ID NO: 8107927 - DNA, 22 bp, Homo sapiens
aggaggtgcgtggtgatcccct

SEQ ID NO: 8107928 - DNA, 22 bp, Homo sapiens
aggaggtgtagatttcctgtca

SEQ ID NO: 8107929 - DNA, 22 bp, Homo sapiens
aggaggtgttgatagaaggttt

SEQ ID NO: 8107930 - DNA, 22 bp, Homo sapiens
aggaggtggcctgagcgtgccc

SEQ ID NO: 8107931 - DNA, 22 bp, Homo sapiens
aggaggtggctgaacttgaggg

SEQ ID NO: 8107932 - DNA, 22 bp, Homo sapiens
aggaggtggcctgagcgtgccc

SEQ ID NO: 8107933 - DNA, 22 bp, Homo sapiens
aggaggtgctagagaagatgtt

SEQ ID NO: 8107934 - DNA, 22 bp, Homo sapiens
aggaggtggcaactgtcgacag

SEQ ID NO: 8107935 - DNA, 22 bp, Homo sapiens
aggaggtggcaactgtcgacag

SEQ ID NO: 8107936 - DNA, 22 bp, Homo sapiens
aggaggtgctgtttgtcctgga

SEQ ID NO: 8107937 - DNA, 22 bp, Homo sapiens
catgcacatgcaatagtgcttt

SEQ ID NO: 8107938 - DNA, 22 bp, Homo sapiens
catgcactggaatctgattaca

SEQ ID NO: 8107939 - DNA, 22 bp, Homo sapiens
catgcactctttgagaaggatg

SEQ ID NO: 8107940 - DNA, 22 bp, Homo sapiens
agctggcttcacaggcagtgtg

SEQ ID NO: 8107941 - DNA, 22 bp, Homo sapiens
caggaggtgccctctagtggca

SEQ ID NO: 8107942 - DNA, 22 bp, Homo sapiens
caggaggtgacttccaggggtt

SEQ ID NO: 8107943 - DNA, 22 bp, Homo sapiens
caggaggttgtaagagcaggcc

SEQ ID NO: 8107944 - DNA, 22 bp, Homo sapiens
caggaggttggtagcagtagat

SEQ ID NO: 8107945 - DNA, 22 bp, Homo sapiens
agctggcattctccttgttatt

SEQ ID NO: 8107946 - DNA, 22 bp, Homo sapiens
caggacagaccaagatcgtgct

SEQ ID NO: 8107947 - DNA, 22 bp, Homo sapiens
agctggcagtcggccttgatgc

SEQ ID NO: 8107948 - DNA, 21 bp, Homo sapiens
caggaaaagcggaagtctagc

SEQ ID NO: 8107949 - DNA, 22 bp, Homo sapiens
caggaaaaatgccaggagtcag

SEQ ID NO: 8107950 - DNA, 22 bp, Homo sapiens
cagcttcttacgagctggtact

SEQ ID NO: 8107951 - DNA, 22 bp, Homo sapiens
cagctctacgtttctatgaatc

SEQ ID NO: 8107952 - DNA, 22 bp, Homo sapiens
cagctgttgtctctcacatatt

SEQ ID NO: 8107953 - DNA, 22 bp, Homo sapiens
cagctgttgtgatccatttacg

SEQ ID NO: 8107954 - DNA, 22 bp, Homo sapiens
agctctggaagccctggtagtt

SEQ ID NO: 8107955 - DNA, 22 bp, Homo sapiens
cagcttttgcagacttcttgcc

SEQ ID NO: 8107956 - DNA, 23 bp, Homo sapiens
cagcttctttgggattctttata

SEQ ID NO: 8107957 - DNA, 22 bp, Homo sapiens
agctgaggcatggacaggctgc

SEQ ID NO: 8107958 - DNA, 22 bp, Homo sapiens
agctgaggcatgatgctatcag

SEQ ID NO: 8107959 - DNA, 23 bp, Homo sapiens
agctgaggctgtgggtgtcagag

SEQ ID NO: 8107960 - DNA, 21 bp, Homo sapiens
agctgcaggcctcccagggat

SEQ ID NO: 8107961 - DNA, 22 bp, Homo sapiens
agcttgaacctaaaacaataat

SEQ ID NO: 8107962 - DNA, 22 bp, Homo sapiens
agcttacaccccccaagattct

SEQ ID NO: 8107963 - DNA, 22 bp, Homo sapiens
agcttacagttcaatgacaaag

SEQ ID NO: 8107964 - DNA, 22 bp, Homo sapiens
agcttgtaacagacataaaaat

SEQ ID NO: 8107965 - DNA, 22 bp, Homo sapiens
agctgtttaaatgacttacttt

SEQ ID NO: 8107966 - DNA, 22 bp, Homo sapiens
agctggcttttgtgaaggtttt

SEQ ID NO: 8107967 - DNA, 22 bp, Homo sapiens
agctgtgtgactctaagcaagt

SEQ ID NO: 8107968 - DNA, 22 bp, Homo sapiens
agctgtgtcctgaagacactgc

SEQ ID NO: 8107969 - DNA, 22 bp, Homo sapiens
caggcctggttgagccctgaga

SEQ ID NO: 8107970 - DNA, 22 bp, Homo sapiens
aggaagctccatgaaggcagag

SEQ ID NO: 8107971 - DNA, 22 bp, Homo sapiens
aggaacctaagagcctgcagtc

SEQ ID NO: 8107972 - DNA, 22 bp, Homo sapiens
aggaaccctgcgccatactttg

SEQ ID NO: 8107973 - DNA, 22 bp, Homo sapiens
aggaacccggtctgtcactgtg

SEQ ID NO: 8107974 - DNA, 22 bp, Homo sapiens
aggaaccagaggttgagcaact

SEQ ID NO: 8107975 - DNA, 22 bp, Homo sapiens
aggaactgatttataactttag

SEQ ID NO: 8107976 - DNA, 22 bp, Homo sapiens
aggaacaattgataaactcaca

SEQ ID NO: 8107977 - DNA, 22 bp, Homo sapiens
agctttatataaaagagtacat

SEQ ID NO: 8107978 - DNA, 17 bp, Homo sapiens
agcttgtttttgaaagc

SEQ ID NO: 8107979 - DNA, 22 bp, Homo sapiens
agcttgttttgttgaatactta

SEQ ID NO: 8107980 - DNA, 22 bp, Homo sapiens
agcttgttagaaatgtagactc

SEQ ID NO: 8107981 - DNA, 22 bp, Homo sapiens
agctttacctgaaatttgatcc

SEQ ID NO: 8107982 - DNA, 18 bp, Homo sapiens
agcctgtcccttctcctg

SEQ ID NO: 8107983 - DNA, 22 bp, Homo sapiens
cagcagcatgaattcgagccac

SEQ ID NO: 8107984 - DNA, 22 bp, Homo sapiens
cagcagcagtgttctagaatct

SEQ ID NO: 8107985 - DNA, 22 bp, Homo sapiens
cagcagcagcttagtggtcccc

SEQ ID NO: 8107986 - DNA, 22 bp, Homo sapiens
cagcagcagccccaggaaggtt

SEQ ID NO: 8107987 - DNA, 22 bp, Homo sapiens
agcctcagtgtcaccatctacc

SEQ ID NO: 8107988 - DNA, 22 bp, Homo sapiens
agcctcagtgtcaccatctacc

SEQ ID NO: 8107989 - DNA, 19 bp, Homo sapiens
cagcaagaatgaaggcata

SEQ ID NO: 8107990 - DNA, 22 bp, Homo sapiens
agctccctgagatgccacagca

SEQ ID NO: 8107991 - DNA, 22 bp, Homo sapiens
agctcccagcagagctggccac

SEQ ID NO: 8107992 - DNA, 22 bp, Homo sapiens
cagccagcctctcaaccatgca

SEQ ID NO: 8107993 - DNA, 22 bp, Homo sapiens
cagccagctgaatgtaccatga

SEQ ID NO: 8107994 - DNA, 21 bp, Homo sapiens
agctccctgtttcctcactct

SEQ ID NO: 8107995 - DNA, 22 bp, Homo sapiens
cagccctgggagttggggccga

SEQ ID NO: 8107996 - DNA, 22 bp, Homo sapiens
cagccctgggtccctgccctgg

SEQ ID NO: 8107997 - DNA, 22 bp, Homo sapiens
cagcaggagcagtcagactcct

SEQ ID NO: 8107998 - DNA, 22 bp, Homo sapiens
agctaggataagcagagactgg

SEQ ID NO: 8107999 - DNA, 22 bp, Homo sapiens
agctcacagtgtccttcctcaa

SEQ ID NO: 8108000 - DNA, 22 bp, Homo sapiens
agccttctaggatgtcatctgc

SEQ ID NO: 8108001 - DNA, 22 bp, Homo sapiens
agccttctctgaaattctgttt

SEQ ID NO: 8108002 - DNA, 22 bp, Homo sapiens
cactgaaatcgaaaaatgtagg

SEQ ID NO: 8108003 - DNA, 22 bp, Homo sapiens
agccacagagcaggagaccttt

SEQ ID NO: 8108004 - DNA, 22 bp, Homo sapiens
cagaactggcctttcatcagtc

SEQ ID NO: 8108005 - DNA, 22 bp, Homo sapiens
agccaggatggtctcgatcggc

SEQ ID NO: 8108006 - DNA, 22 bp, Homo sapiens
agccaggcagggctctcgctct

SEQ ID NO: 8108007 - DNA, 22 bp, Homo sapiens
cagaagctgaggagtgaggcaa

SEQ ID NO: 8108008 - DNA, 22 bp, Homo sapiens
agcccagcctgattctacaccc

SEQ ID NO: 8108009 - DNA, 22 bp, Homo sapiens
agcccaggaatctgcatcttga

SEQ ID NO: 8108010 - DNA, 22 bp, Homo sapiens
cagagctggacttaaatatatt

SEQ ID NO: 8108011 - DNA, 22 bp, Homo sapiens
cagagctggagaagtggattta

SEQ ID NO: 8108012 - DNA, 22 bp, Homo sapiens
cagagctggagcttgaatggag

SEQ ID NO: 8108013 - DNA, 22 bp, Homo sapiens
cagagctggagggaaccctggc

SEQ ID NO: 8108014 - DNA, 22 bp, Homo sapiens
cagagctggcggtgagaagaca

SEQ ID NO: 8108015 - DNA, 22 bp, Homo sapiens
cagagctggcctgtgatttttg

SEQ ID NO: 8108016 - DNA, 22 bp, Homo sapiens
agcccctgtttttccagtcaga

SEQ ID NO: 8108017 - DNA, 22 bp, Homo sapiens
agcccggagccagtgcacctac

SEQ ID NO: 8108018 - DNA, 22 bp, Homo sapiens
cagagagggcggccctggcttc

SEQ ID NO: 8108019 - DNA, 22 bp, Homo sapiens
cagagatggggccagctgctcc

SEQ ID NO: 8108020 - DNA, 22 bp, Homo sapiens
cagagatgtgatccagctgtct

SEQ ID NO: 8108021 - DNA, 22 bp, Homo sapiens
cagagcacacatgcatagagtg

SEQ ID NO: 8108022 - DNA, 22 bp, Homo sapiens
cagagattattataactaatta

SEQ ID NO: 8108023 - DNA, 22 bp, Homo sapiens
cagacagcaaatctgcttgcat

SEQ ID NO: 8108024 - DNA, 20 bp, Homo sapiens
agccagggttctggatgcac

SEQ ID NO: 8108025 - DNA, 22 bp, Homo sapiens
agccagggttagaagatagtca

SEQ ID NO: 8108026 - DNA, 22 bp, Homo sapiens
agcagtttagctatactgcttg

SEQ ID NO: 8108027 - DNA, 22 bp, Homo sapiens
caccagggcagcagcctagtct

SEQ ID NO: 8108028 - DNA, 22 bp, Homo sapiens
cacatcaagcatccatgagttt

SEQ ID NO: 8108029 - DNA, 22 bp, Homo sapiens
cacagtcaatgtagaaatatga

SEQ ID NO: 8108030 - DNA, 22 bp, Homo sapiens
agcaggagcatttccatgattc

SEQ ID NO: 8108031 - DNA, 22 bp, Homo sapiens
cacagtacgcacccgatacatg

SEQ ID NO: 8108032 - DNA, 22 bp, Homo sapiens
agcagcttacatgtggcctatc

SEQ ID NO: 8108033 - DNA, 22 bp, Homo sapiens
cacaggaagctgactgctggca

SEQ ID NO: 8108034 - DNA, 22 bp, Homo sapiens
caatgacatggataatcatatt

SEQ ID NO: 8108035 - DNA, 22 bp, Homo sapiens
agcagctgtactttcatctgtt

SEQ ID NO: 8108036 - DNA, 22 bp, Homo sapiens
caaatgtttttattctacaaca

SEQ ID NO: 8108037 - DNA, 22 bp, Homo sapiens
caaatgtttggtggcattttgt

SEQ ID NO: 8108038 - DNA, 22 bp, Homo sapiens
attttctctttgtatatgctag

SEQ ID NO: 8108039 - DNA, 22 bp, Homo sapiens
caactcgatgggtggagaaaat

SEQ ID NO: 8108040 - DNA, 22 bp, Homo sapiens
caactgcttggaggaatactgc

SEQ ID NO: 8108041 - DNA, 22 bp, Homo sapiens
caactatatagaaattgattgt

SEQ ID NO: 8108042 - DNA, 22 bp, Homo sapiens
agcagcagaagggagacccagg

SEQ ID NO: 8108043 - DNA, 22 bp, Homo sapiens
caatctgtacttgaaaaattat

SEQ ID NO: 8108044 - DNA, 22 bp, Homo sapiens
caatctgttagaaatgcagaca

SEQ ID NO: 8108045 - DNA, 22 bp, Homo sapiens
agcagcagggtgtaattgggca

SEQ ID NO: 8108046 - DNA, 22 bp, Homo sapiens
atggcagatggctggagcaggt

SEQ ID NO: 8108047 - DNA, 22 bp, Homo sapiens
atggcagatccacagtttgaag

SEQ ID NO: 8108048 - DNA, 22 bp, Homo sapiens
atggagtgcctgtggcagtggg

SEQ ID NO: 8108049 - DNA, 22 bp, Homo sapiens
atgggaggatgctcgggtgctc

SEQ ID NO: 8108050 - DNA, 22 bp, Homo sapiens
atgggaggcaaagatcgcagaa

SEQ ID NO: 8108051 - DNA, 22 bp, Homo sapiens
atgggaggcagcagagcccagc

SEQ ID NO: 8108052 - DNA, 22 bp, Homo sapiens
atgggaggcagacactaagttc

SEQ ID NO: 8108053 - DNA, 22 bp, Homo sapiens
atgggaggcaggctcagaaccg

SEQ ID NO: 8108054 - DNA, 22 bp, Homo sapiens
atgggaggatcacttgaggcca

SEQ ID NO: 8108055 - DNA, 22 bp, Homo sapiens
atgggaggaaggaggcccttga

SEQ ID NO: 8108056 - DNA, 22 bp, Homo sapiens
atggctgtgaaggtcacaccct

SEQ ID NO: 8108057 - DNA, 22 bp, Homo sapiens
atgtaaactactgactacacta

SEQ ID NO: 8108058 - DNA, 22 bp, Homo sapiens
atgtaaaccgtgcactcccagg

SEQ ID NO: 8108059 - DNA, 20 bp, Homo sapiens
atgtaaaagacagggagtag

SEQ ID NO: 8108060 - DNA, 22 bp, Homo sapiens
atgtcccaagatacagctagag

SEQ ID NO: 8108061 - DNA, 22 bp, Homo sapiens
atgtctgttcattattaactgc

SEQ ID NO: 8108062 - DNA, 22 bp, Homo sapiens
agacacatcttaggttgtcagg

SEQ ID NO: 8108063 - DNA, 22 bp, Homo sapiens
agacagtgctatcccatctgtg

SEQ ID NO: 8108064 - DNA, 21 bp, Homo sapiens
agaattaaattggatttgtgt

SEQ ID NO: 8108065 - DNA, 21 bp, Homo sapiens
agaattaaattggatttgtgt

SEQ ID NO: 8108066 - DNA, 22 bp, Homo sapiens
agaattacagcttttagaatag

SEQ ID NO: 8108067 - DNA, 22 bp, Homo sapiens
agaattacataaatacatgaat

SEQ ID NO: 8108068 - DNA, 18 bp, Homo sapiens
agaattaccaaagtgctt

SEQ ID NO: 8108069 - DNA, 22 bp, Homo sapiens
agaattctgacaatagaattgg

SEQ ID NO: 8108070 - DNA, 21 bp, Homo sapiens
agaattcttaagtattctaat

SEQ ID NO: 8108071 - DNA, 22 bp, Homo sapiens
agaatgattttggacaatatgg

SEQ ID NO: 8108072 - DNA, 22 bp, Homo sapiens
agaagaatacttgatgttcatg

SEQ ID NO: 8108073 - DNA, 20 bp, Homo sapiens
agaagaggatacaaccaggc

SEQ ID NO: 8108074 - DNA, 22 bp, Homo sapiens
atctttaaagacatgtgaactt

SEQ ID NO: 8108075 - DNA, 22 bp, Homo sapiens
atctttaaagacatgtgaactt

SEQ ID NO: 8108076 - DNA, 22 bp, Homo sapiens
atctttaggaacctaacctatt

SEQ ID NO: 8108077 - DNA, 22 bp, Homo sapiens
agaatacaccacaggccgaaat

SEQ ID NO: 8108078 - DNA, 21 bp, Homo sapiens
agaataatggtatcatttgct

SEQ ID NO: 8108079 - DNA, 22 bp, Homo sapiens
atctttagtagaggaatatatt

SEQ ID NO: 8108080 - DNA, 22 bp, Homo sapiens
agaaggcctagagtaagacatt

SEQ ID NO: 8108081 - DNA, 22 bp, Homo sapiens
agaaggccctgtgtggtctgag

SEQ ID NO: 8108082 - DNA, 22 bp, Homo sapiens
agaatagaattctcatagaatt

SEQ ID NO: 8108083 - DNA, 22 bp, Homo sapiens
agaatacatctagtgctgcatg

SEQ ID NO: 8108084 - DNA, 22 bp, Homo sapiens
agaatactaggcttcagaaagg

SEQ ID NO: 8108085 - DNA, 22 bp, Homo sapiens
agaatataaagataattctgtt

SEQ ID NO: 8108086 - DNA, 22 bp, Homo sapiens
atgtgtatgagtgtgcttcttt

SEQ ID NO: 8108087 - DNA, 23 bp, Homo sapiens
atgtttgcagtaacccatcctgg

SEQ ID NO: 8108088 - DNA, 22 bp, Homo sapiens
atgttttaaatatgtgtgtaaa

SEQ ID NO: 8108089 - DNA, 22 bp, Homo sapiens
agagggtgctggagagacattg

SEQ ID NO: 8108090 - DNA, 22 bp, Homo sapiens
agagggagcccagtcatagctg

SEQ ID NO: 8108091 - DNA, 22 bp, Homo sapiens
agagggatcaccctgtttctgg

SEQ ID NO: 8108092 - DNA, 22 bp, Homo sapiens
attctctgtgcagatttaagac

SEQ ID NO: 8108093 - DNA, 22 bp, Homo sapiens
attatacattttgtgtagagat

SEQ ID NO: 8108094 - DNA, 22 bp, Homo sapiens
attatacattttgtgtagagat

SEQ ID NO: 8108095 - DNA, 22 bp, Homo sapiens
attatacaaggctggtgcctaa

SEQ ID NO: 8108096 - DNA, 22 bp, Homo sapiens
attcacagaatagttttaccag

SEQ ID NO: 8108097 - DNA, 22 bp, Homo sapiens
attcacagaatagttttaccag

SEQ ID NO: 8108098 - DNA, 22 bp, Homo sapiens
attcacagagtggttagtggta

SEQ ID NO: 8108099 - DNA, 22 bp, Homo sapiens
attcacagagtggttagtggta

SEQ ID NO: 8108100 - DNA, 22 bp, Homo sapiens
attcacacacatttagagcaga

SEQ ID NO: 8108101 - DNA, 22 bp, Homo sapiens
attcacacatactcatgtgtga

SEQ ID NO: 8108102 - DNA, 22 bp, Homo sapiens
attcaaagagctgccagaactg

SEQ ID NO: 8108103 - DNA, 22 bp, Homo sapiens
attcaaagcccagtaaacattg

SEQ ID NO: 8108104 - DNA, 22 bp, Homo sapiens
attcacagggacaatgggagag

SEQ ID NO: 8108105 - DNA, 22 bp, Homo sapiens
attcacagggacaatgggagag

SEQ ID NO: 8108106 - DNA, 20 bp, Homo sapiens
attcacaggcacaaaaccct

SEQ ID NO: 8108107 - DNA, 20 bp, Homo sapiens
attcacaggcacaaaaccct

SEQ ID NO: 8108108 - DNA, 22 bp, Homo sapiens
attcacagggctttccgcatgg

SEQ ID NO: 8108109 - DNA, 21 bp, Homo sapiens
attcacaggtatcctctccct

SEQ ID NO: 8108110 - DNA, 22 bp, Homo sapiens
attcacagggggagaagggtat

SEQ ID NO: 8108111 - DNA, 22 bp, Homo sapiens
attcacagggggagaagggtat

SEQ ID NO: 8108112 - DNA, 22 bp, Homo sapiens
attcacagggctttccgcatgg

SEQ ID NO: 8108113 - DNA, 21 bp, Homo sapiens
attcacaggtatcctctccct

SEQ ID NO: 8108114 - DNA, 22 bp, Homo sapiens
attcacagtatggacgaaatga

SEQ ID NO: 8108115 - DNA, 22 bp, Homo sapiens
attcacagtatggacgaaatga

SEQ ID NO: 8108116 - DNA, 22 bp, Homo sapiens
attcacagttactgctgaacca

SEQ ID NO: 8108117 - DNA, 22 bp, Homo sapiens
attcacagttactgctgaacca

SEQ ID NO: 8108118 - DNA, 22 bp, Homo sapiens
attcacagttcattagctgtaa

SEQ ID NO: 8108119 - DNA, 22 bp, Homo sapiens
attcacagttcattagctgtaa

SEQ ID NO: 8108120 - DNA, 22 bp, Homo sapiens
attcacagttactgctgaacca

SEQ ID NO: 8108121 - DNA, 22 bp, Homo sapiens
attcacagttcattagctgtaa

SEQ ID NO: 8108122 - DNA, 22 bp, Homo sapiens
attcacagtttcctcatattct

SEQ ID NO: 8108123 - DNA, 22 bp, Homo sapiens
attcacagtttcctcatattct

SEQ ID NO: 8108124 - DNA, 22 bp, Homo sapiens
atttgcttctgctaaacaactt

SEQ ID NO: 8108125 - DNA, 22 bp, Homo sapiens
atttgcttatctccacagttgt

SEQ ID NO: 8108126 - DNA, 22 bp, Homo sapiens
atttgcttcatagatctgtgga

SEQ ID NO: 8108127 - DNA, 22 bp, Homo sapiens
atttgcttggtcttctctccgt

SEQ ID NO: 8108128 - DNA, 22 bp, Homo sapiens
agatgtcagctcacatgccacc

SEQ ID NO: 8108129 - DNA, 20 bp, Homo sapiens
atttgcttaccttgtttcta

SEQ ID NO: 8108130 - DNA, 22 bp, Homo sapiens
atttgcttgttcaccagtactt

SEQ ID NO: 8108131 - DNA, 22 bp, Homo sapiens
atttgctttcagccttaaggat

SEQ ID NO: 8108132 - DNA, 22 bp, Homo sapiens
atttccacataagggaaataag

SEQ ID NO: 8108133 - DNA, 21 bp, Homo sapiens
atttccaaataaggtcacatt

SEQ ID NO: 8108134 - DNA, 21 bp, Homo sapiens
atttccaagggtacctaagat

SEQ ID NO: 8108135 - DNA, 22 bp, Homo sapiens
agatggtgatagagctgggatt

SEQ ID NO: 8108136 - DNA, 20 bp, Homo sapiens
agatggtgggctggaacacc

SEQ ID NO: 8108137 - DNA, 22 bp, Homo sapiens
agatgaagatatctgcaggggc

SEQ ID NO: 8108138 - DNA, 22 bp, Homo sapiens
agagtggggacagggcctgtcc

SEQ ID NO: 8108139 - DNA, 22 bp, Homo sapiens
agagtggggacagggcctgtcc

SEQ ID NO: 8108140 - DNA, 22 bp, Homo sapiens
agagtggggaaggtgttgagaa

SEQ ID NO: 8108141 - DNA, 22 bp, Homo sapiens
agagtggggaaggtgttgagaa

SEQ ID NO: 8108142 - DNA, 22 bp, Homo sapiens
agagtgggcaggagcctcgact

SEQ ID NO: 8108143 - DNA, 22 bp, Homo sapiens
agagtgggcctagctgtaaaag

SEQ ID NO: 8108144 - DNA, 22 bp, Homo sapiens
agagtgggcctctgagtcccag

SEQ ID NO: 8108145 - DNA, 22 bp, Homo sapiens
agagtgggacacgggcgctgtc

SEQ ID NO: 8108146 - DNA, 22 bp, Homo sapiens
agagtgggcaggagcctcgact

SEQ ID NO: 8108147 - DNA, 22 bp, Homo sapiens
agagtgggacacgggcgctgtc

SEQ ID NO: 8108148 - DNA, 22 bp, Homo sapiens
atttattgaacactgactatgt

SEQ ID NO: 8108149 - DNA, 22 bp, Homo sapiens
atttaggaatgttctgcacaaa

SEQ ID NO: 8108150 - DNA, 22 bp, Homo sapiens
attgttaataactattacattg

SEQ ID NO: 8108151 - DNA, 22 bp, Homo sapiens
attcttcatacagacaagtcct

SEQ ID NO: 8108152 - DNA, 22 bp, Homo sapiens
agaggtagaaaataatggagag

SEQ ID NO: 8108153 - DNA, 22 bp, Homo sapiens
attcttcatcagagatgcacta

SEQ ID NO: 8108154 - DNA, 22 bp, Homo sapiens
attcttcatggctgtgagtcct

SEQ ID NO: 8108155 - DNA, 22 bp, Homo sapiens
attcttcatgttgaagctgtca

SEQ ID NO: 8108156 - DNA, 23 bp, Homo sapiens
attcttcattatcttctagaaaa

SEQ ID NO: 8108157 - DNA, 22 bp, Homo sapiens
agtttcatttcttagtaccagt

SEQ ID NO: 8108158 - DNA, 20 bp, Homo sapiens
actgtgaatgctgaattagc

SEQ ID NO: 8108159 - DNA, 22 bp, Homo sapiens
actgtgaaagctaacatcttag

SEQ ID NO: 8108160 - DNA, 21 bp, Homo sapiens
actgtgaagatgctataaact

SEQ ID NO: 8108161 - DNA, 22 bp, Homo sapiens
actgtgaacggactgaagccca

SEQ ID NO: 8108162 - DNA, 22 bp, Homo sapiens
agtttacagatgctacaggagc

SEQ ID NO: 8108163 - DNA, 22 bp, Homo sapiens
agtttacagttctcatcgcaac

SEQ ID NO: 8108164 - DNA, 22 bp, Homo sapiens
agtttacataaaaaggcagagg

SEQ ID NO: 8108165 - DNA, 22 bp, Homo sapiens
actgtgtgctggacatgatgtt

SEQ ID NO: 8108166 - DNA, 22 bp, Homo sapiens
acttcacagatatttatttggt

SEQ ID NO: 8108167 - DNA, 22 bp, Homo sapiens
acttcaaattttcagaagaaat

SEQ ID NO: 8108168 - DNA, 22 bp, Homo sapiens
acttcaaacaattaacagagaa

SEQ ID NO: 8108169 - DNA, 22 bp, Homo sapiens
acttcaaacaattaacagagaa

SEQ ID NO: 8108170 - DNA, 22 bp, Homo sapiens
acttcaaatgtgacaatgtgaa

SEQ ID NO: 8108171 - DNA, 22 bp, Homo sapiens
acttgccccagaattgctgctg

SEQ ID NO: 8108172 - DNA, 22 bp, Homo sapiens
acttgccataaatgaaaatact

SEQ ID NO: 8108173 - DNA, 22 bp, Homo sapiens
acttggagagcattgctgggga

SEQ ID NO: 8108174 - DNA, 22 bp, Homo sapiens
acttggaaaattcaaaatggca

SEQ ID NO: 8108175 - DNA, 22 bp, Homo sapiens
acttggagggagctgggtggaa

SEQ ID NO: 8108176 - DNA, 22 bp, Homo sapiens
acttcatgaactaagggatcgg

SEQ ID NO: 8108177 - DNA, 23 bp, Homo sapiens
acttcatggcactgtcttagagg

SEQ ID NO: 8108178 - DNA, 22 bp, Homo sapiens
acttcatgctttagagagatga

SEQ ID NO: 8108179 - DNA, 23 bp, Homo sapiens
acttcatggcactgtcttagagg

SEQ ID NO: 8108180 - DNA, 22 bp, Homo sapiens
acttcatgcagaagagagctgt

SEQ ID NO: 8108181 - DNA, 22 bp, Homo sapiens
acttcatgaacatgtggcctgt

SEQ ID NO: 8108182 - DNA, 22 bp, Homo sapiens
acttcatgtttctattagctca

SEQ ID NO: 8108183 - DNA, 22 bp, Homo sapiens
acttcatgttgtttacaactta

SEQ ID NO: 8108184 - DNA, 22 bp, Homo sapiens
acttcatgttgctcttggctat

SEQ ID NO: 8108185 - DNA, 22 bp, Homo sapiens
acttcatgttgctcttggctat

SEQ ID NO: 8108186 - DNA, 22 bp, Homo sapiens
acttcatgtagtccatcaggtt

SEQ ID NO: 8108187 - DNA, 22 bp, Homo sapiens
acttcatgtactgttcaaggcc

SEQ ID NO: 8108188 - DNA, 22 bp, Homo sapiens
acttgatttttataataaatgg

SEQ ID NO: 8108189 - DNA, 22 bp, Homo sapiens
agaaacagaagggaaagctttt

SEQ ID NO: 8108190 - DNA, 22 bp, Homo sapiens
agaaaatttattcatgttagtt

SEQ ID NO: 8108191 - DNA, 22 bp, Homo sapiens
atatctttgtttttgccaagat

SEQ ID NO: 8108192 - DNA, 22 bp, Homo sapiens
atatgaaaagaagtcaccattg

SEQ ID NO: 8108193 - DNA, 22 bp, Homo sapiens
atatataacctggataaggctt

SEQ ID NO: 8108194 - DNA, 19 bp, Homo sapiens
atatccttgagaaagggaa

SEQ ID NO: 8108195 - DNA, 22 bp, Homo sapiens
atatcctttgtgtaggcaattt

SEQ ID NO: 8108196 - DNA, 22 bp, Homo sapiens
atatccttttcggaagagcagc

SEQ ID NO: 8108197 - DNA, 22 bp, Homo sapiens
atatccagcagcaggtgagtat

SEQ ID NO: 8108198 - DNA, 22 bp, Homo sapiens
atatccatagtaaaagtcatta

SEQ ID NO: 8108199 - DNA, 22 bp, Homo sapiens
acttggtgtattagctctcact

SEQ ID NO: 8108200 - DNA, 22 bp, Homo sapiens
atataatagtttcataaaggct

SEQ ID NO: 8108201 - DNA, 22 bp, Homo sapiens
atatataacctggataaggctt

SEQ ID NO: 8108202 - DNA, 22 bp, Homo sapiens
actttgtaggaaaaagtcacaa

SEQ ID NO: 8108203 - DNA, 22 bp, Homo sapiens
actttgtaatagtttaaggtca

SEQ ID NO: 8108204 - DNA, 22 bp, Homo sapiens
actttgtaaacatctcaaggtc

SEQ ID NO: 8108205 - DNA, 22 bp, Homo sapiens
atcacaaaggctgcttcatgat

SEQ ID NO: 8108206 - DNA, 22 bp, Homo sapiens
atcagagggtgagatggagaaa

SEQ ID NO: 8108207 - DNA, 22 bp, Homo sapiens
atcagaggtgagggagagcccc

SEQ ID NO: 8108208 - DNA, 22 bp, Homo sapiens
atcactatgggcattatattta

SEQ ID NO: 8108209 - DNA, 22 bp, Homo sapiens
atcacccaggctggagtgcagt

SEQ ID NO: 8108210 - DNA, 22 bp, Homo sapiens
atcacccaagctggagtgcagt

SEQ ID NO: 8108211 - DNA, 22 bp, Homo sapiens
atcacattgttagcatagactg

SEQ ID NO: 8108212 - DNA, 22 bp, Homo sapiens
atccacttggctggttgttcta

SEQ ID NO: 8108213 - DNA, 22 bp, Homo sapiens
atccacttgccactgtatagtt

SEQ ID NO: 8108214 - DNA, 22 bp, Homo sapiens
atcagcaagatgtaatttctat

SEQ ID NO: 8108215 - DNA, 22 bp, Homo sapiens
actggattgggaaagtacttca

SEQ ID NO: 8108216 - DNA, 22 bp, Homo sapiens
agtggctgctatgatcaggaca

SEQ ID NO: 8108217 - DNA, 22 bp, Homo sapiens
actgctggggctcattcatctc

SEQ ID NO: 8108218 - DNA, 22 bp, Homo sapiens
actgctggcatgcatatacaaa

SEQ ID NO: 8108219 - DNA, 22 bp, Homo sapiens
actgctggaaacccagaatggt

SEQ ID NO: 8108220 - DNA, 22 bp, Homo sapiens
actgctctctgcaagtagatgg

SEQ ID NO: 8108221 - DNA, 22 bp, Homo sapiens
actgctattttataacagaaga

SEQ ID NO: 8108222 - DNA, 22 bp, Homo sapiens
actgcaacctccgcctgccagg

SEQ ID NO: 8108223 - DNA, 21 bp, Homo sapiens
actgcctgtctccatagtcta

SEQ ID NO: 8108224 - DNA, 22 bp, Homo sapiens
actgcaacacctcctgggttca

SEQ ID NO: 8108225 - DNA, 22 bp, Homo sapiens
actgatgaaaactaataaatta

SEQ ID NO: 8108226 - DNA, 22 bp, Homo sapiens
actcttcatgctatgctcaact

SEQ ID NO: 8108227 - DNA, 22 bp, Homo sapiens
actcttcatgctatgctcaact

SEQ ID NO: 8108228 - DNA, 22 bp, Homo sapiens
actcttcatccctttatcagga

SEQ ID NO: 8108229 - DNA, 23 bp, Homo sapiens
actgaaaggatcctagcagagac

SEQ ID NO: 8108230 - DNA, 22 bp, Homo sapiens
agtctcttccttcaaggctggt

SEQ ID NO: 8108231 - DNA, 22 bp, Homo sapiens
agtctcttgcacattgtattaa

SEQ ID NO: 8108232 - DNA, 22 bp, Homo sapiens
agtctgggagaaggtgagatta

SEQ ID NO: 8108233 - DNA, 22 bp, Homo sapiens
agtctggggtctggtagaacga

SEQ ID NO: 8108234 - DNA, 22 bp, Homo sapiens
actccagaatcctagggtcagc

SEQ ID NO: 8108235 - DNA, 22 bp, Homo sapiens
agtctcttaattttttctaagt

SEQ ID NO: 8108236 - DNA, 22 bp, Homo sapiens
agtctctggactgggagatggc

SEQ ID NO: 8108237 - DNA, 22 bp, Homo sapiens
agtctaatgtttgtaaaatcat

SEQ ID NO: 8108238 - DNA, 22 bp, Homo sapiens
actccagggctgaacgaggccc

SEQ ID NO: 8108239 - DNA, 22 bp, Homo sapiens
acctgctgtgattctaattggc

SEQ ID NO: 8108240 - DNA, 22 bp, Homo sapiens
acctgctgtcttgggggaatgc

SEQ ID NO: 8108241 - DNA, 22 bp, Homo sapiens
acctgctgaggagggggaatta

SEQ ID NO: 8108242 - DNA, 18 bp, Homo sapiens
acctgctgagtctaagca

SEQ ID NO: 8108243 - DNA, 22 bp, Homo sapiens
acctggaagtgggtgctatggc

SEQ ID NO: 8108244 - DNA, 22 bp, Homo sapiens
aggtagaaggaccagaatttat

SEQ ID NO: 8108245 - DNA, 22 bp, Homo sapiens
acctgtgcaaagactggtcagg

SEQ ID NO: 8108246 - DNA, 22 bp, Homo sapiens
acctgtgcacagtcagccctgg

SEQ ID NO: 8108247 - DNA, 22 bp, Homo sapiens
acctgtctataaaagtgaatac

SEQ ID NO: 8108248 - DNA, 22 bp, Homo sapiens
acctgtctgcatgatctaaaac

SEQ ID NO: 8108249 - DNA, 22 bp, Homo sapiens
actaaatagttttgacagaaca

SEQ ID NO: 8108250 - DNA, 22 bp, Homo sapiens
actaaatacacacatttgttca

SEQ ID NO: 8108251 - DNA, 22 bp, Homo sapiens
actatcaacatcattgctctag

SEQ ID NO: 8108252 - DNA, 23 bp, Homo sapiens
actcaaaatttggcatttgagga

SEQ ID NO: 8108253 - DNA, 22 bp, Homo sapiens
actattgtgtagtagaagcatc

SEQ ID NO: 8108254 - DNA, 22 bp, Homo sapiens
actattcatgtttcctaactat

SEQ ID NO: 8108255 - DNA, 22 bp, Homo sapiens
actattagcatatcatgaatgg

SEQ ID NO: 8108256 - DNA, 22 bp, Homo sapiens
actattagcatatcatgaatgg

SEQ ID NO: 8108257 - DNA, 22 bp, Homo sapiens
actaaagatgtctaaatatatt

SEQ ID NO: 8108258 - DNA, 22 bp, Homo sapiens
actaaacattcttgtctctcaa

SEQ ID NO: 8108259 - DNA, 22 bp, Homo sapiens
actaaacacatgagattcctgc

SEQ ID NO: 8108260 - DNA, 22 bp, Homo sapiens
actaaaacagtggctagtagac

SEQ ID NO: 8108261 - DNA, 22 bp, Homo sapiens
acgttatatctgaaaaaagtga

SEQ ID NO: 8108262 - DNA, 22 bp, Homo sapiens
acgtgtgttggtcagggggccc

SEQ ID NO: 8108263 - DNA, 22 bp, Homo sapiens
accttcaattatttttgttcca

SEQ ID NO: 8108264 - DNA, 22 bp, Homo sapiens
accttcatattctctgatacct

SEQ ID NO: 8108265 - DNA, 22 bp, Homo sapiens
accttcaagattgtgggtcaat

SEQ ID NO: 8108266 - DNA, 22 bp, Homo sapiens
accttcaagtatgtgggctgaa

SEQ ID NO: 8108267 - DNA, 22 bp, Homo sapiens
accttaaatgtgacatagtcta

SEQ ID NO: 8108268 - DNA, 22 bp, Homo sapiens
accttaaaactgacacatggag

SEQ ID NO: 8108269 - DNA, 19 bp, Homo sapiens
accttacagaaacaggcat

SEQ ID NO: 8108270 - DNA, 22 bp, Homo sapiens
agctgctatgagaaaggcactg

SEQ ID NO: 8108271 - DNA, 22 bp, Homo sapiens
acagccttgagctcaaaaggaa

SEQ ID NO: 8108272 - DNA, 22 bp, Homo sapiens
acagccttgcttatttgtctct

SEQ ID NO: 8108273 - DNA, 22 bp, Homo sapiens
acagcagacacaggcacgctgt

SEQ ID NO: 8108274 - DNA, 22 bp, Homo sapiens
acagcacttattcagcacagtg

SEQ ID NO: 8108275 - DNA, 21 bp, Homo sapiens
acagcagacaggcttaggacc

SEQ ID NO: 8108276 - DNA, 22 bp, Homo sapiens
agctgccagcaagtttcaaaca

SEQ ID NO: 8108277 - DNA, 22 bp, Homo sapiens
agctgccagcatcccggaaggg

SEQ ID NO: 8108278 - DNA, 17 bp, Homo sapiens
agctgccagggagtgtg

SEQ ID NO: 8108279 - DNA, 22 bp, Homo sapiens
agctgccagggactgggcatgg

SEQ ID NO: 8108280 - DNA, 22 bp, Homo sapiens
agctgccaggcccctgagaacc

SEQ ID NO: 8108281 - DNA, 22 bp, Homo sapiens
agctgccatcctgttcagcacc

SEQ ID NO: 8108282 - DNA, 22 bp, Homo sapiens
agctgccatctgaagaactgca

SEQ ID NO: 8108283 - DNA, 22 bp, Homo sapiens
acagctatagacgatgtataga

SEQ ID NO: 8108284 - DNA, 22 bp, Homo sapiens
acagctatgacagatggataat

SEQ ID NO: 8108285 - DNA, 22 bp, Homo sapiens
acagctgtgaaaatccacagga

SEQ ID NO: 8108286 - DNA, 22 bp, Homo sapiens
acagctgtggccacttgcatcc

SEQ ID NO: 8108287 - DNA, 22 bp, Homo sapiens
acagctgtgatttctatcatga

SEQ ID NO: 8108288 - DNA, 22 bp, Homo sapiens
acagctgtgagggtcacttgta

SEQ ID NO: 8108289 - DNA, 22 bp, Homo sapiens
acagctgtgagggtcacttgta

SEQ ID NO: 8108290 - DNA, 22 bp, Homo sapiens
acagctgtgaagcaagcactct

SEQ ID NO: 8108291 - DNA, 22 bp, Homo sapiens
acagctgtgggctctgcatata

SEQ ID NO: 8108292 - DNA, 22 bp, Homo sapiens
acagctgtgttttataatcagc

SEQ ID NO: 8108293 - DNA, 22 bp, Homo sapiens
agctttatgcttcctacaagct

SEQ ID NO: 8108294 - DNA, 22 bp, Homo sapiens
aggaagggctgtttctccaaga

SEQ ID NO: 8108295 - DNA, 22 bp, Homo sapiens
aggaatggtgctcagcagaaat

SEQ ID NO: 8108296 - DNA, 22 bp, Homo sapiens
acaggtggacacagcagcagtc

SEQ ID NO: 8108297 - DNA, 22 bp, Homo sapiens
acaggtggaaacatggtgttgg

SEQ ID NO: 8108298 - DNA, 22 bp, Homo sapiens
acaggtggagtggttagcaggc

SEQ ID NO: 8108299 - DNA, 21 bp, Homo sapiens
aggagctgtgttagctggtcg

SEQ ID NO: 8108300 - DNA, 20 bp, Homo sapiens
aggagcttaggaggttattg

SEQ ID NO: 8108301 - DNA, 22 bp, Homo sapiens
acaggtggcttattggctgatt

SEQ ID NO: 8108302 - DNA, 20 bp, Homo sapiens
aggagtccctgtgctctctc

SEQ ID NO: 8108303 - DNA, 22 bp, Homo sapiens
aggagtccatgagcagctagag

SEQ ID NO: 8108304 - DNA, 22 bp, Homo sapiens
aggagggtgatccgggctggtc

SEQ ID NO: 8108305 - DNA, 22 bp, Homo sapiens
aggaggaaaaaggccacagcaa

SEQ ID NO: 8108306 - DNA, 21 bp, Homo sapiens
aggaggaacccgtggctgggc

SEQ ID NO: 8108307 - DNA, 22 bp, Homo sapiens
aggaggaaagaaggcccccagc

SEQ ID NO: 8108308 - DNA, 22 bp, Homo sapiens
aggaggaactcagaaagaaggt

SEQ ID NO: 8108309 - DNA, 20 bp, Homo sapiens
aggaggaagaaagcacactg

SEQ ID NO: 8108310 - DNA, 22 bp, Homo sapiens
acagttcaagtcttagacaaca

SEQ ID NO: 8108311 - DNA, 22 bp, Homo sapiens
acagttcactttttatatcaaa

SEQ ID NO: 8108312 - DNA, 22 bp, Homo sapiens
acagttattttcccagcattta

SEQ ID NO: 8108313 - DNA, 22 bp, Homo sapiens
acagttcaagacatcagtatga

SEQ ID NO: 8108314 - DNA, 22 bp, Homo sapiens
acagttaagcagtatgatcaca

SEQ ID NO: 8108315 - DNA, 22 bp, Homo sapiens
acagttaatcaaatggcatatg

SEQ ID NO: 8108316 - DNA, 22 bp, Homo sapiens
acagtgatgagggaattttgtg

SEQ ID NO: 8108317 - DNA, 22 bp, Homo sapiens
acagtgatcttttagttggaac

SEQ ID NO: 8108318 - DNA, 22 bp, Homo sapiens
acagtgatgagccggctgaggc

SEQ ID NO: 8108319 - DNA, 22 bp, Homo sapiens
acagtgatgggggtgcaggaag

SEQ ID NO: 8108320 - DNA, 22 bp, Homo sapiens
acagtgatgccgggcgagaatg

SEQ ID NO: 8108321 - DNA, 22 bp, Homo sapiens
acagtgatcagttactgtctgt

SEQ ID NO: 8108322 - DNA, 22 bp, Homo sapiens
acagtgatatttttactcaaat

SEQ ID NO: 8108323 - DNA, 22 bp, Homo sapiens
acagtgataaaatttcacatgt

SEQ ID NO: 8108324 - DNA, 22 bp, Homo sapiens
acagtgattattagttggtggt

SEQ ID NO: 8108325 - DNA, 22 bp, Homo sapiens
acagtgattctgcaaaccatat

SEQ ID NO: 8108326 - DNA, 22 bp, Homo sapiens
acagtgattggcactgattcag

SEQ ID NO: 8108327 - DNA, 18 bp, Homo sapiens
acagtgattgttctatgc

SEQ ID NO: 8108328 - DNA, 22 bp, Homo sapiens
acagtgattggggtatctgcag

SEQ ID NO: 8108329 - DNA, 22 bp, Homo sapiens
acagtgattggtttgggggtga

SEQ ID NO: 8108330 - DNA, 22 bp, Homo sapiens
acagtgattttttcgagcagaa

SEQ ID NO: 8108331 - DNA, 22 bp, Homo sapiens
acagtgatttctgcaagggctc

SEQ ID NO: 8108332 - DNA, 22 bp, Homo sapiens
acagtgattttaggatagatgg

SEQ ID NO: 8108333 - DNA, 22 bp, Homo sapiens
acagtgatttcatccttctggg

SEQ ID NO: 8108334 - DNA, 22 bp, Homo sapiens
aggcagcatgggcccagagtcc

SEQ ID NO: 8108335 - DNA, 22 bp, Homo sapiens
agggaattcactggaacgccct

SEQ ID NO: 8108336 - DNA, 22 bp, Homo sapiens
acatttttgggttgatgtctga

SEQ ID NO: 8108337 - DNA, 19 bp, Homo sapiens
accaaacagtggacggagc

SEQ ID NO: 8108338 - DNA, 22 bp, Homo sapiens
acatttttattcatcaaagcag

SEQ ID NO: 8108339 - DNA, 22 bp, Homo sapiens
acatttttcacatttgtagggt

SEQ ID NO: 8108340 - DNA, 22 bp, Homo sapiens
acatttttcacatttgtagggt

SEQ ID NO: 8108341 - DNA, 22 bp, Homo sapiens
acatttttctaggaggcaaggt

SEQ ID NO: 8108342 - DNA, 22 bp, Homo sapiens
acatttgtcttctttcagatta

SEQ ID NO: 8108343 - DNA, 22 bp, Homo sapiens
acatttgtcttctttcagatta

SEQ ID NO: 8108344 - DNA, 22 bp, Homo sapiens
aggctggcaaggcagatgtgtg

SEQ ID NO: 8108345 - DNA, 22 bp, Homo sapiens
agggcctggtgacctgggtcct

SEQ ID NO: 8108346 - DNA, 22 bp, Homo sapiens
agggcctggggtagcttactgc

SEQ ID NO: 8108347 - DNA, 22 bp, Homo sapiens
agggcctggttctgtgtaggga

SEQ ID NO: 8108348 - DNA, 22 bp, Homo sapiens
agggcctggttctgtgtaggga

SEQ ID NO: 8108349 - DNA, 22 bp, Homo sapiens
agggcctggtgacctgggtcct

SEQ ID NO: 8108350 - DNA, 22 bp, Homo sapiens
acccgggaggcaggagtcatag

SEQ ID NO: 8108351 - DNA, 22 bp, Homo sapiens
agggcctgggatgtcctcctag

SEQ ID NO: 8108352 - DNA, 22 bp, Homo sapiens
agggcctgggccagcacccttt

SEQ ID NO: 8108353 - DNA, 22 bp, Homo sapiens
acccaaaagtcactcaggagca

SEQ ID NO: 8108354 - DNA, 22 bp, Homo sapiens
acccacaacagctctaggaagt

SEQ ID NO: 8108355 - DNA, 23 bp, Homo sapiens
agggcatgaagcagaggacgtgg

SEQ ID NO: 8108356 - DNA, 22 bp, Homo sapiens
agggcatgaagcagtggacagc

SEQ ID NO: 8108357 - DNA, 22 bp, Homo sapiens
accattaaagagatcctgggga

SEQ ID NO: 8108358 - DNA, 21 bp, Homo sapiens
accattaacacccaggtttct

SEQ ID NO: 8108359 - DNA, 22 bp, Homo sapiens
accattaacatgattttgggga

SEQ ID NO: 8108360 - DNA, 22 bp, Homo sapiens
accattaatctcacaaggataa

SEQ ID NO: 8108361 - DNA, 22 bp, Homo sapiens
accattaagaatctggtttcct

SEQ ID NO: 8108362 - DNA, 20 bp, Homo sapiens
accattaatgtaagctttgt

SEQ ID NO: 8108363 - DNA, 22 bp, Homo sapiens
accattctgagatgctgctggt

SEQ ID NO: 8108364 - DNA, 22 bp, Homo sapiens
accatcaagaccttatctagtt

SEQ ID NO: 8108365 - DNA, 22 bp, Homo sapiens
agggagctcagttggaagcggt

SEQ ID NO: 8108366 - DNA, 22 bp, Homo sapiens
acatgaggtaagggatgttaag

SEQ ID NO: 8108367 - DNA, 17 bp, Homo sapiens
aggcaggcagagcggga

SEQ ID NO: 8108368 - DNA, 22 bp, Homo sapiens
acatggagaccagatggaagta

SEQ ID NO: 8108369 - DNA, 22 bp, Homo sapiens
aggccctgttatgagccactgt

SEQ ID NO: 8108370 - DNA, 22 bp, Homo sapiens
aggccctgtccatggtgctgaa

SEQ ID NO: 8108371 - DNA, 22 bp, Homo sapiens
aggccctgcccagagctcctcg

SEQ ID NO: 8108372 - DNA, 22 bp, Homo sapiens
aggcgctgagtaggcaaggagg

SEQ ID NO: 8108373 - DNA, 22 bp, Homo sapiens
aggcctgtttcttgtccagctc

SEQ ID NO: 8108374 - DNA, 22 bp, Homo sapiens
aggcctgttggcgtgggctcta

SEQ ID NO: 8108375 - DNA, 22 bp, Homo sapiens
aggcctgttccttcctgggcac

SEQ ID NO: 8108376 - DNA, 22 bp, Homo sapiens
aggcctgttccaggcccctttt

SEQ ID NO: 8108377 - DNA, 22 bp, Homo sapiens
aggctatttccactcttctcat

SEQ ID NO: 8108378 - DNA, 22 bp, Homo sapiens
aggctaggcatgtgctaccaca

SEQ ID NO: 8108379 - DNA, 22 bp, Homo sapiens
acagcagagcctggtacttact

SEQ ID NO: 8108380 - DNA, 22 bp, Homo sapiens
acagcagagtggagatgagcac

SEQ ID NO: 8108381 - DNA, 22 bp, Homo sapiens
acagcagagccagtggctctag

SEQ ID NO: 8108382 - DNA, 22 bp, Homo sapiens
acagcagagcaccagggccact

SEQ ID NO: 8108383 - DNA, 21 bp, Homo sapiens
acagcagagatcaagactaag

SEQ ID NO: 8108384 - DNA, 22 bp, Homo sapiens
acagcagagacactcaggaggc

SEQ ID NO: 8108385 - DNA, 22 bp, Homo sapiens
acagcaaaagacaagaacttaa

SEQ ID NO: 8108386 - DNA, 22 bp, Homo sapiens
aagcagaggaccgacggaggga

SEQ ID NO: 8108387 - DNA, 22 bp, Homo sapiens
aagcagaactgggaagtagtgg

SEQ ID NO: 8108388 - DNA, 22 bp, Homo sapiens
aagcagaatttaatagaaaggt

SEQ ID NO: 8108389 - DNA, 22 bp, Homo sapiens
aagcagagccaccagctttgga

SEQ ID NO: 8108390 - DNA, 22 bp, Homo sapiens
aagcagagaatctgggagcgag

SEQ ID NO: 8108391 - DNA, 22 bp, Homo sapiens
aagcaatagggtaatctactca

SEQ ID NO: 8108392 - DNA, 22 bp, Homo sapiens
aagcaagtaggtatttgacaaa

SEQ ID NO: 8108393 - DNA, 22 bp, Homo sapiens
acacatttattacatgcatgtg

SEQ ID NO: 8108394 - DNA, 22 bp, Homo sapiens
acacatttctaaatttttaccg

SEQ ID NO: 8108395 - DNA, 22 bp, Homo sapiens
acacatttagcaccaggtttat

SEQ ID NO: 8108396 - DNA, 22 bp, Homo sapiens
acacatttatggatcgcagaaa

SEQ ID NO: 8108397 - DNA, 22 bp, Homo sapiens
acacatttaaaaaggaacatat

SEQ ID NO: 8108398 - DNA, 22 bp, Homo sapiens
aatttgttacacagcaatataa

SEQ ID NO: 8108399 - DNA, 21 bp, Homo sapiens
aatttcagacccattttgcct

SEQ ID NO: 8108400 - DNA, 22 bp, Homo sapiens
aatttcagggtgaatggactga

SEQ ID NO: 8108401 - DNA, 22 bp, Homo sapiens
aagaccattgctgtatttgtag

SEQ ID NO: 8108402 - DNA, 22 bp, Homo sapiens
acacaaaatcaaagtcctaggc

SEQ ID NO: 8108403 - DNA, 22 bp, Homo sapiens
aagagcagaagtccttggatcc

SEQ ID NO: 8108404 - DNA, 22 bp, Homo sapiens
acaatgttttgaaacatctagg

SEQ ID NO: 8108405 - DNA, 22 bp, Homo sapiens
aagaacaactgctttaaaagca

SEQ ID NO: 8108406 - DNA, 22 bp, Homo sapiens
aagaaatggcttcatctgagta

SEQ ID NO: 8108407 - DNA, 22 bp, Homo sapiens
aagaaatgtgaatattgaatag

SEQ ID NO: 8108408 - DNA, 22 bp, Homo sapiens
aatttcactggaaaagataatt

SEQ ID NO: 8108409 - DNA, 22 bp, Homo sapiens
aatttcacctatcacttaagcc

SEQ ID NO: 8108410 - DNA, 22 bp, Homo sapiens
aattctacattggttcacattt

SEQ ID NO: 8108411 - DNA, 23 bp, Homo sapiens
aattcctagtcgatctaaatcag

SEQ ID NO: 8108412 - DNA, 22 bp, Homo sapiens
aattctcaggtaaaagttaagt

SEQ ID NO: 8108413 - DNA, 20 bp, Homo sapiens
aagaaacttgaaagtacaag

SEQ ID NO: 8108414 - DNA, 21 bp, Homo sapiens
aagaaagataattaaggaccc

SEQ ID NO: 8108415 - DNA, 23 bp, Homo sapiens
aactggtccaagatagattgtcc

SEQ ID NO: 8108416 - DNA, 22 bp, Homo sapiens
aactggtcctcaaattttgatg

SEQ ID NO: 8108417 - DNA, 22 bp, Homo sapiens
aactggtctttagaatattctg

SEQ ID NO: 8108418 - DNA, 22 bp, Homo sapiens
aactgggcccagtctgagttgg

SEQ ID NO: 8108419 - DNA, 22 bp, Homo sapiens
aactgctttttgatctcaggag

SEQ ID NO: 8108420 - DNA, 22 bp, Homo sapiens
aagaaaacaatgacttgccagc

SEQ ID NO: 8108421 - DNA, 22 bp, Homo sapiens
aagaaaacatgatctaatttaa

SEQ ID NO: 8108422 - DNA, 20 bp, Homo sapiens
aagaaaacgtcttcagggga

SEQ ID NO: 8108423 - DNA, 22 bp, Homo sapiens
aacctcatttccttctttgtaa

SEQ ID NO: 8108424 - DNA, 18 bp, Homo sapiens
aactagagggctgtcaat

SEQ ID NO: 8108425 - DNA, 22 bp, Homo sapiens
aactactcaactctgccattgt

SEQ ID NO: 8108426 - DNA, 22 bp, Homo sapiens
aactactaccacagtcaagaca

SEQ ID NO: 8108427 - DNA, 22 bp, Homo sapiens
aatgacatgctttttaattata

SEQ ID NO: 8108428 - DNA, 22 bp, Homo sapiens
aatagactttctttttagaaca

SEQ ID NO: 8108429 - DNA, 22 bp, Homo sapiens
aacatgaaaagcccagagaggt

SEQ ID NO: 8108430 - DNA, 22 bp, Homo sapiens
aatagaatttgtactgtgtttt

SEQ ID NO: 8108431 - DNA, 22 bp, Homo sapiens
aacatctttgataaacttagtg

SEQ ID NO: 8108432 - DNA, 22 bp, Homo sapiens
aacatctgaaaaggcttcactc

SEQ ID NO: 8108433 - DNA, 22 bp, Homo sapiens
aacagctgcttctatcttttca

SEQ ID NO: 8108434 - DNA, 22 bp, Homo sapiens
aacagctgcttcagtacttgaa

SEQ ID NO: 8108435 - DNA, 22 bp, Homo sapiens
aagtgtacagtttggtggcatt

SEQ ID NO: 8108436 - DNA, 22 bp, Homo sapiens
aacagctgtatactgtagctgt

SEQ ID NO: 8108437 - DNA, 22 bp, Homo sapiens
aacagctgtatactgtagctgt

SEQ ID NO: 8108438 - DNA, 22 bp, Homo sapiens
aacagctgtctgcctatctctg

SEQ ID NO: 8108439 - DNA, 22 bp, Homo sapiens
aacagctgttcgcagatgtagg

SEQ ID NO: 8108440 - DNA, 18 bp, Homo sapiens
aaattattcttccttttc

SEQ ID NO: 8108441 - DNA, 22 bp, Homo sapiens
aaattattctcatgtgtttctt

SEQ ID NO: 8108442 - DNA, 23 bp, Homo sapiens
aaattattgctcttcaattgcct

SEQ ID NO: 8108443 - DNA, 22 bp, Homo sapiens
aaattattgggtcccaccccag

SEQ ID NO: 8108444 - DNA, 22 bp, Homo sapiens
aaattattttcagaatggagaa

SEQ ID NO: 8108445 - DNA, 22 bp, Homo sapiens
aaattattcaaaaagctgtgtt

SEQ ID NO: 8108446 - DNA, 22 bp, Homo sapiens
aaggaagatatatcaagcttaa

SEQ ID NO: 8108447 - DNA, 22 bp, Homo sapiens
aaggaagatgaaagtactgcta

SEQ ID NO: 8108448 - DNA, 22 bp, Homo sapiens
aaggaagatgaggtgctgctta

SEQ ID NO: 8108449 - DNA, 22 bp, Homo sapiens
aaggaagagtctagaacaggca

SEQ ID NO: 8108450 - DNA, 22 bp, Homo sapiens
aaggaagaggcaggttttgctg

SEQ ID NO: 8108451 - DNA, 22 bp, Homo sapiens
aaatgcattaagtcagaacaat

SEQ ID NO: 8108452 - DNA, 22 bp, Homo sapiens
aaggaagacacagatgaagtga

SEQ ID NO: 8108453 - DNA, 22 bp, Homo sapiens
aaggaagactcgcaggtctatg

SEQ ID NO: 8108454 - DNA, 22 bp, Homo sapiens
aaggaagacttgagaaggttcc

SEQ ID NO: 8108455 - DNA, 22 bp, Homo sapiens
aaggaagagaatccttctcaga

SEQ ID NO: 8108456 - DNA, 22 bp, Homo sapiens
aaggaagagcaaagaattatgt

SEQ ID NO: 8108457 - DNA, 22 bp, Homo sapiens
aacacagatcaaaatatttcct

SEQ ID NO: 8108458 - DNA, 22 bp, Homo sapiens
aacacagggactcccaggagaa

SEQ ID NO: 8108459 - DNA, 22 bp, Homo sapiens
aaatttctgttgttttgagcca

SEQ ID NO: 8108460 - DNA, 22 bp, Homo sapiens
aaatttcttgaggctctctagc

SEQ ID NO: 8108461 - DNA, 22 bp, Homo sapiens
aaatttgtcaacttcatatgtt

SEQ ID NO: 8108462 - DNA, 22 bp, Homo sapiens
aaatttgttcaatgtctatttg

SEQ ID NO: 8108463 - DNA, 22 bp, Homo sapiens
aaatttgccagatcaattctga

SEQ ID NO: 8108464 - DNA, 22 bp, Homo sapiens
aaatttctaagtcaagaagaac

SEQ ID NO: 8108465 - DNA, 22 bp, Homo sapiens
aaatttctaagtcaagaagaac

SEQ ID NO: 8108466 - DNA, 22 bp, Homo sapiens
aacagaaatcatttagggctct

SEQ ID NO: 8108467 - DNA, 22 bp, Homo sapiens
aacagacagaaaaatgtgatct

SEQ ID NO: 8108468 - DNA, 20 bp, Homo sapiens
aacacagggttaccatcaga

SEQ ID NO: 8108469 - DNA, 22 bp, Homo sapiens
aacacagttttccaaaatagag

SEQ ID NO: 8108470 - DNA, 22 bp, Homo sapiens
aacacagtttctctatgagagt

SEQ ID NO: 8108471 - DNA, 21 bp, Homo sapiens
aacacttgggttagtgggaga

SEQ ID NO: 8108472 - DNA, 22 bp, Homo sapiens
aacatataaactcttaagttca

SEQ ID NO: 8108473 - DNA, 22 bp, Homo sapiens
aacatacatatttcagtgtcca

SEQ ID NO: 8108474 - DNA, 22 bp, Homo sapiens
aacatacatatttcagtgtcca

SEQ ID NO: 8108475 - DNA, 22 bp, Homo sapiens
aacataatgtggccaaagtcac

SEQ ID NO: 8108476 - DNA, 22 bp, Homo sapiens
aacatacagtgagcagtggact

SEQ ID NO: 8108477 - DNA, 22 bp, Homo sapiens
aacatacttatactaaataatg

SEQ ID NO: 8108478 - DNA, 22 bp, Homo sapiens
aaagattatggcattgaaatac

SEQ ID NO: 8108479 - DNA, 22 bp, Homo sapiens
aacacttatccacatttgaaag

SEQ ID NO: 8108480 - DNA, 22 bp, Homo sapiens
aacacttaaggagagatcaaat

SEQ ID NO: 8108481 - DNA, 23 bp, Homo sapiens
aaagcaaggaattggcaacagag

SEQ ID NO: 8108482 - DNA, 22 bp, Homo sapiens
aaaggcagagttgttggaggca

SEQ ID NO: 8108483 - DNA, 22 bp, Homo sapiens
aactgcaaaataatcaagttgt

SEQ ID NO: 8108484 - DNA, 19 bp, Homo sapiens
aaaggcagtgggtggcgtg

SEQ ID NO: 8108485 - DNA, 22 bp, Homo sapiens
aagaaataagacttctctgtcc

SEQ ID NO: 8108486 - DNA, 22 bp, Homo sapiens
aaagtaacaataaggttctatt

SEQ ID NO: 8108487 - DNA, 22 bp, Homo sapiens
aaagtaaagattgggaatgtgt

SEQ ID NO: 8108488 - DNA, 22 bp, Homo sapiens
aactgtgaggatgtgcaaattc

SEQ ID NO: 8108489 - DNA, 22 bp, Homo sapiens
aagatcaccttgacatgaaaag

SEQ ID NO: 8108490 - DNA, 20 bp, Homo sapiens
aagattcattgtaattaggg

SEQ ID NO: 8108491 - DNA, 22 bp, Homo sapiens
aaatctctggcagaaataaact

SEQ ID NO: 8108492 - DNA, 22 bp, Homo sapiens
aaagtgatgaactctgtgacct

SEQ ID NO: 8108493 - DNA, 22 bp, Homo sapiens
aaagtgcaaggattacaggcat

SEQ ID NO: 8108494 - DNA, 19 bp, Homo sapiens
aaagtgattttttctggca

SEQ ID NO: 8108495 - DNA, 22 bp, Homo sapiens
aagataaactcttgatttctga

SEQ ID NO: 8108496 - DNA, 22 bp, Homo sapiens
aaatactctcaataaagaaagt

SEQ ID NO: 8108497 - DNA, 22 bp, Homo sapiens
aaatactagaattcagagttga

SEQ ID NO: 8108498 - DNA, 22 bp, Homo sapiens
aagagggcagcacaggtgggtc

SEQ ID NO: 8108499 - DNA, 22 bp, Homo sapiens
aagagggctgcaatcttattgc

SEQ ID NO: 8108500 - DNA, 22 bp, Homo sapiens
aaatagttagccctgcatatat

SEQ ID NO: 8108501 - DNA, 22 bp, Homo sapiens
aaatagttcagcttgtaaaccc

SEQ ID NO: 8108502 - DNA, 22 bp, Homo sapiens
aaacttcattttcaactgcaaa

SEQ ID NO: 8108503 - DNA, 22 bp, Homo sapiens
aaacttttttaggttcataggc

SEQ ID NO: 8108504 - DNA, 21 bp, Homo sapiens
aaagaaatctcccattggtag

SEQ ID NO: 8108505 - DNA, 22 bp, Homo sapiens
aaagaaatagatggcatttaaa

SEQ ID NO: 8108506 - DNA, 22 bp, Homo sapiens
aaagaaatacctttctcagctt

SEQ ID NO: 8108507 - DNA, 22 bp, Homo sapiens
aaagaacaatgtggaatctcct

SEQ ID NO: 8108508 - DNA, 22 bp, Homo sapiens
aaacagataatgctataaatgg

SEQ ID NO: 8108509 - DNA, 22 bp, Homo sapiens
aaacattgtaattttagcatgg

SEQ ID NO: 8108510 - DNA, 22 bp, Homo sapiens
aaacattgctaaataatgctgc

SEQ ID NO: 8108511 - DNA, 22 bp, Homo sapiens
aaacatgtaattctgcttaaga

SEQ ID NO: 8108512 - DNA, 22 bp, Homo sapiens
aaaattattcatggcttttgga

SEQ ID NO: 8108513 - DNA, 22 bp, Homo sapiens
aaaattattcatggcttttgga

SEQ ID NO: 8108514 - DNA, 22 bp, Homo sapiens
aaaactttcagggatacagaaa

SEQ ID NO: 8108515 - DNA, 22 bp, Homo sapiens
aaaagtaattgcaattttgtag

SEQ ID NO: 8108516 - DNA, 22 bp, Homo sapiens
aaaaccttctagactttatatt

SEQ ID NO: 8108517 - DNA, 22 bp, Homo sapiens
aaaactgaaccttgagatcttt

SEQ ID NO: 8108518 - DNA, 22 bp, Homo sapiens
aaaacctgattgaattctattt

SEQ ID NO: 8108519 - DNA, 22 bp, Homo sapiens
aaaaccttcaggtttggagttt

SEQ ID NO: 8108520 - DNA, 22 bp, Homo sapiens
aaaaggatcagattttgagcag

SEQ ID NO: 8108521 - DNA, 22 bp, Homo sapiens
aaagagctggcatttatagtct

SEQ ID NO: 8108522 - DNA, 22 bp, Homo sapiens
aaacacatcattcatgtcgtca

SEQ ID NO: 8108523 - DNA, 22 bp, Homo sapiens
aaagagcttcatttccatttat

SEQ ID NO: 8108524 - DNA, 22 bp, Homo sapiens
aaacaccagtcccagtatacac

SEQ ID NO: 8108525 - DNA, 22 bp, Homo sapiens
aaacaccaagagctagctatta

SEQ ID NO: 8108526 - DNA, 22 bp, Homo sapiens
aaacaccagcactgtttacaaa

SEQ ID NO: 8108527 - DNA, 22 bp, Homo sapiens
aaagagcccttccatgactctt

SEQ ID NO: 8108528 - DNA, 20 bp, Homo sapiens
aaaattgctctgcagtcccc

SEQ ID NO: 8108529 - DNA, 22 bp, Homo sapiens
aaaattctgtcattaaattgtg

SEQ ID NO: 8108530 - DNA, 17 bp, Homo sapiens
aaaattctgtaaagagg

SEQ ID NO: 8108531 - DNA, 17 bp, Homo sapiens
aaaattctgtaaagagg

SEQ ID NO: 8108532 - DNA, 22 bp, Homo sapiens
aaaattctgtcattaaattgtg

SEQ ID NO: 8108533 - DNA, 22 bp, Homo sapiens
aaaattctcttgatcttgacag

SEQ ID NO: 8108534 - DNA, 22 bp, Homo sapiens
aaaattctaacatgcagccaag

SEQ ID NO: 8108535 - DNA, 22 bp, Homo sapiens
aaactggtaataaaatggatta

SEQ ID NO: 8108536 - DNA, 22 bp, Homo sapiens
acacagagtttgacacatggga

SEQ ID NO: 8108537 - DNA, 22 bp, Homo sapiens
acacagaggcatgacagtggct

SEQ ID NO: 8108538 - DNA, 22 bp, Homo sapiens
acacagatattttgaatacata

SEQ ID NO: 8108539 - DNA, 22 bp, Homo sapiens
acacagatattgtacttgatcc

SEQ ID NO: 8108540 - DNA, 22 bp, Homo sapiens
acacagatattgtacttgatcc

SEQ ID NO: 8108541 - DNA, 22 bp, Homo sapiens
acacagataatgctcatatagg

SEQ ID NO: 8108542 - DNA, 22 bp, Homo sapiens
acacagatgctatttagtctct

SEQ ID NO: 8108543 - DNA, 22 bp, Homo sapiens
acaatgcaccagcatcttcacc

SEQ ID NO: 8108544 - DNA, 22 bp, Homo sapiens
agcagatagtagaacatgtata

SEQ ID NO: 8108545 - DNA, 22 bp, Homo sapiens
agcagatatttgttgagcactt

SEQ ID NO: 8108546 - DNA, 22 bp, Homo sapiens
acactgaaagaagccagcttgt

SEQ ID NO: 8108547 - DNA, 22 bp, Homo sapiens
acactgaatatacaatgaatat

SEQ ID NO: 8108548 - DNA, 22 bp, Homo sapiens
acactctgctctgagcttcagg

SEQ ID NO: 8108549 - DNA, 22 bp, Homo sapiens
acacattatagagagtataata

SEQ ID NO: 8108550 - DNA, 22 bp, Homo sapiens
acactgcagatgaaagcataag

SEQ ID NO: 8108551 - DNA, 22 bp, Homo sapiens
acactgactgggacagaagacc

SEQ ID NO: 8108552 - DNA, 22 bp, Homo sapiens
acactgactgggcagtatagtc

SEQ ID NO: 8108553 - DNA, 22 bp, Homo sapiens
acacatgtatgttttgtatttg

SEQ ID NO: 8108554 - DNA, 22 bp, Homo sapiens
acacattaacctttgaaattct

SEQ ID NO: 8108555 - DNA, 22 bp, Homo sapiens
acacagggcggaaagcatgaga

SEQ ID NO: 8108556 - DNA, 22 bp, Homo sapiens
acacatcttagactgaaatatg

SEQ ID NO: 8108557 - DNA, 22 bp, Homo sapiens
acacagggaggaggtgctgtgc

SEQ ID NO: 8108558 - DNA, 18 bp, Homo sapiens
acacaggctgacagcacc

SEQ ID NO: 8108559 - DNA, 19 bp, Homo sapiens
agccagggtccagacatgt

SEQ ID NO: 8108560 - DNA, 19 bp, Homo sapiens
agccagggtgagaaggagc

SEQ ID NO: 8108561 - DNA, 22 bp, Homo sapiens
agccagggtctctcgctctgtt

SEQ ID NO: 8108562 - DNA, 20 bp, Homo sapiens
acagagactgagacacttgc

SEQ ID NO: 8108563 - DNA, 22 bp, Homo sapiens
acacttttaagactttaatgaa

SEQ ID NO: 8108564 - DNA, 22 bp, Homo sapiens
acactttatcaatattcaaaaa

SEQ ID NO: 8108565 - DNA, 22 bp, Homo sapiens
acactttatcaatattcaaaaa

SEQ ID NO: 8108566 - DNA, 22 bp, Homo sapiens
acacttttgtttgaagtctcca

SEQ ID NO: 8108567 - DNA, 20 bp, Homo sapiens
acagaaagagagaatgtcag

SEQ ID NO: 8108568 - DNA, 22 bp, Homo sapiens
acagaattaatgaaaattacaa

SEQ ID NO: 8108569 - DNA, 22 bp, Homo sapiens
acagaaagataggcacaaggtc

SEQ ID NO: 8108570 - DNA, 22 bp, Homo sapiens
acagacacaggcgtggagtcgc

SEQ ID NO: 8108571 - DNA, 22 bp, Homo sapiens
acagacaagtagttcagacaag

SEQ ID NO: 8108572 - DNA, 22 bp, Homo sapiens
acagacagacagattgcatatg

SEQ ID NO: 8108573 - DNA, 22 bp, Homo sapiens
acagacagacagagaactattc

SEQ ID NO: 8108574 - DNA, 18 bp, Homo sapiens
acagacacttagtatgag

SEQ ID NO: 8108575 - DNA, 19 bp, Homo sapiens
acagagctctctgcttctg

SEQ ID NO: 8108576 - DNA, 20 bp, Homo sapiens
acagatgaggatgcggaggc

SEQ ID NO: 8108577 - DNA, 22 bp, Homo sapiens
acagatgtacactcatatataa

SEQ ID NO: 8108578 - DNA, 22 bp, Homo sapiens
agctcctgcttgacagaagagg

SEQ ID NO: 8108579 - DNA, 17 bp, Homo sapiens
agctcctgcccatggct

SEQ ID NO: 8108580 - DNA, 22 bp, Homo sapiens
agaggccctctctgctcagtct

SEQ ID NO: 8108581 - DNA, 22 bp, Homo sapiens
agaggccctctctctcctgatg

SEQ ID NO: 8108582 - DNA, 22 bp, Homo sapiens
agaggctgttacactcccagat

SEQ ID NO: 8108583 - DNA, 22 bp, Homo sapiens
agaggctgtgcccaccaggcaa

SEQ ID NO: 8108584 - DNA, 22 bp, Homo sapiens
acaaagaaggaattggtcttta

SEQ ID NO: 8108585 - DNA, 22 bp, Homo sapiens
acaaagtaggaagattagctga

SEQ ID NO: 8108586 - DNA, 23 bp, Homo sapiens
acaaagtaattcctgcttccaaa

SEQ ID NO: 8108587 - DNA, 22 bp, Homo sapiens
acaaagtaggcagtgggctgga

SEQ ID NO: 8108588 - DNA, 22 bp, Homo sapiens
acaaagtaggtcatcaaagctc

SEQ ID NO: 8108589 - DNA, 20 bp, Homo sapiens
acaaagtattgaggacaagt

SEQ ID NO: 8108590 - DNA, 22 bp, Homo sapiens
acaaagtagtcaaagtagatga

SEQ ID NO: 8108591 - DNA, 22 bp, Homo sapiens
acaaagtaagggctaatgagca

SEQ ID NO: 8108592 - DNA, 22 bp, Homo sapiens
agagggggtgtcagcactgcag

SEQ ID NO: 8108593 - DNA, 22 bp, Homo sapiens
agagggggtgttccagaagcat

SEQ ID NO: 8108594 - DNA, 22 bp, Homo sapiens
agagggggaaaatagaggtgtt

SEQ ID NO: 8108595 - DNA, 22 bp, Homo sapiens
acaagaatgtagattagttaag

SEQ ID NO: 8108596 - DNA, 22 bp, Homo sapiens
agataactggtttacattattg

SEQ ID NO: 8108597 - DNA, 22 bp, Homo sapiens
acaagaattatttctagttaac

SEQ ID NO: 8108598 - DNA, 22 bp, Homo sapiens
acaagaattatttctagttaac

SEQ ID NO: 8108599 - DNA, 22 bp, Homo sapiens
acaagagtatctttgactttag

SEQ ID NO: 8108600 - DNA, 22 bp, Homo sapiens
acaagagtctgcatttctaaca

SEQ ID NO: 8108601 - DNA, 22 bp, Homo sapiens
agataactcattttgtatatcc

SEQ ID NO: 8108602 - DNA, 22 bp, Homo sapiens
acaacaaagacacttgaaatga

SEQ ID NO: 8108603 - DNA, 22 bp, Homo sapiens
acaacacagctttcctcaagtt

SEQ ID NO: 8108604 - DNA, 22 bp, Homo sapiens
acaagattcaatgaattgattg

SEQ ID NO: 8108605 - DNA, 22 bp, Homo sapiens
acaagctcacatcagccaatga

SEQ ID NO: 8108606 - DNA, 22 bp, Homo sapiens
acaagctccttattcagctggg

SEQ ID NO: 8108607 - DNA, 22 bp, Homo sapiens
acaagcttccaggtgatgctga

SEQ ID NO: 8108608 - DNA, 22 bp, Homo sapiens
acaatgaaaaaatttactgtgg

SEQ ID NO: 8108609 - DNA, 22 bp, Homo sapiens
acaatgaacacacaaggaattc

SEQ ID NO: 8108610 - DNA, 22 bp, Homo sapiens
acaatgaacgctttttaactgt

SEQ ID NO: 8108611 - DNA, 22 bp, Homo sapiens
acaatgaagataatgttgcagt

SEQ ID NO: 8108612 - DNA, 20 bp, Homo sapiens
agacaatgagtgacagagtt

SEQ ID NO: 8108613 - DNA, 22 bp, Homo sapiens
aatgtgacaagcacagactgtg

SEQ ID NO: 8108614 - DNA, 22 bp, Homo sapiens
aatgtgacatatctggcttagg

SEQ ID NO: 8108615 - DNA, 22 bp, Homo sapiens
aatggtttaacatatgcttgag

SEQ ID NO: 8108616 - DNA, 22 bp, Homo sapiens
aatggtttgtacctgtccttgg

SEQ ID NO: 8108617 - DNA, 22 bp, Homo sapiens
aatgggctttcttggacaggag

SEQ ID NO: 8108618 - DNA, 22 bp, Homo sapiens
agagcctgcatctagcctcaga

SEQ ID NO: 8108619 - DNA, 22 bp, Homo sapiens
agagcagtcaggctaggacact

SEQ ID NO: 8108620 - DNA, 22 bp, Homo sapiens
agagacaggatatctgctcatg

SEQ ID NO: 8108621 - DNA, 22 bp, Homo sapiens
aattaaattggtttagagagga

SEQ ID NO: 8108622 - DNA, 22 bp, Homo sapiens
aattaaaagataacccatgagt

SEQ ID NO: 8108623 - DNA, 22 bp, Homo sapiens
aattaaattggtttagagagga

SEQ ID NO: 8108624 - DNA, 22 bp, Homo sapiens
aatgtggttaaaatttggttgt

SEQ ID NO: 8108625 - DNA, 22 bp, Homo sapiens
acctttatgattcacaatgtat

SEQ ID NO: 8108626 - DNA, 22 bp, Homo sapiens
aagtcctttccagtcctgtgat

SEQ ID NO: 8108627 - DNA, 22 bp, Homo sapiens
actacacagggatgtgactacc

SEQ ID NO: 8108628 - DNA, 22 bp, Homo sapiens
actccctccaaatctgcacagt

SEQ ID NO: 8108629 - DNA, 20 bp, Homo sapiens
actctaccagggcagcagca

SEQ ID NO: 8108630 - DNA, 22 bp, Homo sapiens
actctcaatgtggttaatccaa

SEQ ID NO: 8108631 - DNA, 22 bp, Homo sapiens
actatacattgaatgttaaggt

SEQ ID NO: 8108632 - DNA, 22 bp, Homo sapiens
actatacaagattagggatttg

SEQ ID NO: 8108633 - DNA, 22 bp, Homo sapiens
actatacaccaaaatattaagg

SEQ ID NO: 8108634 - DNA, 22 bp, Homo sapiens
actataaaaggataaaccagaa

SEQ ID NO: 8108635 - DNA, 22 bp, Homo sapiens
actataaaaggataaaccagaa

SEQ ID NO: 8108636 - DNA, 22 bp, Homo sapiens
actgcactccagcctcggggtc

SEQ ID NO: 8108637 - DNA, 22 bp, Homo sapiens
actgcactccagcctcggggtc

SEQ ID NO: 8108638 - DNA, 22 bp, Homo sapiens
actgcactccaacctgggtgac

SEQ ID NO: 8108639 - DNA, 22 bp, Homo sapiens
actgcactccaacctgggtgac

SEQ ID NO: 8108640 - DNA, 22 bp, Homo sapiens
actgcactccagcctgggtaac

SEQ ID NO: 8108641 - DNA, 22 bp, Homo sapiens
actgcactccagcctgggtaac

SEQ ID NO: 8108642 - DNA, 22 bp, Homo sapiens
actgagagaacgggctgctccc

SEQ ID NO: 8108643 - DNA, 22 bp, Homo sapiens
actggcccttgattgcatcagc

SEQ ID NO: 8108644 - DNA, 22 bp, Homo sapiens
actggccctggctgctaggctg

SEQ ID NO: 8108645 - DNA, 22 bp, Homo sapiens
aatacctttcctgccattcact

SEQ ID NO: 8108646 - DNA, 22 bp, Homo sapiens
aataccttccaacatcaagaca

SEQ ID NO: 8108647 - DNA, 22 bp, Homo sapiens
actggacaggttcatggtttta

SEQ ID NO: 8108648 - DNA, 22 bp, Homo sapiens
actgcactccagcctgggtgac

SEQ ID NO: 8108649 - DNA, 22 bp, Homo sapiens
actggaggcccctcccagtgaa

SEQ ID NO: 8108650 - DNA, 22 bp, Homo sapiens
aatgatgtatgtataaggcagg

SEQ ID NO: 8108651 - DNA, 22 bp, Homo sapiens
agaacaaggctgtttccaatgc

SEQ ID NO: 8108652 - DNA, 22 bp, Homo sapiens
agaacaattgccccaaagcttg

SEQ ID NO: 8108653 - DNA, 22 bp, Homo sapiens
agaaattatgcagtagttttat

SEQ ID NO: 8108654 - DNA, 22 bp, Homo sapiens
agaaattattagtgaatagtct

SEQ ID NO: 8108655 - DNA, 22 bp, Homo sapiens
aatcataattcaaataagctta

SEQ ID NO: 8108656 - DNA, 22 bp, Homo sapiens
aatcagttaaatattgagtaca

SEQ ID NO: 8108657 - DNA, 22 bp, Homo sapiens
aatcagaatttgtcccctgagt

SEQ ID NO: 8108658 - DNA, 22 bp, Homo sapiens
aatcagaacttctcagggtggg

SEQ ID NO: 8108659 - DNA, 22 bp, Homo sapiens
aatcagaactcctaccacagag

SEQ ID NO: 8108660 - DNA, 22 bp, Homo sapiens
aatcagaaccttgggtcataac

SEQ ID NO: 8108661 - DNA, 22 bp, Homo sapiens
aatcagaatttattgaatcttt

SEQ ID NO: 8108662 - DNA, 22 bp, Homo sapiens
aatcagaatcagttgacacagc

SEQ ID NO: 8108663 - DNA, 22 bp, Homo sapiens
aatcagaatcagttgacacagc

SEQ ID NO: 8108664 - DNA, 22 bp, Homo sapiens
actgttcatttggatttctctg

SEQ ID NO: 8108665 - DNA, 22 bp, Homo sapiens
actgttcatctcttagaaagta

SEQ ID NO: 8108666 - DNA, 22 bp, Homo sapiens
actgttcacccagcactagcag

SEQ ID NO: 8108667 - DNA, 22 bp, Homo sapiens
aatatagttctagaaatatttt

SEQ ID NO: 8108668 - DNA, 22 bp, Homo sapiens
aatatagatttactcaagagaa

SEQ ID NO: 8108669 - DNA, 22 bp, Homo sapiens
aatactatgtagccaaaataat

SEQ ID NO: 8108670 - DNA, 22 bp, Homo sapiens
actgggctgtaaagagaggcaa

SEQ ID NO: 8108671 - DNA, 22 bp, Homo sapiens
actgggcttatgctgtggagta

SEQ ID NO: 8108672 - DNA, 23 bp, Homo sapiens
actgggcttatgaggaggcttgt

SEQ ID NO: 8108673 - DNA, 22 bp, Homo sapiens
aatcagaaagaggtcatgttgc

SEQ ID NO: 8108674 - DNA, 22 bp, Homo sapiens
aatcagaaagatcttgatgaga

SEQ ID NO: 8108675 - DNA, 22 bp, Homo sapiens
aatcacatctcattcaacagcc

SEQ ID NO: 8108676 - DNA, 22 bp, Homo sapiens
aatcagaaattctacatcacaa

SEQ ID NO: 8108677 - DNA, 22 bp, Homo sapiens
aatcagaaattctacatcacaa

SEQ ID NO: 8108678 - DNA, 20 bp, Homo sapiens
aatcagaaagtgtgagctct

SEQ ID NO: 8108679 - DNA, 20 bp, Homo sapiens
aatcagaaagtgtgagctct

SEQ ID NO: 8108680 - DNA, 19 bp, Homo sapiens
aatcagaaatatcgaggcc

SEQ ID NO: 8108681 - DNA, 22 bp, Homo sapiens
aatcagaaaggctaaggaagca

SEQ ID NO: 8108682 - DNA, 22 bp, Homo sapiens
aatcagaaagatcttgatgaga

SEQ ID NO: 8108683 - DNA, 22 bp, Homo sapiens
actttatttcctattgcatcca

SEQ ID NO: 8108684 - DNA, 22 bp, Homo sapiens
actttcttaggctgtataaatg

SEQ ID NO: 8108685 - DNA, 22 bp, Homo sapiens
actttcttcttatgcattaagg

SEQ ID NO: 8108686 - DNA, 22 bp, Homo sapiens
actttcttcttatgcattaagg

SEQ ID NO: 8108687 - DNA, 22 bp, Homo sapiens
actttcttaggctgtataaatg

SEQ ID NO: 8108688 - DNA, 23 bp, Homo sapiens
actttattgaccccaggtcagtt

SEQ ID NO: 8108689 - DNA, 22 bp, Homo sapiens
actgttgaagtgccagcttgat

SEQ ID NO: 8108690 - DNA, 22 bp, Homo sapiens
actttaaaactgatcatcagag

SEQ ID NO: 8108691 - DNA, 22 bp, Homo sapiens
actgttctgcatgtacctgagg

SEQ ID NO: 8108692 - DNA, 22 bp, Homo sapiens
actgttcttcatttagcaaaga

SEQ ID NO: 8108693 - DNA, 19 bp, Homo sapiens
actgttctaacttgcagct

SEQ ID NO: 8108694 - DNA, 22 bp, Homo sapiens
actgttctgcatgtacctgagg

SEQ ID NO: 8108695 - DNA, 22 bp, Homo sapiens
actgttctgccaagatcaacgt

SEQ ID NO: 8108696 - DNA, 22 bp, Homo sapiens
acatttcatgttttccagagca

SEQ ID NO: 8108697 - DNA, 22 bp, Homo sapiens
acatttgtgcaacgtatccaca

SEQ ID NO: 8108698 - DNA, 22 bp, Homo sapiens
acatttctggagtttctcaaca

SEQ ID NO: 8108699 - DNA, 22 bp, Homo sapiens
acattgttgtttgcagcacagg

SEQ ID NO: 8108700 - DNA, 22 bp, Homo sapiens
acattgttgtgcaattatagtt

SEQ ID NO: 8108701 - DNA, 22 bp, Homo sapiens
aaggctctccaaatgatataat

SEQ ID NO: 8108702 - DNA, 23 bp, Homo sapiens
acattgttcaatgaaagttagga

SEQ ID NO: 8108703 - DNA, 22 bp, Homo sapiens
accctgccctctccagctcagg

SEQ ID NO: 8108704 - DNA, 22 bp, Homo sapiens
accctgccgtgggctgcttgtg

SEQ ID NO: 8108705 - DNA, 22 bp, Homo sapiens
accctgcctctgcttcctgtag

SEQ ID NO: 8108706 - DNA, 22 bp, Homo sapiens
accctgccaaggatggccccga

SEQ ID NO: 8108707 - DNA, 20 bp, Homo sapiens
accctgccaggcatgtgaat

SEQ ID NO: 8108708 - DNA, 22 bp, Homo sapiens
accatgttggccaagctggtct

SEQ ID NO: 8108709 - DNA, 22 bp, Homo sapiens
acatttgtttctctagagtagg

SEQ ID NO: 8108710 - DNA, 22 bp, Homo sapiens
acattttacagttgtctggcta

SEQ ID NO: 8108711 - DNA, 22 bp, Homo sapiens
acattttacaccaagacttctt

SEQ ID NO: 8108712 - DNA, 22 bp, Homo sapiens
aaggagagagctttgctggaac

SEQ ID NO: 8108713 - DNA, 22 bp, Homo sapiens
aaggagaatttggcttgtgatg

SEQ ID NO: 8108714 - DNA, 22 bp, Homo sapiens
aaggaggaataaagaggtggtg

SEQ ID NO: 8108715 - DNA, 22 bp, Homo sapiens
acatatgtctatttcatgtaaa

SEQ ID NO: 8108716 - DNA, 22 bp, Homo sapiens
aaggaggaatttcagggtgaat

SEQ ID NO: 8108717 - DNA, 22 bp, Homo sapiens
aaggaggacacccaggactggg

SEQ ID NO: 8108718 - DNA, 22 bp, Homo sapiens
aaggaggagcggaggcttgttg

SEQ ID NO: 8108719 - DNA, 22 bp, Homo sapiens
aaggaggcaccctgagcctgcc

SEQ ID NO: 8108720 - DNA, 22 bp, Homo sapiens
aagccaacatgattactataat

SEQ ID NO: 8108721 - DNA, 20 bp, Homo sapiens
aagctagcaaaagccacaaa

SEQ ID NO: 8108722 - DNA, 21 bp, Homo sapiens
aagctacagaaaataatttga

SEQ ID NO: 8108723 - DNA, 22 bp, Homo sapiens
acagcctggcctgagttaaggc

SEQ ID NO: 8108724 - DNA, 19 bp, Homo sapiens
aagctccagcagatccttt

SEQ ID NO: 8108725 - DNA, 22 bp, Homo sapiens
gtggacaggcaggctgtcgggg

SEQ ID NO: 8108726 - DNA, 22 bp, Homo sapiens
gtggagggtgattgccggctgt

SEQ ID NO: 8108727 - DNA, 22 bp, Homo sapiens
gtggagggtgagctcatgtttg

SEQ ID NO: 8108728 - DNA, 22 bp, Homo sapiens
gtggcagccgcaggccctgtgt

SEQ ID NO: 8108729 - DNA, 22 bp, Homo sapiens
gtggcagcggcccaggccgtct

SEQ ID NO: 8108730 - DNA, 22 bp, Homo sapiens
gtggcagaggctgtgaggatgc

SEQ ID NO: 8108731 - DNA, 22 bp, Homo sapiens
gtggcagagccgtgcaggtagg

SEQ ID NO: 8108732 - DNA, 22 bp, Homo sapiens
gtggcagagttgctgactagaa

SEQ ID NO: 8108733 - DNA, 22 bp, Homo sapiens
gtggcagaggttcctcagtgtg

SEQ ID NO: 8108734 - DNA, 22 bp, Homo sapiens
gtggcagagtgcggttctgacc

SEQ ID NO: 8108735 - DNA, 22 bp, Homo sapiens
gtggcagagccaggctttgaac

SEQ ID NO: 8108736 - DNA, 22 bp, Homo sapiens
gtggatggagctggaagccatt

SEQ ID NO: 8108737 - DNA, 22 bp, Homo sapiens
gtggaaggtgctagaacaagga

SEQ ID NO: 8108738 - DNA, 22 bp, Homo sapiens
gtggaagggactgcctagagga

SEQ ID NO: 8108739 - DNA, 22 bp, Homo sapiens
gtggaaggaattaacagactag

SEQ ID NO: 8108740 - DNA, 22 bp, Homo sapiens
gtggaaggaagagatggcccca

SEQ ID NO: 8108741 - DNA, 22 bp, Homo sapiens
gtggaaggtgaaggagcagcga

SEQ ID NO: 8108742 - DNA, 22 bp, Homo sapiens
gtggaaggtaatgcagcttact

SEQ ID NO: 8108743 - DNA, 22 bp, Homo sapiens
gtggaagggtcacagcccctac

SEQ ID NO: 8108744 - DNA, 22 bp, Homo sapiens
gtgcctggcacacagaaggcaa

SEQ ID NO: 8108745 - DNA, 20 bp, Homo sapiens
gtgcctggagaagaggctgt

SEQ ID NO: 8108746 - DNA, 22 bp, Homo sapiens
gtgcctggaactgggtaggctg

SEQ ID NO: 8108747 - DNA, 22 bp, Homo sapiens
gtgcctggaatgcgcctcggcg

SEQ ID NO: 8108748 - DNA, 22 bp, Homo sapiens
gtgacaatattagctcaggggc

SEQ ID NO: 8108749 - DNA, 22 bp, Homo sapiens
gtgacagccttcagtgtctctg

SEQ ID NO: 8108750 - DNA, 22 bp, Homo sapiens
gtgacagctccttggttagatg

SEQ ID NO: 8108751 - DNA, 22 bp, Homo sapiens
gtgacagcattgcagggcctct

SEQ ID NO: 8108752 - DNA, 22 bp, Homo sapiens
gtgacagcctcttgggaggttg

SEQ ID NO: 8108753 - DNA, 18 bp, Homo sapiens
gtgacagctgctagctca

SEQ ID NO: 8108754 - DNA, 22 bp, Homo sapiens
gtgacagcatgaggaatcaatg

SEQ ID NO: 8108755 - DNA, 22 bp, Homo sapiens
gtgggagcatggtcccagtgcc

SEQ ID NO: 8108756 - DNA, 22 bp, Homo sapiens
gtgggagctgcggaggcctggg

SEQ ID NO: 8108757 - DNA, 22 bp, Homo sapiens
gtgggagctgcggaggcctggg

SEQ ID NO: 8108758 - DNA, 22 bp, Homo sapiens
gtgggagctttggcatcaggct

SEQ ID NO: 8108759 - DNA, 22 bp, Homo sapiens
gtggctgcagcggctgtggaga

SEQ ID NO: 8108760 - DNA, 19 bp, Homo sapiens
gtggcctgcgctgggtgcg

SEQ ID NO: 8108761 - DNA, 22 bp, Homo sapiens
gtggcctggaaaggctggtctg

SEQ ID NO: 8108762 - DNA, 22 bp, Homo sapiens
gtggcctgatgccagccctgtg

SEQ ID NO: 8108763 - DNA, 22 bp, Homo sapiens
gtggcctgagcttcagagttgg

SEQ ID NO: 8108764 - DNA, 22 bp, Homo sapiens
gtggcctggggtttgttctgag

SEQ ID NO: 8108765 - DNA, 22 bp, Homo sapiens
gtggcctggctggcaccacctc

SEQ ID NO: 8108766 - DNA, 22 bp, Homo sapiens
gtggcctggctggcaccacctc

SEQ ID NO: 8108767 - DNA, 22 bp, Homo sapiens
gtggcctggcgagctggcgcgg

SEQ ID NO: 8108768 - DNA, 22 bp, Homo sapiens
gtggcaggagactggaagatgg

SEQ ID NO: 8108769 - DNA, 22 bp, Homo sapiens
gtggcagggctttgctgttctt

SEQ ID NO: 8108770 - DNA, 22 bp, Homo sapiens
gtggcagggcaatgctccctct

SEQ ID NO: 8108771 - DNA, 22 bp, Homo sapiens
gtggcaggatcacggctcactg

SEQ ID NO: 8108772 - DNA, 20 bp, Homo sapiens
gtggcagtggtggcagcagt

SEQ ID NO: 8108773 - DNA, 22 bp, Homo sapiens
gtggcagggtgctcatcatgca

SEQ ID NO: 8108774 - DNA, 22 bp, Homo sapiens
gtggcagttgctgtggcaataa

SEQ ID NO: 8108775 - DNA, 22 bp, Homo sapiens
gtggcaggggcgggctgttccg

SEQ ID NO: 8108776 - DNA, 22 bp, Homo sapiens
gtggcattaggccaggtgcata

SEQ ID NO: 8108777 - DNA, 22 bp, Homo sapiens
gtggcatttgaacaatcacata

SEQ ID NO: 8108778 - DNA, 22 bp, Homo sapiens
gtggcattctcggcaccatctg

SEQ ID NO: 8108779 - DNA, 22 bp, Homo sapiens
gtggccccagggccctgtctgg

SEQ ID NO: 8108780 - DNA, 22 bp, Homo sapiens
gtggcccaggcaccctgatgac

SEQ ID NO: 8108781 - DNA, 22 bp, Homo sapiens
gtggccagaatcttgaggcctt

SEQ ID NO: 8108782 - DNA, 22 bp, Homo sapiens
gtggccaccctcggcacacaca

SEQ ID NO: 8108783 - DNA, 22 bp, Homo sapiens
gtctctgcctggggggatcaga

SEQ ID NO: 8108784 - DNA, 19 bp, Homo sapiens
gtctctgctccagggtctc

SEQ ID NO: 8108785 - DNA, 22 bp, Homo sapiens
gtctgaattctgtgtaactcta

SEQ ID NO: 8108786 - DNA, 22 bp, Homo sapiens
gtccttcatggagttacagcct

SEQ ID NO: 8108787 - DNA, 22 bp, Homo sapiens
gtctgggctcccagggtcggcg

SEQ ID NO: 8108788 - DNA, 22 bp, Homo sapiens
gtctggcctgccagctctggtg

SEQ ID NO: 8108789 - DNA, 21 bp, Homo sapiens
gtcaggcccatagcagtgcct

SEQ ID NO: 8108790 - DNA, 22 bp, Homo sapiens
gtcaggagatagggcaagcttc

SEQ ID NO: 8108791 - DNA, 22 bp, Homo sapiens
gtatgtgtaagtatgccacctt

SEQ ID NO: 8108792 - DNA, 22 bp, Homo sapiens
gtcagctgggcatctgcagatg

SEQ ID NO: 8108793 - DNA, 22 bp, Homo sapiens
gtcagctgtctccccagagtgg

SEQ ID NO: 8108794 - DNA, 21 bp, Homo sapiens
gtcagctgtgtgtgaggaccc

SEQ ID NO: 8108795 - DNA, 22 bp, Homo sapiens
gtcccactgggcaactagaaaa

SEQ ID NO: 8108796 - DNA, 22 bp, Homo sapiens
gtccagtgtcttctacataaca

SEQ ID NO: 8108797 - DNA, 22 bp, Homo sapiens
gtccagggccccgagcaccagg

SEQ ID NO: 8108798 - DNA, 22 bp, Homo sapiens
gtccttaaccacttgtgtttat

SEQ ID NO: 8108799 - DNA, 22 bp, Homo sapiens
ggtggcagcgtctatctgacat

SEQ ID NO: 8108800 - DNA, 22 bp, Homo sapiens
ggtggcaggccctgagcatccc

SEQ ID NO: 8108801 - DNA, 22 bp, Homo sapiens
ggtggccataggaccagcctgg

SEQ ID NO: 8108802 - DNA, 22 bp, Homo sapiens
ggtgcaggagcggggtgctcgg

SEQ ID NO: 8108803 - DNA, 22 bp, Homo sapiens
ggtggcagcatggtcccagtgt

SEQ ID NO: 8108804 - DNA, 22 bp, Homo sapiens
ggtggcagaggtgcatcagccc

SEQ ID NO: 8108805 - DNA, 22 bp, Homo sapiens
ggtgcaaaagtaatcacagttt

SEQ ID NO: 8108806 - DNA, 22 bp, Homo sapiens
gggtggggtgtatcggatccta

SEQ ID NO: 8108807 - DNA, 22 bp, Homo sapiens
gtatacatgtggtaaaatgcac

SEQ ID NO: 8108808 - DNA, 22 bp, Homo sapiens
gtatacatgtggtaaaatgcac

SEQ ID NO: 8108809 - DNA, 20 bp, Homo sapiens
gtatataaccatagtgacta

SEQ ID NO: 8108810 - DNA, 22 bp, Homo sapiens
gtatataaggtaaagcgattgt

SEQ ID NO: 8108811 - DNA, 23 bp, Homo sapiens
gtaaaatacgcagtgcagtgtga

SEQ ID NO: 8108812 - DNA, 22 bp, Homo sapiens
gtaaacattttcatctgtgccc

SEQ ID NO: 8108813 - DNA, 22 bp, Homo sapiens
gtaaagtaaacccactttgtag

SEQ ID NO: 8108814 - DNA, 22 bp, Homo sapiens
gtaaagaagtttttgaatgcat

SEQ ID NO: 8108815 - DNA, 22 bp, Homo sapiens
gtacagctaagaatttcatctt

SEQ ID NO: 8108816 - DNA, 22 bp, Homo sapiens
gtacacaaataataaagttaca

SEQ ID NO: 8108817 - DNA, 22 bp, Homo sapiens
gtaaataactggtaattggggt

SEQ ID NO: 8108818 - DNA, 22 bp, Homo sapiens
gtaaataactggtaattggggt

SEQ ID NO: 8108819 - DNA, 22 bp, Homo sapiens
gtgtctctatctatgcctgaag

SEQ ID NO: 8108820 - DNA, 22 bp, Homo sapiens
gtgtcctcttattgctcttggc

SEQ ID NO: 8108821 - DNA, 22 bp, Homo sapiens
gtgtcctcttattgctcttggc

SEQ ID NO: 8108822 - DNA, 22 bp, Homo sapiens
gtgtcctgatcaattgagctgg

SEQ ID NO: 8108823 - DNA, 22 bp, Homo sapiens
gtgtcacatggtttactgcagc

SEQ ID NO: 8108824 - DNA, 22 bp, Homo sapiens
gtgtcagatgtccagggcagca

SEQ ID NO: 8108825 - DNA, 22 bp, Homo sapiens
gtgtcaggcagtcagcatggag

SEQ ID NO: 8108826 - DNA, 22 bp, Homo sapiens
gtgtgcagaacagggagtgggt

SEQ ID NO: 8108827 - DNA, 22 bp, Homo sapiens
gtgtgcagaggcaggaggtgct

SEQ ID NO: 8108828 - DNA, 22 bp, Homo sapiens
gtgtgcagatgtgatgctgggc

SEQ ID NO: 8108829 - DNA, 22 bp, Homo sapiens
gtgtgcagggctgcctgtgccg

SEQ ID NO: 8108830 - DNA, 22 bp, Homo sapiens
gtgtgcagggctgcctgtgccg

SEQ ID NO: 8108831 - DNA, 22 bp, Homo sapiens
gtgtggggtcttctcttggcct

SEQ ID NO: 8108832 - DNA, 22 bp, Homo sapiens
gttgtatagagggcatgaatct

SEQ ID NO: 8108833 - DNA, 22 bp, Homo sapiens
gttgtatatgtagagaatggtc

SEQ ID NO: 8108834 - DNA, 22 bp, Homo sapiens
gttgtcaggtaaaacagtatgg

SEQ ID NO: 8108835 - DNA, 22 bp, Homo sapiens
gttgttaatccaactcagcttg

SEQ ID NO: 8108836 - DNA, 22 bp, Homo sapiens
gttgtgcagtcagactgcctgg

SEQ ID NO: 8108837 - DNA, 22 bp, Homo sapiens
gttgtgcagggcgaggacctga

SEQ ID NO: 8108838 - DNA, 22 bp, Homo sapiens
gttgtgcagaagtgcctcagta

SEQ ID NO: 8108839 - DNA, 22 bp, Homo sapiens
gttgtgcaccactgttgattga

SEQ ID NO: 8108840 - DNA, 22 bp, Homo sapiens
gttctccactgcagagtctctc

SEQ ID NO: 8108841 - DNA, 22 bp, Homo sapiens
gttctcatatggcagagagagt

SEQ ID NO: 8108842 - DNA, 22 bp, Homo sapiens
gttctcatagtggaaaataggt

SEQ ID NO: 8108843 - DNA, 22 bp, Homo sapiens
gttattttaacttctcagtaat

SEQ ID NO: 8108844 - DNA, 21 bp, Homo sapiens
gttattttaagtgagctttgc

SEQ ID NO: 8108845 - DNA, 21 bp, Homo sapiens
gttattttaagtgagctttgc

SEQ ID NO: 8108846 - DNA, 22 bp, Homo sapiens
gttattttatctctgagaggtt

SEQ ID NO: 8108847 - DNA, 22 bp, Homo sapiens
gttattttcattggctcagact

SEQ ID NO: 8108848 - DNA, 21 bp, Homo sapiens
gttcaaatcctgacactacac

SEQ ID NO: 8108849 - DNA, 22 bp, Homo sapiens
gttcaaattgagatggtataaa

SEQ ID NO: 8108850 - DNA, 18 bp, Homo sapiens
gttcaagccaacatcaag

SEQ ID NO: 8108851 - DNA, 22 bp, Homo sapiens
gtgggcctgatgctgccatgag

SEQ ID NO: 8108852 - DNA, 22 bp, Homo sapiens
gtgggccttcaaccctgtctgg

SEQ ID NO: 8108853 - DNA, 22 bp, Homo sapiens
gtgggccttcaaccctgtctgg

SEQ ID NO: 8108854 - DNA, 22 bp, Homo sapiens
gtgggcctttcaggcgatctgg

SEQ ID NO: 8108855 - DNA, 22 bp, Homo sapiens
gtgggctcaggcctctgtgggg

SEQ ID NO: 8108856 - DNA, 22 bp, Homo sapiens
gtgggccttgcagggtgcaggg

SEQ ID NO: 8108857 - DNA, 22 bp, Homo sapiens
gtgggctcccctggcatgtcca

SEQ ID NO: 8108858 - DNA, 22 bp, Homo sapiens
gtgggctggaccctcctgctcc

SEQ ID NO: 8108859 - DNA, 22 bp, Homo sapiens
gtgggctttgctggatccttcc

SEQ ID NO: 8108860 - DNA, 22 bp, Homo sapiens
gtgggggcaggcagtgctagga

SEQ ID NO: 8108861 - DNA, 22 bp, Homo sapiens
gtggggcttcctggggcaagtt

SEQ ID NO: 8108862 - DNA, 22 bp, Homo sapiens
gtggggagcagccttagcccct

SEQ ID NO: 8108863 - DNA, 22 bp, Homo sapiens
gtgggcttttgacagtgcctgg

SEQ ID NO: 8108864 - DNA, 20 bp, Homo sapiens
gtgggcagcaggcatactgg

SEQ ID NO: 8108865 - DNA, 22 bp, Homo sapiens
gtgggcagcaccagggaagtgt

SEQ ID NO: 8108866 - DNA, 20 bp, Homo sapiens
gtgggcagatgtgtgcatgg

SEQ ID NO: 8108867 - DNA, 22 bp, Homo sapiens
gtgggcagattaatttctcaat

SEQ ID NO: 8108868 - DNA, 22 bp, Homo sapiens
gtgggcagccccttcaaggcca

SEQ ID NO: 8108869 - DNA, 22 bp, Homo sapiens
gtgggcaggaggccctgccctg

SEQ ID NO: 8108870 - DNA, 22 bp, Homo sapiens
gtgggccaggacccgctgtccg

SEQ ID NO: 8108871 - DNA, 22 bp, Homo sapiens
gtgggcagttggtgattctcgt

SEQ ID NO: 8108872 - DNA, 22 bp, Homo sapiens
gtggttcagtgtcatattaacg

SEQ ID NO: 8108873 - DNA, 22 bp, Homo sapiens
gtggttcacttgaggtcaggag

SEQ ID NO: 8108874 - DNA, 21 bp, Homo sapiens
gtggttctagagaaacagaat

SEQ ID NO: 8108875 - DNA, 22 bp, Homo sapiens
gtgggtgatgtactggaggcca

SEQ ID NO: 8108876 - DNA, 22 bp, Homo sapiens
gtggtcagagatgacagtgggt

SEQ ID NO: 8108877 - DNA, 22 bp, Homo sapiens
gtggtcagaatggagcccagga

SEQ ID NO: 8108878 - DNA, 22 bp, Homo sapiens
gtggtcagcagcagtgggagtg

SEQ ID NO: 8108879 - DNA, 22 bp, Homo sapiens
gtggtcaggggctgaggtgccc

SEQ ID NO: 8108880 - DNA, 22 bp, Homo sapiens
gtggggtgtccagcagcgagct

SEQ ID NO: 8108881 - DNA, 22 bp, Homo sapiens
gtggggtgggctgagttaggcc

SEQ ID NO: 8108882 - DNA, 22 bp, Homo sapiens
gtggggtagatctttctcagga

SEQ ID NO: 8108883 - DNA, 22 bp, Homo sapiens
gtgggggctggctcgtcctgtg

SEQ ID NO: 8108884 - DNA, 22 bp, Homo sapiens
gtggggggagctgcaagctgga

SEQ ID NO: 8108885 - DNA, 22 bp, Homo sapiens
taaagcaggtgctcagtgacca

SEQ ID NO: 8108886 - DNA, 22 bp, Homo sapiens
taaagcaggtgctcagtgacca

SEQ ID NO: 8108887 - DNA, 22 bp, Homo sapiens
taaaactagaccgtgagtctaa

SEQ ID NO: 8108888 - DNA, 22 bp, Homo sapiens
taaaaccataaggctggaagga

SEQ ID NO: 8108889 - DNA, 22 bp, Homo sapiens
taaaggaactgctgctatggaa

SEQ ID NO: 8108890 - DNA, 22 bp, Homo sapiens
taaaggaacagaggactcattt

SEQ ID NO: 8108891 - DNA, 22 bp, Homo sapiens
taaaggcacggagttgttatgg

SEQ ID NO: 8108892 - DNA, 22 bp, Homo sapiens
taaaggataactttcaagaatt

SEQ ID NO: 8108893 - DNA, 22 bp, Homo sapiens
taaaggcaaatgtgtgtttgtg

SEQ ID NO: 8108894 - DNA, 22 bp, Homo sapiens
taaaggaatcagttttagagat

SEQ ID NO: 8108895 - DNA, 18 bp, Homo sapiens
taaaggaagtgggagagg

SEQ ID NO: 8108896 - DNA, 19 bp, Homo sapiens
taaaggaagaggaagggaa

SEQ ID NO: 8108897 - DNA, 22 bp, Homo sapiens
taaaggaagaattctctgtgat

SEQ ID NO: 8108898 - DNA, 19 bp, Homo sapiens
taaaggaagaagggaggat

SEQ ID NO: 8108899 - DNA, 22 bp, Homo sapiens
taaatactttacaggatgtctc

SEQ ID NO: 8108900 - DNA, 22 bp, Homo sapiens
taaaggcatgcaggtgaatgta

SEQ ID NO: 8108901 - DNA, 22 bp, Homo sapiens
taaaggcagcctaggaagtgtt

SEQ ID NO: 8108902 - DNA, 22 bp, Homo sapiens
gtttttctttgtgtgaagacaa

SEQ ID NO: 8108903 - DNA, 22 bp, Homo sapiens
gttttttcatgagtagttatct

SEQ ID NO: 8108904 - DNA, 22 bp, Homo sapiens
gtttttctgtgagcggtaaagg

SEQ ID NO: 8108905 - DNA, 20 bp, Homo sapiens
gtttttcttgggcgagctat

SEQ ID NO: 8108906 - DNA, 22 bp, Homo sapiens
gtttttctctgaaatagttgac

SEQ ID NO: 8108907 - DNA, 22 bp, Homo sapiens
gtttttctagactgggagtttg

SEQ ID NO: 8108908 - DNA, 20 bp, Homo sapiens
gtttttctctcttgccacta

SEQ ID NO: 8108909 - DNA, 22 bp, Homo sapiens
gtttttctaggaccatgtgatt

SEQ ID NO: 8108910 - DNA, 22 bp, Homo sapiens
gtttaataatgttgaattacta

SEQ ID NO: 8108911 - DNA, 22 bp, Homo sapiens
gtttaagaaaattcatgttgtt

SEQ ID NO: 8108912 - DNA, 22 bp, Homo sapiens
gtttaagagggtttcattccca

SEQ ID NO: 8108913 - DNA, 22 bp, Homo sapiens
gtttttctaagtagcgatattt

SEQ ID NO: 8108914 - DNA, 22 bp, Homo sapiens
gtttttctagaaatctcctcct

SEQ ID NO: 8108915 - DNA, 22 bp, Homo sapiens
gtttaaagtagcttccttttgg

SEQ ID NO: 8108916 - DNA, 22 bp, Homo sapiens
gtttaaataattaggggcctgt

SEQ ID NO: 8108917 - DNA, 22 bp, Homo sapiens
taagaaatttagttatagaatg

SEQ ID NO: 8108918 - DNA, 22 bp, Homo sapiens
taacactaagaatctaaattta

SEQ ID NO: 8108919 - DNA, 22 bp, Homo sapiens
taaatgaagaaatggagattgt

SEQ ID NO: 8108920 - DNA, 22 bp, Homo sapiens
taaatacttttactccactgat

SEQ ID NO: 8108921 - DNA, 22 bp, Homo sapiens
taaatcactcctaataatcagt

SEQ ID NO: 8108922 - DNA, 22 bp, Homo sapiens
taaatcactcctaataatcagt

SEQ ID NO: 8108923 - DNA, 22 bp, Homo sapiens
ggagagggtaggggtcctgccc

SEQ ID NO: 8108924 - DNA, 22 bp, Homo sapiens
ggagagggggctccctgcttgg

SEQ ID NO: 8108925 - DNA, 22 bp, Homo sapiens
ggagcggcagatggagtgggag

SEQ ID NO: 8108926 - DNA, 22 bp, Homo sapiens
ggagcggagggagggccactgt

SEQ ID NO: 8108927 - DNA, 18 bp, Homo sapiens
ggaaggtgctggagtgca

SEQ ID NO: 8108928 - DNA, 22 bp, Homo sapiens
ggaagtggtagagccatgagtg

SEQ ID NO: 8108929 - DNA, 22 bp, Homo sapiens
ggaagtggtagagccatgagtg

SEQ ID NO: 8108930 - DNA, 21 bp, Homo sapiens
ggagaaggacaatgttgagta

SEQ ID NO: 8108931 - DNA, 22 bp, Homo sapiens
ggagctcagtggggggactgtg

SEQ ID NO: 8108932 - DNA, 22 bp, Homo sapiens
ggagctcaccttggagtctctg

SEQ ID NO: 8108933 - DNA, 22 bp, Homo sapiens
ggaggagcatgagagggtagtg

SEQ ID NO: 8108934 - DNA, 22 bp, Homo sapiens
ggaggagcccactcaaagggga

SEQ ID NO: 8108935 - DNA, 22 bp, Homo sapiens
ggaggaagtgcagttctactac

SEQ ID NO: 8108936 - DNA, 22 bp, Homo sapiens
ggaggaagcacacggcttgtat

SEQ ID NO: 8108937 - DNA, 22 bp, Homo sapiens
ggaggaagaggttgttctctca

SEQ ID NO: 8108938 - DNA, 22 bp, Homo sapiens
ggaggagctgctgtgggggccc

SEQ ID NO: 8108939 - DNA, 22 bp, Homo sapiens
ggaggaggcaagtaccagatgc

SEQ ID NO: 8108940 - DNA, 22 bp, Homo sapiens
ggaggcagaatagagtgtgggt

SEQ ID NO: 8108941 - DNA, 22 bp, Homo sapiens
ggaggcagaatagagtgtgggt

SEQ ID NO: 8108942 - DNA, 22 bp, Homo sapiens
ggaggccagggacccagtcagc

SEQ ID NO: 8108943 - DNA, 19 bp, Homo sapiens
ggaaggtgacagtggtgaa

SEQ ID NO: 8108944 - DNA, 22 bp, Homo sapiens
ggaaggggtgtcgcccatggat

SEQ ID NO: 8108945 - DNA, 22 bp, Homo sapiens
ggaagggagtagttggaatgca

SEQ ID NO: 8108946 - DNA, 22 bp, Homo sapiens
ggaaggggtgggtgagcctcag

SEQ ID NO: 8108947 - DNA, 22 bp, Homo sapiens
ggaacttgaaaatcaaggtggt

SEQ ID NO: 8108948 - DNA, 22 bp, Homo sapiens
gcttctggtgaggcctcaggaa

SEQ ID NO: 8108949 - DNA, 22 bp, Homo sapiens
gcttctggaggagctgggctga

SEQ ID NO: 8108950 - DNA, 22 bp, Homo sapiens
gcttctggagtcttcagaggaa

SEQ ID NO: 8108951 - DNA, 22 bp, Homo sapiens
ggaaaccaggactgcaccgtct

SEQ ID NO: 8108952 - DNA, 22 bp, Homo sapiens
ggaaagaatcaagtgatcctgt

SEQ ID NO: 8108953 - DNA, 22 bp, Homo sapiens
ggaaagaaagtgtgaacaactt

SEQ ID NO: 8108954 - DNA, 21 bp, Homo sapiens
ggaaagaaggcaaggctcagg

SEQ ID NO: 8108955 - DNA, 22 bp, Homo sapiens
ggaaagaaccctggatggctgg

SEQ ID NO: 8108956 - DNA, 22 bp, Homo sapiens
ggaaagagggacccagcttggt

SEQ ID NO: 8108957 - DNA, 22 bp, Homo sapiens
ggaactgaatgtctcggtataa

SEQ ID NO: 8108958 - DNA, 22 bp, Homo sapiens
gctgggccagactttcaatgtc

SEQ ID NO: 8108959 - DNA, 22 bp, Homo sapiens
gctgggctcatttgtgtgtctg

SEQ ID NO: 8108960 - DNA, 22 bp, Homo sapiens
gctgggctccaggccagggtga

SEQ ID NO: 8108961 - DNA, 21 bp, Homo sapiens
gctgggctccagtctgccgct

SEQ ID NO: 8108962 - DNA, 22 bp, Homo sapiens
gctgggctctgtcatgccttcc

SEQ ID NO: 8108963 - DNA, 22 bp, Homo sapiens
gctgggctcttatcacctgtac

SEQ ID NO: 8108964 - DNA, 22 bp, Homo sapiens
gctgggctctttacccctgtac

SEQ ID NO: 8108965 - DNA, 22 bp, Homo sapiens
gctgggctgagaagttaagcaa

SEQ ID NO: 8108966 - DNA, 22 bp, Homo sapiens
gctgggctgagctagacttggc

SEQ ID NO: 8108967 - DNA, 22 bp, Homo sapiens
gctgggctggaaggccaaggca

SEQ ID NO: 8108968 - DNA, 22 bp, Homo sapiens
gctgggctgcccaacctctgac

SEQ ID NO: 8108969 - DNA, 22 bp, Homo sapiens
gctgggctgcgtcggggaagcc

SEQ ID NO: 8108970 - DNA, 22 bp, Homo sapiens
gcttctgcagccaaagaagccg

SEQ ID NO: 8108971 - DNA, 17 bp, Homo sapiens
gcttcctgtgctgggga

SEQ ID NO: 8108972 - DNA, 22 bp, Homo sapiens
gcttcatgggtgtgcaacctgt

SEQ ID NO: 8108973 - DNA, 18 bp, Homo sapiens
gcttcatggaagggttgt

SEQ ID NO: 8108974 - DNA, 22 bp, Homo sapiens
gcttcatgccaggaggtttaag

SEQ ID NO: 8108975 - DNA, 22 bp, Homo sapiens
gcttcatgcttgctccaaagct

SEQ ID NO: 8108976 - DNA, 22 bp, Homo sapiens
gcttcatgaaaatcactggtca

SEQ ID NO: 8108977 - DNA, 21 bp, Homo sapiens
gcttcagcaaggcttgctggt

SEQ ID NO: 8108978 - DNA, 22 bp, Homo sapiens
ggcagagacaccgaatgactct

SEQ ID NO: 8108979 - DNA, 22 bp, Homo sapiens
ggagtggcactctgaggcgggg

SEQ ID NO: 8108980 - DNA, 22 bp, Homo sapiens
ggagtggcagcgaggatcagat

SEQ ID NO: 8108981 - DNA, 22 bp, Homo sapiens
ggagtgggcagcactgccctgt

SEQ ID NO: 8108982 - DNA, 22 bp, Homo sapiens
ggagtgggcagcactgccctgt

SEQ ID NO: 8108983 - DNA, 19 bp, Homo sapiens
ggagtgggtagttagtggt

SEQ ID NO: 8108984 - DNA, 22 bp, Homo sapiens
ggagtgggaacaatgacatggt

SEQ ID NO: 8108985 - DNA, 22 bp, Homo sapiens
ggagtgtgggatggagctcagg

SEQ ID NO: 8108986 - DNA, 22 bp, Homo sapiens
ggcaagggacggccgtgagaca

SEQ ID NO: 8108987 - DNA, 22 bp, Homo sapiens
ggcagaggaagctggaagtggg

SEQ ID NO: 8108988 - DNA, 22 bp, Homo sapiens
ggcagaggaagctggaagtggg

SEQ ID NO: 8108989 - DNA, 22 bp, Homo sapiens
ggcagctgtaagatgagtgaat

SEQ ID NO: 8108990 - DNA, 22 bp, Homo sapiens
ggcaggcctgagaggcagggct

SEQ ID NO: 8108991 - DNA, 20 bp, Homo sapiens
ggcaggtgctcgcttggtct

SEQ ID NO: 8108992 - DNA, 22 bp, Homo sapiens
ggagggtgcagaccctttgcaa

SEQ ID NO: 8108993 - DNA, 22 bp, Homo sapiens
ggaggggagatgtttgggctca

SEQ ID NO: 8108994 - DNA, 22 bp, Homo sapiens
ggaggggaactaatcccgtgac

SEQ ID NO: 8108995 - DNA, 22 bp, Homo sapiens
ggaggggaggattaatgacaaa

SEQ ID NO: 8108996 - DNA, 22 bp, Homo sapiens
ggaggggagtctcccaaagccg

SEQ ID NO: 8108997 - DNA, 22 bp, Homo sapiens
ggaggggaggtccagctgatct

SEQ ID NO: 8108998 - DNA, 22 bp, Homo sapiens
ggagggggaagaagctaaagac

SEQ ID NO: 8108999 - DNA, 22 bp, Homo sapiens
ggagggggaattcagccccagc

SEQ ID NO: 8109000 - DNA, 22 bp, Homo sapiens
ggaggtcaaatggagggctggg

SEQ ID NO: 8109001 - DNA, 22 bp, Homo sapiens
ggaggtgggagacataggcggc

SEQ ID NO: 8109002 - DNA, 22 bp, Homo sapiens
ggaggtggcagggaacataatt

SEQ ID NO: 8109003 - DNA, 22 bp, Homo sapiens
ggaggtggcagagggacattct

SEQ ID NO: 8109004 - DNA, 22 bp, Homo sapiens
ggaggtgggattaggacctaaa

SEQ ID NO: 8109005 - DNA, 22 bp, Homo sapiens
ggaggtgggctaaggactctct

SEQ ID NO: 8109006 - DNA, 16 bp, Homo sapiens
ggaggtgggtaaggtg

SEQ ID NO: 8109007 - DNA, 22 bp, Homo sapiens
ggaggtggtggcagtgacaatt

SEQ ID NO: 8109008 - DNA, 22 bp, Homo sapiens
ggagggctcgtcatccaccact

SEQ ID NO: 8109009 - DNA, 22 bp, Homo sapiens
ggagggctgagactggggtctg

SEQ ID NO: 8109010 - DNA, 22 bp, Homo sapiens
ggagggctcaattgactcctga

SEQ ID NO: 8109011 - DNA, 22 bp, Homo sapiens
ggagggctccctgggagtggat

SEQ ID NO: 8109012 - DNA, 22 bp, Homo sapiens
ggagggctgccacccgctcacg

SEQ ID NO: 8109013 - DNA, 22 bp, Homo sapiens
ggagggctgccaggtggagcgg

SEQ ID NO: 8109014 - DNA, 18 bp, Homo sapiens
ggagggctttggggactg

SEQ ID NO: 8109015 - DNA, 23 bp, Homo sapiens
ggagggcttcatcagacccccag

SEQ ID NO: 8109016 - DNA, 22 bp, Homo sapiens
ggagggacccactgcggtgacc

SEQ ID NO: 8109017 - DNA, 22 bp, Homo sapiens
ggagggacccactctagaggtg

SEQ ID NO: 8109018 - DNA, 21 bp, Homo sapiens
ggagggcagcccagactggct

SEQ ID NO: 8109019 - DNA, 22 bp, Homo sapiens
ggagggcagagtcccctgctga

SEQ ID NO: 8109020 - DNA, 20 bp, Homo sapiens
ggagggcagctgagagttgg

SEQ ID NO: 8109021 - DNA, 22 bp, Homo sapiens
ggagggccatcttgggtgtgat

SEQ ID NO: 8109022 - DNA, 22 bp, Homo sapiens
ggagggcccctccagtgggcag

SEQ ID NO: 8109023 - DNA, 22 bp, Homo sapiens
ggaggcggaggttgcagtgagt

SEQ ID NO: 8109024 - DNA, 22 bp, Homo sapiens
ggaggcggaggttgcagtgagc

SEQ ID NO: 8109025 - DNA, 22 bp, Homo sapiens
ggaggcctcctgggggaggttc

SEQ ID NO: 8109026 - DNA, 22 bp, Homo sapiens
ggaggcctcctgggggaggttc

SEQ ID NO: 8109027 - DNA, 22 bp, Homo sapiens
ggaggcctagccagctccagtt

SEQ ID NO: 8109028 - DNA, 22 bp, Homo sapiens
ggaggcccagagaggtgaagtg

SEQ ID NO: 8109029 - DNA, 22 bp, Homo sapiens
ggaggctgctgcctcacgtggg

SEQ ID NO: 8109030 - DNA, 22 bp, Homo sapiens
ggaggctgaggcccctcacagg

SEQ ID NO: 8109031 - DNA, 22 bp, Homo sapiens
ggaggctgaggcaggcggatca

SEQ ID NO: 8109032 - DNA, 22 bp, Homo sapiens
ggaggctgagaggtcgcagtgg

SEQ ID NO: 8109033 - DNA, 22 bp, Homo sapiens
ggccttggagtcctccactgga

SEQ ID NO: 8109034 - DNA, 20 bp, Homo sapiens
ggccttggaatagcacagct

SEQ ID NO: 8109035 - DNA, 22 bp, Homo sapiens
ggccttgagagccagtgcaggc

SEQ ID NO: 8109036 - DNA, 22 bp, Homo sapiens
ggccttgccaaggagcccttaa

SEQ ID NO: 8109037 - DNA, 19 bp, Homo sapiens
ggccttgatgagtggggag

SEQ ID NO: 8109038 - DNA, 22 bp, Homo sapiens
ggccttaggttccctgcctcca

SEQ ID NO: 8109039 - DNA, 22 bp, Homo sapiens
ggccttcacgtgacctggcgtg

SEQ ID NO: 8109040 - DNA, 22 bp, Homo sapiens
ggcctgggcccactgtcaagag

SEQ ID NO: 8109041 - DNA, 22 bp, Homo sapiens
ggcctgggcctttgtgttttga

SEQ ID NO: 8109042 - DNA, 22 bp, Homo sapiens
ggccctgcaaggtacccaggcc

SEQ ID NO: 8109043 - DNA, 22 bp, Homo sapiens
ggccctgcatgagattaaggtt

SEQ ID NO: 8109044 - DNA, 22 bp, Homo sapiens
ggccctgcaaggtacccaggcc

SEQ ID NO: 8109045 - DNA, 22 bp, Homo sapiens
ggccctgcgattaggtggcagg

SEQ ID NO: 8109046 - DNA, 22 bp, Homo sapiens
ggccctgcgattaggtggcagg

SEQ ID NO: 8109047 - DNA, 21 bp, Homo sapiens
ggctcctgctttgtgaggggc

SEQ ID NO: 8109048 - DNA, 22 bp, Homo sapiens
ggctcagcttggtgcgcagaaa

SEQ ID NO: 8109049 - DNA, 22 bp, Homo sapiens
ggctcaggactgcagcgtagag

SEQ ID NO: 8109050 - DNA, 22 bp, Homo sapiens
ggccttggcctagccctccagg

SEQ ID NO: 8109051 - DNA, 18 bp, Homo sapiens
ggctcagcaggctctctc

SEQ ID NO: 8109052 - DNA, 22 bp, Homo sapiens
ggctcagcgcgctgggagggag

SEQ ID NO: 8109053 - DNA, 22 bp, Homo sapiens
ggctcagcttatctgggcaggc

SEQ ID NO: 8109054 - DNA, 22 bp, Homo sapiens
ggcaggtgctgggagcatctca

SEQ ID NO: 8109055 - DNA, 22 bp, Homo sapiens
ggccacctgggttcgactgggc

SEQ ID NO: 8109056 - DNA, 22 bp, Homo sapiens
ggccagaggacctctcatagcc

SEQ ID NO: 8109057 - DNA, 22 bp, Homo sapiens
ggccagaggccatcctcctgct

SEQ ID NO: 8109058 - DNA, 22 bp, Homo sapiens
ggccatggtggtttgagcacct

SEQ ID NO: 8109059 - DNA, 22 bp, Homo sapiens
ggccccagcagaccctcctctg

SEQ ID NO: 8109060 - DNA, 22 bp, Homo sapiens
ggccccagattctgggctgggt

SEQ ID NO: 8109061 - DNA, 22 bp, Homo sapiens
ggctgcaagcatgcacagatac

SEQ ID NO: 8109062 - DNA, 22 bp, Homo sapiens
ggctgcagaagtacttccggat

SEQ ID NO: 8109063 - DNA, 22 bp, Homo sapiens
ggctgcagaggcgatctgaggt

SEQ ID NO: 8109064 - DNA, 22 bp, Homo sapiens
ggctgcagagctgggtgggcct

SEQ ID NO: 8109065 - DNA, 22 bp, Homo sapiens
ggctcctgggagaagttttatt

SEQ ID NO: 8109066 - DNA, 22 bp, Homo sapiens
ggctcctgggagatagaggtca

SEQ ID NO: 8109067 - DNA, 22 bp, Homo sapiens
ggctggcctgtgtggccgccac

SEQ ID NO: 8109068 - DNA, 22 bp, Homo sapiens
ggctgctgaacaagggaaccct

SEQ ID NO: 8109069 - DNA, 22 bp, Homo sapiens
ggctgctctccatcccaggcct

SEQ ID NO: 8109070 - DNA, 22 bp, Homo sapiens
ggctgctctgcacaggggctgg

SEQ ID NO: 8109071 - DNA, 22 bp, Homo sapiens
ggctgctcttcttggcgacctc

SEQ ID NO: 8109072 - DNA, 22 bp, Homo sapiens
ggctgcaggatgcccagccgtg

SEQ ID NO: 8109073 - DNA, 19 bp, Homo sapiens
ggcttcagtttagcaggct

SEQ ID NO: 8109074 - DNA, 22 bp, Homo sapiens
ggcttcctggggcctcctgcaa

SEQ ID NO: 8109075 - DNA, 22 bp, Homo sapiens
ggcttcctggggcctcctgcaa

SEQ ID NO: 8109076 - DNA, 22 bp, Homo sapiens
gggaaaggatcagtgggaggct

SEQ ID NO: 8109077 - DNA, 22 bp, Homo sapiens
gggcccagcactggctgggatc

SEQ ID NO: 8109078 - DNA, 22 bp, Homo sapiens
gggccagttctccgcctctttt

SEQ ID NO: 8109079 - DNA, 22 bp, Homo sapiens
gggcagaggttcaacttcaaca

SEQ ID NO: 8109080 - DNA, 22 bp, Homo sapiens
gggcagatcacctgaggtcagg

SEQ ID NO: 8109081 - DNA, 22 bp, Homo sapiens
gggccagtagcacctgtgtgga

SEQ ID NO: 8109082 - DNA, 22 bp, Homo sapiens
gggacgggcagtccaaggggtc

SEQ ID NO: 8109083 - DNA, 18 bp, Homo sapiens
gggaggccccagcaggag

SEQ ID NO: 8109084 - DNA, 22 bp, Homo sapiens
gggaggctcagtggtgtcctct

SEQ ID NO: 8109085 - DNA, 22 bp, Homo sapiens
gggaggctgccatccttcagga

SEQ ID NO: 8109086 - DNA, 22 bp, Homo sapiens
gggaggagggtgctggctaaac

SEQ ID NO: 8109087 - DNA, 22 bp, Homo sapiens
gggaggaggaatgttttgtgta

SEQ ID NO: 8109088 - DNA, 22 bp, Homo sapiens
gggcagaggggcgcttccctct

SEQ ID NO: 8109089 - DNA, 22 bp, Homo sapiens
gggatggggagctggaaagggg

SEQ ID NO: 8109090 - DNA, 22 bp, Homo sapiens
gggatggatcttggctgaggct

SEQ ID NO: 8109091 - DNA, 22 bp, Homo sapiens
gggaggctggctctggccacag

SEQ ID NO: 8109092 - DNA, 22 bp, Homo sapiens
gggaggcttgagccatactgcc

SEQ ID NO: 8109093 - DNA, 22 bp, Homo sapiens
gggagggaaagcttgatctgtc

SEQ ID NO: 8109094 - DNA, 22 bp, Homo sapiens
gggagggaaggaccttatgaat

SEQ ID NO: 8109095 - DNA, 22 bp, Homo sapiens
gggagggaaggaggcgccgtgt

SEQ ID NO: 8109096 - DNA, 22 bp, Homo sapiens
gggagggaaggtacctgtgtga

SEQ ID NO: 8109097 - DNA, 22 bp, Homo sapiens
gggatggactgacggtagcgcg

SEQ ID NO: 8109098 - DNA, 19 bp, Homo sapiens
gggtgaggaagagcgttgc

SEQ ID NO: 8109099 - DNA, 22 bp, Homo sapiens
gggtgagacagaaagagcaaaa

SEQ ID NO: 8109100 - DNA, 22 bp, Homo sapiens
gggtgagagtcaggcagagatt

SEQ ID NO: 8109101 - DNA, 22 bp, Homo sapiens
ggggacgggacttagcatgagt

SEQ ID NO: 8109102 - DNA, 22 bp, Homo sapiens
ggggacctaggctctgtctctt

SEQ ID NO: 8109103 - DNA, 22 bp, Homo sapiens
ggggggctgttctggacaggaa

SEQ ID NO: 8109104 - DNA, 20 bp, Homo sapiens
ggggggcttcagggcctgtg

SEQ ID NO: 8109105 - DNA, 22 bp, Homo sapiens
gggctggagcctggcggtggtt

SEQ ID NO: 8109106 - DNA, 22 bp, Homo sapiens
gggctggagcctggcggtggtt

SEQ ID NO: 8109107 - DNA, 22 bp, Homo sapiens
gggctggaccgctcgcctccct

SEQ ID NO: 8109108 - DNA, 22 bp, Homo sapiens
gggctggatctcctgcaggcag

SEQ ID NO: 8109109 - DNA, 22 bp, Homo sapiens
gggctggatgtttgatgacgaa

SEQ ID NO: 8109110 - DNA, 22 bp, Homo sapiens
ggggacagttaaagaccaagac

SEQ ID NO: 8109111 - DNA, 22 bp, Homo sapiens
ggggaagggagtccaagtgtta

SEQ ID NO: 8109112 - DNA, 16 bp, Homo sapiens
ggggaaggcaagaggg

SEQ ID NO: 8109113 - DNA, 22 bp, Homo sapiens
gggctaggcttggccagcactg

SEQ ID NO: 8109114 - DNA, 22 bp, Homo sapiens
gggctctggtacttcctggctc

SEQ ID NO: 8109115 - DNA, 22 bp, Homo sapiens
gggctctggtgccttcacagaa

SEQ ID NO: 8109116 - DNA, 22 bp, Homo sapiens
gggctgcttgctggagacagac

SEQ ID NO: 8109117 - DNA, 22 bp, Homo sapiens
gggctggaagacaggaaatgct

SEQ ID NO: 8109118 - DNA, 22 bp, Homo sapiens
gggctctgtgttctagctctcg

SEQ ID NO: 8109119 - DNA, 22 bp, Homo sapiens
gggctctgtggttgtgctttgt

SEQ ID NO: 8109120 - DNA, 22 bp, Homo sapiens
gggctgagacgatggggtcttc

SEQ ID NO: 8109121 - DNA, 22 bp, Homo sapiens
gagagtgtctggaggaagctaa

SEQ ID NO: 8109122 - DNA, 22 bp, Homo sapiens
gagatacagttggctgcaggct

SEQ ID NO: 8109123 - DNA, 22 bp, Homo sapiens
gagctgggaagatagcttgagc

SEQ ID NO: 8109124 - DNA, 22 bp, Homo sapiens
gagctggcagtggtagacatgg

SEQ ID NO: 8109125 - DNA, 22 bp, Homo sapiens
gagctggcaagtctgtccttgg

SEQ ID NO: 8109126 - DNA, 20 bp, Homo sapiens
gagatcctcatctgtaaagt

SEQ ID NO: 8109127 - DNA, 22 bp, Homo sapiens
gagctgggagctgggatttgga

SEQ ID NO: 8109128 - DNA, 22 bp, Homo sapiens
gagctgggaggactgggaactt

SEQ ID NO: 8109129 - DNA, 22 bp, Homo sapiens
gaggaagggctgcctgccgggc

SEQ ID NO: 8109130 - DNA, 22 bp, Homo sapiens
gaggaagagcatggccagtttc

SEQ ID NO: 8109131 - DNA, 23 bp, Homo sapiens
gagctgggatacaggcttactgc

SEQ ID NO: 8109132 - DNA, 22 bp, Homo sapiens
gaggacagagccgcctggcaag

SEQ ID NO: 8109133 - DNA, 21 bp, Homo sapiens
gaggaatggtttgcaaagcac

SEQ ID NO: 8109134 - DNA, 22 bp, Homo sapiens
gaggaatgtcagcacaggcctc

SEQ ID NO: 8109135 - DNA, 22 bp, Homo sapiens
gaggagggagctggaagctctt

SEQ ID NO: 8109136 - DNA, 22 bp, Homo sapiens
gaggaggctgaacaatgccctg

SEQ ID NO: 8109137 - DNA, 22 bp, Homo sapiens
gaggaggctgtttctctgcatt

SEQ ID NO: 8109138 - DNA, 22 bp, Homo sapiens
gaggaggcttccgggaggcacg

SEQ ID NO: 8109139 - DNA, 22 bp, Homo sapiens
gaggcagaggttgcagtgagct

SEQ ID NO: 8109140 - DNA, 22 bp, Homo sapiens
gaggaggtcgctgctgagcccc

SEQ ID NO: 8109141 - DNA, 22 bp, Homo sapiens
gaggcccagtggagggccatgg

SEQ ID NO: 8109142 - DNA, 22 bp, Homo sapiens
gaggcccagtcctgcaagcacg

SEQ ID NO: 8109143 - DNA, 22 bp, Homo sapiens
gaggccctccagctgtcagctg

SEQ ID NO: 8109144 - DNA, 21 bp, Homo sapiens
gaggcccatgggacaggggct

SEQ ID NO: 8109145 - DNA, 22 bp, Homo sapiens
gaggccctggtaggtcagagtg

SEQ ID NO: 8109146 - DNA, 22 bp, Homo sapiens
gaggcctataggcaagtgctgc

SEQ ID NO: 8109147 - DNA, 22 bp, Homo sapiens
gaggccctcttgccacaatgaa

SEQ ID NO: 8109148 - DNA, 22 bp, Homo sapiens
gaggtcaggcttgcagcagggt

SEQ ID NO: 8109149 - DNA, 22 bp, Homo sapiens
gaggtgggatgtgtgtgctact

SEQ ID NO: 8109150 - DNA, 22 bp, Homo sapiens
gaggtgggatgtgtgtgctact

SEQ ID NO: 8109151 - DNA, 22 bp, Homo sapiens
gaggtgggcggatcacaaggtc

SEQ ID NO: 8109152 - DNA, 22 bp, Homo sapiens
gaggggcgctgtcgggtcacct

SEQ ID NO: 8109153 - DNA, 22 bp, Homo sapiens
gaggggcgtcctgagtgggcct

SEQ ID NO: 8109154 - DNA, 22 bp, Homo sapiens
gaggggcctggcactgagctgg

SEQ ID NO: 8109155 - DNA, 22 bp, Homo sapiens
gaggggccggcatgtgcctctc

SEQ ID NO: 8109156 - DNA, 22 bp, Homo sapiens
gaggtcaaggtcaagagacaga

SEQ ID NO: 8109157 - DNA, 22 bp, Homo sapiens
gagtcattgcacactagctcag

SEQ ID NO: 8109158 - DNA, 22 bp, Homo sapiens
gagtcatttgggggcttcttga

SEQ ID NO: 8109159 - DNA, 22 bp, Homo sapiens
gaggtggggttttgttcttgaa

SEQ ID NO: 8109160 - DNA, 19 bp, Homo sapiens
gaggtgggtccccgcagcc

SEQ ID NO: 8109161 - DNA, 22 bp, Homo sapiens
gaggtgggtgtatcacaggtca

SEQ ID NO: 8109162 - DNA, 22 bp, Homo sapiens
gaggtgggtgtatcacaggtca

SEQ ID NO: 8109163 - DNA, 22 bp, Homo sapiens
gagtcacatactatgtaataga

SEQ ID NO: 8109164 - DNA, 22 bp, Homo sapiens
gaggtgtcccgcagtccccaag

SEQ ID NO: 8109165 - DNA, 22 bp, Homo sapiens
gaggggagtaaagtcatgttac

SEQ ID NO: 8109166 - DNA, 22 bp, Homo sapiens
gaggggatgcagagaggcttat

SEQ ID NO: 8109167 - DNA, 22 bp, Homo sapiens
gaggggattggaaggaacaccc

SEQ ID NO: 8109168 - DNA, 22 bp, Homo sapiens
gaggggcacagcagctgttgca

SEQ ID NO: 8109169 - DNA, 22 bp, Homo sapiens
gagggcagtgaattttgaagct

SEQ ID NO: 8109170 - DNA, 22 bp, Homo sapiens
gagggccaatggatttcaactg

SEQ ID NO: 8109171 - DNA, 22 bp, Homo sapiens
gagggcaggggtcttgcacggt

SEQ ID NO: 8109172 - DNA, 22 bp, Homo sapiens
gaggctggacgtgcatttctac

SEQ ID NO: 8109173 - DNA, 22 bp, Homo sapiens
gaggcctgctttggcactctgg

SEQ ID NO: 8109174 - DNA, 22 bp, Homo sapiens
gaggcctgcagcgtggtccctg

SEQ ID NO: 8109175 - DNA, 22 bp, Homo sapiens
gaggcctgaggctgcctggagc

SEQ ID NO: 8109176 - DNA, 22 bp, Homo sapiens
gaggctggcagaaaagcacagg

SEQ ID NO: 8109177 - DNA, 16 bp, Homo sapiens
gagggcagaggcggaa

SEQ ID NO: 8109178 - DNA, 22 bp, Homo sapiens
gagggatgcagaaacagaggcc

SEQ ID NO: 8109179 - DNA, 22 bp, Homo sapiens
gaggctgggaagtccaagacca

SEQ ID NO: 8109180 - DNA, 22 bp, Homo sapiens
gatcccctattcttttcctcag

SEQ ID NO: 8109181 - DNA, 22 bp, Homo sapiens
gatcttgagcaagttgtgtaac

SEQ ID NO: 8109182 - DNA, 22 bp, Homo sapiens
gatcctcttttcctaggaaggt

SEQ ID NO: 8109183 - DNA, 22 bp, Homo sapiens
gatctgtgtgattggatgcatt

SEQ ID NO: 8109184 - DNA, 22 bp, Homo sapiens
gatgattttctgtgttagaaga

SEQ ID NO: 8109185 - DNA, 22 bp, Homo sapiens
gatgattacacttttaaaacag

SEQ ID NO: 8109186 - DNA, 22 bp, Homo sapiens
gatgattttgttggtgattcaa

SEQ ID NO: 8109187 - DNA, 22 bp, Homo sapiens
gatgcacggtcatgtcttttca

SEQ ID NO: 8109188 - DNA, 22 bp, Homo sapiens
gatacattccatttctacttaa

SEQ ID NO: 8109189 - DNA, 22 bp, Homo sapiens
gatagagaaacacagataaatg

SEQ ID NO: 8109190 - DNA, 22 bp, Homo sapiens
gatataaattaatcaagtgcaa

SEQ ID NO: 8109191 - DNA, 19 bp, Homo sapiens
gatataaagagatggtgaa

SEQ ID NO: 8109192 - DNA, 22 bp, Homo sapiens
gatattttgagaaatcctatga

SEQ ID NO: 8109193 - DNA, 22 bp, Homo sapiens
gatcaccagttgtaggtatttt

SEQ ID NO: 8109194 - DNA, 22 bp, Homo sapiens
gatcaatactattaagatcata

SEQ ID NO: 8109195 - DNA, 18 bp, Homo sapiens
gagtgtggcactgggccc

SEQ ID NO: 8109196 - DNA, 22 bp, Homo sapiens
gagtgtgggggtgctgaggaca

SEQ ID NO: 8109197 - DNA, 22 bp, Homo sapiens
gagtgtggtatgctctgaggct

SEQ ID NO: 8109198 - DNA, 22 bp, Homo sapiens
gagttctgtgagccatcctagc

SEQ ID NO: 8109199 - DNA, 22 bp, Homo sapiens
gataaattatcaggggtttaaa

SEQ ID NO: 8109200 - DNA, 20 bp, Homo sapiens
gataaattgtctcttaagtg

SEQ ID NO: 8109201 - DNA, 22 bp, Homo sapiens
gataaattgcactttttcttac

SEQ ID NO: 8109202 - DNA, 22 bp, Homo sapiens
gataaaatatgtggcctttagt

SEQ ID NO: 8109203 - DNA, 22 bp, Homo sapiens
gataaaataactatggaatact

SEQ ID NO: 8109204 - DNA, 22 bp, Homo sapiens
gataaacacaaggtgatttcat

SEQ ID NO: 8109205 - DNA, 22 bp, Homo sapiens
gagttttaatgagctgctgtgg

SEQ ID NO: 8109206 - DNA, 22 bp, Homo sapiens
gagttcttctatatagtatgag

SEQ ID NO: 8109207 - DNA, 22 bp, Homo sapiens
gagtggggctttaaaggctcag

SEQ ID NO: 8109208 - DNA, 17 bp, Homo sapiens
gagtgctggtggagctc

SEQ ID NO: 8109209 - DNA, 18 bp, Homo sapiens
gagtctttgttactgctg

SEQ ID NO: 8109210 - DNA, 22 bp, Homo sapiens
gagtgagggccaacatccagct

SEQ ID NO: 8109211 - DNA, 22 bp, Homo sapiens
ctggctggagtgcaggtgagtg

SEQ ID NO: 8109212 - DNA, 22 bp, Homo sapiens
cttctcttcctttgtcaactga

SEQ ID NO: 8109213 - DNA, 22 bp, Homo sapiens
cttctcttgggtgtggtgtctt

SEQ ID NO: 8109214 - DNA, 22 bp, Homo sapiens
cttcttttgaagggcgttgtgt

SEQ ID NO: 8109215 - DNA, 22 bp, Homo sapiens
cttcttttgaagggcgttgtgt

SEQ ID NO: 8109216 - DNA, 22 bp, Homo sapiens
cttgaaatccagatttcagagg

SEQ ID NO: 8109217 - DNA, 22 bp, Homo sapiens
cttcttttcatggcttgggaag

SEQ ID NO: 8109218 - DNA, 22 bp, Homo sapiens
cttcttttacaggtcttgggtt

SEQ ID NO: 8109219 - DNA, 22 bp, Homo sapiens
cttctttcccaggcatgtttta

SEQ ID NO: 8109220 - DNA, 22 bp, Homo sapiens
cttgaattgggggaagatcact

SEQ ID NO: 8109221 - DNA, 22 bp, Homo sapiens
cttgaattgggggaagatcact

SEQ ID NO: 8109222 - DNA, 22 bp, Homo sapiens
cttggattccgtgaacttaacc

SEQ ID NO: 8109223 - DNA, 22 bp, Homo sapiens
cttggcagagggctgggctcag

SEQ ID NO: 8109224 - DNA, 22 bp, Homo sapiens
cttgggaggggagcattggcct

SEQ ID NO: 8109225 - DNA, 22 bp, Homo sapiens
cttgggccttgagaatgttctg

SEQ ID NO: 8109226 - DNA, 22 bp, Homo sapiens
ctttagaatttgatataatcaa

SEQ ID NO: 8109227 - DNA, 22 bp, Homo sapiens
ctttagatgtgcaaaggagaaa

SEQ ID NO: 8109228 - DNA, 22 bp, Homo sapiens
ctttagtgttgttgtgaggatt

SEQ ID NO: 8109229 - DNA, 22 bp, Homo sapiens
ctttgtaagtctttctccaaga

SEQ ID NO: 8109230 - DNA, 22 bp, Homo sapiens
ctttatgaaaaccagattgggg

SEQ ID NO: 8109231 - DNA, 22 bp, Homo sapiens
ctttatcatggaggtaaatatg

SEQ ID NO: 8109232 - DNA, 22 bp, Homo sapiens
ctttatcagaaaacacattagg

SEQ ID NO: 8109233 - DNA, 22 bp, Homo sapiens
ctttatgaaggaacaatgctcc

SEQ ID NO: 8109234 - DNA, 22 bp, Homo sapiens
gaaatacaaatgcctagatcct

SEQ ID NO: 8109235 - DNA, 22 bp, Homo sapiens
gaaatacaaatgcctagatcct

SEQ ID NO: 8109236 - DNA, 22 bp, Homo sapiens
gaaatacaaagccagccatttt

SEQ ID NO: 8109237 - DNA, 22 bp, Homo sapiens
gaaatacaaagccagccatttt

SEQ ID NO: 8109238 - DNA, 22 bp, Homo sapiens
gaaatttattatctacatcatt

SEQ ID NO: 8109239 - DNA, 22 bp, Homo sapiens
gaaatacaattttgtcccagct

SEQ ID NO: 8109240 - DNA, 22 bp, Homo sapiens
gaacacagtacttgttcgtctt

SEQ ID NO: 8109241 - DNA, 22 bp, Homo sapiens
gaacacaggtggcccggcaggg

SEQ ID NO: 8109242 - DNA, 22 bp, Homo sapiens
gaacacagtgtgatcgtatgtc

SEQ ID NO: 8109243 - DNA, 22 bp, Homo sapiens
gaacacatgattataaatgcta

SEQ ID NO: 8109244 - DNA, 22 bp, Homo sapiens
gaacacatgattataaatgcta

SEQ ID NO: 8109245 - DNA, 22 bp, Homo sapiens
gaactgaagacttttactgtac

SEQ ID NO: 8109246 - DNA, 22 bp, Homo sapiens
gaactcaacgctttcttaggag

SEQ ID NO: 8109247 - DNA, 22 bp, Homo sapiens
gaactccagatgactcaggaac

SEQ ID NO: 8109248 - DNA, 22 bp, Homo sapiens
gaacccagccagactccctaca

SEQ ID NO: 8109249 - DNA, 23 bp, Homo sapiens
gaacccagctctgccacttgcca

SEQ ID NO: 8109250 - DNA, 22 bp, Homo sapiens
gaaaagtacacagcccaaacat

SEQ ID NO: 8109251 - DNA, 22 bp, Homo sapiens
gaaaaggaaatttatagagatc

SEQ ID NO: 8109252 - DNA, 22 bp, Homo sapiens
cttttaatgggagcagtatttg

SEQ ID NO: 8109253 - DNA, 22 bp, Homo sapiens
ctttgtttatatttctcctcga

SEQ ID NO: 8109254 - DNA, 22 bp, Homo sapiens
gaaagggagtgaagatggtata

SEQ ID NO: 8109255 - DNA, 22 bp, Homo sapiens
gacacaggggggcgctagaaga

SEQ ID NO: 8109256 - DNA, 22 bp, Homo sapiens
gacacagggacgtgctctgcct

SEQ ID NO: 8109257 - DNA, 22 bp, Homo sapiens
gacagctgtgcaggagaagggg

SEQ ID NO: 8109258 - DNA, 20 bp, Homo sapiens
gacacaggcagtcctcagag

SEQ ID NO: 8109259 - DNA, 23 bp, Homo sapiens
gacacaggagcacccagctgagc

SEQ ID NO: 8109260 - DNA, 22 bp, Homo sapiens
gacacaggaaaagctccagccc

SEQ ID NO: 8109261 - DNA, 22 bp, Homo sapiens
gaagttcaggtgggaattgagc

SEQ ID NO: 8109262 - DNA, 22 bp, Homo sapiens
gaattacatagtttctaggttc

SEQ ID NO: 8109263 - DNA, 22 bp, Homo sapiens
gaagttcactggctacattcca

SEQ ID NO: 8109264 - DNA, 22 bp, Homo sapiens
gaagttcaaaagacagatttga

SEQ ID NO: 8109265 - DNA, 22 bp, Homo sapiens
gaagttagttggggcccaagaa

SEQ ID NO: 8109266 - DNA, 22 bp, Homo sapiens
gaagttagtacctggtatactt

SEQ ID NO: 8109267 - DNA, 22 bp, Homo sapiens
gaagttagtcattgaagcccca

SEQ ID NO: 8109268 - DNA, 22 bp, Homo sapiens
gaagttagtcttgaagttagtc

SEQ ID NO: 8109269 - DNA, 18 bp, Homo sapiens
gaagttagtggtgtgcta

SEQ ID NO: 8109270 - DNA, 22 bp, Homo sapiens
gaagttagtgtaatgcagggtg

SEQ ID NO: 8109271 - DNA, 22 bp, Homo sapiens
gaagttagtgtggatgcaggga

SEQ ID NO: 8109272 - DNA, 22 bp, Homo sapiens
gaattcaaatattaaacacgac

SEQ ID NO: 8109273 - DNA, 19 bp, Homo sapiens
gaattatttttatgggatg

SEQ ID NO: 8109274 - DNA, 23 bp, Homo sapiens
gaattcttaaggtcactaaagtc

SEQ ID NO: 8109275 - DNA, 22 bp, Homo sapiens
gaattcttctgtctttaactga

SEQ ID NO: 8109276 - DNA, 22 bp, Homo sapiens
gaattctttgatcttaatcttg

SEQ ID NO: 8109277 - DNA, 22 bp, Homo sapiens
gaattctaccagggcaagaggg

SEQ ID NO: 8109278 - DNA, 22 bp, Homo sapiens
gaattctaaccattaagccaag

SEQ ID NO: 8109279 - DNA, 22 bp, Homo sapiens
gaaggcctctccccttctccag

SEQ ID NO: 8109280 - DNA, 22 bp, Homo sapiens
gaaggaagccgtttctctccag

SEQ ID NO: 8109281 - DNA, 22 bp, Homo sapiens
gaaggaagctgtctggatgtgt

SEQ ID NO: 8109282 - DNA, 22 bp, Homo sapiens
gaaggaaggaaaaatatattta

SEQ ID NO: 8109283 - DNA, 22 bp, Homo sapiens
gaaggaagggctggctgtcttg

SEQ ID NO: 8109284 - DNA, 22 bp, Homo sapiens
gaaggaagtgctcatactagtt

SEQ ID NO: 8109285 - DNA, 22 bp, Homo sapiens
gaaggaagtttattttagaaga

SEQ ID NO: 8109286 - DNA, 20 bp, Homo sapiens
gaaggaagggggcaaggtga

SEQ ID NO: 8109287 - DNA, 22 bp, Homo sapiens
gaaggaagtcattagtgcagac

SEQ ID NO: 8109288 - DNA, 22 bp, Homo sapiens
gaaggctgcgaggggagtgccg

SEQ ID NO: 8109289 - DNA, 22 bp, Homo sapiens
gaaggctgcatggaggctgtgg

SEQ ID NO: 8109290 - DNA, 22 bp, Homo sapiens
gaaggctgcgaggggagtgccg

SEQ ID NO: 8109291 - DNA, 22 bp, Homo sapiens
gaaggctgagtgggtacggagg

SEQ ID NO: 8109292 - DNA, 19 bp, Homo sapiens
gaaggctgaaatgaagcac

SEQ ID NO: 8109293 - DNA, 22 bp, Homo sapiens
gaagttagatgtggtcactgac

SEQ ID NO: 8109294 - DNA, 22 bp, Homo sapiens
gaagttaggctttcctatgctt

SEQ ID NO: 8109295 - DNA, 22 bp, Homo sapiens
gaagttagagaaggcagccagg

SEQ ID NO: 8109296 - DNA, 22 bp, Homo sapiens
gaagtgggctttgtggtcagct

SEQ ID NO: 8109297 - DNA, 22 bp, Homo sapiens
gagagctgatagatgagctact

SEQ ID NO: 8109298 - DNA, 22 bp, Homo sapiens
gagagctgatagatgagctact

SEQ ID NO: 8109299 - DNA, 22 bp, Homo sapiens
gagagctgaggggcctggcact

SEQ ID NO: 8109300 - DNA, 22 bp, Homo sapiens
gagagctgcaaggtagggcggg

SEQ ID NO: 8109301 - DNA, 22 bp, Homo sapiens
gagagctgcagccgagaggggg

SEQ ID NO: 8109302 - DNA, 22 bp, Homo sapiens
gagagctgcattctcagacaca

SEQ ID NO: 8109303 - DNA, 18 bp, Homo sapiens
gagagctgctacctagct

SEQ ID NO: 8109304 - DNA, 22 bp, Homo sapiens
gagagctaactacctggaaatg

SEQ ID NO: 8109305 - DNA, 22 bp, Homo sapiens
gagagctatttggcaagcattt

SEQ ID NO: 8109306 - DNA, 20 bp, Homo sapiens
gagagctggggatgaggctg

SEQ ID NO: 8109307 - DNA, 22 bp, Homo sapiens
gagagctgggggactgtggatg

SEQ ID NO: 8109308 - DNA, 22 bp, Homo sapiens
gagagctgggaaagccgtggag

SEQ ID NO: 8109309 - DNA, 22 bp, Homo sapiens
gagagctgggctttgggtgaag

SEQ ID NO: 8109310 - DNA, 22 bp, Homo sapiens
gactttattatagtggcaatag

SEQ ID NO: 8109311 - DNA, 22 bp, Homo sapiens
gactttgtgccaaacgccagaa

SEQ ID NO: 8109312 - DNA, 21 bp, Homo sapiens
gacaggcaaggagtcacttag

SEQ ID NO: 8109313 - DNA, 22 bp, Homo sapiens
gaccagtcattactcatgccct

SEQ ID NO: 8109314 - DNA, 22 bp, Homo sapiens
gacttattcacgcagctatact

SEQ ID NO: 8109315 - DNA, 22 bp, Homo sapiens
gatggcctgggtccccttccgg

SEQ ID NO: 8109316 - DNA, 22 bp, Homo sapiens
gatggaggagatggcagggtgc

SEQ ID NO: 8109317 - DNA, 22 bp, Homo sapiens
gatgggctgtctgagcgctgtg

SEQ ID NO: 8109318 - DNA, 22 bp, Homo sapiens
gatgcattcgggatgtttactt

SEQ ID NO: 8109319 - DNA, 22 bp, Homo sapiens
gatgcccaggcccaaccatgga

SEQ ID NO: 8109320 - DNA, 22 bp, Homo sapiens
gatgctttggccccatcatgag

SEQ ID NO: 8109321 - DNA, 22 bp, Homo sapiens
gatgctgctcgggtgcctggga

SEQ ID NO: 8109322 - DNA, 22 bp, Homo sapiens
gatgctgggaccacagagtgtt

SEQ ID NO: 8109323 - DNA, 22 bp, Homo sapiens
gatgtacttgccttatctatcc

SEQ ID NO: 8109324 - DNA, 22 bp, Homo sapiens
gatgtcatcaggctaagacact

SEQ ID NO: 8109325 - DNA, 22 bp, Homo sapiens
gatggggatgagaagtgagcag

SEQ ID NO: 8109326 - DNA, 22 bp, Homo sapiens
gattcacagaacttagtcaagc

SEQ ID NO: 8109327 - DNA, 22 bp, Homo sapiens
gattcactcatattttacgttt

SEQ ID NO: 8109328 - DNA, 22 bp, Homo sapiens
gattcaaagacagactcatttc

SEQ ID NO: 8109329 - DNA, 22 bp, Homo sapiens
gattattttgtgcaataatcgg

SEQ ID NO: 8109330 - DNA, 22 bp, Homo sapiens
gattagtatccttattaagaga

SEQ ID NO: 8109331 - DNA, 22 bp, Homo sapiens
gattagtaagagtttacctatt

SEQ ID NO: 8109332 - DNA, 22 bp, Homo sapiens
gattaatagacacaaccaagct

SEQ ID NO: 8109333 - DNA, 22 bp, Homo sapiens
gattaagtggaatgagtatttg

SEQ ID NO: 8109334 - DNA, 22 bp, Homo sapiens
gattaagtaactgaacactttg

SEQ ID NO: 8109335 - DNA, 22 bp, Homo sapiens
gattgtgtctcactgtgatgct

SEQ ID NO: 8109336 - DNA, 22 bp, Homo sapiens
gattgtgttcataggcatgtta

SEQ ID NO: 8109337 - DNA, 22 bp, Homo sapiens
gatttatttttaatcagcaggg

SEQ ID NO: 8109338 - DNA, 22 bp, Homo sapiens
gatttcaaaagtagatccatca

SEQ ID NO: 8109339 - DNA, 22 bp, Homo sapiens
gcagaaagcttagagggtttgc

SEQ ID NO: 8109340 - DNA, 22 bp, Homo sapiens
gcagaaagctccttgcgatctg

SEQ ID NO: 8109341 - DNA, 21 bp, Homo sapiens
gcagaaaggaatcttaggtcc

SEQ ID NO: 8109342 - DNA, 22 bp, Homo sapiens
gcacttgtcaaatattatagta

SEQ ID NO: 8109343 - DNA, 22 bp, Homo sapiens
gcaatataaccagttgtcatgc

SEQ ID NO: 8109344 - DNA, 22 bp, Homo sapiens
gcaaaaaatgcttgttgcttag

SEQ ID NO: 8109345 - DNA, 22 bp, Homo sapiens
gattttgaatattaaagaagag

SEQ ID NO: 8109346 - DNA, 22 bp, Homo sapiens
gatttcttctctcccaagagga

SEQ ID NO: 8109347 - DNA, 22 bp, Homo sapiens
gatttcttgacccctgtctcag

SEQ ID NO: 8109348 - DNA, 22 bp, Homo sapiens
gatttcttcatttgtggtgaat

SEQ ID NO: 8109349 - DNA, 22 bp, Homo sapiens
gatttcaagcccccagagattc

SEQ ID NO: 8109350 - DNA, 22 bp, Homo sapiens
gatttcttggcccactctcaga

SEQ ID NO: 8109351 - DNA, 22 bp, Homo sapiens
gatttctttagctcatcagatc

SEQ ID NO: 8109352 - DNA, 22 bp, Homo sapiens
gatttctttaggtgtaatagtg

SEQ ID NO: 8109353 - DNA, 22 bp, Homo sapiens
gatttctttatgaagtacagaa

SEQ ID NO: 8109354 - DNA, 22 bp, Homo sapiens
gatttctttgtacccacaatcc

SEQ ID NO: 8109355 - DNA, 22 bp, Homo sapiens
gatttctttgaattagagaggt

SEQ ID NO: 8109356 - DNA, 22 bp, Homo sapiens
gatttctttgcaagctgtgttc

SEQ ID NO: 8109357 - DNA, 19 bp, Homo sapiens
gccagcagaatgatgaggc

SEQ ID NO: 8109358 - DNA, 19 bp, Homo sapiens
gccagcacatgtcttctag

SEQ ID NO: 8109359 - DNA, 22 bp, Homo sapiens
gccacagctccagtcaggtgac

SEQ ID NO: 8109360 - DNA, 22 bp, Homo sapiens
gcatgtggtgctgaggctgtcg

SEQ ID NO: 8109361 - DNA, 22 bp, Homo sapiens
gcatgggcaccagtctctaggt

SEQ ID NO: 8109362 - DNA, 22 bp, Homo sapiens
gcatgggcaagaggactggggg

SEQ ID NO: 8109363 - DNA, 22 bp, Homo sapiens
gccacagacagagagtctagtg

SEQ ID NO: 8109364 - DNA, 19 bp, Homo sapiens
gcagggtggcagagctctt

SEQ ID NO: 8109365 - DNA, 19 bp, Homo sapiens
gcagggtggcagagctctt

SEQ ID NO: 8109366 - DNA, 22 bp, Homo sapiens
gcaggtggaagcagcagactca

SEQ ID NO: 8109367 - DNA, 22 bp, Homo sapiens
gcagggtgatagtgaggctcag

SEQ ID NO: 8109368 - DNA, 22 bp, Homo sapiens
gcagggtgatagtgaggctcag

SEQ ID NO: 8109369 - DNA, 22 bp, Homo sapiens
gcaggtggagcagtagtctggt

SEQ ID NO: 8109370 - DNA, 22 bp, Homo sapiens
gcaggtgggagccgctgcctga

SEQ ID NO: 8109371 - DNA, 22 bp, Homo sapiens
gcaggtggcagaggtgggatct

SEQ ID NO: 8109372 - DNA, 22 bp, Homo sapiens
gcaggtgggggtcggtgcatct

SEQ ID NO: 8109373 - DNA, 22 bp, Homo sapiens
gcaggtgggagccgctgcctga

SEQ ID NO: 8109374 - DNA, 22 bp, Homo sapiens
gcaggtggtgggggagccgttc

SEQ ID NO: 8109375 - DNA, 22 bp, Homo sapiens
gcaggtggtgggggagccgttc

SEQ ID NO: 8109376 - DNA, 22 bp, Homo sapiens
gcaggtggtccccgtggagtgg

SEQ ID NO: 8109377 - DNA, 22 bp, Homo sapiens
gcaggtggtccccgtggagtgg

SEQ ID NO: 8109378 - DNA, 22 bp, Homo sapiens
gcagtgggcaacaagagctgga

SEQ ID NO: 8109379 - DNA, 22 bp, Homo sapiens
gcagtaggagaagaggatgctt

SEQ ID NO: 8109380 - DNA, 22 bp, Homo sapiens
gcagtgggcctgaggaagggtg

SEQ ID NO: 8109381 - DNA, 22 bp, Homo sapiens
gcagtggggaatgctggggaga

SEQ ID NO: 8109382 - DNA, 22 bp, Homo sapiens
gcaggagaacaaagcaagctgc

SEQ ID NO: 8109383 - DNA, 22 bp, Homo sapiens
gcagctattgtctcctgggccc

SEQ ID NO: 8109384 - DNA, 22 bp, Homo sapiens
gcagctattgtctcctgggccc

SEQ ID NO: 8109385 - DNA, 16 bp, Homo sapiens
gcagagctcagggact

SEQ ID NO: 8109386 - DNA, 22 bp, Homo sapiens
gcagagctcaaggtgttcagct

SEQ ID NO: 8109387 - DNA, 22 bp, Homo sapiens
gcagagctatcttctggatttg

SEQ ID NO: 8109388 - DNA, 22 bp, Homo sapiens
gcagagctcatgcctgcacctc

SEQ ID NO: 8109389 - DNA, 22 bp, Homo sapiens
gcagagctccccaagacaccaa

SEQ ID NO: 8109390 - DNA, 22 bp, Homo sapiens
gcaggcagaggtggaggagaca

SEQ ID NO: 8109391 - DNA, 22 bp, Homo sapiens
gcagggcaaatgtggaaaggag

SEQ ID NO: 8109392 - DNA, 22 bp, Homo sapiens
gcaggggcaggagatctcaggc

SEQ ID NO: 8109393 - DNA, 21 bp, Homo sapiens
gcaggggatagaaatggtctg

SEQ ID NO: 8109394 - DNA, 22 bp, Homo sapiens
gctggcctctacaggccggcca

SEQ ID NO: 8109395 - DNA, 22 bp, Homo sapiens
gctggccagtgtcccagggatc

SEQ ID NO: 8109396 - DNA, 22 bp, Homo sapiens
gctgggagtttgatttgactgg

SEQ ID NO: 8109397 - DNA, 22 bp, Homo sapiens
gctgggagttactgtctccttt

SEQ ID NO: 8109398 - DNA, 22 bp, Homo sapiens
gctgggcaaggctgaagctacc

SEQ ID NO: 8109399 - DNA, 22 bp, Homo sapiens
gctgggcaccggagagacccca

SEQ ID NO: 8109400 - DNA, 22 bp, Homo sapiens
gctgggcaatgccagagaggag

SEQ ID NO: 8109401 - DNA, 22 bp, Homo sapiens
gctgagccacccttgcttccct

SEQ ID NO: 8109402 - DNA, 22 bp, Homo sapiens
gctgagccctcatccctagttt

SEQ ID NO: 8109403 - DNA, 20 bp, Homo sapiens
gctgaggattcctggcccct

SEQ ID NO: 8109404 - DNA, 22 bp, Homo sapiens
gctgcctggagaggcagggatg

SEQ ID NO: 8109405 - DNA, 22 bp, Homo sapiens
gctgcctgatgtccagcaggac

SEQ ID NO: 8109406 - DNA, 21 bp, Homo sapiens
gctgctcgagatccagtgctt

SEQ ID NO: 8109407 - DNA, 22 bp, Homo sapiens
gctgctgcaagagccagctctt

SEQ ID NO: 8109408 - DNA, 20 bp, Homo sapiens
gctgctgagcttccctgggg

SEQ ID NO: 8109409 - DNA, 22 bp, Homo sapiens
gctgctgcatgaacagcggtca

SEQ ID NO: 8109410 - DNA, 22 bp, Homo sapiens
gctgctgcctgtagccagggtg

SEQ ID NO: 8109411 - DNA, 22 bp, Homo sapiens
gctgctgctgaggatgcacctg

SEQ ID NO: 8109412 - DNA, 22 bp, Homo sapiens
gctcttccatttctcttgaact

SEQ ID NO: 8109413 - DNA, 22 bp, Homo sapiens
gctgagagtgtgagatcagatt

SEQ ID NO: 8109414 - DNA, 22 bp, Homo sapiens
gctgagagtgggtgcagtgctt

SEQ ID NO: 8109415 - DNA, 22 bp, Homo sapiens
gctgagcacacctagggtagag

SEQ ID NO: 8109416 - DNA, 22 bp, Homo sapiens
gctcttggaagacaggatgtgt

SEQ ID NO: 8109417 - DNA, 22 bp, Homo sapiens
gctctgaggctgggagcactct

SEQ ID NO: 8109418 - DNA, 22 bp, Homo sapiens
gctcagactctggcctgatgat

SEQ ID NO: 8109419 - DNA, 22 bp, Homo sapiens
gctccagctcgtggctcccagc

SEQ ID NO: 8109420 - DNA, 22 bp, Homo sapiens
gctcatttctgtttcttgcaac

SEQ ID NO: 8109421 - DNA, 22 bp, Homo sapiens
gctcctggcaggcagtgtgtgt

SEQ ID NO: 8109422 - DNA, 22 bp, Homo sapiens
gctcctggctctctgagggctg

SEQ ID NO: 8109423 - DNA, 22 bp, Homo sapiens
gcctgggattgtgtaagtgaat

SEQ ID NO: 8109424 - DNA, 22 bp, Homo sapiens
gcctgtgctttcttccctcctg

SEQ ID NO: 8109425 - DNA, 21 bp, Homo sapiens
gcctgtggagcccaagggccc

SEQ ID NO: 8109426 - DNA, 20 bp, Homo sapiens
gcctgtggaggaggacggac

SEQ ID NO: 8109427 - DNA, 22 bp, Homo sapiens
gcctgtgtggatgcgccggtgc

SEQ ID NO: 8109428 - DNA, 22 bp, Homo sapiens
gcctgtgtgtttagctctgggg

SEQ ID NO: 8109429 - DNA, 22 bp, Homo sapiens
gcctgtgtgtgaggactggctg

SEQ ID NO: 8109430 - DNA, 22 bp, Homo sapiens
gcctgtgtggatgggcccctgg

SEQ ID NO: 8109431 - DNA, 22 bp, Homo sapiens
gcctgtggggctgaggctgcct

SEQ ID NO: 8109432 - DNA, 22 bp, Homo sapiens
gcctgtgtccttcccagtgggg

SEQ ID NO: 8109433 - DNA, 22 bp, Homo sapiens
gcctgtgtctgggtggccagag

SEQ ID NO: 8109434 - DNA, 22 bp, Homo sapiens
gcctgggatagaggcaatgcat

SEQ ID NO: 8109435 - DNA, 22 bp, Homo sapiens
gcctgggagaatgacctccaac

SEQ ID NO: 8109436 - DNA, 18 bp, Homo sapiens
gcctgggagaagtttcac

SEQ ID NO: 8109437 - DNA, 21 bp, Homo sapiens
gcctgggatagtggcctccgg

SEQ ID NO: 8109438 - DNA, 22 bp, Homo sapiens
gcctgggattcccagaggggca

SEQ ID NO: 8109439 - DNA, 22 bp, Homo sapiens
gcctgggattctcaaaggggtg

SEQ ID NO: 8109440 - DNA, 19 bp, Homo sapiens
gcctgggatgggcagaact

SEQ ID NO: 8109441 - DNA, 20 bp, Homo sapiens
gcctgggattatccactggt

SEQ ID NO: 8109442 - DNA, 23 bp, Homo sapiens
gcctgggactcaggaggagctca

SEQ ID NO: 8109443 - DNA, 22 bp, Homo sapiens
gcctgggactggatgtgtttgt

SEQ ID NO: 8109444 - DNA, 23 bp, Homo sapiens
gcctgggactggtagtgtgacct

SEQ ID NO: 8109445 - DNA, 22 bp, Homo sapiens
gcctgggactgcagatccccag

SEQ ID NO: 8109446 - DNA, 22 bp, Homo sapiens
gcctgggaagactaagtgggag

SEQ ID NO: 8109447 - DNA, 22 bp, Homo sapiens
gcctgggaactctgatctcctg

SEQ ID NO: 8109448 - DNA, 21 bp, Homo sapiens
gcctgggaagagaaaggtaag

SEQ ID NO: 8109449 - DNA, 22 bp, Homo sapiens
gcctgggacccttagctcttgg

SEQ ID NO: 8109450 - DNA, 22 bp, Homo sapiens
gcctgggaaatggtggggtcag

SEQ ID NO: 8109451 - DNA, 22 bp, Homo sapiens
gcctgggaaagagtagggaaat

SEQ ID NO: 8109452 - DNA, 21 bp, Homo sapiens
gcctgggaaatctgggaagcc

SEQ ID NO: 8109453 - DNA, 17 bp, Homo sapiens
gcctggcccagcctggc

SEQ ID NO: 8109454 - DNA, 22 bp, Homo sapiens
gcctggcaggggcctgggagtg

SEQ ID NO: 8109455 - DNA, 22 bp, Homo sapiens
gcctggcagttgacagtttgct

SEQ ID NO: 8109456 - DNA, 22 bp, Homo sapiens
gcctggcagtgtaattcctgtc

SEQ ID NO: 8109457 - DNA, 22 bp, Homo sapiens
gcctggcattggagccggggca

SEQ ID NO: 8109458 - DNA, 22 bp, Homo sapiens
gcctggaggggacagtctctgg

SEQ ID NO: 8109459 - DNA, 22 bp, Homo sapiens
gcctggaggggccagggtggta

SEQ ID NO: 8109460 - DNA, 23 bp, Homo sapiens
gcctgctgtcacagcgggcccag

SEQ ID NO: 8109461 - DNA, 23 bp, Homo sapiens
gcctgctggtcacctaatctgcc

SEQ ID NO: 8109462 - DNA, 23 bp, Homo sapiens
gcctgctgtcacagcgggcccag

SEQ ID NO: 8109463 - DNA, 21 bp, Homo sapiens
gcctgctgttcaccctgccac

SEQ ID NO: 8109464 - DNA, 22 bp, Homo sapiens
gcctgctgttaactgcaggaat

SEQ ID NO: 8109465 - DNA, 22 bp, Homo sapiens
gcctgctgtcctgattcccatg

SEQ ID NO: 8109466 - DNA, 22 bp, Homo sapiens
gcctgctgttaactgcaggaat

SEQ ID NO: 8109467 - DNA, 22 bp, Homo sapiens
gcctgctgttgagggaagagct

SEQ ID NO: 8109468 - DNA, 21 bp, Homo sapiens
gcctgctgttcaccctgccac

SEQ ID NO: 8109469 - DNA, 22 bp, Homo sapiens
gcctgctgttgagggaagagct

SEQ ID NO: 8109470 - DNA, 22 bp, Homo sapiens
gcctgctttaagtctgttgcct

SEQ ID NO: 8109471 - DNA, 22 bp, Homo sapiens
gcctgcctgttggctgaggtgc

SEQ ID NO: 8109472 - DNA, 22 bp, Homo sapiens
gcctgcctgctgtgtgcaagtt

SEQ ID NO: 8109473 - DNA, 22 bp, Homo sapiens
gcctgcctgctgtcatctgcct

SEQ ID NO: 8109474 - DNA, 20 bp, Homo sapiens
gcctgcctcagctagctgag

SEQ ID NO: 8109475 - DNA, 22 bp, Homo sapiens
gcctgccacgcatgcagagtca

SEQ ID NO: 8109476 - DNA, 22 bp, Homo sapiens
gcctgccaaaagaagctgctgg

SEQ ID NO: 8109477 - DNA, 22 bp, Homo sapiens
gcctgccagccacagtggcagc

SEQ ID NO: 8109478 - DNA, 18 bp, Homo sapiens
gcctgccagccgagggac

SEQ ID NO: 8109479 - DNA, 21 bp, Homo sapiens
gccgctgctgcgtgtcccttt

SEQ ID NO: 8109480 - DNA, 22 bp, Homo sapiens
gcctcctgttatgccatgtgcc

SEQ ID NO: 8109481 - DNA, 22 bp, Homo sapiens
gccgggttcaagccattctcct

SEQ ID NO: 8109482 - DNA, 22 bp, Homo sapiens
gcctctgcaccagtactgtgcc

SEQ ID NO: 8109483 - DNA, 22 bp, Homo sapiens
gcctctgcccatccaccatcag

SEQ ID NO: 8109484 - DNA, 22 bp, Homo sapiens
gcctctgcatcatcactccagc

SEQ ID NO: 8109485 - DNA, 22 bp, Homo sapiens
gcctctgcatgctcagcaccca

SEQ ID NO: 8109486 - DNA, 22 bp, Homo sapiens
gcctctgcatcttcgccgcact

SEQ ID NO: 8109487 - DNA, 22 bp, Homo sapiens
gcctctgcggggcccgagcccg

SEQ ID NO: 8109488 - DNA, 21 bp, Homo sapiens
gccctcaggggaggatggcct

SEQ ID NO: 8109489 - DNA, 22 bp, Homo sapiens
gccctcgcttcttcctaggggt

SEQ ID NO: 8109490 - DNA, 22 bp, Homo sapiens
gccctcctttgcttctcctagt

SEQ ID NO: 8109491 - DNA, 22 bp, Homo sapiens
gcccttggaacagcctcctgct

SEQ ID NO: 8109492 - DNA, 22 bp, Homo sapiens
gcccttgggaggttccactggg

SEQ ID NO: 8109493 - DNA, 17 bp, Homo sapiens
gccagttgtcttggcat

SEQ ID NO: 8109494 - DNA, 21 bp, Homo sapiens
gccatttcacacagacatttg

SEQ ID NO: 8109495 - DNA, 22 bp, Homo sapiens
gccattaatgagatcaagaatc

SEQ ID NO: 8109496 - DNA, 22 bp, Homo sapiens
gccattaatgtgaaggaaggaa

SEQ ID NO: 8109497 - DNA, 22 bp, Homo sapiens
gccattaaagtgcatgttttgc

SEQ ID NO: 8109498 - DNA, 22 bp, Homo sapiens
gccattaacaagaatatagtag

SEQ ID NO: 8109499 - DNA, 22 bp, Homo sapiens
gccatgggtctgctggctcagc

SEQ ID NO: 8109500 - DNA, 22 bp, Homo sapiens
gccatggggagggcagcgcctg

SEQ ID NO: 8109501 - DNA, 19 bp, Homo sapiens
gccatgggctggcagcaga

SEQ ID NO: 8109502 - DNA, 22 bp, Homo sapiens
ctcctgggagcagggatggatg

SEQ ID NO: 8109503 - DNA, 22 bp, Homo sapiens
ctcctgggagctgtggcagagc

SEQ ID NO: 8109504 - DNA, 22 bp, Homo sapiens
ctcctgggctatgtctgcttgg

SEQ ID NO: 8109505 - DNA, 22 bp, Homo sapiens
ctcctgggctcaagtgatcctc

SEQ ID NO: 8109506 - DNA, 19 bp, Homo sapiens
ctctcactcgccacatcct

SEQ ID NO: 8109507 - DNA, 22 bp, Homo sapiens
ctcctgacacagtccacacttg

SEQ ID NO: 8109508 - DNA, 22 bp, Homo sapiens
ctcctgacttgtgagcccctcc

SEQ ID NO: 8109509 - DNA, 22 bp, Homo sapiens
ctcctctggcttcctggaggca

SEQ ID NO: 8109510 - DNA, 22 bp, Homo sapiens
ctcctctggaaattcctctgcc

SEQ ID NO: 8109511 - DNA, 22 bp, Homo sapiens
tttagaatgtgactgtatttga

SEQ ID NO: 8109512 - DNA, 22 bp, Homo sapiens
tttacatggaatattgtcttgt

SEQ ID NO: 8109513 - DNA, 22 bp, Homo sapiens
tttaaaaggcagcttcttttgt

SEQ ID NO: 8109514 - DNA, 22 bp, Homo sapiens
tttaaatttagaagaaacactg

SEQ ID NO: 8109515 - DNA, 22 bp, Homo sapiens
tttaacactcagtttaatagcc

SEQ ID NO: 8109516 - DNA, 22 bp, Homo sapiens
tttaacactagtttctttaact

SEQ ID NO: 8109517 - DNA, 22 bp, Homo sapiens
tttaacacctgtagcaggataa

SEQ ID NO: 8109518 - DNA, 22 bp, Homo sapiens
tttaacacccaggtagttctga

SEQ ID NO: 8109519 - DNA, 22 bp, Homo sapiens
ttggcatttattctaaggtcaa

SEQ ID NO: 8109520 - DNA, 22 bp, Homo sapiens
ttgatacatagcacagtttagg

SEQ ID NO: 8109521 - DNA, 22 bp, Homo sapiens
ttgatattcccgatttaaggta

SEQ ID NO: 8109522 - DNA, 22 bp, Homo sapiens
ttgatacccaagtgttatgggt

SEQ ID NO: 8109523 - DNA, 22 bp, Homo sapiens
ctcagtttttttaagagccatg

SEQ ID NO: 8109524 - DNA, 22 bp, Homo sapiens
ctcatccatgtcgtaacatatg

SEQ ID NO: 8109525 - DNA, 22 bp, Homo sapiens
ctcatccagtcaagcttttaga

SEQ ID NO: 8109526 - DNA, 22 bp, Homo sapiens
ttgggaggtcataaatctgttc

SEQ ID NO: 8109527 - DNA, 22 bp, Homo sapiens
ttgtatttgattgtcatatcgt

SEQ ID NO: 8109528 - DNA, 22 bp, Homo sapiens
tttaaaaaactagtctgagtct

SEQ ID NO: 8109529 - DNA, 22 bp, Homo sapiens
ttgttaaaactccattggtttg

SEQ ID NO: 8109530 - DNA, 22 bp, Homo sapiens
ttgttaaaactccattggtttg

SEQ ID NO: 8109531 - DNA, 22 bp, Homo sapiens
ttgttacagcacttaacctttt

SEQ ID NO: 8109532 - DNA, 22 bp, Homo sapiens
ttgttacacataataacatttt

SEQ ID NO: 8109533 - DNA, 22 bp, Homo sapiens
ttgttacagcagcaatagaaaa

SEQ ID NO: 8109534 - DNA, 22 bp, Homo sapiens
ttgttaaaggcaaaacaagcac

SEQ ID NO: 8109535 - DNA, 22 bp, Homo sapiens
ctagggaatgagagactggatc

SEQ ID NO: 8109536 - DNA, 22 bp, Homo sapiens
ctagggaaataaactgagtggt

SEQ ID NO: 8109537 - DNA, 20 bp, Homo sapiens
ctagcctggccttgctctgg

SEQ ID NO: 8109538 - DNA, 22 bp, Homo sapiens
ctagccatgggcattaaaggta

SEQ ID NO: 8109539 - DNA, 22 bp, Homo sapiens
ctattttaacttgattacctct

SEQ ID NO: 8109540 - DNA, 22 bp, Homo sapiens
ttctgtatttagtttgaggaca

SEQ ID NO: 8109541 - DNA, 22 bp, Homo sapiens
ttctgtatgtacatatgtgtat

SEQ ID NO: 8109542 - DNA, 22 bp, Homo sapiens
ttctgtatttcaatgtctttat

SEQ ID NO: 8109543 - DNA, 22 bp, Homo sapiens
ttctgtatgccaatgggttttt

SEQ ID NO: 8109544 - DNA, 22 bp, Homo sapiens
ttctgtatctctgtgtttcttg

SEQ ID NO: 8109545 - DNA, 22 bp, Homo sapiens
ctatttctaaacctataagtga

SEQ ID NO: 8109546 - DNA, 22 bp, Homo sapiens
ctatttctaaacctataagtga

SEQ ID NO: 8109547 - DNA, 22 bp, Homo sapiens
ctatttcaaggcccagatatga

SEQ ID NO: 8109548 - DNA, 22 bp, Homo sapiens
ctatttctgcctaatgacctgt

SEQ ID NO: 8109549 - DNA, 22 bp, Homo sapiens
ctattcaacttgactgtttcac

SEQ ID NO: 8109550 - DNA, 22 bp, Homo sapiens
ctattcaattttgctattgtag

SEQ ID NO: 8109551 - DNA, 22 bp, Homo sapiens
ctattttaagaggccattaggt

SEQ ID NO: 8109552 - DNA, 22 bp, Homo sapiens
ctattttaagaggccattaggt

SEQ ID NO: 8109553 - DNA, 22 bp, Homo sapiens
ttcttgtatataaaaatcattt

SEQ ID NO: 8109554 - DNA, 22 bp, Homo sapiens
ttcttgttctggttctgttagc

SEQ ID NO: 8109555 - DNA, 22 bp, Homo sapiens
ttcttgttctggttctgttagc

SEQ ID NO: 8109556 - DNA, 22 bp, Homo sapiens
ttcttgtatgtatgcaaaatca

SEQ ID NO: 8109557 - DNA, 22 bp, Homo sapiens
ctcagaggggatgcttggagaa

SEQ ID NO: 8109558 - DNA, 22 bp, Homo sapiens
ctcagcagtaaacgtccggaac

SEQ ID NO: 8109559 - DNA, 22 bp, Homo sapiens
ctcagcagaggcagtattcagt

SEQ ID NO: 8109560 - DNA, 20 bp, Homo sapiens
ctcagcagattcttctagaa

SEQ ID NO: 8109561 - DNA, 23 bp, Homo sapiens
ctcagcagcctgctgcagataag

SEQ ID NO: 8109562 - DNA, 22 bp, Homo sapiens
ttgagcttgctggccttcagct

SEQ ID NO: 8109563 - DNA, 22 bp, Homo sapiens
ttgataaaatgatgaaatcact

SEQ ID NO: 8109564 - DNA, 22 bp, Homo sapiens
ttgatacacaatggaacaatgt

SEQ ID NO: 8109565 - DNA, 18 bp, Homo sapiens
ttgataaacaatttcatt

SEQ ID NO: 8109566 - DNA, 22 bp, Homo sapiens
ttgataaaatgatgaaatcact

SEQ ID NO: 8109567 - DNA, 22 bp, Homo sapiens
ttgagctcccgcttcttctttg

SEQ ID NO: 8109568 - DNA, 22 bp, Homo sapiens
ttgagctctgatgcttttcaga

SEQ ID NO: 8109569 - DNA, 22 bp, Homo sapiens
ttgagctctcctcatcaccctg

SEQ ID NO: 8109570 - DNA, 22 bp, Homo sapiens
ttgagctttgatgcatggcagg

SEQ ID NO: 8109571 - DNA, 22 bp, Homo sapiens
ttcacataatcctccagtggca

SEQ ID NO: 8109572 - DNA, 22 bp, Homo sapiens
ttcacataaatagatcacatca

SEQ ID NO: 8109573 - DNA, 22 bp, Homo sapiens
ttcacataaatagatcacatca

SEQ ID NO: 8109574 - DNA, 22 bp, Homo sapiens
ttcacagtggtaagggttgtga

SEQ ID NO: 8109575 - DNA, 22 bp, Homo sapiens
cggcatgggcgtccccctcact

SEQ ID NO: 8109576 - DNA, 22 bp, Homo sapiens
cgctgggcgccgacctgctggc

SEQ ID NO: 8109577 - DNA, 22 bp, Homo sapiens
cgctgggcgccgacctgctggc

SEQ ID NO: 8109578 - DNA, 22 bp, Homo sapiens
ttcattcttatttgtgatctgg

SEQ ID NO: 8109579 - DNA, 22 bp, Homo sapiens
ttcagaaaggctgtgccagcca

SEQ ID NO: 8109580 - DNA, 23 bp, Homo sapiens
ttcatgagttggacaagactggg

SEQ ID NO: 8109581 - DNA, 21 bp, Homo sapiens
ttcatgatacagttttagagt

SEQ ID NO: 8109582 - DNA, 22 bp, Homo sapiens
ttcattcccttatattagcatt

SEQ ID NO: 8109583 - DNA, 22 bp, Homo sapiens
ttcattcccaagagtaaacata

SEQ ID NO: 8109584 - DNA, 22 bp, Homo sapiens
ttcattccttccctaagcaact

SEQ ID NO: 8109585 - DNA, 22 bp, Homo sapiens
ttcattcctgagcccatattta

SEQ ID NO: 8109586 - DNA, 22 bp, Homo sapiens
ttcagaaaaagaccattgcaat

SEQ ID NO: 8109587 - DNA, 22 bp, Homo sapiens
ttcagaaacagagtgagtgagt

SEQ ID NO: 8109588 - DNA, 22 bp, Homo sapiens
ttcccaagtctccaatgtggga

SEQ ID NO: 8109589 - DNA, 22 bp, Homo sapiens
ttccaaagaagttcacatttac

SEQ ID NO: 8109590 - DNA, 22 bp, Homo sapiens
ttccaaagtcatgttgctgata

SEQ ID NO: 8109591 - DNA, 19 bp, Homo sapiens
ctaaggcaagaaactggac

SEQ ID NO: 8109592 - DNA, 22 bp, Homo sapiens
ttccgagggctcggcggccgcc

SEQ ID NO: 8109593 - DNA, 22 bp, Homo sapiens
ttcccttaaattatggcatcta

SEQ ID NO: 8109594 - DNA, 22 bp, Homo sapiens
ctacaaatataaaacacagata

SEQ ID NO: 8109595 - DNA, 22 bp, Homo sapiens
ctacaaagaaagtatactggac

SEQ ID NO: 8109596 - DNA, 22 bp, Homo sapiens
ctacaaagaatttctctagctc

SEQ ID NO: 8109597 - DNA, 22 bp, Homo sapiens
ctacaaaagtaattgtggtttt

SEQ ID NO: 8109598 - DNA, 22 bp, Homo sapiens
ctacaaagtaccacagactggg

SEQ ID NO: 8109599 - DNA, 22 bp, Homo sapiens
ctacaaagctcttctacaggca

SEQ ID NO: 8109600 - DNA, 22 bp, Homo sapiens
ctacaaaagtaattgtggtttt

SEQ ID NO: 8109601 - DNA, 22 bp, Homo sapiens
ctaagtcatggaaagtgtgtgt

SEQ ID NO: 8109602 - DNA, 22 bp, Homo sapiens
ctctgggctccttcagcccttt

SEQ ID NO: 8109603 - DNA, 23 bp, Homo sapiens
ttttattgatatgtagctgttgt

SEQ ID NO: 8109604 - DNA, 22 bp, Homo sapiens
ctctgggccaccgctggtgtat

SEQ ID NO: 8109605 - DNA, 22 bp, Homo sapiens
tttgtcttggcctcagttttct

SEQ ID NO: 8109606 - DNA, 22 bp, Homo sapiens
tttgtcttggcctcagttttct

SEQ ID NO: 8109607 - DNA, 22 bp, Homo sapiens
tttgtcttgaggctggggaagt

SEQ ID NO: 8109608 - DNA, 22 bp, Homo sapiens
ctctcctggggagcacacacac

SEQ ID NO: 8109609 - DNA, 22 bp, Homo sapiens
tttgtcttgtgtccttaggacc

SEQ ID NO: 8109610 - DNA, 22 bp, Homo sapiens
tttgtctttcccctcctcattg

SEQ ID NO: 8109611 - DNA, 22 bp, Homo sapiens
tttgtcttgtaagttaaattca

SEQ ID NO: 8109612 - DNA, 22 bp, Homo sapiens
ctctttttcagccttaccaaag

SEQ ID NO: 8109613 - DNA, 22 bp, Homo sapiens
ctctttttcacctctgtcagcg

SEQ ID NO: 8109614 - DNA, 22 bp, Homo sapiens
ctcttttcaaacctgtttatgg

SEQ ID NO: 8109615 - DNA, 22 bp, Homo sapiens
ctcttttcaaaatttcactgca

SEQ ID NO: 8109616 - DNA, 20 bp, Homo sapiens
ctcttttcactctcagtggt

SEQ ID NO: 8109617 - DNA, 22 bp, Homo sapiens
tttttaagagtctggaaatagt

SEQ ID NO: 8109618 - DNA, 22 bp, Homo sapiens
tttttaagctcctttgatgtca

SEQ ID NO: 8109619 - DNA, 22 bp, Homo sapiens
tttttaagctcctttgatgtca

SEQ ID NO: 8109620 - DNA, 23 bp, Homo sapiens
ttttattgatatgtagctgttgt

SEQ ID NO: 8109621 - DNA, 21 bp, Homo sapiens
ttttattgatgaatggccact

SEQ ID NO: 8109622 - DNA, 22 bp, Homo sapiens
ctgaactcatgatatgcttttg

SEQ ID NO: 8109623 - DNA, 22 bp, Homo sapiens
tttttaatgcagtctgagacat

SEQ ID NO: 8109624 - DNA, 19 bp, Homo sapiens
tttttaatgggctggagca

SEQ ID NO: 8109625 - DNA, 22 bp, Homo sapiens
ctgaaaggaataaggctctttg

SEQ ID NO: 8109626 - DNA, 20 bp, Homo sapiens
ctgaaaggagtcgggatgtc

SEQ ID NO: 8109627 - DNA, 22 bp, Homo sapiens
ctgaaaggagagctgcaaggat

SEQ ID NO: 8109628 - DNA, 22 bp, Homo sapiens
ctgagaataaagccagcaggag

SEQ ID NO: 8109629 - DNA, 22 bp, Homo sapiens
ctgcctgcgttgcctcgtgcct

SEQ ID NO: 8109630 - DNA, 22 bp, Homo sapiens
ctgcctctataggagtccacca

SEQ ID NO: 8109631 - DNA, 22 bp, Homo sapiens
ctgcctagcgccatctgcctct

SEQ ID NO: 8109632 - DNA, 22 bp, Homo sapiens
ctgccatcgggggccccactgc

SEQ ID NO: 8109633 - DNA, 22 bp, Homo sapiens
ctgccatccacggcccactcat

SEQ ID NO: 8109634 - DNA, 22 bp, Homo sapiens
ctgccctggggggcctccttgc

SEQ ID NO: 8109635 - DNA, 22 bp, Homo sapiens
ctgccatgcagttagtccctca

SEQ ID NO: 8109636 - DNA, 22 bp, Homo sapiens
ctgccatgctcaagaagtcttt

SEQ ID NO: 8109637 - DNA, 22 bp, Homo sapiens
ctgccctgggtgctggggatcc

SEQ ID NO: 8109638 - DNA, 22 bp, Homo sapiens
ctgccctggggggcctccttgc

SEQ ID NO: 8109639 - DNA, 22 bp, Homo sapiens
ctgccgagtgggtcatgaggca

SEQ ID NO: 8109640 - DNA, 22 bp, Homo sapiens
ctgcctagaaaaccaggctcct

SEQ ID NO: 8109641 - DNA, 22 bp, Homo sapiens
ctgccctgggttttatgggagt

SEQ ID NO: 8109642 - DNA, 22 bp, Homo sapiens
ctgccgtccatctacgtctcag

SEQ ID NO: 8109643 - DNA, 22 bp, Homo sapiens
ctgcagattcagtgagaagccc

SEQ ID NO: 8109644 - DNA, 21 bp, Homo sapiens
ctgcagcaaaactttgctcct

SEQ ID NO: 8109645 - DNA, 22 bp, Homo sapiens
ctgcagcaaatgttaagtgact

SEQ ID NO: 8109646 - DNA, 22 bp, Homo sapiens
ctgcagcaagagaagtgctgac

SEQ ID NO: 8109647 - DNA, 22 bp, Homo sapiens
ctgcagcagcctccagccttgg

SEQ ID NO: 8109648 - DNA, 22 bp, Homo sapiens
ctgcagcagaataatctgctca

SEQ ID NO: 8109649 - DNA, 22 bp, Homo sapiens
ctgcagcaggaggctcctgcag

SEQ ID NO: 8109650 - DNA, 22 bp, Homo sapiens
ctgcagcagtactcagcagcca

SEQ ID NO: 8109651 - DNA, 22 bp, Homo sapiens
ctgcagcagggcttgcccacct

SEQ ID NO: 8109652 - DNA, 22 bp, Homo sapiens
ctgcagcatgacttatgtctgg

SEQ ID NO: 8109653 - DNA, 22 bp, Homo sapiens
ctgcagcatcctagggtctgtg

SEQ ID NO: 8109654 - DNA, 22 bp, Homo sapiens
ctgcagcatcgccacctgcctc

SEQ ID NO: 8109655 - DNA, 22 bp, Homo sapiens
ctgcagcagtgtgtctcatttt

SEQ ID NO: 8109656 - DNA, 22 bp, Homo sapiens
ctgcagcagtagtccccaagtg

SEQ ID NO: 8109657 - DNA, 22 bp, Homo sapiens
ctgaggcactgtcagctgaggc

SEQ ID NO: 8109658 - DNA, 22 bp, Homo sapiens
ctgaggagtgggtgggcagtga

SEQ ID NO: 8109659 - DNA, 22 bp, Homo sapiens
ctgaggagaaatgggatggttc

SEQ ID NO: 8109660 - DNA, 22 bp, Homo sapiens
ctgattctgtaatttttcctaa

SEQ ID NO: 8109661 - DNA, 22 bp, Homo sapiens
ctgattctctgactcttggctt

SEQ ID NO: 8109662 - DNA, 22 bp, Homo sapiens
ctgattctttcttcttgccagg

SEQ ID NO: 8109663 - DNA, 22 bp, Homo sapiens
ctgatttctcagttctaggaag

SEQ ID NO: 8109664 - DNA, 22 bp, Homo sapiens
ctgatttcatgctatcaatgtt

SEQ ID NO: 8109665 - DNA, 22 bp, Homo sapiens
ctgatgcccctggacctgtgac

SEQ ID NO: 8109666 - DNA, 22 bp, Homo sapiens
ctggcccttctcttgcttcctg

SEQ ID NO: 8109667 - DNA, 22 bp, Homo sapiens
ctggcctggcaggggacctcta

SEQ ID NO: 8109668 - DNA, 22 bp, Homo sapiens
ctggccagttactgctattggc

SEQ ID NO: 8109669 - DNA, 22 bp, Homo sapiens
ctggccagttgtcctggcttgg

SEQ ID NO: 8109670 - DNA, 22 bp, Homo sapiens
ctggctctaagtgtcagctccc

SEQ ID NO: 8109671 - DNA, 22 bp, Homo sapiens
ctggccaggctctcacgtggtc

SEQ ID NO: 8109672 - DNA, 22 bp, Homo sapiens
ctggccaggctctcacgtggtc

SEQ ID NO: 8109673 - DNA, 22 bp, Homo sapiens
ctggcatgccttgggtgcctct

SEQ ID NO: 8109674 - DNA, 22 bp, Homo sapiens
ctggatggaaggaggatagtat

SEQ ID NO: 8109675 - DNA, 22 bp, Homo sapiens
ctggattctcatcagagccaga

SEQ ID NO: 8109676 - DNA, 22 bp, Homo sapiens
ctggatggtcccatgagcagct

SEQ ID NO: 8109677 - DNA, 22 bp, Homo sapiens
ctggcagagtctgctgtctgca

SEQ ID NO: 8109678 - DNA, 22 bp, Homo sapiens
ctggcagatagccacgcctgtc

SEQ ID NO: 8109679 - DNA, 22 bp, Homo sapiens
ctggcagatatttgcagacatg

SEQ ID NO: 8109680 - DNA, 22 bp, Homo sapiens
ctggagggacaaggtatgcatt

SEQ ID NO: 8109681 - DNA, 22 bp, Homo sapiens
ctggacagtgggcagaggagac

SEQ ID NO: 8109682 - DNA, 22 bp, Homo sapiens
ctggaccagcctccgccttcac

SEQ ID NO: 8109683 - DNA, 22 bp, Homo sapiens
ctggagttttggaaaaatgctt

SEQ ID NO: 8109684 - DNA, 22 bp, Homo sapiens
ctggagtttgcggggacagaga

SEQ ID NO: 8109685 - DNA, 18 bp, Homo sapiens
ctggagtcacagtgggga

SEQ ID NO: 8109686 - DNA, 21 bp, Homo sapiens
ctggagtcattttctgagtag

SEQ ID NO: 8109687 - DNA, 21 bp, Homo sapiens
ctggagggtagagttgggctg

SEQ ID NO: 8109688 - DNA, 22 bp, Homo sapiens
ctggagggtggagagaagtctc

SEQ ID NO: 8109689 - DNA, 22 bp, Homo sapiens
ctggagggctggactaaggaaa

SEQ ID NO: 8109690 - DNA, 22 bp, Homo sapiens
ctggagggcttctgcaggttac

SEQ ID NO: 8109691 - DNA, 22 bp, Homo sapiens
ctggaggggctggcatggtagc

SEQ ID NO: 8109692 - DNA, 22 bp, Homo sapiens
ctggacaggctggggactgcaa

SEQ ID NO: 8109693 - DNA, 22 bp, Homo sapiens
ctggacaggaagaattgggagc

SEQ ID NO: 8109694 - DNA, 22 bp, Homo sapiens
ctggacagatcccttgtagctt

SEQ ID NO: 8109695 - DNA, 22 bp, Homo sapiens
ctggacagaaagggctgctgtg

SEQ ID NO: 8109696 - DNA, 22 bp, Homo sapiens
ctggaaggttctttgtgtgcct

SEQ ID NO: 8109697 - DNA, 22 bp, Homo sapiens
ctgcctgctcaccagggctctg

SEQ ID NO: 8109698 - DNA, 22 bp, Homo sapiens
ctgcctgctcaccagggctctg

SEQ ID NO: 8109699 - DNA, 22 bp, Homo sapiens
ctgcctggatgaatggcgcctt

SEQ ID NO: 8109700 - DNA, 22 bp, Homo sapiens
ctgcctggcccagggatgggcc

SEQ ID NO: 8109701 - DNA, 22 bp, Homo sapiens
tggcaagggattgtggagaact

SEQ ID NO: 8109702 - DNA, 22 bp, Homo sapiens
tggcaaggctgtgggggcagag

SEQ ID NO: 8109703 - DNA, 23 bp, Homo sapiens
tggcaaggaatgggatggagact

SEQ ID NO: 8109704 - DNA, 22 bp, Homo sapiens
tggcaaggccacaggtgcagtt

SEQ ID NO: 8109705 - DNA, 22 bp, Homo sapiens
tggcagaggtatattgggagga

SEQ ID NO: 8109706 - DNA, 22 bp, Homo sapiens
tggcaaggaagagcctggtgca

SEQ ID NO: 8109707 - DNA, 22 bp, Homo sapiens
tggatgaaaaatgagaattttc

SEQ ID NO: 8109708 - DNA, 22 bp, Homo sapiens
ccctggcctccaggcagtcctg

SEQ ID NO: 8109709 - DNA, 20 bp, Homo sapiens
ccctggcctgtttcatgccc

SEQ ID NO: 8109710 - DNA, 23 bp, Homo sapiens
ccctggccttggggcacaggctg

SEQ ID NO: 8109711 - DNA, 22 bp, Homo sapiens
ccctggctgccagtcaccagac

SEQ ID NO: 8109712 - DNA, 22 bp, Homo sapiens
ccctccagccatggacccaggt

SEQ ID NO: 8109713 - DNA, 22 bp, Homo sapiens
ccctcagtctggctgggaagac

SEQ ID NO: 8109714 - DNA, 22 bp, Homo sapiens
ccctcagttttccagtgtgggc

SEQ ID NO: 8109715 - DNA, 22 bp, Homo sapiens
ccctccagagcttgacctgctg

SEQ ID NO: 8109716 - DNA, 22 bp, Homo sapiens
ccctggagaaggggacgcggag

SEQ ID NO: 8109717 - DNA, 22 bp, Homo sapiens
ccctgctgcagagagctttcca

SEQ ID NO: 8109718 - DNA, 22 bp, Homo sapiens
ccctggactgttcagggcctga

SEQ ID NO: 8109719 - DNA, 22 bp, Homo sapiens
ccctgctgacaacttgattttg

SEQ ID NO: 8109720 - DNA, 22 bp, Homo sapiens
ccctgctgatgccttgattttg

SEQ ID NO: 8109721 - DNA, 22 bp, Homo sapiens
ccctccaggcactgccctcttc

SEQ ID NO: 8109722 - DNA, 22 bp, Homo sapiens
ccctccagggagccatgctggg

SEQ ID NO: 8109723 - DNA, 22 bp, Homo sapiens
cctctctgtgtggcctctccat

SEQ ID NO: 8109724 - DNA, 22 bp, Homo sapiens
cctctctgtaagggtccctccc

SEQ ID NO: 8109725 - DNA, 22 bp, Homo sapiens
cctctctgtagcagcccccagt

SEQ ID NO: 8109726 - DNA, 22 bp, Homo sapiens
cctctcagcgattcctcttgga

SEQ ID NO: 8109727 - DNA, 22 bp, Homo sapiens
cctctgagcctgtgtgcggcac

SEQ ID NO: 8109728 - DNA, 23 bp, Homo sapiens
cctctgacaatgatgtcacctgc

SEQ ID NO: 8109729 - DNA, 22 bp, Homo sapiens
cctctgggggcttccttaccct

SEQ ID NO: 8109730 - DNA, 22 bp, Homo sapiens
cctctgtgacaaacagtcctgg

SEQ ID NO: 8109731 - DNA, 22 bp, Homo sapiens
cctctgggtatctgtggaagta

SEQ ID NO: 8109732 - DNA, 22 bp, Homo sapiens
cctctgggggtcctcagagtct

SEQ ID NO: 8109733 - DNA, 22 bp, Homo sapiens
tggctcagtttcagtcctggtt

SEQ ID NO: 8109734 - DNA, 22 bp, Homo sapiens
tggctcagtttctgcccagctg

SEQ ID NO: 8109735 - DNA, 22 bp, Homo sapiens
tggctcagtttagcagctcagt

SEQ ID NO: 8109736 - DNA, 22 bp, Homo sapiens
tggctcagctgtcacagcctgg

SEQ ID NO: 8109737 - DNA, 22 bp, Homo sapiens
tggccctgcttatgtctctctt

SEQ ID NO: 8109738 - DNA, 22 bp, Homo sapiens
tggccctgctgtatcatctgct

SEQ ID NO: 8109739 - DNA, 22 bp, Homo sapiens
tggccctgctgtatcatctgct

SEQ ID NO: 8109740 - DNA, 22 bp, Homo sapiens
tggccctgcttatgtctctctt

SEQ ID NO: 8109741 - DNA, 22 bp, Homo sapiens
tggccctgctgggtcagagctg

SEQ ID NO: 8109742 - DNA, 22 bp, Homo sapiens
tggccctgctgggtcagagctg

SEQ ID NO: 8109743 - DNA, 22 bp, Homo sapiens
tggccccccagagctggaggac

SEQ ID NO: 8109744 - DNA, 22 bp, Homo sapiens
tggccctgctatgatcctgcaa

SEQ ID NO: 8109745 - DNA, 22 bp, Homo sapiens
tggccctgctggacacgcctgc

SEQ ID NO: 8109746 - DNA, 22 bp, Homo sapiens
tggccctgctggacacgcctgc

SEQ ID NO: 8109747 - DNA, 22 bp, Homo sapiens
tggcccagtgcttatgctctga

SEQ ID NO: 8109748 - DNA, 22 bp, Homo sapiens
tggcccagtgcttatgctctga

SEQ ID NO: 8109749 - DNA, 20 bp, Homo sapiens
tggcccagtggggcagggtg

SEQ ID NO: 8109750 - DNA, 22 bp, Homo sapiens
cctccctggccagagcagcagc

SEQ ID NO: 8109751 - DNA, 22 bp, Homo sapiens
cctcggctgcccagcccagctg

SEQ ID NO: 8109752 - DNA, 22 bp, Homo sapiens
cctccagcgcgatccactccgg

SEQ ID NO: 8109753 - DNA, 22 bp, Homo sapiens
cctccagcattactggcccatg

SEQ ID NO: 8109754 - DNA, 17 bp, Homo sapiens
cccagctggcagtgccg

SEQ ID NO: 8109755 - DNA, 18 bp, Homo sapiens
cccagctggtgggtcagt

SEQ ID NO: 8109756 - DNA, 22 bp, Homo sapiens
cccagctttccacttcctctgg

SEQ ID NO: 8109757 - DNA, 23 bp, Homo sapiens
cccagctttcccactgccgagag

SEQ ID NO: 8109758 - DNA, 22 bp, Homo sapiens
tgcatcagaggatagctgcagt

SEQ ID NO: 8109759 - DNA, 22 bp, Homo sapiens
tgcattaaatataatctgttga

SEQ ID NO: 8109760 - DNA, 22 bp, Homo sapiens
cccagcctttgcttcctggttc

SEQ ID NO: 8109761 - DNA, 22 bp, Homo sapiens
cccagcctttgcttcctggttc

SEQ ID NO: 8109762 - DNA, 22 bp, Homo sapiens
cccagccttccaccctggacta

SEQ ID NO: 8109763 - DNA, 22 bp, Homo sapiens
tgcagggaccccgaggctctct

SEQ ID NO: 8109764 - DNA, 16 bp, Homo sapiens
tgcctgctctgatctc

SEQ ID NO: 8109765 - DNA, 22 bp, Homo sapiens
tgccaagaggtccaggtgggaa

SEQ ID NO: 8109766 - DNA, 22 bp, Homo sapiens
tgcctgggactgtactaaattt

SEQ ID NO: 8109767 - DNA, 22 bp, Homo sapiens
tgcctgggagtgaccaagactc

SEQ ID NO: 8109768 - DNA, 22 bp, Homo sapiens
tgcctgggacatgctgtggact

SEQ ID NO: 8109769 - DNA, 22 bp, Homo sapiens
tgcctgggactctgttatcttg

SEQ ID NO: 8109770 - DNA, 22 bp, Homo sapiens
tgcctgctctttattttatgat

SEQ ID NO: 8109771 - DNA, 22 bp, Homo sapiens
tgcctgctcttgagacttacaa

SEQ ID NO: 8109772 - DNA, 22 bp, Homo sapiens
tgcctgctcttaccactctccc

SEQ ID NO: 8109773 - DNA, 22 bp, Homo sapiens
tgcctgctctgtgccacagttg

SEQ ID NO: 8109774 - DNA, 20 bp, Homo sapiens
tgcctgggaaggcgtggagg

SEQ ID NO: 8109775 - DNA, 20 bp, Homo sapiens
tgcctgggaaggcgtggagg

SEQ ID NO: 8109776 - DNA, 22 bp, Homo sapiens
tgcctgggatctgtgccctttg

SEQ ID NO: 8109777 - DNA, 22 bp, Homo sapiens
tgcctgggcctctgaggaaggc

SEQ ID NO: 8109778 - DNA, 22 bp, Homo sapiens
tgcctgggctcaccgcctcttt

SEQ ID NO: 8109779 - DNA, 22 bp, Homo sapiens
tgcctgggccttcccacctctg

SEQ ID NO: 8109780 - DNA, 22 bp, Homo sapiens
tgctcccaaacctgacaggctc

SEQ ID NO: 8109781 - DNA, 22 bp, Homo sapiens
tgctcccaaacgacctactgtg

SEQ ID NO: 8109782 - DNA, 22 bp, Homo sapiens
tgctcccagctgtaggaatgtt

SEQ ID NO: 8109783 - DNA, 22 bp, Homo sapiens
tgctcccagctcctgcagcaac

SEQ ID NO: 8109784 - DNA, 22 bp, Homo sapiens
tgctcccacactactcggaggc

SEQ ID NO: 8109785 - DNA, 22 bp, Homo sapiens
tgctgagagccagggctggcat

SEQ ID NO: 8109786 - DNA, 22 bp, Homo sapiens
ccccagccttccatgggaattg

SEQ ID NO: 8109787 - DNA, 22 bp, Homo sapiens
tgctggagatcattaatgttca

SEQ ID NO: 8109788 - DNA, 22 bp, Homo sapiens
cccctctggtcaaccagtcaca

SEQ ID NO: 8109789 - DNA, 22 bp, Homo sapiens
ccctcagcttctccctgcagct

SEQ ID NO: 8109790 - DNA, 22 bp, Homo sapiens
cctgggcctcacccagctcttg

SEQ ID NO: 8109791 - DNA, 22 bp, Homo sapiens
tgtggggcagctagccggcctg

SEQ ID NO: 8109792 - DNA, 22 bp, Homo sapiens
tgtggggccaaagcccagccac

SEQ ID NO: 8109793 - DNA, 22 bp, Homo sapiens
tgtggggcctcgtgctagctgg

SEQ ID NO: 8109794 - DNA, 22 bp, Homo sapiens
tgtggggctccctggcagcctg

SEQ ID NO: 8109795 - DNA, 22 bp, Homo sapiens
tgtggggctgtcaggcaactgg

SEQ ID NO: 8109796 - DNA, 22 bp, Homo sapiens
tgtggggcttacaaaggcagat

SEQ ID NO: 8109797 - DNA, 22 bp, Homo sapiens
tgtggggctgtggtgttcttct

SEQ ID NO: 8109798 - DNA, 21 bp, Homo sapiens
cctgggccaaattccctggac

SEQ ID NO: 8109799 - DNA, 21 bp, Homo sapiens
cctgggccaaattccctggac

SEQ ID NO: 8109800 - DNA, 23 bp, Homo sapiens
cctgggcattggctgcagcttct

SEQ ID NO: 8109801 - DNA, 22 bp, Homo sapiens
cctgggcatcaacaagcagaga

SEQ ID NO: 8109802 - DNA, 22 bp, Homo sapiens
cctgggcatctcatgcacctgc

SEQ ID NO: 8109803 - DNA, 19 bp, Homo sapiens
cctgggaggcggaggttgc

SEQ ID NO: 8109804 - DNA, 22 bp, Homo sapiens
cctgggagctgtggaaaggctg

SEQ ID NO: 8109805 - DNA, 22 bp, Homo sapiens
tgtggcaggcattctgaggctg

SEQ ID NO: 8109806 - DNA, 22 bp, Homo sapiens
tgtggcagggatactgaggcag

SEQ ID NO: 8109807 - DNA, 22 bp, Homo sapiens
tgtggcagctggaggtggagaa

SEQ ID NO: 8109808 - DNA, 22 bp, Homo sapiens
tgtgttcatgttgattcatagc

SEQ ID NO: 8109809 - DNA, 22 bp, Homo sapiens
tgtgttcatgtatgtatacata

SEQ ID NO: 8109810 - DNA, 22 bp, Homo sapiens
tgtgttcagtatgacattcaca

SEQ ID NO: 8109811 - DNA, 22 bp, Homo sapiens
tgtgttcaatgacttcatcttt

SEQ ID NO: 8109812 - DNA, 22 bp, Homo sapiens
cctgggcctggcgggtcggctc

SEQ ID NO: 8109813 - DNA, 20 bp, Homo sapiens
cctgggctcaaagcatcctc

SEQ ID NO: 8109814 - DNA, 22 bp, Homo sapiens
cctgggctcaagcgatcttgtc

SEQ ID NO: 8109815 - DNA, 22 bp, Homo sapiens
cctgggctcaagtgatcctcct

SEQ ID NO: 8109816 - DNA, 22 bp, Homo sapiens
cctgggcctctcaaagtgctgg

SEQ ID NO: 8109817 - DNA, 22 bp, Homo sapiens
cctgggaagcccatagcagctt

SEQ ID NO: 8109818 - DNA, 22 bp, Homo sapiens
cctgggaacagtgggttggctc

SEQ ID NO: 8109819 - DNA, 22 bp, Homo sapiens
cctgggaagaccggcagtgggg

SEQ ID NO: 8109820 - DNA, 22 bp, Homo sapiens
cctgggaagagctgacaggagg

SEQ ID NO: 8109821 - DNA, 22 bp, Homo sapiens
tgtgcccatccctctggagtgt

SEQ ID NO: 8109822 - DNA, 22 bp, Homo sapiens
tgtgcccattccacttgagtac

SEQ ID NO: 8109823 - DNA, 22 bp, Homo sapiens
cctggctttgaccttgctgttt

SEQ ID NO: 8109824 - DNA, 20 bp, Homo sapiens
cctggctttgcagcatgaga

SEQ ID NO: 8109825 - DNA, 22 bp, Homo sapiens
cctgggaacagcagagtcctgg

SEQ ID NO: 8109826 - DNA, 22 bp, Homo sapiens
cctggctgtggcggtgctctca

SEQ ID NO: 8109827 - DNA, 22 bp, Homo sapiens
cctggctgtggcggtgctctca

SEQ ID NO: 8109828 - DNA, 22 bp, Homo sapiens
cctggctgtgtgaccttggcaa

SEQ ID NO: 8109829 - DNA, 22 bp, Homo sapiens
cctggctgtttgagcggggaat

SEQ ID NO: 8109830 - DNA, 22 bp, Homo sapiens
cctggctgcccatggaccctct

SEQ ID NO: 8109831 - DNA, 22 bp, Homo sapiens
cctggctgcattttgctggatg

SEQ ID NO: 8109832 - DNA, 22 bp, Homo sapiens
cctggctgccgagtgtgcagcg

SEQ ID NO: 8109833 - DNA, 22 bp, Homo sapiens
cctggctgctatagcagcatgt

SEQ ID NO: 8109834 - DNA, 19 bp, Homo sapiens
cctggctgtgaagcctgca

SEQ ID NO: 8109835 - DNA, 23 bp, Homo sapiens
cctggctgtggatttgggcctgc

SEQ ID NO: 8109836 - DNA, 22 bp, Homo sapiens
cctggctgtgcattgccggccc

SEQ ID NO: 8109837 - DNA, 22 bp, Homo sapiens
tgtctttacttagaagttcagg

SEQ ID NO: 8109838 - DNA, 22 bp, Homo sapiens
tgtctttagaaagaagcagaca

SEQ ID NO: 8109839 - DNA, 22 bp, Homo sapiens
tgtctgtccactcactgtggag

SEQ ID NO: 8109840 - DNA, 23 bp, Homo sapiens
tgtctgtcatggaatttcaaggt

SEQ ID NO: 8109841 - DNA, 22 bp, Homo sapiens
tgtctgtcagcagtgggtcagg

SEQ ID NO: 8109842 - DNA, 22 bp, Homo sapiens
cctggctgagggacctcgggta

SEQ ID NO: 8109843 - DNA, 21 bp, Homo sapiens
cctggctgcacagttgctggt

SEQ ID NO: 8109844 - DNA, 22 bp, Homo sapiens
tgtctgggtcacccctcctggc

SEQ ID NO: 8109845 - DNA, 22 bp, Homo sapiens
cctggctgaacaaagtccctcc

SEQ ID NO: 8109846 - DNA, 23 bp, Homo sapiens
cctggctgacctgaaggtgtagt

SEQ ID NO: 8109847 - DNA, 22 bp, Homo sapiens
tgtgagcagagcctgacatgag

SEQ ID NO: 8109848 - DNA, 22 bp, Homo sapiens
cctggctgcagtttttgcagaa

SEQ ID NO: 8109849 - DNA, 22 bp, Homo sapiens
tgtgaagagtagacatgtggtg

SEQ ID NO: 8109850 - DNA, 22 bp, Homo sapiens
tgtgaaggagcatgcagagggg

SEQ ID NO: 8109851 - DNA, 22 bp, Homo sapiens
tgtgaagaattaatgtgaatca

SEQ ID NO: 8109852 - DNA, 22 bp, Homo sapiens
cctggactcaggctgtgggcac

SEQ ID NO: 8109853 - DNA, 22 bp, Homo sapiens
cctggactgtgtcctgtggtca

SEQ ID NO: 8109854 - DNA, 22 bp, Homo sapiens
tgtaaacagtaggactaaagag

SEQ ID NO: 8109855 - DNA, 22 bp, Homo sapiens
tggtccatgtcctccatctctc

SEQ ID NO: 8109856 - DNA, 22 bp, Homo sapiens
tggtccctgatctaatgtctca

SEQ ID NO: 8109857 - DNA, 21 bp, Homo sapiens
tggtccctttcagagtctgga

SEQ ID NO: 8109858 - DNA, 22 bp, Homo sapiens
tggtccctggatttctggaaca

SEQ ID NO: 8109859 - DNA, 22 bp, Homo sapiens
cctctgtgcctcgtgtcctctg

SEQ ID NO: 8109860 - DNA, 21 bp, Homo sapiens
cctctgtgctaaagggctccc

SEQ ID NO: 8109861 - DNA, 22 bp, Homo sapiens
cctctgtggccctgactctctt

SEQ ID NO: 8109862 - DNA, 22 bp, Homo sapiens
cctgccagtgcctcccactggt

SEQ ID NO: 8109863 - DNA, 22 bp, Homo sapiens
cctgccagtgaagctgacgggc

SEQ ID NO: 8109864 - DNA, 20 bp, Homo sapiens
tggtcctcacaggtcctccc

SEQ ID NO: 8109865 - DNA, 22 bp, Homo sapiens
cctgcccacagagagggtgcat

SEQ ID NO: 8109866 - DNA, 22 bp, Homo sapiens
tgtattatcaagtaaatacatg

SEQ ID NO: 8109867 - DNA, 22 bp, Homo sapiens
tgtattatgattgttgttcatg

SEQ ID NO: 8109868 - DNA, 22 bp, Homo sapiens
tgtattaacattaataaaatgg

SEQ ID NO: 8109869 - DNA, 22 bp, Homo sapiens
cctggcagactgtgagggcagg

SEQ ID NO: 8109870 - DNA, 22 bp, Homo sapiens
cctggcagaatattaaagtgca

SEQ ID NO: 8109871 - DNA, 22 bp, Homo sapiens
cctggcagaatattaaagtgca

SEQ ID NO: 8109872 - DNA, 21 bp, Homo sapiens
cctggcagaagcctgatatgc

SEQ ID NO: 8109873 - DNA, 21 bp, Homo sapiens
cctggcagaagcctgatatgc

SEQ ID NO: 8109874 - DNA, 21 bp, Homo sapiens
cctggcactggcctgctgagc

SEQ ID NO: 8109875 - DNA, 22 bp, Homo sapiens
cctggcaccttcacagactact

SEQ ID NO: 8109876 - DNA, 22 bp, Homo sapiens
cctggcacatgcagtactcaag

SEQ ID NO: 8109877 - DNA, 22 bp, Homo sapiens
tgtaaacatgctgaggctggag

SEQ ID NO: 8109878 - DNA, 22 bp, Homo sapiens
tgtaaacatatgtatgtatgta

SEQ ID NO: 8109879 - DNA, 22 bp, Homo sapiens
tgtataaaccatggacagcttt

SEQ ID NO: 8109880 - DNA, 22 bp, Homo sapiens
tgtcccaaccctgagaagattc

SEQ ID NO: 8109881 - DNA, 22 bp, Homo sapiens
cctggccatttgaacttcagac

SEQ ID NO: 8109882 - DNA, 22 bp, Homo sapiens
cctggcccacatggcttctccc

SEQ ID NO: 8109883 - DNA, 22 bp, Homo sapiens
cctggccagggtctgggctgct

SEQ ID NO: 8109884 - DNA, 22 bp, Homo sapiens
tgtcctcaggacctggcacagt

SEQ ID NO: 8109885 - DNA, 22 bp, Homo sapiens
tgtcctccaggacctgcagggc

SEQ ID NO: 8109886 - DNA, 22 bp, Homo sapiens
cctggcagttcatcaaatggca

SEQ ID NO: 8109887 - DNA, 22 bp, Homo sapiens
cctggcagttttgcccaggatt

SEQ ID NO: 8109888 - DNA, 22 bp, Homo sapiens
cctggcagttttgcccaggatt

SEQ ID NO: 8109889 - DNA, 22 bp, Homo sapiens
cctggccagcgccggctgctcg

SEQ ID NO: 8109890 - DNA, 22 bp, Homo sapiens
cctggccagggtctgggctgct

SEQ ID NO: 8109891 - DNA, 22 bp, Homo sapiens
cctggccagctaattgcccatc

SEQ ID NO: 8109892 - DNA, 22 bp, Homo sapiens
tgtcattatgaggattacaata

SEQ ID NO: 8109893 - DNA, 22 bp, Homo sapiens
tgtcattaaaatgcttctcaaa

SEQ ID NO: 8109894 - DNA, 18 bp, Homo sapiens
cctggcagccatgcgcgc

SEQ ID NO: 8109895 - DNA, 18 bp, Homo sapiens
cctggcagccatgcgcgc

SEQ ID NO: 8109896 - DNA, 22 bp, Homo sapiens
cctggcagcagcacatgccttc

SEQ ID NO: 8109897 - DNA, 22 bp, Homo sapiens
cctggcagcaggtgggcccgtg

SEQ ID NO: 8109898 - DNA, 22 bp, Homo sapiens
cctggcagcagcacatgccttc

SEQ ID NO: 8109899 - DNA, 22 bp, Homo sapiens
cctggcaggcccctcctggatt

SEQ ID NO: 8109900 - DNA, 22 bp, Homo sapiens
cctggcaggctggggacagtgc

SEQ ID NO: 8109901 - DNA, 22 bp, Homo sapiens
cctggcaggtggcgccctcggc

SEQ ID NO: 8109902 - DNA, 22 bp, Homo sapiens
cctggcaggttacaaccagtta

SEQ ID NO: 8109903 - DNA, 22 bp, Homo sapiens
cctggcagtcaggggagtcctt

SEQ ID NO: 8109904 - DNA, 22 bp, Homo sapiens
cctggcaggtggaggttgcagt

SEQ ID NO: 8109905 - DNA, 22 bp, Homo sapiens
cctggcaggtggaggttgcagt

SEQ ID NO: 8109906 - DNA, 22 bp, Homo sapiens
cctggcaggtggcgccctcggc

SEQ ID NO: 8109907 - DNA, 22 bp, Homo sapiens
tgtcctggagacacaaggtggt

SEQ ID NO: 8109908 - DNA, 22 bp, Homo sapiens
tgtctcagaggcaggaagagcc

SEQ ID NO: 8109909 - DNA, 18 bp, Homo sapiens
tgtctcaggctgaaacag

SEQ ID NO: 8109910 - DNA, 18 bp, Homo sapiens
tgtctcttcttatgtggg

SEQ ID NO: 8109911 - DNA, 22 bp, Homo sapiens
tgtctcttgagtttgttttaat

SEQ ID NO: 8109912 - DNA, 22 bp, Homo sapiens
tgtctcagtatacgaaacactt

SEQ ID NO: 8109913 - DNA, 22 bp, Homo sapiens
cctggcctggcactccctctgc

SEQ ID NO: 8109914 - DNA, 22 bp, Homo sapiens
cctggcctcgtgctcacggctc

SEQ ID NO: 8109915 - DNA, 19 bp, Homo sapiens
cctggccctgctgcgcggg

SEQ ID NO: 8109916 - DNA, 22 bp, Homo sapiens
cctggccctggaatagggcagg

SEQ ID NO: 8109917 - DNA, 22 bp, Homo sapiens
cctggctcgctgacctcagggg

SEQ ID NO: 8109918 - DNA, 22 bp, Homo sapiens
gtttcaaaatgatgctgtaact

SEQ ID NO: 8109919 - DNA, 22 bp, Homo sapiens
gtttattgataaaagctggaca

SEQ ID NO: 8109920 - DNA, 22 bp, Homo sapiens
gtttattgggtattgtggagcc

SEQ ID NO: 8109921 - DNA, 22 bp, Homo sapiens
gtttcaaagcacagctcacatt

SEQ ID NO: 8109922 - DNA, 22 bp, Homo sapiens
gtttcaaagcacagctcacatt

SEQ ID NO: 8109923 - DNA, 22 bp, Homo sapiens
gtttcaaaagtcaggctattct

SEQ ID NO: 8109924 - DNA, 22 bp, Homo sapiens
gtttcaaaagtcaggctattct

SEQ ID NO: 8109925 - DNA, 22 bp, Homo sapiens
gtttacatgtttttctcttaca

SEQ ID NO: 8109926 - DNA, 22 bp, Homo sapiens
gtttacatgcatgcaagaatga

SEQ ID NO: 8109927 - DNA, 22 bp, Homo sapiens
gtttattattcaacttcatgtt

SEQ ID NO: 8109928 - DNA, 22 bp, Homo sapiens
caggaagaggtggggctaaagt

SEQ ID NO: 8109929 - DNA, 22 bp, Homo sapiens
caggaagattagaccaagagct

SEQ ID NO: 8109930 - DNA, 22 bp, Homo sapiens
gtttacatatgtctgtctgcac

SEQ ID NO: 8109931 - DNA, 22 bp, Homo sapiens
gtttacatgcagaaaatcaatg

SEQ ID NO: 8109932 - DNA, 22 bp, Homo sapiens
gtttacaacatcttgtccttca

SEQ ID NO: 8109933 - DNA, 21 bp, Homo sapiens
gtttacaaggctttgctcctg

SEQ ID NO: 8109934 - DNA, 22 bp, Homo sapiens
caggaaaggtgtgtcatgatgg

SEQ ID NO: 8109935 - DNA, 22 bp, Homo sapiens
gttggagtgcagcttgtgcgat

SEQ ID NO: 8109936 - DNA, 19 bp, Homo sapiens
gttggcactgaaaatggct

SEQ ID NO: 8109937 - DNA, 22 bp, Homo sapiens
caggaaagtctgtaaaggaacc

SEQ ID NO: 8109938 - DNA, 22 bp, Homo sapiens
caggaacaactcccagcatctc

SEQ ID NO: 8109939 - DNA, 22 bp, Homo sapiens
gttcttcaaagtgacaactaaa

SEQ ID NO: 8109940 - DNA, 19 bp, Homo sapiens
gttctgtgtcctggaggaa

SEQ ID NO: 8109941 - DNA, 22 bp, Homo sapiens
gttcttaagaccacaataaaaa

SEQ ID NO: 8109942 - DNA, 22 bp, Homo sapiens
gttcttaaagattcatcaagca

SEQ ID NO: 8109943 - DNA, 22 bp, Homo sapiens
gttcacagtctacatagtaaag

SEQ ID NO: 8109944 - DNA, 22 bp, Homo sapiens
gttcacaggttctctttctaag

SEQ ID NO: 8109945 - DNA, 20 bp, Homo sapiens
gttcacaggcttcctttcag

SEQ ID NO: 8109946 - DNA, 22 bp, Homo sapiens
gttcacagcttgtgttttctct

SEQ ID NO: 8109947 - DNA, 22 bp, Homo sapiens
gttcacagcttcttaggtcata

SEQ ID NO: 8109948 - DNA, 22 bp, Homo sapiens
gttcacagggatccttgttgaa

SEQ ID NO: 8109949 - DNA, 22 bp, Homo sapiens
gttcacagggttaggaatcact

SEQ ID NO: 8109950 - DNA, 22 bp, Homo sapiens
gttcacagttttatacctgaga

SEQ ID NO: 8109951 - DNA, 22 bp, Homo sapiens
gttcacagtttctaatcccagc

SEQ ID NO: 8109952 - DNA, 22 bp, Homo sapiens
gttcacagttcagcctgtaaca

SEQ ID NO: 8109953 - DNA, 22 bp, Homo sapiens
gttcacagtgttttctttgcat

SEQ ID NO: 8109954 - DNA, 22 bp, Homo sapiens
gttcacagttaggacaactgct

SEQ ID NO: 8109955 - DNA, 22 bp, Homo sapiens
cagctgtgggcctgacgtggca

SEQ ID NO: 8109956 - DNA, 22 bp, Homo sapiens
cagctgtgctgtattaagctct

SEQ ID NO: 8109957 - DNA, 22 bp, Homo sapiens
cagctgtgctgtattaagctct

SEQ ID NO: 8109958 - DNA, 22 bp, Homo sapiens
cagctgtgattcctgctgtcca

SEQ ID NO: 8109959 - DNA, 22 bp, Homo sapiens
cagctgttgtgtatcaggcaga

SEQ ID NO: 8109960 - DNA, 22 bp, Homo sapiens
cagctgttgttatgtctgcagg

SEQ ID NO: 8109961 - DNA, 22 bp, Homo sapiens
cagctgttgtgctgggcagtta

SEQ ID NO: 8109962 - DNA, 22 bp, Homo sapiens
cagctgttgtgatttccaggag

SEQ ID NO: 8109963 - DNA, 22 bp, Homo sapiens
cagctgtttcagtagcgttact

SEQ ID NO: 8109964 - DNA, 22 bp, Homo sapiens
cagctgtttgggcatggccaga

SEQ ID NO: 8109965 - DNA, 22 bp, Homo sapiens
gtgtttggtcagacgtccgggg

SEQ ID NO: 8109966 - DNA, 22 bp, Homo sapiens
gtgtttggtcagacgtccgggg

SEQ ID NO: 8109967 - DNA, 22 bp, Homo sapiens
gtgttttatggagtcataacgt

SEQ ID NO: 8109968 - DNA, 22 bp, Homo sapiens
gtgttttatcagacaaagtata

SEQ ID NO: 8109969 - DNA, 22 bp, Homo sapiens
gtgttttagtgctgctgagctg

SEQ ID NO: 8109970 - DNA, 22 bp, Homo sapiens
gtgttttaagaaagaagctcag

SEQ ID NO: 8109971 - DNA, 23 bp, Homo sapiens
gtgtgtggaaagtgcatgggcct

SEQ ID NO: 8109972 - DNA, 22 bp, Homo sapiens
gttacaatgtccttacatgaaa

SEQ ID NO: 8109973 - DNA, 22 bp, Homo sapiens
gttacaatgttcttcagttctg

SEQ ID NO: 8109974 - DNA, 22 bp, Homo sapiens
gttacaaatgtaaattctgggg

SEQ ID NO: 8109975 - DNA, 22 bp, Homo sapiens
gttacaaatgccaaagctgaga

SEQ ID NO: 8109976 - DNA, 22 bp, Homo sapiens
gtgttttattggtgcagtcaga

SEQ ID NO: 8109977 - DNA, 22 bp, Homo sapiens
caggaaaatggaatcacctgta

SEQ ID NO: 8109978 - DNA, 22 bp, Homo sapiens
caggaaaatggaatcacctgta

SEQ ID NO: 8109979 - DNA, 22 bp, Homo sapiens
gttcacaagctgattgtctttc

SEQ ID NO: 8109980 - DNA, 22 bp, Homo sapiens
gttcacagaaggccagatggta

SEQ ID NO: 8109981 - DNA, 22 bp, Homo sapiens
gttcacagaaattgtgtacctc

SEQ ID NO: 8109982 - DNA, 22 bp, Homo sapiens
gttcacaatggctttacctaag

SEQ ID NO: 8109983 - DNA, 22 bp, Homo sapiens
gttcacagatccttgaagccag

SEQ ID NO: 8109984 - DNA, 22 bp, Homo sapiens
gttcacagcaaacctatgaact

SEQ ID NO: 8109985 - DNA, 22 bp, Homo sapiens
gttcacagcaaacctatgaact

SEQ ID NO: 8109986 - DNA, 22 bp, Homo sapiens
gttcacagctgggacaagactg

SEQ ID NO: 8109987 - DNA, 22 bp, Homo sapiens
gttcacagcttcttaggtcata

SEQ ID NO: 8109988 - DNA, 22 bp, Homo sapiens
caggaaaatgtcaatggaaagc

SEQ ID NO: 8109989 - DNA, 22 bp, Homo sapiens
cagcttgctaactggtaggggt

SEQ ID NO: 8109990 - DNA, 22 bp, Homo sapiens
gttattcaacttgtgtctctta

SEQ ID NO: 8109991 - DNA, 22 bp, Homo sapiens
gttattcaacttgtgtctctta

SEQ ID NO: 8109992 - DNA, 22 bp, Homo sapiens
gttattcaatggcttataagga

SEQ ID NO: 8109993 - DNA, 22 bp, Homo sapiens
gttattaaagtatttgatgtta

SEQ ID NO: 8109994 - DNA, 22 bp, Homo sapiens
gttattgacatgtattaagcac

SEQ ID NO: 8109995 - DNA, 22 bp, Homo sapiens
gttattcaatggcttataagga

SEQ ID NO: 8109996 - DNA, 22 bp, Homo sapiens
gtggcagaccttcccttctcct

SEQ ID NO: 8109997 - DNA, 22 bp, Homo sapiens
gtggcagagaacaaggagaggt

SEQ ID NO: 8109998 - DNA, 22 bp, Homo sapiens
gtggcagagagcaagtgtctga

SEQ ID NO: 8109999 - DNA, 22 bp, Homo sapiens
gtggcagagcaggagacaggac

SEQ ID NO: 8110000 - DNA, 22 bp, Homo sapiens
gtggcagaaatgggactttgag

SEQ ID NO: 8110001 - DNA, 22 bp, Homo sapiens
gtggcagaaactggcagaggag

SEQ ID NO: 8110002 - DNA, 22 bp, Homo sapiens
gtggcagaagagtaggatgggc

SEQ ID NO: 8110003 - DNA, 22 bp, Homo sapiens
gtggcagaactatgtgattgct

SEQ ID NO: 8110004 - DNA, 22 bp, Homo sapiens
gtggcagagccaaggctggagc

SEQ ID NO: 8110005 - DNA, 22 bp, Homo sapiens
gtggcaggtggagcctcctgca

SEQ ID NO: 8110006 - DNA, 21 bp, Homo sapiens
cagcccagcttcttccccagt

SEQ ID NO: 8110007 - DNA, 22 bp, Homo sapiens
gtggccagtgggaatgggctca

SEQ ID NO: 8110008 - DNA, 22 bp, Homo sapiens
gtggccatctttggccctgact

SEQ ID NO: 8110009 - DNA, 22 bp, Homo sapiens
gtggcagtcatcaaggacagat

SEQ ID NO: 8110010 - DNA, 22 bp, Homo sapiens
gtggcaggttccgtagacagca

SEQ ID NO: 8110011 - DNA, 22 bp, Homo sapiens
gtggcagtctttggcaatgaca

SEQ ID NO: 8110012 - DNA, 22 bp, Homo sapiens
cagctctggcagagcccaaccc

SEQ ID NO: 8110013 - DNA, 22 bp, Homo sapiens
cagctcttccctcttcttgtag

SEQ ID NO: 8110014 - DNA, 22 bp, Homo sapiens
cagctgagtgttggcatgttca

SEQ ID NO: 8110015 - DNA, 22 bp, Homo sapiens
gtgggaagaacttcaagtggct

SEQ ID NO: 8110016 - DNA, 22 bp, Homo sapiens
gtggccttgctcacatgtccag

SEQ ID NO: 8110017 - DNA, 22 bp, Homo sapiens
gtggccttggcttctaccctga

SEQ ID NO: 8110018 - DNA, 22 bp, Homo sapiens
gtggcctttcttgggctacaga

SEQ ID NO: 8110019 - DNA, 22 bp, Homo sapiens
gtggcctttatcttaggtatcc

SEQ ID NO: 8110020 - DNA, 22 bp, Homo sapiens
gtgggcaggccctaggcgattt

SEQ ID NO: 8110021 - DNA, 22 bp, Homo sapiens
gtgggcagggttgctttctccg

SEQ ID NO: 8110022 - DNA, 22 bp, Homo sapiens
gtgggcagtgcctgacggatga

SEQ ID NO: 8110023 - DNA, 22 bp, Homo sapiens
gtggggcggcagatgctccctg

SEQ ID NO: 8110024 - DNA, 22 bp, Homo sapiens
gtggggctaaaaactgtgcagt

SEQ ID NO: 8110025 - DNA, 22 bp, Homo sapiens
gtggggctaaaaactgtgcagt

SEQ ID NO: 8110026 - DNA, 22 bp, Homo sapiens
gtggggctcccatctcctggct

SEQ ID NO: 8110027 - DNA, 22 bp, Homo sapiens
cagctgatttgagaaagaatga

SEQ ID NO: 8110028 - DNA, 22 bp, Homo sapiens
gtggggctgagtggagccagaa

SEQ ID NO: 8110029 - DNA, 22 bp, Homo sapiens
cagctgcccctccagggctggg

SEQ ID NO: 8110030 - DNA, 22 bp, Homo sapiens
cagctggccctttggtagcctt

SEQ ID NO: 8110031 - DNA, 22 bp, Homo sapiens
cagctggctccacctctgggct

SEQ ID NO: 8110032 - DNA, 22 bp, Homo sapiens
cagctggcgcctggggaccaga

SEQ ID NO: 8110033 - DNA, 22 bp, Homo sapiens
cagctggctgcatgatgccaaa

SEQ ID NO: 8110034 - DNA, 22 bp, Homo sapiens
cagctgctgttcagttttgttt

SEQ ID NO: 8110035 - DNA, 22 bp, Homo sapiens
cagctgcctgtctggaggcaat

SEQ ID NO: 8110036 - DNA, 22 bp, Homo sapiens
gtgtatctgttaagtataaaaa

SEQ ID NO: 8110037 - DNA, 22 bp, Homo sapiens
gtgtctggaacgggtggtactc

SEQ ID NO: 8110038 - DNA, 22 bp, Homo sapiens
cagctggggcagccacgtgcgg

SEQ ID NO: 8110039 - DNA, 22 bp, Homo sapiens
cagctgggctaagagtagaggc

SEQ ID NO: 8110040 - DNA, 22 bp, Homo sapiens
cagctgggcctcctgagccctg

SEQ ID NO: 8110041 - DNA, 22 bp, Homo sapiens
cagctgtgaattgtcttatcta

SEQ ID NO: 8110042 - DNA, 22 bp, Homo sapiens
cagctgtgagagtgcattgaag

SEQ ID NO: 8110043 - DNA, 22 bp, Homo sapiens
cagctgtctaagttgagcagga

SEQ ID NO: 8110044 - DNA, 22 bp, Homo sapiens
cagctgtcttttctaaatatta

SEQ ID NO: 8110045 - DNA, 22 bp, Homo sapiens
cagctgtctgaagcaggagtcc

SEQ ID NO: 8110046 - DNA, 22 bp, Homo sapiens
cagctgggagctccattagata

SEQ ID NO: 8110047 - DNA, 22 bp, Homo sapiens
tacatatgaactttataacttg

SEQ ID NO: 8110048 - DNA, 22 bp, Homo sapiens
tacatcaagataaaaactgtca

SEQ ID NO: 8110049 - DNA, 22 bp, Homo sapiens
tacatcaagataaaaactgtca

SEQ ID NO: 8110050 - DNA, 22 bp, Homo sapiens
tacagtaacatgttgtacaagc

SEQ ID NO: 8110051 - DNA, 22 bp, Homo sapiens
caggccctgctgctgagacctt

SEQ ID NO: 8110052 - DNA, 22 bp, Homo sapiens
tacagtaaatgtggtagaaact

SEQ ID NO: 8110053 - DNA, 22 bp, Homo sapiens
caggccctggcagggctgagtc

SEQ ID NO: 8110054 - DNA, 22 bp, Homo sapiens
tacaaactccgaagtttgtacc

SEQ ID NO: 8110055 - DNA, 22 bp, Homo sapiens
tacaagttgcagaaagttgttt

SEQ ID NO: 8110056 - DNA, 21 bp, Homo sapiens
tacaagttcatgttgaaggaa

SEQ ID NO: 8110057 - DNA, 22 bp, Homo sapiens
tacaagtcattggatgaggaat

SEQ ID NO: 8110058 - DNA, 23 bp, Homo sapiens
tacaaggtagcattagtttcttc

SEQ ID NO: 8110059 - DNA, 22 bp, Homo sapiens
tacaagtttcaaagagatcatg

SEQ ID NO: 8110060 - DNA, 22 bp, Homo sapiens
tacaagtttatccatcattgtt

SEQ ID NO: 8110061 - DNA, 22 bp, Homo sapiens
tacaggtaaaattatcagaaac

SEQ ID NO: 8110062 - DNA, 22 bp, Homo sapiens
tacaggtcttgccatggcaatg

SEQ ID NO: 8110063 - DNA, 22 bp, Homo sapiens
caggcaggagaggaggatttct

SEQ ID NO: 8110064 - DNA, 22 bp, Homo sapiens
taacaacttgcttttatcttag

SEQ ID NO: 8110065 - DNA, 22 bp, Homo sapiens
taacaactggacaatgttgctc

SEQ ID NO: 8110066 - DNA, 19 bp, Homo sapiens
taacaaagtctgaagtcag

SEQ ID NO: 8110067 - DNA, 22 bp, Homo sapiens
taacaactcagtttgttccttg

SEQ ID NO: 8110068 - DNA, 22 bp, Homo sapiens
taacaactcagtttgttccttg

SEQ ID NO: 8110069 - DNA, 22 bp, Homo sapiens
taacaatacccattctaattac

SEQ ID NO: 8110070 - DNA, 22 bp, Homo sapiens
taacagaaatagaaatgagagt

SEQ ID NO: 8110071 - DNA, 22 bp, Homo sapiens
taagaaacatttttatgacagt

SEQ ID NO: 8110072 - DNA, 19 bp, Homo sapiens
taagacacaaatgcaagcc

SEQ ID NO: 8110073 - DNA, 22 bp, Homo sapiens
taagcaaatagctagatcagag

SEQ ID NO: 8110074 - DNA, 22 bp, Homo sapiens
taagcaaataatgcatcaaggg

SEQ ID NO: 8110075 - DNA, 22 bp, Homo sapiens
taagcaaataatgcatcaaggg

SEQ ID NO: 8110076 - DNA, 22 bp, Homo sapiens
taagacacattgagaaacacaa

SEQ ID NO: 8110077 - DNA, 23 bp, Homo sapiens
taagacacccgactccagagatg

SEQ ID NO: 8110078 - DNA, 22 bp, Homo sapiens
taagacacatgcgtacaagata

SEQ ID NO: 8110079 - DNA, 22 bp, Homo sapiens
taagacacattcatatctgtct

SEQ ID NO: 8110080 - DNA, 22 bp, Homo sapiens
caggagctcttaaggatgtgat

SEQ ID NO: 8110081 - DNA, 22 bp, Homo sapiens
caggagatgacagggaagaacc

SEQ ID NO: 8110082 - DNA, 22 bp, Homo sapiens
taaatatcacctggaattgtta

SEQ ID NO: 8110083 - DNA, 22 bp, Homo sapiens
taaatatcagtccagctcttcc

SEQ ID NO: 8110084 - DNA, 22 bp, Homo sapiens
taaatcacatcgaaatctgggt

SEQ ID NO: 8110085 - DNA, 22 bp, Homo sapiens
taaatcaagaatatcagcttgt

SEQ ID NO: 8110086 - DNA, 22 bp, Homo sapiens
taaatcaagaatatcagcttgt

SEQ ID NO: 8110087 - DNA, 22 bp, Homo sapiens
taaatcacccatctcctaatct

SEQ ID NO: 8110088 - DNA, 22 bp, Homo sapiens
taaagccacgctggaaatcagg

SEQ ID NO: 8110089 - DNA, 22 bp, Homo sapiens
taaagtcatctttacatctttg

SEQ ID NO: 8110090 - DNA, 22 bp, Homo sapiens
taaagtcatctttacatctttg

SEQ ID NO: 8110091 - DNA, 22 bp, Homo sapiens
taaagtcatctttaaacatgcc

SEQ ID NO: 8110092 - DNA, 23 bp, Homo sapiens
taaagtcacatattagagtgagc

SEQ ID NO: 8110093 - DNA, 22 bp, Homo sapiens
taaagtcacagagcaggtgcaa

SEQ ID NO: 8110094 - DNA, 22 bp, Homo sapiens
taaagtcaaggtactgtttcac

SEQ ID NO: 8110095 - DNA, 22 bp, Homo sapiens
taaagtcagggagattgaggct

SEQ ID NO: 8110096 - DNA, 22 bp, Homo sapiens
taaagtcataagagtggatccg

SEQ ID NO: 8110097 - DNA, 22 bp, Homo sapiens
taacaaagtaccatagattggg

SEQ ID NO: 8110098 - DNA, 22 bp, Homo sapiens
caggaggcatcatggagcggac

SEQ ID NO: 8110099 - DNA, 22 bp, Homo sapiens
taaatgtcaatgtgatttataa

SEQ ID NO: 8110100 - DNA, 22 bp, Homo sapiens
caggaggaaagttccactcaac

SEQ ID NO: 8110101 - DNA, 22 bp, Homo sapiens
caggaggaaatgtgaccctgct

SEQ ID NO: 8110102 - DNA, 22 bp, Homo sapiens
caggaagctgtgaaggagacgg

SEQ ID NO: 8110103 - DNA, 22 bp, Homo sapiens
caggacagctcaacacctcctc

SEQ ID NO: 8110104 - DNA, 22 bp, Homo sapiens
caggacaaagccctttgagaaa

SEQ ID NO: 8110105 - DNA, 22 bp, Homo sapiens
caggacaatggtcatactggat

SEQ ID NO: 8110106 - DNA, 22 bp, Homo sapiens
caggacaacctcaggttgctgc

SEQ ID NO: 8110107 - DNA, 22 bp, Homo sapiens
caggacaatttccacttggtaa

SEQ ID NO: 8110108 - DNA, 22 bp, Homo sapiens
taaaatagcatgtgcagtgaaa

SEQ ID NO: 8110109 - DNA, 22 bp, Homo sapiens
gttttctcatctcctcaatggt

SEQ ID NO: 8110110 - DNA, 22 bp, Homo sapiens
taaaaagcagctgagattttct

SEQ ID NO: 8110111 - DNA, 22 bp, Homo sapiens
taaaaagtagtgagaatggcgc

SEQ ID NO: 8110112 - DNA, 22 bp, Homo sapiens
taaaaaacattactctgtcctg

SEQ ID NO: 8110113 - DNA, 22 bp, Homo sapiens
caggacagttggcatctgctgc

SEQ ID NO: 8110114 - DNA, 22 bp, Homo sapiens
taaactatctgtgtttgaagtt

SEQ ID NO: 8110115 - DNA, 22 bp, Homo sapiens
taaactactgggcaaggacagg

SEQ ID NO: 8110116 - DNA, 22 bp, Homo sapiens
taaactacccatgacagtttca

SEQ ID NO: 8110117 - DNA, 22 bp, Homo sapiens
tctgtcataaacacacacaagc

SEQ ID NO: 8110118 - DNA, 22 bp, Homo sapiens
ccaggaagcctcagatgctgag

SEQ ID NO: 8110119 - DNA, 22 bp, Homo sapiens
ccagcttctctctgatgcagct

SEQ ID NO: 8110120 - DNA, 22 bp, Homo sapiens
ccagcttcggcaagcagacttt

SEQ ID NO: 8110121 - DNA, 22 bp, Homo sapiens
ccaggaaccgatgatcagaggg

SEQ ID NO: 8110122 - DNA, 21 bp, Homo sapiens
ccaggaaggactgagctccct

SEQ ID NO: 8110123 - DNA, 22 bp, Homo sapiens
ccagctggtctgtgctcatgtt

SEQ ID NO: 8110124 - DNA, 22 bp, Homo sapiens
ccagctggggaagtggggcata

SEQ ID NO: 8110125 - DNA, 22 bp, Homo sapiens
ccagctggtaagtgatggagcc

SEQ ID NO: 8110126 - DNA, 22 bp, Homo sapiens
tctgcctgaaccactcttggag

SEQ ID NO: 8110127 - DNA, 22 bp, Homo sapiens
tctgcctctttcaggcctggca

SEQ ID NO: 8110128 - DNA, 19 bp, Homo sapiens
tctgcctctggtcaggctc

SEQ ID NO: 8110129 - DNA, 19 bp, Homo sapiens
tctgcctctggtcaggctc

SEQ ID NO: 8110130 - DNA, 22 bp, Homo sapiens
ccagcttcatgggcatgcacca

SEQ ID NO: 8110131 - DNA, 22 bp, Homo sapiens
tctgagagtctttcttcaagtg

SEQ ID NO: 8110132 - DNA, 20 bp, Homo sapiens
tctgagagtctgagtgatga

SEQ ID NO: 8110133 - DNA, 22 bp, Homo sapiens
ccagccctcactgaggcctctc

SEQ ID NO: 8110134 - DNA, 22 bp, Homo sapiens
ccagcccaaacaagccgccttc

SEQ ID NO: 8110135 - DNA, 21 bp, Homo sapiens
ccagcccagctgtgtcccagc

SEQ ID NO: 8110136 - DNA, 21 bp, Homo sapiens
ccagcccagcctccttctctt

SEQ ID NO: 8110137 - DNA, 22 bp, Homo sapiens
ccagccctacagtatcacctgt

SEQ ID NO: 8110138 - DNA, 22 bp, Homo sapiens
ccagcccgaatccctggccagg

SEQ ID NO: 8110139 - DNA, 23 bp, Homo sapiens
tctctcttagctatgcttatggc

SEQ ID NO: 8110140 - DNA, 22 bp, Homo sapiens
ccagccactgggccactgccag

SEQ ID NO: 8110141 - DNA, 22 bp, Homo sapiens
ccagctcctcttgtctctagca

SEQ ID NO: 8110142 - DNA, 22 bp, Homo sapiens
ccagctctcaaggctccctggg

SEQ ID NO: 8110143 - DNA, 22 bp, Homo sapiens
ccagctctagccccatgtggct

SEQ ID NO: 8110144 - DNA, 22 bp, Homo sapiens
ccagctctcagcgggagactca

SEQ ID NO: 8110145 - DNA, 22 bp, Homo sapiens
tctgccaccacctacactagta

SEQ ID NO: 8110146 - DNA, 20 bp, Homo sapiens
tctgccacgtctggtgactg

SEQ ID NO: 8110147 - DNA, 22 bp, Homo sapiens
tctgccagaagttctgagagta

SEQ ID NO: 8110148 - DNA, 22 bp, Homo sapiens
tctgccagaagccagggtctgg

SEQ ID NO: 8110149 - DNA, 22 bp, Homo sapiens
tctgccagaaccagtcaccgat

SEQ ID NO: 8110150 - DNA, 22 bp, Homo sapiens
tctgccacttacctccatgtac

SEQ ID NO: 8110151 - DNA, 22 bp, Homo sapiens
tctgccacttgaggtcattggc

SEQ ID NO: 8110152 - DNA, 22 bp, Homo sapiens
tctgccactgtggccatgggag

SEQ ID NO: 8110153 - DNA, 20 bp, Homo sapiens
tctgccactgcactctgccc

SEQ ID NO: 8110154 - DNA, 22 bp, Homo sapiens
tctgccactagtggttacctta

SEQ ID NO: 8110155 - DNA, 22 bp, Homo sapiens
tctgccagcttctggtggttgc

SEQ ID NO: 8110156 - DNA, 21 bp, Homo sapiens
tctgccagctgaagaggtgga

SEQ ID NO: 8110157 - DNA, 22 bp, Homo sapiens
tctgccaggcattgtgctgctc

SEQ ID NO: 8110158 - DNA, 22 bp, Homo sapiens
tctgcctcctgcttgtcccgac

SEQ ID NO: 8110159 - DNA, 22 bp, Homo sapiens
ccagcctggggaggcagcttct

SEQ ID NO: 8110160 - DNA, 22 bp, Homo sapiens
ccagcctcatcatattcctgct

SEQ ID NO: 8110161 - DNA, 22 bp, Homo sapiens
tctgagttgaggaaatgcattt

SEQ ID NO: 8110162 - DNA, 23 bp, Homo sapiens
tctgagttatgtccttacatttg

SEQ ID NO: 8110163 - DNA, 22 bp, Homo sapiens
tctgataaataacatttggaaa

SEQ ID NO: 8110164 - DNA, 22 bp, Homo sapiens
ccagcctttctattggtttctc

SEQ ID NO: 8110165 - DNA, 22 bp, Homo sapiens
ccagccttgggggatccaggac

SEQ ID NO: 8110166 - DNA, 22 bp, Homo sapiens
ccagccttgaatcagttgctgc

SEQ ID NO: 8110167 - DNA, 22 bp, Homo sapiens
ccagccttggctttcctagccc

SEQ ID NO: 8110168 - DNA, 22 bp, Homo sapiens
ccagcctgggtgttagaagaca

SEQ ID NO: 8110169 - DNA, 23 bp, Homo sapiens
ccagctcatccattacctctctt

SEQ ID NO: 8110170 - DNA, 22 bp, Homo sapiens
ccagcgcttcccatcagggagg

SEQ ID NO: 8110171 - DNA, 17 bp, Homo sapiens
ccacagcctggcacttg

SEQ ID NO: 8110172 - DNA, 22 bp, Homo sapiens
tcctgccaggagtgctggccct

SEQ ID NO: 8110173 - DNA, 22 bp, Homo sapiens
tcctgccatcccacccggctca

SEQ ID NO: 8110174 - DNA, 22 bp, Homo sapiens
tcctgccagcccacagactcat

SEQ ID NO: 8110175 - DNA, 22 bp, Homo sapiens
tcctgccaggagatggtagcca

SEQ ID NO: 8110176 - DNA, 22 bp, Homo sapiens
tcctgccagcaggaggtggcag

SEQ ID NO: 8110177 - DNA, 22 bp, Homo sapiens
tcctgccaaaatatccctacct

SEQ ID NO: 8110178 - DNA, 22 bp, Homo sapiens
tcctgccaccgggggtggcgat

SEQ ID NO: 8110179 - DNA, 22 bp, Homo sapiens
tcctgccaaagcatgtactggg

SEQ ID NO: 8110180 - DNA, 20 bp, Homo sapiens
tcctgccacacctcagttgc

SEQ ID NO: 8110181 - DNA, 22 bp, Homo sapiens
ccaaatcaggggccacaagcat

SEQ ID NO: 8110182 - DNA, 22 bp, Homo sapiens
ccacaagtttcagcacccagag

SEQ ID NO: 8110183 - DNA, 22 bp, Homo sapiens
ccaatttctgcctgagggcttt

SEQ ID NO: 8110184 - DNA, 22 bp, Homo sapiens
ccaagggcccttctaaaattct

SEQ ID NO: 8110185 - DNA, 22 bp, Homo sapiens
ccaagggccatcctatcacttg

SEQ ID NO: 8110186 - DNA, 22 bp, Homo sapiens
catttgacttgctttcccagct

SEQ ID NO: 8110187 - DNA, 22 bp, Homo sapiens
tccctgcctgacagcacccacc

SEQ ID NO: 8110188 - DNA, 22 bp, Homo sapiens
tccctgcctgacagcacccacc

SEQ ID NO: 8110189 - DNA, 20 bp, Homo sapiens
tccctgccttttactgctgg

SEQ ID NO: 8110190 - DNA, 19 bp, Homo sapiens
ccaaaagcaattccaagta

SEQ ID NO: 8110191 - DNA, 22 bp, Homo sapiens
ccaaaaattagatacacatata

SEQ ID NO: 8110192 - DNA, 21 bp, Homo sapiens
tccctgctttctggcccagtc

SEQ ID NO: 8110193 - DNA, 22 bp, Homo sapiens
tccctgcttgctctcagccctt

SEQ ID NO: 8110194 - DNA, 22 bp, Homo sapiens
tccctgctgcactcacacctac

SEQ ID NO: 8110195 - DNA, 22 bp, Homo sapiens
tcccagggccgcaaacgagttt

SEQ ID NO: 8110196 - DNA, 22 bp, Homo sapiens
catttatataaaatgtccagaa

SEQ ID NO: 8110197 - DNA, 22 bp, Homo sapiens
ccagagcctgctgagccccatt

SEQ ID NO: 8110198 - DNA, 22 bp, Homo sapiens
ccagaggagatgcctcctctgt

SEQ ID NO: 8110199 - DNA, 22 bp, Homo sapiens
ccagaggaggggggtctttctg

SEQ ID NO: 8110200 - DNA, 22 bp, Homo sapiens
ccagaggagttgaggctttggg

SEQ ID NO: 8110201 - DNA, 22 bp, Homo sapiens
ccactgccatgggctaggcatg

SEQ ID NO: 8110202 - DNA, 22 bp, Homo sapiens
ccactgccagctttgtcctccc

SEQ ID NO: 8110203 - DNA, 22 bp, Homo sapiens
ccactgccgtgggccttgggga

SEQ ID NO: 8110204 - DNA, 22 bp, Homo sapiens
ccactcttgaatcaagagctca

SEQ ID NO: 8110205 - DNA, 22 bp, Homo sapiens
ccacagggtcagccactctgca

SEQ ID NO: 8110206 - DNA, 22 bp, Homo sapiens
tataagtctggcatatgtatgc

SEQ ID NO: 8110207 - DNA, 22 bp, Homo sapiens
tataagtctggcatatgtatgc

SEQ ID NO: 8110208 - DNA, 22 bp, Homo sapiens
tataagatacttggcatagtgc

SEQ ID NO: 8110209 - DNA, 22 bp, Homo sapiens
caggggccggctgtccgtgccc

SEQ ID NO: 8110210 - DNA, 22 bp, Homo sapiens
caggggccaagggtccagacct

SEQ ID NO: 8110211 - DNA, 22 bp, Homo sapiens
caggggcctggctgtctaggaa

SEQ ID NO: 8110212 - DNA, 22 bp, Homo sapiens
tatacagttaagtttcttcagt

SEQ ID NO: 8110213 - DNA, 22 bp, Homo sapiens
tatgtttttaagagaatgcatt

SEQ ID NO: 8110214 - DNA, 22 bp, Homo sapiens
tatgtgtattgagcattgttac

SEQ ID NO: 8110215 - DNA, 22 bp, Homo sapiens
tattaaagagagaatcatcatc

SEQ ID NO: 8110216 - DNA, 22 bp, Homo sapiens
tattaaagggaagttatgcatg

SEQ ID NO: 8110217 - DNA, 22 bp, Homo sapiens
tattaaagagagaatcatcatc

SEQ ID NO: 8110218 - DNA, 22 bp, Homo sapiens
cagtctcagaggtgggagtggg

SEQ ID NO: 8110219 - DNA, 22 bp, Homo sapiens
cagtgagttcatcaagacatga

SEQ ID NO: 8110220 - DNA, 22 bp, Homo sapiens
cagtgagtaagtagacagctta

SEQ ID NO: 8110221 - DNA, 22 bp, Homo sapiens
cagtgattttctcagaacttga

SEQ ID NO: 8110222 - DNA, 22 bp, Homo sapiens
cagtgcagaacacatggaaaat

SEQ ID NO: 8110223 - DNA, 22 bp, Homo sapiens
tatttaccctggcagctgtagc

SEQ ID NO: 8110224 - DNA, 22 bp, Homo sapiens
tcaccagggctccagccagcct

SEQ ID NO: 8110225 - DNA, 22 bp, Homo sapiens
tcaccaggctggaatgcagtgg

SEQ ID NO: 8110226 - DNA, 22 bp, Homo sapiens
cagtgctgtgctggaagctgtt

SEQ ID NO: 8110227 - DNA, 19 bp, Homo sapiens
cagtgctgttcattcagtg

SEQ ID NO: 8110228 - DNA, 22 bp, Homo sapiens
cagtgctgttgggcccagagag

SEQ ID NO: 8110229 - DNA, 18 bp, Homo sapiens
cagtgctgttaacagtga

SEQ ID NO: 8110230 - DNA, 22 bp, Homo sapiens
cagtgctgttaataaacacaaa

SEQ ID NO: 8110231 - DNA, 22 bp, Homo sapiens
cagtgctgggcagaggagagcg

SEQ ID NO: 8110232 - DNA, 22 bp, Homo sapiens
cagtgctggctgttaggacagt

SEQ ID NO: 8110233 - DNA, 22 bp, Homo sapiens
cagtgctgacagggaggaacct

SEQ ID NO: 8110234 - DNA, 21 bp, Homo sapiens
cagtgctgcctaatagggagt

SEQ ID NO: 8110235 - DNA, 22 bp, Homo sapiens
tcacccagaaaagacagcagat

SEQ ID NO: 8110236 - DNA, 22 bp, Homo sapiens
tcactcagaaatagaatgaacc

SEQ ID NO: 8110237 - DNA, 22 bp, Homo sapiens
tcagaaaggttgagtcatgtgc

SEQ ID NO: 8110238 - DNA, 22 bp, Homo sapiens
tcagaaatcttgtcaaggcatc

SEQ ID NO: 8110239 - DNA, 22 bp, Homo sapiens
tcagaaatgatcgttattcatt

SEQ ID NO: 8110240 - DNA, 22 bp, Homo sapiens
tcagaaatgatcgttattcatt

SEQ ID NO: 8110241 - DNA, 22 bp, Homo sapiens
tcagaaatacaaaacacttact

SEQ ID NO: 8110242 - DNA, 22 bp, Homo sapiens
tcagaaatactatcagcttttg

SEQ ID NO: 8110243 - DNA, 22 bp, Homo sapiens
tcagaaattttctcagtagttc

SEQ ID NO: 8110244 - DNA, 22 bp, Homo sapiens
tcagaaattttctcagtagttc

SEQ ID NO: 8110245 - DNA, 22 bp, Homo sapiens
catactttttagatctgccttc

SEQ ID NO: 8110246 - DNA, 22 bp, Homo sapiens
catacttttgccctgacattct

SEQ ID NO: 8110247 - DNA, 22 bp, Homo sapiens
catacttttgccctgacattct

SEQ ID NO: 8110248 - DNA, 22 bp, Homo sapiens
tcagctgagctccagctcatag

SEQ ID NO: 8110249 - DNA, 22 bp, Homo sapiens
cagtttcttagtgacacaaatc

SEQ ID NO: 8110250 - DNA, 22 bp, Homo sapiens
cagtttcttaagactgagatct

SEQ ID NO: 8110251 - DNA, 22 bp, Homo sapiens
cagtttcttcatctgcagaatc

SEQ ID NO: 8110252 - DNA, 22 bp, Homo sapiens
cagtttcttcctcccccagaga

SEQ ID NO: 8110253 - DNA, 22 bp, Homo sapiens
cagtttcttcaattcagacact

SEQ ID NO: 8110254 - DNA, 22 bp, Homo sapiens
cagtttcttcatcagttaagca

SEQ ID NO: 8110255 - DNA, 22 bp, Homo sapiens
cagtttcttctattttgaacta

SEQ ID NO: 8110256 - DNA, 22 bp, Homo sapiens
cagtttcttggatgccaatttc

SEQ ID NO: 8110257 - DNA, 22 bp, Homo sapiens
cagtttctttccattgttacct

SEQ ID NO: 8110258 - DNA, 22 bp, Homo sapiens
cagtttctgtctgttcttatcc

SEQ ID NO: 8110259 - DNA, 22 bp, Homo sapiens
cagtttctgggcgttcacaggt

SEQ ID NO: 8110260 - DNA, 22 bp, Homo sapiens
cagtttctgccaggatgtgtta

SEQ ID NO: 8110261 - DNA, 22 bp, Homo sapiens
cagtttctgagccctgtcattt

SEQ ID NO: 8110262 - DNA, 22 bp, Homo sapiens
tcagaagtactgtgctacaata

SEQ ID NO: 8110263 - DNA, 22 bp, Homo sapiens
tcagaagtattatgctaaagga

SEQ ID NO: 8110264 - DNA, 22 bp, Homo sapiens
tcagaagtaggagacattcttg

SEQ ID NO: 8110265 - DNA, 22 bp, Homo sapiens
tcaggaagttttgaatcaactg

SEQ ID NO: 8110266 - DNA, 22 bp, Homo sapiens
catatacacttccacctctgtg

SEQ ID NO: 8110267 - DNA, 20 bp, Homo sapiens
catatatacctagaagtgga

SEQ ID NO: 8110268 - DNA, 22 bp, Homo sapiens
catatcaaagagaaggatagga

SEQ ID NO: 8110269 - DNA, 22 bp, Homo sapiens
catcacaggcattttgagtgtc

SEQ ID NO: 8110270 - DNA, 22 bp, Homo sapiens
catcacaaatgtaataatgtct

SEQ ID NO: 8110271 - DNA, 22 bp, Homo sapiens
tcagggcccagagctcaggcaa

SEQ ID NO: 8110272 - DNA, 22 bp, Homo sapiens
catgagtgtgccagtctgatat

SEQ ID NO: 8110273 - DNA, 22 bp, Homo sapiens
tcagtttatagatattgctgat

SEQ ID NO: 8110274 - DNA, 19 bp, Homo sapiens
catgatgagcatcctgcag

SEQ ID NO: 8110275 - DNA, 22 bp, Homo sapiens
catgattatgtgttagagtttg

SEQ ID NO: 8110276 - DNA, 22 bp, Homo sapiens
tcatttcaatgatactactaag

SEQ ID NO: 8110277 - DNA, 22 bp, Homo sapiens
tcatttgtttaggtagcaccat

SEQ ID NO: 8110278 - DNA, 18 bp, Homo sapiens
tcatttgttttgcatgaa

SEQ ID NO: 8110279 - DNA, 22 bp, Homo sapiens
tcatttcaagttctgacagcta

SEQ ID NO: 8110280 - DNA, 22 bp, Homo sapiens
catccctgccctcatgcctata

SEQ ID NO: 8110281 - DNA, 22 bp, Homo sapiens
catcttaaccctcagcctccca

SEQ ID NO: 8110282 - DNA, 17 bp, Homo sapiens
catcttaactatggact

SEQ ID NO: 8110283 - DNA, 22 bp, Homo sapiens
catcttaaattaaagcttaagg

SEQ ID NO: 8110284 - DNA, 22 bp, Homo sapiens
catcttaacaggtctctgaggg

SEQ ID NO: 8110285 - DNA, 21 bp, Homo sapiens
catcttaattgaaagcagaga

SEQ ID NO: 8110286 - DNA, 22 bp, Homo sapiens
catcttaataaatctcctccct

SEQ ID NO: 8110287 - DNA, 22 bp, Homo sapiens
catctttaaaggggagacaccc

SEQ ID NO: 8110288 - DNA, 22 bp, Homo sapiens
tcagttctaagtgctttacatg

SEQ ID NO: 8110289 - DNA, 22 bp, Homo sapiens
catctttagtaggttctggaga

SEQ ID NO: 8110290 - DNA, 20 bp, Homo sapiens
tccagcccagcagcctgaca

SEQ ID NO: 8110291 - DNA, 22 bp, Homo sapiens
tccagcccagctcctctcagaa

SEQ ID NO: 8110292 - DNA, 18 bp, Homo sapiens
tccagcccacattttctg

SEQ ID NO: 8110293 - DNA, 22 bp, Homo sapiens
tccagcccacacctgaagctgg

SEQ ID NO: 8110294 - DNA, 22 bp, Homo sapiens
catgtgacaggagcagctctaa

SEQ ID NO: 8110295 - DNA, 22 bp, Homo sapiens
catgtgcagggccaggcattgc

SEQ ID NO: 8110296 - DNA, 22 bp, Homo sapiens
catgattttgtcttgtgttaat

SEQ ID NO: 8110297 - DNA, 22 bp, Homo sapiens
catgcaaaatgtattttattag

SEQ ID NO: 8110298 - DNA, 18 bp, Homo sapiens
tcattttgtctgcctttg

SEQ ID NO: 8110299 - DNA, 22 bp, Homo sapiens
tcattttcacacataaatagca

SEQ ID NO: 8110300 - DNA, 22 bp, Homo sapiens
tcattttgcagagctgaggaac

SEQ ID NO: 8110301 - DNA, 22 bp, Homo sapiens
tgtgtcagaaatcagtgcctcg

SEQ ID NO: 8110302 - DNA, 22 bp, Homo sapiens
tgttaaaaatgcagattcctat

SEQ ID NO: 8110303 - DNA, 22 bp, Homo sapiens
tgtgggaggtctggaaggctcc

SEQ ID NO: 8110304 - DNA, 20 bp, Homo sapiens
tgtgggcccttggctggcaa

SEQ ID NO: 8110305 - DNA, 22 bp, Homo sapiens
tgtgggcctgggaaggtgacac

SEQ ID NO: 8110306 - DNA, 22 bp, Homo sapiens
tgtgggcctcagcaggactcca

SEQ ID NO: 8110307 - DNA, 22 bp, Homo sapiens
tgtgggccctaggcaccttgtc

SEQ ID NO: 8110308 - DNA, 22 bp, Homo sapiens
tgtgggcccagattctgaggct

SEQ ID NO: 8110309 - DNA, 22 bp, Homo sapiens
tgtgggctgtactgagggcagg

SEQ ID NO: 8110310 - DNA, 22 bp, Homo sapiens
tgtgggctctaatggcagcaga

SEQ ID NO: 8110311 - DNA, 20 bp, Homo sapiens
tgtgggccttcggcgtgctc

SEQ ID NO: 8110312 - DNA, 22 bp, Homo sapiens
tgtgggctttggagtcaggaag

SEQ ID NO: 8110313 - DNA, 22 bp, Homo sapiens
tgtgtacaaatttagccagcag

SEQ ID NO: 8110314 - DNA, 22 bp, Homo sapiens
tgtgtacatatacacaaataca

SEQ ID NO: 8110315 - DNA, 23 bp, Homo sapiens
tgtgtacatacatatgtacacac

SEQ ID NO: 8110316 - DNA, 22 bp, Homo sapiens
tgtgtacagcatggtccagcag

SEQ ID NO: 8110317 - DNA, 22 bp, Homo sapiens
tgtgggaggaattagaatggga

SEQ ID NO: 8110318 - DNA, 22 bp, Homo sapiens
tgtgggagaaggaagcaagctg

SEQ ID NO: 8110319 - DNA, 23 bp, Homo sapiens
tgtgggaatgttggagaggaaac

SEQ ID NO: 8110320 - DNA, 22 bp, Homo sapiens
tgtgggaatgacgaggaagagg

SEQ ID NO: 8110321 - DNA, 21 bp, Homo sapiens
tgtggctgcctctggccctgg

SEQ ID NO: 8110322 - DNA, 22 bp, Homo sapiens
tgtggcctttcaaggatggaat

SEQ ID NO: 8110323 - DNA, 22 bp, Homo sapiens
tgtggccttgcagcctggaggt

SEQ ID NO: 8110324 - DNA, 22 bp, Homo sapiens
tgtggctctcctcctgctgccc

SEQ ID NO: 8110325 - DNA, 22 bp, Homo sapiens
tgttttaagagcgcactttata

SEQ ID NO: 8110326 - DNA, 22 bp, Homo sapiens
tgttttaagggtcaactgtcac

SEQ ID NO: 8110327 - DNA, 22 bp, Homo sapiens
tgttttaatctcccattgctct

SEQ ID NO: 8110328 - DNA, 22 bp, Homo sapiens
tgttttaatctcccattgctct

SEQ ID NO: 8110329 - DNA, 22 bp, Homo sapiens
tgttttatgagccatataacct

SEQ ID NO: 8110330 - DNA, 22 bp, Homo sapiens
tgttttagttctgtcttgcatg

SEQ ID NO: 8110331 - DNA, 22 bp, Homo sapiens
tgtttcaaaacagtgataattt

SEQ ID NO: 8110332 - DNA, 22 bp, Homo sapiens
tgtttgtgctgcctggtgggca

SEQ ID NO: 8110333 - DNA, 22 bp, Homo sapiens
ttaaacagtatatctgagcaag

SEQ ID NO: 8110334 - DNA, 22 bp, Homo sapiens
ttaaaccatagtttaacataag

SEQ ID NO: 8110335 - DNA, 20 bp, Homo sapiens
ttaaaaagagtcacaggaga

SEQ ID NO: 8110336 - DNA, 22 bp, Homo sapiens
ttaaaaatatgtagggcccgat

SEQ ID NO: 8110337 - DNA, 22 bp, Homo sapiens
ttaaaaaccatcttcctttcct

SEQ ID NO: 8110338 - DNA, 22 bp, Homo sapiens
tgtttactcctgatatattttt

SEQ ID NO: 8110339 - DNA, 22 bp, Homo sapiens
tgtttactgcattctatttgct

SEQ ID NO: 8110340 - DNA, 20 bp, Homo sapiens
tgtttactctagagggtaga

SEQ ID NO: 8110341 - DNA, 21 bp, Homo sapiens
tgtttactccctgcaagcacg

SEQ ID NO: 8110342 - DNA, 22 bp, Homo sapiens
tgttgtagcttgacagcagcca

SEQ ID NO: 8110343 - DNA, 22 bp, Homo sapiens
tgttgtttctactaataggcca

SEQ ID NO: 8110344 - DNA, 22 bp, Homo sapiens
tgtttatgcatcgttaatacca

SEQ ID NO: 8110345 - DNA, 22 bp, Homo sapiens
tgtttattcatggctaatgaaa

SEQ ID NO: 8110346 - DNA, 22 bp, Homo sapiens
tgttctttagcagaccatgttg

SEQ ID NO: 8110347 - DNA, 22 bp, Homo sapiens
tgttcttatgatgaagcactga

SEQ ID NO: 8110348 - DNA, 22 bp, Homo sapiens
tgttctttggcttcctttccgt

SEQ ID NO: 8110349 - DNA, 22 bp, Homo sapiens
tgttctttggcttcctttccgt

SEQ ID NO: 8110350 - DNA, 22 bp, Homo sapiens
tgttcttaacttttgtgtatat

SEQ ID NO: 8110351 - DNA, 22 bp, Homo sapiens
tgttcttacggaacttatcttt

SEQ ID NO: 8110352 - DNA, 22 bp, Homo sapiens
tgttcttagcaggagcatctat

SEQ ID NO: 8110353 - DNA, 22 bp, Homo sapiens
tgttcttacggaacttatcttt

SEQ ID NO: 8110354 - DNA, 22 bp, Homo sapiens
tgttcttaggtatttgacagtc

SEQ ID NO: 8110355 - DNA, 22 bp, Homo sapiens
tgttcttatgaattcaagacac

SEQ ID NO: 8110356 - DNA, 22 bp, Homo sapiens
tgttcttatgatgaagcactga

SEQ ID NO: 8110357 - DNA, 22 bp, Homo sapiens
tgttagctgtgctttagccttc

SEQ ID NO: 8110358 - DNA, 22 bp, Homo sapiens
tgttacatcgttggctaggaga

SEQ ID NO: 8110359 - DNA, 22 bp, Homo sapiens
tgttacagtggctttttaaaca

SEQ ID NO: 8110360 - DNA, 22 bp, Homo sapiens
tgtcttttctactgtaagcata

SEQ ID NO: 8110361 - DNA, 22 bp, Homo sapiens
tgtcttctgtattcaagtctat

SEQ ID NO: 8110362 - DNA, 22 bp, Homo sapiens
tgtctttaagcaaacagtgttt

SEQ ID NO: 8110363 - DNA, 20 bp, Homo sapiens
tgtctgtgccacggcactcc

SEQ ID NO: 8110364 - DNA, 22 bp, Homo sapiens
tgtctgtgcccaaggctcccgg

SEQ ID NO: 8110365 - DNA, 22 bp, Homo sapiens
tgtctgttattggtgtataaga

SEQ ID NO: 8110366 - DNA, 22 bp, Homo sapiens
tgtctgggatgttggcagccac

SEQ ID NO: 8110367 - DNA, 22 bp, Homo sapiens
tgtctgctgccctggagcctgg

SEQ ID NO: 8110368 - DNA, 22 bp, Homo sapiens
tgtctcctactgcctgtggatc

SEQ ID NO: 8110369 - DNA, 22 bp, Homo sapiens
tgtctccattttcaagtagcag

SEQ ID NO: 8110370 - DNA, 22 bp, Homo sapiens
tgtctacagaatgttaatattt

SEQ ID NO: 8110371 - DNA, 22 bp, Homo sapiens
tgtctacttgggctctacagca

SEQ ID NO: 8110372 - DNA, 20 bp, Homo sapiens
tgtctgctgagctgctgccc

SEQ ID NO: 8110373 - DNA, 22 bp, Homo sapiens
tgtctctgctttccttgcaggg

SEQ ID NO: 8110374 - DNA, 22 bp, Homo sapiens
tgtgaaatgtgtgtataattaa

SEQ ID NO: 8110375 - DNA, 22 bp, Homo sapiens
tgtgaatggacaattaaatcta

SEQ ID NO: 8110376 - DNA, 22 bp, Homo sapiens
tgtgacagaattggtctgttct

SEQ ID NO: 8110377 - DNA, 21 bp, Homo sapiens
tgtgacagaggcggtgcctac

SEQ ID NO: 8110378 - DNA, 22 bp, Homo sapiens
tgtgacagatctctatacatga

SEQ ID NO: 8110379 - DNA, 22 bp, Homo sapiens
tgtgacagttagtttggtgtta

SEQ ID NO: 8110380 - DNA, 22 bp, Homo sapiens
tgtgacagtaacttgggatgga

SEQ ID NO: 8110381 - DNA, 22 bp, Homo sapiens
tgtgacagtcgttaggagctca

SEQ ID NO: 8110382 - DNA, 23 bp, Homo sapiens
tgtgacagggtcattgaaaaggg

SEQ ID NO: 8110383 - DNA, 22 bp, Homo sapiens
tgtgacaggaactatgtggatg

SEQ ID NO: 8110384 - DNA, 22 bp, Homo sapiens
tgtgatcaggtgatcatgtgag

SEQ ID NO: 8110385 - DNA, 19 bp, Homo sapiens
tgtgatattgttagtaata

SEQ ID NO: 8110386 - DNA, 22 bp, Homo sapiens
tgtgatcattgctaacatccat

SEQ ID NO: 8110387 - DNA, 22 bp, Homo sapiens
tgtgatttattgaaaagagctt

SEQ ID NO: 8110388 - DNA, 22 bp, Homo sapiens
tgtgattactgaatagaaaata

SEQ ID NO: 8110389 - DNA, 22 bp, Homo sapiens
tgtgattagctgaatacactgg

SEQ ID NO: 8110390 - DNA, 22 bp, Homo sapiens
tgtgattatttgattaacatgt

SEQ ID NO: 8110391 - DNA, 22 bp, Homo sapiens
tgtgattatattgtagtacatt

SEQ ID NO: 8110392 - DNA, 22 bp, Homo sapiens
tgtgagcaagattcagagattc

SEQ ID NO: 8110393 - DNA, 22 bp, Homo sapiens
tgtgactatcattctaaacatc

SEQ ID NO: 8110394 - DNA, 22 bp, Homo sapiens
tgtgcctgttcccactttgcct

SEQ ID NO: 8110395 - DNA, 20 bp, Homo sapiens
tgtgcctggctttgtcctga

SEQ ID NO: 8110396 - DNA, 22 bp, Homo sapiens
tgtgcctggtccctgagtcgag

SEQ ID NO: 8110397 - DNA, 22 bp, Homo sapiens
tgtgcctgtcccgcattctggt

SEQ ID NO: 8110398 - DNA, 22 bp, Homo sapiens
tgtgcgggtgcgcatgcagagg

SEQ ID NO: 8110399 - DNA, 22 bp, Homo sapiens
tgtgcctttcttcccaagtaga

SEQ ID NO: 8110400 - DNA, 22 bp, Homo sapiens
tgtgccttcctctgagcttgtc

SEQ ID NO: 8110401 - DNA, 22 bp, Homo sapiens
tgtgccttctcagtcctgctca

SEQ ID NO: 8110402 - DNA, 22 bp, Homo sapiens
tgtgcctggatctctgtgacaa

SEQ ID NO: 8110403 - DNA, 22 bp, Homo sapiens
tgtgcctggcattctgggcttc

SEQ ID NO: 8110404 - DNA, 22 bp, Homo sapiens
tgtgcctgatggtcacgtggcc

SEQ ID NO: 8110405 - DNA, 22 bp, Homo sapiens
tgtgctctacctcagtgtcatt

SEQ ID NO: 8110406 - DNA, 22 bp, Homo sapiens
tgtgctctgcaatcagttcttt

SEQ ID NO: 8110407 - DNA, 22 bp, Homo sapiens
tgtgcaggtgcaggaagggggc

SEQ ID NO: 8110408 - DNA, 22 bp, Homo sapiens
tgtgcagagtaaggcagctgtt

SEQ ID NO: 8110409 - DNA, 22 bp, Homo sapiens
tgtgcagagcccacaggcagct

SEQ ID NO: 8110410 - DNA, 22 bp, Homo sapiens
tgtgcagagtaaggcagctgtt

SEQ ID NO: 8110411 - DNA, 22 bp, Homo sapiens
tgtgcagagttgaagacaggag

SEQ ID NO: 8110412 - DNA, 22 bp, Homo sapiens
tgtgcctctgcctcatgccctg

SEQ ID NO: 8110413 - DNA, 22 bp, Homo sapiens
ttcagcttgctgactgcggcag

SEQ ID NO: 8110414 - DNA, 22 bp, Homo sapiens
ttcaggaaatttgtgtcacagg

SEQ ID NO: 8110415 - DNA, 22 bp, Homo sapiens
ttcagcaggtggtgagttctgc

SEQ ID NO: 8110416 - DNA, 19 bp, Homo sapiens
ttcagcaggctgaagcttc

SEQ ID NO: 8110417 - DNA, 21 bp, Homo sapiens
ttcagcagtcctctagagata

SEQ ID NO: 8110418 - DNA, 21 bp, Homo sapiens
ttcagcagtcctctagagata

SEQ ID NO: 8110419 - DNA, 22 bp, Homo sapiens
ttcagcagcttttagtacattg

SEQ ID NO: 8110420 - DNA, 22 bp, Homo sapiens
ttcagcaggcggtagctgccac

SEQ ID NO: 8110421 - DNA, 22 bp, Homo sapiens
ttcagcagtgcagacacccagt

SEQ ID NO: 8110422 - DNA, 22 bp, Homo sapiens
ttcagcagtcgtccaggaaaag

SEQ ID NO: 8110423 - DNA, 22 bp, Homo sapiens
ttcagcagttcctattagatgt

SEQ ID NO: 8110424 - DNA, 22 bp, Homo sapiens
ttcagcagtttctgagaagcaa

SEQ ID NO: 8110425 - DNA, 22 bp, Homo sapiens
ttcagcagtttctgagaagcaa

SEQ ID NO: 8110426 - DNA, 22 bp, Homo sapiens
ttatttctactattttgcctga

SEQ ID NO: 8110427 - DNA, 20 bp, Homo sapiens
ttatttctcattctcctact

SEQ ID NO: 8110428 - DNA, 22 bp, Homo sapiens
ttatttcctgacacagctgatt

SEQ ID NO: 8110429 - DNA, 22 bp, Homo sapiens
ttatttgacttcttgctatgct

SEQ ID NO: 8110430 - DNA, 22 bp, Homo sapiens
ttcaccactttgcaccaggcct

SEQ ID NO: 8110431 - DNA, 22 bp, Homo sapiens
ttcaccagcagctcactagtca

SEQ ID NO: 8110432 - DNA, 22 bp, Homo sapiens
ttcacattgttttaatgtgaat

SEQ ID NO: 8110433 - DNA, 23 bp, Homo sapiens
ttcattcaaaaggaaaagtcatg

SEQ ID NO: 8110434 - DNA, 19 bp, Homo sapiens
ttcattctttctacttacc

SEQ ID NO: 8110435 - DNA, 22 bp, Homo sapiens
ttcattgaaatacagtcttgac

SEQ ID NO: 8110436 - DNA, 22 bp, Homo sapiens
ttccagaggcctgggcacactc

SEQ ID NO: 8110437 - DNA, 22 bp, Homo sapiens
ttccagaggctctaggggagaa

SEQ ID NO: 8110438 - DNA, 20 bp, Homo sapiens
ttccagccgccacttccgcc

SEQ ID NO: 8110439 - DNA, 23 bp, Homo sapiens
ttccagagtccacatctgccacc

SEQ ID NO: 8110440 - DNA, 22 bp, Homo sapiens
ttccagagtattggtagctata

SEQ ID NO: 8110441 - DNA, 22 bp, Homo sapiens
ttccagagttgggggagtggtt

SEQ ID NO: 8110442 - DNA, 22 bp, Homo sapiens
ttccagaggggaggtggcagcc

SEQ ID NO: 8110443 - DNA, 22 bp, Homo sapiens
ttacaaagtgttatgataaaca

SEQ ID NO: 8110444 - DNA, 22 bp, Homo sapiens
ttaattaaattcatgagcattg

SEQ ID NO: 8110445 - DNA, 22 bp, Homo sapiens
ttaattaattagttaagcatgt

SEQ ID NO: 8110446 - DNA, 22 bp, Homo sapiens
ttaattaagagatactgcagta

SEQ ID NO: 8110447 - DNA, 22 bp, Homo sapiens
ttacaaagagaagttgtagaat

SEQ ID NO: 8110448 - DNA, 20 bp, Homo sapiens
ttacaaagaggcatcgcttt

SEQ ID NO: 8110449 - DNA, 22 bp, Homo sapiens
ttaattaattagttaagcatgt

SEQ ID NO: 8110450 - DNA, 22 bp, Homo sapiens
ttacaactttcctgtgtcaaat

SEQ ID NO: 8110451 - DNA, 22 bp, Homo sapiens
ttacaactctgaactacagagg

SEQ ID NO: 8110452 - DNA, 22 bp, Homo sapiens
ttacaacatatttagcttgatt

SEQ ID NO: 8110453 - DNA, 22 bp, Homo sapiens
ttaataaagtatgaattggaaa

SEQ ID NO: 8110454 - DNA, 22 bp, Homo sapiens
ttaaagcaaccatcaatttgga

SEQ ID NO: 8110455 - DNA, 22 bp, Homo sapiens
ttaatacagaagcaagacactg

SEQ ID NO: 8110456 - DNA, 22 bp, Homo sapiens
ttaatacagtctccagaagtaa

SEQ ID NO: 8110457 - DNA, 22 bp, Homo sapiens
ttaatacagtctccagaagtaa

SEQ ID NO: 8110458 - DNA, 22 bp, Homo sapiens
ttaatacaagcatatgcacaca

SEQ ID NO: 8110459 - DNA, 22 bp, Homo sapiens
ttaatacaagcatatgcacaca

SEQ ID NO: 8110460 - DNA, 22 bp, Homo sapiens
ttaataacattgtgtatcaccc

SEQ ID NO: 8110461 - DNA, 22 bp, Homo sapiens
ttaataaagtatgaattggaaa

SEQ ID NO: 8110462 - DNA, 22 bp, Homo sapiens
ttaataagtagtagttattgtt

SEQ ID NO: 8110463 - DNA, 22 bp, Homo sapiens
ttacacaaaaataagatatggc

SEQ ID NO: 8110464 - DNA, 22 bp, Homo sapiens
ttacacaaaaataagatatggc

SEQ ID NO: 8110465 - DNA, 22 bp, Homo sapiens
ttacacaaacacattccagata

SEQ ID NO: 8110466 - DNA, 22 bp, Homo sapiens
ttacagatactttgtaggcaag

SEQ ID NO: 8110467 - DNA, 22 bp, Homo sapiens
ttacaagtactgaatatgattt

SEQ ID NO: 8110468 - DNA, 22 bp, Homo sapiens
ttacaagggtcagtgtgtttgt

SEQ ID NO: 8110469 - DNA, 22 bp, Homo sapiens
ttacaaggtaagttgttaagtc

SEQ ID NO: 8110470 - DNA, 22 bp, Homo sapiens
ttacaaggaggatagcatttcc

SEQ ID NO: 8110471 - DNA, 23 bp, Homo sapiens
ttacaaggaagtgcacagatggg

SEQ ID NO: 8110472 - DNA, 22 bp, Homo sapiens
ttacaagcagctacatatcaca

SEQ ID NO: 8110473 - DNA, 22 bp, Homo sapiens
ttacagatggatctagcaaaat

SEQ ID NO: 8110474 - DNA, 22 bp, Homo sapiens
ttacagatggggttgcaataaa

SEQ ID NO: 8110475 - DNA, 22 bp, Homo sapiens
ttacagcacagtgcttttactg

SEQ ID NO: 8110476 - DNA, 22 bp, Homo sapiens
ttacagatgtttcaggaatact

SEQ ID NO: 8110477 - DNA, 22 bp, Homo sapiens
ttagggttacaccagcctcctg

SEQ ID NO: 8110478 - DNA, 22 bp, Homo sapiens
ttagtaaataaagtctactttc

SEQ ID NO: 8110479 - DNA, 22 bp, Homo sapiens
ttaggaagagctttcaatcact

SEQ ID NO: 8110480 - DNA, 22 bp, Homo sapiens
ttagataacagtagaatatcaa

SEQ ID NO: 8110481 - DNA, 22 bp, Homo sapiens
ttagataatgtagagatatgag

SEQ ID NO: 8110482 - DNA, 22 bp, Homo sapiens
ttagatacctttgtgttgtaga

SEQ ID NO: 8110483 - DNA, 22 bp, Homo sapiens
ttacattttggggtaaggataa

SEQ ID NO: 8110484 - DNA, 22 bp, Homo sapiens
ttagaaaggaatcttcatttca

SEQ ID NO: 8110485 - DNA, 22 bp, Homo sapiens
ttagaaaggcttatggtgcctt

SEQ ID NO: 8110486 - DNA, 22 bp, Homo sapiens
ttagaaagggtgtctgaatctg

SEQ ID NO: 8110487 - DNA, 22 bp, Homo sapiens
ttagaacaatattctccctaca

SEQ ID NO: 8110488 - DNA, 22 bp, Homo sapiens
ttatgatttgccacagattggt

SEQ ID NO: 8110489 - DNA, 22 bp, Homo sapiens
ttatgatttgccacagattggt

SEQ ID NO: 8110490 - DNA, 22 bp, Homo sapiens
ttatgaaaacaatcagtaggca

SEQ ID NO: 8110491 - DNA, 22 bp, Homo sapiens
ttatatgtttctgtttggaggc

SEQ ID NO: 8110492 - DNA, 18 bp, Homo sapiens
ttatctctggcatgtgcc

SEQ ID NO: 8110493 - DNA, 19 bp, Homo sapiens
ttatctgtgttgcagtggt

SEQ ID NO: 8110494 - DNA, 22 bp, Homo sapiens
ttattcattaacagggaccaaa

SEQ ID NO: 8110495 - DNA, 22 bp, Homo sapiens
ttattcatcagtgcattaattt

SEQ ID NO: 8110496 - DNA, 22 bp, Homo sapiens
ttattcagggataacatccagg

SEQ ID NO: 8110497 - DNA, 22 bp, Homo sapiens
ttattattggtgagttaaggaa

SEQ ID NO: 8110498 - DNA, 22 bp, Homo sapiens
ttattcaggtcatggactgtca

SEQ ID NO: 8110499 - DNA, 22 bp, Homo sapiens
tgggcagagagtagaggcaacg

SEQ ID NO: 8110500 - DNA, 22 bp, Homo sapiens
tgggcagaggacagggaagatc

SEQ ID NO: 8110501 - DNA, 22 bp, Homo sapiens
tgggcagaggacagggaagatc

SEQ ID NO: 8110502 - DNA, 22 bp, Homo sapiens
tgggcagagtcatacaggagac

SEQ ID NO: 8110503 - DNA, 22 bp, Homo sapiens
tgggcagagtagctcagaagaa

SEQ ID NO: 8110504 - DNA, 22 bp, Homo sapiens
tgggaggcttccagaccttgct

SEQ ID NO: 8110505 - DNA, 22 bp, Homo sapiens
tgggaggccgaggcaggtggat

SEQ ID NO: 8110506 - DNA, 22 bp, Homo sapiens
tgggaggcccaggcctggcagg

SEQ ID NO: 8110507 - DNA, 22 bp, Homo sapiens
tgggaggcaggtaggtgatgat

SEQ ID NO: 8110508 - DNA, 22 bp, Homo sapiens
tgggaggccaaggcaggcggat

SEQ ID NO: 8110509 - DNA, 23 bp, Homo sapiens
tgggatggattcaccagtgtgct

SEQ ID NO: 8110510 - DNA, 22 bp, Homo sapiens
tgggcagatgtggctctccttg

SEQ ID NO: 8110511 - DNA, 22 bp, Homo sapiens
tgggcagattaatgcagtggct

SEQ ID NO: 8110512 - DNA, 21 bp, Homo sapiens
tgggcagatggcagtgtggct

SEQ ID NO: 8110513 - DNA, 22 bp, Homo sapiens
tgggcagatctttggtggctag

SEQ ID NO: 8110514 - DNA, 22 bp, Homo sapiens
tgggcagcagcaaagccagact

SEQ ID NO: 8110515 - DNA, 22 bp, Homo sapiens
tgggcagggagctggaaccaca

SEQ ID NO: 8110516 - DNA, 19 bp, Homo sapiens
tgggcaggttcagtaatgg

SEQ ID NO: 8110517 - DNA, 18 bp, Homo sapiens
tgggcctgcatcctagtc

SEQ ID NO: 8110518 - DNA, 19 bp, Homo sapiens
tgggcctgcatctgggtct

SEQ ID NO: 8110519 - DNA, 22 bp, Homo sapiens
tgggcctgggtctttgctgcca

SEQ ID NO: 8110520 - DNA, 22 bp, Homo sapiens
tgggcctgggctcctgtcctct

SEQ ID NO: 8110521 - DNA, 23 bp, Homo sapiens
tgggcctggaaagccttagagag

SEQ ID NO: 8110522 - DNA, 22 bp, Homo sapiens
tgggcctggacaaggccactag

SEQ ID NO: 8110523 - DNA, 22 bp, Homo sapiens
tgggcctggacaaggccactag

SEQ ID NO: 8110524 - DNA, 22 bp, Homo sapiens
tgggcctgggctcctgtcctct

SEQ ID NO: 8110525 - DNA, 20 bp, Homo sapiens
tgggcctgagcctgtgggct

SEQ ID NO: 8110526 - DNA, 22 bp, Homo sapiens
tgggcctgacacttactaggga

SEQ ID NO: 8110527 - DNA, 22 bp, Homo sapiens
tgggcctgactcacctgcctcc

SEQ ID NO: 8110528 - DNA, 22 bp, Homo sapiens
tgggcctgagctcaccaggggc

SEQ ID NO: 8110529 - DNA, 22 bp, Homo sapiens
tgggcctgagtttgggaactgg

SEQ ID NO: 8110530 - DNA, 21 bp, Homo sapiens
tgggcctgattcccagggtca

SEQ ID NO: 8110531 - DNA, 22 bp, Homo sapiens
tgggcctgaaattcccatttta

SEQ ID NO: 8110532 - DNA, 22 bp, Homo sapiens
tgggcctgaaggagctgcgccc

SEQ ID NO: 8110533 - DNA, 22 bp, Homo sapiens
tgggcctctgtttcctcatctg

SEQ ID NO: 8110534 - DNA, 20 bp, Homo sapiens
tgggcctctggtgcctctgg

SEQ ID NO: 8110535 - DNA, 22 bp, Homo sapiens
tgggcctctgccacgctccccc

SEQ ID NO: 8110536 - DNA, 22 bp, Homo sapiens
tgggcctctgggttagtcccta

SEQ ID NO: 8110537 - DNA, 22 bp, Homo sapiens
tgggcctcggggaagcccgtgt

SEQ ID NO: 8110538 - DNA, 19 bp, Homo sapiens
tgggcctctcatatctgcc

SEQ ID NO: 8110539 - DNA, 22 bp, Homo sapiens
tgggcctcctttccattcagag

SEQ ID NO: 8110540 - DNA, 21 bp, Homo sapiens
tgggcctcaggcagctgtgac

SEQ ID NO: 8110541 - DNA, 21 bp, Homo sapiens
tgggcctcaggcagctgtgac

SEQ ID NO: 8110542 - DNA, 22 bp, Homo sapiens
tgggcctcatgcccagccaccc

SEQ ID NO: 8110543 - DNA, 22 bp, Homo sapiens
tgggcctcagtttccttaggat

SEQ ID NO: 8110544 - DNA, 22 bp, Homo sapiens
tgggcctcaccttcttggcagc

SEQ ID NO: 8110545 - DNA, 22 bp, Homo sapiens
tgggcctcatcttcaatgagtc

SEQ ID NO: 8110546 - DNA, 22 bp, Homo sapiens
tgggcctcctccgacagccggg

SEQ ID NO: 8110547 - DNA, 22 bp, Homo sapiens
tgggcctcctgccctggcctag

SEQ ID NO: 8110548 - DNA, 22 bp, Homo sapiens
tgggcctcccatgtcttaggga

SEQ ID NO: 8110549 - DNA, 22 bp, Homo sapiens
tgggccagggcacccagtccag

SEQ ID NO: 8110550 - DNA, 22 bp, Homo sapiens
tgggccaggtctgtgtcagctg

SEQ ID NO: 8110551 - DNA, 22 bp, Homo sapiens
tgggccaggggcctcttctgat

SEQ ID NO: 8110552 - DNA, 22 bp, Homo sapiens
tgggccaggtctgcggtcattt

SEQ ID NO: 8110553 - DNA, 22 bp, Homo sapiens
tgggccaggtgcagtgctttag

SEQ ID NO: 8110554 - DNA, 22 bp, Homo sapiens
tgggcctgtgatgctgggctat

SEQ ID NO: 8110555 - DNA, 21 bp, Homo sapiens
tgggcctgtccctcttggagg

SEQ ID NO: 8110556 - DNA, 22 bp, Homo sapiens
tgggcctgggttcctcctgggc

SEQ ID NO: 8110557 - DNA, 22 bp, Homo sapiens
tgggcctgtggcttggctctag

SEQ ID NO: 8110558 - DNA, 20 bp, Homo sapiens
tgggcctgtggcagaagtct

SEQ ID NO: 8110559 - DNA, 22 bp, Homo sapiens
tgggccttacttggggctgact

SEQ ID NO: 8110560 - DNA, 22 bp, Homo sapiens
tgggccttctaatctggtccct

SEQ ID NO: 8110561 - DNA, 22 bp, Homo sapiens
tgggccttctaatctggtccct

SEQ ID NO: 8110562 - DNA, 22 bp, Homo sapiens
tgggccttctcaatgcactgga

SEQ ID NO: 8110563 - DNA, 22 bp, Homo sapiens
tgggccttggatcgctaagctg

SEQ ID NO: 8110564 - DNA, 22 bp, Homo sapiens
tgggccttgtcccctcagctgt

SEQ ID NO: 8110565 - DNA, 22 bp, Homo sapiens
tgggcctgttgcctgagtccat

SEQ ID NO: 8110566 - DNA, 22 bp, Homo sapiens
tgggcctgtttcccttcagggc

SEQ ID NO: 8110567 - DNA, 22 bp, Homo sapiens
tgggcctgtttcccttcagggc

SEQ ID NO: 8110568 - DNA, 22 bp, Homo sapiens
tgggctcaggaccccagaggcc

SEQ ID NO: 8110569 - DNA, 22 bp, Homo sapiens
tgggctcagtctgcacctgcgg

SEQ ID NO: 8110570 - DNA, 22 bp, Homo sapiens
tgggctcagggaagcttggcct

SEQ ID NO: 8110571 - DNA, 22 bp, Homo sapiens
tgggctcagccttcatgtggcc

SEQ ID NO: 8110572 - DNA, 22 bp, Homo sapiens
tgggctcagcctcagtctgtgg

SEQ ID NO: 8110573 - DNA, 22 bp, Homo sapiens
tgggctcagccatgacctccac

SEQ ID NO: 8110574 - DNA, 22 bp, Homo sapiens
tgggctcactggggcagggacc

SEQ ID NO: 8110575 - DNA, 22 bp, Homo sapiens
tgggctcagaagatagtttcca

SEQ ID NO: 8110576 - DNA, 21 bp, Homo sapiens
tgggcgcttgacctctgcact

SEQ ID NO: 8110577 - DNA, 22 bp, Homo sapiens
tgggctcaatctgcttctgttt

SEQ ID NO: 8110578 - DNA, 22 bp, Homo sapiens
tgggctcaaactggaggttgtt

SEQ ID NO: 8110579 - DNA, 22 bp, Homo sapiens
tgggctgccctgatggtcctca

SEQ ID NO: 8110580 - DNA, 22 bp, Homo sapiens
tgggctgccggcaggctctgcc

SEQ ID NO: 8110581 - DNA, 21 bp, Homo sapiens
tgggctctttaacccaggcac

SEQ ID NO: 8110582 - DNA, 22 bp, Homo sapiens
tgggctctggtttcctggctgg

SEQ ID NO: 8110583 - DNA, 22 bp, Homo sapiens
tgggctctgggtggcctgagca

SEQ ID NO: 8110584 - DNA, 22 bp, Homo sapiens
tgggctctggagggcctaggat

SEQ ID NO: 8110585 - DNA, 22 bp, Homo sapiens
tgggctcagtctgcttggtcct

SEQ ID NO: 8110586 - DNA, 22 bp, Homo sapiens
tgggctctcaaagtgcggcttg

SEQ ID NO: 8110587 - DNA, 22 bp, Homo sapiens
tgggctctgaagtcagtctgct

SEQ ID NO: 8110588 - DNA, 22 bp, Homo sapiens
tgggctctgaagggtcccggat

SEQ ID NO: 8110589 - DNA, 22 bp, Homo sapiens
tgggctctcgtccctgcagaag

SEQ ID NO: 8110590 - DNA, 22 bp, Homo sapiens
tgggctctctcacctggaggct

SEQ ID NO: 8110591 - DNA, 22 bp, Homo sapiens
tggggaggttcgggaatcttgt

SEQ ID NO: 8110592 - DNA, 22 bp, Homo sapiens
tggggaggtaacaatttcaggc

SEQ ID NO: 8110593 - DNA, 21 bp, Homo sapiens
tggggaggggacctgattatg

SEQ ID NO: 8110594 - DNA, 23 bp, Homo sapiens
tggggagggaagtcatttctgta

SEQ ID NO: 8110595 - DNA, 22 bp, Homo sapiens
tggggaggacgggcgccttcct

SEQ ID NO: 8110596 - DNA, 22 bp, Homo sapiens
tggggaggatatgtgagttatt

SEQ ID NO: 8110597 - DNA, 22 bp, Homo sapiens
tggggaggaagtcagatttcag

SEQ ID NO: 8110598 - DNA, 22 bp, Homo sapiens
tggggacgtactgagaggtccg

SEQ ID NO: 8110599 - DNA, 18 bp, Homo sapiens
tgggctgcctggcctctg

SEQ ID NO: 8110600 - DNA, 22 bp, Homo sapiens
tggggccagagatggggcgcag

SEQ ID NO: 8110601 - DNA, 22 bp, Homo sapiens
tggggccaggtggctgcaggtc

SEQ ID NO: 8110602 - DNA, 22 bp, Homo sapiens
tggggccagcggggaggactca

SEQ ID NO: 8110603 - DNA, 22 bp, Homo sapiens
tggggcctgaaaggttctcgcc

SEQ ID NO: 8110604 - DNA, 22 bp, Homo sapiens
tggggcctgaggtggagctgca

SEQ ID NO: 8110605 - DNA, 19 bp, Homo sapiens
tggggcctcctgtccctgg

SEQ ID NO: 8110606 - DNA, 22 bp, Homo sapiens
tggggcctcaggccttttccta

SEQ ID NO: 8110607 - DNA, 22 bp, Homo sapiens
tggggcctcaggccttttccta

SEQ ID NO: 8110608 - DNA, 22 bp, Homo sapiens
tggggctctccacagtgtctca

SEQ ID NO: 8110609 - DNA, 23 bp, Homo sapiens
tggggctctggcaggcctgaggt

SEQ ID NO: 8110610 - DNA, 22 bp, Homo sapiens
tggggcctgaggtggagctgca

SEQ ID NO: 8110611 - DNA, 22 bp, Homo sapiens
tggggcctgcacaggctgaatg

SEQ ID NO: 8110612 - DNA, 22 bp, Homo sapiens
tggggcctggtcagagctgcac

SEQ ID NO: 8110613 - DNA, 20 bp, Homo sapiens
tggggcctgtttctgtggtt

SEQ ID NO: 8110614 - DNA, 22 bp, Homo sapiens
tggggccttggcctcattagat

SEQ ID NO: 8110615 - DNA, 22 bp, Homo sapiens
tggggctcacctaggctggaag

SEQ ID NO: 8110616 - DNA, 22 bp, Homo sapiens
tggggctagaatcctgcaggaa

SEQ ID NO: 8110617 - DNA, 22 bp, Homo sapiens
tggtatgtaaattgtaactcaa

SEQ ID NO: 8110618 - DNA, 21 bp, Homo sapiens
tggtatcaaactatacaatat

SEQ ID NO: 8110619 - DNA, 20 bp, Homo sapiens
tggtatcaattactagattg

SEQ ID NO: 8110620 - DNA, 22 bp, Homo sapiens
tggtatcaaacaattaattaga

SEQ ID NO: 8110621 - DNA, 22 bp, Homo sapiens
tggtatttcagcttttgtatct

SEQ ID NO: 8110622 - DNA, 20 bp, Homo sapiens
tgggttcaactcctacagtc

SEQ ID NO: 8110623 - DNA, 22 bp, Homo sapiens
tgggtagggacttagctggctg

SEQ ID NO: 8110624 - DNA, 22 bp, Homo sapiens
tgggtccttgccatcttggagt

SEQ ID NO: 8110625 - DNA, 22 bp, Homo sapiens
tgggtcctgtctccttgttctg

SEQ ID NO: 8110626 - DNA, 22 bp, Homo sapiens
tgggtcctttttggacttcttc

SEQ ID NO: 8110627 - DNA, 22 bp, Homo sapiens
tgggtctccagttcagggcagg

SEQ ID NO: 8110628 - DNA, 20 bp, Homo sapiens
tgggtcctgcttcttcctga

SEQ ID NO: 8110629 - DNA, 20 bp, Homo sapiens
tgggtcctgcacattctcca

SEQ ID NO: 8110630 - DNA, 22 bp, Homo sapiens
tggggggatacttgctactggc

SEQ ID NO: 8110631 - DNA, 20 bp, Homo sapiens
tggggtctagttggcctggg

SEQ ID NO: 8110632 - DNA, 22 bp, Homo sapiens
tggggtctgagtatctgcattt

SEQ ID NO: 8110633 - DNA, 18 bp, Homo sapiens
tggggtctctcaggtaag

SEQ ID NO: 8110634 - DNA, 22 bp, Homo sapiens
tgtcatgagttatttcatagga

SEQ ID NO: 8110635 - DNA, 22 bp, Homo sapiens
tgtcatcagcatataagacagt

SEQ ID NO: 8110636 - DNA, 22 bp, Homo sapiens
tgtcatttaaagctttccagat

SEQ ID NO: 8110637 - DNA, 22 bp, Homo sapiens
tgtcattcatttaagtatgttt

SEQ ID NO: 8110638 - DNA, 22 bp, Homo sapiens
tgtcatttagtcctctgtgtgt

SEQ ID NO: 8110639 - DNA, 22 bp, Homo sapiens
tgtcatttattctcttattcta

SEQ ID NO: 8110640 - DNA, 22 bp, Homo sapiens
tgtcattttgtctcactgctat

SEQ ID NO: 8110641 - DNA, 22 bp, Homo sapiens
tgtcattttgtctcactgctat

SEQ ID NO: 8110642 - DNA, 22 bp, Homo sapiens
tgtcatttcacaatatcactca

SEQ ID NO: 8110643 - DNA, 22 bp, Homo sapiens
tgtcatttattttgctgtctgt

SEQ ID NO: 8110644 - DNA, 22 bp, Homo sapiens
tgtcatttcctgaatgctgagt

SEQ ID NO: 8110645 - DNA, 22 bp, Homo sapiens
tgtcatttggtgccaggaaaga

SEQ ID NO: 8110646 - DNA, 22 bp, Homo sapiens
tgtcattttctaatctgttgtc

SEQ ID NO: 8110647 - DNA, 22 bp, Homo sapiens
tgtcattttagtgcatcactca

SEQ ID NO: 8110648 - DNA, 22 bp, Homo sapiens
tgtcattttagtgcatcactca

SEQ ID NO: 8110649 - DNA, 22 bp, Homo sapiens
tgtcagtagattattacaataa

SEQ ID NO: 8110650 - DNA, 22 bp, Homo sapiens
tgtcagaactctattgatgtcc

SEQ ID NO: 8110651 - DNA, 22 bp, Homo sapiens
tgtcaggtagtaggtagaaact

SEQ ID NO: 8110652 - DNA, 22 bp, Homo sapiens
tgtcaggttggttttcagagaa

SEQ ID NO: 8110653 - DNA, 22 bp, Homo sapiens
tgtccctttgtgttctgaaact

SEQ ID NO: 8110654 - DNA, 22 bp, Homo sapiens
tgtccaggtcagcagcagggac

SEQ ID NO: 8110655 - DNA, 22 bp, Homo sapiens
tgtcctttgggagggcacagct

SEQ ID NO: 8110656 - DNA, 22 bp, Homo sapiens
tgtccttttctttagtgcagct

SEQ ID NO: 8110657 - DNA, 22 bp, Homo sapiens
tgtcctggtgctccaggtggct

SEQ ID NO: 8110658 - DNA, 22 bp, Homo sapiens
tgtcctgtccttcctggaagtc

SEQ ID NO: 8110659 - DNA, 22 bp, Homo sapiens
tgtcctcagatatgtctactct

SEQ ID NO: 8110660 - DNA, 22 bp, Homo sapiens
tgtcctcacaggaatgaacttt

SEQ ID NO: 8110661 - DNA, 22 bp, Homo sapiens
tgtcacagagcgtgcaacagaa

SEQ ID NO: 8110662 - DNA, 22 bp, Homo sapiens
tgtcaaaatgactttactacag

SEQ ID NO: 8110663 - DNA, 22 bp, Homo sapiens
tgtcaatgaagtcatccttgtg

SEQ ID NO: 8110664 - DNA, 22 bp, Homo sapiens
tgtcacaaggccatgaaaagaa

SEQ ID NO: 8110665 - DNA, 22 bp, Homo sapiens
tgtcacaagtaactggcaatgc

SEQ ID NO: 8110666 - DNA, 22 bp, Homo sapiens
tgtatgcaccattgtattacct

SEQ ID NO: 8110667 - DNA, 22 bp, Homo sapiens
tgtatgcagggcttgtatgcag

SEQ ID NO: 8110668 - DNA, 17 bp, Homo sapiens
tgtatgcatatgctttt

SEQ ID NO: 8110669 - DNA, 22 bp, Homo sapiens
tgtatgcataaaattatttaca

SEQ ID NO: 8110670 - DNA, 22 bp, Homo sapiens
tgtatttcgctaggtactccct

SEQ ID NO: 8110671 - DNA, 22 bp, Homo sapiens
tgtatttcctggtttagatcaa

SEQ ID NO: 8110672 - DNA, 22 bp, Homo sapiens
tgtattttcagagtggcatttc

SEQ ID NO: 8110673 - DNA, 22 bp, Homo sapiens
tgtactgtattcatctttaact

SEQ ID NO: 8110674 - DNA, 22 bp, Homo sapiens
tgtagaaactacacatgcaaca

SEQ ID NO: 8110675 - DNA, 22 bp, Homo sapiens
tgtagctctccagccagcaagg

SEQ ID NO: 8110676 - DNA, 22 bp, Homo sapiens
tgtatattctgcctaaaagctt

SEQ ID NO: 8110677 - DNA, 22 bp, Homo sapiens
tgtatattctgcctaaaagctt

SEQ ID NO: 8110678 - DNA, 22 bp, Homo sapiens
tgtatcttagtgtgaaaatatt

SEQ ID NO: 8110679 - DNA, 22 bp, Homo sapiens
tgtatctttctgtacttttatg

SEQ ID NO: 8110680 - DNA, 22 bp, Homo sapiens
tgtatctttctgtacttttatg

SEQ ID NO: 8110681 - DNA, 23 bp, Homo sapiens
tgtatctgtactattcctgcctc

SEQ ID NO: 8110682 - DNA, 22 bp, Homo sapiens
tgtatacatttaactagataga

SEQ ID NO: 8110683 - DNA, 22 bp, Homo sapiens
tgtatacaggcataagagatac

SEQ ID NO: 8110684 - DNA, 22 bp, Homo sapiens
tgtatacaggcataagagatac

SEQ ID NO: 8110685 - DNA, 21 bp, Homo sapiens
tgtatacacgtgttgaaaaca

SEQ ID NO: 8110686 - DNA, 22 bp, Homo sapiens
tgtatacaagtcgtgtaaactt

SEQ ID NO: 8110687 - DNA, 22 bp, Homo sapiens
tgtataaacttaagcaggaacc

SEQ ID NO: 8110688 - DNA, 22 bp, Homo sapiens
tgtataaacttaagcaggaacc

SEQ ID NO: 8110689 - DNA, 22 bp, Homo sapiens
tggtttgtttgttcatgtaaaa

SEQ ID NO: 8110690 - DNA, 22 bp, Homo sapiens
tggttttatttatgttgagtca

SEQ ID NO: 8110691 - DNA, 22 bp, Homo sapiens
tggttttagagtatattcaggg

SEQ ID NO: 8110692 - DNA, 22 bp, Homo sapiens
tgtaaaaccaaatcaatctagt

SEQ ID NO: 8110693 - DNA, 22 bp, Homo sapiens
tgtaaaaggaaatcaaagcact

SEQ ID NO: 8110694 - DNA, 18 bp, Homo sapiens
tgtaaacactttcattct

SEQ ID NO: 8110695 - DNA, 20 bp, Homo sapiens
tgtaaacaatagtgttcttg

SEQ ID NO: 8110696 - DNA, 22 bp, Homo sapiens
tgtaaacaaatgcattcttgct

SEQ ID NO: 8110697 - DNA, 22 bp, Homo sapiens
tgtaaacagccccatggagagc

SEQ ID NO: 8110698 - DNA, 22 bp, Homo sapiens
tgtaaataatgcatgtaaatca

SEQ ID NO: 8110699 - DNA, 22 bp, Homo sapiens
tggtgtcaggcactagcatgca

SEQ ID NO: 8110700 - DNA, 22 bp, Homo sapiens
tggttgtgcacggagctgcagg

SEQ ID NO: 8110701 - DNA, 19 bp, Homo sapiens
tggttctccttccacagtc

SEQ ID NO: 8110702 - DNA, 17 bp, Homo sapiens
tggttcttttcattccc

SEQ ID NO: 8110703 - DNA, 23 bp, Homo sapiens
tggttgcagtgccaagtatcacg

SEQ ID NO: 8110704 - DNA, 22 bp, Homo sapiens
tggttgcctctcagagattccg

SEQ ID NO: 8110705 - DNA, 22 bp, Homo sapiens
tggttgcctctcagagattccg

SEQ ID NO: 8110706 - DNA, 22 bp, Homo sapiens
tgtaaattctatacacttaaaa

SEQ ID NO: 8110707 - DNA, 22 bp, Homo sapiens
tgtaaattgtcacctaaatgct

SEQ ID NO: 8110708 - DNA, 22 bp, Homo sapiens
tgtacaaagagtatagctttga

SEQ ID NO: 8110709 - DNA, 22 bp, Homo sapiens
tgtacaaaggtactttgatgtt

SEQ ID NO: 8110710 - DNA, 22 bp, Homo sapiens
tgtacaatggctataataccct

SEQ ID NO: 8110711 - DNA, 22 bp, Homo sapiens
tgtacaatgccgagactaactc

SEQ ID NO: 8110712 - DNA, 22 bp, Homo sapiens
tgtacaagcaaatagaccttca

SEQ ID NO: 8110713 - DNA, 22 bp, Homo sapiens
tgtacagtcatgctttctgttc

SEQ ID NO: 8110714 - DNA, 22 bp, Homo sapiens
tgtacagctgccttttttactt

SEQ ID NO: 8110715 - DNA, 22 bp, Homo sapiens
tggtgagatgcagcaacagaca

SEQ ID NO: 8110716 - DNA, 22 bp, Homo sapiens
tggtgagatgtatggagggttg

SEQ ID NO: 8110717 - DNA, 22 bp, Homo sapiens
tggtgagacaggatcaacccct

SEQ ID NO: 8110718 - DNA, 22 bp, Homo sapiens
tggtgagaagttttgagattct

SEQ ID NO: 8110719 - DNA, 22 bp, Homo sapiens
tggtgagaagttttgagattct

SEQ ID NO: 8110720 - DNA, 22 bp, Homo sapiens
tggtgagataactttcggcaag

SEQ ID NO: 8110721 - DNA, 22 bp, Homo sapiens
tggtgagagctgaccgtgcgag

SEQ ID NO: 8110722 - DNA, 22 bp, Homo sapiens
tggtgagagcagaccttctttt

SEQ ID NO: 8110723 - DNA, 20 bp, Homo sapiens
tggtgagagcacctgatggg

SEQ ID NO: 8110724 - DNA, 22 bp, Homo sapiens
tggtgagaccttgttccttatg

SEQ ID NO: 8110725 - DNA, 22 bp, Homo sapiens
tggtcctggggtgcaggctgac

SEQ ID NO: 8110726 - DNA, 22 bp, Homo sapiens
tggtccttcgtggtgcagttct

SEQ ID NO: 8110727 - DNA, 22 bp, Homo sapiens
tggtcgtgccctcagctctcta

SEQ ID NO: 8110728 - DNA, 22 bp, Homo sapiens
tggtcagcttcagagtgttcca

SEQ ID NO: 8110729 - DNA, 22 bp, Homo sapiens
tggtcagcgtttgtcagagcag

SEQ ID NO: 8110730 - DNA, 22 bp, Homo sapiens
tggtccagactttgacctctca

SEQ ID NO: 8110731 - DNA, 22 bp, Homo sapiens
tggtcctgagcaccagcctgac

SEQ ID NO: 8110732 - DNA, 22 bp, Homo sapiens
tggtcctcaggttctctgtgcg

SEQ ID NO: 8110733 - DNA, 22 bp, Homo sapiens
tggtcctgcccacgcccatctg

SEQ ID NO: 8110734 - DNA, 23 bp, Homo sapiens
tggtcctgccaacggtgcccctc

SEQ ID NO: 8110735 - DNA, 22 bp, Homo sapiens
tggtcctggaaggtcctgaggg

SEQ ID NO: 8110736 - DNA, 22 bp, Homo sapiens
tggtggacaccgcagccatgaa

SEQ ID NO: 8110737 - DNA, 22 bp, Homo sapiens
tggtgcccactctggacccagc

SEQ ID NO: 8110738 - DNA, 22 bp, Homo sapiens
tggtgcaggtgttgatgcagga

SEQ ID NO: 8110739 - DNA, 22 bp, Homo sapiens
tggtggcagtctcctggctgtg

SEQ ID NO: 8110740 - DNA, 22 bp, Homo sapiens
tggtggcagctgagtgtcaggt

SEQ ID NO: 8110741 - DNA, 22 bp, Homo sapiens
tggtggcatcactcagcctccc

SEQ ID NO: 8110742 - DNA, 22 bp, Homo sapiens
tggtggcatcactcagcctccc

SEQ ID NO: 8110743 - DNA, 19 bp, Homo sapiens
tggtggcaatgtcagctaa

SEQ ID NO: 8110744 - DNA, 19 bp, Homo sapiens
tggtggcaatgtcagctaa

SEQ ID NO: 8110745 - DNA, 22 bp, Homo sapiens
tggaaggaaaggtagcagagaa

SEQ ID NO: 8110746 - DNA, 22 bp, Homo sapiens
tggaaggaagccaaggaaggtt

SEQ ID NO: 8110747 - DNA, 22 bp, Homo sapiens
tggaagcctcagtttgccttct

SEQ ID NO: 8110748 - DNA, 22 bp, Homo sapiens
tggaagccagctgggcacctgc

SEQ ID NO: 8110749 - DNA, 22 bp, Homo sapiens
tggaagccaggcccgctcctaa

SEQ ID NO: 8110750 - DNA, 22 bp, Homo sapiens
tggaagagcaggcagacaatgc

SEQ ID NO: 8110751 - DNA, 22 bp, Homo sapiens
tggaagagaaaggagtggatct

SEQ ID NO: 8110752 - DNA, 22 bp, Homo sapiens
tggaagaggcccatgactgcct

SEQ ID NO: 8110753 - DNA, 20 bp, Homo sapiens
tggaagaggagatgcctctg

SEQ ID NO: 8110754 - DNA, 22 bp, Homo sapiens
tggaaggcaacggagtgagctg

SEQ ID NO: 8110755 - DNA, 22 bp, Homo sapiens
tggaagggagtgacagtcagag

SEQ ID NO: 8110756 - DNA, 22 bp, Homo sapiens
tggaaggggagctggaaagggg

SEQ ID NO: 8110757 - DNA, 16 bp, Homo sapiens
tggaaggggtctccgg

SEQ ID NO: 8110758 - DNA, 20 bp, Homo sapiens
tggaaggtcccagaggaatt

SEQ ID NO: 8110759 - DNA, 22 bp, Homo sapiens
tggaaggggttacgcagcagga

SEQ ID NO: 8110760 - DNA, 22 bp, Homo sapiens
tggaagggggaagacagctctg

SEQ ID NO: 8110761 - DNA, 22 bp, Homo sapiens
tggaaggggccaggcgcggagt

SEQ ID NO: 8110762 - DNA, 22 bp, Homo sapiens
tggaaggggagttgttccacgt

SEQ ID NO: 8110763 - DNA, 21 bp, Homo sapiens
tggacttatggagtgtttctt

SEQ ID NO: 8110764 - DNA, 22 bp, Homo sapiens
tggaccccagacaagccagggt

SEQ ID NO: 8110765 - DNA, 22 bp, Homo sapiens
tggacctcactgtctgctggta

SEQ ID NO: 8110766 - DNA, 22 bp, Homo sapiens
tggaatgaatatgttttaagga

SEQ ID NO: 8110767 - DNA, 22 bp, Homo sapiens
tggacaacatagtgagacctca

SEQ ID NO: 8110768 - DNA, 22 bp, Homo sapiens
tggacagagaggaaggccattt

SEQ ID NO: 8110769 - DNA, 20 bp, Homo sapiens
tggacagaattagacacttt

SEQ ID NO: 8110770 - DNA, 22 bp, Homo sapiens
tggaaaggtgtaaagcagaacc

SEQ ID NO: 8110771 - DNA, 22 bp, Homo sapiens
tggaaagggacttatgagttcc

SEQ ID NO: 8110772 - DNA, 19 bp, Homo sapiens
tggaaaatggattgaatca

SEQ ID NO: 8110773 - DNA, 22 bp, Homo sapiens
tggaaaatgtgactattctaaa

SEQ ID NO: 8110774 - DNA, 22 bp, Homo sapiens
tggaaacactgcatgttcaccc

SEQ ID NO: 8110775 - DNA, 21 bp, Homo sapiens
tggaaacagcgccatctgccg

SEQ ID NO: 8110776 - DNA, 22 bp, Homo sapiens
tgctttttagtactgtcttatt

SEQ ID NO: 8110777 - DNA, 21 bp, Homo sapiens
tgctttatgggaaaaatgtca

SEQ ID NO: 8110778 - DNA, 22 bp, Homo sapiens
tgctttatgttatcagaagggt

SEQ ID NO: 8110779 - DNA, 20 bp, Homo sapiens
tgctttatgctatactttgt

SEQ ID NO: 8110780 - DNA, 22 bp, Homo sapiens
tgctttatcaaagctatagtga

SEQ ID NO: 8110781 - DNA, 22 bp, Homo sapiens
tgctttataggggattgcaggc

SEQ ID NO: 8110782 - DNA, 22 bp, Homo sapiens
tgctttatagacaaggaagtag

SEQ ID NO: 8110783 - DNA, 22 bp, Homo sapiens
tgctttattaagagagaaattt

SEQ ID NO: 8110784 - DNA, 22 bp, Homo sapiens
tgcttgattctgtccctttatt

SEQ ID NO: 8110785 - DNA, 19 bp, Homo sapiens
tgcttgaggtgtgctagag

SEQ ID NO: 8110786 - DNA, 22 bp, Homo sapiens
tgcttgctcgccgcctgctgac

SEQ ID NO: 8110787 - DNA, 22 bp, Homo sapiens
tgctttaaaatggactgttttg

SEQ ID NO: 8110788 - DNA, 22 bp, Homo sapiens
tgctttaacataagatatcttt

SEQ ID NO: 8110789 - DNA, 19 bp, Homo sapiens
tgcttctggaaccatgatc

SEQ ID NO: 8110790 - DNA, 22 bp, Homo sapiens
tgcttctgctcagcttcctact

SEQ ID NO: 8110791 - DNA, 19 bp, Homo sapiens
tgcttctggaatgcaaggc

SEQ ID NO: 8110792 - DNA, 19 bp, Homo sapiens
tgcttctggaatgcaaggc

SEQ ID NO: 8110793 - DNA, 22 bp, Homo sapiens
tgcttctgggtcccagcctggc

SEQ ID NO: 8110794 - DNA, 22 bp, Homo sapiens
tgcttctgttacataccagaac

SEQ ID NO: 8110795 - DNA, 22 bp, Homo sapiens
tggagccagaagagccagttca

SEQ ID NO: 8110796 - DNA, 20 bp, Homo sapiens
tggagccaaggtgtgtctgg

SEQ ID NO: 8110797 - DNA, 20 bp, Homo sapiens
tggagccacagtcaggttcc

SEQ ID NO: 8110798 - DNA, 22 bp, Homo sapiens
tggagccagcccaggcccctct

SEQ ID NO: 8110799 - DNA, 18 bp, Homo sapiens
tggagcaggaagcctggc

SEQ ID NO: 8110800 - DNA, 22 bp, Homo sapiens
tggagccatgcctggcctttcc

SEQ ID NO: 8110801 - DNA, 22 bp, Homo sapiens
tggagaggagcaccatggccat

SEQ ID NO: 8110802 - DNA, 22 bp, Homo sapiens
tggagcagagatgggagcccaa

SEQ ID NO: 8110803 - DNA, 22 bp, Homo sapiens
tggagcagaggaagaaggcttt

SEQ ID NO: 8110804 - DNA, 19 bp, Homo sapiens
tggagaggaaatgctgctc

SEQ ID NO: 8110805 - DNA, 18 bp, Homo sapiens
tggagagcagcagtgggg

SEQ ID NO: 8110806 - DNA, 22 bp, Homo sapiens
tggagagaaagttgaatggagg

SEQ ID NO: 8110807 - DNA, 22 bp, Homo sapiens
tggaggagggctggtgtctgta

SEQ ID NO: 8110808 - DNA, 22 bp, Homo sapiens
tggaggagtgtgattgtctgcc

SEQ ID NO: 8110809 - DNA, 22 bp, Homo sapiens
tggaggagtagattttcagagg

SEQ ID NO: 8110810 - DNA, 22 bp, Homo sapiens
tggaggaggaacttcttatctc

SEQ ID NO: 8110811 - DNA, 22 bp, Homo sapiens
tggaggaggatgcatttgttgt

SEQ ID NO: 8110812 - DNA, 22 bp, Homo sapiens
tggaggagaccgcattttattt

SEQ ID NO: 8110813 - DNA, 19 bp, Homo sapiens
tggaggagaggaaaagtca

SEQ ID NO: 8110814 - DNA, 22 bp, Homo sapiens
tggaggagaatttatggtcgaa

SEQ ID NO: 8110815 - DNA, 22 bp, Homo sapiens
tggaggagaccattccactcag

SEQ ID NO: 8110816 - DNA, 19 bp, Homo sapiens
tggaggcaagacatggagg

SEQ ID NO: 8110817 - DNA, 22 bp, Homo sapiens
tggaggccatacctcctgacat

SEQ ID NO: 8110818 - DNA, 22 bp, Homo sapiens
tggaggccagtgaaagtagatt

SEQ ID NO: 8110819 - DNA, 22 bp, Homo sapiens
tggaggctggagtgcagtggcg

SEQ ID NO: 8110820 - DNA, 22 bp, Homo sapiens
tggaggctggagtgcagtggcg

SEQ ID NO: 8110821 - DNA, 22 bp, Homo sapiens
tggaggccggactgagaggcat

SEQ ID NO: 8110822 - DNA, 22 bp, Homo sapiens
tggaggcctggtctctcttccc

SEQ ID NO: 8110823 - DNA, 20 bp, Homo sapiens
tggaggcctgcaggtttggg

SEQ ID NO: 8110824 - DNA, 22 bp, Homo sapiens
tggaggcctaggttgatgtgtg

SEQ ID NO: 8110825 - DNA, 22 bp, Homo sapiens
tggaggcccacactgggtagat

SEQ ID NO: 8110826 - DNA, 22 bp, Homo sapiens
tggaggccctcattgtagaagt

SEQ ID NO: 8110827 - DNA, 22 bp, Homo sapiens
tggaggccgaattagagcgttg

SEQ ID NO: 8110828 - DNA, 22 bp, Homo sapiens
tggaggccgcgtagtctgagca

SEQ ID NO: 8110829 - DNA, 20 bp, Homo sapiens
tggagggattgttggcaaat

SEQ ID NO: 8110830 - DNA, 22 bp, Homo sapiens
tggagggcatctgtggtcaggc

SEQ ID NO: 8110831 - DNA, 22 bp, Homo sapiens
tggagggcatagctgttctttc

SEQ ID NO: 8110832 - DNA, 22 bp, Homo sapiens
tggagggcatgctgtccatggg

SEQ ID NO: 8110833 - DNA, 23 bp, Homo sapiens
tggagggcagaataacagactac

SEQ ID NO: 8110834 - DNA, 22 bp, Homo sapiens
tggagggaacccaggctgctct

SEQ ID NO: 8110835 - DNA, 22 bp, Homo sapiens
tggagggctctttcacctggta

SEQ ID NO: 8110836 - DNA, 18 bp, Homo sapiens
tggagggcttgctgcagc

SEQ ID NO: 8110837 - DNA, 22 bp, Homo sapiens
tggagggcgcttagatggaggg

SEQ ID NO: 8110838 - DNA, 22 bp, Homo sapiens
tggagggctaagctgagggata

SEQ ID NO: 8110839 - DNA, 22 bp, Homo sapiens
tggaggtgggagggactgtcct

SEQ ID NO: 8110840 - DNA, 22 bp, Homo sapiens
tggaggtggcatctgacagctg

SEQ ID NO: 8110841 - DNA, 22 bp, Homo sapiens
tggaggtggggctcaggaatct

SEQ ID NO: 8110842 - DNA, 20 bp, Homo sapiens
tggaggtggtctgctgtcct

SEQ ID NO: 8110843 - DNA, 21 bp, Homo sapiens
tggataaaggcacttttcatc

SEQ ID NO: 8110844 - DNA, 22 bp, Homo sapiens
tggagttaaaaacaggatgcac

SEQ ID NO: 8110845 - DNA, 22 bp, Homo sapiens
tggagtgggcaatgtaggcaag

SEQ ID NO: 8110846 - DNA, 22 bp, Homo sapiens
tggatatccttgttaactttct

SEQ ID NO: 8110847 - DNA, 22 bp, Homo sapiens
tggaggtgtggagtcaaaggga

SEQ ID NO: 8110848 - DNA, 22 bp, Homo sapiens
tggagtggacttcatgaggcca

SEQ ID NO: 8110849 - DNA, 22 bp, Homo sapiens
tgctcctgccgtggtcgggact

SEQ ID NO: 8110850 - DNA, 22 bp, Homo sapiens
tgctcctgaggttggagatcca

SEQ ID NO: 8110851 - DNA, 22 bp, Homo sapiens
tgctcctgaggttggagatcca

SEQ ID NO: 8110852 - DNA, 22 bp, Homo sapiens
tgctcccaggactcttgagcca

SEQ ID NO: 8110853 - DNA, 22 bp, Homo sapiens
tgctcccagggactctggctgg

SEQ ID NO: 8110854 - DNA, 22 bp, Homo sapiens
tgctcccaggctctgtggtctg

SEQ ID NO: 8110855 - DNA, 22 bp, Homo sapiens
tgctcccaggcattctctgttg

SEQ ID NO: 8110856 - DNA, 22 bp, Homo sapiens
tgctcccatgtgtgggtacaga

SEQ ID NO: 8110857 - DNA, 23 bp, Homo sapiens
tgctcccaggtgacgctgctgtt

SEQ ID NO: 8110858 - DNA, 22 bp, Homo sapiens
tgctccaggcaagctgagagtt

SEQ ID NO: 8110859 - DNA, 22 bp, Homo sapiens
tgctccagggcctccagtgggg

SEQ ID NO: 8110860 - DNA, 22 bp, Homo sapiens
tgctccagcgctgccaccagtt

SEQ ID NO: 8110861 - DNA, 23 bp, Homo sapiens
tgctccagcctctttgatagtgt

SEQ ID NO: 8110862 - DNA, 22 bp, Homo sapiens
tgctccttcccttcccagtgag

SEQ ID NO: 8110863 - DNA, 22 bp, Homo sapiens
tgctcctggctccttccctaac

SEQ ID NO: 8110864 - DNA, 22 bp, Homo sapiens
tgctcctggatgaggtactcca

SEQ ID NO: 8110865 - DNA, 22 bp, Homo sapiens
tgctctgggctcaatggcagct

SEQ ID NO: 8110866 - DNA, 22 bp, Homo sapiens
tgctctggggagctcctctgcg

SEQ ID NO: 8110867 - DNA, 22 bp, Homo sapiens
tgctgagatgaatagggctgtc

SEQ ID NO: 8110868 - DNA, 22 bp, Homo sapiens
tgctgagcgcatccggcggccg

SEQ ID NO: 8110869 - DNA, 22 bp, Homo sapiens
tgctgaaatatttatgggtcaa

SEQ ID NO: 8110870 - DNA, 20 bp, Homo sapiens
tgctctgggggtggagagac

SEQ ID NO: 8110871 - DNA, 22 bp, Homo sapiens
tgctctggtcctccctcggcgc

SEQ ID NO: 8110872 - DNA, 22 bp, Homo sapiens
tgctcttcggggccactgcttg

SEQ ID NO: 8110873 - DNA, 19 bp, Homo sapiens
tgctgcagtcaggcgaggg

SEQ ID NO: 8110874 - DNA, 22 bp, Homo sapiens
tgctccagaacctgaccatgct

SEQ ID NO: 8110875 - DNA, 22 bp, Homo sapiens
tgctcagcaaaaagcttgtgag

SEQ ID NO: 8110876 - DNA, 22 bp, Homo sapiens
tgctcagcacagaccaggccag

SEQ ID NO: 8110877 - DNA, 22 bp, Homo sapiens
tgctcagccgtgagcagagccg

SEQ ID NO: 8110878 - DNA, 22 bp, Homo sapiens
tgctcagctgctctgtattctt

SEQ ID NO: 8110879 - DNA, 22 bp, Homo sapiens
tgctcagctggtgccagggtcc

SEQ ID NO: 8110880 - DNA, 19 bp, Homo sapiens
tgctcagctcctgtgagtc

SEQ ID NO: 8110881 - DNA, 22 bp, Homo sapiens
tgcggaggtcggtgctgcgggc

SEQ ID NO: 8110882 - DNA, 22 bp, Homo sapiens
tgccttgaacatagtggacagt

SEQ ID NO: 8110883 - DNA, 22 bp, Homo sapiens
tgcctgtgtccccttcttggca

SEQ ID NO: 8110884 - DNA, 22 bp, Homo sapiens
tgcctgtgtccccttcttggca

SEQ ID NO: 8110885 - DNA, 22 bp, Homo sapiens
tgcctgtgtcacagtgatgttt

SEQ ID NO: 8110886 - DNA, 22 bp, Homo sapiens
tgcctgtgtatttccggcctgc

SEQ ID NO: 8110887 - DNA, 22 bp, Homo sapiens
tgcctgtgtatgtgcatgcaca

SEQ ID NO: 8110888 - DNA, 22 bp, Homo sapiens
tgcctgtgggtgatgatttgat

SEQ ID NO: 8110889 - DNA, 22 bp, Homo sapiens
tgcctgtgtatgtgcatgcaca

SEQ ID NO: 8110890 - DNA, 19 bp, Homo sapiens
tgcctgtggcgagcatctt

SEQ ID NO: 8110891 - DNA, 22 bp, Homo sapiens
tgcctgtgccctttgctgggag

SEQ ID NO: 8110892 - DNA, 22 bp, Homo sapiens
tgcctgtgccctttgctgggag

SEQ ID NO: 8110893 - DNA, 22 bp, Homo sapiens
tgcctgtgcccttcttggcatt

SEQ ID NO: 8110894 - DNA, 22 bp, Homo sapiens
tgcctgtgcccttcttggcatt

SEQ ID NO: 8110895 - DNA, 22 bp, Homo sapiens
tgcctgtgcccttcttggcatt

SEQ ID NO: 8110896 - DNA, 22 bp, Homo sapiens
tgcctgtggaaaggctggtgct

SEQ ID NO: 8110897 - DNA, 22 bp, Homo sapiens
tgcgagcccagccagctctctg

SEQ ID NO: 8110898 - DNA, 22 bp, Homo sapiens
tgcctgggggactaaggccaaa

SEQ ID NO: 8110899 - DNA, 22 bp, Homo sapiens
tgcctggggttggcaaactgct

SEQ ID NO: 8110900 - DNA, 22 bp, Homo sapiens
tgcctgggtccaggccaagcct

SEQ ID NO: 8110901 - DNA, 22 bp, Homo sapiens
tgcctggggattgctctgggcc

SEQ ID NO: 8110902 - DNA, 22 bp, Homo sapiens
tgcctgggctcggtagccatcg

SEQ ID NO: 8110903 - DNA, 22 bp, Homo sapiens
tgcctgggaaccaatcctggct

SEQ ID NO: 8110904 - DNA, 22 bp, Homo sapiens
tgcctggccagaccctatagag

SEQ ID NO: 8110905 - DNA, 22 bp, Homo sapiens
tgcctggctgaggtgacaggtt

SEQ ID NO: 8110906 - DNA, 22 bp, Homo sapiens
tgcctgggtgtaaagggccaac

SEQ ID NO: 8110907 - DNA, 22 bp, Homo sapiens
tgcctgggtgctggctggtcac

SEQ ID NO: 8110908 - DNA, 22 bp, Homo sapiens
tgcctgggtgccctctgctcct

SEQ ID NO: 8110909 - DNA, 22 bp, Homo sapiens
tgcctgggtgctggctggtcac

SEQ ID NO: 8110910 - DNA, 22 bp, Homo sapiens
tgcctgggttgactcttagctg

SEQ ID NO: 8110911 - DNA, 22 bp, Homo sapiens
tgcctgggttcccaccccaaag

SEQ ID NO: 8110912 - DNA, 22 bp, Homo sapiens
tgcctgtcttaatatctggaaa

SEQ ID NO: 8110913 - DNA, 22 bp, Homo sapiens
tgcctgtgacccaaggatgcga

SEQ ID NO: 8110914 - DNA, 22 bp, Homo sapiens
tgcctgtgaaaaccctggggtt

SEQ ID NO: 8110915 - DNA, 22 bp, Homo sapiens
tgcctgtgatcagctgagttca

SEQ ID NO: 8110916 - DNA, 22 bp, Homo sapiens
tgcctgtgatcagctgagttca

SEQ ID NO: 8110917 - DNA, 17 bp, Homo sapiens
tgcctgtgataagcaca

SEQ ID NO: 8110918 - DNA, 22 bp, Homo sapiens
tgctggctccaacctggcatct

SEQ ID NO: 8110919 - DNA, 22 bp, Homo sapiens
tgctggctcagtttgcagactc

SEQ ID NO: 8110920 - DNA, 22 bp, Homo sapiens
tgctggctctaggctgagacag

SEQ ID NO: 8110921 - DNA, 22 bp, Homo sapiens
tgctggctgcagtgctgtcaaa

SEQ ID NO: 8110922 - DNA, 22 bp, Homo sapiens
tgctggctgggctgctggagac

SEQ ID NO: 8110923 - DNA, 22 bp, Homo sapiens
tgctggcttcctgtgcacagca

SEQ ID NO: 8110924 - DNA, 22 bp, Homo sapiens
tgctgctgtatccttagtgtca

SEQ ID NO: 8110925 - DNA, 22 bp, Homo sapiens
tgctgctgtttcctacatctca

SEQ ID NO: 8110926 - DNA, 22 bp, Homo sapiens
tgctgccagagagacagggact

SEQ ID NO: 8110927 - DNA, 22 bp, Homo sapiens
tgctgccacatttaaagagggg

SEQ ID NO: 8110928 - DNA, 22 bp, Homo sapiens
tgctgccaagcccgtgctcctg

SEQ ID NO: 8110929 - DNA, 22 bp, Homo sapiens
tgctgctgatcatttatagtct

SEQ ID NO: 8110930 - DNA, 22 bp, Homo sapiens
tgctgcctaacagaactctttc

SEQ ID NO: 8110931 - DNA, 22 bp, Homo sapiens
tgctgggcctcttccctggata

SEQ ID NO: 8110932 - DNA, 22 bp, Homo sapiens
tgctgggcagtgtgccctcgag

SEQ ID NO: 8110933 - DNA, 18 bp, Homo sapiens
tgctgggcattaggctta

SEQ ID NO: 8110934 - DNA, 22 bp, Homo sapiens
tgctgggcatcgtaggaggtac

SEQ ID NO: 8110935 - DNA, 20 bp, Homo sapiens
tgctgggcatgcagtggaaa

SEQ ID NO: 8110936 - DNA, 23 bp, Homo sapiens
tgctgggcagagctggtgctgag

SEQ ID NO: 8110937 - DNA, 22 bp, Homo sapiens
tgctgggctagggtggagctct

SEQ ID NO: 8110938 - DNA, 22 bp, Homo sapiens
tgctgggctagggtggagctct

SEQ ID NO: 8110939 - DNA, 22 bp, Homo sapiens
tgctgggctagaagctgaggcc

SEQ ID NO: 8110940 - DNA, 22 bp, Homo sapiens
tgctgggcttcaactgcctgag

SEQ ID NO: 8110941 - DNA, 22 bp, Homo sapiens
tgctggtgaggtccttgctgga

SEQ ID NO: 8110942 - DNA, 22 bp, Homo sapiens
tgctggtgattaaatcctgaag

SEQ ID NO: 8110943 - DNA, 22 bp, Homo sapiens
tgctgtcagacagcagtggtaa

SEQ ID NO: 8110944 - DNA, 22 bp, Homo sapiens
tgctgtcaagaaaacaagcaat

SEQ ID NO: 8110945 - DNA, 22 bp, Homo sapiens
tgcttaaatttcagcagcttaa

SEQ ID NO: 8110946 - DNA, 18 bp, Homo sapiens
tgcttacaggagttcctg

SEQ ID NO: 8110947 - DNA, 22 bp, Homo sapiens
tgcttaaacatccagacagtat

SEQ ID NO: 8110948 - DNA, 22 bp, Homo sapiens
tgcttaaacatactatttatat

SEQ ID NO: 8110949 - DNA, 22 bp, Homo sapiens
tgcttaaaatgatgattatttt

SEQ ID NO: 8110950 - DNA, 22 bp, Homo sapiens
tgcttaaagctgctcagttgta

SEQ ID NO: 8110951 - DNA, 22 bp, Homo sapiens
tgcttaaaccctgatcatgtgt

SEQ ID NO: 8110952 - DNA, 22 bp, Homo sapiens
tgctgtgacgcctcaggaatcc

SEQ ID NO: 8110953 - DNA, 22 bp, Homo sapiens
tgcttaaaatagttcatttttg

SEQ ID NO: 8110954 - DNA, 22 bp, Homo sapiens
tgcttaaaaagtaactgctgat

SEQ ID NO: 8110955 - DNA, 22 bp, Homo sapiens
tgctgtgatggagaattctgga

SEQ ID NO: 8110956 - DNA, 22 bp, Homo sapiens
tgctgtgaggttgagaaggaag

SEQ ID NO: 8110957 - DNA, 22 bp, Homo sapiens
tgcttcatgcttctgacaatag

SEQ ID NO: 8110958 - DNA, 22 bp, Homo sapiens
tgcttccagttcctcaccacat

SEQ ID NO: 8110959 - DNA, 23 bp, Homo sapiens
tgcttattcaaaaggtgctttca

SEQ ID NO: 8110960 - DNA, 22 bp, Homo sapiens
tggcagcagggaggccagtgtt

SEQ ID NO: 8110961 - DNA, 22 bp, Homo sapiens
tggcagcagccatggaaggccc

SEQ ID NO: 8110962 - DNA, 18 bp, Homo sapiens
tggcagcaggaagccatt

SEQ ID NO: 8110963 - DNA, 22 bp, Homo sapiens
tggcagcagaacatgaaaccca

SEQ ID NO: 8110964 - DNA, 20 bp, Homo sapiens
tggcagagttgtcccaccca

SEQ ID NO: 8110965 - DNA, 22 bp, Homo sapiens
tggcagagttggaggtggaaga

SEQ ID NO: 8110966 - DNA, 22 bp, Homo sapiens
tggcagagtggaccatactcaa

SEQ ID NO: 8110967 - DNA, 18 bp, Homo sapiens
tggcagagtgtctgttct

SEQ ID NO: 8110968 - DNA, 22 bp, Homo sapiens
tggcagagttcgctcctattca

SEQ ID NO: 8110969 - DNA, 22 bp, Homo sapiens
tggcagagttatgggtatttat

SEQ ID NO: 8110970 - DNA, 21 bp, Homo sapiens
tggcagagttgagtagttatg

SEQ ID NO: 8110971 - DNA, 22 bp, Homo sapiens
tggcagagttcgctgtgccttt

SEQ ID NO: 8110972 - DNA, 22 bp, Homo sapiens
tggcagagtctgggcttgggca

SEQ ID NO: 8110973 - DNA, 22 bp, Homo sapiens
tggcagagtctctcctttccag

SEQ ID NO: 8110974 - DNA, 22 bp, Homo sapiens
tggcagagtcatcacatctgga

SEQ ID NO: 8110975 - DNA, 22 bp, Homo sapiens
tggcagagtaggatggccctgt

SEQ ID NO: 8110976 - DNA, 22 bp, Homo sapiens
tggcagagtgcagaagaggcat

SEQ ID NO: 8110977 - DNA, 22 bp, Homo sapiens
tggcagagtgcggcatcccctg

SEQ ID NO: 8110978 - DNA, 21 bp, Homo sapiens
tggcagagtgcagtctataca

SEQ ID NO: 8110979 - DNA, 22 bp, Homo sapiens
tggcaggaaccaggaggctctc

SEQ ID NO: 8110980 - DNA, 20 bp, Homo sapiens
tggcaggaggcagcagtgga

SEQ ID NO: 8110981 - DNA, 22 bp, Homo sapiens
tggcaggagcctgcggggaggt

SEQ ID NO: 8110982 - DNA, 22 bp, Homo sapiens
tggcaggaggatgaggcggcta

SEQ ID NO: 8110983 - DNA, 22 bp, Homo sapiens
tggcaggagacacatggcatag

SEQ ID NO: 8110984 - DNA, 22 bp, Homo sapiens
tggcaggaagcatctataggtc

SEQ ID NO: 8110985 - DNA, 20 bp, Homo sapiens
tggcaggaatagggccagag

SEQ ID NO: 8110986 - DNA, 22 bp, Homo sapiens
tggcaggaaggagactcagccc

SEQ ID NO: 8110987 - DNA, 18 bp, Homo sapiens
tggcaggggcagtacgcc

SEQ ID NO: 8110988 - DNA, 21 bp, Homo sapiens
tggcaggcagctggaagcttg

SEQ ID NO: 8110989 - DNA, 21 bp, Homo sapiens
tggcaggcagctggaagcttg

SEQ ID NO: 8110990 - DNA, 22 bp, Homo sapiens
tggcaggatctttgagagtgaa

SEQ ID NO: 8110991 - DNA, 22 bp, Homo sapiens
tggatgggttgaaatgtgagcc

SEQ ID NO: 8110992 - DNA, 22 bp, Homo sapiens
tggcacatagaaaaggatcaat

SEQ ID NO: 8110993 - DNA, 22 bp, Homo sapiens
tggcacatagtaggtgctcaat

SEQ ID NO: 8110994 - DNA, 22 bp, Homo sapiens
tggcagagcaaaaagatagaat

SEQ ID NO: 8110995 - DNA, 22 bp, Homo sapiens
tggcagagatgaagagttgttt

SEQ ID NO: 8110996 - DNA, 22 bp, Homo sapiens
tggcagagcccagaactgagca

SEQ ID NO: 8110997 - DNA, 22 bp, Homo sapiens
tggcagaggaaaaagtcactgg

SEQ ID NO: 8110998 - DNA, 16 bp, Homo sapiens
tggcagaggttcagcc

SEQ ID NO: 8110999 - DNA, 22 bp, Homo sapiens
tggcagagctggctgcggatga

SEQ ID NO: 8111000 - DNA, 22 bp, Homo sapiens
tggcagagcccagactccagtc

SEQ ID NO: 8111001 - DNA, 22 bp, Homo sapiens
tggcagagccttgccaaactcc

SEQ ID NO: 8111002 - DNA, 22 bp, Homo sapiens
tggcagagagactctccttgat

SEQ ID NO: 8111003 - DNA, 22 bp, Homo sapiens
tggcagagagagtgcagtcgac

SEQ ID NO: 8111004 - DNA, 22 bp, Homo sapiens
tggcagagactcctcctgggag

SEQ ID NO: 8111005 - DNA, 23 bp, Homo sapiens
tggcagagacccagaatctacat

SEQ ID NO: 8111006 - DNA, 22 bp, Homo sapiens
tggcagagacaaggccgggcct

SEQ ID NO: 8111007 - DNA, 22 bp, Homo sapiens
tggcagagaacctgggctttgt

SEQ ID NO: 8111008 - DNA, 22 bp, Homo sapiens
tggcagagaataaatcttgact

SEQ ID NO: 8111009 - DNA, 22 bp, Homo sapiens
tggcagagaacacggctgatct

SEQ ID NO: 8111010 - DNA, 22 bp, Homo sapiens
tggcctgatacttccagagttc

SEQ ID NO: 8111011 - DNA, 22 bp, Homo sapiens
tggcctgattttgctaagagaa

SEQ ID NO: 8111012 - DNA, 22 bp, Homo sapiens
tggcctgactgtccagccaggg

SEQ ID NO: 8111013 - DNA, 22 bp, Homo sapiens
tggcctgagttgtctgcaggcc

SEQ ID NO: 8111014 - DNA, 22 bp, Homo sapiens
tggcctgcagaggctgtggggc

SEQ ID NO: 8111015 - DNA, 22 bp, Homo sapiens
tggcctgcaaagtcttcttgct

SEQ ID NO: 8111016 - DNA, 22 bp, Homo sapiens
tggcctgcctgggagcagcagg

SEQ ID NO: 8111017 - DNA, 22 bp, Homo sapiens
tggcctgcccagagcagctctg

SEQ ID NO: 8111018 - DNA, 22 bp, Homo sapiens
tggcctgactgtcaggctgtat

SEQ ID NO: 8111019 - DNA, 21 bp, Homo sapiens
tggcctgaagctccctctccc

SEQ ID NO: 8111020 - DNA, 22 bp, Homo sapiens
tggcctgaattatggcagatct

SEQ ID NO: 8111021 - DNA, 22 bp, Homo sapiens
tggcctctgtgggagctgagca

SEQ ID NO: 8111022 - DNA, 22 bp, Homo sapiens
tggcctctgtgggagctgagca

SEQ ID NO: 8111023 - DNA, 22 bp, Homo sapiens
tggcctggccctgaggccctgt

SEQ ID NO: 8111024 - DNA, 22 bp, Homo sapiens
tggcctggaacctggcagggac

SEQ ID NO: 8111025 - DNA, 22 bp, Homo sapiens
tggcctgctctgactttggggg

SEQ ID NO: 8111026 - DNA, 22 bp, Homo sapiens
tggcctgccttcgctgagctga

SEQ ID NO: 8111027 - DNA, 22 bp, Homo sapiens
tggccctgtgtcctgctgccag

SEQ ID NO: 8111028 - DNA, 22 bp, Homo sapiens
tggccctgtgtcctgctgccag

SEQ ID NO: 8111029 - DNA, 22 bp, Homo sapiens
tggccctgtgtgcaggctgcac

SEQ ID NO: 8111030 - DNA, 23 bp, Homo sapiens
tggccctgtgcatgctgcttccc

SEQ ID NO: 8111031 - DNA, 22 bp, Homo sapiens
tggccctgtggcttcagaacag

SEQ ID NO: 8111032 - DNA, 20 bp, Homo sapiens
tggccctgttttctccaggc

SEQ ID NO: 8111033 - DNA, 20 bp, Homo sapiens
tggccctgttttctccaggc

SEQ ID NO: 8111034 - DNA, 22 bp, Homo sapiens
tggccctgttctgtacctcata

SEQ ID NO: 8111035 - DNA, 22 bp, Homo sapiens
tggccctgtgtgcaggctgcac

SEQ ID NO: 8111036 - DNA, 22 bp, Homo sapiens
tggccctgttctgtacctcata

SEQ ID NO: 8111037 - DNA, 22 bp, Homo sapiens
tggccctgccgccacgacgtct

SEQ ID NO: 8111038 - DNA, 22 bp, Homo sapiens
tggccctgggcatctttcgtga

SEQ ID NO: 8111039 - DNA, 22 bp, Homo sapiens
tggccctgccactcactgctga

SEQ ID NO: 8111040 - DNA, 22 bp, Homo sapiens
tggccctgccgccacgacgtct

SEQ ID NO: 8111041 - DNA, 22 bp, Homo sapiens
tggccctgccgcactatcctca

SEQ ID NO: 8111042 - DNA, 22 bp, Homo sapiens
tggccctgccgcactatcctca

SEQ ID NO: 8111043 - DNA, 22 bp, Homo sapiens
tggccctgccctcttcatcttt

SEQ ID NO: 8111044 - DNA, 22 bp, Homo sapiens
tggccctgccctcttcatcttt

SEQ ID NO: 8111045 - DNA, 22 bp, Homo sapiens
tggccctgtccctggagcctgg

SEQ ID NO: 8111046 - DNA, 22 bp, Homo sapiens
tggccctgtccctggagcctgg

SEQ ID NO: 8111047 - DNA, 22 bp, Homo sapiens
tggccctggtggcacagcctgc

SEQ ID NO: 8111048 - DNA, 22 bp, Homo sapiens
tggccctggtggcacagcctgc

SEQ ID NO: 8111049 - DNA, 22 bp, Homo sapiens
tggccctgggtggaatgtccca

SEQ ID NO: 8111050 - DNA, 22 bp, Homo sapiens
tggccctgtctgcacacaggat

SEQ ID NO: 8111051 - DNA, 22 bp, Homo sapiens
tggccctgtctgcacacaggat

SEQ ID NO: 8111052 - DNA, 22 bp, Homo sapiens
tggccctgtgactgagttctag

SEQ ID NO: 8111053 - DNA, 23 bp, Homo sapiens
tggccctgtgcatgctgcttccc

SEQ ID NO: 8111054 - DNA, 22 bp, Homo sapiens
tggcccagccctgctctagggc

SEQ ID NO: 8111055 - DNA, 22 bp, Homo sapiens
tggcccagctcagggtgggcgg

SEQ ID NO: 8111056 - DNA, 22 bp, Homo sapiens
tggccagttgaagacaatgctc

SEQ ID NO: 8111057 - DNA, 22 bp, Homo sapiens
tggccagtgattaatgacgctt

SEQ ID NO: 8111058 - DNA, 22 bp, Homo sapiens
tggccagtctgtggaagccagg

SEQ ID NO: 8111059 - DNA, 22 bp, Homo sapiens
tggcccaggggctcttggtgtt

SEQ ID NO: 8111060 - DNA, 22 bp, Homo sapiens
tggcccagggagttcatggtgt

SEQ ID NO: 8111061 - DNA, 22 bp, Homo sapiens
tggcccagggcacagcagggag

SEQ ID NO: 8111062 - DNA, 22 bp, Homo sapiens
tggcccaggtctctctgagccc

SEQ ID NO: 8111063 - DNA, 22 bp, Homo sapiens
tggcccaggcgaggtgggcaga

SEQ ID NO: 8111064 - DNA, 22 bp, Homo sapiens
tggcccaggccaaagccctgga

SEQ ID NO: 8111065 - DNA, 22 bp, Homo sapiens
tggcccagctgcagatggtgga

SEQ ID NO: 8111066 - DNA, 22 bp, Homo sapiens
tggcccaggaggccagagggca

SEQ ID NO: 8111067 - DNA, 22 bp, Homo sapiens
tggcccaggtgcaagagacaga

SEQ ID NO: 8111068 - DNA, 22 bp, Homo sapiens
tggcccagtagaaaagggatcg

SEQ ID NO: 8111069 - DNA, 22 bp, Homo sapiens
tggcccagtcagcaggagaggg

SEQ ID NO: 8111070 - DNA, 22 bp, Homo sapiens
tggccctgaaggccttgagcat

SEQ ID NO: 8111071 - DNA, 22 bp, Homo sapiens
tggccctgaaggccttgagcat

SEQ ID NO: 8111072 - DNA, 23 bp, Homo sapiens
tggccctgaatctgtcctggagg

SEQ ID NO: 8111073 - DNA, 23 bp, Homo sapiens
tggccctgaatctgtcctggagg

SEQ ID NO: 8111074 - DNA, 22 bp, Homo sapiens
tggccctgaatcaaggccagca

SEQ ID NO: 8111075 - DNA, 22 bp, Homo sapiens
tggccctgacaggtcctgggca

SEQ ID NO: 8111076 - DNA, 22 bp, Homo sapiens
tggccctgacaggtcctgggca

SEQ ID NO: 8111077 - DNA, 22 bp, Homo sapiens
tggccctgacacgtggtactgg

SEQ ID NO: 8111078 - DNA, 22 bp, Homo sapiens
tggccctgactgatgtggaggg

SEQ ID NO: 8111079 - DNA, 22 bp, Homo sapiens
tggccctgactgatgtggaggg

SEQ ID NO: 8111080 - DNA, 22 bp, Homo sapiens
tggccctgaggacccagtgtgg

SEQ ID NO: 8111081 - DNA, 22 bp, Homo sapiens
tggccctgacttggaggcctga

SEQ ID NO: 8111082 - DNA, 22 bp, Homo sapiens
tggccctgacttggaggcctga

SEQ ID NO: 8111083 - DNA, 22 bp, Homo sapiens
tggccctgcagaactagcctgg

SEQ ID NO: 8111084 - DNA, 22 bp, Homo sapiens
tggccctgccactcactgctga

SEQ ID NO: 8111085 - DNA, 22 bp, Homo sapiens
tggccctgcagaactagcctgg

SEQ ID NO: 8111086 - DNA, 22 bp, Homo sapiens
tggccctgcacccagagcagtt

SEQ ID NO: 8111087 - DNA, 22 bp, Homo sapiens
tggccctgcacccagagcagtt

SEQ ID NO: 8111088 - DNA, 22 bp, Homo sapiens
tggccctgaggggctgtgcccc

SEQ ID NO: 8111089 - DNA, 22 bp, Homo sapiens
tggccctgagggctcggagcca

SEQ ID NO: 8111090 - DNA, 22 bp, Homo sapiens
tggccctgagggctcggagcca

SEQ ID NO: 8111091 - DNA, 22 bp, Homo sapiens
tggccctgaggggctgtgcccc

SEQ ID NO: 8111092 - DNA, 22 bp, Homo sapiens
tggcagggtgccagttgcgagt

SEQ ID NO: 8111093 - DNA, 22 bp, Homo sapiens
tggcagtgatgcggcaggacat

SEQ ID NO: 8111094 - DNA, 22 bp, Homo sapiens
tggcagtcttgtaggcatctcc

SEQ ID NO: 8111095 - DNA, 22 bp, Homo sapiens
tggcagtcccctgtgcctggaa

SEQ ID NO: 8111096 - DNA, 22 bp, Homo sapiens
tggcagtcctcttcctcgggcg

SEQ ID NO: 8111097 - DNA, 22 bp, Homo sapiens
tggcagtcgatcatattcagca

SEQ ID NO: 8111098 - DNA, 22 bp, Homo sapiens
tggcagtcggacttctatctca

SEQ ID NO: 8111099 - DNA, 22 bp, Homo sapiens
tggcagtcttcatcagttctgg

SEQ ID NO: 8111100 - DNA, 22 bp, Homo sapiens
tggcagtctgggttggcagtta

SEQ ID NO: 8111101 - DNA, 22 bp, Homo sapiens
tggccagattcatgcatgtatc

SEQ ID NO: 8111102 - DNA, 22 bp, Homo sapiens
tggccacactgcccccactggg

SEQ ID NO: 8111103 - DNA, 22 bp, Homo sapiens
tggcatttcctcagtgctcaga

SEQ ID NO: 8111104 - DNA, 22 bp, Homo sapiens
tggcatttcacctttcatttcc

SEQ ID NO: 8111105 - DNA, 22 bp, Homo sapiens
tggccacccctttctctgcact

SEQ ID NO: 8111106 - DNA, 22 bp, Homo sapiens
tggccaccttcccacttctgcc

SEQ ID NO: 8111107 - DNA, 22 bp, Homo sapiens
tggccagaactcagacatgtgg

SEQ ID NO: 8111108 - DNA, 22 bp, Homo sapiens
tggccagacctgactgtcaggg

SEQ ID NO: 8111109 - DNA, 17 bp, Homo sapiens
tggccagagcaggcccc

SEQ ID NO: 8111110 - DNA, 22 bp, Homo sapiens
tggccagagtccagtgagcctt

SEQ ID NO: 8111111 - DNA, 22 bp, Homo sapiens
tgggagagtgctcaatgtgcaa

SEQ ID NO: 8111112 - DNA, 20 bp, Homo sapiens
tgggagaagaacactggaac

SEQ ID NO: 8111113 - DNA, 22 bp, Homo sapiens
tgggagcactctttgggaagca

SEQ ID NO: 8111114 - DNA, 22 bp, Homo sapiens
tgggagcagcattgccatgtgc

SEQ ID NO: 8111115 - DNA, 20 bp, Homo sapiens
tgggagctggtgaggtctca

SEQ ID NO: 8111116 - DNA, 22 bp, Homo sapiens
tgggaggaatgtcactgagcca

SEQ ID NO: 8111117 - DNA, 22 bp, Homo sapiens
tgggaggagccctctgggaagg

SEQ ID NO: 8111118 - DNA, 22 bp, Homo sapiens
tgggaggatcgcttgagcccag

SEQ ID NO: 8111119 - DNA, 22 bp, Homo sapiens
tgggaggatctcttgaggccag

SEQ ID NO: 8111120 - DNA, 22 bp, Homo sapiens
tgggacatctgtgaagctgaat

SEQ ID NO: 8111121 - DNA, 22 bp, Homo sapiens
tgggaagcacgctcagcagaaa

SEQ ID NO: 8111122 - DNA, 22 bp, Homo sapiens
tgggaagatggagtgacaggca

SEQ ID NO: 8111123 - DNA, 22 bp, Homo sapiens
tgggaagcctagcagacagctg

SEQ ID NO: 8111124 - DNA, 22 bp, Homo sapiens
tgggaagctactcatgcaggca

SEQ ID NO: 8111125 - DNA, 22 bp, Homo sapiens
tgggaagggagtttcttggagt

SEQ ID NO: 8111126 - DNA, 22 bp, Homo sapiens
tgggaagggagagtgtcctgga

SEQ ID NO: 8111127 - DNA, 22 bp, Homo sapiens
tgggaagggccgatggagcctc

SEQ ID NO: 8111128 - DNA, 22 bp, Homo sapiens
tgggaagggtcaacagctggaa

SEQ ID NO: 8111129 - DNA, 22 bp, Homo sapiens
tgggaagggcctgcccttcctc

SEQ ID NO: 8111130 - DNA, 22 bp, Homo sapiens
tgggaaggggagctggaaagga

SEQ ID NO: 8111131 - DNA, 22 bp, Homo sapiens
tgggaagggtcagtttcttcat

SEQ ID NO: 8111132 - DNA, 22 bp, Homo sapiens
tgggaaggtacacgggaaagag

SEQ ID NO: 8111133 - DNA, 22 bp, Homo sapiens
tgggaaggtgattttccaaaag

SEQ ID NO: 8111134 - DNA, 22 bp, Homo sapiens
tggctgggccgggccttgtgcc

SEQ ID NO: 8111135 - DNA, 22 bp, Homo sapiens
tggctggggcctgaatcctgca

SEQ ID NO: 8111136 - DNA, 19 bp, Homo sapiens
tggctgggtgccaatggcc

SEQ ID NO: 8111137 - DNA, 19 bp, Homo sapiens
tggctgtggggaaatgctt

SEQ ID NO: 8111138 - DNA, 22 bp, Homo sapiens
tggctgtgggatatgtgactga

SEQ ID NO: 8111139 - DNA, 22 bp, Homo sapiens
tggcttcaaaggtagcatacaa

SEQ ID NO: 8111140 - DNA, 18 bp, Homo sapiens
tggcttctgctagctgga

SEQ ID NO: 8111141 - DNA, 22 bp, Homo sapiens
tgggaaagactcaggacaggag

SEQ ID NO: 8111142 - DNA, 22 bp, Homo sapiens
tgggaagactcctcaggaggcg

SEQ ID NO: 8111143 - DNA, 22 bp, Homo sapiens
tgggaagaggcgggaggctgtt

SEQ ID NO: 8111144 - DNA, 22 bp, Homo sapiens
tgggaaagtgttgaggtgtctt

SEQ ID NO: 8111145 - DNA, 22 bp, Homo sapiens
tgggaacagtagctgctgagct

SEQ ID NO: 8111146 - DNA, 22 bp, Homo sapiens
tggcctggtgtctgcgaggcct

SEQ ID NO: 8111147 - DNA, 22 bp, Homo sapiens
tggctcagaggggaagtggttt

SEQ ID NO: 8111148 - DNA, 22 bp, Homo sapiens
tggctcagatgctcttccagtg

SEQ ID NO: 8111149 - DNA, 22 bp, Homo sapiens
tggctcagaactacttctagtt

SEQ ID NO: 8111150 - DNA, 22 bp, Homo sapiens
tggctcagtgcattcacagtaa

SEQ ID NO: 8111151 - DNA, 22 bp, Homo sapiens
tggctcagtgacattcctccca

SEQ ID NO: 8111152 - DNA, 22 bp, Homo sapiens
tggctcagtctgggttgactga

SEQ ID NO: 8111153 - DNA, 22 bp, Homo sapiens
tggctcagtaatcgagtctcct

SEQ ID NO: 8111154 - DNA, 22 bp, Homo sapiens
tggctcagggtccccaaatggt

SEQ ID NO: 8111155 - DNA, 22 bp, Homo sapiens
tggctcagctttccccatctgg

SEQ ID NO: 8111156 - DNA, 22 bp, Homo sapiens
tggctcagcttacttttgaggg

SEQ ID NO: 8111157 - DNA, 22 bp, Homo sapiens
tggctcaggcctacgacgcctt

SEQ ID NO: 8111158 - DNA, 22 bp, Homo sapiens
tggctcaggccacttcttttat

SEQ ID NO: 8111159 - DNA, 22 bp, Homo sapiens
tggctcctaatcggcttctttc

SEQ ID NO: 8111160 - DNA, 22 bp, Homo sapiens
tggctcctaggatggtgcctgg

SEQ ID NO: 8111161 - DNA, 22 bp, Homo sapiens
tggctcctcttctgggtgtccc

SEQ ID NO: 8111162 - DNA, 23 bp, Homo sapiens
tggctctgtggatccctcaggag

SEQ ID NO: 8111163 - DNA, 22 bp, Homo sapiens
tggctgaggctggagtgcagtg

SEQ ID NO: 8111164 - DNA, 22 bp, Homo sapiens
tgaagcagagtgaaggtgaatt

SEQ ID NO: 8111165 - DNA, 19 bp, Homo sapiens
tgaagcaggcagagaagat

SEQ ID NO: 8111166 - DNA, 22 bp, Homo sapiens
tgaagcaggaaccagcagcatt

SEQ ID NO: 8111167 - DNA, 22 bp, Homo sapiens
tgaagaacctgatgagctgtgt

SEQ ID NO: 8111168 - DNA, 18 bp, Homo sapiens
tgaaattgcatccatgag

SEQ ID NO: 8111169 - DNA, 22 bp, Homo sapiens
tgaacagttactttgtagaaga

SEQ ID NO: 8111170 - DNA, 22 bp, Homo sapiens
tgaacagtttcaagaaaacttt

SEQ ID NO: 8111171 - DNA, 22 bp, Homo sapiens
tgaacagtgtatctagatcatg

SEQ ID NO: 8111172 - DNA, 22 bp, Homo sapiens
tgaacagtggttcatgtcacgg

SEQ ID NO: 8111173 - DNA, 22 bp, Homo sapiens
tgaacagtgggcatgtgaagac

SEQ ID NO: 8111174 - DNA, 22 bp, Homo sapiens
tgaacacacacctatgtacaaa

SEQ ID NO: 8111175 - DNA, 22 bp, Homo sapiens
tgaacacacacctatgtacaaa

SEQ ID NO: 8111176 - DNA, 23 bp, Homo sapiens
tgaaatattcttttgcatgagct

SEQ ID NO: 8111177 - DNA, 22 bp, Homo sapiens
tgaaatcaattgcaatgtttat

SEQ ID NO: 8111178 - DNA, 22 bp, Homo sapiens
tgaaatcagtggtataatcggg

SEQ ID NO: 8111179 - DNA, 22 bp, Homo sapiens
tgaaatatccagcccagcagga

SEQ ID NO: 8111180 - DNA, 22 bp, Homo sapiens
tgaaagatgctcaatgaatggt

SEQ ID NO: 8111181 - DNA, 22 bp, Homo sapiens
tgaaatcatgtagttattgcaa

SEQ ID NO: 8111182 - DNA, 22 bp, Homo sapiens
tgaaatcattgccaagtattga

SEQ ID NO: 8111183 - DNA, 22 bp, Homo sapiens
tgaaatggatgagagcagaggt

SEQ ID NO: 8111184 - DNA, 22 bp, Homo sapiens
tgaaatgttggtaattttatat

SEQ ID NO: 8111185 - DNA, 22 bp, Homo sapiens
tgaaattagaaatatgtatggg

SEQ ID NO: 8111186 - DNA, 22 bp, Homo sapiens
tctttgtctgaacagggacatt

SEQ ID NO: 8111187 - DNA, 22 bp, Homo sapiens
tctttgattttgttactaagac

SEQ ID NO: 8111188 - DNA, 22 bp, Homo sapiens
tcttttatagtgaattttcttg

SEQ ID NO: 8111189 - DNA, 22 bp, Homo sapiens
tctttgttattgctttatctat

SEQ ID NO: 8111190 - DNA, 20 bp, Homo sapiens
tctttgttaattttatctcc

SEQ ID NO: 8111191 - DNA, 22 bp, Homo sapiens
tcttttaaaagccctgctgtct

SEQ ID NO: 8111192 - DNA, 18 bp, Homo sapiens
tctttgtttccttcttgc

SEQ ID NO: 8111193 - DNA, 22 bp, Homo sapiens
tcttttatcctacatttagctc

SEQ ID NO: 8111194 - DNA, 19 bp, Homo sapiens
tcttttcacgcattttgaa

SEQ ID NO: 8111195 - DNA, 22 bp, Homo sapiens
tcttttcacagacaaatggaga

SEQ ID NO: 8111196 - DNA, 23 bp, Homo sapiens
tcttttcaatggttctttatgtg

SEQ ID NO: 8111197 - DNA, 23 bp, Homo sapiens
tcttttcaatggttctttatgtg

SEQ ID NO: 8111198 - DNA, 22 bp, Homo sapiens
tcttttctccagacctgggatc

SEQ ID NO: 8111199 - DNA, 21 bp, Homo sapiens
tcttttctctgcaggattcct

SEQ ID NO: 8111200 - DNA, 22 bp, Homo sapiens
tcttttctagcaaatccaggag

SEQ ID NO: 8111201 - DNA, 21 bp, Homo sapiens
tcttttctcagctttgtggtt

SEQ ID NO: 8111202 - DNA, 21 bp, Homo sapiens
tcttttctcagctttgtggtt

SEQ ID NO: 8111203 - DNA, 22 bp, Homo sapiens
tcttttcattgagaacacactg

SEQ ID NO: 8111204 - DNA, 22 bp, Homo sapiens
tgaaaagactgcaagagagcat

SEQ ID NO: 8111205 - DNA, 22 bp, Homo sapiens
tctttttatattgacaaaaggt

SEQ ID NO: 8111206 - DNA, 22 bp, Homo sapiens
tctttttttcctgtgcagagct

SEQ ID NO: 8111207 - DNA, 22 bp, Homo sapiens
tcttttgttgcctacttattaa

SEQ ID NO: 8111208 - DNA, 22 bp, Homo sapiens
tgaaacaaaccagtaattttgt

SEQ ID NO: 8111209 - DNA, 22 bp, Homo sapiens
tgaaacaaaattaagattctcg

SEQ ID NO: 8111210 - DNA, 17 bp, Homo sapiens
tgaaagaatcagggaga

SEQ ID NO: 8111211 - DNA, 22 bp, Homo sapiens
tgaaagaagtgtcacattgcca

SEQ ID NO: 8111212 - DNA, 21 bp, Homo sapiens
tgaaagaaggtgcagtctgaa

SEQ ID NO: 8111213 - DNA, 22 bp, Homo sapiens
tgaaagaagtgtcacattgcca

SEQ ID NO: 8111214 - DNA, 22 bp, Homo sapiens
tgaaagaactagcatcttcaag

SEQ ID NO: 8111215 - DNA, 22 bp, Homo sapiens
tgaaagaactagcatcttcaag

SEQ ID NO: 8111216 - DNA, 22 bp, Homo sapiens
tgaaagaagcctccctttggag

SEQ ID NO: 8111217 - DNA, 22 bp, Homo sapiens
tgaaagaagggtggaaaatgta

SEQ ID NO: 8111218 - DNA, 21 bp, Homo sapiens
tgaaagaaggtgcagtctgaa

SEQ ID NO: 8111219 - DNA, 22 bp, Homo sapiens
tgaaagaagccttcgaggctcg

SEQ ID NO: 8111220 - DNA, 22 bp, Homo sapiens
tgaaagaaacaggtatattggg

SEQ ID NO: 8111221 - DNA, 22 bp, Homo sapiens
tgaaactaggccaatcaaatta

SEQ ID NO: 8111222 - DNA, 21 bp, Homo sapiens
tgaaactacctacaagctacc

SEQ ID NO: 8111223 - DNA, 22 bp, Homo sapiens
tgacagctgaattccagggata

SEQ ID NO: 8111224 - DNA, 22 bp, Homo sapiens
tgacagctttgcttggggaaga

SEQ ID NO: 8111225 - DNA, 22 bp, Homo sapiens
tgacaggcagtgctgggcatgt

SEQ ID NO: 8111226 - DNA, 23 bp, Homo sapiens
tgacaggctgcttctggctgagg

SEQ ID NO: 8111227 - DNA, 22 bp, Homo sapiens
tgacactgcaaatataaatatt

SEQ ID NO: 8111228 - DNA, 22 bp, Homo sapiens
tgacacagggcatgcagcagaa

SEQ ID NO: 8111229 - DNA, 22 bp, Homo sapiens
tgacatttttataagagtcaaa

SEQ ID NO: 8111230 - DNA, 18 bp, Homo sapiens
tgacatttccagagtgta

SEQ ID NO: 8111231 - DNA, 22 bp, Homo sapiens
tgacatttaatccctaaatatt

SEQ ID NO: 8111232 - DNA, 20 bp, Homo sapiens
tgacctcctgggctcaagcc

SEQ ID NO: 8111233 - DNA, 22 bp, Homo sapiens
tgacgtgtgtccccatttcaag

SEQ ID NO: 8111234 - DNA, 22 bp, Homo sapiens
tgactggattgtcattacgacg

SEQ ID NO: 8111235 - DNA, 22 bp, Homo sapiens
tgacttgtctctttgggagaca

SEQ ID NO: 8111236 - DNA, 22 bp, Homo sapiens
tgacttgtctctttgggagaca

SEQ ID NO: 8111237 - DNA, 19 bp, Homo sapiens
tgaattaaagattaaagtc

SEQ ID NO: 8111238 - DNA, 22 bp, Homo sapiens
tgaatgtgatgctaaacatatg

SEQ ID NO: 8111239 - DNA, 22 bp, Homo sapiens
tgaatgtgatgctaaacatatg

SEQ ID NO: 8111240 - DNA, 22 bp, Homo sapiens
tgaatcaattgtcttaagacat

SEQ ID NO: 8111241 - DNA, 23 bp, Homo sapiens
tgaatcaattatgggattcaatg

SEQ ID NO: 8111242 - DNA, 19 bp, Homo sapiens
tgaatacagagatacagaa

SEQ ID NO: 8111243 - DNA, 22 bp, Homo sapiens
tgaatacactaaaaatcacttt

SEQ ID NO: 8111244 - DNA, 22 bp, Homo sapiens
tgaagttttctggttgattaag

SEQ ID NO: 8111245 - DNA, 22 bp, Homo sapiens
tgaataaattgagagcgaatgt

SEQ ID NO: 8111246 - DNA, 23 bp, Homo sapiens
tgaaggtattacctgagatgctc

SEQ ID NO: 8111247 - DNA, 22 bp, Homo sapiens
tgaagccacactagcttgtcct

SEQ ID NO: 8111248 - DNA, 22 bp, Homo sapiens
tgaagccacactagcttgtcct

SEQ ID NO: 8111249 - DNA, 22 bp, Homo sapiens
tgaagccacagagcatctgcct

SEQ ID NO: 8111250 - DNA, 22 bp, Homo sapiens
tgaagccaatctgccaggcaga

SEQ ID NO: 8111251 - DNA, 22 bp, Homo sapiens
tgaagccagctttggaagacac

SEQ ID NO: 8111252 - DNA, 21 bp, Homo sapiens
tgaagccaggatcacgattct

SEQ ID NO: 8111253 - DNA, 22 bp, Homo sapiens
tgaagccagggactgacacttc

SEQ ID NO: 8111254 - DNA, 22 bp, Homo sapiens
tgaagccataggacagaggata

SEQ ID NO: 8111255 - DNA, 22 bp, Homo sapiens
tgaagccagtcaatgttaagtt

SEQ ID NO: 8111256 - DNA, 22 bp, Homo sapiens
tgaagccaaggatgcctttctc

SEQ ID NO: 8111257 - DNA, 22 bp, Homo sapiens
tgaagccactttccagaatcac

SEQ ID NO: 8111258 - DNA, 22 bp, Homo sapiens
tgaagccaccgaaccagaagag

SEQ ID NO: 8111259 - DNA, 22 bp, Homo sapiens
tgaagctaggttcatgaggtcg

SEQ ID NO: 8111260 - DNA, 22 bp, Homo sapiens
tgaagccattactgtgttaggg

SEQ ID NO: 8111261 - DNA, 22 bp, Homo sapiens
tgaagccatccctcagatggcc

SEQ ID NO: 8111262 - DNA, 22 bp, Homo sapiens
tgaagccatctcagagtcaaga

SEQ ID NO: 8111263 - DNA, 22 bp, Homo sapiens
tgaagccatcaggaagccagca

SEQ ID NO: 8111264 - DNA, 16 bp, Homo sapiens
tgaggtcttattagca

SEQ ID NO: 8111265 - DNA, 22 bp, Homo sapiens
tgaggtgaaggagttttaaagt

SEQ ID NO: 8111266 - DNA, 22 bp, Homo sapiens
tgaggtgaccgcagatgggaag

SEQ ID NO: 8111267 - DNA, 22 bp, Homo sapiens
tgaggtgaggttgaggaaagaa

SEQ ID NO: 8111268 - DNA, 22 bp, Homo sapiens
tgaggggcggcctgcagaggcc

SEQ ID NO: 8111269 - DNA, 22 bp, Homo sapiens
tgaggtggctagggaggcactc

SEQ ID NO: 8111270 - DNA, 22 bp, Homo sapiens
tgaggtggcacacacttcctgc

SEQ ID NO: 8111271 - DNA, 22 bp, Homo sapiens
tgaggtgtgtccccagggaggt

SEQ ID NO: 8111272 - DNA, 22 bp, Homo sapiens
tgaggtggttcaagagccttgt

SEQ ID NO: 8111273 - DNA, 22 bp, Homo sapiens
tgaggtggtccaaagactgttt

SEQ ID NO: 8111274 - DNA, 22 bp, Homo sapiens
tgaggtggtgctaatctctgct

SEQ ID NO: 8111275 - DNA, 22 bp, Homo sapiens
tgaggggagacagagtggactc

SEQ ID NO: 8111276 - DNA, 22 bp, Homo sapiens
tgaggggagaagcagcagcctg

SEQ ID NO: 8111277 - DNA, 22 bp, Homo sapiens
tgaggggaaggcatgataaata

SEQ ID NO: 8111278 - DNA, 22 bp, Homo sapiens
tgaggggagctagcatgccttg

SEQ ID NO: 8111279 - DNA, 22 bp, Homo sapiens
tgaggggagcccgccctggacg

SEQ ID NO: 8111280 - DNA, 19 bp, Homo sapiens
tgaggggaggagaggcctg

SEQ ID NO: 8111281 - DNA, 22 bp, Homo sapiens
tgaggggatacggtacacattg

SEQ ID NO: 8111282 - DNA, 22 bp, Homo sapiens
tgaggggaggttggggcacatc

SEQ ID NO: 8111283 - DNA, 22 bp, Homo sapiens
tgagggaatattgatagatccg

SEQ ID NO: 8111284 - DNA, 22 bp, Homo sapiens
tgaggctccagccaggccagca

SEQ ID NO: 8111285 - DNA, 18 bp, Homo sapiens
tgaggctcagctcctggt

SEQ ID NO: 8111286 - DNA, 22 bp, Homo sapiens
tgaggctcaagaatagacagta
